United States Patent 11,446,398 (REGULATED BIOCIRCUIT SYSTEMS) - sequence listing, part 58

SEQ ID NO: 153442 - DNA, 2241 bp, Homo sapiens
  Payload ID: 10181
  Gene Symbol: MTAP
  Gene Name: methylthioadenosine phosphorylase
  ENST ID: ENST00000419385
  CDS Start-End: 93-245
gcagtgaggttggcacagccaccgctctgtggctcgcttggttcccttagtcccgagcgctcgcccactgcagattcctttcccgtgcagacatggcctctggcaccaccaccaccgccgtgaagattggaataattggtggaacaggcctggatgatccagaaattttagaaggaagaactgaaaaatatgtggatactccatttggcaaggttaatatccaacttgtggagacatccatctgatgccttaattttggggaagataaaaaatgttgattgcgtcctccttgcaaggcatggaaggcagcacaccatcatgccttcaaaggtcaactaccaggcgaacatctgggctttgaaggaagagggctgtacacatgtcatagtgaccacagcttgtggctccttgagggaggagattcagcccggcgatattgtcattattgatcagttcattgacaggaccactatgagacctcagtccttctatgatggaagtcattcttgtgccagaggagtgtgccatattccaatggctgagccgttttgccccaaaacgagagaggttcttatagagactgctaagaagctaggactccggtgccactcaaaggggacaatggtcacaatcgagggacctcgttttagctcccgggcagaaagcttcatgttccgcacctggggggcggatgttatcaacatgaccacagttccagaggtggttcttgctaaggaggctggaatttgttacgcaagtatcgccatggcgacagattatgactgctggaaggagcacgaggaagcagtttcggtggaccgggtcttaaagaccctgaaagaaaacgctaataaagccaaaagcttactgctcactaccatacctcagatagggtccacagaatggtcagaaaccctccataacctgaagaatatggcccagttttctgttttattaccaagacattaaagtagcatggctgcccaggagaaaagaagacattctaattccagtcattttgggaattcctgcttaacttgaaaaaaatatgggaaagacatgcagctttcatgcccttgcctatcaaagagtatgttgtaagaaagacaagacattgtgtgtattagagactcctgaatgatttagacaacttcaaaatacagaagaaaagcaaatgactagtaaacatgtgggaaaaaatattacattttaagggggaaaaaaaaacccaccattctcttctccccctattaaatttgcaacaataaagggtggagggtaatctctactttcctatactgccaaagaatgtgaggaagaaatgggactctttggttatttattgatgcgactgtaaattggtacagtatttctggagggcaatttggtaaaatgcatcaaaagacttaaaaatacggacgtactttgtgctgggaactctacatctagcaatttctctttaaaaccatatcagagatgcatacaaagaattatatataaagaagggtgtttaataatgatagttataataataaataattgaaacaatctgaatcccttgcaattggaggtaaattatgtcttagttataattagattgtgaatcagccaactgaaaatcctttttgcatatttcaatgtcctaaaaagacacggttgctctatatatgaagtgaaaaaaggatatggtagcattttatagtactagttttgctttaaaatgctatgtaaatatacaaaaaaactagaaagaaatatatataaccttgttattgtatttgggggagggatactgggataatttttattttctttgaatctttctgtgtcttcacatttttctacagtgaatttaatcaaatagtaaagttgttgtaaaaataaaagtggatttagaaagatccagttcttgaaaacactgtttctggtaatgaagcagaatttaagttggtaatattaaggtgaatgtcatttaagggagttacatctttattctgctaaagaagaggatcattgatttctgtacagtcagaacagtacttgggtttgcaacagctttctgagaaaagctaggtgtttaatagtttaactgaaagtttaactatttaaaagactaaatgcacattttatggtatctgatattttaaaaagtaatgtttgattctcctttttatgagttaaattattttatacgagttggtaatttttgctttttaataaagtggaagcttgcttttttaa

SEQ ID NO: 153443 - DNA, 1434 bp, Homo sapiens
  Payload ID: 10181
  Gene Symbol: MTAP
  Gene Name: methylthioadenosine phosphorylase
  ENST ID: ENST00000460874
  CDS Start-End: 226-1128
actgctcactcccgcgcagtgaggttggcacagccaccgctctgtggctcgcttggttcccttagtcccgagcgctcgcccactgcagattcctttcccgtgcagacatggcctctggcaccaccaccaccgccgtgaaggtgagatgagccctcccagccgcagcggttcgccctgccggatgccttctcgcccccgcgccgggggaccgcgcctccgggggccatgcgcccggcccgtgcgtcccttgccgccgcggggagggactggggcgcggcactcgggactcacttgccgcgcgaggagaggattggaataattggtggaacaggcctggatgatccagaaattttagaaggaagaactgaaaaatatgtggatactccatttggcaagccatctgatgccttaattttggggaagataaaaaatgttgattgcgtcctccttgcaaggcatggaaggcagcacaccatcatgccttcaaaggtcaactaccaggcgaacatctgggctttgaaggaagagggctgtacacatgtcatagtgaccacagcttgtggctccttgagggaggagattcagcccggcgatattgtcattattgatcagttcattgacaggaccactatgagacctcagtccttctatgatggaagtcattcttgtgccagaggagtgtgccatattccaatggctgagccgttttgccccaaaacgagagaggttcttatagagactgctaagaagctaggactccggtgccactcaaaggggacaatggtcacaatcgagggacctcgttttagctcccgggcagaaagcttcatgttccgcacctggggggcggatgttatcaacatgaccacagttccagaggtggttcttgctaaggaggctggaatttgttacgcaagtatcgccatggcgacagattatgactgctggaaggagcacgaggaagcagtttcggtggaccgggtcttaaagaccctgaaagaaaacgctaataaagccaaaagcttactgctcactaccatacctcagatagggtccacagaatggtcagaaaccctccataacctgaagaatatggcccagttttctgttttattaccaagacattaaagtagcatggctgcccaggagaaaagaagacattctaattccagtcattttgggaattcctgcttaacttgaaaaaaatatgggaaagacatgcagctttcatgcccttgcctatcaaagagtatgttgtaagaaagacaagacattgtgtgtattagagactcctgaatgatttagacaacttcaaaatacagaagaaaagcaaatgactagtaaacatgtgggaaaaaatattacattttaagggggaaaaaaaaacccaccattctcttctccccctattaaatttgcaacaataaagggtgg

SEQ ID NO: 153444 - DNA, 339 bp, Homo sapiens
  Payload ID: 10181
  Gene Symbol: MTAP
  Gene Name: methylthioadenosine phosphorylase
  ENST ID: ENST00000577563
  CDS Start-End: 1-339
gaaagcttcatgttccgcacctggggggcggatgttatcaacatgaccacagttccagaggtggttcttgctaaggaggctggaatttgttacgcaagtatcgccatggcgacagattatgactgctggaaggagcacgaggaagcaatgatcaagttccagatgatcctcagtgagggataccatcctttcaatattcaagagtcacccttctacagaggactcctagacttcccatcagtgggacatggcagaggtgaaatcctgcccctgtctcccttagacctggctggatactgcttccaacaacccatgcagccaccctgccctgacagctag

SEQ ID NO: 153445 - DNA, 7557 bp, Homo sapiens
  Payload ID: 10181
  Gene Symbol: MTAP
  Gene Name: methylthioadenosine phosphorylase
  Uniprot ID: Q13126
  ENST ID: ENST00000580900
  CDS Start-End: 101-1105
actcccgcgcagtgaggttggcacagccaccgctctgtggctcgcttggttcccttagtcccgagcgctcgcccactgcagattcctttcccgtgcagacatggcctctggcaccaccaccaccgccgtgaagattggaataattggtggaacaggcctggatgatccagaaattttagaaggaagaactgaaaaatatgtggatactccatttggcaagccatctgatgccttaattttggggaagataaaaaatgttgattgcgtcctccttgcaaggcatggaaggcagcacaccatcatgccttcaaaggtcaactaccaggcgaacatctgggctttgaaggaagagggctgtacacatgtcatagtgaccacagcttgtggctccttgagggaggagattcagcccggcgatattgtcattattgatcagttcattgacaggaccactatgagacctcagtccttctatgatggaagtcattcttgtgccagaggagtgtgccatattccaatggctgagccgttttgccccaaaacgagagaggttcttatagagactgctaagaagctaggactccggtgccactcaaaggggacaatggtcacaatcgagggacctcgttttagctcccgggcagaaagcttcatgttccgcacctggggggcggatgttatcaacatgaccacagttccagaggtggttcttgctaaggaggctggaatttgttacgcaagtatcgccatggcgacagattatgactgctggaaggagcacgaggaagcagtttcggtggaccgggtcttaaagaccctgaaagaaaacgctaataaagccaaaagcttactgctcactaccatacctcagatagggtccacagaatggtcagaaaccctccataacctgaagatgatcaagttccagatgatcctcagtgagggataccatcctttcaatattcaagagtcacccttctacagaggactcctagacttcccatcagtgggacatggcagaggtgaaatcctgcccctgtctcccttagacctggctggatactgcttccaacaacccatgcagccaccctgccctgacagctagcaagaggccaagacccacagaacaatcaccatcacacctctgtcagcaggaagcagttacagaagactgaccttcatccagtttcccaaagaattgggtcatggatttttgcgggggaaaatgttagagtaggtaattaggcagacatgagtaagggaggagagaccccctccaactaggaatgtcaggtgagcatcagatgatcatcaggtggttgttaaactctctctctaaaataataataggttgcaactggcagcagggaaagacaatctcccaatagatagaaaagtcctgaagctggtgatcagcagcttcctagtaagatctcaggatttgggcaagcaggctcaaacatgggcactaagaggcaaaatcgtggagtttaactggtatacagacttcctctaaaaacacatgactcatgcacatgtggacagcctgccccaaggaaaaatcaaaagaggagagatgcaaaaccccagaagcatgccaatatataaaaccccaagtctaaggtcaaacagggcacttggatttctcaagttgcccacttggccctcttctaagtgtactttatttcctttcattcctgctctaaaactttttaaatttcactcctgctcaaaaacttgcctcagtctttcactctgccttatgccccttggaagaattatttccttcaagatggcaaaaagcaagctgctgcagacccatacagatttgctgctgctaacaggaggataacttgagcccagaaggttaaggctgcggtgagccttgattatgccactgctctccagcctggcaacagaatgagactctatttttttttcttttaaaaagactttttacaaaaggcaaaatgataatggaactaaaaatgtacgttgactgacttaactccaactgcttcttccctcaattgaaaccacctttgcaaaaattataacagtgagaaaattatggcagtaggggtgatctgatcaagccaaaccccatcttgcctttagccttcaagctgcccataattattcctgggcttaggccaagctaactttgggagacacttggtctatagtttaaatgataatagtccttccttaaaattcaaccacctcagcaaagctgatgagaggccaccaggcaaggaggatagaggagtctaaattctgctaaggtgtagatataaacagtttccagccattattctggaggtcacaaaatgtgcaacttcttcaattactcctgcagataacatcagtattttagaacctaagattggccttttgagatgtcttttcaggtttttttgtgtgtctgactaccgatggctccacctggacccaccaaccactcctgtggccccatccagaagcaactcagcatgcataaggactatttcccacacccctatgattgcacccccaaccaattagcagcaaggacttattgcctaaaacagccccattcatcccccaaaccatccatgaaaaaccctagctttcaaatttccggggaagctgatttgagcaataataaaatacgtctcccatttagccaactctacatgtataaaactctttctctattgcaattcccctgccttgataaatgataaatcagctctatctgggcagcaggcaagaagaacccgttgagtccttacaatatccttctttctaccctcctctgcctaattactctgaatctactaactttttcactcagttatttttccactttgaagacaaaaagttagaaaaaaaaatgccttatgaaattagtccctcagaataaaccagctgggctttctttagccacctgtatgctttagtcaaaatctaagctcagaggcaatagtgaaaggctttcttatcccaaaggaaaactctcagaaatttgctgaagctatccacactgagtgtaggtatagaacatgctttgccctatttattcatgggcaccatcctgaactcagtaatctagcttttttcttttgaagctggatggggaagacacagatctagctgaattagttgccaaaatatgctatctggcataaagattattttgagagagttattttgagactctttgtaagagaaatttatatctacaaaggaagtctccatttataagcttgtctctctgcatcaggaagaaaagaaggactaaatcaccagacactcttaaccaatggagaaggagtttaagtaacaaaccttacctttgtttaaggtgctttttctggctctctgccattaagatctacattttccaccctgtctcctctaggacctgagggttatctctttgatatgcaaatgccagggagattactcaccagaagaagaagaagaaatagagctaattggaaattgagcaaataaaaaaatcttgttttttctcccagaaacagtgaaaagctttagccatcctttagataatcttaacttgttccatctgccagaaacacaatttggattcagaaattctttatgaactgtttttgtattattgtacctggcacatggctacagttttcaaatgaaaactgtgaaatctgcttctgtctgtattttatgtatgtctgtgtatgcatgtatgtgtaatatttttctacctctagagactatcctaaaattaacttataaagagctgtatttaattgccttaaagaaaaagcacttatacaaattaagtattttttaaactttcagaaaaataagacctagcgcaaatgttcttcaagttgatattgttaaaagaagaaacttcagccaaattaaacttaaagaagtttaattgagcaatgaatgattcacaaatcaggcagcctccagagttacagctgattcatggagactccagggatgcctcatggtcagaacaaatttatagacaaaaaaagggaagtgacatacagaaattagaagtgaagtacagaaagagctggactggttacaggttggtgtttgccttatttgaacacagtttgaacactcagcagtgtctaagtggttgaagtatggctactagaattggccaagactcggctattgttacaggaacgtactcctaaattaggttttcaatcttgtctacctgttaagttaggttacagttcatccacaaggactcaaatatagaagtacggagtccttctcaggctatcttcagttctctttaacagtatgatacgggataatcttcagtaaataaaaatttctttaagtttgttggattaactaaagcaggcatgtcttcagagttgtcaacattaaatataatacatacatacagtttttttctaccaggggttactaggcaaataagtttgttattgtaactagatgtttaagattataaaactgtcagtttaatctaagagcaaaagtgaaaatgtggtagctattttattaagtacagcggtaaagcaagtatatattaagtatagcagtaaagcaaaaaaacaaaaaaaaacaagtatttaacttttttttggtttttttttttgagacggagtctctctctgttgcccaggctggaatgcagtggcacaatctcagctcactgcaacctccacctcccgggttcaagcgattctcctacctcagcctcctgagtagctgggattacaggcgtgcaccaccatgcccggctaatttttgtatttttagtagagatggtgtttcaccatgttggtcaggctggtctcgagctcctgacctcatgatctgctcgcctcggcctcccaaagtgctgggattacaggcatgagccaccaagcccggccttaacttttttttaggttcttgcttttgtgatatttggctaacatacatatgctgtaaaaattgttaataggaaaatattaataatgagatgttgactagctttgtctgtctaatgaaatttcataagtcaattaaaattaagaacaattgaattatagaatagaattcaattgaattctattgaatacacttgctgaatacaacaattgaattgtaaatagaatagaaattataaatgaacttttcaatagtaattattttttaatacgggtacttaaaattgtgtcaacttcttaacaaaagaaatggaggcaaaattagtataaacagtttatttgggccaaatttgagaactgcaatgtgggagacacgtcttcaagttgctatgaatataaactccaattagcagcagttacaagcggttttttttttttaaagaaggggcagttctttagttgcatataaactattgattggctatacatttttttttaaccataaattccaggagcatgaacataatgggtgagggtcacatcccctgggcatggatttggggcaggatgtgacaaaaatctcatactcatgtctctctgggcctgataaattttgcatactttatatagttcagactcttctgagctacgtttctttctcttccttttggttgagtttttttttcttctgaaagtattgatgatcaacattttagatgtaagtttgtcccatgtcactggaagacttagttttagttagtctcatcccacattggaggaagagaggagagataaaatggcttaagaatgcagtgaagtctcaaggccaagttgattggcaacacaaagggacagggcaatggtatttcaggtcatctgcttacaaaggagctatggcatgttggatcatttctaagcatctagctatcattattttagtgtttttgttgattttggacatctagaagtgcaaagtataatcaatttgagaataaaagacatgatgcaaataaagacaattactaacaaaagccagatctgaaaaatgtttttatttccgaaggcgaccaaataaatatgttttctacttcttgtgctgatctaaagatcaatgtataggagatctccagtgatgagtttgtccactcaggcagagctgcctttttaaaataaaaattatgaatgcataagtcaatgtatttgaatttaactccacaagtattggttaacaatacagatatggtcgcttccaaggtgtttggagggagttttgtatttgatggcattccacattggaggccatgctatttgatgtcttcatctcctggaaccacactgtattgtttggacatatctatccagacagatgatgataaattttgcatatctcacatagttcagactgctctgggctacttttctttctcaatagcttctcattgttaacttatgcctgtagagttttgctaaactaaattagataatggacatttattaaatatttagatcatttccaaataacataaaatgctgaaacattaattgcttaacataagttaatctacttttggtttttattacaaaggaactaaatatatttacatctgttaaaaaacactttaaactgtactatgagaaagaatatacttctatagaaattataaaatggtatatttatagatttaccattttatggaataccccataaccgttcacaatttcttatttcctagttttcactagaaattgaagttactaagagttaacaattttaactaatatagagtagttaaaaagactaaaaataataagggagataactatatgcaaagaaagtaagacatgtttttggtaaggaaagccataaggtataaggatgtgcttttttttaaggaaaaggaagaataatttggtctagtttggaggttatttaaaggttgtttcagaatgaatgaaagataaaatctaaatggatacaaaaaggaagagagatgacacacacacaaaatgaatgactcttgtatggacaagttggctagaactgaatgtattataaggttttaaaaatgagtcttgaccaagcactgtggctcacgcctgtaatcccagcactttgggaggccaaggcgggcagatcatgaggtcaagagatcaagaccatggtgaaactccatctctactaaaaatacaaaaattagctgggcgtggtggtgcgcacctgtagtcccagctactagggaggctgaggcaggagaatcgcatgaacccaggaggcagaggttgcagtgaactgagatcacaccactgcactccagcctggcgacacagtgagactccatctcaaaaaaaaaaagagtcttaatatcaaaagtaaactgatgcaaaactagaatttggtcttctctgtgaaaatgacagttttctttttaaagagtattgctccagtttttaaaagtgattgtgaaaaattttcctttcccttgtaactaatcggcctacaaaatgaagattttgtgttttctcaaaataattctttgtgcttcgtgttgcctttttttggtctttaattacttaagaaaattgaatcttcccaacaaaagagctagttttgtttgttttgtttttacagttattaaactttctctatttgcctttg

SEQ ID NO: 153446 - DNA, 1309 bp, Homo sapiens
  Payload ID: 10181
  Gene Symbol: MTAP
  Gene Name: methylthioadenosine phosphorylase
  ENST ID: ENST00000580718
  CDS Start-End: 88-816
gaggttggcacagccaccgctctgtggctcgcttggttcccttagtcccgagcgctcgcccactgcagattcctttcccgtgcagacatggcctctggcaccaccaccaccgccgtgaagattggaataattggtggaacaggcctggatgatccagaaattttagaaggaagaactgaaaaatatgtggatactccatttggcaagccatctgatgccttaattttggggaagataaaaaatgttgattgcgtcctccttgcaaggcatggaaggcagcacaccatcatgccttcaaaggtcaactaccaggcgaacatctgggctttgaaggaagagggctgtacacatgtcatagtgaccacagcttgtggctccttgagggaggagattcagcccggcgatattgtcattattgatcagttcattgacaggaccactatgagacctcagtccttctatgatggaagtcattcttgtgccagaggagtgtgccatattccaatggctgagccgttttgccccaaaacgagagaggttcttatagagactgctaagaagctaggactccggtgccactcaaaggggacaatggtcacaatcgagggacctcgttttagctcccgggcagaaagcttcatgttccgcacctggggggcggatgttatcaacatgaccacagttccagaggtggttcttgctaaggaggctggaatttgttacgcaagtatcgccatggcgacagattatgactgctggaaggagcacgaggaagcatgctattgtttctctaggtttcggtggaccgggtcttaaagaccctgaaagaaaacgctaataaagccaaaagcttactgctcactaccatacctcagatagggtccacagaatggtcagaaaccctccataacctgaagaatatggcccagttttctgttttattaccaagacattaaagtagcatggctgcccaggagaaaagaagacattctaattccagtcattttgggaattcctgcttaacttgaaaaaaatatgggaaagacatgcagctttcatgcccttgcctatcaaagagtatgttgtaagaaagacaagacattgtgtgtattagagactcctgaatgatttagacaacttcaaaatacagaagaaaagcaaatgactagtaaacatgtgggaaaaaatattacattttaagggggaaaaaaaaacccaccattctcttctccccctattaaatttgcaacaataaagggtggagggtaatctctactttcctatactgccaaagaatgtgaggaagaaa

SEQ ID NO: 153447 - DNA, 1735 bp, Homo sapiens
  Payload ID: 10182
  Gene Symbol: MRI1
  Gene Name: methylthioribose-1-phosphate isomerase 1
  Uniprot ID: Q9BV20
  ENST ID: ENST00000040663
  CDS Start-End: 41-1150
ctagctccctctgagttgcgctgggcttggctgctgcaccatgaccctggaggcgatccgctactcgcggggctccctgcagatcctagaccagctgctgctgcccaagcagagccgctacgaggcggtgggctcggtgcaccaggcctgggaggccatccgcgccatgaaggtgcggggcgccccggccatagccctggtgggctgtctcagcctcgccgtggagctgcaggcgggcgccgggggaccgggactcgccgcgctcgtggccttcgtgcgcgacaagctgagcttcctcgtcaccgcccggcccaccgctgtcaacatggcccgcgccgcccgcgacctggctgatgttgcagcccgggaggccgaacgggagggcgctacggaagaggcggtccgggagagagtgatctgctgcaccgaggacatgctggagaaagacctcagagacaaccgaagcattggggacctaggagcccgccacctcctggagcgggtggcccccagcggtggcaaggtgactgtgctgacccactgtaacactggtgctctggccaccgctggctatggtacagccctaggtgtgattcgctcactgcacagcctgggccgcctggagcatgccttctgcacagagacccggccctacaaccagggagcccggctgacggcctttgagctggtctatgagcagatccccgccacccttatcaccgacagcatggtggctgctgccatggcccataggggcgtgtcagctgtggtcgtgggagctgaccgcgtggttgccaacggcgacacagccaacaaggtgggcacctaccagctggccattgtcgccaagcaccatggcattcccttctacgtggctgcccccagctcttcatgtgacctccgtctggagaccggcaaggagatcattattgaagagcgaccgggccaggagctgaccgatgttaatggggtccggattgcagcacctgggattggagtttggaatcctgccttcgatgtcaccccccacgacctcatcactggtggcatcatcacagaactgggggtctttgcccctgaggagctccggacagccctaaccaccaccatctcttccagggatggaaccctagatggaccccagatgtaaccaactcagctctccctagcctgcctctctaggtttttcaatacatttcttgaatggctacccaaaagctgaccgtccagcccctgaccacacttgttcctagtgcagggagctcagacagggccttccatctagagcccagcacctagagccaggctgcccagattcaaatcctgactccgccacttttcccactgtatgatcttgggcaagtcacttcacctctctgtgccttggtttcctcatttataaaatgtggataacaggccgggcgcagtggctcacacctgtaatcccagcactttgggaggccgaggcaggtggatcacaagatcaggagattgagaccatcctggctaacatggtgaaaccccatctctactaaaaatacaaaaaattagccgggtgtggtggtgggcacctgcagtcccagctacttgggaggctgaggcaggagaatggcgtgaaactgggaggcagagcttgcagtgagccgagatagcgccactgcactccagcctgggcaacagagcgagactccgtctcaaaaataaatataattaattaattatttaattaaaaaaa

SEQ ID NO: 153448 - DNA, 3027 bp, Homo sapiens
  Payload ID: 10182
  Gene Symbol: MRI1
  Gene Name: methylthioribose-1-phosphate isomerase 1
  Uniprot ID: Q9BV20
  ENST ID: ENST00000319545
  CDS Start-End: 58-1026
caagtgcgcgcggacccctagctccctctgagttgcgctgggcttggctgctgcaccatgaccctggaggcgatccgctactcgcggggctccctgcagatcctagaccagctgctgctgcccaagcagagccgctacgaggcggtgggctcggtgcaccaggcctgggaggccatccgcgccatgaaggtgcggggcgccccggccatagccctggtgggctgtctcagcctcgccgtggagctgcaggcgggcgccgggggaccgggactcgccgcgctcgtggccttcgtgcgcgacaagctgagcttcctcgtcaccgcccggcccaccgctgtcaacatggcccgcgccgcccgcgacctggctgatgttgcagcccgggaggccgaacgggagggcgctacggaagaggcggtccgggagagacgtgaaacggagctatgcgagcattgggaagagcataccaggcagagggaactgccactgcgagggcccctgggcgggactgtgctcgagacccggccctacaaccagggagcccggctgacggcctttgagctggtctatgagcagatccccgccacccttatcaccgacagcatggtggctgctgccatggcccataggggcgtgtcagctgtggtcgtgggagctgaccgcgtggttgccaacggcgacacagccaacaaggtgggcacctaccagctggccattgtcgccaagcaccatggcattcccttctacgtggctgcccccagctcttcatgtgacctccgtctggagaccggcaaggagatcattattgaagagcgaccgggccaggagctgaccgatgttaatggggtccggattgcagcacctgggattggagtttggaatcctgccttcgatgtcaccccccacgacctcatcactggtggcatcatcacagaactgggggtctttgcccctgaggagctccggacagccctaaccaccaccatctcttccagggatggaaccctagatggaccccagatgtaaccaactcagctctccctagcctgcctctctaggtttttcaatacatttcttgaatggctacccaaaagctgaccgtccagcccctgaccacacttgttcctagtgcagggagctcagacagggccttccatctagagcccagcacctagagccaggctgcccagattcaaatcctgactccgccacttttcccactgtatgatcttgggcaagtcacttcacctctctgtgccttggtttcctcatttataaaatgtggataacaggccgggcgcagtggctcacacctgtaatcccagcactttgggaggccgaggcaggtggatcacaagatcaggagattgagaccatcctggctaacatggtgaaaccccatctctactaaaaatacaaaaaattagccgggtgtggtggtgggcacctgcagtcccagctacttgggaggctgaggcaggagaatggcgtgaaactgggaggcagagcttgcagtgagccgagatagcgccactgcactccagcctgggcaacagagcgagactccgtctcaaaaataaatataattaattaattatttaattaaaaaaataaaaaataaatgtggataatactagtacctccctcttaaggtcagggctggagctagggtgacatctccagggcagaattttaagaggacaccaaaaaagctcagcaaccaagataaaaaatattttaaagcaatattttgttttgggttttttttttttgagatcaagtatcactcgttacccaggctggaatgtagaggcgagatctcagctcactgaaacctgtgcctccccggttcaagcgattctcctgccacagcctcctgagtagctgggattacaggcatgcgccaccatgcccagctaatttttctatttttagtagagacatgatttcaccatgttggccaggctggtctcgaactcctgactcaaatgatccccctgcctcagcctcccaaagtgctgggactacaggcatgagccactgtgcctgaccttacagcagtattttttaaaaatcaaaattaatgcaaaaatccatgatgaggccaggcttggtggctcatgcctgtaattccagcactttgggaggatcccttgagcccaggtgtttgagaccagtttgggtaacataggaagagcttgtctctacaaacaaaaatttaaaaacaatgagctgggcatggaactcacacctctagccccagctactcaggctgaagtgggaggatggcttgagcccaggagttcaaggatgcagtgtgctttgattgcactactgcacttcaccctaagcaacagagtgagaccccatctctttaaaaaaaaaaaaaaatccatgatgaacaaaacaagtatttgtttgagacggggtctcgctctgtcgcccaggctggagtacagtggtgccatctcagctcactgcaacctccgccttctgggttcaagcgactctcctgcctcagcctcccgagtagctgggattacaggagcctggcactatgcctggctaatttttgtatttttattggagacaccatgttagtcgtggctggtctccaactcctgacctcgggtgatccgcgccccgcggcctccgaaagtgctgggattacaagcgtgagccaccgtgcccggcctaaataaaattttgaagaggctagaaccccgcacttgtgccttgagcttactgacctcaacaccctggttccactaaaactttatttacaaaattatgctgccggtctgcaggatgtagtttaacaatttgattattttggatattaaaatattttttaagtcttgaaaatattgtttactattaccaaagtttttgaaccttcttaaattctgtaccagaggtgagtgccacaccctaacctagtctgagtttttatgtgtaaagatcataaaacgttgtaagttttctaaaacacataagctctcaataaacgttagcttatcattgtca

SEQ ID NO: 153449 - DNA, 1096 bp, Homo sapiens
  Payload ID: 10183
  Gene Symbol: METTL1
  Gene Name: methyltransferase like 1
  Uniprot ID: Q9UBP6
  ENST ID: ENST00000257848
  CDS Start-End: 37-504
cacgtggatttggtagagaaaccccggactgggatcatggcagccgagactcggaacgtggccggagcagaggccccaccgccccagaagcgctactaccggcaacgtgctcactccaaccccatggcggaccacacgctgcgctaccctgtgaagccagaggagatggactggtctgagctatacccagagttcttcgctccactcactcaaaatcagagccacgatgacccaaaggataagaaagaaaagagagctcaggcccaagtggagtttgcagacataggctgtggctatggtggcctgttagctgacaaagatgttcttcctcttccccgacccacatttcaagcggacaaagcacaagtggcgaatcatcagtcccaccctgctagcagaatatgcctacgtgctaagagttggggggctggtgtataccataaccgatgtgctggagctacacgactggatgtgcactcatttcgaagagcacccactgtttgagcgtgtgcctctggaggacctgagtgaagaccccgttgtgggacatctaggcacctcaactgaggaggggaagaaagttctacgtaatggagggaagaatttcccagccatcttccgaagaatacaagatcccgtcctccaggcagtgacctcccaaaccagcctgcctggtcactgactgcttactctaccttagctggacctcgtctcccagggattagagaaaagagcaggagtcctgggtcttcccagttgagactgctggagctgagacacagtactctcttaaagaaggtggggagctgcccagggcagaacccactggtgttcatgactacccctggctcctctcaccttgtccctccactgccaacagaaaacaaagcagctgactgagatggtcaaaggactttggaccataggggatctttggaaggctgtggggtcttgctcttccttagcactcctttctccttgtgagatctctcctcagctggaatgaggaatgtagtccatctaaactgcttgctaggctcaattaccacttctgtttgctttgtggatcctgggataacatgtatatgtgtacaca

SEQ ID NO: 153450 - DNA, 2066 bp, Homo sapiens
  Payload ID: 10183
  Gene Symbol: METTL1
  Gene Name: methyltransferase like 1
  Uniprot ID: Q9UBP6
  ENST ID: ENST00000324871
  CDS Start-End: 711-1541
aaagagcccgacctcccgcgggaacaccgattccgactcagattcgggatctgggccggggtccgccatccggcccgccaagggagtgcctgggcaccgcggccggcgctcagatcccggatccggagcggggtagaggctgggggccgcgagccgtcgtggtgtccctgtggaacgagccccgcctccctgagtttgccctccttcctccagttcgatttcctggaggtggaatgaggagctgcccctcccgccccggccccgagcgcacactcgacgaaacccacacgggaccacaagagtcagaccgggcggactggtccgagaccaggagtaaggggacaggagcgaggactgatgccactgtagaaggcgaggtctctagacccctctcacctgtggggtgcacaggtgcctgcaaccaggatggtaacccagaccaggcagaagcaagctaagagaaaacgttgggtccctgggcctggcctcgccctcccagttggaggctaacggtgcggaggttccctccagcactcgctccttacagccctccccacctagcccagcccagcccagcccagcccagctgaatttgctcttgggtctttaaggggcgggaactgccaccaacgcgcatggctgcgtcattaacttgcgcctctggcctgcgcctccacgtggatttggtagagaaaccccggactgggatcatggcagccgagactcggaacgtggccggagcagaggccccaccgccccagaagcgctactaccggcaacgtgctcactccaaccccatggcggaccacacgctgcgctaccctgtgaagccagaggagatggactggtctgagctatacccagagttcttcgctccactcactcaaaatcagagccacgatgacccaaaggataagaaagaaaagagagctcaggcccaagtggagtttgcagacataggctgtggctatggtggcctgttagtggaactgtcaccgctgttcccagacacacttattctgggtctggagatccgggtgaaggtctcagactatgtacaagaccggattcgggccctacgcgcagctcctgcaggtggcttccagaacatcgcctgtctccgtagcaatgccatgaagcaccttcctaacttcttctacaagggccagctgacaaagatgttcttcctcttccccgacccacatttcaagcggacaaagcacaagtggcgaatcatcagtcccaccctgctagcagaatatgcctacgtgctaagagttggggggctggtgtataccataaccgatgtgctggagctacacgactggatgtgcactcatttcgaagagcacccactgtttgagcgtgtgcctctggaggacctgagtgaagaccccgttgtgggacatctaggcacctcaactgaggaggggaagaaagttctacgtaatggagggaagaatttcccagccatcttccgaagaatacaagatcccgtcctccaggcagtgacctcccaaaccagcctgcctggtcactgactgcttactctaccttagctggacctcgtctcccagggattagagaaaagagcaggagtcctgggtcttcccagttgagactgctggagctgagacacagtactctcttaaagaaggtggggagctgcccagggcagaacccactggtgttcatgactacccctggctcctctcaccttgtccctccactgccaacagaaaacaaagcagctgactgagatggtcaaaggactttggaccataggggatctttggaaggctgtggggtcttgctcttccttagcactcctttctccttgtgagatctctcctcagctggaatgaggaatgtagtccatctaaactgcttgctaggctcaattaccacttctgtttgctttgtggatcctgggataacatgtatatgtgtacacatgcctattctgccatttctcaggaaagggtggagtatgtatcatatgccttctaccatcctcctgtcctctccctgcgtaagacttgacctggggaatctgtgttccctaa

SEQ ID NO: 153451 - DNA, 726 bp, Homo sapiens
  Payload ID: 10183
  Gene Symbol: METTL1
  Gene Name: methyltransferase like 1
  ENST ID: ENST00000547653
  CDS Start-End: 1-190
ccccgacccacatttcaagcggacaaagcacaagtggcgaatcatcagtcccaccctgctagcagaatatgcctacgtgctaagagttgggggtgattttgcctatgcaggggctggtgtataccataaccgatgtgctggagctacacgactggatgtgcactcatttcgaagagcacccactgtttgagcgtgtgcctctggaggacctgagtgaagaccccgttgtgggacatctaggcacctcaactgaggaggggaagaaagttctacgtaatggagggaagaatttcccagccatcttccgaagaatacaagatcccgtcctccaggcagtgacctcccaaaccagcctgcctggtcactgactgcttactctaccttagctggacctcgtctcccagggattagagaaaagagcaggagtcctgggtcttcccagttgagactgctggagctgagacacagtactctcttaaagaaggtggggagctgcccagggcagaacccactggtgttcatgactacccctggctcctctcaccttgtccctccactgccaacagaaaacaaagcagctgactgagatggtcaaaggactttggaccataggggatctttggaaggctgtggggtcttgctcttccttagcactcctttctccttgtgagatctctcctcagctggaatgaggaatgtagtccatctaaactgcttgctaggctc

SEQ ID NO: 153452 - DNA, 503 bp, Homo sapiens
  Payload ID: 10183
  Gene Symbol: METTL1
  Gene Name: methyltransferase like 1
  ENST ID: ENST00000551117
  CDS Start-End: 1-245
ccgagactcggaacgtggccggagcagaggccccaccgccccagaagcgctactaccggcaacgtgctcactccaaccccatggcggaccacacgctgcgctatggaactgtcaccgctgttcccagacacacttattctgggtctggagatccgggtgaaggtctcagactatgtacaagaccggattcgggccctacgcgcagctcctgcaggtggcttccagaacatcgcctgtctccgtagcaatgccatgaagcaccttcctaacttcttctacaagggccagctgacaaagatgttcttcctcttccccgacccacatttcaagcggacaaagcacaagtggcgaatcatcagtcccaccctgctagcagaatatgcctacgtgctaagagttggggggctggtgtataccataaccgatgtgctggagctacacgactggatgtgcactcatttcgaagagcacccactgtttgagcgtgtgcctctggaggacct

SEQ ID NO: 153453 - DNA, 717 bp, Homo sapiens
  Payload ID: 10183
  Gene Symbol: METTL1
  Gene Name: methyltransferase like 1
  ENST ID: ENST00000553125
  CDS Start-End: 34-144
gtggatttggtagagaaaccccggactgggatcatggcagccgagactcggaacgtggccggagcagaggccccaccgccccagaagcgctactaccggcaacgtgctcactccaaccccatggcggaccacacgctgcgctaagcacaaacacaaagtaggatcccagtgcattaggcagccagtctcgggagaaggggaacttgtgccccagaaagggcagttacccggccagggtcacatcaaccgccagaagtggagttgggcagccctgtgaagccagaggagatggactggtctgagctatacccagagttcttcgctccactcactcaaaatcagagccacgatgacccaaaggataagaaagaaaagagagctcaggcccaagtggagtttgcagacataggctgtggctatggtggcctgttagtggaactgtcaccgctgttcccagacacacttattctgggtctggagatccgggtgaaggtctcagactatgtacaagaccggattcgggccctacgcgcagctcctgcaggtggcttccagaacatcgcctgtctccgtagcaatgccatgaagcaccttcctaacttcttctacaagggccagctgacaaagatgttcttcctcttccccgacccacatttcaagcggacaaagcacaagtggcgaatcatcagtcccaccctgctagcagaatatgcctac

SEQ ID NO: 153454 - DNA, 371 bp, Homo sapiens
  Payload ID: 10183
  Gene Symbol: METTL1
  Gene Name: methyltransferase like 1
  ENST ID: ENST00000548504
  CDS Start-End: 1-371
cctacgcgcagctcctgcaggtggcttccagaacatcgcctgtctccgtagcaatgccatgaagcaccttcctaacttcttctacaagggccagcggacaaagcacaagtggcgaatcatcagtcccaccctgctagcagaatatgcctacgtgctaagagttggggggctggtgtataccataaccgatgtgctggagctacacgactggatgtgcactcatttcgaagagcacccactgtttgagcgtgtgcctctggaggacctgagtgaagaccccgttgtgggacatctaggcacctcaactgaggaggggaagaaagttctacgtaatggagggaagaatttcccagccatcttccgaagaatac

SEQ ID NO: 153455 - DNA, 1462 bp, Homo sapiens
  Payload ID: 10184
  Gene Symbol: METTL10
  Gene Name: methyltransferase like 10
  Uniprot ID: Q5JPI9
  ENST ID: ENST00000368836
  CDS Start-End: 38-913
atggcggccccaacggccgtccaggacgtggagcgaaatgagctcgggcgctgacggcggcggtggcgctgcggtggcggcgcggtcggacaagggcagtcccggggaggacggtttcgtcccgtcggcgctggggacccgcgagcattgggatgctgtctatgagagagaactgcaaactttccgagaatatggagatacaggtgaaatctggtttggagaagagagtatgaatcgactaataaggtggatgcagaaacacaagattccactggatgcttcagtgcttgatattggaactggaaatggtgttttcctggttgaacttgcaaaatttggtttctctaatattactggaattgattactctccttctgcaattcagctttctggaagtattatagaaaaagaaggtttatctaacattaagttaaaggtagaagactttttgaatctctccacacagctgtctggatttcatatttgtattgacaaagggacttttgatgccataagccttaatcctgacaatgcaattgagaagaggaagcaatatgtgaaatctctctccagggtgttgaaagtaaaaggcttttttctaataacgtcatgtaattggaccaaggaagagttgctaaatgaattcagtgaaggttggagtacagtggcaggattttggctcactgcagccttgacttcctgggctcaagcgatcttttccacttcagcctcccgagtaggtggaactacaggcacacatcatcatgcctggataatttttgtatttttagcagagacgaggttttgccatgttgtccaggctggtctggaactcctgggctcaagtgattctcccacctggcctcccaaagtgctgggattataccatgccaggccctcgttggcattttagatttgaacttctcgaagagctaccaacacccaagttcagctttggaggcagatctggaaacagtgtagcagcattggttttccaaaaaatgtgagactttttcttggacgaattcaggtagctacacagaatctacacagcaaagttaacctgacacagaaaatccttgtgcaaataaatgcttagtaagtacacaggatgcacatgttgaatagagtatactggattggtgaaagaaaataataataatgagcatctaagtggttgggttttagagatcaatcaagaataattttaattttcttttgtatttgaaatgtaaatagttttcttttcgattaaaaaaatttcctataactgctaaacagttaaaaactttaaagtagtaaatgagtttatagaaagcatgtattcttgatttttgtgccttggtaaagttgataactatttatgaatatttgaccaaattattccagcatcagaataataagcaaaataactttgttagtgttttgttagactgtttatgaaatataacaagaaatacta

SEQ ID NO: 153456 - DNA, 1013 bp, Homo sapiens
  Payload ID: 10184
  Gene Symbol: METTL10
  Gene Name: methyltransferase like 10
  ENST ID: ENST00000464099
  CDS Start-End: 36-350
ggcggccccaacggccgtccaggacgtggagcgaaatgagctcgggcgctgacggcggcggtggcgctgcggtggcggcgcggtcggacaagggcagtcccggggaggacggtttcgtcccgtcggcgctggggacccgcgagcattgggatgctgtctatgagagagaactgcaaactttccgagaatatggagatacaggtgaaatctggtttggagaagagagtatgaatcgactaataaggtggatgcagaaacacaagattccactggatgcttcagtgcttgatattggaactggaaatggtgttttcctggttgaacttgttggcaaaatttggtttctctaatattactggaattgattactctccttctgcaattcagctttctggaagtattatagaaaaagaaggtttatctaacattaagttaaaggtagaagactttttgaatctctccacacagctgtctggatttcatatttgtattgacaaagggacttttgatgccataagccttaatcctgacaatgcaattgagaagaggaagcaatatgtgaaatctctctccagggtgttgaaagtaaaaggcttttttctaataacgtcatgtaattggaccaaggaagagttgctaaatgaattcagtgaaggatttgaacttctcgaagagctaccaacacccaagttcagctttggaggcagatctggaaacagtgtagcagcattggttttccaaaaaatgtgagactttttcttggacgaattcaggtagctacacagaatctacacagcaaagttaacctgacacagaaaatccttgtgcaaataaatgcttagtaagtacacaggatgcacatgttgaatagagtatactggattggtgaaagaaaataataataatgagcatctaagtggttgggttttagagatcaatcaagaataattttaattttcttttgtatttgaaatgtaaatagttttcttttcgattaaaaaaatttcctataa

SEQ ID NO: 153457 - DNA, 3587 bp, Homo sapiens
  Payload ID: 10184
  Gene Symbol: METTL10
  Gene Name: methyltransferase like 10
  ENST ID: ENST00000466270
  CDS Start-End: 36-350
ggcggccccaacggccgtccaggacgtggagcgaaatgagctcgggcgctgacggcggcggtggcgctgcggtggcggcgcggtcggacaagggcagtcccggggaggacggtttcgtcccgtcggcgctggggacccgcgagcattgggatgctgtctatgagagagaactgcaaactttccgagaatatggagatacaggtgaaatctggtttggagaagagagtatgaatcgactaataaggtggatgcagaaacacaagattccactggatgcttcagtgcttgatattggaactggaaatggtgttttcctggttgaacttgttggcaaaatttggtttctctaatattactggaattgattactctccttctgcaattcagctttctggaagtattatagaaaaagaaggtttatctaacattaagttaaaggtagaagactttttgaatctctccacacagctgtctggatttcatatttgtattgacaaagggacttttgatgccataagccttaatcctgacaatgcaattgagaagaggaagcaatatgtgaaatctctctccagggtgttgaaagtaaaaggcttttttctaataacgtcatgtaattggaccaaggaagagttgctaaatgaattcagtgaaggttggagtacagtggcaggattttggctcactgcagccttgacttcctgggctcaagcgatcttttccacttcagcctcccgagtaggtggaactacaggcacacatcatcatgcctggataatttttgtatttttagcagagacgaggttttgccatgttgtccaggctggtctggaactcctgggctcaagtgattctcccacctggcctcccaaagtgctgggattataccatgccaggccctcgttggcattttagatttgaacttctcgaagagctaccaacacccaagttcagctttggaggcagatctggaaacagtgtagcagcattggttttccaaaaaatgtgagactttttcttggacgaattcaggtagctacacagaatctacacagcaaagttaacctgacacagaaaatccttgtgcaaataaatgcttagtaagtacacaggatgcacatgttgaatagagtatactggattggtgaaagaaaataataataatgagcatctaagtggttgggttttagagatcaatcaagaataattttaattttcttttgtatttgaaatgtaaatagttttcttttcgattaaaaaaatttcctataactgctaaacagttaaaaactttaaagtagtaaatgagtttatagaaagcatgtattcttgatttttgtgccttggtaaagttgataactatttatgaatatttgaccaaattattccagcatcagaataataagcaaaataactttgttagtgttttgttagactgtttatgaaatataacaagaaatactattttgtgttggatggcggttatttttaaacttaattaatacctgtgaaaaggcctcttacctttatgtatataattaaacaaaatcagagaaatgtatcagttgctcaagttatcaagcctgcattttgcagctatggtcttctacacactgtaagggtagtagaaggaaagagaactaaggaatgttattatttgctagcgctatgttaagttgtcttattaagtaattgagtcctttcaatgtcttcttgaggtatgtattgcttgttcttgtttctacgtataaggaaaatgaagctgagagaagtgaagtcacttttatgaggttcaacagtacaggatggagccaggatttttatctgggtctgtctgactttaaaacacatactcttctcctagcatattctgcctcacaggtgcttagtctttgcctttgtagcatttacagtacagctggagacccatgatgattacatataaagttcagttagaaaagatgggtagttactttattagtgttcatctgtggagtatcagaatagcagtcagccaactctgtctcatatcatccttcattacttttccccatctccctactcaaagacttgcctctattaagaattttgtcattcttctgtgaaagggtagtgtaagttatataagccctcagcgatacatgcacaaagatgttctagttaggggctaatttggcaagagaaacagtttattaatgtttttgaaaagataagtcatattcatacttaataccattttgtatttgtggtaatattttaatattggagctaaatacaaatttttgcataattttttgatgattttcagctttgtgggcctattgggttacataagtgactttttgtttggcaaatgttactcctgtattgagtaagtctaacattacgtcccttttctttttggggaggggtagccagaggagtgagtttttcatttagatcaacattgatcaaccattaagacaagatagttgaagacatgtatgtggactgtcaacaaaaataacattttttgaaaagcttttattttcaacatgtaaaaagtgagaaattacttcaaaatatatgcaatttaaattttttagaagattgtgttgattttaccaagacaggagatcttaaactgtagaaacttttatagtttttgagatcgggtctttgttttttttcacattaatattctttgatttcaaatataacatagataagtactcttagaattttgagttaagtatatgctattttaatgtgctaatcctacaaactaggctttctgtgtgactagactgagatgttgagtttgattcacaaaaagcttagaatggttctttgttgaaaagcttttcgagtcactatttggggcatgttagtgccatttgcaaaggtgaaggttttctttttttttttttttttaaccatagagcttttgataaggttaggaaaaggaagttgtcatctcttcttattactctaatcctgctggaagctagcttcttagggactaaaaccagaacaaatggaaggtccaaaaatgctaataagaaattagtattttcacataataccaaactgtaaaaaccaggccagcaagtgtcaccaggttcctgaaacaaaccataaatacattatttaacttagtattgttaaattgtataaatatgtgggtaactgtgacagaaattatgcacttataaaaagcagtaagttacatagtgaatgctgttttctgtggataagaagctggaattgtgatttcatttaatcgaaagacgcttactttgaggaaacttgtttgaaatgcaaacgcgatttctctgtggagccttcacggaattgctgcttttcactatgattattgctgcataacaggccacttctgtgtgtaggaagtgcgtgtgcaagtccaaagggaattgaggcctgaatgggtgggttatcccaattaacaaatacaaagttttcagtacattttgttttaagccaggtgcacaagttagagttgctttttgggactggcatttatgtatgtgagaatcaaacctgatatcactcttggcagcctgactaaagccatttaaaaataagta

SEQ ID NO: 153458 - DNA, 524 bp, Homo sapiens
  Payload ID: 10184
  Gene Symbol: METTL10
  Gene Name: methyltransferase like 10
  ENST ID: ENST00000495711
  CDS Start-End: 1-95
gatttgaacttctcgaagagctaccaacacccaagttcagctttggaggcagatctggaaacagtgtagcagcattggttttccaaaaaatgtgagactttttcttggacgaattcaggtagctacacagaatctacacagcaaagttaacctgacacagaaaatccttgtgcaaataaatgcttacttactttaccagaactcttccctccagtgagttgcaagcgtgacatttgctgtgttttcagcacctgccaacttggaaagcagggtttgtgttcaggacttaggctcacaacccatactttgtggtgcacaatgctggcccagctggcatgctttcgtacctcaatggtgctagacagtcagttacaaagctgtgtggcttcacatgcgctgatctcaatagtcactcctcttcaagctgctttcaactcttattttgtatcaaaggagtgggattggtattattaaactcattgctgaggttatttttcagtgaaaataaattgttttatttagtt

SEQ ID NO: 153459 - DNA, 1459 bp, Homo sapiens
  Payload ID: 10184
  Gene Symbol: METTL10
  Gene Name: methyltransferase like 10
  ENST ID: ENST00000612459
  CDS Start-End: 38-613
atggcggccccaacggccgtccaggacgtggagcgaaatgagctcgggcgctgacggcggcggtggcgctgcggtggcggcgcggtcggacaagggcagtcccggggaggacggtttcgtcccgtcggcgctggggacccgcgagcattgggatgctgtctatgagagagaactgcaaactttccgagaatatggagatacaggtgaaatctggtttggagaagagagtatgaatcgactaataaggtggatgcagaaacacaagattccactggatgcttcagtgcttgatattggaactggaaatggtgttttcctggttgaacttgcaaaatttggtttctctaatattactggaattgattactctccttctgcaattcagctttctggaagtattatagaaaaagaaggtttatctaacattaagttaaaggtagaagactttttgaatctctccacacagctgtctggatttcatatttgtattgacaaagggacttttgatgccataagccttaatcctgacaatgcaattgagaagaggaagcaatatgtgaaatctctctccagggtgttgaaagtaaaaggcttttctaataacgtcatgtaattggaccaaggaagagttgctaaatgaattcagtgaaggttggagtacagtggcaggattttggctcactgcagccttgacttcctgggctcaagcgatcttttccacttcagcctcccgagtaggtggaactacaggcacacatcatcatgcctggataatttttgtatttttagcagagacgaggttttgccatgttgtccaggctggtctggaactcctgggctcaagtgattctcccacctggcctcccaaagtgctgggattataccatgccaggccctcgttggcattttagatttgaacttctcgaagagctaccaacacccaagttcagctttggaggcagatctggaaacagtgtagcagcattggttttccaaaaaatgtgagactttttcttggacgaattcaggtagctacacagaatctacacagcaaagttaacctgacacagaaaatccttgtgcaaataaatgcttagtaagtacacaggatgcacatgttgaatagagtatactggattggtgaaagaaaataataataatgagcatctaagtggttgggttttagagatcaatcaagaataattttaattttcttttgtatttgaaatgtaaatagttttcttttcgattaaaaaaatttcctataactgctaaacagttaaaaactttaaagtagtaaatgagtttatagaaagcatgtattcttgatttttgtgccttggtaaagttgataactatttatgaatatttgaccaaattattccagcatcagaataataagcaaaataactttgttagtgttttgttagactgtttatgaaatataacaagaaatact

SEQ ID NO: 153460 - DNA, 992 bp, Homo sapiens
  Payload ID: 10185
  Gene Symbol: METTL11B
  Gene Name: methyltransferase like 11B
  Uniprot ID: Q5VVY1
  ENST ID: ENST00000439373
  CDS Start-End: 108-959
ggtttaaaatgacagtctcaagttcatttagaaagagaaggctaattcaaagaaacagcaaggcaagcttcctttctctgtaggaatcattattatccccctttgtcatggcccaccggggagcccattttgcctttagatcccgctggcagaagaccgacgatgaactctgtagacatagcatgtcttttatccttcacaaagccattcgcaatgacttctttcagagctatctctacctgctggaaaaaattcccctggtgaaattgtacgctttaacaagccaagtcatcaatggtgagatgcagttctatgccagagctaaacttttctaccaagaagtaccagccacagaagagggtatgatgggaaatttcattgaactgtccagcccagacatccaggcctctcagaaatttcttaggaaatttgttggggggcctgggagagctggaacagactgcgccttggactgcggctccgggataggaagggtcagcaaacacgtcttattgcctgttttcaacagtgtggagctggtggatatgatggaatcctttctccttgaagcccagaactacctgcaggtcaaaggtgacaaagtagaaagctaccactgctacagcctgcaggaattcacaccccccttcaggagatatgatgtcatctggattcagtgggtctctgggcacctgactgataaggaccttcttgcatttctttcccggtgccgagatggcctgaaagaaaatggcatcatcatattgaaggacaatgtggcccgggagggctgtatccttgatctctctgacagcagtgtgactcgggacatggacatcctccggagcctaataaggaagagtgggctggtggtgctgggccaggagaagcaggatggcttcccagagcagtgcatccccgtgtggatgttcgcactgcacagcgacagacactcctgaaaaagcagtgggaatgaacgactggactgggca

SEQ ID NO: 153461 - DNA, 2037 bp, Homo sapiens
  Payload ID: 10186
  Gene Symbol: METTL12
  Gene Name: methyltransferase like 12
  Uniprot ID: A8MUP2
  ENST ID: ENST00000532971
  CDS Start-End: 258-980
ggcctttcggagggtggtgagctagtctgcggacgctgtataccctcctccacttcccgctgcagccaataaaggccgttcctaccatagtctgtgtccgcgttcttttttccgggactgcagagttcggggaagctgtacgccgcctttcgctacgcggaatttgcagatcttcccctggacctcaggcctctccggctggagtagggtggacgcttcacataagcttctctggtcgaacttacccgaatctccagatggccgcgctgcgtcgaatgctccacttgccgagcctgatgatggggacgtgccgcccctttgcgggctcactggctgatagttgcctggcggaccgctgtctctgggatcggctgcatgcccagcctcgtttgggcactgtccccaccttcgactggttctttggatacgacgaagtccaggggctcctactgccattgctgcaggaggcacaggctgccagtcctctgcgagtgctggatgtgggctgtgggacttccagcctatgtacaggcctctacaccaaatctccacacccagtggatgtgctgggggtggacttttctcctgtggctgtggcccacatgaatagcctcctggagggtggcccaggccaaacacctctatgccctggacaccctgcctcaagcctccacttcatgcacgccgatgctcagaacctgggggctgtggcttcttcaggctctttccaactactgctggacaaaggcacatgggatgctgttgcccggggaggtctgcctagggcttaccagcttctatcagaatgcttgagggttctaaaccctcaggggaccctgattcagttctcagatgaggaccctgatgtgcgactgccctgcctggaacaagggtcctatggctggactgtgactgtgcaggagctaggcccgttcaggggcatcacctactttgcttacttgattcaaggctctcattaaagacattttagtagtcctgaccctagtatttctgtgggcaaggagagggctgaagaactgtctttgcaagctatctggctgcaaagtgagaatttgagtcctggcttccacatttactagctgggtgccatattgctgaatgtttctgttccccagtttactcatctgcagagtgagaataacttggagttacggagattacatacaatgatgtgcgcaatatttagcacaaaatgaatgctgaaaagagaaggtacaattgggtcattccccagtttcaactaactggagctcctaaaagcagcagacaggaactgaatcaaaacccctgcgctgactgacttgtataatctagtggcctaacctgtaagcctcatttttgtcacctgtaaaaggagattgtaagaggatgggtataaggagcttcataaacctggatgagatatttgagggggagggaacaatacttaccctcaaagctattaggaggcaggagatgggaatattccacaaagccacttctacaaacacgggagcctgttgagtcccagaagggacagtggttggtggcttccagacatgctgtgtcctcaagaatccaacaagcatcttcttcatcctggtcctgcccccagctgagtccagcgttaaatgttcttaaaggacttctagggtcctgtgggctccaagcccagcctgggatggaggaagagaggggacaaaaatattactgatatattatcaaattacaaaactaggccaggcatgctggctcatacctataatcacagcactttgggaggccaaggtgggcagattgcttgagccctggcaataaagtgacacccctaactctacaaaaacaaatgagcccgggatagtggcacaggcatgtagttccaactactcaggaggctgagctgggaggactgcttgaaccctgggaggtcaaagctgcaatgggccatgataagctgctgcacttgagctaaaaattaatttctgtggtattttttgcttataaaaaaatagagcaattatatcactaagagcctaa

SEQ ID NO: 153462 - DNA, 3327 bp, Homo sapiens
  Payload ID: 10187
  Gene Symbol: METTL13
  Gene Name: methyltransferase like 13
  Uniprot ID: Q8N6R0
  ENST ID: ENST00000361735
  CDS Start-End: 267-2366
gtgtgaggggctcttcacgtggggaaggaacagcaggcgcggaggagggggcaagcgtgtgtgagattcagtggtccatgcgtgcgtttgtcgtgtaagggtcattcctggggtttggagtgggggaacaaatcaatgtggctgtttttccgtggaaagaattcccactgcagtgtcccggagcctgcgtgtggtgggcaagctcctcaaatggtatctcacagggaataggggagtcttgaaaacgcagcttcggcagtaggaacatgaacctcttacctaaaagttccagggagtttggctccgttgactattgggagaagttcttccagcagcgaggaaagaaagctttcgagtggtatggaacctacctggaactgtgcggggtgctacataaatatatcaagcccagggaaaaggtgctggtgattgggtgtggcaactcagaactgagtgagcaactgtatgatgtgggctatcgggatatagtgaacatcgacatcagtgaggttgtcatcaagcaaatgaaggaatgtaatgccacccgacggccccagatgagcttcttgaagatggacatgacgcagatggagtttcctgatgcctcgttccaggtggtgttggacaagggcaccctggatgctgtcctgacagatgaggaagagaagaccttacaacaggtggacaggatgctggctgaggttggccgtgtcctgcaggtgggcggtcgctatctctgcatctccctggctcaggctcacatcctgaagaaagcagtgggccacttctcccgggaggggtggatggtgagggtgcaccaagtggccaacagccaggaccaggtgttggaagcagagcctcagttctccttgcctgtctttgccttcatcatgaccaagttcaggccagtccctggctctgcccttcagatctttgagctgtgtgctcaggagcagcgcaagcctgtgcggctggagagtgccgagcggctggccgaggcggtgcaggagcgacagcagtatgcctggctgtgcagccagctgcgccgcaaggccaggctggggagtgtgtctctggacttgtgcgatggggacacgggggagccacgctacaccctccacgtggtggacagccccactgtgaaaccatcgcgggacaatcattttgcgattttcatcatccctcagggccgggagaccgagtggctctttggcatggatgagggccggaaacagctggcggccagtgctggcttcaggaggttgattacagtggcccttcaccgaggtcagcagtatgaaagcatggaccacatccaagctgagctgtcggctagagtcatggagctggccccagctgggatgcccacccagcagcaggtcccctttctgtctgtgggtggggacattggggtccggaccgttcagcaccaagactgcagccccttgagcggtgactatgtcattgaggatgtgcaaggggatgacaagcgatacttccgtcgactgatcttcctcagcaacaggaatgtggtgcagtccgaagccaggttgctgaaggatgtgtctcacaaagcccagaagaagcggaaaaaggacaggaagaagcagcggcctgctgatgcggaggacctccctgcagccccggggcagtccattgataagagttacctgtgttgtgaacaccacaaagccatgatcgctggccttgccctgctgagaaacccagagctactcctagagatcccactggcattgttggtggtaggcctgggcgggggcagcctccccctctttgtccacgatcattttccaaagtcctgcattgatgctgtggagatcgatccctccatgttggaagtggccacccagtggtttggcttctcccagagtgaccgaatgaaggtccacattgcagatggcctggactatatcgccagcttggcaggaggaggagaagcacggccttgctacgatgtcataatgtttgatgttgacagtaaggacccaacactgggaatgagttgtccgcccccagcatttgtggagcaatcttttctacagaaggttaaaagcatcttgactcctgaaggtgtttttattctcaaccttgtgtgccgagacttggggctaaaagactcagtgctggctgggctcaaggcagtgttccccctcctatatgtccggcgaattgagggtgaagtgaatgagatcctgttctgtcagctgcaccctgagcaaaaacttgccacaccagagctcctagaaacagcccaggctttggagcggaccctgaggaagcctgggaggggttgggatgacacgtatgtcttgtcagatatgctcaagacggtgaaaattgtgtgactgcttaggccaagcagccctcctgcctagactgaccttggactcccagcctgccagagaatgaagaaatacaacgcacagtacttttgaagcttcgtatttttcttggtttcacactcagctacatgtgacctccagcttggtgaggttgcctgaagattagggaaaataaaaatgtccttcccatcttgtcctcttcagtaccacttgggttggtttgtctttgcttcctacaccacgtccttgagtggagttccctgctgaagcccctagcacacactgcatgccttaacaagtgtgtgcaagcccctcagaactcaagacatccaaattttattgcgtctctacttatactggtttgcttttgatttattcctctattagttctataggagtgatctcaagtgagatagcagagcaagatgccaaaagaccataaatagagtaaggtttctatagatgtgagacagatttgagagagcatttactctgtctccctgtggatgaaactgctgctgaaatggttccaatttttaggaatctgcttacccacttcattatttgacagctttccttggtgacccaaaccttgtagcctaagccatttgtctttttctcagtggagggagtgtatggacctggccccatggctttgcatgttagagacctggcagactaaagtctctagtgtttgtttgctcacatttgctgagtgacagctatgtgccagactgcataaagggtggtggcagaagtgaaaatgtttaagaatgaccaaaaacattagtaatgaaagttaatgtgttccaggcattcttctaagtggtttacatgcactgtctcatttaatctgagataaaggatacttaagcccaaactatatctaaacccaaatctcacttggctggaaacatcaatcttaaccatttattcagaaccattaaaccaatgattccaagac

SEQ ID NO: 153463 - DNA, 3022 bp, Homo sapiens
  Payload ID: 10187
  Gene Symbol: METTL13
  Gene Name: methyltransferase like 13
  Uniprot ID: Q8N6R0
  ENST ID: ENST00000362019
  CDS Start-End: 220-2061
ggaaatctagttcgggaaaagtgtgaggggctcttcacgtggggaaggaacagcaggcgcggaggagggggcaagcgtgtgtgagattcagtggtccatgcgtgcgtttgtcgtgtgctggtgattgggtgtggcaactcagaactgagtgagcaactgtatgatgtgggctatcgggatatagtgaacatcgacatcagtgaggttgtcatcaagcaaatgaaggaatgtaatgccacccgacggccccagatgagcttcttgaagatggacatgacgcagatggagtttcctgatgcctcgttccaggtggtgttggacaagggcaccctggatgctgtcctgacagatgaggaagagaagaccttacaacaggtggacaggatgctggctgaggttggccgtgtcctgcaggtgggcggtcgctatctctgcatctccctggctcaggctcacatcctgaagaaagcagtgggccacttctcccgggaggggtggatggtgagggtgcaccaagtggccaacagccaggaccaggtgttggaagcagagcctcagttctccttgcctgtctttgccttcatcatgaccaagttcaggccagtccctggctctgcccttcagatctttgagctgtgtgctcaggagcagcgcaagcctgtgcggctggagagtgccgagcggctggccgaggcggtgcaggagcgacagcagtatgcctggctgtgcagccagctgcgccgcaaggccaggctggggagtgtgtctctggacttgtgcgatggggacacgggggagccacgctacaccctccacgtggtggacagccccactgtgaaaccatcgcgggacaatcattttgcgattttcatcatccctcagggccgggagaccgagtggctctttggcatggatgagggccggaaacagctggcggccagtgctggcttcaggaggttgattacagtggcccttcaccgaggtcagcagtatgaaagcatggaccacatccaagctgagctgtcggctagagtcatggagctggccccagctgggatgcccacccagcagcaggtcccctttctgtctgtgggtggggacattggggtccggaccgttcagcaccaagactgcagccccttgagcggtgactatgtcattgaggatgtgcaaggggatgacaagcgatacttccgtcgactgatcttcctcagcaacaggaatgtggtgcagtccgaagccaggttgctgaaggatgtgtctcacaaagcccagaagaagcggaaaaaggacaggaagaagcagcggcctgctgatgcggaggacctccctgcagccccggggcagtccattgataagagttacctgtgttgtgaacaccacaaagccatgatcgctggccttgccctgctgagaaacccagagctactcctagagatcccactggcattgttggtggtaggcctgggcgggggcagcctccccctctttgtccacgatcattttccaaagtcctgcattgatgctgtggagatcgatccctccatgttggaagtggccacccagtggtttggcttctcccagagtgaccgaatgaaggtccacattgcagatggcctggactatatcgccagcttggcaggaggaggagaagcacggccttgctacgatgtcataatgtttgatgttgacagtaaggacccaacactgggaatgagttgtccgcccccagcatttgtggagcaatcttttctacagaaggttaaaagcatcttgactcctgaaggtgtttttattctcaaccttgtgtgccgagacttggggctaaaagactcagtgctggctgggctcaaggcagtgttccccctcctatatgtccggcgaattgagggtgaagtgaatgagatcctgttctgtcagctgcaccctgagcaaaaacttgccacaccagagctcctagaaacagcccaggctttggagcggaccctgaggaagcctgggaggggttgggatgacacgtatgtcttgtcagatatgctcaagacggtgaaaattgtgtgactgcttaggccaagcagccctcctgcctagactgaccttggactcccagcctgccagagaatgaagaaatacaacgcacagtacttttgaagcttcgtatttttcttggtttcacactcagctacatgtgacctccagcttggtgaggttgcctgaagattagggaaaataaaaatgtccttcccatcttgtcctcttcagtaccacttgggttggtttgtctttgcttcctacaccacgtccttgagtggagttccctgctgaagcccctagcacacactgcatgccttaacaagtgtgtgcaagcccctcagaactcaagacatccaaattttattgcgtctctacttatactggtttgcttttgatttattcctctattagttctataggagtgatctcaagtgagatagcagagcaagatgccaaaagaccataaatagagtaaggtttctatagatgtgagacagatttgagagagcatttactctgtctccctgtggatgaaactgctgctgaaatggttccaatttttaggaatctgcttacccacttcattatttgacagctttccttggtgacccaaaccttgtagcctaagccatttgtctttttctcagtggagggagtgtatggacctggccccatggctttgcatgttagagacctggcagactaaagtctctagtgtttgtttgctcacatttgctgagtgacagctatgtgccagactgcataaagggtggtggcagaagtgaaaatgtttaagaatgaccaaaaacattagtaatgaaagttaatgtgttccaggcattcttctaagtggtttacatgcactgtctcatttaatctgagataaaggatacttaagcccaaactatatctaaacccaaatctcacttggctggaaacatcaatcttaaccatttattcagaaccattaaaccaatgattccaagac

SEQ ID NO: 153464 - DNA, 2865 bp, Homo sapiens
  Payload ID: 10187
  Gene Symbol: METTL13
  Gene Name: methyltransferase like 13
  Uniprot ID: Q8N6R0
  ENST ID: ENST00000367737
  CDS Start-End: 273-1904
ggaaaagtgtgaggggctcttcacgtggggaaggaacagcaggcgcggaggagggggcaagcgtgtgtgagattcagtggtccatgcgtgcgtttgtcgtgtaagggtcattcctggggtttggagtgggggaacaaatcaatgtggctgtttttccgtggaaagaattcccactgcagtgtcccggagcctgcgtgtggtgggcaagctcctcaaatggtatctcacagggaataggggagtcttgaaaacgcagcttcggcagtaggaacatgaacctcttacctaaaagttccagggagtttggctccgttgactattgggagaagttcttccagcagcgaggaaagaaagctttcgagtggtatggaacctacctggaactgtgcggggtgctacataaatatatcaagcccagggaaaaggtgctggtgattgggtgtggcaactcagaactgagtgagcaactgtatgatgtgggctatcgggatatagtgaacatcgacatcagtgaggttgtcatcaagcaaatgaaggaatgtaatgccacccgacggccccagatgagcttcttgaagatggacatgacgcagatggagtttcctgatgcctcgttccaggtggtgttggacaagggcaccctggatgctgtcctgacagatgaggaagagaagaccttacaacaggtggacaggatgctggctgaggttggccgtgtcctgcagggccgggagaccgagtggctctttggcatggatgagggccggaaacagctggcggccagtgctggcttcaggaggttgattacagtggcccttcaccgaggtcagcagtatgaaagcatggaccacatccaagctgagctgtcggctagagtcatggagctggccccagctgggatgcccacccagcagcaggtcccctttctgtctgtgggtggggacattggggtccggaccgttcagcaccaagactgcagccccttgagcggtgactatgtcattgaggatgtgcaaggggatgacaagcgatacttccgtcgactgatcttcctcagcaacaggaatgtggtgcagtccgaagccaggttgctgaaggatgtgtctcacaaagcccagaagaagcggaaaaaggacaggaagaagcagcggcctgctgatgcggaggacctccctgcagccccggggcagtccattgataagagttacctgtgttgtgaacaccacaaagccatgatcgctggccttgccctgctgagaaacccagagctactcctagagatcccactggcattgttggtggtaggcctgggcgggggcagcctccccctctttgtccacgatcattttccaaagtcctgcattgatgctgtggagatcgatccctccatgttggaagtggccacccagtggtttggcttctcccagagtgaccgaatgaaggtccacattgcagatggcctggactatatcgccagcttggcaggaggaggagaagcacggccttgctacgatgtcataatgtttgatgttgacagtaaggacccaacactgggaatgagttgtccgcccccagcatttgtggagcaatcttttctacagaaggttaaaagcatcttgactcctgaaggtgtttttattctcaaccttgtgtgccgagacttggggctaaaagactcagtgctggctgggctcaaggcagtgttccccctcctatatgtccggcgaattgagggtgaagtgaatgagatcctgttctgtcagctgcaccctgagcaaaaacttgccacaccagagctcctagaaacagcccaggctttggagcggaccctgaggaagcctgggaggggttgggatgacacgtatgtcttgtcagatatgctcaagacggtgaaaattgtgtgactgcttaggccaagcagccctcctgcctagactgaccttggactcccagcctgccagagaatgaagaaatacaacgcacagtacttttgaagcttcgtatttttcttggtttcacactcagctacatgtgacctccagcttggtgaggttgcctgaagattagggaaaataaaaatgtccttcccatcttgtcctcttcagtaccacttgggttggtttgtctttgcttcctacaccacgtccttgagtggagttccctgctgaagcccctagcacacactgcatgccttaacaagtgtgtgcaagcccctcagaactcaagacatccaaattttattgcgtctctacttatactggtttgcttttgatttattcctctattagttctataggagtgatctcaagtgagatagcagagcaagatgccaaaagaccataaatagagtaaggtttctatagatgtgagacagatttgagagagcatttactctgtctccctgtggatgaaactgctgctgaaatggttccaatttttaggaatctgcttacccacttcattatttgacagctttccttggtgacccaaaccttgtagcctaagccatttgtctttttctcagtggagggagtgtatggacctggccccatggctttgcatgttagagacctggcagactaaagtctctagtgtttgtttgctcacatttgctgagtgacagctatgtgccagactgcataaagggtggtggcagaagtgaaaatgtttaagaatgaccaaaaacattagtaatgaaagttaatgtgttccaggcattcttctaagtggtttacatgcactgtctcatttaatctgagataaaggatacttaagcccaaactatatctaaacccaaatctcacttggctggaaacatcaatcttaaccatttattcagaaccattaaaccaatgattccaagac

SEQ ID NO: 153465 - DNA, 6669 bp, Homo sapiens
  Payload ID: 10188
  Gene Symbol: METTL14
  Gene Name: methyltransferase like 14
  Uniprot ID: Q9HCE5
  ENST ID: ENST00000388822
  CDS Start-End: 168-1538
gcgagccaattccggccgcgccggaagtctctactgaggaaagctatgaggatactctgttcgtaagctcccggtgaattttgttccacagactcggaagaaaggttggataagagttcactggagattgacaagtactcgggatagtgaaaagccggagttggaacatggatagccgcttgcaggagatccgggagcggcagaagttacggcgacagctcctcgcgcagcagttgggagctgaaagtgccgacagcattggtgccgtgttaaatagcaaagatgagcagagagaaattgctgaaacaagagaaacttgcagggcttcctatgatacctctgctccaaatgcaaaacgtaagtatctggatgaaggagagacagatgaagacaaaatggaagaatataaggatgaactagaaatgcaacaggatgaagaaaatttgccatatgaagaagagatttacaaagattctagtacttttcttaagggaacacagagcttaaatccccataatgattactgccaacattttgtagacactggacatagacctcagaatttcatcagggatgtaggtttagctgacagatttgaagaatatcctaaactgagggagctcatcaggctaaaggatgagttaatagctaaatctaacactcctcccatgtacttacaagccgatatagaagcctttgacatcagagaactaacacccaaatttgatgtgattcttctggaaccccctttagaagaatattacagagaaactggcatcactgctaatgaaaaatgctggacttgggatgatattatgaagttagaaattgatgagattgcagcacctcgatcatttatttttctctggtgtggttctggggaggggttggaccttggaagagtgtgtttacgaaaatggggttacagaagatgtgaagatatttgttggattaaaaccaataaaaacaatcctgggaagactaagactttagatccaaaggctgtctttcagagaacaaaggaacactgcctcatggggatcaaaggaactgtgaagcgtagcacagacggggacttcattcatgctaatgttgacattgacttaattatcacagaagaacctgaaattggcaatatagaaaaacctgtagaaatttttcatataattgagcatttttgtcttggtagaagacgccttcatctatttggaagagatagtacaattcgaccaggctggctcacagttggaccaacgcttacaaatagcaactacaatgcagaaacatatgcatcctatttcagtgctcctaattcctacttgactggttgtacagaagaaattgagagacttcgaccaaaatcgcctcctcccaaatctaaatctgaccgaggaggtggagctcccagaggtggaggaagaggtggaacttctgctggccgtggacgagaaagaaatagatctaacttccgaggagaaagaggtggctttagagggggccgtggaggagcacacagaggtggctttccacctcgataattgttgaagacattgaacctattcatcctcctctaaccttctttattgtaattaaatttcaagtgggagacttaactttagaactcacttccagcttgcactttgctttaatttctctgagctgcaagaatgtcttagcgagccttgcttgcagttgtcacacacactgtctggtttttttcaggataaatgaatgattctgccttttgttatgtgcgtgaacagaatggaacaactcaagtagcttcatcttcagagactgaatttattctgatagacttcagctaattacaaaggattttgctaatttttgggaataaataatggaaaaagatccagtctgtggtatcatgctagtgctgacagggccttgatagaatagagttggaaaagatggtaagcttttgtcagggttttaacattttcttgatgaaacaataaaaagaggtaagcttttttcttctttttttttaagttttaaataaactcagatataatttgaatactgaagaaattaagagactttgaacaaaaactcttcccaaatctaaatttgataggggaggtggagattccaggggtgggtgaaagaagagatagaacttagcaggcagacttaaaaaaaaaaaaaaagtttatcatcataatctcaattttgtggctatgactcctaatcacgcttcctaagaagcaaaggaggacaaatattcatgtgctagatagcactgtggtgtggacttgaacttggattgaccttaaattttatattcctcaaataaaagagaggcagcgacaagatacctcattatcagatgcttggtttatacattttgggactaaaatacttggtgatgaaatgacatacacctttaaacttgttatggagatagtttaatgtaaaaccaactacggaaaaccctcaacttaaggatacagcttggaaattggaactgcaattgccttttattaaaaccatatggtgtgatgtttgtttttaaaattatataagactttatgctgtcacttctcttgctgtactgtaattcatgttttaaatgaatttgataatgaaattatactattatcattcttgatgaatacttttcttatttttatgatttttctaatgaaactttaaacttttgagatttgagagtctgttttctataagtagaattactgttgttacaaaatgaaaaaggactgacctaaaatcagtctcttcttttggtctgtgatggattttaatggccgttctgtgctcatatatacctaagatgagattatattacatccaccaaagactcagtttgaagataaggaatgagtgatagaagaaataaggctgagatccttaaaagcctaattaatttaactcgcttaacccattagtactatctagtacaagacccctttttttttgctgaaattatggtatattttcaacttcactaattacaaattatctagatttagaactctatatgtcagcattgacctgggaatgaagtcaggatagagaaattccacttgcctgtgatgggtccttagaagtatcagctaaggagtgaccctgtcctatacacagggctctctattacgttccataccctgggcctacccaaggtgacattcctgctgtttacatggcataggcacctgtgagatcagtgtcacaatttcatcttagaaagaggtaggtatggctgctttgtcggttgaaagttaaggggagccatgatctaccatatttaggaaaaagttatttaaaaaagagcagatggtggaaaaagaatgtaagacccagaatttatccctttgacaatgaatctggcctttttaatagcaggatggaattgattcactagtttttgctaactttcactttcagtaaaggttgaggtgttgtttttgcaatgactgtgtattcattgaggaaaggtttccaatgaaatttcattactctgacctcttctaatttttggtcttctttatatttacatgtcttacattccacaaaattatttagaaatgctgggcatggtggctcatgcctgtaatcccagcactttgtgaggccgatgtgggtggatcacttgaggtcaggagtttgagaccagcctgaccaatatggagaaatcccatctctactaaaaatacaaaattagctgggcgtggtggcatgtgcacgcctgtaatccccgctactcgggaggctgtggcaggagaattgcctgaacccaggaggcggaggttgcagtgagccgagattgtgccactgcactccagcctgggcgacagagtgagactctgtctcaaaaaaaaaaaaaaaaattgtatagaaataaatttttagttgctttatgcactaattccttactggggatagaagctaattattgtgaaataacctagtttagaagttagaagatcagcatgtctgagtttttacagaattataattcatggtattccaaaccaactgttgttatttatttccagtgagaaccattttcccactgaccttcctcctttcagaggatggggattaggaggcccaaagtactgattgagtaggaatacttttttactcttcttcactgtggagaaagaagagggcaggtagttgatgatgtcaggagaacagattttatggtgtggaataccatacctaaacacaaatgaatcagattagaccacagaattgtgatgatggcagtcagaatgtaatacggtcatcatgaaacagcacagtgtgagaggtcaaggtgtcaacctgggaagtgagaatcaagcaggagtgtggcatggcaaccaactcacagatccagagttgagagggatcactactgcagcagttctgctctgttactctggtaagtagtagagccactttatgagcccttatttcctatctcccttattctgaggccaggtcagtgatatgctatagtttcatttaagttaatggagtataaagatgggatacttgggagctatattgtgcatcagggtgtcacagctgctactaggagttactccttttcatgtcttttaaaatactttctacccatcttaattgctaaattatctttcagttagttacagcgcttaatttaaaacctgtactgttttcatcctgaatttagaacataagatttagcctttgaagtatagtttcagactttactaatttgtttaatataatccttattaacatgacaaaatgaaagccctgttgggacttagtctaaacagtagtctttgatctgaaagtgtctcatattttgtgatctattagaaacataaacctttgcttatgcagaaggtctttcttagaacaatcctgtaatcttagggttcatgtgtgactagcattatcctctctttgatgttgggtaatagaggctgaacttttcttgtgtatatatagttagttttgaggccataaatctaggacttctcaaaagattagaacatttatccagtaaactgactccattgaagacttcatttctggaaataccacattgcttctgctctcaataactctatcatttactcgtataaatattgctagctgtaatgcacagagaaaaactacctcattcaatctagataattgggacatccttttccagtaaaccctttttccactactggataaaatattaaaatgatcagtttgagtgtatgttagagttcatgtttctgtaactaaaggtgctaataaactgaaatcagataaggtaggtttttccaaaaatacttctaaataattgacaacctagaagtcaacaatgtaaaatgcatatgggactctatattaatagagaagcaggccaagaactttttaatgggataattgtcttctttaggcacattgtttgcatattaacgacatggaaatattttcactcatttactttcatccatctatctgtgctttttctcactttgatgagttctctcaactcctttctaagaaaagcagagcagagcagcatagagtgcgttagtaaatggccactgactcttggtctcaggccatagcaactatagagagaagagtggggctggagacctcataccctgggtaaagtggacatcacttgtcagctccagctaattgtcaccacagagagaagagggtaagtctgagatgttcatgtgcatttccctacattttagaggttgacaaaatagtttgtgacttttgcttacatttgcattcatagaactaaaaaaaatttaacttggctaacaaaataccacatgcatattttcttttttatttttattttttgagacagagtctctgttacccaggctggggggcagtgataagatcttggctcactgcaacctccgcctccagggttgaagcgattcttctgcctcagcctcctgagtagctggaattacaggtgcccaccaccacacccagctaattttagtattcttagtagagacaggatttcaccatgttggccaggctggtctcaaactcccgacctcaactgatccacccaccctggcctcccaaagtgtcaggattacaggcgtgagcctctgcaactggccaacatgcatatttaaattatgcatgcattgtagctgtatactgtgtgaccacatttacttaaaaaagaggaaaaaaggttacttgcttgagacaggaaactatcacctttgaaagcatattaagtagttggcttactttggaacacacagtagactgaaaatgtgaactaatactttaaaattgccgtataatgatgtcattgcaagccattcatctatccaatgggggaaaatgtggaggtctaggcttgtgttgtcacaaaatacaccttttagataatccttacctgtacagatttttataactgttgttatcataagagaatggctacatcattatcctgccttttctgggtgtttattttgttgtttttgaaagtggacaaaacctcaaagcacaattttgttctgatatatccagtttagtagtttatgctggttaaatgatcaaagtaattgcttaaatgtcttgtggaattagctgtcactttatagtttatgtattgtggtgggtaccttaataataaaaagatttttaatgtaataa

SEQ ID NO: 153466 - DNA, 927 bp, Homo sapiens
  Payload ID: 10188
  Gene Symbol: METTL14
  Gene Name: methyltransferase like 14
  ENST ID: ENST00000506780
  CDS Start-End: 1-413
acatcagagaactaacacccaaatttgatgtgattcttctggaaccccctttagaagaatattacagagaaactggcatcactgctaatgaaaaatgctggacttgggatgatattatgaagttagaaattgatgagattgcagcacctcgatcatttatttttctctggtgtggttctggggaggggttggaccttggaagagtgtgtttacgaaaatggggttacagaagatgtgaagatatttgttggattaaaaccaataaaaacaatcctgggaagactaagactttagatccaaaggctgtctttcagagaacaaaggctggctcacagttggaccaacgcttacaaatagcaactacaatgcagaaacatatgcatcctatttcagtgctcctaattcctacttgactggttgtacagaagaaattgagagacttcgaccaaaatcgcctcctcccaaatctaaatctgaccgaggaggtggagctcccagaggtggaggaagaggtggaacttctgctggccgtggacgagaaagaaatagatctaacttccgaggagaaagaggtggctttagagggggccgtggaggagcacacagaggtggctttccacctcgataattgttgaagacattgaacctattcatcctcctctaaccttctttattgtaattaaatttcaagtgggagacttaactttagaactcacttccagcttgcactttgctttaatttctctgagctgcaagaatgtcttagcgagccttgcttgcagttgtcacacacactgtctggtttttttcaggataaatgaatgattctgccttttgttatgtgcgtgaacagaatggaacaactcaagtagcttcatcttcagagactgaatttattctgatagacttcagctaattacaaaggat

SEQ ID NO: 153467 - DNA, 485 bp, Homo sapiens
  Payload ID: 10188
  Gene Symbol: METTL14
  Gene Name: methyltransferase like 14
  ENST ID: ENST00000508801
  CDS Start-End: 121-485
gaggatactctgttcgtaagctcccggtgaattttgttccacagactcggaagaaaggttggataagagttcactggagattgacaagtactcgggatagtgaaaagccggagttggaacatggatagccgcttgcaggagatccgggagcggcagaagttacggcgacagctcctcgcgcagcagatttgtggaatatggctaaaaccgtggaaacttggagtcagatttgttcctttgttccttatcccgctggcattacgatcttgggcaaatcaagtatcctttctaagtcttcttttcgccaacttcttttatcgtattatcttcaaaaatttgggagctgaaagtgccgacagcattggtgccgtgttaaatagcaaagatgagcagagagaaattgctgaaacaagagaaacttgcagggcttcctatgatacctctgctccaaatgcaaaacgtaagtatctggatgaaggagagac

SEQ ID NO: 153468 - DNA, 522 bp, Homo sapiens
  Payload ID: 10188
  Gene Symbol: METTL14
  Gene Name: methyltransferase like 14
  ENST ID: ENST00000626212
  CDS Start-End: 136-330
actgaggaaagctatgaggatactctgttcgtaagctcccggtgaattttgttccacagactcggaagaaaggttggataagagttcactggagattgacaagtactcgggatagtgaaaagccggagttggaacatggatagccgcttgcaggagatccgggagcggcagaagttacggcgacagctcctcgcgcagcagttgggagctgaaagtgccgacagcattggtgccgtgttaaatagcaaagatgagcagagagaaattgctgaaacaagagaaacttgcagggcttcctatgatacctctgctccaaatgcaaaacgatgaactagaaatgcaacaggatgaagaaaatttgccatatgaagaagagatttacaaagattctagtacttttcttaagggaacacagagcttaaatccccataatgattactgccaacattttgtagacactggacatagacctcagaatttcatcagggatgtaggtttagctgacagatttgaagaatatcc

SEQ ID NO: 153469 - DNA, 6625 bp, Homo sapiens
  Payload ID: 10188
  Gene Symbol: METTL14
  Gene Name: methyltransferase like 14
  ENST ID: ENST00000628452
  CDS Start-End: 123-392
atgaggatactctgttcgtaagctcccggtgaattttgttccacagactcggaagaaaggttggataagagttcactggagattgacaagtactcgggatagtgaaaagccggagttggaacatggatagccgcttgcaggagatccgggagcggcagaagttacggcgacagctcctcgcgcagcagttgggagctgaaagtgccgacagcattggtgccgtgttaaatagcaaagatgagcagagagaaattgctgaaacaagagaaacttgcagggcttcctatgatacctctgctccaaatgcaaaacgtaagtatctggatgaaggagagacagatgaagacaaaatggaagaatataaggcaagtagagaaaatgcaacaggatgaagaaaatttgccatatgaagaagagatttacaaagattctagtacttttcttaagggaacacagagcttaaatccccataatgattactgccaacattttgtagacactggacatagacctcagaatttcatcagggatgtaggtttagctgacagatttgaagaatatcctaaactgagggagctcatcaggctaaaggatgagttaatagctaaatctaacactcctcccatgtacttacaagccgatatagaagcctttgacatcagagaactaacacccaaatttgatgtgattcttctggaaccccctttagaagaatattacagagaaactggcatcactgctaatgaaaaatgctggacttgggatgatattatgaagttagaaattgatgagattgcagcacctcgatcatttatttttctctggtgtggttctggggaggggttggaccttggaagagtgtgtttacgaaaatggggttacagaagatgtgaagatatttgttggattaaaaccaataaaaacaatcctgggaagactaagactttagatccaaaggctgtctttcagagaacaaaggaacactgcctcatggggatcaaaggaactgtgaagcgtagcacagacggggacttcattcatgctaatgttgacattgacttaattatcacagaagaacctgaaattggcaatatagaaaaacctgtagaaatttttcatataattgagcatttttgtcttggtagaagacgccttcatctatttggaagagatagtacaattcgaccaggctggctcacagttggaccaacgcttacaaatagcaactacaatgcagaaacatatgcatcctatttcagtgctcctaattcctacttgactggttgtacagaagaaattgagagacttcgaccaaaatcgcctcctcccaaatctaaatctgaccgaggaggtggagctcccagaggtggaggaagaggtggaacttctgctggccgtggacgagaaagaaatagatctaacttccgaggagaaagaggtggctttagagggggccgtggaggagcacacagaggtggctttccacctcgataattgttgaagacattgaacctattcatcctcctctaaccttctttattgtaattaaatttcaagtgggagacttaactttagaactcacttccagcttgcactttgctttaatttctctgagctgcaagaatgtcttagcgagccttgcttgcagttgtcacacacactgtctggtttttttcaggataaatgaatgattctgccttttgttatgtgcgtgaacagaatggaacaactcaagtagcttcatcttcagagactgaatttattctgatagacttcagctaattacaaaggattttgctaatttttgggaataaataatggaaaaagatccagtctgtggtatcatgctagtgctgacagggccttgatagaatagagttggaaaagatggtaagcttttgtcagggttttaacattttcttgatgaaacaataaaaagaggtaagcttttttcttctttttttttaagttttaaataaactcagatataatttgaatactgaagaaattaagagactttgaacaaaaactcttcccaaatctaaatttgataggggaggtggagattccaggggtgggtgaaagaagagatagaacttagcaggcagacttaaaaaaaaaaaaaaagtttatcatcataatctcaattttgtggctatgactcctaatcacgcttcctaagaagcaaaggaggacaaatattcatgtgctagatagcactgtggtgtggacttgaacttggattgaccttaaattttatattcctcaaataaaagagaggcagcgacaagatacctcattatcagatgcttggtttatacattttgggactaaaatacttggtgatgaaatgacatacacctttaaacttgttatggagatagtttaatgtaaaaccaactacggaaaaccctcaacttaaggatacagcttggaaattggaactgcaattgccttttattaaaaccatatggtgtgatgtttgtttttaaaattatataagactttatgctgtcacttctcttgctgtactgtaattcatgttttaaatgaatttgataatgaaattatactattatcattcttgatgaatacttttcttatttttatgatttttctaatgaaactttaaacttttgagatttgagagtctgttttctataagtagaattactgttgttacaaaatgaaaaaggactgacctaaaatcagtctcttcttttggtctgtgatggattttaatggccgttctgtgctcatatatacctaagatgagattatattacatccaccaaagactcagtttgaagataaggaatgagtgatagaagaaataaggctgagatccttaaaagcctaattaatttaactcgcttaacccattagtactatctagtacaagacccctttttttttgctgaaattatggtatattttcaacttcactaattacaaattatctagatttagaactctatatgtcagcattgacctgggaatgaagtcaggatagagaaattccacttgcctgtgatgggtccttagaagtatcagctaaggagtgaccctgtcctatacacagggctctctattacgttccataccctgggcctacccaaggtgacattcctgctgtttacatggcataggcacctgtgagatcagtgtcacaatttcatcttagaaagaggtaggtatggctgctttgtcggttgaaagttaaggggagccatgatctaccatatttaggaaaaagttatttaaaaaagagcagatggtggaaaaagaatgtaagacccagaatttatccctttgacaatgaatctggcctttttaatagcaggatggaattgattcactagtttttgctaactttcactttcagtaaaggttgaggtgttgtttttgcaatgactgtgtattcattgaggaaaggtttccaatgaaatttcattactctgacctcttctaatttttggtcttctttatatttacatgtcttacattccacaaaattatttagaaatgctgggcatggtggctcatgcctgtaatcccagcactttgtgaggccgatgtgggtggatcacttgaggtcaggagtttgagaccagcctgaccaatatggagaaatcccatctctactaaaaatacaaaattagctgggcgtggtggcatgtgcacgcctgtaatccccgctactcgggaggctgtggcaggagaattgcctgaacccaggaggcggaggttgcagtgagccgagattgtgccactgcactccagcctgggcgacagagtgagactctgtctcaaaaaaaaaaaaaaaaattgtatagaaataaatttttagttgctttatgcactaattccttactggggatagaagctaattattgtgaaataacctagtttagaagttagaagatcagcatgtctgagtttttacagaattataattcatggtattccaaaccaactgttgttatttatttccagtgagaaccattttcccactgaccttcctcctttcagaggatggggattaggaggcccaaagtactgattgagtaggaatacttttttactcttcttcactgtggagaaagaagagggcaggtagttgatgatgtcaggagaacagattttatggtgtggaataccatacctaaacacaaatgaatcagattagaccacagaattgtgatgatggcagtcagaatgtaatacggtcatcatgaaacagcacagtgtgagaggtcaaggtgtcaacctgggaagtgagaatcaagcaggagtgtggcatggcaaccaactcacagatccagagttgagagggatcactactgcagcagttctgctctgttactctggtaagtagtagagccactttatgagcccttatttcctatctcccttattctgaggccaggtcagtgatatgctatagtttcatttaagttaatggagtataaagatgggatacttgggagctatattgtgcatcagggtgtcacagctgctactaggagttactccttttcatgtcttttaaaatactttctacccatcttaattgctaaattatctttcagttagttacagcgcttaatttaaaacctgtactgttttcatcctgaatttagaacataagatttagcctttgaagtatagtttcagactttactaatttgtttaatataatccttattaacatgacaaaatgaaagccctgttgggacttagtctaaacagtagtctttgatctgaaagtgtctcatattttgtgatctattagaaacataaacctttgcttatgcagaaggtctttcttagaacaatcctgtaatcttagggttcatgtgtgactagcattatcctctctttgatgttgggtaatagaggctgaacttttcttgtgtatatatagttagttttgaggccataaatctaggacttctcaaaagattagaacatttatccagtaaactgactccattgaagacttcatttctggaaataccacattgcttctgctctcaataactctatcatttactcgtataaatattgctagctgtaatgcacagagaaaaactacctcattcaatctagataattgggacatccttttccagtaaaccctttttccactactggataaaatattaaaatgatcagtttgagtgtatgttagagttcatgtttctgtaactaaaggtgctaataaactgaaatcagataaggtaggtttttccaaaaatacttctaaataattgacaacctagaagtcaacaatgtaaaatgcatatgggactctatattaatagagaagcaggccaagaactttttaatgggataattgtcttctttaggcacattgtttgcatattaacgacatggaaatattttcactcatttactttcatccatctatctgtgctttttctcactttgatgagttctctcaactcctttctaagaaaagcagagcagagcagcatagagtgcgttagtaaatggccactgactcttggtctcaggccatagcaactatagagagaagagtggggctggagacctcataccctgggtaaagtggacatcacttgtcagctccagctaattgtcaccacagagagaagagggtaagtctgagatgttcatgtgcatttccctacattttagaggttgacaaaatagtttgtgacttttgcttacatttgcattcatagaactaaaaaaaatttaacttggctaacaaaataccacatgcatattttcttttttatttttattttttgagacagagtctctgttacccaggctggggggcagtgataagatcttggctcactgcaacctccgcctccagggttgaagcgattcttctgcctcagcctcctgagtagctggaattacaggtgcccaccaccacacccagctaattttagtattcttagtagagacaggatttcaccatgttggccaggctggtctcaaactcccgacctcaactgatccacccaccctggcctcccaaagtgtcaggattacaggcgtgagcctctgcaactggccaacatgcatatttaaattatgcatgcattgtagctgtatactgtgtgaccacatttacttaaaaaagaggaaaaaaggttacttgcttgagacaggaaactatcacctttgaaagcatattaagtagttggcttactttggaacacacagtagactgaaaatgtgaactaatactttaaaattgccgtataatgatgtcattgcaagccattcatctatccaatgggggaaaatgtggaggtctaggcttgtgttgtcacaaaatacaccttttagataatccttacctgtacagatttttataactgttgttatcataagagaatggctacatcattatcctgccttttctgggtgtttattttgttgtttttgaaagtggacaaaacctcaaagcacaattttgttctgatatatccagtttagtagtttatgctggttaaatgatcaaagtaattgcttaaatgtcttgtggaattagctgtcactttatagtttatgtattgtggtgggtaccttaataataaaaagatttttaatgtaataa

SEQ ID NO: 153470 - DNA, 4068 bp, Homo sapiens
  Payload ID: 10189
  Gene Symbol: METTL15
  Gene Name: methyltransferase like 15
  Uniprot ID: A6NJ78
  ENST ID: ENST00000303459
  CDS Start-End: 108-929
ctagacgcgcggcgcattcaggttctcctggaccgtagtggtagtcgctggcccgagttagaggccagctgagaagtcttcgtgcttcagatttgtttacctacaaaatgcttcggtatccatatttttgtagaatgtataaagaatgcctttcatgttggttggaatctggcatacctaatttaggtgtctggccaaacagaatacatactacagcagaaaaatatagagaatatgaagcccgggagcaaacagatcaaactcaagcccaggagttacacagatctcaagatagagattttgaaactatggctaaattacatattccagtaatggtggatgaagttgttcattgtttgtcaccacaaaaaggacagatttttctagatatgacatttggttcgggagggcacacaaaagccattctgcagaaggagtcagatattgttctctatgccttggacagagacccaacagcttatgcattagctgaacatctttcagagttgtatcctaaacaaatccgagctatgctgggccagttcagccaggcagaagccttattaatgaaagctggagtgcagccaggaacttttgatggagttcttatggatcttgggtgttcctccatgcaacttgatactcctgaaagaggtttttcccttcggaaagatggccctttggacatgagaatggatggtggcaggtaccctgacatgcccactgctgctgatgttgtgaatgctttagatcaacaggcacttgcatctatcctaagaacatacggggaggagaagcatgccaagaaaatcgcttcagcaattgttcaggcacgcagcatctaccccatcaccagaacccagcagcttgccagcatcgttgcagaatactctgaaacatatttcccagtggcccaaactctttattaggaaaatggacgaattgaatagcaaatggagcatttcctccctctgctatttatacacggaaagacttactacagcgatctacccatattgccaccaagactttccaggctcttcgcatatttgtgaacaatgagctcaatgaactctacacgggactgaagacagctcagaagtttctgagacctggtggtcgtcttgttgccctctccttccattcactagaggatcgcatcgtcaaaagatttttgcttggaataagcatgacagaaagatttaacctaagtgttagacaacaagtgatgaaaacatctcaattgggttcagatcacgaaaacacggaagaagtctctatgagaagagctcctttaatgtgggaattgatacacaagaaggtacttagtccacaagatcaggatgtacaagataaccccagagggcgctcagccaagcttagagcagctatcaaattataagttatcatcatcttattcttcaaatttttttctcacaatttctctaatctttactcatgttatgtccctgaatgtcttggtataggtttaagtgtgggacagtctgaaaattgatagcatttagcatttcttttttctcaaaaagaaactgtaggaaatacatgacagagaaagttacactcagggagcagcagcacctccagactggaaaaatatgttaatctttgcatcatattggactcttgaaggcaatccttcctctggccaggaaattttttaaaaaataatactgtgttgtgtttatctaaatacgtaaactcaagctaccaaagagaaagatgttgtaatcatatctgcatgtcctaaattttgaatttagatattccaatttgcatcagtctttctgtggctcaaataatgatgattatggaatgaattttaatgtccctacttgtgaataattagctttctcaaatgtaggctttttacaaattttaaattttaaaatattagtttaaatgtgtgttatactgataaaatttcatctttcaaattatagtctattattttaaagggatttttcagtatgatatgggccattttgttcatctatcgcaaagtaaaaatgtaaaatccttacagagaattgtttcacaaaacttatatttcatgtcaattgtatttattttaataatagctcacaatgcctttagtaagtaataaagtctcttattagaatcttgtattttttaattgagctaatcaaaataattcagccaagtctatttgaaatagaaaactgtctatttaatatagtaaaatcaatgctcccttaatgttgttacaaagatatggtaactgtaatatgggtaaaagtttattcaagaaaagagtacttggtagaagattctttaacaaattgaggagattgattcataattcacatgtcaattttttatagtaatatgtacttctaatttattatttatacttaaattgtgacctgaaagatgagttggagataattagtcaaagggcacatggagtatggaagggggcatgttgattaaccatacatagaaataaatattctcttagttatccttgaaatcatatttatactattaatttgctcagtgcacttttttcaaatacagaaaaaagattctccattatagttacaaattttaggttggtgaatccaagtgaatgaaatatcagcataactatgtgggcaaaatagatagaattaaatgcatgaattttcctcagacttattttatctgcctctgtaatatttaactttagtacccaggcttgttcactacttctgctttacaggctttatttaaatctgaacaatcctacagggaaatcagaattaggaaaaaaatctggagaacaatatggttgaaatagaaacaagagaatgcacctaggttaattccctgaatcctacttgaacattgtataaatttctctttgcatataatacatatttgtgaatgagacatattcccaaaaaattcttatctctgtatgtgattggaaaagaaaagatcacatttgtatattcaacaatctttcacctatttcataagtcattttttcaccctgtatagtatgggaattattttttatgttaaatagaaactgaatgtactgggttgaatggtgtcctctccaaaattcatgtacttcctggagcctcagtatgtgaccttatttggaaatactgtggttgtggttgtaagtagctaagatgaggtcatactggagcagggcaggcccttaatccaatatgactggtgttccttataagagaagatagggcgggcatggtggctcacgcctgtaatcccagcactgtgggaggccaagccaggcaaatcgcttgaggctgaggagttcaagaccagcctggccaacatggcgaaaacccatctctactaaaaataaaattagccatgcgtggtgcttgtaatgtcagctacccaggagtctgaggcacaagaatcactcgaacctgggaggtggaggttgcgagatcacaccactgcactccagtgtgagcaacagaacgagactctgtctcaaaaaaaaaaaaaaaaaggaagaaagagaagatagagacacaggggagaatgccacatgaagctggaggcagagattggagtgatacattgtgggaaccctcagaagataggaaaaaagcatggaatagattctccctcagagttccagtagttgccaaccctgctaacatggttttgcacatctagcatccagaacagtgagaatgtatttctgctgttttaaggtacccagttcatggtaatttgttacagcaatcctaggaagctaatactctgacagaaaaaaatcttggataatatgcatgagaaaaatccttcaataaacacaaaattggtttcaaaatgttttcatgtaaaaataaattaacttttctgtaattagattgtgttttatagtaattcttgcctgcttcttagtctttgttgtaggatgcataataaaatacatgaatgagttttaaatggttagctttggagaatggttttgggaagttcctacagtacacagaaataaaagctaatgttactatgaatgcgcattacttttctaataaaatgtttctgaatctc

SEQ ID NO: 153471 - DNA, 4242 bp, Homo sapiens
  Payload ID: 10189
  Gene Symbol: METTL15
  Gene Name: methyltransferase like 15
  Uniprot ID: A6NJ78
  ENST ID: ENST00000407364
  CDS Start-End: 353-1576
gggcggggctaggccggagctgctggtgggaggcagccacttgagatcaccaggcctcctgtagaccggcgggtgcagggcccggtcccagagttaagggaaagtcgtttggaaaccccaggccaacaggaccctttggcagctgaggctggaaacagcggaaccaaaggcagacggtcctcagttgcttgggcggacgtggacccaatctgtccgtccttacaagtttcccccaggggcaggacctagacgcgcggcgcattcaggttctcctggaccgtagtggtagtcgctggcccgagttagaggccagctgagaagtcttcgtgcttcagatttgtttacctacaaaatgcttcggtatccatatttttgtagaatgtataaagaatgcctttcatgttggttggaatctggcatacctaatttaggtgtctggccaaacagaatacatactacagcagaaaaatatagagaatatgaagcccgggagcaaacagatcaaactcaagcccaggagttacacagatctcaagatagagattttgaaactatggctaaattacatattccagtaatggtggatgaagttgttcattgtttgtcaccacaaaaaggacagatttttctagatatgacatttggttcgggagggcacacaaaagccattctgcagaaggagtcagatattgttctctatgccttggacagagacccaacagcttatgcattagctgaacatctttcagagttgtatcctaaacaaatccgagctatgctgggccagttcagccaggcagaagccttattaatgaaagctggagtgcagccaggaacttttgatggagttcttatggatcttgggtgttcctccatgcaacttgatactcctgaaagaggtttttcccttcggaaagatggccctttggacatgagaatggatggtggcaggtaccctgacatgcccactgctgctgatgttgtgaatgctttagatcaacaggcacttgcatctatcctaagaacatacggggaggagaagcatgccaagaaaatcgcttcagcaattgttcaggcacgcagcatctaccccatcaccagaacccagcagcttgccagcatcgttgcaggagcatttcctccctctgctatttatacacggaaagacttactacagcgatctacccatattgccaccaagactttccaggctcttcgcatatttgtgaacaatgagctcaatgaactctacacgggactgaagacagctcagaagtttctgagacctggtggtcgtcttgttgccctctccttccattcactagaggatcgcatcgtcaaaagatttttgcttggaataagcatgacagaaagatttaacctaagtgttagacaacaagtgatgaaaacatctcaattgggttcagatcacgaaaacacggaagaagtctctatgagaagagctcctttaatgtgggaattgatacacaagaaggtacttagtccacaagatcaggatgtacaagataaccccagagggcgctcagccaagcttagagcagctatcaaattataagttatcatcatcttattcttcaaatttttttctcacaatttctctaatctttactcatgttatgtccctgaatgtcttggtataggtttaagtgtgggacagtctgaaaattgatagcatttagcatttcttttttctcaaaaagaaactgtaggaaatacatgacagagaaagttacactcagggagcagcagcacctccagactggaaaaatatgttaatctttgcatcatattggactcttgaaggcaatccttcctctggccaggaaattttttaaaaaataatactgtgttgtgtttatctaaatacgtaaactcaagctaccaaagagaaagatgttgtaatcatatctgcatgtcctaaattttgaatttagatattccaatttgcatcagtctttctgtggctcaaataatgatgattatggaatgaattttaatgtccctacttgtgaataattagctttctcaaatgtaggctttttacaaattttaaattttaaaatattagtttaaatgtgtgttatactgataaaatttcatctttcaaattatagtctattattttaaagggatttttcagtatgatatgggccattttgttcatctatcgcaaagtaaaaatgtaaaatccttacagagaattgtttcacaaaacttatatttcatgtcaattgtatttattttaataatagctcacaatgcctttagtaagtaataaagtctcttattagaatcttgtattttttaattgagctaatcaaaataattcagccaagtctatttgaaatagaaaactgtctatttaatatagtaaaatcaatgctcccttaatgttgttacaaagatatggtaactgtaatatgggtaaaagtttattcaagaaaagagtacttggtagaagattctttaacaaattgaggagattgattcataattcacatgtcaattttttatagtaatatgtacttctaatttattatttatacttaaattgtgacctgaaagatgagttggagataattagtcaaagggcacatggagtatggaagggggcatgttgattaaccatacatagaaataaatattctcttagttatccttgaaatcatatttatactattaatttgctcagtgcacttttttcaaatacagaaaaaagattctccattatagttacaaattttaggttggtgaatccaagtgaatgaaatatcagcataactatgtgggcaaaatagatagaattaaatgcatgaattttcctcagacttattttatctgcctctgtaatatttaactttagtacccaggcttgttcactacttctgctttacaggctttatttaaatctgaacaatcctacagggaaatcagaattaggaaaaaaatctggagaacaatatggttgaaatagaaacaagagaatgcacctaggttaattccctgaatcctacttgaacattgtataaatttctctttgcatataatacatatttgtgaatgagacatattcccaaaaaattcttatctctgtatgtgattggaaaagaaaagatcacatttgtatattcaacaatctttcacctatttcataagtcattttttcaccctgtatagtatgggaattattttttatgttaaatagaaactgaatgtactgggttgaatggtgtcctctccaaaattcatgtacttcctggagcctcagtatgtgaccttatttggaaatactgtggttgtggttgtaagtagctaagatgaggtcatactggagcagggcaggcccttaatccaatatgactggtgttccttataagagaagatagggcgggcatggtggctcacgcctgtaatcccagcactgtgggaggccaagccaggcaaatcgcttgaggctgaggagttcaagaccagcctggccaacatggcgaaaacccatctctactaaaaataaaattagccatgcgtggtgcttgtaatgtcagctacccaggagtctgaggcacaagaatcactcgaacctgggaggtggaggttgcgagatcacaccactgcactccagtgtgagcaacagaacgagactctgtctcaaaaaaaaaaaaaaaaaggaagaaagagaagatagagacacaggggagaatgccacatgaagctggaggcagagattggagtgatacattgtgggaaccctcagaagataggaaaaaagcatggaatagattctccctcagagttccagtagttgccaaccctgctaacatggttttgcacatctagcatccagaacagtgagaatgtatttctgctgttttaaggtacccagttcatggtaatttgttacagcaatcctaggaagctaatactctgacagaaaaaaatcttggataatatgcatgagaaaaatccttcaataaacacaaaattggtttcaaaatgttttcatgtaaaaataaattaacttttctgtaattagattgtgttttatagtaattcttgcctgcttcttagtctttgttgtaggatgcataataaaatacatgaatgagttttaaatggttagctttggagaatggttttgggaagttcctacagtacacagaaataaaagctaatgttactatgaatgcgcattacttttctaataaaatgtttctgaatctc

SEQ ID NO: 153472 - DNA, 4304 bp, Homo sapiens
  Payload ID: 10189
  Gene Symbol: METTL15
  Gene Name: methyltransferase like 15
  Uniprot ID: A6NJ78
  ENST ID: ENST00000406787
  CDS Start-End: 459-1298
ggcagcttggcgccaagaagctcagcctggctgcgcaggggaagctctttgcttgctcgtcaccgtggcaacgcgcgcggccgtttccggaggcggtggccaaagtgggcggggctaggccggagctgctggtgggaggcagccacttgagatcaccaggcctcctgtagaccggcgggtgcagggcccggtcccagagttaagggaaagtcgtttggaaaccccaggccaacaggaccctttggcagctgaggctggaaacagcggaaccaaaggcagacggtcctcagttgcttgggcggacgtggacccaatctgtccgtccttacaagtttcccccaggggcaggacctagacgcgcggcgcattcaggttctcctggaccgtagtggtagtcgctggcccgagttagaggccagctgagaagtcttcgtgcttcagatttgtttacctacaaaatgcttcggtatccatatttttgtagaatgtataaagaatgcctttcatgttggttggaatctggcatacctaatttaggtgtctggccaaacagaatacatactacagcagaaaaatatagagaatatgaagcccgggagcaaacagatcaaactcaagcccaggagttacacagatctcaagatagagattttgaaactatggctaaattacatattccagtaatggtggatgaagttgttcattgtttgtcaccacaaaaaggacagatttttctagatatgacatttggttcgggagggcacacaaaagccattctgcagaaggagtcagatattgttctctatgccttggacagagacccaacagcttatgcattagctgaacatctttcagagttgtatcctaaacaaatccgagctatgctgggccagttcagccaggcagaagccttattaatgaaagctggagtgcagccaggaacttttgatggagttcttatggatcttgggtgttcctccatgcaacttgatactcctgaaagaggtttttcccttcggaaagatggccctttggacatgagaatggatggtggcagatcaacaggcacttgcatctatcctaagaacatacggggaggagaagcatgccaagaaaatcgcttcagcaattgttcaggcacgcagcatctaccccatcaccagaacccagcagcttgccagcatcgttgcaggagcatttcctccctctgctatttatacacggaaagacttactacagcgatctacccatattgccaccaagactttccaggctcttcgcatatttgtgaacaatgagctcaatgaactctacacgggactgaagacagctcagaagtttctgagacctggtggtcgtcttgttgccctctccttccattcactagaggatcgcatcgtcaaaagatttttgcttggaataagcatgacagaaagatttaacctaagtgttagacaacaagtgatgaaaacatctcaattgggttcagatcacgaaaacacggaagaagtctctatgagaagagctcctttaatgtgggaattgatacacaagaaggtacttagtccacaagatcaggatgtacaagataaccccagagggcgctcagccaagcttagagcagctatcaaattataagttatcatcatcttattcttcaaatttttttctcacaatttctctaatctttactcatgttatgtccctgaatgtcttggtataggtttaagtgtgggacagtctgaaaattgatagcatttagcatttcttttttctcaaaaagaaactgtaggaaatacatgacagagaaagttacactcagggagcagcagcacctccagactggaaaaatatgttaatctttgcatcatattggactcttgaaggcaatccttcctctggccaggaaattttttaaaaaataatactgtgttgtgtttatctaaatacgtaaactcaagctaccaaagagaaagatgttgtaatcatatctgcatgtcctaaattttgaatttagatattccaatttgcatcagtctttctgtggctcaaataatgatgattatggaatgaattttaatgtccctacttgtgaataattagctttctcaaatgtaggctttttacaaattttaaattttaaaatattagtttaaatgtgtgttatactgataaaatttcatctttcaaattatagtctattattttaaagggatttttcagtatgatatgggccattttgttcatctatcgcaaagtaaaaatgtaaaatccttacagagaattgtttcacaaaacttatatttcatgtcaattgtatttattttaataatagctcacaatgcctttagtaagtaataaagtctcttattagaatcttgtattttttaattgagctaatcaaaataattcagccaagtctatttgaaatagaaaactgtctatttaatatagtaaaatcaatgctcccttaatgttgttacaaagatatggtaactgtaatatgggtaaaagtttattcaagaaaagagtacttggtagaagattctttaacaaattgaggagattgattcataattcacatgtcaattttttatagtaatatgtacttctaatttattatttatacttaaattgtgacctgaaagatgagttggagataattagtcaaagggcacatggagtatggaagggggcatgttgattaaccatacatagaaataaatattctcttagttatccttgaaatcatatttatactattaatttgctcagtgcacttttttcaaatacagaaaaaagattctccattatagttacaaattttaggttggtgaatccaagtgaatgaaatatcagcataactatgtgggcaaaatagatagaattaaatgcatgaattttcctcagacttattttatctgcctctgtaatatttaactttagtacccaggcttgttcactacttctgctttacaggctttatttaaatctgaacaatcctacagggaaatcagaattaggaaaaaaatctggagaacaatatggttgaaatagaaacaagagaatgcacctaggttaattccctgaatcctacttgaacattgtataaatttctctttgcatataatacatatttgtgaatgagacatattcccaaaaaattcttatctctgtatgtgattggaaaagaaaagatcacatttgtatattcaacaatctttcacctatttcataagtcattttttcaccctgtatagtatgggaattattttttatgttaaatagaaactgaatgtactgggttgaatggtgtcctctccaaaattcatgtacttcctggagcctcagtatgtgaccttatttggaaatactgtggttgtggttgtaagtagctaagatgaggtcatactggagcagggcaggcccttaatccaatatgactggtgttccttataagagaagatagggcgggcatggtggctcacgcctgtaatcccagcactgtgggaggccaagccaggcaaatcgcttgaggctgaggagttcaagaccagcctggccaacatggcgaaaacccatctctactaaaaataaaattagccatgcgtggtgcttgtaatgtcagctacccaggagtctgaggcacaagaatcactcgaacctgggaggtggaggttgcgagatcacaccactgcactccagtgtgagcaacagaacgagactctgtctcaaaaaaaaaaaaaaaaaggaagaaagagaagatagagacacaggggagaatgccacatgaagctggaggcagagattggagtgatacattgtgggaaccctcagaagataggaaaaaagcatggaatagattctccctcagagttccagtagttgccaaccctgctaacatggttttgcacatctagcatccagaacagtgagaatgtatttctgctgttttaaggtacccagttcatggtaatttgttacagcaatcctaggaagctaatactctgacagaaaaaaatcttggataatatgcatgagaaaaatccttcaataaacacaaaattggtttcaaaatgttttcatgtaaaaataaattaacttttctgtaattagattgtgttttatagtaattcttgcctgcttcttagtctttgttgtaggatgcataataaaatacatgaatgagttttaaatggttagctttggagaatggttttgggaagttcctacagtacacagaaataaaagctaatgttactatgaatgcgcattacttttctaataaaatgtttctgaatctc

SEQ ID NO: 153473 - DNA, 795 bp, Homo sapiens
  Payload ID: 10189
  Gene Symbol: METTL15
  Gene Name: methyltransferase like 15
  ENST ID: ENST00000403099
  CDS Start-End: 387-668
gcgcgcggccgtttccggaggcggtggccaaagtgggcggggctaggccggagctgctggtgggaggcagccacttgagatcaccaggcctcctgtagaccggcgggtgcagggcccggtcccagagttaagggaaagtcgtttggaaaccccaggccaacaggaccctttggcagctgaggctggaaacagcggaaccaaaggcagacggtcctcagttgcttgggcggacgtggacccaatctgtccgtccttacaagtttcccccaggggcaggacctagacgcgcggcgcattcaggttctcctggaccgtagtggtagtcgctggcccgagttagaggccagctgagaagtcttcgtgcttcagatttgtttacctacaaaatgcttcggtatccatatttttgtagaatgtataaagaatgcctttcatgttggttggaatctggcatacctaatttaggtgtctggccaaacagaatacatactacagcagaaaaatatagagaatatgaagcccgggagcaaacagatcaaactcaagcccaggagttacacagatctcaagatagagattttgaaactatggctaaattacatattccagtaatggtggatgaagttgttcattgtttgtcaccacaaaaaggacagcaaaagaagtaaactgtggatatttaatatattcataaagatggagaatttcccacttgagtgtattctattctgaattttggaaccaagctagctgattttacacgtttgattttatgattacatatggaaaaaaatc

SEQ ID NO: 153474 - DNA, 831 bp, Homo sapiens
  Payload ID: 10189
  Gene Symbol: METTL15
  Gene Name: methyltransferase like 15
  Uniprot ID: A6NJ78
  ENST ID: ENST00000437814
  CDS Start-End: 105-404
gacgcgcggcgcattcaggttctcctggaccgtagtggtagtcgctggcccgagttagaggccagctgagaagtcttcgtgcttcagatttgtttacctacaaaatgcttcggtatccatatttttgtagaatgtataaagaatgcctttcatgttggttggaatctggcatacctaatttaggtgtctggccaaacagaatacatactacagcagaaaaatatagagaatatgaagcccgggagcaaacagatcaaactcaagcccaggagttacacagatctcaagatagagattttgaaactatggctaaattacatattccagtaatggtggatgaagttgttcattgtttgtcaccacaaaaaggacagagtcttggtgtgaggagtgtgggaatatgaatcctacagcaaaagaagtaaactgtggatatttaatatattcataaagatggagaatttcccacttgagtgtattctattctgaattttggaaccaagctagctgattttacacgtttgattttatgattacatatggaaaaaaatcaaaaccgcaatgttacaggtctctcacacctttcactgtacttctgtaataaagggaattagaataatttattggttaaataaggtaactataaaccaatttttaacaaatttgattttgagttacgatgattgcgtattccaggtacaacttaaattgctgtaactgttttgttaagttcttttttggataaaaaatcttctaaaatcttatttttctgaaatgtaaacttaccttatagtatatgcatcttaattaaactgttcttgatcgacttaa

SEQ ID NO: 153475 - DNA, 1868 bp, Homo sapiens
  Payload ID: 10189
  Gene Symbol: METTL15
  Gene Name: methyltransferase like 15
  ENST ID: ENST00000451385
  CDS Start-End: 377-871
gtttccggaggcggtggccaaagtgggcggggctaggccggagctgctggtgggaggcagccacttgagatcaccaggcctcctgtagaccggcgggtgcagggcccggtcccagagttaagggaaagtcgtttggaaaccccaggccaacaggaccctttggcagctgaggctggaaacagcggaaccaaaggcagacggtcctcagttgcttgggcggacgtggacccaatctgtccgtccttacaagtttcccccaggggcaggacctagacgcgcggcgcattcaggttctcctggaccgtagtggtagtcgctggcccgagttagaggccagctgagaagtcttcgtgcttcagatttgtttacctacaaaatgcttcggtatccatatttttgtagaatgtataaagaatgcctttcatgttggttggaatctggcatacctaatttaggtgtctggccaaacagaatacatactacagcagaaaaatatagagaatatgaagcccgggagcaaacagatcaaactcaagcccaggagttacacagatctcaagatagagattttgaaactatggctaaattacatattccagtaatggtggatgaagttgttcattgtttgtcaccacaaaaaggacagattttgttcatgtgtattgtcttatttgcatatcccaatttcctggtgatgtggactaggatggtgtatttatttccatttacacacgaggaaactgaggctcagagaaatttttctagatatgacatttggttcgggagggcacacaaaagccattctgcagaaggagtcagatattgttctctatgccttggacagagacccaacagcttatgcattagctgaacatctttcagagttgtatcctaaacaaatccgagctatgctgggccagttcagccaggcagaagccttattaatgaaagctggagtgcagccaggaacttttgatggagttcttatggatcttgggtgttcctccatgcaacttgatactcctgaaagaggtttttcccttcggaaagatggccctttggacatgagaatggatggtggcaggtaccctgacatgcccactgctgctgatgttgtgaatgctttagatcaacaggcacttgcatctatcctaagaacatacggggaggagaagcatgccaagaaaatcgcttcagcaattgttcaggcacgcagcatctaccccatcaccagaacccagcagcttgccagcatcgttgcaggagcatttcctccctctgctatttatacacggaaagacttactacagcgatctacccatattgccaccaagactttccaggctcttcgcatatttgtgaacaatgagctcaatgaactctacacgggactgaagacagctcagaagtttctgagacctggtggtcgtcttgttgccctctccttccattcactagaggatcgcatcgtcaaaagatttttgcttggaataagcatgacagaaagatttaacctaagtgttagacaacaagtgatgaaaacatctcaattgggttcagatcacgaaaacacggaagaagtctctatgagaagagctcctttaatgtgggaattgatacacaagaaggctttatttaaatctgaacaatcctacagggaaatcagaattaggaaaaaaatctggagaacaatatggttgaaatagaaacaagagaatgcacctaggttaattccctgaatcctacttgaacattgtataaatttctctttgcatataatacatatttgtgaatgagacatattcccaaaaaattcttatctctgtatgtgattggaaaagaaaagatcacatttgtatattcaacaa

SEQ ID NO: 153476 - DNA, 718 bp, Homo sapiens
  Payload ID: 10189
  Gene Symbol: METTL15
  Gene Name: methyltransferase like 15
  ENST ID: ENST00000634762
  CDS Start-End: 105-428
gacgcgcggcgcattcaggttctcctggaccgtagtggtagtcgctggcccgagttagaggccagctgagaagtcttcgtgcttcagatttgtttacctacaaaatgcttcggtatccatatttttgtagaatgtataaagaatgcctttcatgttggttggaatctggcatacctaatttaggtgtctggccaaacagaatacatactacagcagaaaaatatagagaatatgaagcccgggagcaaacagatcaaactcaagcccaggagttacacagatctcaagatagagattttgaaactatggctaaattacatattccagtaatggtggatgaagttgttcattgtttgtcaccacaaaaaggacagcaactgctgttgcgaaaaagtggacgaagacctctcttaactgcttcctgctgacaggaggcgctgttttggaaaagcggcagttaggactcctcctgagactctccaggatgttagaactggctttggcctgtggaacacctcgtcttgtgcattctatttcctgaataaagggtcttctttgttttccctgcaacgagtggtcttttgctcctcatttctgtggtcctttacccattctcccaacccaatggcatttcaaaactatttaaaatttaaaaaaattattaatataattgcttacattattactctgtgatttaataaactgagttagataaact

SEQ ID NO: 153477 - DNA, 1178 bp, Homo sapiens
  Payload ID: 10189
  Gene Symbol: METTL15
  Gene Name: methyltransferase like 15
  ENST ID: ENST00000634627
  CDS Start-End: 108-932
ctagacgcgcggcgcattcaggttctcctggaccgtagtggtagtcgctggcccgagttagaggccagctgagaagtcttcgtgcttcagatttgtttacctacaaaatgcttcggtatccatatttttgtagaatgtataaagaatgcctttcatgttggttggaatctggcatacctaatttaggtgtctggccaaacagaatacatactacagcagaaaaatatagagaatatgaagcccgggagcaaacagatcaaactcaagcccaggagttacacagatctcaagatagagattttgaaactatggctaaattacatattccagtaatggtggatgaagttgttcattgtttgtcaccacaaaaaggacagatttttctagatatgacatttggttcgggagggcacacaaaagccattctgcagaaggagtcagatattgttctctatgccttggacagagacccaacagcttatgcattagctgaacatctttcagagttgtatcctaaacaaatccgagctatgctgggccagttcagccaggcagaagccttattaatgaaagctggagtgcagccaggaacttttgatggagttcttatggatcttgggtgttcctccatgcaacttgatactcctgaaagaggtttttcccttcggaaagatggccctttggacatgagaatggatggtggcaggtaccctgacatgcccactgctgctgatgttgtgaatgctttagatcaacaggcacttgcatctatcctaagaacatacggggaggagaagcatgccaagaaaatcgcttcagcaattgttcaggcacgcagcatctaccccatcaccagaacccagcagcttgccagcatcgttgcaggttgcactggagaatctaaactcttttggagatgtcccaaggcctaacctgcacctcttcacagcataggcattttcccccaataaactacttattctcccaacttcatctcagtgtcagcttcctagaagacccaaacaacgtggatggccttcaaagaaaaatggagggaaaaatggaaagcttttccactaagatcagatacaagacagggatgcctgctttcaccacttccattcaacatagtactggaaatactggcaagaaaaattacacaagaaaaagaaataaaa

SEQ ID NO: 153478 - DNA, 1182 bp, Homo sapiens
  Payload ID: 10189
  Gene Symbol: METTL15
  Gene Name: methyltransferase like 15
  ENST ID: ENST00000634721
  CDS Start-End: 105-554
gacgcgcggcgcattcaggttctcctggaccgtagtggtagtcgctggcccgagttagaggccagctgagaagtcttcgtgcttcagatttgtttacctacaaaatgcttcggtatccatatttttgtagaatgtataaagaatgcctttcatgttggttggaatctggcatacctaatttaggtgtctggccaaacagaatacatactacagcagaaaaatatagagaatatgaagcccgggagcaaacagatcaaactcaagcccaggagttacacagatctcaagatagagattttgaaactatggctaaattacatattccagtaatggtggatgaagttgttcattgtttgtcaccacaaaaaggacagaattctgtcaggcttcatggtctttttcccatgtgctcatctttctgcacctgttaccagaacttcattctacagcagccctgcttttgctgtcatttgaaatcggttccaaatttttcctcttgtaactctctccccatgctgttactcggttatctaattttgcatagatctttctaataagatgcttcttcttactgatctctctctctctctctctctctgtgtgtgtgtgtgtgtttgtctggagaatacacaatcaaatgtatttcctcaccttcaatgacttaggtaaaataatgttatctatttaattttcccccagaatcaattgccccaaaatggcttataccctgagaacttaatatacttttttttaaatatctttaactaaaatttagtgagctatttttattgttgttaattttttaagtcctttttttctgtagcctggaagctttttctttgatcattaaagtaggaacctcaatttgaaaacttgccacaactgaacatatgtcccctcttgtattagaaagagttataattttaatacatttttcaaattatgatttatgtctctttaggagagattctgtttgttttttaaagagccaagccaaaattttttcttactttataattaatgggattacatttatgttttaacttaaatctgaattttagaggtaattgtaattcagaagaaaatgcaaacatcaaaatatcacatgtatagctctttaaatatgaacattaattatctttggagattgattattgccaaaataaaatcactatatctctt

SEQ ID NO: 153479 - DNA, 1419 bp, Homo sapiens
  Payload ID: 10189
  Gene Symbol: METTL15
  Gene Name: methyltransferase like 15
  ENST ID: ENST00000532947
  CDS Start-End: 254-526
gaaagtcgtttggaaaccccaggccaacaggaccctttggcagctgaggctggaaacagcggaaccaaaggcagacggtcctcagttgcttgggcggacgtggacccaatctgtccgtccttacaagtttcccccaggggcaggacctagacgcgcggcgcattcaggttctcctggaccgtagtggtagtcgctggcccgagttagaggccagctgagaagtcttcgtgcttcagatttgtttacctacaaaatgcttcggtatccatatttttgtagaatgtataaagaatgcctttcatgttggttggaatctggcatacctaatttaggtgtctggccaaacagaatacatactacagcagaaaaatatagagaatatgaagcccgggagcaaacagatcaaactcaagcccaggagttacacagatctcaagatagagattttgaaactatggctaaattacatattccagtaatggtggatgaagttgttcattgtttgtcaccacaaaaaggacagtaaacaaatccgagctatgctgggccagttcagccaggcagaagccttattaatgaaagctggagtgcagccaggaacttttgatggagttcttatggatcttgggtgttcctccatgcaacttgatactcctgaaagaggtttttcccttcggaaagatggccctttggacatgagaatggatggtggcaggttgcactggagaatctaaactcttttggagatgtcccaaggcctaacctgcacctcttcacagcataggcattttcccccaataaactacttattctcccaacttcatctcagtgtcagcttcctagaagacccaaacaacgtggatggccttcaaagaaaaatggaggctgcacatgttcttcggaaaaagatctaaaagcatcaccttttgctttgtctgctggtgcttaagtttgaatatgtcatcccactgcctttggccttcatagcttctggcccaggaaagggaagaattacatgaagacacatggagaggggagccaaggggagaggttcagaagaaacaaagcctgctgatatcttgatcttggggtctaacctccagaacggtgatgaaatgtctgttatttaagccattcggtctgtggtattggtgacaacagtctaagcagactaatgcaagccctgacacagactttatgcaatttaattctcttttctcagtcatgattttctcctctgtaataagctctaattatcagtgatgaaaattaaatgtgtaaatgtgtacattattgtttaaagacaagtaaagaaaaccaacacccttgtttttgtttaacggatctacctatttttaggaaatgtttaagcagatgtggattttttttttaacacaataaaatactatccttttctca

SEQ ID NO: 153480 - DNA, 1353 bp, Homo sapiens
  Payload ID: 10189
  Gene Symbol: METTL15
  Gene Name: methyltransferase like 15
  ENST ID: ENST00000634973
  CDS Start-End: 108-932
ctagacgcgcggcgcattcaggttctcctggaccgtagtggtagtcgctggcccgagttagaggccagctgagaagtcttcgtgcttcagatttgtttacctacaaaatgcttcggtatccatatttttgtagaatgtataaagaatgcctttcatgttggttggaatctggcatacctaatttaggtgtctggccaaacagaatacatactacagcagaaaaatatagagaatatgaagcccgggagcaaacagatcaaactcaagcccaggagttacacagatctcaagatagagattttgaaactatggctaaattacatattccagtaatggtggatgaagttgttcattgtttgtcaccacaaaaaggacagatttttctagatatgacatttggttcgggagggcacacaaaagccattctgcagaaggagtcagatattgttctctatgccttggacagagacccaacagcttatgcattagctgaacatctttcagagttgtatcctaaacaaatccgagctatgctgggccagttcagccaggcagaagccttattaatgaaagctggagtgcagccaggaacttttgatggagttcttatggatcttgggtgttcctccatgcaacttgatactcctgaaagaggtttttcccttcggaaagatggccctttggacatgagaatggatggtggcaggtaccctgacatgcccactgctgctgatgttgtgaatgctttagatcaacaggcacttgcatctatcctaagaacatacggggaggagaagcatgccaagaaaatcgcttcagcaattgttcaggcacgcagcatctaccccatcaccagaacccagcagcttgccagcatcgttgcaggttgcactggagaatctaaactcttttggagatgtcccaaggcctaacctgcacctcttcacagcataggcattttcccccaataaactacttattctcccaacttcatctcagtgtcagcttcctagaagacccaaacaacgtggatggccttcaaagaaaaatggagggtttttatggaggacacaaacaaatggaaaaacattccatgctcatgtatagaaagaatcaatattgtgaaaatggacatactgcccaagtaatttatagattcagtgctattcccctcaagctaccattgactttcttcacagaattagaaaaagctactttaaatttcatatggaaccaaaaaagggcccatatagccaagaccatactaagcaaaaagaacaaagctgaaggcatcacactacctgacttcaaactatcctacaaggctacagtaaccaaaacagcataatactg

SEQ ID NO: 153481 - DNA, 5711 bp, Homo sapiens
  Payload ID: 10190
  Gene Symbol: METTL16
  Gene Name: methyltransferase like 16
  Uniprot ID: Q86W50
  ENST ID: ENST00000263092
  CDS Start-End: 129-1817
aagatggcggcgcgctgggagcgtatcatctgcgtttctaggagcttcgctatgcggctgctttaagattctagggttgtacaggcccacgccagacacgacgtctggcaggaacctcggcctcagagatggctctgagtaaatcaatgcatgcaagaaatagatacaaggacaaacctcctgactttgcatatctggcatccaaatatccagattttaagcagcatgttcagataaatctgaatggaagagtgagccttaattttaaagaccccgaagcagtcagagctctgacgtgtactctcctaagggaagattttggactttctattgatattccattggagagactaattcccacagttcccttgagactcaactatattcactgggtagaagatctgatcggtcaccaggattctgacaaaagtactctccgaagaggaattgacataggcacgggggcatcttgcatctaccccttacttggagcaaccttgaatggctggtatttcctcgcaacagaagtggatgatatgtgtttcaactatgcaaagaaaaatgtggaacagaataacttatctgatctcataaaagtggtgaaagtgccacagaagacactcctgatggatgctcttaaagaagaatctgagataatctatgacttttgcatgtgcaaccctcccttttttgccaatcaattggaagccaagggagtaaactcacgaaatcctcgaagacctccgcctagttctgttaatacaggaggcatcacagagatcatggcagaaggaggtgaattagagtttgttaaaaggatcatccatgacagtctacaacttaaaaaaagattaagatggtatagctgcatgctgggaaagaaatgcagcctggcgcctctgaaggaggagcttcgcatacaaggggttcccaaagtaacgtacactgaattctgtcaaggtcggacaatgagatgggccttagcttggagtttttatgatgatgtcacagtaccatcaccaccaagtaagcgaagaaaattagagaaaccgagaaaacccataacattcgtggtgctggcgtccgtgatgaaggaattatccctcaaagcatcacctctgcgctcggagacggcggaaggcatagtcgttgtcacgacatggattgaaaaaattctcactgatttgaaggtccagcataaacgagttccctgtggaaaagaggaagtcagccttttcctaacggccatagaaaactcctggattcatttaaggagaaagaaaagagagcgtgtgagacagctgagagaagttccccgagctcctgaggacgtcattcaggccttggaagagaaaaagcccacccccaaagagtctggcaatagccaagaactggccaggggcccccaggagaggaccccctgtgggcctgctctgcgggaaggcgaggctgccgctgtggagggcccgtgcccgagccaggagtccctgtcccaggaggaaaacccggaacccacggaggatgaaaggagtgaggaaaagggaggggtggaggttttggaaagttgtcaaggctctagcaacggagcccaggaccaagaggcttctgagcagttcggcagcccagtggctgaaagggggaaacgtctcccaggagtggccggacagtacctgtttaagtgtttgataaacgttaagaaggaggtggacgatgccttagtggagatgcactgggttgagggccagaacagggatctgatgaaccagctttgcacctacatacgtaaccaaattttcaggcttgttgcagttaactagaaacctcctgcacagttggaaacgtgttgatagtaacttgctttggagtggcctgtggggtggcaagaggaatcctaccagcggcccattagtagcacgatgtggaattatcttcgaaaacaaaaacctatgaatctgtcccccacctccccccgcctccttcccgctttttgagttacagggagtcgtagtgtggtcatttacaaggaggaattgtggtcatcagtaacaacagaaagccctcagtaaactcccgagggattgcaagctggctcaagctggcccctcagctctggactgcctctgcaaggtcagaagggttgtttgtggagtctgggctgggcagcactgcctagaatatcatgctgtctctgtcacccaagggtgtttcttgaggaggggtggctctctctgcctccagctggaggccctggtaccctgttctaggtcactcttcaagatggggcctaccttgcatcaatcccacaaagggagctgtatggtgggtggtggggaatctgggagagaaaccttagtaatgctgggaaggagcagcagagtctggggaccacccggtaaatggcacattcctgacacctggctgttttgatgttgcttatttcagaagcagaattaggtaagcaaaactccccggtgtgactgaggcacacagaaggcacccatacccccacctccagcctgttgacagtaccattttgtagcagttttactactgtgtgatttttgtttggacatctgaagtagagcttgttttgtttttaaataagaatattcacaaattaaaaaccagcggtcctatttgaatcctggggttagctgagtgagcggctgatgatagaaatgagaaatagaacaaaatagtatgtgccgtaggtagcttaagaaagtctcagatattttgttgctgatcaaatactgtttttttgtggcttcacttgtaatcccccctgtacttacctactcacattggagagttctgaggccggagtaactgtgtccttgaaacacgtttctaattggaatgccagggttcagtagccgtccccccggaaaggggtgaccttttgctgtgcttgatgttgcatcagcagcctagggttctgtttagactaaaatcttggccagagctccttgccatctgctaagaagactggggctgagtagttaagccagccttctgagaggtggctgttggtcaggacgggaagctggtgaccttggcatgtcttggcagcagctagatcaggccctcggcagagacacaggaagcggaactgctgtgccttaacttggctgtggagctggagctggagaaggcagcatactgaccagtggctttttgattgattgtttgttatgaggtggagttttactcttgttgtctaggctggagtgccgtggtgcgatcttagctcactgcaacccccgcctcccgggttcaagcgattctcctgcctcagcctcccaagtagctgggattacaggcacgcgccaccacgcctggctaattttgtgtttttggtagagatgggatttcaccatgttggccaggctaatctcgaactcatgatctcgggtgatccgcccaccttggcctcccaaagtgctgggattacagccgtgagccactactcccagcctctgaccagtgttcttaacctggtccgtggacctccagagagtccatgtacctcctagagttacttctaaaagctctgtgagcatgtgtgtgtgtgtgtgtgtgtgtgtgtattttttttcctggagagagggttcccagaaccctcagacacagacaaaggggtcaataacccactaaggattaagaatcattattctagtccaagcattcatgtgtcaggctgcaaaaaacaatacccagggtcacacagagccaagactcaattcaggaccgtggattcccctggtctagaaattttctgctgtgccagcccacaccaccccactgtccttacctcgagtgaatattacatttgagtcatttgctgggcccaaacctagtttccttggtataattttaggataattgtttaagtggcaactattcattcagtaagtagtaagtacttattgtttgcttgtttcattatgaaagagtggcacatgctcattaaagatttggaaaaatgaaagtcaaaacaacaaaatcaccccgagtcccaaccttctgtaacataaccactcttggcattggcgtgttcctttctagtctctctgtagacggggtgtgtgagtgtgtgggtttaactttggttgtcctcatgctgcgtattcagttttgtattctggtcctttgttcatttaacatcttacaagtatttgtccatgttgtaacagtagtgtattagcttacactccttgcctgttcaaaatgtctttcaggcacagcactggcctttaagcctgtgtcgtagggatttccagagaatgctctgtgtattgaagcacagaaggtgtttctgtgtctcagtgtgtttctgtccctaggtttaaggcttcatgtcatggaggagattttatagatgtcaagctaatgaccttagagttttaaaaaatccgtgaccgtggccaggcgcagtggctcacgcctgtaatcccagcactgtgaggctgagatgggcgcatcgcatgaggtcgggagtttgagaccagcctggccaacatggcgaaaccccgtctctactcaaaatacaaaaattagccgggcatgatagcacgtgcctgtaatcccagctactcgggaggctgaggcaggagactcgcttgaacctgggaggtggaggttgcagtgagccgagaatgccactgcactacagcctgggcgacaaagtgggactgtctcaaaaaaaaaaaaaaaaaaaaaaaaaaaggaacccatgagcaggccagctttcagtctggagccgagtgccttctgtgcatttggatgtttccatttccttccctgagaagattttcttaggctacctagtgagagaacattgaaaatatttttaaaggacatctaagcattgttttggtcatgcatatgctttataattgtgtgttgtttcatagcatatacctctggtacaggtgggcaagtttttctttgaagaaatgggttattgactcatatgtcataaccttgagtgttactctcccggtgtccagaggtcacattcatgttgcggggttggtatgaaattaaatcttggtgatgtgaccctacattctcttctggtccctagaatcggcttctggtctcctgataactgaagtggagacagaagttgagcctgttgcccaggcaaactaaagctgcttttgttcttcggaatctgctttgcctccgtcagcctgcttccttccccacacatgctggccgcactgtccccactccagacctctgctgtgtgtcctgggcagggccgcgttttggcagtaccctttcaactcatcctaagcttcgtgtagattactttagtatatattttttataaaacataaagcctttcctctcgatggaaatcaaagcttaccatgtgagcactcgaacttctaagttgtgacaggaataacaaaactgcaaggagtggaaaagatggaaaagcctgtgggaaatccgaggccttttgaaagaagggagctgatgacttcacgaccagctcctggagcccctcctttctgctgaagccgcggcatttccctccgtggccacacgagggcacccttggcccttttatcaaagcgccttcacttccccgtgggaatggagacaagtctgtccacggtgttttcttgaaatacccagttgctacccagatttgtatttttatgtaaacaaatacattttcacagaaataaaatttg

SEQ ID NO: 153482 - DNA, 1602 bp, Homo sapiens
  Payload ID: 10190
  Gene Symbol: METTL16
  Gene Name: methyltransferase like 16
  ENST ID: ENST00000574752
  CDS Start-End: 78-584
atgcggctgctttaagattctagggttgtacaggcccacgccagacacgacgtctggcaggaacctcggcctcagagatggctctgagtaaatcaatgcatgcaagaaatagatacaaggacaaacctcctgactttgcatatctggcatccaaatatccagattttaagcagcatgttcagataaatctgaatggaagagtgagccttaattttaaagaccccgaagcagtcagagctctgacgtgtactctcctaagggaagattttggactttctattgatattccattggagagactaattcccacagttcccttgagactcaactatattcactgggtagaagatctgatcggtcaccaggattctgacaaaagtactctccgaagaggaattgacataggcacgggggcatcttgcatctaccccttacttggagcaaccttgaatggctggtatttcctcgcaacagaagtggatgatatgtgtttcaactatgcaaagaaaaatgtggaacagaataacttatctgatctcataaaagggagtaaactcacgaaatcctcgaagacctccgcctagttctgttaatacaggaggcatcacagagatcatggcagaaggaggtgaattagagtttgttaaaaggatcatccatgacagtctacaacttaaaaaaagattaagatggtatagctgcatgctgggaaagaaatgcagcctggcgcctctgaaggaggagcttcgcatacaaggggttcccaaagtaacgtacactgaattctgtcaaggtcggacaatgagatgggccttagcttggagtttttatgatgatgtcacagtaccatgctgctataggtaaaggaaaaccacctctgagctggccagactgaatgattttccgggcagtgacagaacagcatctgttgcttctcacagttccctcccaggtgtggttggcttcttgttgcctggagattcccagctgaagtgtctgcacacactgcccagcagtcaccaccaagtaagcgaagaaaattagagaaaccgagaaaacccataacattcgtggtgctggcgtccgtgatgaaggaattatccctcaaagcatcacctctgcgctcggagacggcggaaggcatagtcgttgtcacgacatggattgaaaaaattctcactgatttgaaggtccagcataaacgagttccctgtggaaaagaggaagtcagccttttcctaacggccatagaaaactcctggattcatttaaggagaaagaaaagagagcgtgtgagacagctgagagaagttccccgagctcctgaggacgtcattcaggccttggaagagaaaaagcccacccccaaagagtctggcaatagccaagaactggccaggggcccccaggagaggaccccctgtgggcctgctctgcgggaaggcgaggctgccgctgtggagggcccgtgcccgagccaggagtccctgtcccaggaggaaaacccggaacccacggaggatgaaaggagtgaggaaaagggaggggtggaggttttggaaagttgtcaaggctctagcaacggagcccaggaccaagagg

SEQ ID NO: 153483 - DNA, 1944 bp, Homo sapiens
  Payload ID: 10190
  Gene Symbol: METTL16
  Gene Name: methyltransferase like 16
  ENST ID: ENST00000576556
  CDS Start-End: 131-496
acaagatggcggcgcgctgggagcgtatcatctgcgtttctaggagcttcgctatgcggctgctttaagattctagggttgtacaggcccacgccagacacgacgtctggcaggaacctcggcctcagagatggctctgagtaaatcaatgcatgcaagaaatagatacaaggacaaacctcctgactttgcatatctggcatccaaatatccagattttaagcagcatgttcagataaatctgaatggaagagtgagccttaattttaaagaccccgaagcagtcagagctctgacgtgtactctcctaagggaagattttggactttctattgatattccattggagagactaattcccacagttcccttgagactcaactatattcactgggtagaagatctgatcggtcaccaggattctgacaaaagtactctccgaagaggaattgacatagggagtaaactcacgaaatcctcgaagacctccgcctagttctgttaatacaggaggcatcacagagatcatggcagaaggaggtgaattagagtttgttaaaaggatcatccatgacagtctacaacttaaaaaaagattaagatggtatagctgcatgctgggaaagaaatgcagcctggcgcctctgaaggaggagcttcgcatacaaggggttcccaaagtaacgtacactgaattctgtcaaggtcggacaatgagatgggccttagcttggagtttttatgatgatgtcacagtaccatcaccaccaagtaagcgaagaaaattagagaaaccgagaaaacccataacattcgtggtgctggcgtccgtgatgaaggaattatccctcaaagcatcacctctgcgctcggagacggcggaaggcatagtcgttgtcacgacatggattgaaaaaattctcactgatttgaaggtccagcataaacgagttccctgtggaaaagaggaagtcagccttttcctaacggccatagaaaactcctggattcatttaaggagaaagaaaagagagcgtgtgagacagctgagagaagttccccgagctcctgaggacgtcattcaggccttggaagagaaaaagcccacccccaaagagtctggcaatagccaagaactggccaggggcccccaggagaggaccccctgtgggcctgctctgcgggaaggcgaggctgccgctgtggagggcccgtgcccgagccaggagtccctgtcccaggaggaaaacccggaacccacggaggatgaaaggagtgaggaaaagggaggggtggaggttttggaaagttgtcaaggctctagcaacggagcccaggaccaagaggcttctgagcagttcggcagcccagtggctgaaagggggaaacgtctcccaggagtggccggacagtacctgtttaagtgtttgataaacgttaagaaggaggtggacgatgccttagtggagatgcactgggttgagggccagaacagggatctgatgaaccagctttgcacctacatacgtaaccaaattttcaggcttgttgcagttaactagaaacctcctgcacagttggaaacgtgttgatagtaacttgctttggagtggcctgtggggtggcaagaggaatcctaccagcggcccattagtagcacgatgtggaattatcttcgaaaacaaaaacctatgaatctgtcccccacctccccccgcctccttcccgctttttgagttacagggagtcgtagtgtggtcatttacaaggaggaattgtggtcatcagtaacaacagaaagccctcagtaaactcccgagggattgcaagctggctcaagctggcccctcagctctggactgcctctgcaaggtcagaagggttgtttgtggagtctgggctgggcagcactgcctagaatatcatgctgtctctgtcacccaa

SEQ ID NO: 153484 - DNA, 575 bp, Homo sapiens
  Payload ID: 10190
  Gene Symbol: METTL16
  Gene Name: methyltransferase like 16
  ENST ID: ENST00000576976
  CDS Start-End: 132-575
cacaagatggcggcgcgctgggagcgtatcatctgcgtttctaggagcttcgctatgcggctgctttaagattctagggttgtacaggcccacgccagacacgacgtctggcaggaacctcggcctcagagatggctctgagtaaatcaatgcatgcaagaaatagatacaaggacaaacctcctgactttgcatatctggcatccaaatatccagattttaagcagcatgttcagataaatctgaatggaagagtgagccttaattttaaagaccccgaagcagtcagagctctgacgtgtactctcctaagggaagattttggactttctattgatattccattggagagactaattcccacagttcccttgagactcaactatattcactgggtagaagatctgatcggtcaccaggattctgacaaaagtactctccgaagaggaattgacatagtggtgaaagtgccacagaagacactcctgatggatgctcttaaagaagaatctgagataatctatgacttttgcatgtgcaaccctcccttttttgccaatcaattggaagccaag

SEQ ID NO: 153485 - DNA, 624 bp, Homo sapiens
  Payload ID: 10190
  Gene Symbol: METTL16
  Gene Name: methyltransferase like 16
  ENST ID: ENST00000571298
  CDS Start-End: 1-304
ccttaattttaaagaccccgaagcagtcagagctctgacgtgtactctcctaagggaagattttggactttctattgatattccattggagagactaattcccacagttcccttgagactcaactatattcactgggtagaagatctgatcggtcaccaggattctgacaaaagtactctccgaagaggaattgacataggtatccaaggacgtgcttgtccagtagcactggggccaggataccctcgggcaaaaatggcacgggggcatcttgcatctaccccttacttggagcaaccttgaatggctggtatttcctcgcaacagaagtggatgatatgtgtttcaactatgcaaagaaaaatgtggaacagaataacttatctgatctcataaaagggagtaaactcacgaaatcctcgaagacctccgcctagttctgttaatacaggaggcatcacagagatcatggcagaaggaggtgaattagagtttgttaaaaggatcatccatgacagtctacaacttaaaaaaagattaaggctggagtgcaatggtgtgatctcagctcactgcaacccccgcttcctggattcaagcgattatcctgcctccgcctcgag

SEQ ID NO: 153486 - DNA, 1749 bp, Homo sapiens
  Payload ID: 10191
  Gene Symbol: METTL17
  Gene Name: methyltransferase like 17
  Uniprot ID: Q9H7H0
  ENST ID: ENST00000339374
  CDS Start-End: 234-1604
ctcttgatttctggggccggtgaccaggcccaacgcagccttcaagtcggcccaaacacggtttctgcctcaaggattatttatataaccattgcttattggctgctggcaaacactcgctcttctcgttggctgaaactgtcgggagaagttctgcgaaggctgctccttgcggcgttgggactgagggtcacaggcacctgtatttccgtttccggttcgcctccggagccatggcggcggcactgaagtgtctactgacattaggaagatggtgccccggccttggagtggctccccaggcccgggcgctcgccgccttagtacccggagtgacccaggtagataacaagtccggtttcctgcagaagaggcctcatcgccagcaccctggcatcctaaagctgccgcacgtgcggctgccacaggcactggctaacggtgcccagttattgctacttgggagcgctgggcccactatggagaatcaggtgcaaacactgaccagttatctctggagcagacatttgcctgtagagccagaggagttgcaaagacgggctaggcatcttgagaaaaaattcctggaaaacccagacttatctcagacagaggagaaacttcgtggagcagtgctacacgcactacgtaaaactacctaccattggcaagaactgagctacactgagggactgagcctggtgtatatggcagcaagactggatggtggctttgcagcagtctccagagcattccatgagatccgggctcgaaatccagcatttcagccacaaactttgatggactttggctcaggtactggttctgtcacctgggctgctcacagtatttggggccagagcctacgtgaatatatgtgtgtggacagatcagctgccatgttggttttggcagaaaaactactgaaaggtggttcagaatctggggagccttatattccaggtgtctttttcagacagtttctacctgtatcacccaaggtgcagtttgatgtagtagtgtcagctttttccttaagtgaactgcccagcaaggctgaccgcactgaggtagttcaaaccttatggcgtaagacaggtcatttcctggtactggtggagaatggaacaaaagctgggcacagccttctcatggatgccagggatctggtccttaagggaaaagagaagtcacctttggaccctcgacctggttttgtctttgccccgtgtccccatgaactcccttgtccccagttgaccaacctggcctgtagcttctcacaggcgtaccatcccatccccttcagctggaacaagaaaccaaaggaagaaaagttctctatggtgatccttgctcgggggtctccagaggaggctcatcgctggccccgtatcactcagcctgtccttaaacggcctcgccatgtgcattgtcacttgtgctgtccagatgggcacatgcagcatgctgtgctcacagcccgccggcacggcagggatttgtatcgttgtgcccgtgtcagctcctggggagatcttttacctgtgcttactccgtctgcgtttcctccatctacggctcaggatccctctgagagttgatgaggatgtgtaacaagtattttcttctatcgtgcctgccagggctgaagctgcctggtatccaggaggggaatgctggtatccccatatgtctgtgtttgtttgagatttttaataataaataataaatttttgaagaatggaa

SEQ ID NO: 153487 - DNA, 1586 bp, Homo sapiens
  Payload ID: 10191
  Gene Symbol: METTL17
  Gene Name: methyltransferase like 17
  Uniprot ID: Q9H7H0
  ENST ID: ENST00000382985
  CDS Start-End: 24-1460
gtttccggttcgcctccggagccatggcggcggcactgaagtgtctactgacattaggaagatggtgccccggccttggagtggctccccaggcccgggcgctcgccgccttagtacccggagtgacccaggtagataacaagtccggtttcctgcagaagaggcctcatcgccagcaccctggcatcctaaagctgccgcacgtgcggctgccacaggcactggctaacggtgcccagttattgctacttgggagcgctgggcccactatggagaatcaggtgcaaacactgaccagttatctctggagcagacatttgcctgtagagccagaggagttgcaaagacgggctaggcatcttgagaaaaaattcctggaaaacccagacttatctcagacagaggagaaacttcgtggagcagtgctacacgcactacgtaaaactacctaccattggcaagaactgagctacactgagggactgagcctggtgtatatggcagcaagactggatggtggctttgcagcagtctccagagcattccatgagatccgggctcgaaatccagcatttcagccacaaactttgatggactttggctcaggtactggttctgtcacctgggctgctcacagtatttggggccagagcctacgtgaatatatgtgtgtggacagatcagctgccatgttggttttggcagaaaaactactgaaaggtggttcagaatctggggagccttatattccaggtgtctttttcagacagtttctacctgtatcacccaaggtgcagtttgatgtagtagtgtcagctttttccttaagtgaactgcccagcaaggctgaccgcactgaggtagttcaaaccttatggcgtaagacaggtcatttcctggtactggtggagaatggaacaaaagctgggcacagccttctcatggatgccagggatctggtccttaagggaaaagagaagtcacctttggaccctcgacctggttttgtctttgccccgtgtccccatgaactcccttgtccccagttgaccaacctggcctgtagcttctcacaggcgtaccatcccatccccttcagctggaacaagaaaccaaaggaagaaaagttctctatggtgatccttgctcgggggtctccagaggaggctcatcgctggccccgtatcactcagcctgtccttaaacggcctcgccatgtgcattgtcacttgtgctgtccagatgggcacatgcagcatgctgtgctcacagcccgccggcacggcaggtatggggggtgtgaccaaaatcagtgggatgtggcaggaagctgcagcccacgccagcatctgtttccacagggatttgtatcgttgtgcccgtgtcagctcctggggagatcttttacctgtgcttactccgtctgcgtttcctccatctacggctcaggatccctctgagagttgatgaggatgtgtaacaagtattttcttctatcgtgcctgccagggctgaagctgcctggtatccaggaggggaatgctggtatccccatatgtctgtgtttgtttgagatttttaataat

SEQ ID NO: 153488 - DNA, 2887 bp, Homo sapiens
  Payload ID: 10191
  Gene Symbol: METTL17
  Gene Name: methyltransferase like 17
  ENST ID: ENST00000555640
  CDS Start-End: 10-486
tccggagccatggcggcggcactgaagtgtctactgacattaggaagatggtgccccggccttggagtggctccccaggcccgggcgctcgccgccttagtacccggagtgacccaggtagataacaagtccggtttcctgcagaagaggcctcatcgccagcaccctggcatcctaaagctgccgcacgtgcggctgccacaggcactggctaacggtgcccagttattgctacttgggagcgctgggcccactatggagaatcaggtgcaaacactgaccagttatctctggagcagacatttgcctgtagagccagaggagttgcaaagacgggctaggcatcttgagaaaaaattcctggaaaacccaggtcctgacttccagtccttgttctcaccacagacttatctcagacagaggagaaacttcgtggagcagtgctacacgcactacgtaaaactacctaccattggcaagaactgagctacactgagggactgagcctggtgtatatggcagcaagactggatggtggctttgcagcagtctccagagcattccatgagatccgggctcgaaatccagcatttcagccacaaactttgatggactttggctcaggtactggttctgtcacctggtgagtaactttcttcagccctatcttggtcaattttagctctagaaagccatacttacaccactccaaaattaacagactggaaaaccagagggagaataggcaagttgggaatctataatgtttcttccatcagattaggcaaggcagaagaaggtatatggattggggccagaacttaaaagaaatgtcaagtaaaaaaaggcgcatgtgtagaaaaattaaaaagaaaaggaattatcaatcaaagttgtttttgcctacaaatagtattttgagtctaccttttttttttcttttttgaaacggtgtctcactctgtcgcccaggctggagtgcagtggcacaatctcggctcactgcagcctccactcctgggttcaagtgattctcctgcctcaccctcccgagtagctgggactacaggtgcacgccaccacacccagctaatttttgtatttttagtagagacggggtttcaccatattggccaggctggtctctaactcctgaccttgtgatccgcccaccttggcctcccaaagtgctgggattacaagcatgagccactgtgcccagctgagtctacctttttttttttaggagttgtaaataaaacaagaaaataacactattagttattttattactaactatacaactactttaacataacactctcttttcccaggggtggggttgggtgtaaatgggcctcttgtagagatgactcttggtcatgggaattggtgatttataataattttgccatcttagggctgctcacagtatttggggccagagcctacgtgaatatatgtgtgtggacagatcagctgccatgttggttttggcagaaaaactactgaaaggtggttcagaatctggggagccttatattccaggtgtctttttcagacagtttctacctgtatcacccaaggtgcagtttgatgtagtagtgtcagctttttccttaagtgaactgcccagcaaggctgaccgcactgaggtagttcaaaccttatggcgtaagacaggtcatttcctggtgagttaaaattccttgttctccttaagtcttgaagcagcttcatggatttcatgcctttgctcctctcattgtctttattcttcaccatttttctccttcatgggtttctttatccctctttgagggtctccatcctgattatgtaatgcctatttctttttaggactccttctccctctatgattgctcttacacagctactgacatttatactttcgtgtaattcaagtcttctgcatattttccccttttgtgaacaggtactggtggagaatggaacaaaagctgggcacagccttctcatggatgccagggatctggtccttaagggaaaagagaagtcacctttggaccctcgacctggttttgtctttgccccggtgagtattacttctgcctgtcccaccacacggatctgaacttaggcgtggccgggaaatgtaagatggtaaagctaagccactctccactactttgtgttcctatccagttcctacctaatgattcccctggctcttcctacccactgctcctgtcctcccttctccctggccccttttgactctattattctcagtttttaagttttgtgattgatggctcttttgtcttacctcatttttttatgtgttcacagtgtccccatgaactcccttgtccccagttgaccaacctggcctgtagcttctcacaggcgtaccatcccatccccttcagctggaacaagaaaccaaaggaagaaaagttctctatggtgatccttgctcgggggtctccagaggaggctcatcgctggccccgtatcactcagcctgtccttaaacggcctcgccatgtgcattgtcacttgtgctgtccagatgggcacatgcagcatgctgtgctcacagcccgccggcacggcaggtatggggggtgtgaccaaaatcagtgggatgtggcaggaagctgcagcccacgccagcatctgtttccacagggatttgtatcgttgtgcccgtgtcagctcctggggagatcttttacctgtgcttactccgtctgcgtttcctccatctacggctcaggatccctctgagagttgatgaggatgtgtaacaagtattttcttctatcgtgcctgccagggctgaagctgcctggtatccaggaggggaatgctggtatccccatatgtctgtgtttgtttg

SEQ ID NO: 153489 - DNA, 1500 bp, Homo sapiens
  Payload ID: 10191
  Gene Symbol: METTL17
  Gene Name: methyltransferase like 17
  Uniprot ID: Q9H7H0
  ENST ID: ENST00000556670
  CDS Start-End: 17-1360
gttcgcctccggagccatggcggcggcactgaagtgtctactgacattaggaagatggtgccccggccttggagtggctccccaggcccgggcgctcgccgccttagtacccggagtgacccaggtagataacaagtccggtttcctgcagaagaggcctcatcgccagcaccctggcatcctaaagctgccgcacgtgcggctgccacaggcactggctaacggtgcccagttattgctacttgggagcgctgggcccactatggagaatcaggtgcaaacactgaccagttatctctggagcagacatttgcctgtagagccagaggagttgcaaagacgggctaggcatcttgagaaaaaattcctggaaaacccagacttatctcagacagaggagaaacttcgtggagcagtgctacacgcactacgtaaaactacctaccattggcaagaactgagctacactgagggactgagcctggtgtatatggcagcaagactggatggtggctttgcagcagtctccagagcattccatgagatccgggctcgaaatccagcatttcagccacaaactttgatggactttggctcaggtactggttctgtcacctgggctgctcacagtatttggggccagagcctacgtgaatatatgtgtgtggacagatcagctgccatgttggttttggcagaaaaactactgaaaggtggttcagaatctggggagccttatattccaggtgtctttttcagacagtttctacctgtatcacccaaggtgcagtttgatgtagtagtgtcagctttttccttaagtgaactgcccagcaaggctgaccgcactgaggtagttcaaaccttatggcgtaagacaggtcatttcctggtactggtggagaatggaacaaaagctgggcacagccttctcatggatgccagggatctggtccttaagggaaaagagaagtcacctttggaccctcgacctggttttgtctttgccccgtgtccccatgaactcccttgtccccagttgaccaacctggcctgtagcttctcacaggcgtaccatcccatccccttcagctggaacaagaaaccaaaggaagaaaagttctctatggtgatccttgctcgggggtctccagaggaggctcatcgctggccccgtatcactcagcctgtccttaaacggcctcgccatgtgcattgtcacttgtgctgtccagatgggcacatgcagcatgctgtgctcacagcccgccggcacggcagctcctggggagatcttttacctgtgcttactccgtctgcgtttcctccatctacggctcaggatccctctgagagttgatgaggatgtgtaacaagtattttcttctatcgtgcctgccagggctgaagctgcctggtatccaggaggggaatgctggtatccccatatgtctgtgtttgtttgagatttttaataataaataataaatttttgaagaa

SEQ ID NO: 153490 - DNA, 1605 bp, Homo sapiens
  Payload ID: 10191
  Gene Symbol: METTL17
  Gene Name: methyltransferase like 17
  ENST ID: ENST00000555533
  CDS Start-End: 10-486
tccggagccatggcggcggcactgaagtgtctactgacattaggaagatggtgccccggccttggagtggctccccaggcccgggcgctcgccgccttagtacccggagtgacccaggtagataacaagtccggtttcctgcagaagaggcctcatcgccagcaccctggcatcctaaagctgccgcacgtgcggctgccacaggcactggctaacggtgcccagttattgctacttgggagcgctgggcccactatggagaatcaggtgcaaacactgaccagttatctctggagcagacatttgcctgtagagccagaggagttgcaaagacgggctaggcatcttgagaaaaaattcctggaaaacccaggtcctgacttccagtccttgttctcaccacagacttatctcagacagaggagaaacttcgtggagcagtgctacacgcactacgtaaaactacctaccattggcaagaactgagctacactgagggactgagcctggtgtatatggcagcaagactggatggtggctttgcagcagtctccagagcattccatgagatccgggctcgaaatccagcatttcagccacaaactttgatggactttggctcaggtactggttctgtcacctgggctgctcacagtatttggggccagagcctacgtgaatatatgtgtgtggacagatcagctgccatgttggttttggcagaaaaactactgaaaggtggttcagaatctggggagccttatattccaggtgtctttttcagacagtttctacctgtatcacccaaggtgcagtttgatgtagtagtgtcagctttttccttaagtgaactgcccagcaaggctgaccgcactgaggtagttcaaaccttatggcgtaagacaggtcatttcctggtactggtggagaatggaacaaaagctgggcacagccttctcatggatgccagggatctggtccttaagggaaaagagaagtcacctttggaccctcgacctggttttgtctttgccccgtgtccccatgaactcccttgtccccagttgaccaacctggcctgtagcttctcacaggcgtaccatcccatccccttcagctggaacaagaaaccaaaggaagaaaagttctctatggtgatccttgctcgggggtctccagaggaggctcatcgctggccccgtatcactcagcctgtccttaaacggcctcgccatgtgcattgtcacttgtgctgtccagatgggcacatgcagcatgctgtgctcacagcccgccggcacggcaggtatggggggtgtgaccaaaatcagtgggatgtggcaggaagctgcagcccacgccagcatctgtttccacagggatttgtatcgttgtgcccgtgtcagctcctggggagatcttttacctgtgcttactccgtctgcgtttcctccatctacggctcaggatccctctgagagttgatgaggatgtgtaacaagtattttcttctatcgtgcctgccagggctgaagctgcctggtatccaggaggggaatgctggtatccccatatgtctgtgtttgtttgagatttttaataata

SEQ ID NO: 153491 - DNA, 803 bp, Homo sapiens
  Payload ID: 10191
  Gene Symbol: METTL17
  Gene Name: methyltransferase like 17
  ENST ID: ENST00000555670
  CDS Start-End: 282-803
cccggccttggagtggctccccaggcccgggcgctcgccgccttagtacccggagtgacccaggtagataacaagtccggtttcctgcagaagaggcctcatcgccagcaccctggcatcctaaagctgccgcacgtgcggctgccacaggcactggctaacggtgcccagttattgctacttggtgagtaacggcgggaaagcgagaagaaacgggactggacctacatgcaagtgattccgcttttcgtctttggcccatagggagcgctgggcccactatggagaatcaggtgcaaacactgaccagttatctctggagcagacatttgcctgtagagccagaggagttgcaaagacgggctaggcatcttgagaaaaaattcctggaaaacccagacttatctcagacagaggagaaacttcgtggagcagtgctacacgcactacgtaaaactacctaccattggcaagaactgagctacactgagggactgagcctggtgtatatggcagcaagactggatggtggctttgcagcagtctccagagcattccatgagatccgggctcgaaatccagcatttcagccacaaactttgatggactttggctcaggtactggttctgtcacctgggctgctcacagtatttggggccagagcctacgtgaatatatgtgtgtggacagatcagctgccatgttggttttggcagaaaaactactgaaaggtggttcagaatctggggagccttatattccaggtgtctttttcagacagtttctacctgtatcacccaag

SEQ ID NO: 153492 - DNA, 900 bp, Homo sapiens
  Payload ID: 10191
  Gene Symbol: METTL17
  Gene Name: methyltransferase like 17
  ENST ID: ENST00000553564
  CDS Start-End: 480-900
catggcggcggcactgaagtgtctactgacattaggaagatggtgccccggccttggagtggctccccaggcccgggtgagtgcctacattccctgctgtcggagagactctggatctgcagagacatctccgcgcagaggaggagcgctcctggcagcccccgccctagcgattgccagcaactttcctttctgccaggaaatcaacctacctttctctgcctgcaggcgctcgccgccttagtacccggagtgacccaggtagataacaagtccggtttcctgcagaagaggcctcatcgccagcaccctggcatcctaaagctgccgcacgtgcggctgccacaggcactggctaacggtgcccagttattgctacttggtgagtaacggcgggaaagcgagaagaaacgggactggacctacatgcaagtgattccgcttttcgtctttggcccatagggagcgctgggcccactatggagaatcaggtgcaaacactgaccagttatctctggagcagacatttgcctgtagagccagaggagttgcaaagacgggctaggcatcttgagaaaaaattcctggaaaacccagacttatctcagacagaggagaaacttcgtggagcagtgctacacgcactacgtaaaactacctaccattggcaagaactgagctacactgagggactgagcctggtgtatatggcagcaagactggatggtggctttgcagcagtctccagagcattccatgagatccgggctcgaaatccagcatttcagccacaaactttgatggactttggctcaggtactggttctgtcacctgggctgctcacagtatttggggccagagcctacgtgaatatatgtgtgtggacagatcagctgcca

SEQ ID NO: 153493 - DNA, 568 bp, Homo sapiens
  Payload ID: 10191
  Gene Symbol: METTL17
  Gene Name: methyltransferase like 17
  ENST ID: ENST00000554283
  CDS Start-End: 10-568
attaggaagatggtgccccggccttggagtggctccccaggcccgggtgagtgcctacattccctgctgtcggagagactctggatctgcagagacatctccgcgcagaggaggagcgctcctggcagcccccgccctagcgattgccagcaactttcctttctgccaggaaatcaacctacctttctctgcctgcaggcgctcgccgccttagtacccggagtgacccaggtagataacaagtccggtttcctgcagaagaggcctcatcgccagcaccctggcatcctaaagctgccgcacgtgcggctgccacaggcactggctaacggtgcccagttattgctacttgggagcgctgggcccactatggagaatcaggtgcaaacactgaccagttatctctggagcagacatttgcctgtagagccagaggagttgcaaagacgggctaggcatcttgagaaaaaattcctggaaaacccagacttatctcagacagaggagaaacttcgtggagcagtgctacacgcactacgtaaaactacctaccattggcaagaactga

SEQ ID NO: 153494 - DNA, 556 bp, Homo sapiens
  Payload ID: 10191
  Gene Symbol: METTL17
  Gene Name: methyltransferase like 17
  ENST ID: ENST00000554751
  CDS Start-End: 251-556
acattaggaagatggtgccccggccttggagtggctccccaggcccgggtgagtgcctacattccctgctgtcggagagactctggatctgcagagacatctccgcgcagaggaggagcgctcctggcagcccccgccctagcgattgccagcaactttcctttctgccaggaaatcaacctacctttctctgcctgcaggcgctcgccgccttagtacccggagtgacccagggagcgctgggcccactatggagaatcaggtgcaaacactgaccagttatctctggagcagacatttgcctgtagagccagaggagttgcaaagacgggctaggcatcttgagaaaaaattcctggaaaacccagacttatctcagacagaggagaaacttcgtggagcagtgctacacgcactacgtaaaactacctaccattggcaagaactgagctacactgagggactgagcctggtgtatatggcagcaagactggatggtggctttgcagcagtctccagagcattccatgagatccgggctcgaaatccagcattt

SEQ ID NO: 153495 - DNA, 510 bp, Homo sapiens
  Payload ID: 10191
  Gene Symbol: METTL17
  Gene Name: methyltransferase like 17
  ENST ID: ENST00000556733
  CDS Start-End: 1-370
acctggttttgtctttgccccgtgtccccatgaactcccttgtccccagttgaccaacctggcctgtagcttctcacaggcgtaccatcccatccccttcagctggaacaagaaaccaaaggaagaaaagttctctatggtgatccttgctcgggggtctccagaggaggctcatcgctggccccgtatcactcagcctgtccttaaacggcctcgccatgtgcattgtcacttgtgctgtccagatgggcacatgcagcatgctgtgctcacagcccgccggcacggcagctcctggggagatcttttacctgtgcttactccgtctgcgtttcctccatctacggctcaggatccctctgagagttgatgaggatgtgtaacaagtattttcttctatcgtgcctgccagggctgaagctgcctggtatccaggaggggaatgctggtatccccatatgtctgtgtttgtttgagatttttaataataaataataaatttttgaagaa

SEQ ID NO: 153496 - DNA, 1529 bp, Homo sapiens
  Payload ID: 10191
  Gene Symbol: METTL17
  Gene Name: methyltransferase like 17
  ENST ID: ENST00000557550
  CDS Start-End: 1-477
atggcggcggcactgaagtgtctactgacattaggaagatggtgccccggccttggagtggctccccaggcccgggcgctcgccgccttagtacccggagtgacccaggtagataacaagtccggtttcctgcagaagaggcctcatcgccagcaccctggcatcctaaagctgccgcacgtgcggctgccacaggcactggctaacggtgcccagttattgctacttgggagcgctgggcccactatggagaatcaggtgcaaacactgaccagttatctctggagcagacatttgcctgtagagccagaggagttgcaaagacgggctaggcatcttgagaaaaaattcctggaaaacccaggtcctgacttccagtccttgttctcaccacagacttatctcagacagaggagaaacttcgtggagcagtgctacacgcactacgtaaaactacctaccattggcaagaactgagctacactgagggactgagcctggtgtatatggcagcaagactggatggtggctttgcagcagtctccagagcattccatgagatccgggctcgaaatccagcatttcagccacaaactttgatggactttggctcaggtactggttctgtcacctgggctgctcacagtatttggggccagagcctacgtgaatatatgtgtgtggacagatcagctgccatgttggttttggcagaaaaactactgaaaggtggttcagaatctggggagccttatattccaggtgtctttttcagacagtttctacctgtatcacccaaggtgcagtttgatgtagtagtgtcagctttttccttaagtgaactgcccagcaaggctgaccgcactgaggtagttcaaaccttatggcgtaagacaggtcatttcctggtactggtggagaatggaacaaaagctgggcacagccttctcatggatgccagggatctggtccttaagggaaaagagaagtcacctttggaccctcgacctggttttgtctttgccccgtgtccccatgaactcccttgtccccagttgaccaacctggcctgtagcttctcacaggcgtaccatcccatccccttcagctggaacaagaaaccaaaggaagaaaagttctctatggtgatccttgctcgggggtctccagaggaggctcatcgctggccccgtatcactcagcctgtccttaaacggcctcgccatgtgcattgtcacttgtgctgtccagatgggcacatgcagcatgctgtgctcacagcccgccggcacggcagggatttgtatcgttgtgcccgtgtcagctcctggggagatcttttacctgtgcttactccgtctgcgtttcctccatctacggctcaggatccctctgagagttgatgaggatgtgtaacaagtattttcttctatcgtgcctgccagggctgaagctgcctggtatccaggaggggaatgctggtatccccatatgtctgtgtttgtttgagatttttaataataaataat

SEQ ID NO: 153497 - DNA, 1426 bp, Homo sapiens
  Payload ID: 10192
  Gene Symbol: METTL18
  Gene Name: methyltransferase like 18
  Uniprot ID: O95568
  ENST ID: ENST00000303469
  CDS Start-End: 260-1378
gaggaaagaggcgcgttcctagccgcgggactgggtgacccgcctctcccccaaattagctgcttggaaagaggaccaaagacgtctaaaaagtcatttggaaatatctctaaatatttgttaccatgtataagctgctaaagagaaattgggcccaacaaaactaattgaataattgaggcagatttgtgtgtatcatcaaattctatccagaagttgaagaatctgaatttaaagattgtgtgcatttaataagaggatgacctttcagtttaatttcactatagaagaccatctggaaaatgaattaacacccattagagatggagctttgaccctggattcctcaaaagagctgtcagtctcagaaagtcaaaaaggagaagagagggacagaaaatgttctgcagaacaatttgacttgcctcaggatcacttgtgggaacataagtcaatggaaaatgcagctccctctcaagacacagacagtccactcagtgcagccagcagttcaaggaacttggagccacatggaaaacagccctccttgagagctgccaaagagcatgctatgcctaaagatttaaagaagatgttagaaaataaagtcatagaaacattaccaggtttccagcatgttaagttatcagtagtgaaaaccatcttgttgaaagagaacttccctggagaaaacatagtttcaaaaagcttttcttctcactctgatctgattacaggtgtttatgagggaggcttaaaaatctgggaatgtacctttgacctcctggcttatttcacaaaggccaaagtgaaatttgctgggaaaaaagtcttggatcttggttgtggatcaggtttactaggtataactgcattcaagggagggtccaaagaaattcactttcaagattataacagtatggtgattgatgaagtaaccttacctaatgtagtagctaactccactttggaagatgaagaaaatgatgtaaatgagccagatgtgaaaagatgcaggaaaccaaaagtaacacaactatataaatgccgatttttttctggtgagtggtctgagttttgtaagcttgtactaagtagtgaaaaactttttgtaaaatatgatctcattctcacctcagaaaccatttacaacccagattattatagtaatttgcaccagactttccttagactgttaagtaaaaatggacgtgtacttttggccagcaaagcacattattttggtgtaggtggaggtgttcatctctttcagaagtttgtagaagaaagagatgtttttaagaccagaatactcaaaataattgatgaaggattgaagaggttcataattgaaataacttttaagtttcctggttaattaacattcactgagtatccaaaatgaaataaacagaaggaccaaaaa

SEQ ID NO: 153498 - DNA, 1521 bp, Homo sapiens
  Payload ID: 10192
  Gene Symbol: METTL18
  Gene Name: methyltransferase like 18
  Uniprot ID: O95568
  ENST ID: ENST00000310392
  CDS Start-End: 355-1473
cgggtccctcaaggccggaaagaaagtcgggcttctctagcccctggaggactcgactcactggtgcgcgatttaggtccggaggaggcgttgtgaggtgagctttttcagaagcgcgatcccaggacacgtcgggaagcaagcatccccagagctgcttggaaagaggaccaaagacgtctaaaaagtcatttggaaatatctctaaatatttgttaccatgtataagctgctaaagagaaattgggcccaacaaaactaattgaataattgaggcagatttgtgtgtatcatcaaattctatccagaagttgaagaatctgaatttaaagattgtgtgcatttaataagaggatgacctttcagtttaatttcactatagaagaccatctggaaaatgaattaacacccattagagatggagctttgaccctggattcctcaaaagagctgtcagtctcagaaagtcaaaaaggagaagagagggacagaaaatgttctgcagaacaatttgacttgcctcaggatcacttgtgggaacataagtcaatggaaaatgcagctccctctcaagacacagacagtccactcagtgcagccagcagttcaaggaacttggagccacatggaaaacagccctccttgagagctgccaaagagcatgctatgcctaaagatttaaagaagatgttagaaaataaagtcatagaaacattaccaggtttccagcatgttaagttatcagtagtgaaaaccatcttgttgaaagagaacttccctggagaaaacatagtttcaaaaagcttttcttctcactctgatctgattacaggtgtttatgagggaggcttaaaaatctgggaatgtacctttgacctcctggcttatttcacaaaggccaaagtgaaatttgctgggaaaaaagtcttggatcttggttgtggatcaggtttactaggtataactgcattcaagggagggtccaaagaaattcactttcaagattataacagtatggtgattgatgaagtaaccttacctaatgtagtagctaactccactttggaagatgaagaaaatgatgtaaatgagccagatgtgaaaagatgcaggaaaccaaaagtaacacaactatataaatgccgatttttttctggtgagtggtctgagttttgtaagcttgtactaagtagtgaaaaactttttgtaaaatatgatctcattctcacctcagaaaccatttacaacccagattattatagtaatttgcaccagactttccttagactgttaagtaaaaatggacgtgtacttttggccagcaaagcacattattttggtgtaggtggaggtgttcatctctttcagaagtttgtagaagaaagagatgtttttaagaccagaatactcaaaataattgatgaaggattgaagaggttcataattgaaataacttttaagtttcctggttaattaacattcactgagtatccaaaatgaaataaacagaaggaccaaaaa

SEQ ID NO: 153499 - DNA, 850 bp, Homo sapiens
  Payload ID: 10192
  Gene Symbol: METTL18
  Gene Name: methyltransferase like 18
  ENST ID: ENST00000454472
  CDS Start-End: 297-850
gtccctcaaggccggaaagaaagtcgggcttctctagcccctggaggactcgactcactggtgcgcgatttaggtccggaggaggcgttgtgagagctgcttggaaagaggaccaaagacgtctaaaaagtcatttggaaatatctctaaatatttgttaccatgtataagctgctaaagagaaattgggcccaacaaaactaattgaataattgaggcagatttgtgtgtatcatcaaattctatccagaagttgaagaatctgaatttaaagattgtgtgcatttaataagaggatgacctttcagtttaatttcactatagaagaccatctggaaaatgaattaacacccattagagatggagctttgaccctggattcctcaaaagagctgtcagtctcagaaagtcaaaaaggagaagagagggacagaaaatgttctgcagaacaatttgacttgcctcaggatcacttgtgggaacataagtcaatggaaaatgcagctccctctcaagacacagacagtccactcagtgcagccagcagttcaaggaacttggagccacatggaaaacagccctccttgagagctgccaaagagcatgctatgcctaaagatttaaagaagatgttagaaaataaagtcatagaaacattaccaggtttccagcatgttaagttatcagtagtgaaaaccatcttgttgaaagagaacttccctggagaaaacatagtttcaaaaagcttttcttctcactctgatctgattacaggtgtttatgagggaggcttaaaaatctgggaatgtacctttgacctcctggcttatttcacaaaggccaaagtgaa

SEQ ID NO: 153500 - DNA, 6128 bp, Homo sapiens
  Payload ID: 10193
  Gene Symbol: METTL20
  Gene Name: methyltransferase like 20
  Uniprot ID: Q8IXQ9
  ENST ID: ENST00000357721
  CDS Start-End: 216-1004
agtctagtgggataccaggccctgagagacccctacgatcccaggacactgatgtggggtaactaacacccactggaagtctacgctgagttcacaggctatagtcagaggttccggttgagatcaagttgggagacacacccttgttcattctccttgagaagcagctattatcaacagaacattgacagaacctgtgtttggggaaaggactgatggctttgagtctaggttggaaagcacacaggaaccactgtggtctcctcttgcaggctctgcgaagcagtggtcttctcttgtttccctgtggccagtgtccctggagaggagctggaagctttttggaccctgagataaaggctttcctggaggagaacactgaagtcaccagcagtggtagcctcacccctgaaatccagttgcggcttttgacccccagatgcaaattctggtgggagagagctgacctgtggccccacagtgatccttactgggcaatctactggccaggaggccaagccctgtctaggtatcttttggataatcctgatgttgtcagaggaaaatctgtattagatcttgggagtggatgtggagctacagctattgctgctaagatgagtggggcatcaaggatcttggccaatgacatagaccctattgcaggaatggctattacactaaattgtgaattgaacagactgaatccttttcctattttaatccaaaacattttgaatttggaacaagataagtgggaccttgttgttcttggcgatatgttttatgatgaagaccttgcagatagtcttcatcagtggctgaagaagtgcttctggacctatagaactcgagtactgattggtgaccctgggcggccccagttcagtggacacagcattcagcatcacctgcacaaagtggtagaatattcacttttggagtctactaggcaggaaaacagtggactgacaacaagcacagtgtggggttttcagccttgagttgtcaaagtgcttccaagtatgaatatagtaatgtttggatctgactctaaaagttttctctataggagatactctccagtttaatgaatgtaattcttgttaaatggaaaatcttgtttttaaaatatgaaggtttagagttttgtttacttttgtcatgtaactggttctgtatttctatgcatgccaattatacacatctctatctgcatttttttttctattttaaccgctgaaggaatatgattatacaatgccatactcaatggtggcagcatttaatttaagtaatggagaagaattaaacattgtagctggatctgtttctgtagtcgaggacaactgtgatgtaactttgaattaaacaaacaaaacaaaacagaagaagactatatatatattttttctttttttagagacagtctcactttgctcccaggctggaatgcagtggctattcagaggcttaatcattgggcactgcagccttgaactctgggcttttttttttttttgagatggagtctcagctctgtcgtccaggctggagtgcagtgactcatgtctcggctcactgtagcctccacctcccccaatcaagcgattgtcctgtctcagcctccagagtagctgggattttaggtgtgcaccaccatgcctggctaatttttgtatttttagtagagacggggttttgccatgttggccaggccggtctcaaactcctgacctcaggtgatccacccgccttggcctcccaaagtgctaggattacaggtgtgagccaccacgccagcctgacgatgttttttacttctatcacttccttttgattttttcttatagcttctatctctgcttacgtcacccatcattcttgcgtgttgtatgcttttcgcattagagccctttgcatgttaatcagttattttaaatttatgatctggtaattctaaaatgtctgccataactgagtctggttctgatgcttgttttcttttcagactgtttttttgtcttttagcatgccttgtaattttttgttgatagctagacatgatgtattgcataaataaacaagtaaactaaggtagcatgaggttttaaaatctgggtagggctactgtttgctgtagagtagatattacaggctaaattttcctctagtgtcctggctattgtctcctctgttatctttgagtttccctagagattccttcttatatagagtctgaagcttgcagtttttttcacctgtaattccctgttattatacagtagcctaactgatgtgataaggtatgggagaaggtatgttctatagtcctgtgattaagtctcagtcagttaagtcagcctgtgcccctgctgtgaccttcacaagtgctttcagcttttcttttgtcactttggtgagacaggaaggctagaggcagctggagttgggtgcttcctttcccccaggtcaacgaggctctggtaaaatagtttcccttgagaactggcttttgttaaggagaactgaacacttgggcatatttcaaaatggttactttccctatcctcataccagaagaggggatttttctctgatcctcaccctgagaacctggtaggtatcctggaggtaaaactatgaaagtgtggtgtctcccctaggagtgggccccctggagtttgtttgttttaatttaacaaagtttaattgagcaaagaacaatctgtgaattgggcagctcccaaaagcagaataggttcagagtgactgcagggttgccacacctggttagataacgtttatggacagattcctagagcttttgattcttttttttttttttttgaggcagagtttcactcttattgcccaggctggagtgcaatggcgtgatcttggctcactgcaacctccacctcctgggttaaagtgattctcctgcctcagcctcctgagtagctgggattacaggtatacaccaccaaacccagctgggattacaggcatgcaccaccatgcccagctaatttttgtatttttagtaaagacagggcttcgccatgttggccaggctggtctcgaactcctgacctcaggtgatccacctgcctcagcctccccaagtgctgggattacacgtgtgagccactgtgccaggctggagcttttgattcttaagtccatccacatggagcctccagcaactcaggaattacagcataaatgttcctattggtactggctccagcaacaggcttctgctccctgtaagctatggttctttgtatttgcgtttctaatttgtgaggcattctctctttaaccttaattctctaatggatctaagtgttgttgacttttcagtttattgagcttttttcttattgtgaggatgggaatgatgacttccaatctctttatattagaaaatataaatcagactagagactggaaatttttgttgttgttgttgggtgttttgttttgtttgtttttagacaggtcttgctctctcatccaggctggagttcagcaatgcgaccgtgctcactgcagcctcgactttctaggctcaggtaatcctcccacttcagcctccttagtagctaggactgtaggcatgcaccaccatgatgcctggctagtttttttattttgtattttttgtagacatggagtcttgctacattggccaggctgggtattactgggtatttctttctttcctcctttatttctttccatatttacttattcaatgaatatttgagtgcttattatataccaggcactgttctaggcactggggatatggggatacagcaatgaaaaaaaaagataaatactttgtccttatgaaatttgtattctagagtagggagacataatgaacaaatgaaaacaggcatcagatggtgataggtagtaaggagaaaaagaagtaagggtaatagggaatactgggtactggatggggtacagatattttaaacagagtggtgagaaatagttaatacagctagcaacataaaaaaggagaaatatcaaactgcaaactgttttaggaagataaatccttcatagacccaaagaagctcacaatttagatgtcgaaactagtttctgcaaaaaggggaaaatgtgattgacttggttaaatattcagtattaaattttattgaatttgtctttagaaaaatttcatagttagaacaggccttacccattttgcacatatatacatatgcaccacctttgcagtggcaacatatatatccacactataaacataccacatttataaatcttgtaaggacaagaaatggagttgaataagtaccccccaacatatacaagaaagttagcatacttaccccgtttttcactacatcagaggcaaaataagaaatcttttaagaaaatctcaagactggctcatggcaaaatgaatatgctaaatttgggggttggtttaagcgtggtatgtgtcaggtaattttgtgattaccaaaaagttttcacttgaaaactaagacctttgctgtttatttcacaatgtgaaatcaataaacctgaggatacaagtctctgtagtgatattctgtatttactcatttttacacatttttgaatgcaattttgctaaggaaggaaagcttacagatgcataaaatgtaactgggaagagtagccataaaaatcaatgaatggatgtggctgggcaagagcctctgtaatactaatacgctgaatggctaataagtcacttcatttcggtgaaacaaatacctaaattctttgaagaattaacaggcttgatgttcaggtctgcttttggcaaatgggcatttaaatactccaagaaggtaagagccagaaaataggaaggtaactatgcttttagaaatatgtttacttagattctcccaaggtttatacttacaggtaaacttagaacaatagctcaaatacctacataggagaaggaaatctcaagggaaaacagttaattttaaagttatttaagaaacagaatccaacaccatagatcagagttcatgctaggattatcatttcaaaaataatgactcatccaacagatatagaataatagcactttaaagatgtttaagagtaaagcacaaaccatgtatataccaagacttagctaattctctgagagttataacttaagacaataaaataattaaaaatagtgttaacattaagtagaatgcaaatctctatagatggtttcctgggaaagtagttttgataagctttcctagcattgatcatcttcaaaaaagcatcaataaacagtccatgtcacttgctttagtttgtttgggcctactaattgctccaacacttctcgggaatgatctataaaagaaaacaatgacaatatattaattgacaataaaaaatgtttaatgtttcctcatgtctaactggaggtgatgttaattattatacagttatttaaaggattaaaggaggtgatctataaagcacaatatacaactaactcactaataattaattaatggtagccctcactattattaggtgtagtgcacctatcatggtattacttgtttaaaaaaaaaaaacaggcatttgttgttttctctgtaatttcatcataattccaccaaccagagtaatggtctaatttcaccattaacctgtgttaatggttaataacttttttcaggatcttagccggaaatagatgattcactaaagtggggtgactgaacagcatttaatgaagggaatatttaccaaaaaagtaggattaaagaaagccaataggtacggtaaaccaccttgggaagctgcaacacacccaaagggttaaaggaggtagtagtcaccgaacgtgacaagttgacctgtagctgaacatttttccatgtctgtataatactactataaagcatgattttaaatagataaccattatataaatacactgtaatttaaccaatctatattattggacatttagatgttttcagtttttcacaatgtacagtcgtgattttgatatggtttccatcctagttttaggatgtcttttaaaaatctgaattaaagcaaaaatactgataaaa

SEQ ID NO: 153501 - DNA, 2055 bp, Homo sapiens
  Payload ID: 10193
  Gene Symbol: METTL20
  Gene Name: methyltransferase like 20
  Uniprot ID: Q8IXQ9
  ENST ID: ENST00000395763
  CDS Start-End: 290-1078
gccgcgaggggccgccgtccgtcccgccccctgccgggccgcggcgctctgctagagcgtggctcagttttggtagcgggaccccggaaatgtaaagcatgagcgggaacagtcgccagggcgagtgacaggcgagccctatgctttacttccgagggcggtgtcagcaaagctagagtcagaggttccggttgagatcaagttgggagacacacccttgttcattctccttgagaagcagctattatcaacagaacattgacagaacctgtgtttggggaaaggactgatggctttgagtctaggttggaaagcacacaggaaccactgtggtctcctcttgcaggctctgcgaagcagtggtcttctcttgtttccctgtggccagtgtccctggagaggagctggaagctttttggaccctgagataaaggctttcctggaggagaacactgaagtcaccagcagtggtagcctcacccctgaaatccagttgcggcttttgacccccagatgcaaattctggtgggagagagctgacctgtggccccacagtgatccttactgggcaatctactggccaggaggccaagccctgtctaggtatcttttggataatcctgatgttgtcagaggaaaatctgtattagatcttgggagtggatgtggagctacagctattgctgctaagatgagtggggcatcaaggatcttggccaatgacatagaccctattgcaggaatggctattacactaaattgtgaattgaacagactgaatccttttcctattttaatccaaaacattttgaatttggaacaagataagtgggaccttgttgttcttggcgatatgttttatgatgaagaccttgcagatagtcttcatcagtggctgaagaagtgcttctggacctatagaactcgagtactgattggtgaccctgggcggccccagttcagtggacacagcattcagcatcacctgcacaaagtggtagaatattcacttttggagtctactaggcaggaaaacagtggactgacaacaagcacagtgtggggttttcagccttgagttgtcaaagtgcttccaagtatgaatatagtaatgtttggatctgactctaaaagttttctctataggagatactctccagtttaatgaatgtaattcttgttaaatggaaaatcttgtttttaaaatatgaaggtttagagttttgtttacttttgtcatgtaactggttctgtatttctatgcatgccaattatacacatctctatctgcatttttttttctattttaaccgctgaaggaatatgattatacaatgccatactcaatggtggcagcatttaatttaagtaatggagaagaattaaacattgtagctggatctgtttctgtagtcgaggacaactgtgatgtaactttgaattaaacaaacaaaacaaaacagaagaagactatatatatattttttctttttttagagacagtctcactttgctcccaggctggaatgcagtggctattcagaggcttaatcattgggcactgcagccttgaactctgggcttttttttttttttgagatggagtctcagctctgtcgtccaggctggagtgcagtgactcatgtctcggctcactgtagcctccacctcccccaatcaagcgattgtcctgtctcagcctccagagtagctgggattttaggtgtgcaccaccatgcctggctaatttttgtatttttagtagagacggggttttgccatgttggccaggccggtctcaaactcctgacctcaggtgatccacccgccttggcctcccaaagtgctaggattacaggtgtgagccaccacgccagcctgacgatgttttttacttctatcacttccttttgattttttcttatagcttctatctctgcttacgtcacccatcattcttgcgtgttgtatgcttttcgcattagagccctttgcatgttaatcagttattttaaatttatgatctggtaattctaaaatgtctgccataactga

SEQ ID NO: 153502 - DNA, 1083 bp, Homo sapiens
  Payload ID: 10193
  Gene Symbol: METTL20
  Gene Name: methyltransferase like 20
  Uniprot ID: Q8IXQ9
  ENST ID: ENST00000412352
  CDS Start-End: 210-998
ttcttaatggaatccaagcctctaagcctcacagtccaggccctccaccagcctgcctcaccctatcctcatttcatctcccgcaacctggctccgagtcagaggttccggttgagatcaagttgggagacacacccttgttcattctccttgagaagcagctattatcaacagaacattgacagaacctgtgtttggggaaaggactgatggctttgagtctaggttggaaagcacacaggaaccactgtggtctcctcttgcaggctctgcgaagcagtggtcttctcttgtttccctgtggccagtgtccctggagaggagctggaagctttttggaccctgagataaaggctttcctggaggagaacactgaagtcaccagcagtggtagcctcacccctgaaatccagttgcggcttttgacccccagatgcaaattctggtgggagagagctgacctgtggccccacagtgatccttactgggcaatctactggccaggaggccaagccctgtctaggtatcttttggataatcctgatgttgtcagaggaaaatctgtattagatcttgggagtggatgtggagctacagctattgctgctaagatgagtggggcatcaaggatcttggccaatgacatagaccctattgcaggaatggctattacactaaattgtgaattgaacagactgaatccttttcctattttaatccaaaacattttgaatttggaacaagataagtgggaccttgttgttcttggcgatatgttttatgatgaagaccttgcagatagtcttcatcagtggctgaagaagtgcttctggacctatagaactcgagtactgattggtgaccctgggcggccccagttcagtggacacagcattcagcatcacctgcacaaagtggtagaatattcacttttggagtctactaggcaggaaaacagtggactgacaacaagcacagtgtggggttttcagccttgagttgtcaaagtgcttccaagtatgaatatagtaatgtttggatctgactctaaaagttttctctataggagatactctccagttt

SEQ ID NO: 153503 - DNA, 1067 bp, Homo sapiens
  Payload ID: 10193
  Gene Symbol: METTL20
  Gene Name: methyltransferase like 20
  ENST ID: ENST00000538391
  CDS Start-End: 18-362
gtttggggaaaggactgatggctttgagtctaggttggaaagcacacaggaaccactgtggtctcctcttgcaggctctgcgaagcagtggtcttctcttgtttccctgtggccagtgtccctggagaggagctggaagctttttggaccctgagataaaggctttcctggaggagaacactgaagtcaccagcagtggtagcctcacccctgaaatccagttgcggcttttgacccccagatgcaaattctggtgggagagagctgacctgtggccccacagtgatccttactgggcaatctactggccaggaggccaagccctgtctagttgcaggaatggctattacactaaattgtgaattgaacagactgaatccttttcctattttaatccaaaacattttgaatttggaacaagataagtgggaccttgttgttcttggcgatatgttttatgatgaagaccttgcagatagtcttcatcagtggctgaagaagtgcttctggacctatagaactcgagtactgattggtgaccctgggcggccccagttcagtggacacagcattcagcatcacctgcacaaagtggtagaatattcacttttggagtctactaggcaggaaaacagtggactgacaacaagcacagtgtggggttttcagccttgagttgtcaaagtgcttccaagtatgaatatagtaatgtttggatctgactctaaaagttttctctataggagatactctccagtttaatgaatgtaattcttgttaaatggaaaatcttgtttttaaaatatgaaggtttagagttttgtttacttttgtcatgtaactggttctgtatttctatgcatgccaattatacacatctctatctgcatttttttttctattttaaccgctgaaggaatatgattatacaatgccatactcaatggtggcagcatttaatttaagtaatggagaagaattaaacattgtagctggatctgtttctgtagtcgaggacaactgtgatgtaactttgaattaaacaaacaaaacaaaacagaagaaga

SEQ ID NO: 153504 - DNA, 1862 bp, Homo sapiens
  Payload ID: 10193
  Gene Symbol: METTL20
  Gene Name: methyltransferase like 20
  Uniprot ID: Q8IXQ9
  ENST ID: ENST00000538463
  CDS Start-End: 684-1472
agtctagtgggataccaggccctgagagacccctacgatcccaggacactgatgtggggtaactaacacccactggaagtctacgctgagttcacaggctatgtatgacctgacatgcattttgacctgccctgtgttttgatatttgaatgagttgctgatgtttacaagccgaagctggccgggcgtggtggctcgcgcctgtaatcccagcactttgggaggtcgaggcaggaggatcgcttcaggtcaggagttccagaccagtctggccaacatggcgaaacctcgtctctactaaaaaaaaaaaaaaaaaaaaaaatacaaaaattagccgggcgtggtggcacgcccctgtaatcccaggactcgggaggctgagacaattataaattcattaacccccagaactcttggctagacttcataaaggcaaaaactgtgtttgccctgttaactgctttatcccaccactagaatataagcttcctgaagacagaagacttctgttattttgttcacagttaccaagcatgcctactttgttaaatttatgaaagaactttaaagagtcagaggttccggttgagatcaagttgggagacacacccttgttcattctccttgagaagcagctattatcaacagaacattgacagaacctgtgtttggggaaaggactgatggctttgagtctaggttggaaagcacacaggaaccactgtggtctcctcttgcaggctctgcgaagcagtggtcttctcttgtttccctgtggccagtgtccctggagaggagctggaagctttttggaccctgagataaaggctttcctggaggagaacactgaagtcaccagcagtggtagcctcacccctgaaatccagttgcggcttttgacccccagatgcaaattctggtgggagagagctgacctgtggccccacagtgatccttactgggcaatctactggccaggaggccaagccctgtctaggtatcttttggataatcctgatgttgtcagaggaaaatctgtattagatcttgggagtggatgtggagctacagctattgctgctaagatgagtggggcatcaaggatcttggccaatgacatagaccctattgcaggaatggctattacactaaattgtgaattgaacagactgaatccttttcctattttaatccaaaacattttgaatttggaacaagataagtgggaccttgttgttcttggcgatatgttttatgatgaagaccttgcagatagtcttcatcagtggctgaagaagtgcttctggacctatagaactcgagtactgattggtgaccctgggcggccccagttcagtggacacagcattcagcatcacctgcacaaagtggtagaatattcacttttggagtctactaggcaggaaaacagtggactgacaacaagcacagtgtggggttttcagccttgagttgtcaaagtgcttccaagtatgaatatagtaatgtttggatctgactctaaaagttttctctataggagatactctccagtttaatgaatgtaattcttgttaaatggaaaatcttgtttttaaaatatgaaggtttagagttttgtttacttttgtcatgtaactggttctgtatttctatgcatgccaattatacacatctctatctgcatttttttttctattttaaccgctgaaggaatatgattatacaatgccatactcaatggtggcagcatttaatttaagtaatggagaagaattaaacattgtagctggatctgtttctgtagtcgaggacaactgtgatgtaactttgaattaaacaaacaaaacaaaacagaagaa

SEQ ID NO: 153505 - DNA, 554 bp, Homo sapiens
  Payload ID: 10193
  Gene Symbol: METTL20
  Gene Name: methyltransferase like 20
  ENST ID: ENST00000539633
  CDS Start-End: 339-554
gagagacccctacgatcccaggacactgatgtggggtaactaacacccactggaagtctacgctgagttcacaggctatgtatgacctgacatgcattttgacctgccctgtgttttgatatttgaatgagttgctgatgtttacaagccgaagctggccgggcgtggtggctcgcgcctgtaatcccagcactttgggaggtcgaggcaggaggatcgcttcagagtcagaggttccggttgagatcaagttgggagacacacccttgttcattctccttgagaagcagctattatcaacagaacattgacagaacctgtgtttggggaaaggactgatggctttgagtctaggttggaaagcacacaggaaccactgtggtctcctcttgcaggctctgcgaagcagtggtcttctcttgtttccctgtggccagtgtccctggagaggagctggaagctttttggaccctgagataaaggctttcctggaggagaacactgaagtcaccagcagtggtagcctcacccctgaaatccagttgcggcttttg

SEQ ID NO: 153506 - DNA, 1210 bp, Homo sapiens
  Payload ID: 10194
  Gene Symbol: METTL21A
  Gene Name: methyltransferase like 21A
  ENST ID: ENST00000272839
  CDS Start-End: 177-887
tgcaaaagaaattggacaaaggcttcctccacctgtttctttttttcttttgaacttgtaaacgaccttaaaagcatttggagttagttaagaacagataatgtatcttttggccagagcgtcacccaggattcttttgcacggcaggtctgagcagagggcggggtgcaggcggaatggccctcgtgccctatgaggagaccacggaatttgggttgcagaaattccacaagcctcttgcaactttttcctttgcaaaccacacgatccagatccggcaggactggagacacctgggagtcgcagcggtggtttgggatgcggccatcgttctttccacatacctggagatgggagctgtggagctcaggggccgctctgccgtggagctgggtgctggcacggggctggtgggcatagtggctgccctgctggcacttaagtcatcgatgaagcccttgctggtacactgccttttattcttttcaggtgctcatgtgactatcacggatcgaaaagtagcattagaatttcttaaatcaaacgttcaagccaacttacctcctcatatccaaactaaaactgttgttaaggagctgacttggggacaaaatttggggagtttttctcctggagaatttgacctgatacttggtgctgatatcatatatttagaagaaacattcacagatcttcttcagacactggaacatctctgtagcaatcactctgtgattcttttagcatgccgaattcgctatgaacgggataacaacttcttagcaatgctggagaggcaatttactgtgagaaaggttcactacgatcctgaaaaagatgtacatatttacgaagcacagaagagaaaccagaaggaggacttataattggctataatttataagaatgttgtcattgagtgtgtcacttaaggtcttagactgcaaatctaaccatatttaatgaaatgtcttactgtacaaaaagtctaagccaaaggttctcaggggagaaagcacatgtgcagttttaaaacaaagcagtgctttgtcccattgctgtgatttttagtcagactttactcagtctgaaatgcaattaacattaaaggattaagtgtgagatttcgatttatgctatttgtgtatcccatactcctcccttttaataaacagtttccactgatgatatgaagggccggtataaagaa

SEQ ID NO: 153507 - DNA, 1103 bp, Homo sapiens
  Payload ID: 10194
  Gene Symbol: METTL21A
  Gene Name: methyltransferase like 21A
  Uniprot ID: Q8WXB1
  ENST ID: ENST00000406927
  CDS Start-End: 144-800
gggccggggccgcccgcccccgcgtcgcgggctctttaaggccggcggttttcgcagccagcccggggcggggaaagcggagcgcgcgctccacgcgggaccgcctcccgggccgtctgagcagagggcggggtgcaggcggaatggccctcgtgccctatgaggagaccacggaatttgggttgcagaaattccacaagcctcttgcaactttttcctttgcaaaccacacgatccagatccggcaggactggagacacctgggagtcgcagcggtggtttgggatgcggccatcgttctttccacatacctggagatgggagctgtggagctcaggggccgctctgccgtggagctgggtgctggcacggggctggtgggcatagtggctgccctgctgggtgctcatgtgactatcacggatcgaaaagtagcattagaatttcttaaatcaaacgttcaagccaacttacctcctcatatccaaactaaaactgttgttaaggagctgacttggggacaaaatttggggagtttttctcctggagaatttgacctgatacttggtgctgatatcatatatttagaagaaacattcacagatcttcttcagacactggaacatctctgtagcaatcactctgtgattcttttagcatgccgaattcgctatgaacgggataacaacttcttagcaatgctggagaggcaatttactgtgagaaaggttcactacgatcctgaaaaagatgtacatatttacgaagcacagaagagaaaccagaaggaggacttataattggctataatttataagaatgttgtcattgagtgtgtcacttaaggtcttagactgcaaatctaaccatatttaatgaaatgtcttactgtacaaaaagtctaagccaaaggttctcaggggagaaagcacatgtgcagttttaaaacaaagcagtgctttgtcccattgctgtgatttttagtcagactttactcagtctgaaatgcaattaacattaaaggattaagtgtgagatttcgatttatgctatttgtgtatcccatactcctcccttttaataaacagtttccactgatgata

SEQ ID NO: 153508 - DNA, 1366 bp, Homo sapiens
  Payload ID: 10194
  Gene Symbol: METTL21A
  Gene Name: methyltransferase like 21A
  Uniprot ID: Q8WXB1
  ENST ID: ENST00000458426
  CDS Start-End: 300-572
gttttcgcagccagcccggggcggggaaagcggagcgcgcgctccacgcgggaccgcctcccgggccgtaagtaccggcgtggcggcgcctcagcccggcctgggcgagccctgggtgctccgccgggcagctcacggcgccccgtatggcctggggatcctaagaggccctgtgacccccctcgcctggtctccctctcacccctggagggttgccgcagctccggggcccccgggcaggaagggcgcactggtcgtcccgggagaggggtctgagcagagggcggggtgcaggcggaatggccctcgtgccctatgaggagaccacggaatttgggttgcagaaattccacaagcctcttgcaactttttcctttgcaaaccacacgatccagatccggcaggactggagacacctgggagtcgcagcggtggtttgggatgcggccatcgttctttccacatacctggagatgggagctgtggagctcaggggccgctctgccgtggagctgggtgctggcacggggctggtgggcatagtggctgccctgctgggaggtggaatttaattctcctccccttgaatatgggctggacaaagagaaaaatggtagctcaacagtggagacacctggacagcactttaaccaagtgatcaaagttaatatcgccaattatgtatgtgctcccggatgtgatgttatgagaaaggcacactatacctctgtggaattcctccccaaaacctattatctcaatctatccatagaaaacactggacaaatgcaaactgagggatattctaaaagaaaacagatcactactcttcaaaagttacaaggccatcaaagacaaggaaacaaactttcacagactgaaggagactataattaaatgcgatatggtacccaaactggattatgtaagtaaaaaaactggggaaataaaatgtataattcagttaatggtattataccaatgtacttttatttttgataaatgtaccctggttatgtaatatactaagattagagaaagctggatgaagggtatccggaactctgtatttttaaaactcctttgtaagtttaaaattacttaaaaatatattaaaaatgtatatttacctttgtactggtttgagtaaaaaaactgactttagaatgttaacattttagatggtgaaattagaagtaattcaatttttaggtaatgtttcttaatttacttataatgaacatgttttacttgtgtaataataaatttaaaaaacctgatagtaatgtaaatactctttggtaacctgcttttgtccgagaacatcttcccatcttaataaaaatacacctttatttactcttaa

SEQ ID NO: 153509 - DNA, 1003 bp, Homo sapiens
  Payload ID: 10194
  Gene Symbol: METTL21A
  Gene Name: methyltransferase like 21A
  Uniprot ID: Q8WXB1
  ENST ID: ENST00000442521
  CDS Start-End: 281-937
ctgtgctttagttgaaaagggttttgtgacttttccactcgattgccgccaagcgggctattacgccgcttctgaccccaccgtggagacgcggggactagagtgaccatgccttcttcggagcgagctgtctccatcatccgctaacgcgccacctttaaaaaacaggcacaacgcgcaagcgacaaagtcagaggcagagagcggcggagcacatgatagaaaaggtcgagaggcacattcagcgccaggtctgagcagagggcggggtgcaggcggaatggccctcgtgccctatgaggagaccacggaatttgggttgcagaaattccacaagcctcttgcaactttttcctttgcaaaccacacgatccagatccggcaggactggagacacctgggagtcgcagcggtggtttgggatgcggccatcgttctttccacatacctggagatgggagctgtggagctcaggggccgctctgccgtggagctgggtgctggcacggggctggtgggcatagtggctgccctgctgggtgctcatgtgactatcacggatcgaaaagtagcattagaatttcttaaatcaaacgttcaagccaacttacctcctcatatccaaactaaaactgttgttaaggagctgacttggggacaaaatttggggagtttttctcctggagaatttgacctgatacttggtgctgatatcatatatttagaagaaacattcacagatcttcttcagacactggaacatctctgtagcaatcactctgtgattcttttagcatgccgaattcgctatgaacgggataacaacttcttagcaatgctggagaggcaatttactgtgagaaaggttcactacgatcctgaaaaagatgtacatatttacgaagcacagaagagaaaccagaaggaggacttataattggctataatttataagaatgttgtcattgagtgtgtcacttaaggtcttagactgcaaatctaa

SEQ ID NO: 153510 - DNA, 869 bp, Homo sapiens
  Payload ID: 10194
  Gene Symbol: METTL21A
  Gene Name: methyltransferase like 21A
  Uniprot ID: Q8WXB1
  ENST ID: ENST00000425132
  CDS Start-End: 145-417
cgggccggggccgcccgcccccgcgtcgcgggctctttaaggccggcggttttcgcagccagcccggggcggggaaagcggagcgcgcgctccacgcgggaccgcctcccgggccgtctgagcagagggcggggtgcaggcggaatggccctcgtgccctatgaggagaccacggaatttgggttgcagaaattccacaagcctcttgcaactttttcctttgcaaaccacacgatccagatccggcaggactggagacacctgggagtcgcagcggtggtttgggatgcggccatcgttctttccacatacctggagatgggagctgtggagctcaggggccgctctgccgtggagctgggtgctggcacggggctggtgggcatagtggctgccctgctgggaggtggaatttaattctcctccccttgaatatgggctggacaaagagaaaaatggtagctcaacagtggagacacctggacagcactttaaccaagtgatcaaagttaatatcgccaattatgtatgtgctcccggatgtgatgttatgagaaaggcacactatacctctgtggaattcctccccaaaacctattatctcaatctatccatagaaaacactggacaaatgcaaactgagggatattctaaaagaaaacagatcactactcttcaaaagttacaaggccatcaaagacaaggaaacaaactttcacagactgaaggagactataattaaatgcgatatggtacccaaactggattatgtaagtaaaaaaactggggaaataaaatgtataattcagttaatggtattataccaatgtacttttatttttgataaatgtaccctggttatgtaatat

SEQ ID NO: 153511 - DNA, 1051 bp, Homo sapiens
  Payload ID: 10194
  Gene Symbol: METTL21A
  Gene Name: methyltransferase like 21A
  Uniprot ID: Q8WXB1
  ENST ID: ENST00000426075
  CDS Start-End: 192-848
gattcggaagagccatgcaaaagaaattggacaaaggcttcctccacctgtttctttttttcttttgaacttgtaaacgaccttaaaagcatttggagttagttaagaacagataatgtatcttttggccagagcgtcacccaggattcttttgcacggcaggtctgagcagagggcggggtgcaggcggaatggccctcgtgccctatgaggagaccacggaatttgggttgcagaaattccacaagcctcttgcaactttttcctttgcaaaccacacgatccagatccggcaggactggagacacctgggagtcgcagcggtggtttgggatgcggccatcgttctttccacatacctggagatgggagctgtggagctcaggggccgctctgccgtggagctgggtgctggcacggggctggtgggcatagtggctgccctgctgggtgctcatgtgactatcacggatcgaaaagtagcattagaatttcttaaatcaaacgttcaagccaacttacctcctcatatccaaactaaaactgttgttaaggagctgacttggggacaaaatttggggagtttttctcctggagaatttgacctgatacttggtgctgatatcatatatttagaagaaacattcacagatcttcttcagacactggaacatctctgtagcaatcactctgtgattcttttagcatgccgaattcgctatgaacgggataacaacttcttagcaatgctggagaggcaatttactgtgagaaaggttcactacgatcctgaaaaagatgtacatatttacgaagcacagaagagaaaccagaaggaggacttataattggctataatttataagaatgttgtcattgagtgtgtcacttaaggtcttagactgcaaatctaaccatatttaatgaaatgtcttactgtacaaaaagtctaagccaaaggttctcaggggagaaagcacatgtgcagttttaaaacaaagcagtgctttgtcccattgctgtgatttttagtcagactttactcagtctg

SEQ ID NO: 153512 - DNA, 1770 bp, Homo sapiens
  Payload ID: 10194
  Gene Symbol: METTL21A
  Gene Name: methyltransferase like 21A
  Uniprot ID: Q8WXB1
  ENST ID: ENST00000448007
  CDS Start-End: 172-828
ccagtgtcgctcacttccagggtcggggagacggaactgcggcgaccatgtatttctggtttatcaaaccgctaacacccagtctaagggcaggttctgtcccattgttatcactatcgaagcagccgatggaggaggggaggtctgagcagagggcggggtgcaggcggaatggccctcgtgccctatgaggagaccacggaatttgggttgcagaaattccacaagcctcttgcaactttttcctttgcaaaccacacgatccagatccggcaggactggagacacctgggagtcgcagcggtggtttgggatgcggccatcgttctttccacatacctggagatgggagctgtggagctcaggggccgctctgccgtggagctgggtgctggcacggggctggtgggcatagtggctgccctgctgggtgctcatgtgactatcacggatcgaaaagtagcattagaatttcttaaatcaaacgttcaagccaacttacctcctcatatccaaactaaaactgttgttaaggagctgacttggggacaaaatttggggagtttttctcctggagaatttgacctgatacttggtgctgatatcatatatttagaagaaacattcacagatcttcttcagacactggaacatctctgtagcaatcactctgtgattcttttagcatgccgaattcgctatgaacgggataacaacttcttagcaatgctggagaggcaatttactgtgagaaaggttcactacgatcctgaaaaagatgtacatatttacgaagcacagaagagaaaccagaaggaggacttataattggctataatttataagaatgttgtcattgagtgtgtcacttaaggtcttagactgcaaatctaaccatatttaatgaaatgtcttactgtacaaaaagtctaagccaaaggttctcaggggagaaagcacatgtgcagttttaaaacaaagcagtgctttgtcccattgctgtgatttttagtcagactttactcagtctgaaatgcaattaacattaaaggattaagtgtgagatttcgatttatgctatttgtgtatcccatactcctcccttttaataaacagtttccactgatgatatgaagggccggtataaagaagtctttaaatgagtaagctttcttggtaagattaaatcttacaaattatttttaaaaccttgtgatatatacaatgtttagctgagttttctaattttctggatgtaaaacaaaaggtttaacctatacattccttgagctgttagtgctatttaaatcttttgccctgtttaggtcctaaacacttttagttgagtaggatatgagcttttttgggtctcatatcatgctttttgccttaatttcaggtatatatatatatataaataaaggaattaagtaaaaataaaatttcagttactttttaaaagcacctgaaatctggccggatgcggtggctcatgcctgtaatcccaccactttgggaggccgaggcgggcagatcacctgaggtcaggagttcaagaccagcctggccaacatggtgaaaccccatctctactaaaaatacaaaaattagccgggcgtggtgtcaggcgcctgtaatcccagctactcaggaggctgaggcaggagaatcgcttgaacctgggaggcagaggttgcagtgagctgagattgcaccattgtactccagcctgggggacaagagcgagactccatctcaaaaaaaaaaaaa

SEQ ID NO: 153513 - DNA, 869 bp, Homo sapiens
  Payload ID: 10194
  Gene Symbol: METTL21A
  Gene Name: methyltransferase like 21A
  ENST ID: ENST00000448823
  CDS Start-End: 6-164
gcggaatggccctcgtgccctatgaggagaccacggaatttgggttgcagaaattccacaagcctcttgcaactttttcctttgcaaaccacacgatccagatccggcaggactggagacacctgggagtcgcagcggtggtttgggatgcggtgctcatgtgactatcacggatcgaaaagtagcattagaatttcttaaatcaaacgttcaagccaacttacctcctcatatccaaactaaaactgttgttaaggagctgacttggggacaaaatttggggagtttttctcctggagaatttgacctgatacttggtgctgatatcatatatttagaagaaacattcacagatcttcttcagacactggaacatctctgtagcaatcactctgtgattcttttagcatgccgaattcgctatgaacgggataacaacttcttagcaatgctggagaggcaatttactgtgagaaaggttcactacgatcctgaaaaagatgtacatatttacgaagcacagaagagaaaccagaaggaggacttataattggctataatttataagaatgttgtcattgagtgtgtcacttaaggtcttagactgcaaatctaaccatatttaatgaaatgtcttactgtacaaaaagtctaagccaaaggttctcaggggagaaagcacatgtgcagttttaaaacaaagcagtgctttgtcccattgctgtgatttttagtcagactttactcagtctgaaatgcaattaacattaaaggattaagtgtgagatttcgatttatgctatttgtgtatcccatactcctcccttttaataaacagtttccactgatgatatgaagggccggtataa

SEQ ID NO: 153514 - DNA, 4805 bp, Homo sapiens
  Payload ID: 10194
  Gene Symbol: METTL21A
  Gene Name: methyltransferase like 21A
  Uniprot ID: Q8WXB1
  ENST ID: ENST00000411432
  CDS Start-End: 218-874
gcggcgcctcagcccggcctgggcgagccctgggtgctccgccgggcagctcacggcgccccgtatggcctggggatcctaagaggccctgtgacccccctcgcctggtctccctctcacccctggagggttgccgcagctccggggcccccgggcaggaagggcgcactggtcgtcccgggagaggggtctgagcagagggcggggtgcaggcggaatggccctcgtgccctatgaggagaccacggaatttgggttgcagaaattccacaagcctcttgcaactttttcctttgcaaaccacacgatccagatccggcaggactggagacacctgggagtcgcagcggtggtttgggatgcggccatcgttctttccacatacctggagatgggagctgtggagctcaggggccgctctgccgtggagctgggtgctggcacggggctggtgggcatagtggctgccctgctgggtgctcatgtgactatcacggatcgaaaagtagcattagaatttcttaaatcaaacgttcaagccaacttacctcctcatatccaaactaaaactgttgttaaggagctgacttggggacaaaatttggggagtttttctcctggagaatttgacctgatacttggtgctgatatcatatatttagaagaaacattcacagatcttcttcagacactggaacatctctgtagcaatcactctgtgattcttttagcatgccgaattcgctatgaacgggataacaacttcttagcaatgctggagaggcaatttactgtgagaaaggttcactacgatcctgaaaaagatgtacatatttacgaagcacagaagagaaaccagaaggaggacttataattggctataatttataagaatgttgtcattgagtgtgtcacttaaggtcttagactgcaaatctaaccatatttaatgaaatgtcttactgtacaaaaagtctaagccaaaggttctcaggggagaaagcacatgtgcagttttaaaacaaagcagtgctttgtcccattgctgtgatttttagtcagactttactcagtctgaaatgcaattaacattaaaggattaagtgtgagatttcgatttatgctatttgtgtatcccatactcctcccttttaataaacagtttccactgatgatatgaagggccggtataaagaagtctttaaatgagtaagctttcttggtaagattaaatcttacaaattatttttaaaaccttgtgatatatacaatgtttagctgagttttctaattttctggatgtaaaacaaaaggtttaacctatacattccttgagctgttagtgctatttaaatcttttgccctgtttaggtcctaaacacttttagttgagtaggatatgagcttttttgggtctcatatcatgctttttgccttaatttcaggtatatatatatatataaataaaggaattaagtaaaaataaaatttcagttactttttaaaagcacctgaaatctggccggatgcggtggctcatgcctgtaatcccaccactttgggaggccgaggcgggcagatcacctgaggtcaggagttcaagaccagcctggccaacatggtgaaaccccatctctactaaaaatacaaaaattagccgggcgtggtgtcaggcgcctgtaatcccagctactcaggaggctgaggcaggagaatcgcttgaacctgggaggcagaggttgcagtgagctgagattgcaccattgtactccagcctgggggacaagagcgagactccatctcaaaaaaaaaaaaaaaaaaaaaaaaaaaaagcacctgaaatcttgaataggttttctttttttttttttttttttaattaatttattttttttttattgatcattcttgggtgtttctcgcagagggggatttggcagggtcataggacaatagtggagggaaggtcagcagataaacaagtgaacaaaggtctctggttttcctaggcagaggaccctgcggccttggccttccgcagtgtttgtgtccctgggtacttaagattagggagtggtgatgactcttaacgagcatgctgccttcaagcatctgtttaacaaagcacatcttgcaccgcccttaatccatttaaccctgagtggacacagcacatgtttcagagagcacagggttggggataaggtcacagatcaacaggatcccaaggcagaagaatttttcttagtacagaacaaaatgaaaagtctcccatgtctacttctatccacacagacccggcaaccatccgatttctcaattttttccccacccttcccgcctttctattccacaaaaccgccattgtcatcgtggcccatccccaatgagccgctgggcacacctcccagacggggtcgtggccgggcagaggggctcctcacttcccagtaggggcggccgggcagaagcgcccctcacctcccggatggggcggctggccgggcggggggctgacccccccaccaccctcccggacggggcggctggccaggcagaggggctcctcacttcccagtagggacggccgggcagacgcgcccctcacctcctggatagggcggctggctgggcggggggctgtcccccccacctccctcccggacggggcggctggccgggcagaggggtcctcacttcccagtaggggcggccgggcagaggcgcccctcacctcccggacggggcggccggccggaaggggggctgaccccccccacctccctcccggaccgggcggctggccgacccccccccccccccccgcctccctcccggacggggcggctggccgggcagaggggctcctcactttccagtaggggcggccgggcagaggcgcccctcacctcccggacggggcgactggccaggcggggggctgacccccccacctccctcccggatggggcagctggccaggtgggaggatgacccccccacctccctcccgggcggggcggctggccgggcagaggggctcctcacttcccagtaggggcggccgggcagaggcgcccctcacctcccggatggggcggctggccaggcggggggctgatccccccacctccctcccggacggggcggctggccaggcagaggggctcctcacttcccagtaggggcggccgggcagaggagcccctcacctcccggacggggcggctggccgggcggggggctgaccccccccacctccctcccggacggggtggctgctgggcggagacgctcctcacttcccagacggggtggttgccggacggaggggctcctcacttctcagacggggcggttgccaggcagagggtttcctcacttctcagacggagcggccgggcagagacgctccccacctcccagacagggctgcggcccagcagaggcgctcctcacatcccagacagggcggcggggcagaggtgctccccacatctcagacgatgggcggccgggcagagacgctcctcacttcctagatgggatggcggcggggaagaggcgctcctcgcttcccagatgggatggcggccgggcagagacgctcctcactttccagactgggcagccaggcagaggggctcctcacatcccagacgatgggtggccaagcagagacgctcctcacttcccagacggggtggcggccaggcagaggctgcaatctcggctctccgggaggccaaggcaggcggctgggaggtggttgcagcgagccgagatcacgccactgcactccagcctgggcaccattgagcactgagtgaacgagactccatctgcaatcccggcacctcgggaggccgaggctggcggatcactcgcggctaggagctggagaccagcccggccaacacagcgaaaccccgtctccaccaaaaaaaaccgaaaaccagtcaggcgtggcggtgcgcgcctgcaatcgcaggcactcggcaggctgaggcaggagaatcaggcagggaggttgcagtgagccgagatggcagcagtaccgtccagccttggctcggcatcagagggagaccgtggagggagagggagagggagagggagagggagggggagggagagggagagggagggaataggttttctatttcaagtcaagagctgaggttttccccttctgttttacccttgctcaaatgtcttaatgcagttctttcccaagctttccctgcttccttaacaacgcataggatgacattaaaagttttaaatctcatccctgcctgagaggttagcttcctacatataagctccttttgtattggacttgtaattgctcattcagtggtagtattgccctgtagagtgtaagctccttgagggccaagaatgcttctgcctcttccattgttgcttccccagtaccttctgtatatttcataaccaaataatgaaaaagatacattccatttaaagggcattgactttgggttaaatgattgttatattgttttaggattatctatgatacactttgacatctcacacacacacatgaacttttctttttacaatgcaaaagtttaaacaatagcttaaatttagactgcaagaatattataatctcaatatggtatttggtactagagatagatttcttttataaaatcttaaaaacaggacgttctcttccttttgaacctttatcccagaggtgaaaatatccaatatgttgttttctgcatatattgaagtagtagtttcactttaataaagatggattaaaagtt

SEQ ID NO: 153515 - DNA, 869 bp, Homo sapiens
  Payload ID: 10194
  Gene Symbol: METTL21A
  Gene Name: methyltransferase like 21A
  ENST ID: ENST00000432416
  CDS Start-End: 90-473
ggttgccgcagctccggggcccccgggcaggaagggcgcactggtcgtcccgggagaggggtctgagcagagggcggggtgcaggcggaatggccctcgtgccctatgaggagaccacggaatttgggttgcagaaattccacaagcctcttgcaactttttcctttgcaaaccacacgatccagatccggcaggactggagacacctgggagtcgcagcggtggtttgggatgcggccatcgttctttccacatacctggagatgggagctgtggagctcaggggccgctctgccgtggagctgggtgctggcacggggctggtgggcatagtggctgccctgctggaaaacactggacaaatgcaaactgagggatattctaaaagaaaacagatcactactcttcaaaagttacaaggccatcaaagacaaggaaacaaactttcacagactgaaggagactataattaaatgcgatatggtacccaaactggattatgaagagttcattcccactccactgactttgggcttgtccttgcctgtgctgtggctaacagatcacgagtagatgtaacgttcaccaaaatcaagcaaatgctttcaaaagcattgcccttttctcaaagacgtgctgctctatctagcccaggatcctagacccagatgggcacatgaaggagagccacagcaactgacctgcagctgccaaaatgtaacagaagtgaggaagaaattttaagacactgagattcgtggttgttactgtagcaacacaaattaacagaagagctgtctacactttcttttagaatgtttaccacttaccttcatcttgaaataaatggcaatttggatagtgatgaa

SEQ ID NO: 153516 - DNA, 2563 bp, Homo sapiens
  Payload ID: 10195
  Gene Symbol: METTL21B
  Gene Name: methyltransferase like 21B
  Uniprot ID: Q96AZ1
  ENST ID: ENST00000300209
  CDS Start-End: 126-806
ctcagggaggcggggctcgttccacagggacaccacgacggctcgcggcccccagcctctaccccgctccggatccgggatctgagcgccggccgcggtgcccaggcactcccttggcgggccggatggcggaccccggcccagatcccgaatctgagtcggaatcggtgttcccgcgggaggtcgggctctttgcagactcttactcggagaagagccagttctgtttctgtgggcatgtgctgaccatcacgcagaactttgggtcccgcctcggggtggcggcgcgcgtgtgggacgcggccctgagcctgtgcaattatttcgagagtcaaaatgtggatttccgaggcaagaaggtgatcgaactgggtgcggggacaggcatcgtggggatcttggcagcgctgcaggggggggatgttaccatcactgacctgcccctggccctagaacagatccagggcaacgtccaggccaatgtgccagctggaggccaggcccaggtgcgtgccttgtcctgggggattgaccatcatgtcttccctgcaaactatgacctggtgctgggggctgatatcgtgtacctggaacccaccttccctctgctgctggggaccctccaacacctgtgcaggccccatggcaccatctatctggcctccaagatgagaaaggagcatgggacagagagcttctttcagcacctcctgccccagcatttccaactggagctggctcagcgggatgaggatgaaaatgtcaacatctatagggccaggcacagggaaccaagacctgcttgacatcacccttgctgttcttctcaatctcttgctctaatgaaggaactgtgtatctcaaaaaccatatttccagagccacaaacatgaggaccaaaaaggatggatttccctggcctctctcactttcctccttccctctttgttaccccagatactcttgggcaggtgcagtgaggtgcctgcttacaaggaatcccagagttctggcagcactagtgttagaacaccaaggaggttcctggctcctgttctcagagaaggaggatggtaaggtatccaggatttttagggggtaagggagatatatgggatgtgagagcagtgattgtagacagactgtcactgatcacttccattcctgttgctgtttacacagaatggactttaaaaaaattctgtgggatttttttttctttttttctttttttttgagacagggtctcactctgtcatccaggctggagtgcagtggtgtgatcacagctcactgcagcctcaacctctgaaggcccagatgatcttcctgcctcagctccccaagtagctgggactagaggcatgcgccaccacacccggctaatttttgtattttcagtagagacagggtttcgccatgttgcccagggtggtctcaaactcctgggctcaagtgatccacccgccttgcctcccaaagtgctgggattgcaggcatggcccactgtgctagcctaggatttttttttttttttaagaaagaattaagccttaaaaatctattgtgcaagaacccaacttttactcaggagctgagaaggaagaagcctcaaaccacccatttcctgctttttagagatagagtctagtggaaccatggctctaactgggtcaagtcctcctagctctgaagctaaggctgcagagctgtcctttggactgtatttcttcatgctttccagagttagagccttgatcacggaacatcattgtgtgcagaagaatactgtacctagtactaagttcttttcatctttgatttttctttagcttcatcagtccttccttcctaatctctaatcccctgaagcctaacacagttcctaatgtgttttgccttaacctcttttctcttcccacattggtacttctggttggggctctctttacttactgcttaggcacatagtcaccttctctggactccctgcttccatgctttctccttcagtccattccgcaaactcttgtgatcttccaaaattagctctgattagctttcacttcctgtagaagcaagaacaagctcctctgcttggtacttagtctgtgtccatgtgatccaaaattaccttcctattgcatttcctactcctttgctacgtgtattggacctctggccaaattacaaaagatgtactctttgttctctaaaaccacactaaagttttctgacttctttcacactctttatgataatcctctgcctgaaaggctattgccacctgtcaaaatcttcattattctttgcctctttcctgagcctcttgcttgaatgtgatttctttctccctgagacccataaggttcatcttatgggaccttaatttgtcttgcatggacatttgtgattctcattttctcaccattaaattaccttggagggtagggctgtggtttactcctgtctaaacccctgaagcctaacacagttcctggcacacaacaggtgttcaacagatattgtgctcattcaataaatatttactcgctttgtttaa

SEQ ID NO: 153517 - DNA, 2762 bp, Homo sapiens
  Payload ID: 10195
  Gene Symbol: METTL21B
  Gene Name: methyltransferase like 21B
  Uniprot ID: Q96AZ1
  ENST ID: ENST00000333012
  CDS Start-End: 48-497
gatctgagcgccggccgcggtgcccaggcactcccttggcgggccggatggcggaccccggcccagatcccgaatctgagtcggaatcggtgttcccgcgggaggtcgggctctttgcagactcttactcggagaagagccagttctgtttctgtgggcatgtgctgaccatcacgcagaactttgggtcccgcctcggggtggcggcgcgcgtgtgggacgcggccctgagcctgtgcaattatttcgagagtcaaaatgtggatttccgaggcaagaaggtgatcgaactgggtgcggggacaggcatcgtggggatcttggcagcgctgcagggagcttatggtctagtgagggagacagaggacgatgtcatagaacaagaactctggcgaggtatgcgtggagcctgtggacatgctctatccatgtctaccatgactccctgggaatccatcaagggaagctctgtcagggggggatgttaccatcactgacctgcccctggccctagaacagatccagggcaacgtccaggccaatgtgccagctggaggccaggcccaggtgcgtgccttgtcctgggggattgaccatcatgtcttccctgcaaactatgacctggtgctgggggctgatatcgtgtacctggaacccaccttccctctgctgctggggaccctccaacacctgtgcaggccccatggcaccatctatctggcctccaagatgagaaaggagcatgggacagagagcttctttcagcacctcctgccccagcatttccaactggagctggctcagcgggatgaggatgaaaatgtcaacatctatagggccaggcacagggaaccaagacctgcttgacatcacccttgctgttcttctcaatctcttgctctaatgaaggaactgtgtatctcaaaaaccatatttccagagccacaaacatgaggaccaaaaaggatggatttccctggcctctctcactttcctccttccctctttgttaccccagatactcttgggcaggtgcagtgaggtgcctgcttacaaggaatcccagagttctggcagcactagtgttagaacaccaaggaggttcctggctcctgttctcagagaaggaggatggtaaggtatccaggatttttagggggtaagggagatatatgggatgtgagagcagtgattgtagacagactgtcactgatcacttccattcctgttgctgtttacacagaatggactttaaaaaaattctgtgggatttttttttctttttttctttttttttgagacagggtctcactctgtcatccaggctggagtgcagtggtgtgatcacagctcactgcagcctcaacctctgaaggcccagatgatcttcctgcctcagctccccaagtagctgggactagaggcatgcgccaccacacccggctaatttttgtattttcagtagagacagggtttcgccatgttgcccagggtggtctcaaactcctgggctcaagtgatccacccgccttgcctcccaaagtgctgggattgcaggcatggcccactgtgctagcctaggatttttttttttttttaagaaagaattaagccttaaaaatctattgtgcaagaacccaacttttactcaggagctgagaaggaagaagcctcaaaccacccatttcctgctttttagagatagagtctagtggaaccatggctctaactgggtcaagtcctcctagctctgaagctaaggctgcagagctgtcctttggactgtatttcttcatgctttccagagttagagccttgatcacggaacatcattgtgtgcagaagaatactgtacctagtactaagttcttttcatctttgatttttctttagcttcatcagtccttccttcctaatctctaatcccctgaagcctaacacagttcctaatgtgttttgccttaacctcttttctcttcccacattggtacttctggttggggctctctttacttactgcttaggcacatagtcaccttctctggactccctgcttccatgctttctccttcagtccattccgcaaactcttgtgatcttccaaaattagctctgattagctttcacttcctgtagaagcaagaacaagctcctctgcttggtacttagtctgtgtccatgtgatccaaaattaccttcctattgcatttcctactcctttgctacgtgtattggacctctggccaaattacaaaagatgtactctttgttctctaaaaccacactaaagttttctgacttctttcacactctttatgataatcctctgcctgaaaggctattgccacctgtcaaaatcttcattattctttgcctctttcctgagcctcttgcttgaatgtgatttctttctccctgagacccataaggttcatcttatgggaccttaatttgtcttgcatggacatttgtgattctcattttctcaccattaaattaccttggagggtagggctgtggtttactcctgtctaaacccctgaagcctaacacagttcctggcacacaacaggtgttcaacagatattgtgctcattcaataaatatttactcgctttgtttaatggattccacccctgccttcctaggtgaccttggacaaattctcgaacccattcaccaaccacacaagtttgttgtgagtcataaatggataatgaatataaatgcgcattgaaaataaacataaaatgttacccaca

SEQ ID NO: 153518 - DNA, 561 bp, Homo sapiens
  Payload ID: 10195
  Gene Symbol: METTL21B
  Gene Name: methyltransferase like 21B
  ENST ID: ENST00000548256
  CDS Start-End: 84-407
acttctggcggttgatgtgaccctggccgggtaactgccctttctggggcacaagttccccttctcccgagactggctgcctaatgcactgggatcctactttgtgtttgtgctctgcggggagggaaggtaaggccctgagcctgtgcaattatttcgagagtcaaaatgtggatttccgaggcaagaaggtgatcgaactgggtgcggggacaggcatcgtggggatcttggcagcgctgcagggagcttatggtctagtgagggagacagaggacgatgtcatagaacaagaactctggcgaggtatgcgtggagcctgtggacatgctctatccatgtctaccatgactccctgggaatccatcaagggaagctctgtcagggggggatgttaccatcactgacctgcccctggccctagaacagatccagggcaacgtccaggccaatgtgccagctggaggccaggcccaggtgcgtgccttgtcctgggggattgaccatcatgtcttccctgcaaactatgacctggtgctgggggctgatatcgtgtacctg

SEQ ID NO: 153519 - DNA, 836 bp, Homo sapiens
  Payload ID: 10195
  Gene Symbol: METTL21B
  Gene Name: methyltransferase like 21B
  ENST ID: ENST00000551420
  CDS Start-End: 565-702
aaattcagctgggctgggctgggctgggctgggctaggtggggagggctgtaaggagcgagtgctggagggaacctccgcaccgttagcctccaactgggagggcgaggccaggcccagggacccaacgttttctcttagcttgcttctgcctggtctgggttaccatcctggttgcaggcacctgtgcaccccacaggccctgagcctgtgcaattatttcgagagtcaaaatgtggatttccgaggcaagaaggtgatcgaactgggtgcggggacaggcatcgtggggatcttggcagcgctgcaggggggggatgttaccatcactgacctgcccctggccctagaacagatccagggcaacgtccaggccaatgtgccagctggaggccaggcccaggtgcgtgccttgtcctgggggattgaccatcatgtcttccctgcaaactatgacctggtgctgggggctgatatcgtgtacctggaacccaccttccctctgctgctggggaccctccaacacctgtgcaggccccatggcaccatctatctggcctccaagatgagaaaggagcatgggacagagagcttctttcagcacctcctgccccagcatttccaactggagctggctcagcgggatgaggatgaaaatgtcaacatctatagggccaggcacagggaaccaagacctgcttgacatcacccttgctgttcttctcaatctcttgctctaatgaaggaactgtgtatctcaaaaaccatatttccagagccacaaacatgaggaccaaaaaggatggatttccctggcctctctcactttcctccttc

SEQ ID NO: 153520 - DNA, 30 bp, Homo sapiens
  Payload ID: 10195
  Gene Symbol: METTL21B
  Gene Name: methyltransferase like 21B
  ENST ID: ENST00000630957
  CDS Start-End: 1-30
tcgaacccattcaccaaccacacaactaga

SEQ ID NO: 153521 - DNA, 1088 bp, Homo sapiens
  Payload ID: 10196
  Gene Symbol: METTL21C
  Gene Name: methyltransferase like 21C
  Uniprot ID: Q5VZV1
  ENST ID: ENST00000267273
  CDS Start-End: 7-801
ccggctatggacgtgtgtctgagctccgcgcagcagcctgggcgccggggggaaggactcagctccccgggtggctggttagaggctgagaagaagggggctccgcagaaagacagcaccgggggagtcctagaagaatccaacaagatagaaccatctcttcatagcctccagaaatttgttcctacagattacgccagctacactcaggagcattatcggtttgcaggaaaggagattgtcatccaggaatccatagagagttacggagcggtggtgtggccaggggctatggctttgtgtcaatacttggaggaacatgccgaggaattgaatttccaagatgcaaaaatacttgaaattggtgccggaccaggccttgtttccattgtggccagtattttaggagctcaagtcacagcaacagatttgcctgatgtcctgggaaaccttcaatacaatcttttaaaaaacacactacaatgtacagcacatctgcctgaagtgaaagaactggtatggggggaagacctggacaaaaactttcccaagtcagctttttactatgattacgtcctagcctcagatgtggtctaccatcactacttcctggacaagctgctcaccaccatggtgtacctttcccagccagggacggtgctgctttgggcaaacaaattcaggttcagcaccgactatgaatttttagataaattcaagcaagtttttgacacaacactgttggctgaatatccagagtcatcagtcaaactttttaaggggatactaaaatgggactaaatccaacaaaatgcctttcacaacgttactgtgtcttttgagcaatgtgttagaaattgctttggtaatagacttctttcacaggattgagaaggtagtgcatagaaacaacttgtatacttggaacaaatgtaacaatactgcagaaactttctaatttctaagataatttaagattatctggttaatctaaatatctaaaaagaacaacataaaaacatgaaagtagctttgttggttccaacgaagttacatgtttaataaatcttacatggataaagtaataa

SEQ ID NO: 153522 - DNA, 1510 bp, Homo sapiens
  Payload ID: 10197
  Gene Symbol: METTL22
  Gene Name: methyltransferase like 22
  Uniprot ID: Q9BUU2
  ENST ID: ENST00000163678
  CDS Start-End: 256-873
cctgcgcagaccgcctgttatggcggccgcctaagtcccacagagacgggagtcgggtgggatcccaggctgggccccgcggcggctggattctcttccctggccaagtctctgagatcttctcccagggcgatgcaaagctactcgctaccagcttggacctgtctgcagtatctcctctgggacctgccatgctgaggacccattctcacctctgagggactcctgtcctaggactaaggtggagcctgggccatggtacagctggctcctgcggcagccatggacgaggtcacctttaggagcgacactgtgctgtcagatgtccacctctataccccgaaccatagacatctcatggtacggctgaacagcgtggggcagccagttttcctgtcccaattcaagcttctatggagccaagactcttggacagattcaggagccaagggtggcagtcacagagatgttcacacaaaggagcctccttctgctgagacaggcagcacagggtcccctccaggaagtggccatggtaatgagggtttctccctccaggccgggactgacaccactggccaggaagtggctgaagctcagctggatgaggatggggatttggacgtggtgagaagaccacgagccgcctctgattccaacccagcagggcctctgagagacaaggtacatcccatgattctagcacaggaagaagacgacgtcctgggagaggaagcacaaggcagcccgcacgatatcatcagaataggtgtggcggggcgccctgctcctggcagactacatcctgttccgacaggacctcttccgaggatgtacagcgctggagctcggggccggcacggggctcgctagcatcatcgcagccaccatggcacggaccgtttattgtacagatgtcggtgcagatctcttgtccatgtgccagcgaaacattgccctcaacagccacctggctgccactggaggtggtatagttagggtcaaagaactggactggctgaaggacgacctctgcacagatcccaaggtccccttcagttggtcacaagaggaaatttctgacttgtacgatcacaccaccatcctgtttgcagccgaagtgttttacgacgacgacttgactgatgctgtgtttaaaacgctctcccgactcgcccacagattgaaaaatgcctgcacagccatactgtcggtggagaagaggctcaacttcacattgagacacttggacgtcacatgtgaagcctacgatcacttccgctcctgcctgcacgcgctggagcagctcgcagatggcaagctgcgcttcgtggtggagcccgtggaggcctccttcccacagctcctggtttacgagcgcctccagcaactggagctctggaagatcatcgcagaaccagtaacatgacccatcgcctccacaaggcgcggcgtctcgactgttcttagagtgtatttctagtaaaatcagaagctcaccaaagcaaca

SEQ ID NO: 153523 - DNA, 4984 bp, Homo sapiens
  Payload ID: 10197
  Gene Symbol: METTL22
  Gene Name: methyltransferase like 22
  Uniprot ID: Q9BUU2
  ENST ID: ENST00000381920
  CDS Start-End: 259-1473
gcgcctgcgcagaccgcctgttatggcggccgcctaagtcccacagagacgggagtcgggtgggatcccaggctgggccccgcggcggctggattctcttccctggccaagtctctgagatcttctcccagggcgatgcaaagctactcgctaccagcttggacctgtctgcagtatctcctctgggacctgccatgctgaggacccattctcacctctgagggactcctgtcctaggactaaggtggagcctgggccatggtacagctggctcctgcggcagccatggacgaggtcacctttaggagcgacactgtgctgtcagatgtccacctctataccccgaaccatagacatctcatggtacggctgaacagcgtggggcagccagttttcctgtcccaattcaagcttctatggagccaagactcttggacagattcaggagccaagggtggcagtcacagagatgttcacacaaaggagcctccttctgctgagacaggcagcacagggtcccctccaggaagtggccatggtaatgagggtttctccctccaggccgggactgacaccactggccaggaagtggctgaagctcagctggatgaggatggggatttggacgtggtgagaagaccacgagccgcctctgattccaacccagcagggcctctgagagacaaggtacatcccatgattctagcacaggaagaagacgacgtcctgggagaggaagcacaaggcagcccgcacgatatcatcagaatagagcacaccatggccacgcccctggaggatgttggcaagcaggtgtggcggggcgccctgctcctggcagactacatcctgttccgacaggacctcttccgaggatgtacagcgctggagctcggggccggcacggggctcgctagcatcatcgcagccaccatggcacggaccgtttattgtacagatgtcggtgcagatctcttgtccatgtgccagcgaaacattgccctcaacagccacctggctgccactggaggtggtatagttagggtcaaagaactggactggctgaaggacgacctctgcacagatcccaaggtccccttcagttggtcacaagaggaaatttctgacttgtacgatcacaccaccatcctgtttgcagccgaagtgttttacgacgacgacttgactgatgctgtgtttaaaacgctctcccgactcgcccacagattgaaaaatgcctgcacagccatactgtcggtggagaagaggctcaacttcacattgagacacttggacgtcacatgtgaagcctacgatcacttccgctcctgcctgcacgcgctggagcagctcgcagatggcaagctgcgcttcgtggtggagcccgtggaggcctccttcccacagctcctggtttacgagcgcctccagcaactggagctctggaagatcatcgcagaaccagtaacatgacccatcgcctccacaaggcgcggcgtctcgactgttcttagagtgtatttctagtaaaatcagaagctcaccaaagcaacatgcttgagattttgtcattttaaaaatatggttacacgtaccttagatgacccaagatggttttctggggtctgtccctgcctcccagttgtagccagagaaggttgttgctgtgggctggaggtcactttagttgcctgtttctcatggttgtgatgtgtgctccagggtcaagccgagccacgttccttctcagctcagttccacccacgtcagtcatttcagctgtgtgctttacttgcggttgcggccctggctgtgaggtggattcttgtactgccctctgtcagctgtttacagatgggttgactaccactgccagtattgccatcatattgccgctcggcacaaaagcctcatttcctcccagggttgggtatgctccaccccatcactctggtgagggccccatgagaaggaagaggcaggagctggcgccaggaatggactggcattggcctttgtatttaattttaactctttatcacccaaatcaggtacgtttggaataaacctaagagccactctttggggtcatgtgcagctgaccagggtttgtgcagtgatcttcctcagaggtgttcccttccgcctggactcattttccctccgccccttggtctctctgtcttatcacgtgtgtacatgtctgtctgtctggttttttatcttctccatctgtgcctctctcctcccatctccaccccttcctgtcatcctctatgtcccactgtctctctccttctctccagttttggtcccatcttcctgctacccttggccctccctgcagcccctttcccctgccttgctgctgccgcacactttgcaccagggcctttcatggcccctttccgcctcccttgcagctcaggtttcctggcttctccatgcactgtccctgcccacactcgcttctccccaagctcccaggttccatccctaggcccatcatacccctggcattggctaatccctcatgccaggggccaggcacttgcaagtctaacttcatcttcccaacaaatttaggaggtccgcagccttgtgatacccacattacagcggagaagactgaggtccaaaaaggaaaaagtctccatgaggtcagggaccttgtttgtcttaaatatcactacatccctgctgtatggtctggcaaacagtagatgctcaacacatattgttgaatgaattgctaatgtaagttactaattaggtcattatttcctatttgtgagtgattttgcctccaggaacatttggcagtgcctggagacattttcggtggtcacaagtaggggagacgggtgccaccagtatccagtgggtgaggccagagatgctgctgaacgttctataatgcggtaatcacggagcatcccccacaacacaaaatgatccagcccaaaatgtgagtagcgccgaggcggagaaatcctgacttggaagaagaaagccaagtactttagagaagaaaaacggtctcagctgaacctgtagtgagagcatgcaggagagtgacctcaccctgcccctctgggagcaagaagaaaacctatgcatgtacgttattataaatcttcaaagaacctaaaaggcagaagtgatccctattttgcacatgagaaatccaaaattcagagaggttcagcaacttgcccaacatcacacagcaaccaagggcagagtcaggtttagagcccatgtccacccatgtccatctgactcctgagcctgtgcttttcccacattcccgctggagcagcagcagcatctgtggcatcacgtggatgctggttagaaatgcaacatcaggctgagcatgttggctcactcctgcaatcccgatactttgggaggccaaggcaggaggatcaattaaggccaggagttcaaccagcctggacaacaaagcaagaccccatctctattaaaaattaaacagccaattagtctggcatggtggtttgcgcctgcagtcccagctacttgggaggccgaggcaggagaatcgcttgaacctgggaggcgaaggttgcagtgagccaagatcgcaacactgccctccagcctgggcaacagagccagacatctcaaaaattaaaaagccaggcgaggtgccgggcatggtggctcatgcctgtcatcccagcactttgggaggccgaggcgggtggatcacccaaagtcaggagttcaagaccagcctggccaacatggtgaaaccctgcctctactaaaaatacaaaattagccgggtgtggtggctcatgcctgtaatcccagctacttgggaggctgaggcaggagaatcacttgaacccaggaggcagaggttgcagtgagccaagaccatgccattgcactctagcctgggcaacaagagcaaaactccatctcaaaaaaaaaaaaaagccaggcgtagtggctaacgcctgtagtcccaactactcagaaggcaaggtgagaggattgcttgagcctaagaatttgaggctgcagtgagccatgactgcaccattgcactctggcctgggcaacagagagagatcctgtctccaaaaaagaagaaaagtatcaagcctcagctcaggacgtgattccgaatctgcatctcaacgagaccctgggtgatttgtgtgcacagtagtttgagaagctctggggcctaccacatagccctcaacctattgctgttttctaaaattcctacacaaactccgttcctgacagacttgccataatggagcagcattgcagatcactacagggaatattaataatgagtcttcaaatcagaaccccactagacagagccaacaactggcagtacgtcagcactaatggtgacaatttcctagcactcctgggtacaagtccataaatgtaattggcaccaagcaatagagttgtcacagctttcacctgccgcattagggcaaactgcttttatgtctaaaccactgggcctgaaagcttcctctaagtagagcctggaattaatcttgatccactgtaattcaaagtatcgtcagattttcatttcccagagtgggagcgcgcccccattgccatgttttatggccttgtttgagcctctacaagtgcttgtttggcagcgatattcagaatcaccaaaccatggggatgttctgctaggtaattagcccaggccagtggactcaatttttttataacattttcagaaaaatatgtgacccaaggaggggacttggctgttcagctgcagcctgcatgggaaagaactgttaaaaccaacaaagccaggcacagtggctcacacctgtaattccagcattttgggaggccgaggtgggtggatcacctaaggtcaggagttcgagaccagcctggccaacatggtgaaaccccgtctctactaaaaatacaaaaaaaaaaaaaaaaa

SEQ ID NO: 153524 - DNA, 550 bp, Homo sapiens
  Payload ID: 10197
  Gene Symbol: METTL22
  Gene Name: methyltransferase like 22
  ENST ID: ENST00000564554
  CDS Start-End: 503-550
atggcggccgcctaagtcccacagagacgggagtcgggtgggatcccaggctgggccccgcggcggttgaagaagtgggggccctgaagatttcatgacatctacccaggtaggaacagctcctataggcagtcaggggttacaggcaggtttgggtcaaatacctgaaaccaaccccaggacaaggaggttgctggtgttttattaacacctactgtgagccaaggactctgctcagcagtttacccacccagtaacactgcgtgagattgtggctgaagaaacagatgcagagaggcgaagtgattttcctgaaatcacatggctagaagctggattctcttccctggccaagtctctgagatcttctcccagggcgatgcaaagctactcgctaccagcttggacctgtctgcagtatctcctctgggacctgccatgctgaggacccattctcacctctgagggactcctgtcctaggactaaggtggagcctgggccatggtacagctggctcctgcggcagccatggacgaggtcacctttagg

SEQ ID NO: 153525 - DNA, 1312 bp, Homo sapiens
  Payload ID: 10197
  Gene Symbol: METTL22
  Gene Name: methyltransferase like 22
  ENST ID: ENST00000561758
  CDS Start-End: 218-1264
cacagagacgggagtcgggtgggatcccaggctgggccccgcggcggctggattctcttccctggccaagtctctgagatcttctcccagggcgatgcaaagctactcgctaccagcttggacctgtctgcagtatctcctctgggacctgccatgctgaggacccattctcacctctgagggactcctgtcctaggactaaggtggagcctgggccatggtacagctggctcctgcggcagccatggacgaggtcacctttaggagcgacactgtgctgtcagatgtccacctctataccccgaaccatagacatctcatggtacggctgaacagcgtggggcagccagttttcctgtcccaattcaagcttctatggagccaagactcttggacagattcaggagccaagggtggcagtcacagagatgttcacacaaaggagcctccttctgctgagacaggcagcacagggtcccctccaggaagtggccatgcacaggaagaagacgacgtcctgggagaggaagcacaaggcagcccgcacgatatcatcagaatagagcacaccatggccacgcccctggaggatgttggcaagcaggtgtggcggggcgccctgctcctggcagactacatcctgttccgacaggacctcttccgaggatgtacagcgctggagctcggggccggcacggggctcgctagcatcatcgcagccaccatggcacggaccgtttattgtacagatgtcggtgcagatctcttgtccatgtgccagcgaaacattgccctcaacagccacctggctgccactggaggtggtatagttagggtcaaagaactggactggctgaaggacgacctctgcacagatcccaaggtccccttcagttggtcacaagaggaaatttctgacttgtacgatcacaccaccatcctgtttgcagccgaagtgttttacgacgacgacttgactgatgctgtgtttaaaacgctctcccgactcgcccacagattgaaaaatgcctgcacagccatactgtcggtggagaagaggctcaacttcacattgagacacttggacgtcacatgtgaagcctacgatcacttccgctcctgcctgcacgcgctggagcagctcgcagatggcaagctgcgcttcgtggtggagcccgtggaggcctccttcccacagctcctggtttacgagcgcctccagcaactggagctctggaagatcatcgcagaaccagtaacatgacccatcgcctccacaaggcgcggcgtctcgactgttcttagagtgtat

SEQ ID NO: 153526 - DNA, 561 bp, Homo sapiens
  Payload ID: 10197
  Gene Symbol: METTL22
  Gene Name: methyltransferase like 22
  ENST ID: ENST00000565866
  CDS Start-End: 1-140
gtggtatagttagggtcaaagaactggactggctgaaggacgacctctgcacaggtgttgtggtttccctgtgtggtagcatgataatccctgaattatcccaaggtccccttcagttggtcacaagaggaaatttctgacttgtacgatcacaccaccatcctgtttgcagccgaagtgttttacgacgacgacttgactgatgctgtgtttaaaacgctctcccgactcgcccacagattgaaaaatgcctgcacagccatactgtcggtggagaagaggctcaacttcacattgagacacttggacgtcacatgtgaagcctacgatcacttccgctcctgcctgcacgcgctggagcagctcgcagatggcaagctgcgcttcgtggtggagcccgtggaggcctccttcccacagctcctggtttacgagcgcctccagcaactggagctctggaagatcatcgcagaaccagtaacatgacccatcgcctccacaaggcgcggcgtctcgactgttcttagagtgtatttctagtaaaatcagaagctcaccaaa

SEQ ID NO: 153527 - DNA, 614 bp, Homo sapiens
  Payload ID: 10197
  Gene Symbol: METTL22
  Gene Name: methyltransferase like 22
  ENST ID: ENST00000563958
  CDS Start-End: 403-614
gggccgcgcctgcgcagaccgcctgttatggcggccgcctaagtcccacagagacgggagtcgggtgggatcccaggctgggccccgcggcggcttttgctgccccacagcaaccacttaaatgtaggaactccagcagtgtactgggatcattaggacagcctgagtcatgatgacctcattttgcagttgaagaagtgggggccctgaagatttcatgacatctacccagctggattctcttccctggccaagtctctgagatcttctcccagggcgatgcaaagctactcgctaccagcttggacctgtctgcagtatctcctctgggacctgccatgctgaggacccattctcacctctgagggactcctgtcctaggactaaggtggagcctgggccatggtacagctggctcctgcggcagccatggacgaggtcacctttaggagcgacactgtgctgtcagatgtccacctctataccccgaaccatagacatctcatggtacggctgaacagcgtggggcagccagttttcctgtcccaattcaagcttctatggagccaagactcttggacagattcaggagccaagggtggcagtcacagaga

SEQ ID NO: 153528 - DNA, 714 bp, Homo sapiens
  Payload ID: 10197
  Gene Symbol: METTL22
  Gene Name: methyltransferase like 22
  ENST ID: ENST00000567295
  CDS Start-End: 215-358
agagacgggagtcgggtgggatcccaggctgggccccgcggcggctggattctcttccctggccaagtctctgagatcttctcccagggcgatgcaaagctactcgctaccagcttggacctgtctgcagtatctcctctgggacctgccatgctgaggacccattctcacctctgagggactcctgtcctaggactaaggtggagcctgggccatggtacagctggctcctgcggcagccatggacgaggtcacctttaggagcgacactgtgctgtcagatgtccacctctataccccgaaccatagacatctcatggtacggctgaacagcgtggggcagccaggccgggactgacaccactggccaggaagtggctgaagctcagctggatgaggatggggatttggacgtggtgagaagaccacgagccgcctctgattccaacccagcagggcctctgagagacaaggtacatcccatgattctagcacaggaagaagacgacgtcctgggagaggaagcacaaggcagcccgcacgatatcatcagaatagagcacaccatggccacgcccctggaggatgttggcaagcaggtgtggcggggcgccctgctcctggcagactacatcctgttccgacaggacctcttccgaggatgtacagcgctggagctcggggccggcacggggctcgctagcatcatcgcag

SEQ ID NO: 153529 - DNA, 706 bp, Homo sapiens
  Payload ID: 10197
  Gene Symbol: METTL22
  Gene Name: methyltransferase like 22
  ENST ID: ENST00000572956
  CDS Start-End: 1-465
cgaggatgtacagcgctggagctcggggccggcacggggctcgctagcatcatcgcagccaccatggcacggaccgtttattgtacagatgtcggtgcagatctcttgtccatgtgccagcgaaacattgccctcaacagccacctggctgccactggaggtggtatagttagggtcaaagaactggactggctgaaggacgacctctgcacagatcccaaggtccccttcagttggtcacaagaggaaatttctgacttgtacgatcacaccaccatcctgtttgcagccgaagtgttttacgacgacgacttgactgatgctgtgtttaaaacgctctcccgactcgcccacagattgaaaaatgcctgcacagccatactgtcggtggagaagagtttgtgcgtccgactggctggtttgcaggctcaacttcacattgagacacttggacgtcacatgtgaagcctacgatcacttccgctcctgcctgcacgcgctggagcagctcgcagatggcaagctgcgcttcgtggtggagcccgtggaggcctccttcccacagctcctggtttacgagcgcctccagcaactggagctctggaagatcatcgcagaaccagtaacatgacccatcgcctccacaaggcgcggcgtctcgactgttcttagagtgtatttctagtaaaatcagaagctcaccaaa

SEQ ID NO: 153530 - DNA, 586 bp, Homo sapiens
  Payload ID: 10197
  Gene Symbol: METTL22
  Gene Name: methyltransferase like 22
  ENST ID: ENST00000562973
  CDS Start-End: 1-312
tacgacgacgacttgactgatgctgtgtttaaaacgctctcccgactcgcccacagattgaaaaatgcctgcacagccatactgtcggtggagaagaggctcaacttcacattgagacacttggacgtcacatgtgaagcctacgatcacttccgctcctgcctgcacgcgctggagcagctcgcagatggcaagctgcgcttcgtggtggagcccgtggaggcctccttcccacagctcctggtttacgagcgcctccagcaactggtaggtccaggccccgaagcagggccgttggttgctttactgtgaagcgggtgactccagggcaaagaggtgatgaagcaagccctccaagcacaggctccaccctagtcctgcagggggtgaagcctgcgtgcctggcaccatctgtagtggaacctgttgggggagctacatcctgttcttagcagccaccatgtctggagacgggcctacaggcgaaccttgtcttttactttatagcacatattccccccgttggacagttcagactccagaggaggcaagaccgaggcagaggttgtttggggaacaggaagtc

SEQ ID NO: 153531 - DNA, 520 bp, Homo sapiens
  Payload ID: 10197
  Gene Symbol: METTL22
  Gene Name: methyltransferase like 22
  ENST ID: ENST00000562151
  CDS Start-End: 1-496
agttagggtcaaagaactggactggctgaaggacgacctctgcacagatcccaaggtccccttcagttggtcacaagaggaaatttctgacttgtacgatcacaccaccatcctgtttgcagccgaagtgttttacgacgacgacttgactgatgctgtgtttaaaacgctctcccgactcgcccacagattgaaaaatgcctgcacagccatactgtcggtggagaagaggctcaacttcacattgagacacttggacgtcacatgtgaagcctacgatcacttccgctcctgcctgcacgcgctggagcagctcgcagatggcaagctgcgcttcgtggtggagcccgtggaggcctccttcccacagctcctggtttacgagcgcctccagcaactgcctctctgccacagtaaaatagaacagcccagagcaacaaagaaaggaggaagccgcccgtccgctcctgccccagctcgcctgctccgtggctgacgtgttgtctaactactctccttg

SEQ ID NO: 153532 - DNA, 1155 bp, Homo sapiens
  Payload ID: 10198
  Gene Symbol: METTL23
  Gene Name: methyltransferase like 23
  Uniprot ID: Q86XA0
  ENST ID: ENST00000341249
  CDS Start-End: 333-905
agttctgcgcgtgtgagtctctttcgccttgctccgggctttcttcgctcgcagcgcggcagggttatcaccagatctgggctttccccttcttgccgtcaggtgctacggccacgtggcccgcggcttcccgctcgcgcagtctggcagcccggagccttccgcggtcccccgcccgcccggggcccaacgacgccctactgggcgagcacgatttccgaggacagggggtccgggcccagcgctttcgattctcggaggagccgggtccgggggccgacggggctgtcctggaggtccacgtcccgcaggtcctgcatctccagtatggaatgtatgtttggccctgtgctgtggtcctggcccagtacctttggtttcacagaagatctctgccaggcaaggccatcttagagattggagctggagtgagccttccaggaattttggctgccaaatgtggtgcagaagtaatactgtcagacagctcagaactgcctcactgtctggaagtctgtcggcaaagctgccaaatgaataacctgccacatctgcaggtggtaggactaacatggggtcatatatcttgggatcttctggctctaccaccacaagatattatccttgcatctgatgtgttctttgaaccagaagattttgaagacattttggctacaatatattttttgatgcacaagaatcccaaggtccaattgtggtctacttatcaagttaggagtgctgactggtcacttgaagctttactctacaaatgggatatgaaatgtgtccacattcctcttgagtcttttgatgcagacaaagaagatatagcagaatctacccttccaggaagacatacagttgaaatgctggtcatttcctttgcaaaggacagtctctgaattatacctacaacctgttctgggacagtatcaatactgatgagcaacctggcacacaaactatgagcagaccacttcagcttgagaatgcagtgggtctgaagatggtcaagtctgtttgccttagattttgatgtcacctagacaacacttaaactcatatgaaacaaaaattaaaatacgtattacaagtacttggattgttccttagtcattaaataggatataaattaggttgagaagggggtat

SEQ ID NO: 153533 - DNA, 617 bp, Homo sapiens
  Payload ID: 10198
  Gene Symbol: METTL23
  Gene Name: methyltransferase like 23
  ENST ID: ENST00000589977
  CDS Start-End: 72-512
gtgcccatcacttccggtcgcgccagccgcccgttgccagttctgcgcgtgtcctgcatctccagtatggaatgtatgtttggccctgtgctgtggtcctggcccagtacctttggtttcacagaagatctctgccaggcaaggccatcttagagattggagctggagtgagccttccaggaattttggctgccaaatgtggtgcagaagtaatactgtcagacagctcagaactgcctcactgtctggaagtctgtcggcaaagctgccaaatgaataacctgccacatctgcaggtggtaggactaacatggggtcatatatcttgggatcttctggctctaccaccacaagatattatccttgcatctgatgtgttctttgaaccagaagattttgaagacattttggctacaatatattttttgatgcacaagaatcccaaggtccaattgtggtctacttatcaagttaggaggcaagtatggatgacccttactttttatatgtaacttaagccttactctaccctacccatgcgatacataatttaagaatagaatacatctgaagcaaaacagaaaaggcatgactttaaaagaacaactttttttttt

SEQ ID NO: 153534 - DNA, 1049 bp, Homo sapiens
  Payload ID: 10198
  Gene Symbol: METTL23
  Gene Name: methyltransferase like 23
  Uniprot ID: Q86XA0
  ENST ID: ENST00000588822
  CDS Start-End: 606-977
ttctgcgcgtgtgagtctctttcgccttgctccgggctttcttcgctcgcagcgcggcagggttatcaccagatctgggctttccccttcttgccgtcaggtgctacggccacgtggcccgcggcttcccgctcgcgcagtctggcagcccggagccttccgcggtcccccgcccgcccggggcccaacgacgccctactgggcgagcacgatttccgaggacagggggtccgggcccagcgctttcgattctcggaggagccgggtccgggggccgacggggctgtcctggaggtccacgtcccgcaggtgcgtgcagcagcacccgccaggaggcgcctgaggtcaggagcggatgtcggctgacttggctgggttcctgagggaccgggggtgcggacgctcagctgcgcagcttcctgctttaggttgacccccggagcaaaaacgtcggatatgaagcccttcggtgcattaaatgtctctcaattggagctggagtgagccttccaggaattttggctgccaaatgtggtgcagaagtaatactgtcagacagctcagaactgcctcactgtctggaagtctgtcggcaaagctgccaaatgaataacctgccacatctgcaggtggtaggactaacatggggtcatatatcttgggatcttctggctctaccaccacaagatattatccttgcatctgatgtgttctttgaaccagaagattttgaagacattttggctacaatatattttttgatgcacaagaatcccaaggtccaattgtggtctacttatcaagttaggagtgctgactggtcacttgaagctttactctacaaatgggatatgaaatgtgtccacattcctcttgagtcttttgatgcagacaaagaagatatagcagaatctacccttccaggaagacatacagttgaaatgctggtcatttcctttgcaaaggacagtctctgaattatacctacaacctgttctgggacagtatcaatactgatgagcaacctggcacacaaactatgagcagac

SEQ ID NO: 153535 - DNA, 1006 bp, Homo sapiens
  Payload ID: 10198
  Gene Symbol: METTL23
  Gene Name: methyltransferase like 23
  Uniprot ID: Q86XA0
  ENST ID: ENST00000590964
  CDS Start-End: 443-814
agccgcccgttgccagttctgcgcgtgtgagtctctttcgccttgctccgggctttcttcgctcgcagcgcggcagggttatcaccagatctgggctttccccttcttgccgtcaggtgctacggccacgtggcccgcggcttcccgctcgcgcagtctggcagcccggagccttccgcggtcccccgcccgcccggggcccaacgacgccctactgggcgagcacgatttccgaggacagggggtccgggcccagcgctttcgattctcggaggagccgggtccgggggccgacggggctgtcctggaggtccacgtcccgcagattggagctggagtgagccttccaggaattttggctgccaaatgtggtgcagaagtaatactgtcagacagctcagaactgcctcactgtctggaagtctgtcggcaaagctgccaaatgaataacctgccacatctgcaggtggtaggactaacatggggtcatatatcttgggatcttctggctctaccaccacaagatattatccttgcatctgatgtgttctttgaaccagaagattttgaagacattttggctacaatatattttttgatgcacaagaatcccaaggtccaattgtggtctacttatcaagttaggagtgctgactggtcacttgaagctttactctacaaatgggatatgaaatgtgtccacattcctcttgagtcttttgatgcagacaaagaagatatagcagaatctacccttccaggaagacatacagttgaaatgctggtcatttcctttgcaaaggacagtctctgaattatacctacaacctgttctgggacagtatcaatactgatgagcaacctggcacacaaactatgagcagaccacttcagcttgagaatgcagtgggtctgaagatggtcaagtctgtttgccttagattttgatgtcacctagacaacacttaaactcatatgaaacaaaaattaaaatacgtattacaag

SEQ ID NO: 153536 - DNA, 465 bp, Homo sapiens
  Payload ID: 10198
  Gene Symbol: METTL23
  Gene Name: methyltransferase like 23
  ENST ID: ENST00000586200
  CDS Start-End: 250-465
gtcaggtgctacggccacgtggcccgcggcttcccgctcgcgcagtctggcagcccggagccttccgcggtcccccgcccgcccggggcccaacgacgccctactgggcgagcacgatttccgaggacagggggtccgggcccagcgctttcgattctcggaggagccgggtccgggggccgacggggctgtcctggaggtccacgtcccgcagattttgaagacattttggctacaatatattttttgatgcacaagaatcccaaggtccaattgtggtctacttatcaagttaggagtgctgactggtcacttgaagctttactctacaaatgggatatgaaatgtgtccacattcctcttgagtcttttgatgcagacaaagaagatatagcagaatctacccttccaggaagacatacagttgaaatgctggtcatttcctttgcaaaggacagtctctga

SEQ ID NO: 153537 - DNA, 904 bp, Homo sapiens
  Payload ID: 10198
  Gene Symbol: METTL23
  Gene Name: methyltransferase like 23
  Uniprot ID: Q86XA0
  ENST ID: ENST00000586752
  CDS Start-End: 481-852
gccagccgcccgttgccagttctgcgcgtgtgagtctctttcgccttgctccgggctttcttcgctcgcagcgcggcagggttatcaccagatctgggctttccccttcttgccgtcaggtgctacggccacgtggcccgcggcttcccgctcgcgcagtctggcagcccggagccttccgcggtcccccgcccgcccggggcccaacgacgccctactgggcgagcacgatttccgaggacagggggtccgggcccagcgctttcgattctcggaggagccgggtccgggggccgacggggctgtcctggaggtccacgtcccgcaggtgcgtgcagcagcacccgccaggaggcgcctgagattggagctggagtgagccttccaggaattttggctgccaaatgtggtgcagaagtaatactgtcagacagctcagaactgcctcactgtctggaagtctgtcggcaaagctgccaaatgaataacctgccacatctgcaggtggtaggactaacatggggtcatatatcttgggatcttctggctctaccaccacaagatattatccttgcatctgatgtgttctttgaaccagaagattttgaagacattttggctacaatatattttttgatgcacaagaatcccaaggtccaattgtggtctacttatcaagttaggagtgctgactggtcacttgaagctttactctacaaatgggatatgaaatgtgtccacattcctcttgagtcttttgatgcagacaaagaagatatagcagaatctacccttccaggaagacatacagttgaaatgctggtcatttcctttgcaaaggacagtctctgaattatacctacaacctgttctgggacagtatcaatactgatgagcaacctgg

SEQ ID NO: 153538 - DNA, 585 bp, Homo sapiens
  Payload ID: 10198
  Gene Symbol: METTL23
  Gene Name: methyltransferase like 23
  ENST ID: ENST00000591571
  CDS Start-End: 159-398
acttccggtcgcgccagccgcccgttgccagttctgcgcgtattggagctggagtgagccttccaggaattttggctgccaaatgtggtgcagaagtaatactgtcagacagctcagaactgcctcactgtctggaagtctgtcggcaaagctgccaaatgaataacctgccacatctgcaggtggtaggactaacatggggtcatatatcttgggatcttctggctctaccaccacaagatattatccttgcatctgatgtgttctttgaaccagaagattttgaagacattttggctacaatatattttttgatgcacaagaatcccaaggtccaattgtggtctacttatcaagttaggaggcaagtatggatgacccttactttttatatgtaacttaagccttactctaccctacccatgcgatacataatttaagaatagaatacatctgaagcaaaacagaaaaggcatgactttaaaagaacaactttttttttttaagtgctgactggtcacttgaagctttactctacaaatgggatatgaaatgtgtccacattcctcttgagtcttttgatgc

SEQ ID NO: 153539 - DNA, 1184 bp, Homo sapiens
  Payload ID: 10198
  Gene Symbol: METTL23
  Gene Name: methyltransferase like 23
  ENST ID: ENST00000588783
  CDS Start-End: 358-774
ccggtcgcgccagccgcccgttgccagttctgcgcgtgtgagtctctttcgccttgctccgggctttcttcgctcgcagcgcggcagggttatcaccagatctgggctttccccttcttgccgtcaggtgctacggccacgtggcccgcggcttcccgctcgcgcagtctggcagcccggagccttccgcggtcccccgcccgcccggggcccaacgacgccctactgggcgagcacgatttccgaggacagggggtccgggcccagcgctttcgattctcggaggagccgggtccgggggccgacggggctgtcctggaggtccacgtcccgcaggtcctgcatctccagtatggaatgtatgtttggccctgtgctgtggtcctggcccagtacctttggtttcacagaagatctctgccaggcaaggccatcttagagattggagctggagtgagccttccaggaattttggctgccaaatgtggtgcagaagtaatactgtcagacagctcagaactgcctcactgtctggaagtctgtcggcaaagctgccaaatgaataacctgccacatctgcaggtggtaggactaacatggggtcatatatcttgggatcttctggctctaccaccacaagatattatccttgcatctgatgtgttctttgaaccagaagattttgaagacattttggctacaatatattttttgatgcacaagaatcccaaggtccaattgtggtctacttatcaagttaggaggcaatgctgactggtcacttgaagctttactctacaaatgggatatgaaatgtgtccacattcctcttgagtcttttgatgcagacaaagaagatatagcagaatctacccttccaggaagacatacagttgaaatgctggtcatttcctttgcaaaggacagtctctgaattatacctacaacctgttctgggacagtatcaatactgatgagcaacctggcacacaaactatgagcagaccacttcagcttgagaatgcagtgggtctgaagatggtcaagtctgtttgccttagattttgatgtcacctagacaacacttaaactcatatgaaacaaaaattaaaatacgtattacaagtacttggattgttccttagtcattaaataggatataaattaggttgagaagggggtat

SEQ ID NO: 153540 - DNA, 609 bp, Homo sapiens
  Payload ID: 10198
  Gene Symbol: METTL23
  Gene Name: methyltransferase like 23
  ENST ID: ENST00000588964
  CDS Start-End: 440-609
aaaactgaaaatcatggcagaggaatcaagtgccccaaaactacttctgtgtgcatagcaattaactgccagttacgatacatggccctttaatattgaaattgaaggttaagcttttaccttttagcagagtagattcataaggaatgtacttttgtcatgtttatagtaatgttcagttacggtacattttatacaaacccagaaagactgactctatgcttatttaaaaatgcaagaatataatgaaaaagtactaagattcccaattatttgcagttccaagtataattgtgaaatgccatctttcataacttattagattggagctggagtgagccttccaggaattttggctgccaaatgtggtgcagaagtaatactgtcagacagctcagaactgcctcactgtctggaagtctgtcggcaaagctgccaaatgaataacctgccacatctgcaggtggtaggactaacatggggtcatatatcttgggatcttctggctctaccaccacaagatattatccttgcatctgatgtgttctttgaaccagaagattttgaagacattttggctacaatatattttttgatgcacaagaatcc

SEQ ID NO: 153541 - DNA, 581 bp, Homo sapiens
  Payload ID: 10198
  Gene Symbol: METTL23
  Gene Name: methyltransferase like 23
  ENST ID: ENST00000588563
  CDS Start-End: 52-581
cgccagccgcccgttgccagttctgcgcgtgtcctgcatctccagtatggaatgtatgtttggccctgtgctgtggtcctggcccagtacctttggtttcacagaagatctctgccaggcaaggccatcttagagattggagctggagtgagccttccaggaattttggctgccaaatgtggtgcagaagtaatactgtcagacagctcagaactgcctcactgtctggaagtctgtcggcaaagctgccaaatgaataacctgccacatctgcaggtggtaggactaacatggggtcatatatcttgggatcttctggctctaccaccacaagatattatccttgcatctgatgtgttctttgaaccagaagattttgaagacattttggctacaatatattttttgatgcacaagaatcccaaggtccaattgtggtctacttatcaagttaggagtgctgactggtcacttgaagctttactctacaaatgggatatgaaatgtgtccacattcctcttgagtcttttgatgcagacaaagaagatatagcagaatctacccttccaggaagacatac

SEQ ID NO: 153542 - DNA, 846 bp, Homo sapiens
  Payload ID: 10198
  Gene Symbol: METTL23
  Gene Name: methyltransferase like 23
  ENST ID: ENST00000592849
  CDS Start-End: 396-846
cttccggtcgcgccagccgcccgttgccagttctgcgcgtgtgagtctctttcgccttgctccgggctttcttcgctcgcagcgcggcagggttatcaccagatctgggctttccccttcttgccgtcaggtgctacggccacgtggcccgcggcttcccgctcgcgcagtctggcagcccggagccttccgcggtcccccgcccgcccggggcccaacgacgccctactgggcgagcacgatttccgaggacagggggtccgggcccagcgctttcgattctcggaggagccgggtccgggggccgacggggctgtcctggaggtccacgtcccgcaggtgcgtgcagcagcacccgccaggaggcgcctgaggtcctgcatctccagtatggaatgtatgtttggccctgtgctgtggtcctggcccagtacctttggtttcacagaagatctctgccaggcaaggccatcttagagattggagctggagtgagccttccaggaattttggctgccaaatgtggtgcagaagtaatactgtcagacagctcagaactgcctcactgtctggaagtctgtcggcaaagctgccaaatgaataacctgccacatctgcaggtggtaggactaacatggggtcatatatcttgggatcttctggctctaccaccacaagatattatccttgcatctgatgtgttctttgaaccagaagattttgaagacattttggctacaatatattttttgatgcacaagaatcccaaggtccaattgtggtctacttatcaagttaggagtgctgactggtcacttgaagctttactctacaaatgggatatga

SEQ ID NO: 153543 - DNA, 1059 bp, Homo sapiens
  Payload ID: 10198
  Gene Symbol: METTL23
  Gene Name: methyltransferase like 23
  ENST ID: ENST00000586738
  CDS Start-End: 303-719
ccggtcgcgccagccgcccgttgccagttctgcgcgtgtgctacggccacgtggcccgcggcttcccgctcgcgcagtctggcagcccggagccttccgcggtcccccgcccgcccggggcccaacgacgccctactgggcgagcacgatttccgaggacagggggtccgggcccagcgctttcgattctcggaggagccgggtccgggggccgacggggctgtcctggaggtccacgtcccgcaggtgcgtgcagcagcacccgccaggaggcgcctgaggtcctgcatctccagtatggaatgtatgtttggccctgtgctgtggtcctggcccagtacctttggtttcacagaagatctctgccaggcaaggccatcttagagattggagctggagtgagccttccaggaattttggctgccaaatgtggtgcagaagtaatactgtcagacagctcagaactgcctcactgtctggaagtctgtcggcaaagctgccaaatgaataacctgccacatctgcaggtggtaggactaacatggggtcatatatcttgggatcttctggctctaccaccacaagatattatccttgcatctgatgtgttctttgaaccagaagattttgaagacattttggctacaatatattttttgatgcacaagaatcccaaggtccaattgtggtctacttatcaagttaggaggcaatgctgactggtcacttgaagctttactctacaaatgggatatgaaatgtgtccacattcctcttgagtcttttgatgcagacaaagaagatatagcagaatctacccttccaggaagacatacagttgaaatgctggtcatttcctttgcaaaggacagtctctgaattatacctacaacctgttctgggacagtatcaatactgatgagcaacctggcacacaaactatgagcagaccacttcagcttgagaatgcagtgggtctgaagatggtcaagtctgtttgccttagattttgatgtcacctagacaacacttaaactcatatgaaacaaaaattaaaat

SEQ ID NO: 153544 - DNA, 925 bp, Homo sapiens
  Payload ID: 10198
  Gene Symbol: METTL23
  Gene Name: methyltransferase like 23
  ENST ID: ENST00000588302
  CDS Start-End: 356-571
gccagccgcccgttgccagttctgcgcgtgtgctacggccacgtggcccgcggcttcccgctcgcgcagtctggcagcccggagccttccgcggtcccccgcccgcccggggcccaacgacgccctactgggcgagcacgatttccgaggacagggggtccgggcccagcgctttcgattctcggaggagccgggtccgggggccgacggggctgtcctggaggtccacgtcccgcagattggagctggagtgagccttccaggaattttggctgccaaatgtggtgcagaagtaatactgtcagacagctcagaactgcctcactgtctggaagtctgtcggcaaagctgccaaatgaataacctgccacatctgcaggtggtaggactaacatggggtcatatatcttgggatcttctggctctaccaccacaagatattatccttgcatctgatgtgttctttgaaccagaagattttgaagacattttggctacaatatattttttgatgcacaagaatcccaaggtccaattgtggtctacttatcaagttaggaggcaatgctgactggtcacttgaagctttactctacaaatgggatatgaaatgtgtccacattcctcttgagtcttttgatgcagacaaagaagatatagcagaatctacccttccaggaagacatacagttgaaatgctggtcatttcctttgcaaaggacagtctctgaattatacctacaacctgttctgggacagtatcaatactgatgagcaacctggcacacaaactatgagcagaccacttcagcttgagaatgcagtgggtctgaagatggtcaagtctgtttgccttagattttgatgtcacctagacaacacttaaactcatatgaaacaaaaattaaaatacgtattacaagta

SEQ ID NO: 153545 - DNA, 1171 bp, Homo sapiens
  Payload ID: 10198
  Gene Symbol: METTL23
  Gene Name: methyltransferase like 23
  Uniprot ID: Q86XA0
  ENST ID: ENST00000615984
  CDS Start-End: 406-978
gtgcccatcacttccggtcgcgccagccgcccgttgccagttctgcgcgtgtgagtctctttcgccttgctccgggctttcttcgctcgcagcgcggcagggttatcaccagatctgggctttccccttcttgccgtcaggtgctacggccacgtggcccgcggcttcccgctcgcgcagtctggcagcccggagccttccgcggtcccccgcccgcccggggcccaacgacgccctactgggcgagcacgatttccgaggacagggggtccgggcccagcgctttcgattctcggaggagccgggtccgggggccgacggggctgtcctggaggtccacgtcccgcaggtgcgtgcagcagcacccgccaggaggcgcctgaggtcctgcatctccagtatggaatgtatgtttggccctgtgctgtggtcctggcccagtacctttggtttcacagaagatctctgccaggcaaggccatcttagagattggagctggagtgagccttccaggaattttggctgccaaatgtggtgcagaagtaatactgtcagacagctcagaactgcctcactgtctggaagtctgtcggcaaagctgccaaatgaataacctgccacatctgcaggtggtaggactaacatggggtcatatatcttgggatcttctggctctaccaccacaagatattatccttgcatctgatgtgttctttgaaccagaagattttgaagacattttggctacaatatattttttgatgcacaagaatcccaaggtccaattgtggtctacttatcaagttaggagtgctgactggtcacttgaagctttactctacaaatgggatatgaaatgtgtccacattcctcttgagtcttttgatgcagacaaagaagatatagcagaatctacccttccaggaagacatacagttgaaatgctggtcatttcctttgcaaaggacagtctctgaattatacctacaacctgttctgggacagtatcaatactgatgagcaacctggcacacaaactatgagcagaccacttcagcttgagaatgcagtgggtctgaagatggtcaagtctgtttgccttagattttgatgtcacctagacaacacttaaactcatatgaaacaaaaattaaaatacgtattacaagt

SEQ ID NO: 153546 - DNA, 1119 bp, Homo sapiens
  Payload ID: 10199
  Gene Symbol: METTL24
  Gene Name: methyltransferase like 24
  Uniprot ID: Q5JXM2
  ENST ID: ENST00000338882
  CDS Start-End: 1-1101
atggcccgggagaggccgcccgggaggggctgcggcgtcctgcgccggtgtctactcggggctgtgctgttgttcggcctgcggctctgcgcagagctgcggcgcgccgggcccgggtcccccacccgcagcgccccgccgggcccggcctggcggccacctgggccgcacctgccgcccgcgccgggccagccgcgcggcgccagcaggaggcaggtgacctacgtgcgcagcggtcgccgggcgccgccggggggcggcgggagcgggacgccggagcctggctgctgtgccccgcgcgggcgcccccgccggaagggtccccggtggcatatagatctccagccttgggcaggctctgctcagtccctggatgaagaagcctggaggttcctgagatatatcagcaccacccagattgcatgcaatcacatgaatacagacagcctggctactgactctagtcctacacacaagccctggtcagtgtgtcttgacgacaggttcaatttagctcatcaaatccgcaacaagcagtgccgcctctactccttagggctaggaagtgatgatacccattttgaggttagcatggccaacaacggatgtgaagtgcatcgttttgatcctagtgtcaagtcagctcacattctggagagtcagcacctttggtatcaccgcttgtccattgactggcgggatccccatccagctgttgctgcccaaaaaccacatagcaacaccagaaaactgggaagcattttgaatgaatttggacatcacaagattgacgttctcaaggcagatctggaaagtgcagaatggaaagttttggaaaatcttattctggaagatgttcttgagcagattggacagctcatctttgagatccatctccactggcctgggtttgaggtcagtggcagtgacagcagcgttgtgcggttctggtacagccttctcaaagagttagaacaaaaggatttcaggctttttcacagttacaaagacttatctaaacctcagctattcttgaagaaagacattttcaatgcaagtagctgttatactctgagttgggtgaatacaagatggaaataggatgcaggatgtcatcaa

SEQ ID NO: 153547 - DNA, 2093 bp, Homo sapiens
  Payload ID: 10200
  Gene Symbol: METTL25
  Gene Name: methyltransferase like 25
  Uniprot ID: Q8N6Q8
  ENST ID: ENST00000248306
  CDS Start-End: 70-1881
gctaatttgggccgagctggcgcctcacggccatgtttgcgccacctacagcctcggagggtgagcgtcatggcggcttcttgccctctcccggtgaccccggacctgcccacgctgcgtgccaagttgcagggactgctgcagttcctgagggatgccctgtccatttccaatgcacataccgtggatttctacacagaatccgtgtgggaggagctggtcgacttgccaccggagacagtgctggctgcgctgaggaagtcagcgtcggagacggaggccctgccctcagagacgcgccccctagtggaagcagagtgggaagcaggtatgactgattttcccaaaatattttgtgaaacttctcagaagttggtgagtgtggaagcctttgctctggctgcgaaatactattctgtacaaaacttgggaatatgtactccttttgaacagttgcttgtagcccttcgaggaaatcaaaaccagagaattggtgaaaatcagaaggcagttgagtttatgaatatgaagaaatctcatgaagttcaggcaatgtcagagctgatcagcagtattgctgactactatggaataaagcaggtgattgacttgggttccggtaaaggctacctaagctcttttttgtccttgaagtatggcttaaaagtttatggaattgattcttcaaataccaatactcatggagctgaggagagaaacagaaaattgaagaaacattggaaactctgtcatgctcagtcaagattagatgtcaatggactagcattaaaaatggcaaaagaaaggaaagtgcaaaataaagttaaaaataaagctgatactgaggaagtgtttaacaacagtcctacaaatcaagaaaagatgcctacctcagctattttgcctgatttttctggctctgtaatttctaatatcagaaaccaaatggaaacccttcattctcagccacatcaagaagaaaatttgtgttttgaaaattccttttctcttataaaccttttgcctattaatgctgtagagcctacttcttcacagcaaatacccaacagagaaacatctgaagccaataaagagagaagaaaaatgacatcaaagtcaagtgaatcaaatatatattcacctttaacctcttttatcactgctgattcagaactccatgacattattaaagatttggaggattgtttgatggtgggtctccacacttgtggtgatctggctccaaatactttgcgaatatttacctccaactctgaaatcaagggagtttgcagtgtgggttgttgctaccacctcttatctgaagaatttgaaaaccagcataaagaacgtactcaggaaaagtggggatttccaatgtgccactatttaaaggaagagagatggtgctgtggtcgtaatgccagaatgtcagcatgtttggcattggagcgggttgcagctggccaagggctgcctactgaatcactcttctatcgtgctgttcttcaggatattattaaagattgttatggcatcaccaaatgtgatcggcatgttggtaaaatttattccaaatgttcttcttttctggattatgtcagacggtctctaaagaagcttggattagatgagtccaagctgccagaaaaaattataatgaactactacgagaagtataagcctcgaatgaatgagctggaagcttttaatatgttgaaagttgtactggctccctgtatagagactttgattcttctggatcgactttgttacctgaaagagcaggaagatattgcatggtctgctcttgtgaagttgtttgatcccgtgaaatctcccagatgttatgctgttattgccctgaagaagcagcagtgatttccattgaagcaaattattagatgtatttctctatgagacctgttgctgagattgcttttctaaacatatatgtcctgttatacaaaaatttttaaatgactgttatgtattttaaataataaaataatggctaacaacagaaggttataatccatttttccattgtcaaagcatacattaataaaagaagaacctgtcataataatata

SEQ ID NO: 153548 - DNA, 743 bp, Homo sapiens
  Payload ID: 10200
  Gene Symbol: METTL25
  Gene Name: methyltransferase like 25
  ENST ID: ENST00000548200
  CDS Start-End: 27-743
acctacagcctcggagggtgagcgtcatggcggcttcttgccctctcccggtgaccccggacctgcccacgctgcgtgccaagttgcagggactgctgcagttcctgagggatgccctgtccatttccaatgcacataccgtggatttctacacagaatccgtgtgggaggagctggtcgacttgccaccggagacagtgctggctgcgctgaggaagtcagcgtcggagacggaggccctgccctcagagacgcgccccctagtggaagcagagtgggaagcaggtatgactgattttcccaaaatattttgtgaaacttctcagaagttggtgagtgtggaagcctttgctctggctgcgaaatactattctgtacaaaacttgggaatatgtactccttttgaacagttgcttgtagcccttcgaggaaatcaaaaccagagaattggtgaaaatcagaaggcagttgagtttatgaatatgaagaaatctcatgaagttcaggcaatgtcagagctgatcagcagtattgctgactactatggaataaagcaggtgattgacttgggttccggtaaaggctacctaagctcttttttgtccttgaagtatggcttaaaagtttatggaattgattcttcaaataccaatactcatggagctgaggagagaaacagaaaattgaagaaacattggaaactctgtcatgctcagtcaagattagatgtcaatggactagca

SEQ ID NO: 153549 - DNA, 679 bp, Homo sapiens
  Payload ID: 10200
  Gene Symbol: METTL25
  Gene Name: methyltransferase like 25
  ENST ID: ENST00000550298
  CDS Start-End: 1-432
gattcagaactccatgacattattaaagatttggaggattgtttgatggtgggtctccacacttgtggtgatctggctccaaatactttgcgaatatttacctccaactctgaaatcaagggagtttgcagtgtgggttgttgctaccacctcttatctgaagaatttgaaaaccagcataaagaacgtactcaggaaaagtggggatttccaatgtgccactatttaaaggaagagagatggtgctgtggtcgtaatgccagaatgtcagcatgtttggcattggagcgggttgcagctggccaagggctgcctactgaatcactcttctatcgtgctgttcttcaggatattattaaagattgttatggcatcaccaaatggtatgaggattttattttaataagaataactatgttatattgtaagtaaagtgacttttagtcttcaggtgaatttatgcagggtcactgttattagtagaagcaactttgaatttgagcataatgtcaataacaagtacacaacaactgtatcttaggttaattatcattaaagtgggggctctaatgattccttcttgtcctgaaagcttgttgtaatgataaaataatctatgtaaaatgtactttagaatttttgaagtattaaaatattaaatagttcagtgacgatatta

SEQ ID NO: 153550 - DNA, 568 bp, Homo sapiens
  Payload ID: 10200
  Gene Symbol: METTL25
  Gene Name: methyltransferase like 25
  ENST ID: ENST00000550058
  CDS Start-End: 1-568
ctggtggaagccagcagaaccagctcttaaagatggtgtgtccggagtttcttccttcagatgtgtccagagtttcttccttctggtgggttcatggtcctgctgacttcaagaatgaagccgcggaccttcacggtatgactgattttcccaaaatattttgtgaaacttctcagaagttggtgagtgtggaagcctttgctctggctgcgaaatactattctgtacaaaacttgggaatatgtactccttttgaacagttgcttgtagcccttcgaggaaatcaaaaccagagaattggtgaaaatcagaaggcagttgagtttatgaatatgaagaaatctcatgaagttcaggcaatgtcagagctgatcagcagtattgctgactactatggaataaagcaggtgattgacttgggttccggtaaaggctacctaagctcttttttgtccttgaagtatggcttaaaagtttatggaattgattcttcaaataccaatactcatggagctgaggagagaaacagaaaattgaagaaacattggaaactctgtcatgctcagtc

SEQ ID NO: 153551 - DNA, 2537 bp, Homo sapiens
  Payload ID: 10201
  Gene Symbol: METTL2A
  Gene Name: methyltransferase like 2A
  Uniprot ID: Q96IZ6
  ENST ID: ENST00000311506
  CDS Start-End: 37-1173
cgttacggaaagtaaagtgtttccggctccggtgtcatggccggctcctaccctgaaggtgcacctgcagtcctcgccgataagaggcagcagttcggaagccggttcctgagagatccggcgcgcgtcttccaccacaatgcctgggacaatgtggagtggtcggaagagcaagccgcggcggcggagagaaaagtccaggagaacagtatccagcgggtgtgccaggagaaacaagttgattatgagatcaatgcccacaaatactggaatgacttctacaaaatccacgaaaatgggtttttcaaggatagacattggctttttaccgaattccctgagctggcacctagccaaaatcaaaatcatttgaaggactggttcttggagaacaagagtgaagtacctgaatgtagaaacaatgaggatggacctggtttaataatggaagaacagcacaagtgttcttcaaagagccttgaacataaaacacagacacttcctgtggaggagaatgtaactcagaaaattagtgacctggaaatttgtgctgatgagtttcctggatcctcagccacctaccgaatactggaggttggctgtggtgtgggaaacacagtctttccaattttacaaacgaacaatgacccaggactctttgtttattgctgtgatttttcttccacagctatagaactggtccagacaaattcagaatatgatccttctcggtgttttgcctttgttcacgacctgtgtgatgaagagaagagttacccagtgcccaagggcagtcttgatattatcattctcatatttgttctttcagcaattgttccagacaagatgcagaaggctatcaacaggctgagcaggcttctgaaacctggcgggatgatgcttctgcgagattacggccgctatgacatggctcagcttcggtttaaaaaaggtcagtgtctatctggaaatttctacgtgagaggtgatggaaccagagtttacttcttcacacaagaggaactggacacgcttttcaccactgctggactggaaaaagttcagaacctggtggatcgccgactgcaggtgaaccgaggaaagcaactgacaatgtaccgggtttggattcagtgcaaatactgcaagccccttctgtccagcaccagctgagaggcacctgctgccaacacgatgcaagcccattgtgtttccgggcttttttaaaaaaaaaattgtagcactgggcgtggtgcatgcctgtaatcccagccactcaggaggctgaggcggggaggatccattgagcccagcagtccaacctgggcaaaatagtgagagaccctgtatctgaaagtaataataaaaataaaaaatataaatgaggtctcgttgatgttggacaattcaagaattcagacttgaaccttaaacctaggaaaagttactttgtatcaggattctaacaattatgcttcatatttgtgaagtcctttaaaacataattttctcaagttctttctttgagatctcaatctgtcttagcattttgtaactaataactgaaattttattcaaaggaattgtaaaccttaaaccaccaatttatttccatgtgaaaaagtgttacatatgacaagtgttttttgactgtaattgcgttaaatcttttgagaatgtaaatgccgggctaggcaattgcagttaatacatacagaggttagtgaagggcttattaagttgtaggggaagcaagctgggaagaatcagatcagatattttcctgacaaaaaaaaatgaccctacagagagcatcaaaatgtggtgttcttgttaagtaattgatcgtggtcttcgctttaatcttagttccgccaggcacggtggctcacacctgtaatcccagcactttgggaggccaaggcgggcggatcagctgaggtcaggagttggagaccagcgtggccaacatggtgaaaccccgtctctactaaagataaaaaaattagctgagtgtgttggtgggtgcctgtaatccagctacttgggagactgaggcaggagaattgcttgaacccaggaggcagaggttgcagtgagctgagattgtgccactgcactccagcctgggcaacaaagcaagactctgtctcaaaaaaataaaaataaaaaaaaaatcttagttccatggaattttaagcattgttccccctctaacctgtgtctaaagaattaaaagaatttggccgggtgcggcagctcatgcctgtaatcccaacactttgggaggctgaggcaggcggatcacgaggtcaggagatcgagaccatcctggccaacacggtgaaacctcgtctccactaaaaataccaaaaaaattagctgggcatggtggcacacacctgtagtcccctgtagtcccagctactcgggaggctgaggcaggagaatcgtttgaacctgggaggtggaggttgcagtgagccaagatcatgtcactgcattccagcctgggcaacagaggaagactccgtctc

SEQ ID NO: 153552 - DNA, 3150 bp, Homo sapiens
  Payload ID: 10201
  Gene Symbol: METTL2A
  Gene Name: methyltransferase like 2A
  ENST ID: ENST00000616852
  CDS Start-End: 116-1057
ggctccggtgtcatggccggctcctaccctgaaggtgcacctgcagtcctcgccgataagaggcagcagttcggaagccggttcctgagagatccggcgcgcgtcttccaccacaatgcctgttgattatgagatcaatgcccacaaatactggaatgacttctacaaaatccacgaaaatgggtttttcaaggatagacattggctttttaccgaattccctgagctggcacctagccaaaatcaaaatcatttgaaggactggttcttggagaacaagagtgaagtacctgaatgtagaaacaatgaggatggacctggtttaataatggaagaacagcacaagtgttcttcaaagagccttgaacataaaacacagacacttcctgtggaggagaatgtaactcagaaaattagtgacctggaaatttgtgctgatgagtttcctggatcctcagccacctaccgaatactggaggttggctgtggtgtgggaaacacagtctttccaattttacaaacgaacaatgacccaggactctttgtttattgctgtgatttttcttccacagctatagaactggtccagacaaattcagaatatgatccttctcggtgttttgcctttgttcacgacctgtgtgatgaagagaagagttacccagtgcccaagggcagtcttgatattatcattctcatatttgttctttcagcaattgttccagacaagatgcagaaggctatcaacaggctgagcaggcttctgaaacctggcgggatgatgcttctgcgagattacggccgctatgacatggctcagcttcggtttaaaaaaggtcagtgtctatctggaaatttctacgtgagaggtgatggaaccagagtttacttcttcacacaagaggaactggacacgcttttcaccactgctggactggaaaaagttcagaacctggtggatcgccgactgcaggtgaaccgaggaaagcaactgacaatgtaccgggtttggattcagtgcaaatactgcaagccccttctgtccagcaccagctgagaggcacctgctgccaacacgatgcaagcccattgtgtttccgggcttttttaaaaaaaaaattgtagcactgggcgtggtgcatgcctgtaatcccagccactcaggaggctgaggcggggaggatccattgagcccagcagtccaacctgggcaaaatagtgagagaccctgtatctgaaagtaataataaaaataaaaaatataaatgaggtctcgttgatgttggacaattcaagaattcagacttgaaccttaaacctaggaaaagttactttgtatcaggattctaacaattatgcttcatatttgtgaagtcctttaaaacataattttctcaagttctttctttgagatctcaatctgtcttagcattttgtaactaataactgaaattttattcaaaggaattgtaaaccttaaaccaccaatttatttccatgtgaaaaagtgttacatatgacaagtgttttttgactgtaattgcgttaaatcttttgagaatgtaaatgccgggctaggcaattgcagttaatacatacagaggttagtgaagggcttattaagttgtaggggaagcaagctgggaagaatcagatcagatattttcctgacaaaaaaaaatgaccctacagagagcatcaaaatgtggtgttcttgttaagtaattgatcgtggtcttcgctttaatcttagttccgccaggcacggtggctcacacctgtaatcccagcactttgggaggccaaggcgggcggatcagctgaggtcaggagttggagaccagcgtggccaacatggtgaaaccccgtctctactaaagataaaaaaattagctgagtgtgttggtgggtgcctgtaatccagctacttgggagactgaggcaggagaattgcttgaacccaggaggcagaggttgcagtgagctgagattgtgccactgcactccagcctgggcaacaaagcaagactctgtctcaaaaaaataaaaataaaaaaaaaatcttagttccatggaattttaagcattgttccccctctaacctgtgtctaaagaattaaaagaatttggccgggtgcggcagctcatgcctgtaatcccaacactttgggaggctgaggcaggcggatcacgaggtcaggagatcgagaccatcctggccaacacggtgaaacctcgtctccactaaaaataccaaaaaaattagctgggcatggtggcacacacctgtagtcccctgtagtcccagctactcgggaggctgaggcaggagaatcgtttgaacctgggaggtggaggttgcagtgagccaagatcatgtcactgcattccagcctgggcaacagaggaagactccgtctcaaaaaaaaaaaagaaaagaattttcactttttgcaaaattatcttttttaatgcacccttaagtgtttgacacaaaaggaattgagggaacttcttaattttaaccacatcatcacttcacttctgaatgtgatcattatcagtgttagatgcctttttttttttttttttttttttttttttaaggagacagggctctcactttgttgcccaggctggagttcagtggtgcaatgatagctcattatcacctcaaacttctggctcaagccatccctccgcctcagcctcctgagtagctaggactgcaggtgggcaccatcatgcctagctaattgttagatcctttttttttatgttctgcattttttcagttatttttacatatttctctcttgatccatgcagttataggatatatccttaattttagaaagtaaggacttttcgaccaggcgtggcggctcatgcctataatcccagcactttgggaggccgaggtgggcagatcacttgaggtcaggagttccagtccagcctggctaacatagtgaaaccccgtctccactaaaaaataaaaaatcagcccggcatggctgtgggcgcctgtaatcccagctactcaggaggctgaagtagaattgcttgaacctgggaggcagaggttgcagtgagccgagatggtgccattgcactccagcctgggtgacaagagcgaaactgcatctc

SEQ ID NO: 153553 - DNA, 2182 bp, Homo sapiens
  Payload ID: 10202
  Gene Symbol: METTL2B
  Gene Name: methyltransferase like 2B
  Uniprot ID: Q6P1Q9
  ENST ID: ENST00000262432
  CDS Start-End: 38-1174
gcgttacggaaagtgaagtgtttccggctccggtgtcatggccggctcctaccctgaaggtgcacctgcaatcctcgccgataagaggcagcagttcggaagccggttcctgagcgatccggcgcgcgtcttccaccacaatgcctgggacaatgtggagtggtcggaagagcaagccgcggcggcggagagaaaagtccaggagaacagtatccagcgggtgtgccaggagaaacaagttgattatgagatcaatgcccacaaatactggaatgacttctacaaaatccacgaaaatgggtttttcaaggatagacattggctttttaccgaattccctgagctggcacctagccaaaatcaaaatcatttgaaggattggttcttggagaacaagagtgaagtatgtgaatgtagaaacaatgaggatggacctggtttaataatggaagaacagcacaagtgttcttcgaagagccttgaacataaaacacagacacctcctgtggaggagaatgtaactcagaaaattagtgacctggaaatttgtgctgatgagtttcctggatcctcagccacctaccgaatactggaggttggctgtggtgtgggaaacacagtctttccaattttacaaacgaacaatgacccaggactctttgtttattgctgtgatttttcttccacagctatagaactggtccagacaaattcagaatatgatccttctcggtgttttgcctttgttcacgacctgtgtgatgaagagaagagttacccagtgcccaagggcagtcttgatattatcattctcatatttgttctttcagcagttgttccagacaagatgcagaaggctatcaacaggctgagcaggcttctgaaacctggggggatggtacttctgcgagattacggccgctatgacatggctcagcttcggtttaaaaaaggtcagtgtctatctggaaatttctatgtgagaggtgatggaaccagagtttacttcttcacacaagaggaactggacacgcttttcaccactgctggactggaaaaagttcagaatctggtggaccgccgactgcaggtgaaccgagggaagcaactgacaatgtaccgggtttggattcagtgcaaatactgcaagccccttctgtccagcaccagctaagaggcacctgctgccaacacgatgcaagcccgttgtgtttccgagcttttttaaaaaaaaatttgtagcaccgggcatggtgcatgcctgtaatcccagccactcaggaggctgaggcagggaggatccattgagcccaggagtccagcctgggcaaaatagcgagagaccctgaatctgaaagtaatgataaaataaaaagaatataaatgaggtctcgttgatgctggacaattcaagaattcagacttgaaccttaaacctaggaaaagttactttgtatcaggattctaacaattatgcttcatatttgtgaagtcctttaaaacataattttctcaagttctttctttgagacctcaatctgtcttagcattttgtaactaataactgaaattttattcaaaggaattgtaaaccttaaaccaccatttatttccatgtgaaaaagtgttatatatgacaagtgttttttgattgtaattgcgttaaatcttttgagagtgtaaatgccgggctaggcaattgcagttaatacatacaggggttagtgaagggcttattaagttgtaggggaagcaagctgggaagaatcagatcagatattttcctgacaagaaaaaaatgaccctgtagacagcatcaaaatgtggtgttcttgttaagtaattgatcgtggtctttgctttaatcttagttccgccaggcacggtggctcacacctgtaatcccagcactttgggaggccgaggcgggcagatcacctgaggtcaggagttcgagaccagcgtggccaacatggtgaaaccccgtctctactaaagataaaaaaattagctgggtgtgttggtgggtgcctgtaatccagctactcgggaggctgaggcaggagaatcacttgaacccaggaggcagaggttgcagtgagctgagattgcgccactgtactccagcctgggcaacaaagcaagactctgtctcaaaaaaataaaaataaaaaaaatctta

SEQ ID NO: 153554 - DNA, 411 bp, Homo sapiens
  Payload ID: 10202
  Gene Symbol: METTL2B
  Gene Name: methyltransferase like 2B
  ENST ID: ENST00000419443
  CDS Start-End: 1-319
ctcagccacctaccgaatactggaggttggctgtggtgtgggaaacacagtctttccaattttacaaacgaacaatgacccaggactctttgtttattgctgtgatttttcttccacagctatagaactggtccagttcactttatcacactgtacagatgtcatatctgttcatatattgaaagtctgtggcaaccctgcatcaagcaagcctaccagtgccgtttctccaccaccatatgctcacttagtgtctgtgtgtcatgctttggtgattctcagaatatttcagacttttttactattatgtatgttatagtgtgtgacgttactgttgtacttggtttggggttccacaaatcacatctgtgtaagacggtcaacttaataaatgcatgtgttgtgactgcc

SEQ ID NO: 153555 - DNA, 977 bp, Homo sapiens
  Payload ID: 10202
  Gene Symbol: METTL2B
  Gene Name: methyltransferase like 2B
  ENST ID: ENST00000497665
  CDS Start-End: 18-248
tttccggctccggtgtcatggccggctcctaccctgaaggtgcacctgcaatcctcgccgataagaggcagcagttcggaagccggttcctgagcgatccggcgcgcgtcttccaccacaatgcctgggacaatgtggagtggtcggaagagcaagccgcggcggcggagagaaaagtccaggagaacagtatccagcgggtgtgccaggagaaacaagttaaagacacttggaccacaggacattaagtgcttttcccagagttgattatgagatcaatgcccacaaatactggaatgacttctacaaaatccacgaaaatgggtttttcaaggatagacattggctttttaccgaattccctgagctggcacctagccaaaatcaaaatcatttgaaggattggttcttggagaacaagagtgaagtatgtgaatgtagaaacaatgaggatggacctggtttaataatggaagaacagcacaagtgttcttcgaagagccttgaacataaaacacagacacctcctgtggaggagaatgtaactcagaaaattagtgacctggaaatttgtgctgatgagtttcctggatcctcagccacctaccgaatactggaggttggctgtggtgtgggaaacacagtctttccaattttacaaacgaacaatgacccaggactctttgtttattgctgtgatttttcttccacagctatagaactggtccagacaaattcagaatatgatccttctcggtgttttgcctttgttcacgacctgtgtgatgaagagaagagttacccagtgcccaagggcagtcttgatattatcattctcatatttgttctttcagcagttgttccagacaagatgcagaaggctatcaacaggctgagcaggcttctgaaacctggggggatggtacttctgcgagattacggccgctatgacatggctcagcttcggtttaaaaaag

SEQ ID NO: 153556 - DNA, 5743 bp, Homo sapiens
  Payload ID: 10202
  Gene Symbol: METTL2B
  Gene Name: methyltransferase like 2B
  Uniprot ID: Q6P1Q9
  ENST ID: ENST00000480046
  CDS Start-End: 116-1057
ggctccggtgtcatggccggctcctaccctgaaggtgcacctgcaatcctcgccgataagaggcagcagttcggaagccggttcctgagcgatccggcgcgcgtcttccaccacaatgcctgttgattatgagatcaatgcccacaaatactggaatgacttctacaaaatccacgaaaatgggtttttcaaggatagacattggctttttaccgaattccctgagctggcacctagccaaaatcaaaatcatttgaaggattggttcttggagaacaagagtgaagtatgtgaatgtagaaacaatgaggatggacctggtttaataatggaagaacagcacaagtgttcttcgaagagccttgaacataaaacacagacacctcctgtggaggagaatgtaactcagaaaattagtgacctggaaatttgtgctgatgagtttcctggatcctcagccacctaccgaatactggaggttggctgtggtgtgggaaacacagtctttccaattttacaaacgaacaatgacccaggactctttgtttattgctgtgatttttcttccacagctatagaactggtccagacaaattcagaatatgatccttctcggtgttttgcctttgttcacgacctgtgtgatgaagagaagagttacccagtgcccaagggcagtcttgatattatcattctcatatttgttctttcagcagttgttccagacaagatgcagaaggctatcaacaggctgagcaggcttctgaaacctggggggatggtacttctgcgagattacggccgctatgacatggctcagcttcggtttaaaaaaggtcagtgtctatctggaaatttctatgtgagaggtgatggaaccagagtttacttcttcacacaagaggaactggacacgcttttcaccactgctggactggaaaaagttcagaatctggtggaccgccgactgcaggtgaaccgagggaagcaactgacaatgtaccgggtttggattcagtgcaaatactgcaagccccttctgtccagcaccagctaagaggcacctgctgccaacacgatgcaagcccgttgtgtttccgagcttttttaaaaaaaaatttgtagcaccgggcatggtgcatgcctgtaatcccagccactcaggaggctgaggcagggaggatccattgagcccaggagtccagcctgggcaaaatagcgagagaccctgaatctgaaagtaatgataaaataaaaagaatataaatgaggtctcgttgatgctggacaattcaagaattcagacttgaaccttaaacctaggaaaagttactttgtatcaggattctaacaattatgcttcatatttgtgaagtcctttaaaacataattttctcaagttctttctttgagacctcaatctgtcttagcattttgtaactaataactgaaattttattcaaaggaattgtaaaccttaaaccaccatttatttccatgtgaaaaagtgttatatatgacaagtgttttttgattgtaattgcgttaaatcttttgagagtgtaaatgccgggctaggcaattgcagttaatacatacaggggttagtgaagggcttattaagttgtaggggaagcaagctgggaagaatcagatcagatattttcctgacaagaaaaaaatgaccctgtagacagcatcaaaatgtggtgttcttgttaagtaattgatcgtggtctttgctttaatcttagttccgccaggcacggtggctcacacctgtaatcccagcactttgggaggccgaggcgggcagatcacctgaggtcaggagttcgagaccagcgtggccaacatggtgaaaccccgtctctactaaagataaaaaaattagctgggtgtgttggtgggtgcctgtaatccagctactcgggaggctgaggcaggagaatcacttgaacccaggaggcagaggttgcagtgagctgagattgcgccactgtactccagcctgggcaacaaagcaagactctgtctcaaaaaaataaaaataaaaaaaatcttagttccatggaattttaagcactgttccccctctaacctatgtctaaagaattaaaagaatttggctgggtgcggtagctcatgcctgtaatcccaacactttgggaggctgaggcaggtggatcacgaggtcaggagatcgagaccatcctggctaacacggtgaaacctcgtctccactaaaaataccaaaaaaaatagctgggcatggtggcatgcgcctgtagtcccctgtagtcccagctactcgggaggctaaggcaggagaatcgtttgaacctgggaggcagaggttgcagtgagccgagatcatgtcactgcattccagcctgggcaacagaggaagactctgtctcaaaaaaataaaagaaaagaattttcactttttgcaaaattatctttttttactgcacccttaagtgtttgacacaaaaggaattgagagaacttcttaattttaaccacatcatcacttcacttctgaatgtgatcactgtcagtgttagatgctttttttttttttttttaggagacagggctctcactttgttgcccaggctggagttcagtggtgcaatgatagctcattatcacctcgaacttctggcttgagccatcgctccacctcagcctcctgagtagctaggactgcaggtgggcaccatcatgcctagctaattgttagatcctttttttttatgttctgcattttttcaattatttttacatatttctgtcttgatccatgcagttataggatatatccttaattttagaaagtaaggacttttcgaccaggcatggcggctcacgcctataatcccagcactttgggaggctgaggtgggcagatcacttgaggtcaggagttccagtccagcccggctaacatagtgaaaccccgtctccactaaaaaataaaaaatcagcccggcatggttgtgggcgcctgtaatcccagctactcaggaggctgaggtaggagaattgcttgaacctgggaggcggaggttgcagtgagctgagatggtgccattgcactccagcctgggcgacaagagcgaaactgcatctcaaaaacaaagatgcctagctttcaccttgttgatgtttttctaaattttggaataataaatttatataggaatactgcaagaatagtccatttttttctgatgtcccaacatcagcaaatatattaccaaatatatccatcacaagtaggaatacatggaaacattaatgccagccactaaccattcatgtttacccagtagtcccaataatagctttgtcacacaaaaacatgattatgttggctgggcacagtggctcctgtaatcttagcattttgggagcccaaggcaggaggatgacttgaggccaggagttcaagaccaggctgggtaatgtagcaagaccctgactttttttttttttttttttgagatggagtttcgctcttgttgcccaggctggagtacaatggcacgatctcggctcactgcaatctccacctcccaagtttaagtgattctcctgcctcagcctcccaagtagctggaattacaggcatgcagcaccattcccagctaaattttttgtatttttagtagagacaaggtttctccatgttggtcaggctgatctcgaactcccgacctcaggtgatctgcccgcctcagcctcccaaagtgctgggattacaggcgtgagccaccacgcccggccaagaccctgactttttaaaaaatgttaaacataggccgggtgcagtggctcacgcctgtaatcccagcactttgggaggccgaggtgggcggatcatttgaggtcaggagttcgagaccagcctggccaacttaatgaaaccccatctctgctaacaatacagaccaggcatggtggctcacacctgtaatcccagcactttgagagaccgaggcaggtggatcacctgaggtcgggagttcgagaccagcctgaccaacatggagaaaccccgtctctactaaaaatacaaaatagccaggtgtgatggcgcatgcctgtaaccccatctacttggaaggctgaggcaggagaatcacttgaatctgggaggcagaggttgcagtgagccgagatggcgccattgcactccagcctgggcaacaagagtgaaactccgtctcaaaaaaaaaaaaaaaaaaaaattagctgggcatggtggtgggcgcctgtaatcccagctatctgggaggctgagtctagagaatcatttgaacctgggaggcggaggttgcagtgagccgagatcgcaccattgcactccagcctgggcaacagtgagactccgtctcaaaataaaaaaacaaaaaaaatgtaaaaaataaataattgtattgaatttattagttgtgtctcagtctccttcagtctacagtttaggcttgcttttgcacctttgcattttaaggtaagaggctattgtgtaaactcgaattgggtttgttggtgtttcttcatgatttggttcaggctctgcattttgggcaggaatattcagaggtgatgctgtgttcctcccataggatcgtatcaggcgacacatgattatgaatttccccattattggtgatgtcacttagttgtgttgtctgccaggttctgccactgtaaagttaataagtattttgtagggaagtgctttgagactaaatatcctgttcctcatcaaacttctaccccctagtttcagtatctattgctgttttttgtctgaataactatgatagttgccaaatagtggtttctgatccttccattccttctacactgattggttggtattttgtacagaaaagctttctcatatctgatttacttgtctcaatatggacccatgggtatttgagtttcttgtggggttatttgttgttgtttttgagacaggctcacccaggctggagtgcagcagcacgatcactgcttactgcttactgcagcctcgacctcccatgctcaagtgattctcccaccccagcctcccaagtagatgggactacaggcatgtgccaccaagcctaatttttgtattttttgtagagacagggtttcaccatgtgtcccaggctggtcttgagctcctgagctcaagcaatcctcccacctcggcctcccaaagtgctgggatgagccaccgtgactggccccacttaatgggttttcagaggtgggagcaaagaatgaagggaggaagagagctcccatcttttccattaccgtatttacttaaaactggaaaaaactgaatcactgggatggtatttcatttatcttttgaaatgaagaatagatacattaatttaaatgattctctaaagactgtccttcagcatccctaaagcattgcaaaactataggcacagtttttattttatctttctggcacctggtttgggctttggcttagattaaaaagacgagccttctcctgcccctgctcccttttattccctgccatctgctaagctcgactttttatctctcaggccaaatttgactctgtaagggactttgcataacgtttcatcctcagaatcgctaatgatgggcagaggactgttacatgtgttgggagggattaaagtatatgacctcagtgccacttaaaaaataaatactgtctcaactatca

SEQ ID NO: 153557 - DNA, 564 bp, Homo sapiens
  Payload ID: 10202
  Gene Symbol: METTL2B
  Gene Name: methyltransferase like 2B
  ENST ID: ENST00000481392
  CDS Start-End: 1-453
gttcacgacctgtgtgatgaagagaagagttacccagtgcccaagggcagtcttgatattatcattctcatatttgttctttcagcagttgttccagacaagatgcagaaggctatcaacaggctgagcaggcttctgaaacctggggggatggtacttctgcgagattacggccgctatgacatggctcagcttcggtttaaaaaaggtcagtgtctatctggaaatttctatgtgagaggtgatggaaccagagtttacttcttcacacaagaggaactggacacgcttttcaccactgctggactggaaaaagttcagaatctggtggaccgccgactgcagttccgccaggcacggtggctcacacctgtaatcccagcactttgggaggccgaggcgggcagatcacctgaggtcaggagttcgagaccagcgtggccaacatggtgaaaccccgtctctactaaagataaaaaaattagctgggtgtgttggtgggtgcctgtaatccagctactcgggaggctgaggcaggagaatcacttgaacccaggaggcaga

SEQ ID NO: 153558 - DNA, 2015 bp, Homo sapiens
  Payload ID: 10203
  Gene Symbol: METTL3
  Gene Name: methyltransferase like 3
  Uniprot ID: Q86U44
  ENST ID: ENST00000298717
  CDS Start-End: 153-1895
aaatgacttttctgtcttgctcagctccaggggtcattttccggttagccttcggggtgtccgcgtgagaattggctatatcctggagcgagtgctgggaggtgctagtccgccgcgccttattcgagaggtgtcagggctgggagactaggatgtcggacacgtggagctctatccaggcccacaagaagcagctggactctctgcgggagaggctgcagcggaggcggaagcaggactcggggcacttggatctacggaatccagaggcagcattgtctccaaccttccgtagtgacagcccagtgcctactgcacccacctctggtggccctaagcccagcacagcttcagcagttcctgaattagctacagatcctgagttagagaagaagttgctacaccacctctctgatctggccttaacattgcccactgatgctgtgtccatctgtcttgccatctccacgccagatgctcctgccactcaagatggggtagaaagcctcctgcagaagtttgcagctcaggagttgattgaggtaaagcgaggtctcctacaagatgatgcacatcctactcttgtaacctatgctgaccattccaagctctctgccatgatgggtgctgtggcagaaaagaagggccctggggaggtagcagggactgtcacagggcagaagcggcgtgcagaacaggactcgactacagtagctgcctttgccagttcgttagtctctggtctgaactcttcagcatcggaaccagcaaaggagccagccaagaaatcaaggaaacatgctgcctcagatgttgatctggagatagagagccttctgaaccaacagtccactaaggaacaacagagcaagaaggtcagtcaggagatcctagagctattaaatactacaacagccaaggaacaatccattgttgaaaaatttcgctctcgaggtcgggcccaagtgcaagaattctgtgactatggaaccaaggaggagtgcatgaaagccagtgatgctgatcgaccctgtcgcaagctgcacttcagacgaattatcaataaacacactgatgagtctttaggtgactgctctttccttaatacatgtttccacatggatacctgcaagtatgttcactatgaaattgatgcttgcatggattctgaggcccctggcagcaaagaccacacgccaagccaggagcttgctcttacacagagtgtcggaggtgattccagtgcagaccgactcttcccacctcagtggatctgttgtgatatccgctacctggacgtcagtatcttgggcaagtttgcagttgtgatggctgacccaccctgggatattcacatggaactgccctatgggaccctgacagatgatgagatgcgcaggctcaacatacccgtactacaggatgatggctttctcttcctctgggtcacaggcagggccatggagttggggagagaatgtctaaacctctgggggtatgaacgggtagatgaaattatttgggtgaagacaaatcaactgcaacgcatcattcggacaggccgtacaggtcactggttgaaccatgggaaggaacactgcttggttggtgtcaaaggaaatccccaaggcttcaaccagggtctggattgtgatgtgatcgtagctgaggttcgttccaccagtcataaaccagatgaaatctatggcatgattgaaagactatctcctggcactcgcaagattgagttatttggacgaccacacaatgtgcaacccaactggatcacccttggaaaccaactggatgggatccacctactagacccagatgtggttgcacggttcaagcaaaggtacccagatggtatcatctctaaacctaagaatttatagaagcacttccttacagagctaagaatccatagccatggctctgtaagctaaacctgaagagtgatatttgtacaatagctttcttctttatttaaataaacatttgtattgtagttggga

SEQ ID NO: 153559 - DNA, 563 bp, Homo sapiens
  Payload ID: 10203
  Gene Symbol: METTL3
  Gene Name: methyltransferase like 3
  ENST ID: ENST00000377543
  CDS Start-End: 537-563
ccaaatttgtcttgaacacctggcatcaagctgtcctcttgcctaagcctcccaaagtgtttgaattacaggctggaattcagtggcgtgaacacagcttactgcagtctcgacctcagggctcaagtgatcctcctgcctcagcctcctcctgagtggctagcaccacagatctacggaatccagaggcagcattgtctccaaccttccgtagtgacagcccagtgcctactgcacccacctctggtggccctaagcccagcacagcttcagcagttcctgaattagctacagatcctgagttagagaagaagttgctacaccacctctctgatctggccttaacattgcccactgatgctgtgtccatctgtcttgccatctccacgccagatgctcctgccactcaagatggggtagaaagcctcctgcagaagtttgcagctcaggagttgattgaggtaaagcgaggtctcctacaagatgatgcacatcctactcttgtaacctatgctgaccattccaagctctctgccatgatgggtgctgtggcagaaaagaag

SEQ ID NO: 153560 - DNA, 1570 bp, Homo sapiens
  Payload ID: 10203
  Gene Symbol: METTL3
  Gene Name: methyltransferase like 3
  ENST ID: ENST00000544248
  CDS Start-End: 116-853
tttccggttagccttcggggtgtccgcgtgagaattggctatatcctggagcgagtgctgggaggtgctagtccgccgcgccttattcgagaggtgtcagggctgggagactaggatgtcggacacgtggagctctatccaggcccacaagaagcagctggactctctgcgggagaggctgcagcggaggcggaagcaggactcggggcacttggatctacggaatccagaggcagcattgtctccaaccttccgtagtgacagcccagtgcctactgcacccacctctggtggccctaagcccagcacagcttcagcagttcctgaattagctacagatcctgagttagagaagaagttgctacaccacctctctgatctggccttaacattgcccactgatgctgtgtccatctgtcttgccatctccacgccagatgctcctgccactcaagatggggtagaaagcctcctgcagaagtttgcagctcaggagttgattgaggtaaagcgaggtctcctacaagatgatgcacatcctactcttgtaacctatgctgaccattccaagctctctgccatgatgggtgctgtggcagaaaagaagggccctggggaggtagcagggactgtcacagggcagaagcggcgtgcagaacaggactcgactacagtagctgcctttgccagttcgttagtctctggtctgaactcttcagcatcggaaccagcaaaggagccagccaagaaatcaaggaaacatgctgcctcagatgttgatctggagatagagagccttctgaaccaacagtccactaaggaacaacagagcaagaagacgaattatcaataaacacactgatgagtctttaggtgactgctctttccttaatacatgtttccacatggatacctgcaagtatgttcactatgaaattgatgcttgcatggattctgaggcccctggcagcaaagaccacacgccaagccaggagcttgctcttacacagagtgtcggaggtgattccagtgcagaccgactcttcccacctcagtggatctgttgtgatatccgctacctggacgtcagtatcttgggcaagtttgcagttgtgatggctgacccaccctgggatattcacatggaactgccctatgggaccctgacagatgatgagatgcgcaggctcaacatacccgtactacaggatgatggctttctcttcctctgggtcacaggcagggccatggagttggggagagaatgtctaaacctctgggggtatgaacgggtagatgaaattatttgggtgaagacaaatcaactgcaacgcatcattcggacaggccgtacaggtcactggttgaaccatgggaaggaacactgcttggttggtgtcaaaggaaatccccaaggcttcaaccagggtctggattgtgatgtgatcgtagctgaggttcgttccaccagtcataaaccagatgaaatctatggcatgattgaaagactatctcctggcactcgcaagattgagttatttggacgaccacacaatgtgcaacccaactg

SEQ ID NO: 153561 - DNA, 1462 bp, Homo sapiens
  Payload ID: 10203
  Gene Symbol: METTL3
  Gene Name: methyltransferase like 3
  ENST ID: ENST00000539760
  CDS Start-End: 1-1009
agtgcctactgcacccacctctggtggccctaagcccagcacagcttcagcagttcctgaattagctacagatcctgagttagagaagaagttgctacaccacctctctgatctggccttaacattgcccactgatgctgtgtccatctgtcttgccatctccacgccagatgctcctgccactcaagatggggtagaaagcctcctgcagaagtttgcagctcaggagttgattgaggtaaagcgaggtctcctacaagatgatgcacatcctactcttgtaacctatgctgaccattccaagctctctgccatgatgggtgctgtggcagaaaagaagggccctggggaggtagcagggactgtcacagggcagaagcggcgtgcagaacaggactcgactacagtagctgcctttgccagttcgttagtctctggtctgaactcttcagcatcggaaccagcaaaggagccagccaagaaatcaaggaaacatgctgcctcagatgttgatctggagatagagagccttctgaaccaacagtccactaaggaacaacagagcaagaaggtcagtcaggagatcctagagctattaaatactacaacagccaaggaacaatccattgttgaaaaatttcgctctcgaggtcgggcccaagtgcaagaattctgtgactatggaaccaaggaggagtgcatgaaagccagtgatgctgatcgaccctgtcgcaagctgcacttcagacgaattatcaataaacacactgatgagtctttaggtgactgctctttccttaatacatgtttccacatggatacctgcaagtatgttcactatgaaattgatgcttgcatggattctgaggcccctggcagcaaagaccacacgccaagccaggagcttgctcttacacagagtgtcggaggtgattccagtgcagaccgactcttcccacctcagggccatggagttggggagagaatgtctaaacctctgggggtatgaacgggtagatgaaattatttgggtgaagacaaatcaactgcaacgcatcattcggacaggccgtacaggtcactggttgaaccatgggaaggaacactgcttggttcgttccaccagtcataaaccagatgaaatctatggcatgattgaaagactatctcctggcactcgcaagattgagttatttggacgaccacacaatgtgcaacccaactggatcacccttggaaaccaactggatgggatccacctactagacccagatgtggttgcacggttcaagcaaaggtacccagatggtatcatctctaaacctaagaatttatagaagcacttccttacagagctaagaatccatagccatggctctgtaagctaaacctgaagagtgatatttgtacaatagctttcttctttatttaaataaacatttgtattgtagttgggattctg

SEQ ID NO: 153562 - DNA, 2030 bp, Homo sapiens
  Payload ID: 10203
  Gene Symbol: METTL3
  Gene Name: methyltransferase like 3
  ENST ID: ENST00000537163
  CDS Start-End: 118-579
attttccggttagccttcggggtgtccgcgtgagaattggctatatcctggagcgagtgctgggaggtgctagtccgccgcgccttattcgagaggtgtcagggctgggagactaggatgtcggacacgtggagctctatccaggcccacaagaagcagctggactctctgcgggagaggctgcagcggaggcggaagcaggactcggggcacttggatctacggaatccagaggcagcattgtctccaaccttccgtagtgacagcccagtgcctactgcacccacctctggtggccctaagcccagcacagcttcagcagttcctgaattagctacagatcctgagttagagaagaagttgctacaccacctctctgatctggccttaacattgcccactgatgctgtgtccatctgtcttgccatctccacgccagatgctcctgccactcaagatggggtagaaagcctcctgcagaagtttgcagctcaggagttgattgagcatcggaaccagcaaaggagccagccaagaaatcaaggaaacatgctgcctcagatgttgatctggagatagagagccttctgaaccaacagtccactaaggaacaacagagcaagaaggtcagtcaggagatcctagagctattaaatactacaacagccaaggaacaatccattgttgaaaaatttcgctctcgaggtcgggcccaagtgcaagaattctgtgactatggaaccaaggaggagtgcatgaaagccagtgatgctgatcgaccctgtcgcaagctgcacttcagacgaattatcaataaacacactgatgagtctttaggtgactgctctttccttaatacatgtttccacatggatacctgcaagtatgttcactatgaaattgatgcttgcatggattctgaggcccctggcagcaaagaccacacgccaagccaggagcttgctcttacacagagtgtcggaggtgattccagtgcagaccgactcttcccacctcagtggatctgttgtgatatccgctacctggacgtcagtatcttgggcaagtttgcagttgtgatggctgacccaccctgggatattcacatggaactgccctatgggaccctgacagatgatgagatgcgcaggctcaacatacccgtactacaggatgatggctttctcttcctctgggtcacaggcagggccatggagttggggagagaatgtctaaacctctgggggtatgaacgggtagatgaaattatttgggtgaagacaaatcaactgcaacgcatcattcggacaggccgtacaggtcactggttgaaccatgggaaggaacactgcttggtgagcagcagtggggcccaattcaataggtggagcacaaagaagaatcatttgatttcttactgagaaaaagttcaaaggtgtggtttcataaggtaatctgttatctgtggtgagcaggttggtgtcaaaggaaatccccaaggcttcaaccagggtctggattgtgatgtgatcgtagctgaggtatgtgcttcccaggcctccaaagcttccacatttttgttggtatcagttattcatgttgggtgtattctcatcccagatttttctcatttagatcataaacataatagaaagggctagaattgcaatcttgtgtaacttaaaaagcagctagtttttatttcctaggttcgttccaccagtcataaaccagatgaaatctatggcatgattgaaagactatctcctggcactcgcaagattgagttatttggacgaccacacaatgtgcaacccaactggatcacccttggaaaccaactggatgggatccacctactagacccagatgtggttgcacggttcaagcaaaggtacccagatggtatcatctctaaacctaagaatttatagaagcacttccttacagagctaagaatccatagccatggctctgtaagctaaacctgaagagtgatatttgtacaatagctttcttctttatttaaa

SEQ ID NO: 153563 - DNA, 2124 bp, Homo sapiens
  Payload ID: 10203
  Gene Symbol: METTL3
  Gene Name: methyltransferase like 3
  ENST ID: ENST00000543235
  CDS Start-End: 88-864
tgagaattggctatatcctggagcgagtgctgggaggtgctagtccgccgcgccttattcgagaggtgtcagggctgggagactaggatgtcggacacgtggagctctatccaggcccacaagaagcagctggactctctgcgggagaggctgcagcggaggcggaagcaggactcggggcacttggatctacggaatccagaggcagcattgtctccaaccttccgtagtgacagcccagtgcctactgcacccacctctggtggccctaagcccagcacagcttcagcagttcctgaattagctacagatcctgagttagagaagaagttgctacaccacctctctgatctggccttaacattgcccactgatgctgtgtccatctgtcttgccatctccacgccagatgctcctgccactcaagatggggtagaaagcctcctgcagaagtttgcagctcaggagttgattgaggtaaagcgaggtctcctacaagatgatgcacatcctactcttgtaacctatgctgaccattccaagctctctgccatgatgggtgctgtggcagaaaagaagggccctggggaggtagcagggactgtcacagggcagaagcggcgtgcagaacaggactcgactacagtagctgcctttgccagttcgttagtctctggtctgaactcttcagcatcggaaccagcaaaggagccagccaagaaatcaaggaaacatgctgcctcagatgttgatctggagatagagagccttctgaaccaacagtccactaaggaacaacagagcaagaaggtcgggcccaagtgcaagaattctgtgactatggaaccaaggaggagtgcatgaaagccagtgatgctgatcgaccctgtcgcaagctgcacttcagacgaattatcaataaacacactgatgagtctttaggtgactgctctttccttaatacatgtttccacatggatacctgcaagtatgttcactatgaaattgatgcttgcatggattctgaggcccctggcagcaaagaccacacgccaagccaggagcttgctcttacacagagtgtcggaggtgattccagtgcagaccgactcttcccacctcagtggatctgttgtgatatccgctacctggacgtcagtatcttgggcaagtttgcagttgtgatggctgacccaccctgggatattcacatggaactgccctatgggaccctgacagatgatgagatgcgcaggctcaacatacccgtactacaggatgatggctttctcttcctctgggtcacaggcagggccatggagttggggagagaatgtctaaacctctgggggtatgaacgggtagatgaaattatttgggtgaagacaaatcaactgcaacgcatcattcggacaggccgtacaggtcactggttgaaccatgggaaggaacactgcttggtgagcagcagtggggcccaattcaataggtggagcacaaagaagaatcatttgatttcttactgagaaaaagttcaaaggtgtggtttcataaggtaatctgttatctgtggtgagcaggttggtgtcaaaggaaatccccaaggcttcaaccagggtctggattgtgatgtgatcgtagctgaggtatgtgcttcccaggcctccaaagcttccacatttttgttggtatcagttattcatgttgggtgtattctcatcccagatttttctcatttagatcataaacataatagaaagggctagaattgcaatcttgtgtaacttaaaaagcagctagtttttatttcctaggttcgttccaccagtcataaaccagatgaaatctatggcatgattgaaagactatctcctggcactcgcaagattgagttatttggacgaccacacaatgtgcaacccaactggatcacccttggaaaccaactggatgggatccacctactagacccagatgtggttgcacggttcaagcaaaggtacccagatggtatcatctctaaacctaagaatttatagaagcacttccttacagagctaagaatccatagccatggctctgtaagctaaacctgaagagtgatatttgtacaatagctttctt

SEQ ID NO: 153564 - DNA, 3601 bp, Homo sapiens
  Payload ID: 10204
  Gene Symbol: METTL4
  Gene Name: methyltransferase like 4
  ENST ID: ENST00000319888
  CDS Start-End: 800-2059
acttccatgcgaccgcctcgtcgctggaaggctgcgtgctggtcgcgcccagctgcgtcaccccaggaactggggtctgtgggccagtgtggccgtctctacgaagactggcacgacccctaaagttaggtcggaagacctgtgggcagcttgagcgccgaggagtgccctgaacgctcaactcgccctggaaacgtttttccgtacagcaacatggcggcgcccatggactcttagaaaaggagaaagctttttctctgtggactggaaggggcatttttcatgatcactatttagatgggtgctgttttcatgaggagagtctgggaaggcggcgtccgcttttctgacaagggaagaggctactttgtccttttaaggattcaatgacttcctgacttggaggatgtggacctagtggctagacccaaggaccaaagcaagaagtcgtggggggcccaggaagacaggaggatcacattgggattccagacataagatcaggttttaaccccctttggccaaattttggctgaaaatgttgaattatcaactctgaaattaaaaagaaagtttatattaaaacattgcaattttccttagaatttctgtatatattaacatcatgaatgataaattctcttcaatgtgcatgtcaggtttttgtacttgtatatcaaatctatctgtgtgtatgaagtgtatgtttattgaaatacaagatatttaagaagctgatctggaaagttggattttcattctagttcctaattcccagaggcttttttaaaggaagggaatgtctgtggtacaccagttgtcagctgggtggttactggatcatctttcttttatcaacaagataaactatcaacttcaccagcatcatgaaccttgttgccgtaaaaaggagttcactacttctgttcactttgagtctcttcaaatggattctgtgtcctcctctggagtctgtgctgcatttattgcttctgactcttccactaagccagagaatgatgatggaggaaattatgaaatgttcacacgaaaatttgtttttcgacctgaactgtttgatgtcaccaaaccttatataactccagctgttcataaagaatgccagcaaagtaatgaaaaggaagatctgatgaatggtgttaaaaaagaaatctccatttctattattgggaagaagcgtaaaagatgtgttgttttcaatcaaggtgaattggatgctatggaataccatacaaagatcagggagctgattttggatggatctttacagttgatccaggaaggtctcaaaagtggttttctttatccactttttgaaaaacaggacaagggtagtaagcccattactttaccacttgacgcctgcagtttgtcagaattatgtgaaatggcaaagcatttgccttctctgaatgaaatggaacatcagacattacaattggtggaagaggatacatctgttacagaacaggatttatttttgcgagttgttgaaaacaactctagctttacaaaagtgattactttaatgggacagaaatacctgctaccaccgaaaagcagttttcttttatctgacatttcttgtatgcaaccacttctaaactataggaaaacatttgatgtaattgtgatagatccaccatggcagaacaaatcagttaaaagaagtaataggtacagttatttgtcacccctgcaaatacagcaaatacctatccctaaattggctgctccaaactgtcttcttgttacttgggtgaccaatagacagaagcacctacgttttataaaggaagaactttatccctcttggtctgtggaggtagttgctgagtggcactgggtaaaaataaccaattcaggagaatttgtgttcccattagattctccacacaaaaagccctacgaaggtcttatactggggagggttcaagaaaaaactgctctaccattgagaggttttaaaagactacatcaagccagatggggaatatttggagttgtttgctcgaaatttacagccaggttggactagttggggcaatgaagttctcaaatttcagcatgtggattattttattgctgtggagtctggaagctgactatgatcttgattaaagtagtggtttcttcattgtttcctcaccacttttcccttaattctaagtcatttttttattttgttaccaacccatattcttagaatataaacaggacttgtttttttcagtaagggaccagaagtgactagccttcatgtaattttaagatgaattttacttgagttgcactaacattctatgttattctagactatacaaattaagtggtaagcagttataaagacggcaagaccatgctattgaaaaagttcagaaaacatacaccgtggaccagaggtcttaatcctatctatggatgtgttttgtgtgacccatacagtgttgtaaaaaacacttagaaccattattctaaaaaatggggctatttcacattaaagtccagatttctgcttctttttaaacatcagaggctctggctacacagaggcctttgttctttcctggcatcagtctgcaggaccaagcggtggtggctcacttgggaagagccttgtgctctccactttgccacagtaccactgccaccatgctgctcacttatgtcatccacttggcccttgtatgacctgaatttgcaacctctggtatactgttatgttctggagaaaatattcaaagatctgccaaatactgcattagtatactgagtttatacagcatttttgtagggttttaaattgcattcaaggtcactttccaagcactttctggttttgcttgtttttctagaagaaaatgaaaagctattccttataataaacatggcagcaagtaaacagtgtgattgtgaaaaaaatattatttatagattttctacaaataaatatttgtctaccaagtaaaatattttgactgaaatgattctttgaaatgcatattgatttattatgtattgactttttaaaaattgaggtataattttcacaaaattctccaattttcagtgtcaaattcagtgaattttgaaaacatatatacagttgtctgtctgccacagtgatcatgatacagaacactttctttaccctgaaaacttctcatttttccttttgcagtcaatcccctgctcctatccttggcccctggcaaacactggtttgctttctatcattagttctgctgtttgagaatttcatataaatggaatcatgcaatgtgtaatctattgtgcctggcttctttcacgtagcattttgagaaaagcatttatactatttacagattgttgacaaatatttatccactaagtaaaatgttagactgaaatgattctttgacaagcttgccaatttactgattttgtcaaagaaaaatatgttatttttgaagtttgttcatcctttgagtgtgtgagtatagtatcagaggcttaattttgtatttatggagctattctaacttgttatttaaaaggaaaaaggtattaaacttgaagcaaacttctcatgatctca

SEQ ID NO: 153565 - DNA, 2742 bp, Homo sapiens
  Payload ID: 10204
  Gene Symbol: METTL4
  Gene Name: methyltransferase like 4
  Uniprot ID: Q8N3J2
  ENST ID: ENST00000574538
  CDS Start-End: 777-2195
ctggaaggctgcgtgctggtcgcgcccagctgcgtcaccccaggaactggggtctgtgggccagtgtggccgtctctacgaagactggcacgacccctaaagttaggtcggaagacctgtgggcagcttgagcgccgaggagtgccctgaacgctcaactcgccctggaaacgtttttccgtacagcaacatggcggcgcccatggactcttagaaaaggagaaagctttttctctgtggactggaaggggcatttttcatgatcactatttagatgggtgctgttttcatgaggagagtctgggaaggcggcgtccgcttttctgacaagggaagaggctactttgtccttttaaggattcaatgacttcctgacttggaggatgtggacctagtggctagacccaaggaccaaagcaagaagtcgtggggggcccaggaagacaggaggatcacattgggattccagacataagatcaggttttaaccccctttggccaaattttggctgaaaatgttgaattatcaactctgaaattaaaaagaaagtttatattaaaacattgcaattttccttagaatttctgtatatattaacatcatgaatgataaattctcttcaatgtgcatgtcaggtttttgtacttgtatatcaaatctatctgtgtgtatgaagtgtatgtttattgaaatacaagatatttaagaagctgatctggaaagttggattttcattctagttcctaattcccagaggcttttttaaaggaagggaatgtctgtggtacaccagttgtcagctgggtggttactggatcatctttcttttatcaacaagataaactatcaacttcaccagcatcatgaaccttgttgccgtaaaaaggagttcactacttctgttcactttgagtctcttcaaatggattctgtgtcctcctctggagtctgtgctgcatttattgcttctgactcttccactaagccagagaatgatgatggaggaaattatgaaatgttcacacgaaaatttgtttttcgacctgaactgtttgatgtcaccaaaccttatataactccagctgttcataaagaatgccagcaaagtaatgaaaaggaagatctgatgaatggtgttaaaaaagaaatctccatttctattattgggaagaagcgtaaaagatgtgttgttttcaatcaaggtgaattggatgctatggaataccatacaaagatcagggagctgattttggatggatctttacagttgatccaggaaggtctcaaaagtggttttctttatccactttttgaaaaacaggacaagggtagtaagcccattactttaccacttgacgcctgcagtttgtcagaattatgtgaaatggcaaagcatttgccttctctgaatgaaatggaacatcagacattacaattggtggaagaggatacatctgttacagaacaggatttatttttgcgagttgttgaaaacaactctagctttacaaaagtgattactttaatgggacagaaatacctgctaccaccgaaaagcagttttcttttatctgacatttcttgtatgcaaccacttctaaactataggaaaacatttgatgtaattgtgatagatccaccatggcagaacaaatcagttaaaagaagtaataggtacagttatttgtcacccctgcaaatacagcaaatacctatccctaaattggctgctccaaactgtcttcttgttacttgggtgaccaatagacagaagcacctacgttttataaaggaagaactttatccctcttggtctgtggaggtagttgctgagtggcactgggtaaaaataaccaattcaggagaatttgtgttcccattagattctccacacaaaaagccctacgaaggtcttatactggggagggttcaagaaaaaactgctctaccattgaggaatgcagatgtaaacgtgctccccattccagaccacaaattaattgtcagcgtgccctgtactcttcactcacataagccaccgcttgctgaggttttaaaagactacatcaagccagatggggaatatttggagttgtttgctcgaaatttacagccaggttggactagttggggcaatgaagttctcaaatttcagcatgtggattattttattgctgtggagtctggaagctgactatgatcttgattaaagtagtggtttcttcattgtttcctcaccacttttcccttaattctaagtcatttttttattttgttaccaacccatattcttagaatataaacaggacttgtttttttcagtaagggaccagaagtgactagccttcatgtaattttaagatgaattttacttgagttgcactaacattctatgttattctagactatacaaattaagtggtaagcagttataaagacggcaagaccatgctattgaaaaagttcagaaaacatacaccgtggaccagaggtcttaatcctatctatggatgtgttttgtgtgacccatacagtgttgtaaaaaacacttagaaccattattctaaaaaatggggctatttcacattaaagtccagatttctgcttctttttaaacatcagaggctctggctacacagaggcctttgttctttcctggcatcagtctgcaggaccaagcggtggtggctcacttgggaagagccttgtgctctccactttgccacagtaccactgccacc

SEQ ID NO: 153566 - DNA, 544 bp, Homo sapiens
  Payload ID: 10204
  Gene Symbol: METTL4
  Gene Name: methyltransferase like 4
  ENST ID: ENST00000577166
  CDS Start-End: 274-544
tttttcatgatcactatttagatgggtgctgttttcatgaggagagtctgggaaggcggcgtccgcttttctgacaagggaagaggctactttgtccttttaaggattcaatgacttcctgacttggaggatgtggacctagtggctagacccaaggaccaaagcaagaagtcgtggggggcccaggaagacaggaggatcacattgggattccagacataagatcagaagcgtaaaagatgtgttgttttcaatcaaggtgaattggatgctatggaataccatacaaagatcagggagctgattttggatggatctttacagttgatccaggaaggtctcaaaagtggttttctttatccactttttgaaaaacaggacaagggtagtaagcccattactttaccacttgacgcctgcagtttgtcagaattatgtgaaatggcaaagcatttgccttctctgaatgaaatggaacatcagacattacaattggtggaagaggatacatctgttacagaacaggatttatttttgcgagttg

SEQ ID NO: 153567 - DNA, 1884 bp, Homo sapiens
  Payload ID: 10204
  Gene Symbol: METTL4
  Gene Name: methyltransferase like 4
  ENST ID: ENST00000576251
  CDS Start-End: 1-278
cttgtatgcaaccacttctaaactataggaaaacatttgatgtaattgtgatagatccaccatggcagaacaaatcagttaaaagaagtaataggtacagttatttgtcacccctgcaaatacagcaaatacctatccctaaattggctgctccaaactgtcttcttgttacttgggtgaccaatagacagaagcacctacgttttataaaggaagaactttatccctcttggtctgtggaggtagttgctgagtggcactgggtaaaaaggttttaaaagactacatcaagccagatggggaatatttggagttgtttgctcgaaatttacagccaggttggactagttggggcaatgaagttctcaaatttcagcatgtggattattttattgctgtggagtctggaagctgactatgatcttgattaaagtagtggtttcttcattgtttcctcaccacttttcccttaattctaagtcatttttttattttgttaccaacccatattcttagaatataaacaggacttgtttttttcagtaagggaccagaagtgactagccttcatgtaattttaagatgaattttacttgagttgcactaacattctatgttattctagactatacaaattaagtggtaagcagttataaagacggcaagaccatgctattgaaaaagttcagaaaacatacaccgtggaccagaggtcttaatcctatctatggatgtgttttgtgtgacccatacagtgttgtaaaaaacacttagaaccattattctaaaaaatggggctatttcacattaaagtccagatttctgcttctttttaaacatcagaggctctggctacacagaggcctttgttctttcctggcatcagtctgcaggaccaagcggtggtggctcacttgggaagagccttgtgctctccactttgccacagtaccactgccaccatgctgctcacttatgtcatccacttggcccttgtatgacctgaatttgcaacctctggtatactgttatgttctggagaaaatattcaaagatctgccaaatactgcattagtatactgagtttatacagcatttttgtagggttttaaattgcattcaaggtcactttccaagcactttctggttttgcttgtttttctagaagaaaatgaaaagctattccttataataaacatggcagcaagtaaacagtgtgattgtgaaaaaaatattatttatagattttctacaaataaatatttgtctaccaagtaaaatattttgactgaaatgattctttgaaatgcatattgatttattatgtattgactttttaaaaattgaggtataattttcacaaaattctccaattttcagtgtcaaattcagtgaattttgaaaacatatatacagttgtctgtctgccacagtgatcatgatacagaacactttctttaccctgaaaacttctcatttttccttttgcagtcaatcccctgctcctatccttggcccctggcaaacactggtttgctttctatcattagttctgctgtttgagaatttcatataaatggaatcatgcaatgtgtaatctattgtgcctggcttctttcacgtagcattttgagaaaagcatttatactatttacagattgttgacaaatatttatccactaagtaaaatgttagactgaaatgattctttgacaagcttgccaatttactgattttgtcaaagaaaaatatgttatttttgaagtttgttcatcctttgagtgtgtgagtatagtatcagaggcttaattttgtatttatggagctattctaacttgttatttaaaaggaaaaaggtattaaacttgaagcaaacttctcatg

SEQ ID NO: 153568 - DNA, 613 bp, Homo sapiens
  Payload ID: 10204
  Gene Symbol: METTL4
  Gene Name: methyltransferase like 4
  ENST ID: ENST00000574676
  CDS Start-End: 551-613
ctggtcgcgcccagctgcgtcaccccaggaactggggtctgtgggccagtgtggccgtctctacgaagactggcacgacccctaaagttaggtcggaagacctgtgggcagcttgagcgccgaggagtgccctgaacgctcaactcgccctggaaacgtttttccgtacagcaacatggcggcgcccatggactcttagaaaaggagaaagctttttctctgtggactggaaggggcatttttcatgatcactatttagatgggtgctgttttcatgaggagagtctgggaaggcggcgtccgcttttctgacaagggaagaggctactttgtccttttaaggattcaatgacttcctgacttggaggatgtggacctagtggctagacccaaggaccaaagcaagaagtcgtggggggcccaggaagacaggaggatcacattgggattccagacataagatcagataaactatcaacttcaccagcatcatgaaccttgttgccgtaaaaaggagttcactacttctgttcactttgagtctcttcaaatggattctgtgtcctcctctggagtctgtgctgcatttattgcttctgactcttccactaag

SEQ ID NO: 153569 - DNA, 506 bp, Homo sapiens
  Payload ID: 10204
  Gene Symbol: METTL4
  Gene Name: methyltransferase like 4
  ENST ID: ENST00000609769
  CDS Start-End: 1-427
gttgtcagctgggtggttactggatcatctttcttttatcaacaagataaactatcaacttcaccagcatcatgaaccttgttgccgtaaaaaggagttcactacttctgttcactttgagtctcttcaaatggattctgtgtcctcctctggagtctgtgctgcatttattgcttctgactcttccactaagccagagaatgatgatggaggaaattatgaaatgttcacacgaaaatttgtttttcgacctgaactgtttgatgtcaccaaaccttatataactccagctgttcataaagaatgccagcaaagtaatgaaaaggaagatctgatgaatggtgttaaaaaagaaatctccatttctattattgggaaggtagaaagttttaagaaatatttatttttctccagaaaacataattgagatttattatctaaatgtcttaaatatctggtgattcgttaagtataaagaagaatcagtaaaacccaaaaaggcttta

SEQ ID NO: 153570 - DNA, 1010 bp, Homo sapiens
  Payload ID: 10205
  Gene Symbol: METTL5
  Gene Name: methyltransferase like 5
  Uniprot ID: Q9NRN9
  ENST ID: ENST00000260953
  CDS Start-End: 318-947
cggcctggcgcttccggcaccggccgaggtgcgggtcgcctccagaggtgcgtggtcgtggcgcgagggatcctgaggctgctccagcagtgcgccgccgccgtctcctggggcggcttgggttagccgggaggtgggtcagaggctcgccccgtgccctgcgtccgggcgtctccttagggcgcgtcttcgggtccggccagcggtgctgaaaaagggagaaggttgggggtagggaggaaacaagatcccagttcaatagatttctccgcagatcctgtgccttcaaaccctacgagtccatactttaaaacaaaatgaagaaagtaaggcttaaggaactagagagtcgcctgcaacaagtggatggatttgaaaagcccaagctacttctggaacagtatcctaccaggccgcacattgcagcatgtatgctctatacaatccataacacttatgatgacattgaaaataaagtcgttgcagatctaggatgtggttgtggagtacttagcatcggaactgcaatgttaggagcagggttgtgtgttggatttgacatagatgaagacgcattggaaatatttaataggaatgcagaagagtttgagttaacaaatattgacatggttcaatgtgatgtgtgcttattatctaacagaatgtccaagtcattcgatacagtaattatgaatcctccctttgggaccaaaaataataaagggacagatatggcttttctaaagactgctttggaaatggcaagaacagcagtatattccttacacaaatcctcaactagagaacatgttcaaaagaaagctgcagaatggaaaatcaagatagatattatagcagaacttcgatatgacctgccagcatcatacaagtttcacaaaaagaaatcagtggacattgaagtggacctaattcggttttccttttaaaagccccgcaaacaaaagtcgtttaaaacctatttaaaatgaataaaaaattggtttactaaa

SEQ ID NO: 153571 - DNA, 629 bp, Homo sapiens
  Payload ID: 10205
  Gene Symbol: METTL5
  Gene Name: methyltransferase like 5
  ENST ID: ENST00000308099
  CDS Start-End: 78-572
ccggcaccggccgaggtgcgggtcgcctccagagatcctgtgccttcaaaccctacgagtccatactttaaaacaaaatgaagaaagtaaggcttaaggaactagagagtcgcctgcaacaagtggatggatttgaaaagcccaagctacttctggaacagtatcctaccaggccgcacattgcagcatgtatgctctatacaatccataacacttatgatgacattgaaaataaagtcgttgcagatctaggatgtggttgtggagtacttagcatcggaactgcaatgttaggagcagggttgtgtgttggatttgacatagatgaagacgcattggaaatatttaataggaatgcagaagagtttgagttaacaaatattgacatggttcaatgtgatgtgtgcttattatctaacagaatgtccaagtcattcgatacagtaattatgaatcctccctttgggaccaaaaataataaagaacttcgatatgacctgccagcatcatacaagtttcacaaaaagaaatcagtggacattgaagtggacctaattcggttttccttttaaaagccccgcaaacaaaagtcgtttaaaacctatttaaaatgaataaaaaattggttt

SEQ ID NO: 153572 - DNA, 800 bp, Homo sapiens
  Payload ID: 10205
  Gene Symbol: METTL5
  Gene Name: methyltransferase like 5
  Uniprot ID: Q9NRN9
  ENST ID: ENST00000392640
  CDS Start-End: 108-737
gaacgcgtgcgcgcgtgcggcctggcgcttccggcaccggccgaggtgcgggtcgcctccagagatcctgtgccttcaaaccctacgagtccatactttaaaacaaaatgaagaaagtaaggcttaaggaactagagagtcgcctgcaacaagtggatggatttgaaaagcccaagctacttctggaacagtatcctaccaggccgcacattgcagcatgtatgctctatacaatccataacacttatgatgacattgaaaataaagtcgttgcagatctaggatgtggttgtggagtacttagcatcggaactgcaatgttaggagcagggttgtgtgttggatttgacatagatgaagacgcattggaaatatttaataggaatgcagaagagtttgagttaacaaatattgacatggttcaatgtgatgtgtgcttattatctaacagaatgtccaagtcattcgatacagtaattatgaatcctccctttgggaccaaaaataataaagggacagatatggcttttctaaagactgctttggaaatggcaagaacagcagtatattccttacacaaatcctcaactagagaacatgttcaaaagaaagctgcagaatggaaaatcaagatagatattatagcagaacttcgatatgacctgccagcatcatacaagtttcacaaaaagaaatcagtggacattgaagtggacctaattcggttttccttttaaaagccccgcaaacaaaagtcgtttaaaacctatttaaaatgaataaaaaattggtttactaaa

SEQ ID NO: 153573 - DNA, 880 bp, Homo sapiens
  Payload ID: 10205
  Gene Symbol: METTL5
  Gene Name: methyltransferase like 5
  Uniprot ID: Q9NRN9
  ENST ID: ENST00000409965
  CDS Start-End: 188-817
gtgcgcgcgtgcggcctggcgcttccggcaccggccgaggtgcgggtcgcctccagaggtgcgtggtcgtggcgcgagggatcctgaggctgctccagcagtgcgccgccgccgtctcctggggcggcttgggttagccgggagatcctgtgccttcaaaccctacgagtccatactttaaaacaaaatgaagaaagtaaggcttaaggaactagagagtcgcctgcaacaagtggatggatttgaaaagcccaagctacttctggaacagtatcctaccaggccgcacattgcagcatgtatgctctatacaatccataacacttatgatgacattgaaaataaagtcgttgcagatctaggatgtggttgtggagtacttagcatcggaactgcaatgttaggagcagggttgtgtgttggatttgacatagatgaagacgcattggaaatatttaataggaatgcagaagagtttgagttaacaaatattgacatggttcaatgtgatgtgtgcttattatctaacagaatgtccaagtcattcgatacagtaattatgaatcctccctttgggaccaaaaataataaagggacagatatggcttttctaaagactgctttggaaatggcaagaacagcagtatattccttacacaaatcctcaactagagaacatgttcaaaagaaagctgcagaatggaaaatcaagatagatattatagcagaacttcgatatgacctgccagcatcatacaagtttcacaaaaagaaatcagtggacattgaagtggacctaattcggttttccttttaaaagccccgcaaacaaaagtcgtttaaaacctatttaaaatgaataaaaaattggtttactaaa

SEQ ID NO: 153574 - DNA, 936 bp, Homo sapiens
  Payload ID: 10205
  Gene Symbol: METTL5
  Gene Name: methyltransferase like 5
  ENST ID: ENST00000409837
  CDS Start-End: 82-678
gcttccggcaccggccgaggtgcgggtcgcctccagagatcctgtgccttcaaaccctacgagtccatactttaaaacaaaatgaagaaagtaaggcttaaggaactagagagtcgcctgcaacaagtggatggatttgaaaagcccaagctacttctggaacagtatcctaccaggccgcacattgcagcatgtatgctctatacaatccataacacttatgatgacattgaaaataaagtcgttgcagatctaggatgtggttgtggagtacttagcatcggaactgcaatgttaggagcagggttgtgtgttggatttgacatagatgaagacgcattggaaatatttaataggaatgcagaagagtttgagttaacaaatattgacatggttcaatgtgatgtgtgcttattatctaacagaatgtccaagtcattcgatacagtaattatgaatcctccctttgggaccaaaaataataaagggacagatatggcttttctaaagactgctttggaaatggcaagaacagcagtatattccttacacaaatcctcaactagagaacatgttcaaaagaaagctgcagaatggaaaatcaagatagatattatagcagaacttcgatatgacctgccagcatcatacaagtttcacaaaaagaaatcagtctgatcatctaaatcacccgaaaatttcagcaagcatccaatcttttcttctagagatttctataaaaatatacaaagtgatcaaaaagtttcttaaaagcaacaacagaccagaaatgactcacaccaccttatagctatacaagaaaaagactagaaaccaaaatgctattttaaagtagtttcttccgccggggcagcaagagcgaaactccatctcaaaaaataataataataataaataaataaagtagtttcatag

SEQ ID NO: 153575 - DNA, 1370 bp, Homo sapiens
  Payload ID: 10205
  Gene Symbol: METTL5
  Gene Name: methyltransferase like 5
  ENST ID: ENST00000410097
  CDS Start-End: 137-871
tccagaggtgcgtggtcgtggcgcgagggatcctgaggctgctccagcagtgcgccgccgccgtctcctggggcggcttgggttagccgggagatcctgtgccttcaaaccctacgagtccatactttaaaacaaaatgaagaaagtaaggcttaaggaactagagagtcgcctgcaacaagtggatggatttgaaaagcccaagctacttctggaacagtatcctaccaggccgcacattgcagcatgtatgctctatacaatccataacacttatgatgacattgaaaataaagtcgttgcagatctaggatgtggttgtggagtacttagcatcggaactgcaatgttaggagcagggttgtgtgttggatttgacatagatgaagacgcattggaaatatttaataggaatgcagaagagtttgagttaacaaatattgacatggttcaatgtgatgtgtgcttattatctaacagaatgtccaagtcattcgatacagtaattatgaatcctccctttgggaccaaaaataataaagggacagatatggcttttctaaagactgctttggaaatggcaagaacagcagtatattccttacacaaatcctcaactagagaacatgttcaaaagaaagctgcagaatggaaaatcaagatagatattatagcagaacttcgatatgacctgccagcatcatacaagtttcacaaaaagaaatcagtaagtctcttgattttggctggtctacattcggtattgaaaagctttctgggccggatgtggtggttcatgcctgtaatcccagctactcgggaggctgaggcaagagaatcgcttgaactcaggaggcagaggttgcagtgagctgagattgccccactgaactccagcctgcgcgataagagtgagactcagtctcgaaaaagaaaaaaaaaggaaagctttgtgacaagtaattatttctagtgttaccaactttcctgtgtaaatatacaaagccagcctaggagacaccataaatggcctgtgggaaaggcccatcgtcaatagctaatattctagttctttcctaaatgctttgggtacaaaaagaaaaaaaaaatcaaaaactgtttttgctcttttcatatagtatatattttattagttagtttgtactaatacattctcatattacaaaggcaatttaatggaagaatcttccttttgatatttgaatcatctgaaataacacaaacagaacaatacattcaaagaaatctcatttgcataacaaaaagacaagttaaacaacaaaaaaatttttcctttctcacaggtggacattgaagtggacctaattcggttttccttttaaaagccc

SEQ ID NO: 153576 - DNA, 472 bp, Homo sapiens
  Payload ID: 10205
  Gene Symbol: METTL5
  Gene Name: methyltransferase like 5
  ENST ID: ENST00000409340
  CDS Start-End: 77-409
ccgtctcctggggcggcttgggttagccgggagatcctgtgccttcaaaccctacgagtccatactttaaaacaaaatgaagaaagtaaggcttaaggaactagagagtcgcctgcaacaagtggatggatttgaaaagcccaagctacttctggaacagtatcctaccaggccgcacattgcagggacagatatggcttttctaaagactgctttggaaatggcaagaacagcagtatattccttacacaaatcctcaactagagaacatgttcaaaagaaagctgcagaatggaaaatcaagatagatattatagcagaacttcgatatgacctgccagcatcatacaagtttcacaaaaagaaatcagtggacattgaagtggacctaattcggttttccttttaaaagccccgcaaacaaaagtcgtttaaaacctatttaaaatgaataaaaaattggtttactaaa

SEQ ID NO: 153577 - DNA, 443 bp, Homo sapiens
  Payload ID: 10205
  Gene Symbol: METTL5
  Gene Name: methyltransferase like 5
  ENST ID: ENST00000442181
  CDS Start-End: 1-380
ttaataggaatgcagaagagtttgagttaacaaatattgacatggttcaatgtgatgtgtgcttattatctaacagaatgtccaagtcattcgatacagtaattatgaatcctccctttgggaccaaaaataataaagggacagatatggcttttctaaagactgctttggaaatggcaagaacagcagtatattccttacacaaatcctcaactagagaacatgttcaaaagaaagctgcagaatggaaaatcaagatagatattatagcaggtggcttttgttttacagaacttcgatatgacctgccagcatcatacaagtttcacaaaaagaaatcagtggacattgaagtggacctaattcggttttccttttaaaagccccgcaaacaaaagtcgtttaaaacctatttaaaatgaataaaaaattggtttactaaa

SEQ ID NO: 153578 - DNA, 464 bp, Homo sapiens
  Payload ID: 10205
  Gene Symbol: METTL5
  Gene Name: methyltransferase like 5
  ENST ID: ENST00000537825
  CDS Start-End: 1-264
caacaagtggatggatttgaaaagcccaagctacttctggaacagtatcctaccaggccgcacattgcagcatgtatgctctatacaatccataacacttatgatgacattgaaaataaagtcgttgcagatctaggatgtggttgtggagtacttagcatcggaactgcaatgttaggagcaggggacagatatggcttttctaaagactgctttggaaatggcaagaacagcagtatattccttacacaaatcctcaactagagaacatgttcaaaagaaagctgcagaatggaaaatcaagatagatattatagcagaacttcgatatgacctgccagcatcatacaagtttcacaaaaagaaatcagtggacattgaagtggacctaattcggttttccttttaaaagccccgcaaacaaaagtcgtttaaaacctatttaaaatgaataaaaaattggt

SEQ ID NO: 153579 - DNA, 235 bp, Homo sapiens
  Payload ID: 10205
  Gene Symbol: METTL5
  Gene Name: methyltransferase like 5
  ENST ID: ENST00000538491
  CDS Start-End: 90-235
ggcctggcgcttccggcaccggccgaggtgcgggtcgcctccagagatcctgtgccttcaaaccctacgagtccatactttaaaacaaaatgaagaaagtaaggcttaaggaactagagagtcgcctgcaacaagtggatggatttgaaaagcccaagctacttctggaacagtatcctaccaggccgcacattgcagaacttcgatatgacctgccagcatcatacaagtttca

SEQ ID NO: 153580 - DNA, 932 bp, Homo sapiens
  Payload ID: 10205
  Gene Symbol: METTL5
  Gene Name: methyltransferase like 5
  ENST ID: ENST00000614043
  CDS Start-End: 82-480
gcttccggcaccggccgaggtgcgggtcgcctccagagatcctgtgccttcaaaccctacgagtccatactttaaaacaaaatgaagaaagtaaggcttaaggaactagagagtcgcctgcaacaagtggatggatttgaaaagcccaagctacttctggaacagtatcctaccaggccgcacattgcagcatgtatgctctatacaatccataacacttatgatgacattgaaaataaagtcgttgcagatctaggatgtggttgtggagtacttagcatcggaactgcaatgttaggagcagggttgtgtgttggatttgacatagatgaagacgcattggaaatatttaataggaatgcagaagagtttgagttacaaatattgacatggttcaatgtgatgtgtgcttattatctaacagaatgtccaagtcattcgatacagaattatgaatcctccctttgggaccaaaaataataaagggacagatatggcttttctaaagactgctttggaaatggcaagaacagcagtatattccttacacaaatcctcaactagagaacatgttcaaaagaaagctgcagaatggaaaatcaagatagatattatagcagaacttcgatatgacctgccagcatcatacaagtttcacaaaaagaaatcagtctgatcatctaaatcacccgaaaatttcagcaagcatccaatcttttcttctagagatttctataaaaatatacaaagtgatcaaaaagtttcttaaaagcaacaacagaccagaaatgactcacaccaccttatagctatacaagaaaaagactagaaaccaaaatgctattttaaagtagtttcttccgccggggcagcaagagcgaaactccatctcaaaaaataataataataataaataaataaagtagtttcat

SEQ ID NO: 153581 - DNA, 1413 bp, Homo sapiens
  Payload ID: 10206
  Gene Symbol: METTL6
  Gene Name: methyltransferase like 6
  Uniprot ID: Q8TCB7
  ENST ID: ENST00000383789
  CDS Start-End: 256-978
agtggcgggggcggtgccatggcaaaagaactcccggataatccgaattcgtggtcctcagaattggtttagggttgtttcgcggttcttcccgtattctgcctccgaggcccagtggggctggctgtgggccccctgtgctgtttgaggcgtgaaactcacctcaggaaatgtatctgatccattagcgtggattcatattatttggtgatggagaatcttcagctgtgttaagtgttaccgtcagtttcagagatggcttctttgcaaaggaaagggctgcaggcaaggattctcacctctgaagaagaggagaaactgaaaagagaccaaactttggtgtctgattttaaacagcagaaattggaacaagaggctcagaaaaattgggatcttttttacaaaagaaatagcactaatttcttcaaagacagacactggaccaccagagagtttgaggagctaagatcatgtagagagtttgaagatcaaaagttaacaatgcttgaagctggctgtggggttggaaactgtttattcccacttttagaagaagatccgaatatctttgcctatgcctgtgatttttctccaagagccattgaatatgttaagcaaaatcctttatatgatacagaaagatgcaaggtattccagtgtgatctgactaaagatgatcttctggatcatgtaccgccagagtctgtggatgttgttatgttgatatttgtgctgtcagctgttcatcctgataagatgcaccttgtcttacaaaacatttacaagtgccatggctgctcttcagagcttcgccagccctgggacaaggatgattttgcagttacctgggatccatggagtcctgctataagggtcttgctgtgtcactcaggctggagtgcagtggcatggacgtggctcactgcagcctcaacttcctgggctcaagcagttctcccacctcagcctctgaagtagttgggactacaggacgcactaccagatccagctaatttttaatttttgtgtagagatggggtctcactatattgcccaggttggtctctaacattttaatcctgtgacactggacattccagggtgctcttggaggtactcaagaattgtcttcagggacgagcgaggtggctcacgcctgtaatcccaactttgggagactgaggtgggcaaattacttgaggtcaggagttcgagactagcctggccaacatggtgaaacctcatctctactaaaatacaaaaattagccgggcatggtggcgggcacctataatcccagctactcgggaggctgagacacgagaatcacttgaacgtgggagacggaggttgcagtgagctgagattatgccactgcactccagcctgggcgacagagcaagactccatctc

SEQ ID NO: 153582 - DNA, 1335 bp, Homo sapiens
  Payload ID: 10206
  Gene Symbol: METTL6
  Gene Name: methyltransferase like 6
  Uniprot ID: Q8TCB7
  ENST ID: ENST00000383790
  CDS Start-End: 242-1096
tgccatggcaaaagaactcccggataatccgaattcgtggtcctcagaattggtttagggttgtttcgcggttcttcccgtattctgcctccgaggcccagtggggctggctgtgggccccctgtgctgtttgaggcgtgaaactcacctcaggaaatgtatctgatccattagcgtggattcatattatttggtgatggagaatcttcagctgtgttaagtgttaccgtcagtttcagagatggcttctttgcaaaggaaagggctgcaggcaaggattctcacctctgaagaagaggagaaactgaaaagagaccaaactttggtgtctgattttaaacagcagaaattggaacaagaggctcagaaaaattgggatcttttttacaaaagaaatagcactaatttcttcaaagacagacactggaccaccagagagtttgaggagctaagatcatgtagagagtttgaagatcaaaagttaacaatgcttgaagctggctgtggggttggaaactgtttattcccacttttagaagaagatccgaatatctttgcctatgcctgtgatttttctccaagagccattgaatatgttaagcaaaatcctttatatgatacagaaagatgcaaggtattccagtgtgatctgactaaagatgatcttctggatcatgtaccgccagagtctgtggatgttgttatgttgatatttgtgctgtcagctgttcatcctgataagatgcaccttgtcttacaaaacatttacaaggtattaaaaccaggcaaaagtgtcttgtttcgtgactacggactgtatgatcatgccatgcttaggtttaaagccagcagcaaacttggagaaaacttttatgttagacaagatgggaccagatcatatttttttactgatgacttcctggctcagctctttatggacacaggttatgaagaagtggtaaacgagtatgtgtttcgagagacggtgaataaaaaagaaggcctgtgtgtgccaagagttttccttcagagcaaatttctaaagcctcctaagaacccatctcctgtggtcctgggcctggatcctaagtcctgacctttcatgaggttggcatttataccttcccttgaagaggaaaatttaaaatcactctttcgtctgggtgcggtggctcatgcctgtaatcccagcacttcgggaggccgaggttgggggatcatctgaggtcaggagtttgagaccagcctggccaacatggtgagaccccatctctactaaaaatacaaaaaaattagctgggcatagtggcgagtgcctgtaatcccagctactca

SEQ ID NO: 153583 - DNA, 564 bp, Homo sapiens
  Payload ID: 10206
  Gene Symbol: METTL6
  Gene Name: methyltransferase like 6
  ENST ID: ENST00000458728
  CDS Start-End: 1-316
attccagtgtgatctgactaaagatgatcttctggatcatgtaccgccagagtctgtggatgttgttatgttgatatttgtgctgtcagctgttcatcctgataagatgcaccttgtcttacaaaacatttacaaggtattaaaaccaggcaaaagtgtcttgtttcgtgactacggactgtatgatcatgccatgcttaggtttaaagccagcagcaaacttggagaaaacttttatgttagacaagatgggaccagatcatatttttttactgatggtctcaaacaaaagtctggaacctgggattctttgtaggatatctggctgtgcttttgtattatatgaaccacagaaaataatcttccagtatgatattgttttcagtatagtacctcaaccctaattttgcctggtaaccctttatccagagaccttttgttttcaacttacagtcttattctggggtgggggatgtacagtctggctgtgtggacttgcaggagagatttagggttctaacttcttcttactgacttccaaccaattctcctgtattcagtctt

SEQ ID NO: 153584 - DNA, 4020 bp, Homo sapiens
  Payload ID: 10206
  Gene Symbol: METTL6
  Gene Name: methyltransferase like 6
  Uniprot ID: Q8TCB7
  ENST ID: ENST00000443029
  CDS Start-End: 242-1096
tgccatggcaaaagaactcccggataatccgaattcgtggtcctcagaattggtttagggttgtttcgcggttcttcccgtattctgcctccgaggcccagtggggctggctgtgggccccctgtgctgtttgaggcgtgaaactcacctcaggaaatgtatctgatccattagcgtggattcatattatttggtgatggagaatcttcagctgtgttaagtgttaccgtcagtttcagagatggcttctttgcaaaggaaagggctgcaggcaaggattctcacctctgaagaagaggagaaactgaaaagagaccaaactttggtgtctgattttaaacagcagaaattggaacaagaggctcagaaaaattgggatcttttttacaaaagaaatagcactaatttcttcaaagacagacactggaccaccagagagtttgaggagctaagatcatgtagagagtttgaagatcaaaagttaacaatgcttgaagctggctgtggggttggaaactgtttattcccacttttagaagaagatccgaatatctttgcctatgcctgtgatttttctccaagagccattgaatatgttaagcaaaatcctttatatgatacagaaagatgcaaggtattccagtgtgatctgactaaagatgatcttctggatcatgtaccgccagagtctgtggatgttgttatgttgatatttgtgctgtcagctgttcatcctgataagatgcaccttgtcttacaaaacatttacaaggtattaaaaccaggcaaaagtgtcttgtttcgtgactacggactgtatgatcatgccatgcttaggtttaaagccagcagcaaacttggagaaaacttttatgttagacaagatgggaccagatcatatttttttactgatgacttcctggctcagctctttatggacacaggttatgaagaagtggtaaacgagtatgtgtttcgagagacggtgaataaaaaagaaggcctgtgtgtgccaagagttttccttcagagcaaatttctaaagcctcctaagaacccatctcctgtggtcctgggcctggatcctaagtcctgacctttcatgaggtctcaaacaaaagtctggaacctgggattctttgtaggatatctggctgtgcttttgtattatatgaaccacagaaaataatcttccagtatgatattgttttcagtatagtacctcaaccctaattttgcctggtaaccctttatccagagaccttttgttttcaacttacagtcttattctggggtgggggatgtacagtctggctgtgtggacttgcaggagagatttagggttctaacttcttcttactgacttccaaccaattctcctgtattcagtcttatacacacccccacttatactagacgtagctggtactaccaaagcctggtcacaaaactctatgggagtctcaatgcaagttgagttgcttcttgactttcatccctgctggcttaagactcagcttcacaagcctgctaagtcagttgctatttatcctgttttctagcccttcaaaattttaaatgaaaatttacatttttaattgacaaataatatatatatgggataaatatgatgttttgatagtaatagatgtatacattgtggaatgattatatgaagctaattagcatatcacactcctcacatacttctttttctttgtattgagaacatgtaaaatctattcttggccaagcatggtggctcacacctgtaattccaacactttgagaggccaaggcaggaagattgcttgagcccaggaattcaggggttccagacaccagcctgggcaacatagcaataccctgtctctaataaaaaaaaaaaaaagtaaaaataaatgtgtaatttaaaaaattcattattgttattatttttacaattttgaaactgtaggggccaggaacaaacttcccctttgccctctgaagaataactaaaaaatcactcaccaaatgcagattaataggagaaatggaataaaaacttagtaattgttttccttggtggatcccttaggtctttatgtagatagggaaaaggtttcttctagcatctgttgattgctaaggacatttaattcaaaatactcattataccagggagccatatctgggggtaaaattccagatgctccttcaaagtatacattattattgactatggtcaccatgtacagtagatctcaaaaacgtattccccctggctaactgaaatgtgtgccctttggtcaacatctcccctactcctctcctcccccagcctctggtaaccaccattctactttctgctgctgtgagttcaactttttaaaattccacgtataagtgaaatcatgtggtatttgtctttctgaatctggcttatttcacttagcataatatcttccaggttcacccatgttgttgcaaatgatagaatgtccttgtttctaatgttctcccaaatttaatcagttgtatggggtttatgtgataaaaatatccttttgctgtcattttcgtggggtttccagaaggatcctaactaggtacacatgcttagtctgtcttttttttttttttttttttgaagcaagtctccctctgttgccaggctggagtgcagtggcctgatcatgactcattgcaacctctgcctcccaggcccaagcaatcctcctacctcagcctccaagtagctgggactgaaggtgtgtgccagcatgtgtggctaattttatttttgtaaagacagagtctccttatattgcccaggctggtctcaaactcctgggttcgagatcctcctgcctctgcctcccaaagtgctgggattacaggcatgagccatggtgcctggtctagtctgtcatctttaaacaattgggttgggaaggaaaaggtagcacatagatagatgatttaagcagaaatagataagcataattgtccactgtaaaggggctgaatgatctggagaatggaggcatctcaggaaaactgaacttggtggtgtgtgcttaggactaatgaaaagtggccgggcacagatgctcatgcctataatcccagcacttcgggagggtgagagggagtataatttgaggccaggaattcaaggttgcagtgagccatgattgtgccactgttctccagcctgggcagcagagtgagaccccgactcttaaaaaaaaaaaaaaaagaaccaaagaaatgttagttccagggattcccagggacatgggcagggtccaagaatgatgctgagttaaggttaggtggctattcagaaagctacttcgacttgtatcccatattatggatcaaggaccttaaaaatagccatactttttttttgttctagtaactcaatttgtaggattgtttcctaagagataatctgacatattcaaggacttcttcacaaagatattcattagctgcattatttatagtaccaaacattataaatagtctaaaccagagatccacaagctatggctataacagtgacaaggaggcctagcgtgactaactccattttgctcctaacccccctgcagcgataacctgtatcttttaggttaactgcttttgcttatctctgcacataggccaagctaactatagaaggaatttagtttatagtttagagcaaggatggtaatagtgcctcccccaaaactaacccctgaggagataaggaggatgtatgcaagtaataatgttatgttaaagatttataagagcactgtgacctgaccaaggacaaagtttcaccacctccttggacccttgccaccacccagatgtgatcactggccacttcttgacctcaactccctccctcttcccccttcctctcacgtaaaaggagcctgaaatttgtattgacttaaaaatggttcttcaggacactactcttccattttcttggtttgctggctctctgaataaaagtcactttccttgcctcaa

SEQ ID NO: 153585 - DNA, 1221 bp, Homo sapiens
  Payload ID: 10206
  Gene Symbol: METTL6
  Gene Name: methyltransferase like 6
  ENST ID: ENST00000450816
  CDS Start-End: 264-983
ctagcggaagtggcgggggcggtgccatggcaaaagaactcccggataatccgaattcgtggtcctcagaattggtttagggttgtttcgcggttcttcccgtattctgcctccgaggcccagtggggctggctgtgggccccctgtgctgtttgaggcgtgaaactcacctcaggaaatgtatctgatccattagcgtggattcatattatttggtgatggagaatcttcagctgtgttaagtgttaccgtcagtttcagagatggcttctttgcaaaggaaagggctgcaggcaaggattctcacctctgaagaagaggagaaactgaaaagagaccaaactttggtgtctgattttaaacagcagaaattggaacaagaggctcagaaaaattgggatcttttttacaaaagaaatagcactaatttcttcaaagacagacactggaccaccagagagtttgaggagctaagatcatgtagagagcaaaatcctttatatgatacagaaagatgcaaggtattccagtgtgatctgactaaagatgatcttctggatcatgtaccgccagagtctgtggatgttgttatgttgatatttgtgctgtcagctgttcatcctgataagatgcaccttgtcttacaaaacatttacaaggtattaaaaccaggcaaaagtgtcttgtttcgtgactacggactgtatgatcatgccatgcttaggtttaaagccagcagcaaacttggagaaaacttttatgttagacaagatgggaccagatcatatttttttactgatgacttcctggctcagctctttatggacacaggttatgaagaagtggtaaacgagtatgtgtttcgagagacggtgaataaaaaagaaggcctgtgtgtgccaagagttttccttcagagcaaatttctaaagcctcctaagaacccatctcctgtggtcctgggcctggatcctaagtcctgacctttcatgaggttggcatttataccttcccttgaagaggaaaatttaaaatcactctttcgtctgggtgcggtggctcatgcctgtaatcccagcacttcgggaggccgaggttgggggatcatctgaggtcaggagtttgagaccagcctggccaacatggtgagaccccatctctactaaaaatacaaaaaaattagctgggcatagtggcgagtgcctgtaatcccagctactc

SEQ ID NO: 153586 - DNA, 615 bp, Homo sapiens
  Payload ID: 10206
  Gene Symbol: METTL6
  Gene Name: methyltransferase like 6
  ENST ID: ENST00000453819
  CDS Start-End: 1-477
ttattcccacttttagaagaagatccgaatatctttgcctatgcctgtgatttttctccaagagccattgaatatgttaagcaaaatcctttatatgatacagaaagatgcaaggtattccagtgtgatctgactaaagatgatcttctggatcatgtaccgccagagtctgtggatgttgttatgttgatatttgtgctgtcagctgttcatcctgataagatgcaccttgtcttacaaaacatttacaagtgccatggctgctcttcagagcttcgccagccctgggacaaggatgattttgcagttacctgggatccatggagtcctgctataaggctgcttggagaaggcttgcgacatgtgcacgagaccctgaaacaagccctctactgcacaatatttacccagcacctggaaggcacagacctggcccctgcccttgaagagctcacaagccttctctggtgtcagtgactcccctaatgagcttgggttaatggacagcctctgacatgccatgtggattccctactaggaattgtgctggaataagagggagggcaagtcagaaacttcttgtccagttaaaaataaagcaaatttgacagtata

SEQ ID NO: 153587 - DNA, 880 bp, Homo sapiens
  Payload ID: 10206
  Gene Symbol: METTL6
  Gene Name: methyltransferase like 6
  ENST ID: ENST00000598878
  CDS Start-End: 468-880
ctagctggggagggagaggccatatgagtggagggacctgtggaggaaaaattattattactaccttgatgtccgctgaaccaaagtggatggaaatttctcaggacatattcatccaaactacaaaaacagctcttctacaggtctacttaaactttgaaagatgagattgttcaaaaatgacacgagaaaatcacccatcaccactaagttaaagacttgaatatgtgagagttccagagcctcaaactcctactacagtcactgatccataacattttcctcttgcaatggactccacgccaaagtagctcagtcttgcggcatgtttgtgcaccaaaaaccccctgtgctgtttgaggcgtgaaactcacctcaggaaatgtatctgatccattagcgtggattcatattatttggtgatggagaatcttcagctgtgttaagtgttaccgtcagtttcagagatggcttctttgcaaaggaaagggctgcaggcaaggattctcacctctgaagaagaggagaaactgaaaagagaccaaactttggtgtctgattttaaacagcagaaattggaacaagaggctcagaaaaattgggatcttttttacaaaagaaatagcactaatttcttcaaagacagacactggaccaccagagagtttgaggagctaagatcatgtagagagcaaaatcctttatatgatacagaaagatgcaaggtattccagtgtgatctgactaaagatgatcttctggatcatgtaccgccagagtctgtggatgttgttatgttgatatttgtgctgtcagctgttcatcctgataagatgcaccttgtcttacaaaacatttacaagtgccatggctgctcttc

SEQ ID NO: 153588 - DNA, 3390 bp, Homo sapiens
  Payload ID: 10207
  Gene Symbol: METTL7A
  Gene Name: methyltransferase like 7A
  Uniprot ID: Q9H8H3
  ENST ID: ENST00000332160
  CDS Start-End: 289-1023
agaaggggaaacaggaatcgattaggaataaaggattataatccactttccttctgaggaaaagctgggaaccttctcattttgccttatgaaaactaagctgaatcgactgctgccaaacatctattaggcaaaattggcctcttgcccatgatttgactttccagcacagccagttctttttctcctctgcagctgattggctctggagtgtggccagaagcctctctcctgcaattaaaggagtcgggtctctaactgttgatctgtttttttcccttctgagcaatggagcttaccatctttatcctgagactggccatttacatcctgacatttcccttgtacctgctgaactttctgggcttgtggagctggatatgcaaaaaatggttcccctacttcttggtgaggttcactgtgatatacaacgaacagatggcaagcaagaagcgggagctcttcagtaacctgcaggagtttgcgggcccctccgggaaactctccctgctggaagtgggctgtggcacgggggccaacttcaagttctacccacctgggtgcagggtgacctgtattgaccccaaccccaactttgagaagtttttgatcaagagcattgcagagaaccgacacctgcagtttgagcgctttgtggtagctgccggggagaacatgcaccaggtggctgatggctctgtggatgtggtggtctgcaccctggtgctgtgctctgtgaagaaccaggagcggattctccgcgaggtgtgcagagtgctgagaccgggaggggctttctatttcatggagcatgtggcagctgagtgttcgacttggaattacttctggcaacaagtcctggatcctgcctggcaccttctgtttgatgggtgcaacctgaccagagagagctggaaggccctggagcgggccagcttctctaagctgaagctgcagcacatccaggccccactgtcctgggagttggtgcgccctcatatctatggatatgctgtgaaatagtgtgagctggcagttaagagctgaatggctcaaagaatttaaagcttcagttttacatttaaaatgctaagtgggagaagagaaaccttttttttggggggcggtttttttggtttgttgttggttttttttttttttttggcgggaagaaagagttttgctcttgttgcccaggctggagtgcaatgacgtgatctccgctcactgcaacctccacctcgcgggtttaagcgattcttctgcctcagcctccctagtagctgggattacaggtgcccaccaccatgcccagctaatttgtatttttagttgagacagggtttcactacgttggccaggctggtcttgaactcctgatctcaggcaatccacccacctcagcctcccaaagtgctgggatgacaggcgtgagcaaccgcacccagcttaaggtttttttgttttgttttgagacggagttttcgctcttgttgcccaggctggagtgcaatgctgtgatctcagcttaccacaacctccacctcccgggttcaagtgattcacctgcctcagcctcctgagtagctggtattacaggcatgcgtcaccacgccggctaattttgtacttttagtagagatggtgtttccccacgttggtcagtctggtctcaaattcctgacctcaggtgatctgcctgcctcggcctcccaaagtgctgtgattacagacgtcagccaccatgcctggcctgaaaccttttttaggtaaagttgaattccatccttaaaagtttctgttatatcctatttagccattttctattgtctcccaaagaattcacatcaaaaaaacagctttgaactcccccttcaaaggaaacagtcgactttcataattagcatctaccattatccccaaatcttattttattcattgacttgaaattttttccaattgcttttttttttttttttttaaggttaagagcagaggtttactaggccaaagaaagagaatagctctctgttgcagagaggggtcctggagaaatgggttaccccagttgtcttatttaaatggttacccatcagattttaattttatcttctctttgagagcttggtaataagaagcacttaaatcactccaaagaagactttaaaaagggagcagtgaaaaggtcttaataatttattgattgaattaagaaatactagctaattaagaatctgagtctaaacagcacagattttttctttctgcttttaaattgtgttttaaaaaaagagacagggggctgggcgtggtggctcacgcctgtaatcctagcactttgggaggccgaggcgggtggatcacgaggtaggagttaaagaccagcctggccaacatggcaaaaccctactaaagatacaaaaaaaaaaaaaaattagccaggcgtggtggtgggtgcctgtaatcccaggtacttggaaggctgaggcaggagaatctcttgaacccagaaggcgaaggttgcagtgaaccgagatcatgccattgtactctagcctgggtgacaagagcaagactccgtctcaaaaaaaaaaaaaaaaaaaaaaagaagtagagacagggagacagggtctcactgtgttgcctaggccggtcttgaactcctgggctcaagtgattctcccaccttgacctcctaaattgttgggattacaggtgtgagacagtgcacctggccgaaatagctcaagtttctgaaaaacaaatctgaatctatttgttattcttagcgtcactggtctggctttcagaattaacatacaaggttgccacacctagttctgcccagctttatgtcttttattccagtattccaccaaagtttgttttcctgcattccagttctcaagtcttaagataaagattgtacttgacagtttagtatatccataaaactatttgaggtggttaaggttcttgggttcattttccttaatactttgctgaatattgtagattgtaggcaatgaaaaagtctactaaattaggaaaaccttgaataattaggtatcctaggtaagagcccctaaacatcaagcaatctgtgagtctgtaaagaaataaatattttttggattattcttatctaattccacccctgttggaagatgatttctttgttctttgcaactatggaagctgtgaaaatcatcacaagtgcctctgaaagcgagtgttaggttggttagagggtttaatattttctgcaatggtttgtaggaattttaataaatgtagtatattttctgagatgattttgtaaaagtactattttaaatatcaaatcaaccaataaattcacatttgtgttaggaacagaaatatggttta

SEQ ID NO: 153589 - DNA, 1825 bp, Homo sapiens
  Payload ID: 10207
  Gene Symbol: METTL7A
  Gene Name: methyltransferase like 7A
  Uniprot ID: Q9H8H3
  ENST ID: ENST00000547104
  CDS Start-End: 57-791
tgcaattaaaggagtcgggtctctaactgttgatctgtttttttcccttctgagcaatggagcttaccatctttatcctgagactggccatttacatcctgacatttcccttgtacctgctgaactttctgggcttgtggagctggatatgcaaaaaatggttcccctacttcttggtgaggttcactgtgatatacaacgaacagatggcaagcaagaagcgggagctcttcagtaacctgcaggagtttgcgggcccctccgggaaactctccctgctggaagtgggctgtggcacgggggccaacttcaagttctacccacctgggtgcagggtgacctgtattgaccccaaccccaactttgagaagtttttgatcaagagcattgcagagaaccgacacctgcagtttgagcgctttgtggtagctgccggggagaacatgcaccaggtggctgatggctctgtggatgtggtggtctgcaccctggtgctgtgctctgtgaagaaccaggagcggattctccgcgaggtgtgcagagtgctgagaccgggaggggctttctatttcatggagcatgtggcagctgagtgttcgacttggaattacttctggcaacaagtcctggatcctgcctggcaccttctgtttgatgggtgcaacctgaccagagagagctggaaggccctggagcgggccagcttctctaagctgaagctgcagcacatccaggccccactgtcctgggagttggtgcgccctcatatctatggatatgctgtgaaatagtgtgagctggcagttaagagctgaatggctcaaagaatttaaagcttcagttttacatttaaaatgctaagtgggagaagagaaaccttttttttggggggcggtttttttggtttgttgttggttttttttttttttttggcaggagaatctcttgaacccagaaggcgaaggttgcagtgaaccgagatcatgccattgtactctagcctgggtgacaagagcaagactccgtctcaaaaaaaaaaaaaaaaaaaaaaagaagtagagacagggagacagggtctcactgtgttgcctaggccggtcttgaactcctgggctcaagtgattctcccaccttgacctcctaaattgttgggattacaggtgtgagacagtgcacctggccgaaatagctcaagtttctgaaaaacaaatctgaatctatttgttattcttagcgtcactggtctggctttcagaattaacatacaaggttgccacacctagttctgcccagctttatgtcttttattccagtattccaccaaagtttgttttcctgcattccagttctcaagtcttaagataaagattgtacttgacagtttagtatatccataaaactatttgaggtggttaaggttcttgggttcattttccttaatactttgctgaatattgtagattgtaggcaatgaaaaagtctactaaattaggaaaaccttgaataattaggtatcctaggtaagagcccctaaacatcaagcaatctgtgagtctgtaaagaaataaatattttttggattattcttatctaattccacccctgttggaagatgatttctttgttctttgcaactatggaagctgtgaaaatcatcacaagtgcctctgaaagcgagtgttaggttggttagagggtttaatattttctgcaatggtttgtaggaattttaataaatgtagtatattttctgagatgattttgtaaaagtactattttaaatatcaaatcaaccaataaattcacatttgtgttaggaacagaa

SEQ ID NO: 153590 - DNA, 1846 bp, Homo sapiens
  Payload ID: 10207
  Gene Symbol: METTL7A
  Gene Name: methyltransferase like 7A
  ENST ID: ENST00000550097
  CDS Start-End: 1-733
ggagcttaccatctttatcctgagactggccatttacatcctgacatttcccttgtacctgctgaactttctgggcttgtggagctggatatgcaaaaaatggttcccctacttcttggtgaggttcactgtgatatacaacgaacagatggcaagcaagaagcgggagctcttcagtaacctgcaggagtttgcgggcccctccgggaaactctccctgctggaagtgggctgtggcacgggggccaacttcaagttctacccacctgggtgcagggtgacctgtattgaccccaaccccaactttgagaagtttttgatcaagagcattgcagagaaccgacacctgcagtttgagcgctttgtggtagctgccggggagaacatgcaccaggtggctgatggctctgtggatgtggtggtctgcaccctggtgctgtgctctgtgaagaaccaggagcggattctccgcgaggtgtgcagagtgctgagaccgggaggggctttctatttcatggagcatgtggcagctgagtgttcgacttggaattacttctggcaacaagtcctggatcctgcctggcaccttctgtttgatgggtgcaacctgaccagagagagctggaaggccctggagcgggccagcttctctaagctgaagctgcagcacatccaggccccactgtcctgggagttggtgcgccctcatatctatggatatgctgtgaaatagtgtgagctggcagttaagagctgaatggctcaaagaatttaaagcttcagttttacatttaaaatgctaagtgggagaagagaaaccttttttttggggggcggtttttttggtttgttgttggttttttttttttttttggcgggaagaaagagttttgctcttgttgcccaggctggagtgcaatgacgtgatctccgctcactgcaacctccacctcgcgggtttaagcgattcttctgcctcagcctccctagtagctgggattacaggtacttggaaggctgaggcaggagaatctcttgaacccagaaggcgaaggttgcagtgaaccgagatcatgccattgtactctagcctgggtgacaagagcaagactccgtctcaaaaaaaaaaaaaaaaaaaaaaagaagtagagacagggagacagggtctcactgtgttgcctaggccggtcttgaactcctgggctcaagtgattctcccaccttgacctcctaaattgttgggattacaggtgtgagacagtgcacctggccgaaatagctcaagtttctgaaaaacaaatctgaatctatttgttattcttagcgtcactggtctggctttcagaattaacatacaaggttgccacacctagttctgcccagctttatgtcttttattccagtattccaccaaagtttgttttcctgcattccagttctcaagtcttaagataaagattgtacttgacagtttagtatatccataaaactatttgaggtggttaaggttcttgggttcattttccttaatactttgctgaatattgtagattgtaggcaatgaaaaagtctactaaattaggaaaaccttgaataattaggtatcctaggtaagagcccctaaacatcaagcaatctgtgagtctgtaaagaaataaatattttttggattattcttatctaattccacccctgttggaagatgatttctttgttctttgcaactatggaagctgtgaaaatcatcacaagtgcctctgaaagcgagtgttaggttggttagagggtttaatattttctgcaatggtttgtaggaattttaataaatgtagtatattttctgaga

SEQ ID NO: 153591 - DNA, 4076 bp, Homo sapiens
  Payload ID: 10207
  Gene Symbol: METTL7A
  Gene Name: methyltransferase like 7A
  Uniprot ID: Q9H8H3
  ENST ID: ENST00000548553
  CDS Start-End: 982-1716
taaagagatagagtctcactatgttgcccagacaggatttgaattcctgggctcaaggtatgcttctgtcttagctcctcagtagctgagaccatgggcacccaccactgtgcccagattcgggctttcttgtaaaaagcggatggatgcttgaaactattttctgaatccctttggctcccaaatgtgaatattctgggaaatatttttatccaaattagctgagtaatcgagtagttaggcacattttgaagactgaggcttgtcctttaaaagaagggcagcccacaaactgacttccttgagccaaaaattgttttaaaaggggaagtacagcccaaaacagtgattttaaaatatcaacaaaaagagtcaaattctgtaaaatatttaaagagatttattctgagccaaatatgagtgaccatgtcctgtgacacagccctcgggaaatcctgagaacatgtgcccaaggtggtcagggtacagcttggttttctacattttagggagacatgaggcttcaatcaaatacatttaagaaatacattggttcagtccagaaaggcaggacaacccgacgcgaggcagggagcttccaggttatagaggtcactggagagcccggtggggtgtaagtacactgcgcttataaaactctagcaggaagctagcagctgtctccaaacccagagaaggggaaacaggaatcgattaggaataaaggattataatccactttccttctgaggaaaagctgggaaccttctcattttgccttatgaaaactaagctgaatcgactgctgccaaacatctattaggcaaaattggcctcttgcccatgatttgactttccagcacagccagttctttttctcctctgcagctgattggctctggagtgtggccagaagcctctctcctgcaattaaaggagtcgggtctctaactgttgatctgtttttttcccttctgagcaatggagcttaccatctttatcctgagactggccatttacatcctgacatttcccttgtacctgctgaactttctgggcttgtggagctggatatgcaaaaaatggttcccctacttcttggtgaggttcactgtgatatacaacgaacagatggcaagcaagaagcgggagctcttcagtaacctgcaggagtttgcgggcccctccgggaaactctccctgctggaagtgggctgtggcacgggggccaacttcaagttctacccacctgggtgcagggtgacctgtattgaccccaaccccaactttgagaagtttttgatcaagagcattgcagagaaccgacacctgcagtttgagcgctttgtggtagctgccggggagaacatgcaccaggtggctgatggctctgtggatgtggtggtctgcaccctggtgctgtgctctgtgaagaaccaggagcggattctccgcgaggtgtgcagagtgctgagaccgggaggggctttctatttcatggagcatgtggcagctgagtgttcgacttggaattacttctggcaacaagtcctggatcctgcctggcaccttctgtttgatgggtgcaacctgaccagagagagctggaaggccctggagcgggccagcttctctaagctgaagctgcagcacatccaggccccactgtcctgggagttggtgcgccctcatatctatggatatgctgtgaaatagtgtgagctggcagttaagagctgaatggctcaaagaatttaaagcttcagttttacatttaaaatgctaagtgggagaagagaaaccttttttttggggggcggtttttttggtttgttgttggttttttttttttttttggcgggaagaaagagttttgctcttgttgcccaggctggagtgcaatgacgtgatctccgctcactgcaacctccacctcgcgggtttaagcgattcttctgcctcagcctccctagtagctgggattacaggtgcccaccaccatgcccagctaatttgtatttttagttgagacagggtttcactacgttggccaggctggtcttgaactcctgatctcaggcaatccacccacctcagcctcccaaagtgctgggatgacaggcgtgagcaaccgcacccagcttaaggtttttttgttttgttttgagacggagttttcgctcttgttgcccaggctggagtgcaatgctgtgatctcagcttaccacaacctccacctcccgggttcaagtgattcacctgcctcagcctcctgagtagctggtattacaggcatgcgtcaccacgccggctaattttgtacttttagtagagatggtgtttccccacgttggtcagtctggtctcaaattcctgacctcaggtgatctgcctgcctcggcctcccaaagtgctgtgattacagacgtcagccaccatgcctggcctgaaaccttttttaggtaaagttgaattccatccttaaaagtttctgttatatcctatttagccattttctattgtctcccaaagaattcacatcaaaaaaacagctttgaactcccccttcaaaggaaacagtcgactttcataattagcatctaccattatccccaaatcttattttattcattgacttgaaattttttccaattgcttttttttttttttttttaaggttaagagcagaggtttactaggccaaagaaagagaatagctctctgttgcagagaggggtcctggagaaatgggttaccccagttgtcttatttaaatggttacccatcagattttaattttatcttctctttgagagcttggtaataagaagcacttaaatcactccaaagaagactttaaaaagggagcagtgaaaaggtcttaataatttattgattgaattaagaaatactagctaattaagaatctgagtctaaacagcacagattttttctttctgcttttaaattgtgttttaaaaaaagagacagggggctgggcgtggtggctcacgcctgtaatcctagcactttgggaggccgaggcgggtggatcacgaggtaggagttaaagaccagcctggccaacatggcaaaaccctactaaagatacaaaaaaaaaaaaaaattagccaggcgtggtggtgggtgcctgtaatcccaggtacttggaaggctgaggcaggagaatctcttgaacccagaaggcgaaggttgcagtgaaccgagatcatgccattgtactctagcctgggtgacaagagcaagactccgtctcaaaaaaaaaaaaaaaaaaaaaaagaagtagagacagggagacagggtctcactgtgttgcctaggccggtcttgaactcctgggctcaagtgattctcccaccttgacctcctaaattgttgggattacaggtgtgagacagtgcacctggccgaaatagctcaagtttctgaaaaacaaatctgaatctatttgttattcttagcgtcactggtctggctttcagaattaacatacaaggttgccacacctagttctgcccagctttatgtcttttattccagtattccaccaaagtttgttttcctgcattccagttctcaagtcttaagataaagattgtacttgacagtttagtatatccataaaactatttgaggtggttaaggttcttgggttcattttccttaatactttgctgaatattgtagattgtaggcaatgaaaaagtctactaaattaggaaaaccttgaataattaggtatcctaggtaagagcccctaaacatcaagcaatctgtgagtctgtaaagaaataaatattttttggattattcttatctaattccacccctgttggaagatgatttctttgttctttgcaactatggaagctgtgaaaatcatcacaagtgcctctgaaagcgagtgttaggttggttagagggtttaatattttctgcaatggtttgtaggaattttaataaatgtagtatattttctgagatgattttgtaaaagtactattttaaatatcaaatcaaccaataaattcacatttgtgttaggaacagaaata

SEQ ID NO: 153592 - DNA, 618 bp, Homo sapiens
  Payload ID: 10207
  Gene Symbol: METTL7A
  Gene Name: methyltransferase like 7A
  ENST ID: ENST00000550502
  CDS Start-End: 79-618
acatttaagaaatacattggttcagtccagaaaggcaggacaacccgacgcgaggcagggagcttccaggttatagcaatggagcttaccatctttatcctgagactggccatttacatcctgacatttcccttgtacctgctgaactttctgggcttgtggagctggatatgcaaaaaatggttcccctacttcttggtgaggttcactgtgatatacaacgaacagatggcaagcaagaagcgggagctcttcagtaacctgcaggagtttgcgggcccctccgggaaactctccctgctggaagtgggctgtggcacgggggccaacttcaagttctacccacctgggtgcagggtgacctgtattgaccccaaccccaactttgagaagtttttgatcaagagcattgcagagaaccgacacctgcagtttgagcgctttgtggtagctgccggggagaacatgcaccaggtggctgatggctctgtggatgtggtggtctgcaccctggtgctgtgctctgtgaagaaccaggagcggattctccgcgaggtgtgcagagtgctgagaccgggaggggctttctatttcatggagcatgtggcagctgagtgt

SEQ ID NO: 153593 - DNA, 1506 bp, Homo sapiens
  Payload ID: 10208
  Gene Symbol: METTL7B
  Gene Name: methyltransferase like 7B
  Uniprot ID: Q6UX53
  ENST ID: ENST00000394252
  CDS Start-End: 210-944
aaaagtcattgaagagcttgtggggctgtgggacctgcgccctctggaggaattccatacacccactcaactctggcaaataggaaattgtcaagtaggagacaaggagcaaagtcctatcacagcgggaggggacgccagcgcctgcagaggctgagcagggaaaaagccagtgccccagcggaagcacagctcagagctggtctgccatggacatcctggtcccactcctgcagctgctggtgctgcttcttaccctgcccctgcacctcatggctctgctgggctgctggcagcccctgtgcaaaagctacttcccctacctgatggccgtgctgactcccaagagcaaccgcaagatggagagcaagaaacgggagctcttcagccagataaaggggcttacaggagcctccgggaaagtggccctactggagctgggctgcggaaccggagccaactttcagttctacccaccgggctgcagggtcacctgcctagacccaaatccccactttgagaagttcctgacaaagagcatggctgagaacaggcacctccaatatgagcggtttgtggtggctcctggagaggacatgagacagctggctgatggctccatggatgtggtggtctgcactctggtgctgtgctctgtgcagagcccaaggaaggtcctgcaggaggtccggagagtactgagaccgggaggtgtgctctttttctgggagcatgtggcagaaccatatggaagctgggccttcatgtggcagcaagttttcgagcccacctggaaacacattggggatggctgctgcctcaccagagagacctggaaggatcttgagaacgcccagttctccgaaatccaaatggaacgacagccccctcccttgaagtggctacctgttgggccccacatcatgggaaaggctgtcaaataatctttcccaagctccaaggcactcatttgctccttccccagcctccaattagaacaagccacccaccagcctatctatcttccactgagagggacctagcagaatgagagaagacattcatgtaccacctactagtccctctctccccaacctctgccagggcaatctctaacttcaatcccgccttcgacagtgaaaaagctctacttctacgctgacccagggaggaaacactaggaccctgttgtatcctcaactgcaagtttctggactagtctcccaacgtttgcctcccaatgttgtccctttccttcgttcccatggtaaagctcctctcgctttcctcctgaggctacacccatgcgtctctaggaactggtcacaaaagtcatggtgcctgcatccctgccaagcccccctgaccctctctccccactaccaccttcttcctgagctgggggcaccagggagaatcagagatgctggggatgccagagcaagactcaaagaggcagaggttttgttctcaaatattttttaataaatagacgaaaccacgaaa

SEQ ID NO: 153594 - DNA, 1368 bp, Homo sapiens
  Payload ID: 10208
  Gene Symbol: METTL7B
  Gene Name: methyltransferase like 7B
  ENST ID: ENST00000614691
  CDS Start-End: 78-908
ggacgccagcgcctgcagaggctgagcagggaaaaagccagtgccccagcggaagcacagctcagagctggtctgccatggacatcctggtcccactcctgcagctgctggtgctgcttcttaccctgcccctgcacctcatggctctgctgggctgctggcagcccctgtgcaaaagctacttcccctacctgatggccgtgctgactcccaagagcaaccgcaagatggagagcaagaaacgggagctcttcagccagataaaggggcttacaggagcctccgggaaagtggccctactggagctgggctgcggaaccggagccaactttcagttctacccaccgggctgcagggtcacctgcctagacccaaatccccactttgagaagttcctgacaaagagcatggctgagaacaggcacctccaatatgagcggtttgtggtggctcctggagaggacatgagacagctggctgatggctccatggatgtggtggtctgcactctggtgctgtgctctgtgcagagcccaaggaaggtcctgcaggaggtccggagagtactgagaccgggaggtgtgctctttttctgggagcatgtggcagaaccatatggaagctgggccttcatgtggcagcaagttttcgagcccacctggaaacacattggggatggctgctgcctcaccagagagacctggaaggatcttgagaacgcccagttctccgaaatccaaatggaacgacagccccctcccttgaagtggctacctgttgggccccacatcatgggaaaggctgtcaaatctttcccaagctccaaggcactcatttgctccttccccagcctccaattagaacaagccacccaccagcctatctatcttccactgagagggacctagcagaatgagagaagacattcatgtaccacctactagtccctctctccccaacctctgccagggcaatctctaacttcaatcccgccttcgacagtgaaaaagctctacttctacgctgacccagggaggaaacactaggaccctgttgtatcctcaactgcaagtttctggactagtctcccaacgtttgcctcccaatgttgtccctttccttcgttcccatggtaaagctcctctcgctttcctcctgaggctacacccatgcgtctctaggaactggtcacaaaagtcatggtgcctgcatccctgccaagcccccctgaccctctctccccactaccaccttcttcctgagctgggggcaccagggagaatcagagatgctggggatgccagagcaagactcaaagaggcagaggttttgttctcaaatattttttaataaatagacgaaaccacg

SEQ ID NO: 153595 - DNA, 8203 bp, Homo sapiens
  Payload ID: 10209
  Gene Symbol: METTL8
  Gene Name: methyltransferase like 8
  ENST ID: ENST00000375258
  CDS Start-End: 217-1353
gctgggcagagccctgggggcgcggtgctgccgcctccaggtctccgccccgtgtgtgcgccctgcacttagggatccctccctcactgccccggtactcacaagcttctcggccccgaccttcgccctgggaggttctggccaggtgccgggaggggcgctgtgtcgagggcgatccccccaaagcagcgtcccgtgctaaaggtactgcttaggatgaatatgatttggagaaattccatttcttgtctaaggctaggaaaggtgccacacagataccaaagtggttaccacccagtggcccctctgggatcaaggattttaactgacccagccaaagtttttgaacacaacatgtgggatcacatgcagtggtctaaggaagaagaagcagcagccagaaaaaaagtaaaagaaaactcagctgtgcgagtccttctggaagagcaagttaagtatgagagagaagctagtaaatactgggacacattttacaagattcataagaataagtttttcaaggatcgtaattggctgttgagggaatttcctgaaattcttccagttgatcaaaaacctgaagagaaggcgagagaatcatcatgggatcatgtaaaaactagtgctacaaatcgtttctcaagaatgcactgtcctactgtgcctgatgaaaaaaatcattatgagaaaagttctggttcttcagaaggtcaaagcaaaacagaatctgatttttccaacctagactctgaaaaacacaaaaaaggacctatggagactggattgtttcctggtagcaatgccactttcaggatactagaggttggttgtggagctggaaatagtgtgtttccaattttgaacactttggagaactctccggagtcctttctgtattgttgtgattttgcttctggagctgtggagctcgtaaagtcacactcgtcctacagagcaacccagtgttttgcctttgttcatgatgtatgtgatgatggcttaccttacccttttccagatgggatcctggatgtcattctccttgtctttgtgctctcttctattcatcctgacaggatgcaaggtgttgtaaaccgactgtccaagttactgaaacctgggggaatgctgttatttcgagactatggaagatatgataagactcagcttcgttttaaaaagggacattgtttatctgaaaatttttatgttcgaggagatggtaccagagcatatttctttacaaaaggggaagtccacagtatgttctgcaaagccagtttagatgaaaagcaaaatctggttgatcgccgcttacaagttaataggaaaaaacaagtgaaaatgcaccgagtgtggattcaaggcaaattccagaaaccattgcaccagactcagaatagctccaatatggtatctacactcctttcacaagactgaactttgtaacatgttaaggtacaaagccagaggactgtgctattcaaggactactgtaagtctattgtttctcaaaagacaatgagaaaaaaagaagagaatttgtatttcctgccgttttgtcataggtgagctcctttgtgcattttaagcacatgtaagtggttcagcacagtatgcctttttctgtgctttgaaaacttgatatgctcaagcttgtttgaatttattacatctaaccattttgcttgttccttgatttttataagcattcaattaagttagtattatgtcaagtaattttgagaaaatgtaacttgacattttttgcaagtaaaaaaaattgtttatttgtttaggcttagtaaaccagttcccaaacacagtcagactcttcccattgtcatctgattgcagagagaaagcacaccttatttccagggaaagctacaacaagcccaaggtcaaagtgtattattttttgtcttgttgttgtctattttctcccaatttttttttgaaattcagaggctcatatctgaaatagaattttagttcctctttcctttcctaaaattggggaagtacagcccatgctgacattattttcaggctattcttagatatacaagttgttaggccaggtgcaatggctcgcacctgtaatcccagcactttggggggctgaggcaggcagatcggttgagctcaggagttcaagaccagcctggacaacatggcaaaaccctgtctctcccaagaatacaaaaattagccaggcatggtggcacacacctgtggtcccagctactcaggagactgaggtgggaggatcgcttgagcctcggaggcggaggttgcagtgagctgagattgtaccactgcgctccaaactgggtgacatggtgagaccttgtctccaaaaaaaaaaaaaaaaaaaaaaaaggtatgtaagctgacaagctcttgtatcaagggcttttgaaccagagcaacttcatcttgaatagggactgtgtaaaatgaagctgagacctactaggctgcaatcccaggaggttaagacattcttagtcacaggatgagataggaagtcagtacaagatacaggtcatacagaccttgctgataaaacaggttgcagtgaagaagccggccaaatgccaccaaaaccaagatggcaatgagagtgtcctctggctgtcctcactgctacactcccaccagtgccatgatagtttacaaatgccatggcaacatcaggaagttacccatatggtctacaaaggggaggcctgaataatccaccccttgtgtagcatataatcaagaaataaccttaaaaatgggcaaccagtagcccttggggctgctctgcctatggagtagccattctttatgttttactttttttttttttttttttttgagatggagtcttgctctggcacccaggctggagtgcagtggcgtgatctcagctcactgccagctccacctcccgggttcacgccattctcttgcttcagcctcctgagtagctgggactacaagcacccaccaccatgcccagctaattttttttttttttgtatttttagtagagacggggtttcaccatgttagccaggatggtctcaatctcctgaccttgtgatccgcccgcctcggcctcccaaagtgctgggattacaggtgtgagccaccgcgcccagcctattctttacttaaacttgttttcactttgctgtatggactcaattctttcttgcacaagatccaagaatcctctcttggcgtctggatccagaccctttctggtatcagtggtaagctctgtttaagacaactgtcatacccaagagaattcttaaattgtggcagttaaaaatgtatttatcccctcgagggccgggcgcagtcgctcaagcccgtaatcccagcactttgggaggccgaggaggcggatcatgaggtcaggagttcaagaccagcctgaccaacactgtgaaaccctgtctctactaaaaatacaaaaaaaattagccaggcgtggtggtgggcacctgtaatcccagctactcgggaggctgaggcaggagaatcacttgaacccgggaggcagaggttgcagtgagccgagatgacaccactgccctccagcctgggtgacagttgttagactgcgtatcaaaaaaaaaaaaaaaaatttatttactcccttgcttcaaaaaggacataagttggcttgcaaatcacattttgtagaaatgaagtttttaagattagtctcatactcattacataatatttattgactacttacatattgagtgctaaattcagtggaataatatgaacaataaagacccagccttgtttatgctcttcagggagcataaatagagtacagctggcaaaacaaaatgtgcatatcccaaacctgtaaatcatgatctaagacaatatacaaacactcaaatagggaacttaccagctagcagactttgattatgaaccacagaacctagaataaataaatactctcttgaaagaaccatcattggaataattaagttccaactgttttttctttctgaattcacttaaaatccaatttctagaagaatatcattggtccagctttagtcattggttcatctcttaacaggctggggcagggcagcttaattgatgatgccaccagaatgggcaacatgggaaaaaccctatctctaccaaaaatacaaaaattagccagtgatggtggcacgcacctgttgtcccagctactcaggaggctgagctgggaggatcttttgagcctgggaggcagaggttgcagtgagctgagatcgcaccactgcactccaacctggagtggaaggaaatttcacttcctggaatggaagaaagttcttcaaaggaaaatcaagacactgctgtcaaaaaacaccaggggagggatgctgtccagtcacagccaacacatcatatagcagtggtagcagtagtaatagtatttccagagagagagagagagattagctctgaaaaagaatggagaagaatcaggtttcttgggggaggtaggtctcaggctagttcttgaatgtacattctcagcagatggtgagaagacaagtgtggtgtgggacattaatgatgagggataggtagaaaagatgggaagggggtcagcttgtagataacctagactagcaggtgtatgacttctagtctctgaactggagccatctgagatcagtttgagatatggtgtcttataaatgtattgagagaggttgaggagttgtctatagaatggaatggagtgaggtcagagatcagtggcaaggaagaccacataaaggtttttgcacaaacttgccttgatggcaagtcctcaaaagtacaattatcaagctttctgtttaaacatgcataagtcagtaaatataaacattaaaatttgcccaagactcttaactcagttgtatttcataattaaagtgtacattaaaaagccaaactagtcatgaaagtattacatacagcaagggcagtttagataagttaatgttgctatgggaaccccagcagatctccttgtgtctccgtttaaaaatcatggcccaaggtggtttcaaaaacaacagaaggtaaaattattctcacattctcacacatgtaaattgtactgtctctctcagttctaaatagcggattcaagccagcctcttgactggcacagtaaaattcggcttcgtgtctttctataatgtattacagcatgtgagttaacctttagaagcttcaaaaatacatcaaccaaatttggactgtgagacacaaactggtctcttttgggctctgtccagcatagccttcctattccacatggctgcgcagcagggccatttccaccagtgtcttctgcttgcctggtcagtctttctgtctcttaacctacctacaacaacttccttctcggggtttgctgctagatagaaatgtagattttggcacagaaagaaaagggaaagacctatttggaattttgtctatagatgttaagaaatcatgaagcgttgcaaatgtaactgcttgggtattagtttaaaatatttgataactgcatgaaattctaatttacccctcacatccataaagctaggaccagttggttaggcagagtttgatatttaaaaattcatcttctgagagagctgaatttcaaaaggaccattttctttccaggagtaaaaggtatattctttcatcttcttacagtacagaaacaatggaatatattgtttaaatgcacccttcatttttttctccatttctaaaaattcacttttgagcatcgtccaaatgtaaaaattctcacacatgaggaactgtttccgaaggttgtgagaaagtcaagataacagtttctattattaaaagttttgcattcggtatgacacatttgcctgtattgaaacacccatttaacattgacttctgagaacttatttgctttgcctctctcgattccatatgctttgtctacaaattgtgaacacgtcccggtttctacccgtgtgtgattctaagtcgttgctgtactctagcttgtacgtgaaaattcacccatatgcagatagctgccctcttggaggcaaaacttaaagctatcagaaccatctggattgttaaaccccaaaacttccaactcatcaaagtcctgaagcctgaatagatcacacattgttacttctaattggttttgatgtttgttatgctcctcacaagtgcagataacttcacatttgcatcactaatcgacctctttcaaagcctctgctcctcctgcttcctgcctctgttagtcatcaggagacttagtgttggcgtgggtattttccccgcttgtgaaagtgcattgtcaattctagagcattaaatatatgtgaggtattgttattaatctacaaggcagtacacacagtattccagcaacagtgactttttcaaaggttttatgagacattgtaagaaagacagtatctttccatggaaaaaagtgttgcctcagagtcaaacaggaagcatgggtcctagttcctattgaactgcttagctactcttaatttagctctgaatgctagattttgtgtatactatacacattatttaatcctcaaactcctaggaattcattttgatgataaccatttacagaagagatgttgggtaacttgctcaggataccacatctagtaagtagcagagtcacaactcggacccagaactctctgattccaaaacctctacttgctgctcttgtaatggatgggcccaaatgctgctgggaaaggcaccagggaagaaagagctttctgagtcaagcagaaaacgatagcagtggagaggagtttgtttcagacgaccttcaaggttatggctcattctagatccaatcattctagcaaataagtaggttacacttgtccacaattacaaattggaaaagaagagaaggaaaggaactgagaggaatgacaaagcaaaaagctttcaatcagttcttttcagcattctgcttctgcctagttctgcactcgccccaccccctcaggcttcagccttccacttggcatccctcctcgcagagcactctcacttgcatactcctcgcttaaagaaaaaaagcattctgtactgcagtggggaaaaaaaacccttaaaatgtcttcaaaaggattcagctctagggtaatgtaaaatatgtgaaatcaggaggtgtccataataaaatatgagtgaaaacatcgttatttaaaacattgtatgtacattaatgccacattaataccaattcaggcatgaaatgttgagcatttcttggaatacggtttcttggaatatggttggggatttgagaggcgcaaaggtacccgcaagatggctttggtgtagttataaatataaatagaagtaaaataacagttgcatcttcatttataatgaatctatattgtggcctcaaagctacagagaaaagtggatgccaaaatctgtctttcattaacatatgtcttaaatgacaaggaagaggtgttgaagataaaattactttttcctatgagtatgaatcagcaacatgcagtaacaagcaagtaataatagttctgcgtgtgagtgcctacagagggtaagaaaaatagcatcagattgaaaaagcaagtgcacctgcagaagggacccaggaggctgcagagcacagctcccttgagcatcatctcaaagtgtctcagagcacagtgaccctaattctggcaagtcaggttggcatgagatggatggagcacactgaaatctccagatggtcagacagcccaccctcagctgcccctggagctcggcaaaggcaagctacaaggcactgctacttggccaagagtttaaaacaacagcttctgattctacagtgtctgtggtttcacaaccacttaaccttaagtaaggaacagctagagttagctgaatgaataaatacacgttaacgttacataaagagggaaaaaaagcaatacttgagcacatagacttcaaatagtgtccagctagctgtgtccttggcatcccagtgatctgggtctttatctttgattttctccagcaggtaggcactgagtagatccagggcccagggcgggaaatgcttctgtatcagatgttacctatcaaataaaatgagcctttgattgcc

SEQ ID NO: 153596 - DNA, 828 bp, Homo sapiens
  Payload ID: 10209
  Gene Symbol: METTL8
  Gene Name: methyltransferase like 8
  ENST ID: ENST00000392599
  CDS Start-End: 149-828
ttagggatccctccctcactgccccggtactcacaagcttctcggccccgaccttcgccctgggaggttctggccaggtgccgggaggggcgctgtgtcgagggcgatccccccaaagcagcgtcccgtgctaaaggtactgcttaggatgaatatgatttggagaaattccatttcttgtctaaggctaggaaaggtgccacacagataccaaagtggttaccacccagtggcccctctgggatcaaggattttaactgacccagccaaagtttttgaacacaacatgtgggatcacatgcagtggtctaaggaagaagaagcagcagccagaaaaaaagtaaaagaaaactcagctgtgcgagtccttctggaagagcaagttaagtatgagagagaagctagtaaatactgggacacattttacaagattcataagaataagtttttcaaggatcgtaattggctgttgagggaatttcctgaaattcttccagttgatcaaaaacctgaagagaaggcgagagaatcatcatgggatcatgtaaaaactagtgctacaaatcgtttctcaagaatgcactgtcctactgtgcctgatgaaaaaaatcattatgagaaaagttctggttcttcagaaggtcaaagcaaaacagaatctgatttttccaacctagactctgaaaaacacaaaaaaggacctatggagactggattgtttcctggtagcaatgccactttcaggatactagagtcacactcgtcctacagagcaacccagtgttttgcctttgttcatgatgtatgtgatgatggcttaccttaccc

SEQ ID NO: 153597 - DNA, 1697 bp, Homo sapiens
  Payload ID: 10209
  Gene Symbol: METTL8
  Gene Name: methyltransferase like 8
  Uniprot ID: Q9H825
  ENST ID: ENST00000392604
  CDS Start-End: 342-1217
agctgggcagagccctgggggcgcggtgctgccgcctccaggtctccgccccgtgtgtgcgccctgcacttagggatccctccctcactgccccggtactcacaagcttctcggccccgaccttcgccctgggaggttctggccaggtgccgggaggggcgctgtgtcgagggcgatccccccaaagcagcgtcccgtgctaaagaaacagagcctcactctgtcacctaggctggagtgcagtggtgcaattatggctcactgcagtttcaacctcccagattccagtcatcctcctgcctcagccacccaagaagctgggaccacaggtactgcttaggatgaatatgatttggagaaattccatttcttgtctaaggctaggaaaggtgccacacagataccaaagtggttaccacccagtggcccctctgggatcaaggattttaactgacccagccaaagtttttgaacacaacatgtgggatcacatgcagtggtctaaggaagaagaagcagcagccagaaaaaaagtaaaagaaaactcagctgtgcgagtccttctggaagagcaagttaagtatgagagagaagctagtaaatactgggacacattttacaagattcataagaataagtttttcaaggatcgtaattggctgttgagggaatttcctgaaattcttccagttgatcaaaaacctgaagagaaggcgagagaatcatcatgggatcatgtaaaaactagtgctacaaatcgtttctcaagaatgcactgtcctactgtgcctgatgaaaaaaatcattatgagaaaagttctggttcttcagaaggtcaaagcaaaacagaatctgatttttccaacctagactctgaaaaacacaaaaaaggacctatggagactggattgtttcctggtagcaatgccactttcaggatactagaggttggttgtggagctggaaatagtgtgtttccaattttgaacactttggagaactctccggagtcctttctgtattgttgtgattttgcttctggagctgtggagctcgtaaagtcacactcgtcctacagagcaacccagtgttttgcctttgttcatgatgtatgtgatgatggcttaccttacccttttccagatgggatcctggatgtcattctccttgtctttgtgctctcttctattcatcctgacaggacattgtttatctgaaaatttttatgttcgaggagatggtaccagagcatatttctttacaaaaggggaagtccacagtatgttctgcaaagccagtttagatgaaaagcaaaatctggttgatcgccgcttacaagttaataggaaaaaacaagtgaaaatgcaccgagtgtggattcaaggcaaattccagaaaccattgcaccagactcagaatagctccaatatggtatctacactcctttcacaagactgaactttgtaacatgttaaggtacaaagccagaggactgtgctattcaaggactactgtaagtctattgtttctcaaaagacaatgagaaaaaaagaagagaatttgtatttcctgccgttttgtcataggtgagctcctttgtgcattttaagcacatgtaagtggttcagcacagtatgcctttttctgtgctttgaaaacttgatatgctcaagcttgtttgaatttattacatctaa

SEQ ID NO: 153598 - DNA, 578 bp, Homo sapiens
  Payload ID: 10209
  Gene Symbol: METTL8
  Gene Name: methyltransferase like 8
  ENST ID: ENST00000442778
  CDS Start-End: 120-578
aaaaccgcatccccgcaggaggctcggccgccgcgcgcccgcggccctccgtcccgccccggccggctggcggtcacctggcacaccagcgcccgcaggatgcccaggtactgcttaggatgaatatgatttggagaaattccatttcttgtctaaggctaggaaaggtgccacacagataccaaagtggttaccacccagtggcccctctgggatcaaggattttaactgacccagccaaagtttttgaacacaacatgtgggatcacatgcagtggtctaaggaagaagaagcagcagccagaaaaaaagtaaaagaaaactcagctgtgcgagtccttctggaagagcaagttaagtatgagagagaagctagtaaatactgggacacattttacaagattcataagaataagtttttcaaggatcgtaattggctgttgagggaatttcctgaaattcttccagttgatcaaaaacctgaagagaaggcgagagaatcatcatgggatcatgtaaaaactagtgctacaaatcgtttctcaagaatgcactgtcctactgtgcctgatgaaaaa

SEQ ID NO: 153599 - DNA, 981 bp, Homo sapiens
  Payload ID: 10209
  Gene Symbol: METTL8
  Gene Name: methyltransferase like 8
  ENST ID: ENST00000438609
  CDS Start-End: 1-643
tgaaaaacacaaaaaaggacctatggagactggattgtttcctggtagcaatgccactttcaggatactagaggttggttgtggagctggaaatagtgtgtttccaattttgaacactttggagaactctccggagtcctttctgtattgttgtgattttgcttctggagctgtggagctcgtaaaggtatgctactcctgggaatcataccaactgatgcctaagtcacactcgtcctacagagcaacccagtgttttgcctttgttcatgatgtatgtgatgatggcttaccttacccttttccagatgggatcctggatgtcattctccttgtctttgtgctctcttctattcatcctgacaggatgcaaggtgttgtaaaccgactgtccaagttactgaaacctgggggaatgctgttatttcgagactatggaagatatgataagactcagcttcgttttaaaaagggacattgtttatctgaaaatttttatgttcgaggagatggtaccagagcatatttctttacaaaaggggaagtccacagtatgttctgcaaagccagtttagatgaaaagcaaaatctggttgatcgccgcttacaagttaataggaaaaaacaagtgaaaatgcaccgagtgtggattcaaggcaaattccagaaaccattgcaccagactcagaatagctccaatatggtatctacactcctttcacaagactgaactttgtaacatgttaaggtacaaagccagaggactgtgctattcaaggactactgtaagtctattgtttctcaaaagacaatgagaaaaaaagaagagaatttgtatttcctgccgttttgtcataggtgagctcctttgtgcattttaagcacatgtaagtggttcagcacagtatgcctttttctgtgctttgaaaacttgatatgctcaagcttgtttgaatttattacatctaaccattttgcttg

SEQ ID NO: 153600 - DNA, 2246 bp, Homo sapiens
  Payload ID: 10209
  Gene Symbol: METTL8
  Gene Name: methyltransferase like 8
  Uniprot ID: Q9H825
  ENST ID: ENST00000447486
  CDS Start-End: 359-1084
cttctctgtgctgcgagtggctagctgggcagagccctgggggcgcggtgctgccgcctccaggtctccgccccgtgtgtgcgccctgcacttagggatccctccctcactgccccggtactcacaagcttctcggccccgaccttcgccctgggaggttctggccaggtgccgggaggggcgctgtgtcgagggcgatccccccaaagcagcgtcccgtgctaaagaaacagagcctcactctgtcacctaggctggagtgcagtggtgcaattatggctcactgcagtttcaacctcccagattccagtcatcctcctgcctcagccacccaagaagctgggaccacagggatcacatgcagtggtctaaggaagaagaagcagcagccagaaaaaaagtaaaagaaaactcagctgtgcgagtccttctggaagagcaagttaagtatgagagagaagctagtaaatactgggacacattttacaagattcataagaataagtttttcaaggatcgtaattggctgttgagggaatttcctgaaattcttccagttgatcaaaaacctgaagagaaggcgagagaatcatcatgggatcatgtaaaaactagtgctacaaatcgtttctcaagaatgcactgtcctactgtgcctgatgaaaaaaatcattatgagaaaagttctggttcttcagaaggtcaaagcaaaacagaatctgatttttccaacctagactctgaaaaacacaaaaaaggacctatggagactggattgtttcctggtagcaatgccactttcaggatactagaggttggttgtggagctggaaatagtgtgtttccaattttgaacactttggagaactctccggagtcctttctgtattgttgtgattttgcttctggagctgtggagctcgtaaagtcacactcgtcctacagagcaacccagtgttttgcctttgttcatgatgtatgtgatgatggcttaccttacccttttccagatgggatcctggatgtcattctccttgtctttgtgctctcttctattcatcctgacaggacattgtttatctgaaaatttttatgttcgaggagatggtaccagagcatatttctttacaaaaggggaagtccacagtatgttctgcaaagccagtttagatgaaaagcaaaatctggttgatcgccgcttacaagttaataggaaaaaacaagtgaaaatgcaccgagtgtggattcaaggcaaattccagaaaccattgcaccagactcagaatagctccaatatggtatctacactcctttcacaagactgaactttgtaacatgttaaggtacaaagccagaggactgtgctattcaaggactactgtaagtctattgtttctcaaaagacaatgagaaaaaaagaagagaatttgtatttcctgccgttttgtcataggtgagctcctttgtgcattttaagcacatgtaagtggttcagcacagtatgcctttttctgtgctttgaaaacttgatatgctcaagcttgtttgaatttattacatctaaccattttgcttgttccttgatttttataagcattcaattaagttagtattatgtcaagtaattttgagaaaatgtaacttgacattttttgcaagtaaaaaaaattgtttatttgtttaggcttagtaaaccagttcccaaacacagtcagactcttcccattgtcatctgattgcagagagaaagcacaccttatttccagggaaagctacaacaagcccaaggtcaaagtgtattattttttgtcttgttgttgtctattttctcccaatttttttttgaaattcagaggctcatatctgaaatagaattttagttcctctttcctttcctaaaattggggaagtacagcccatgctgacattattttcaggctattcttagatatacaagttgttaggccaggtgcaatggctcgcacctgtaatcccagcactttggggggctgaggcaggcagatcggttgagctcaggagttcaagaccagcctggacaacatggcaaaaccctgtctctcccaagaatacaaaaattagccaggcatggtggcacacacctgtggtcccagctactcaggagactgaggtgggaggatcgcttgagcctcggaggcggaggttgcagtgagctgagattgtaccactgcgctccaaactgggtgacatggtgagaccttgtctcc

SEQ ID NO: 153601 - DNA, 558 bp, Homo sapiens
  Payload ID: 10209
  Gene Symbol: METTL8
  Gene Name: methyltransferase like 8
  ENST ID: ENST00000453846
  CDS Start-End: 244-558
aaaaccgcatccccgcaggaggctcggccgccgcgcgcccgcggccctccgtcccgccccggccggctggcggtcacctggcacaccagcgcccgcaggatgcccagaaacagagcctcactctgtcacctaggctggagtgcagtggtgcaattatggctcactgcagtttcaacctcccagattccagtcatcctcctgcctcagccacccaagaagctgggaccacaggtactgcttaggatgaatatgatttggagaaattccatttcttgtctaaggctaggaaaggtgccacacagataccaaagtggttaccacccagtggcccctctgggatcaaggattttaactgacccagccaaagtttttgaacacaacatgtgggatcacatgcagtggtctaaggaagaagaagcagcagccagaaaaaaagtaaaagaaaactcagctgtgcgagtccttctggaagagcaagttaagtatgagagagaagctagtaaatactgggacacattttacaagattcataagaataagtttttcaaggatcgtaat

SEQ ID NO: 153602 - DNA, 563 bp, Homo sapiens
  Payload ID: 10209
  Gene Symbol: METTL8
  Gene Name: methyltransferase like 8
  ENST ID: ENST00000442541
  CDS Start-End: 315-563
actcacaagcttctcggccccgaccttcgccctgggaggttctggccaggtgccgggaggggcgctgtgtcgagggcgatccccccaaagcagcgtcccgtgctaaaggtaccccagggtactgcctcccacatctcagtgcaggctggatgaattggccttgtctgtgtttcctgtctgagtgtgagtgtgagtgctccctgcgatggaatgtcgtcgtgtccaagggttggttcccaccttgcaccctgagctgaggggataggcttcagccaccctcgaccctgaactggaataattaggtactgcttaggatgaatatgatttggagaaattccatttcttgtctaaggctaggaaaggtgccacacagataccaaagtggttaccacccagtggcccctctgggatcaaggattttaactgacccagccaaagtttttgaacacaacatgtgggatcacatgcagtggtctaaggaagaagaagcagcagccagaaaaaaagtaaaagaaaactcagctgtgcgagtccttctggaagagcaagttaagtatgagaga

SEQ ID NO: 153603 - DNA, 8132 bp, Homo sapiens
  Payload ID: 10209
  Gene Symbol: METTL8
  Gene Name: methyltransferase like 8
  ENST ID: ENST00000612742
  CDS Start-End: 142-1365
taaagggaggccccagcgcgttaaaaccgcatccccgcaggaggctcggccgccgcgcgcccgcggccctccgtcccgccccggccggctggcggtcacctggcacaccagcgcccgcaggatgcccaggtactgcttaggatgaatatgatttggagaaattccatttcttgtctaaggctaggaaaggtgccacacagataccaaagtggttaccacccagtggcccctctgggatcaaggattttaactgacccagccaaagtttttgaacacaacatgtgggatcacatgcagtggtctaaggaagaagaagcagcagccagaaaaaaagtaaaagaaaactcagctgtgcgagtccttctggaagagcaagttaagtatgagagagaagctagtaaatactgggacacattttacaagattcataagaataagtttttcaaggatcgtaattggctgttgagggaatttcctgaaattcttccagttgatcaaaaacctgaagagaaggcgagagaatcatcatgggatcatgtaaaaactagtgctacaaatcgtttctcaagaatgcactgtcctactgtgcctgatgaaaaaaatcattatgagaaaagttctggttcttcagaaggtcaaagcaaaacagaatctgatttttccaacctagactctgaaaaacacaaaaaaggacctatggagactggattgtttcctggtagcaatgccactttcaggatactagaggttggttgtggagctggaaatagtgtgtttccaattttgaacactttggagaactctccggagtcctttctgtattgttgtgattttgcttctggagctgtggagctcgtaaagtcacactcgtcctacagagcaacccagtgttttgcctttgttcatgatgtatgtgatgatggcttaccttacccttttccagatgggatcctggatgtcattctccttgtctttgtgctctcttctattcatcctgacaggatgcaaggtgttgtaaaccgactgtccaagttactgaaacctgggggaatgctgttatttcgagactatggaagatatgataagactcagcttcgttttaaaaagggacattgtttatctgaaaatttttatgttcgaggagatggtaccagagcatatttctttacaaaaggggaagtccacagtatgttctgcaaagccagtttagatgaaaagcaaaatctggttgatcgccgcttacaagttaataggaaaaaacaagtgaaaatgcaccgagtgtggattcaaggcaaattccagaaaccattgcaccagactcagaatagctccaatatggtatctacactcctttcacaagactgaactttgtaacatgttaaggtacaaagccagaggactgtgctattcaaggactactgtaagtctattgtttctcaaaagacaatgagaaaaaaagaagagaatttgtatttcctgccgttttgtcataggtgagctcctttgtgcattttaagcacatgtaagtggttcagcacagtatgcctttttctgtgctttgaaaacttgatatgctcaagcttgtttgaatttattacatctaaccattttgcttgttccttgatttttataagcattcaattaagttagtattatgtcaagtaattttgagaaaatgtaacttgacattttttgcaagtaaaaaaaattgtttatttgtttaggcttagtaaaccagttcccaaacacagtcagactcttcccattgtcatctgattgcagagagaaagcacaccttatttccagggaaagctacaacaagcccaaggtcaaagtgtattattttttgtcttgttgttgtctattttctcccaatttttttttgaaattcagaggctcatatctgaaatagaattttagttcctctttcctttcctaaaattggggaagtacagcccatgctgacattattttcaggctattcttagatatacaagttgttaggccaggtgcaatggctcgcacctgtaatcccagcactttggggggctgaggcaggcagatcggttgagctcaggagttcaagaccagcctggacaacatggcaaaaccctgtctctcccaagaatacaaaaattagccaggcatggtggcacacacctgtggtcccagctactcaggagactgaggtgggaggatcgcttgagcctcggaggcggaggttgcagtgagctgagattgtaccactgcgctccaaactgggtgacatggtgagaccttgtctccaaaaaaaaaaaaaaaaaaaaaaaaggtatgtaagctgacaagctcttgtatcaagggcttttgaaccagagcaacttcatcttgaatagggactgtgtaaaatgaagctgagacctactaggctgcaatcccaggaggttaagacattcttagtcacaggatgagataggaagtcagtacaagatacaggtcatacagaccttgctgataaaacaggttgcagtgaagaagccggccaaatgccaccaaaaccaagatggcaatgagagtgtcctctggctgtcctcactgctacactcccaccagtgccatgatagtttacaaatgccatggcaacatcaggaagttacccatatggtctacaaaggggaggcctgaataatccaccccttgtgtagcatataatcaagaaataaccttaaaaatgggcaaccagtagcccttggggctgctctgcctatggagtagccattctttatgttttactttttttttttttttttttttgagatggagtcttgctctggcacccaggctggagtgcagtggcgtgatctcagctcactgccagctccacctcccgggttcacgccattctcttgcttcagcctcctgagtagctgggactacaagcacccaccaccatgcccagctaattttttttttttttgtatttttagtagagacggggtttcaccatgttagccaggatggtctcaatctcctgaccttgtgatccgcccgcctcggcctcccaaagtgctgggattacaggtgtgagccaccgcgcccagcctattctttacttaaacttgttttcactttgctgtatggactcaattctttcttgcacaagatccaagaatcctctcttggcgtctggatccagaccctttctggtatcagtggtaagctctgtttaagacaactgtcatacccaagagaattcttaaattgtggcagttaaaaatgtatttatcccctcgagggccgggcgcagtcgctcaagcccgtaatcccagcactttgggaggccgaggaggcggatcatgaggtcaggagttcaagaccagcctgaccaacactgtgaaaccctgtctctactaaaaatacaaaaaaaattagccaggcgtggtggtgggcacctgtaatcccagctactcgggaggctgaggcaggagaatcacttgaacccgggaggcagaggttgcagtgagccgagatgacaccactgccctccagcctgggtgacagttgttagactgcgtatcaaaaaaaaaaaaaaaaatttatttactcccttgcttcaaaaaggacataagttggcttgcaaatcacattttgtagaaatgaagtttttaagattagtctcatactcattacataatatttattgactacttacatattgagtgctaaattcagtggaataatatgaacaataaagacccagccttgtttatgctcttcagggagcataaatagagtacagctggcaaaacaaaatgtgcatatcccaaacctgtaaatcatgatctaagacaatatacaaacactcaaatagggaacttaccagctagcagactttgattatgaaccacagaacctagaataaataaatactctcttgaaagaaccatcattggaataattaagttccaactgttttttctttctgaattcacttaaaatccaatttctagaagaatatcattggtccagctttagtcattggttcatctcttaacaggctggggcagggcagcttaattgatgatgccaccagaatgggcaacatgggaaaaaccctatctctaccaaaaatacaaaaattagccagtgatggtggcacgcacctgttgtcccagctactcaggaggctgagctgggaggatcttttgagcctgggaggcagaggttgcagtgagctgagatcgcaccactgcactccaacctggagtggaaggaaatttcacttcctggaatggaagaaagttcttcaaaggaaaatcaagacactgctgtcaaaaaacaccaggggagggatgctgtccagtcacagccaacacatcatatagcagtggtagcagtagtaatagtatttccagagagagagagagagattagctctgaaaaagaatggagaagaatcaggtttcttgggggaggtaggtctcaggctagttcttgaatgtacattctcagcagatggtgagaagacaagtgtggtgtgggacattaatgatgagggataggtagaaaagatgggaagggggtcagcttgtagataacctagactagcaggtgtatgacttctagtctctgaactggagccatctgagatcagtttgagatatggtgtcttataaatgtattgagagaggttgaggagttgtctatagaatggaatggagtgaggtcagagatcagtggcaaggaagaccacataaaggtttttgcacaaacttgccttgatggcaagtcctcaaaagtacaattatcaagctttctgtttaaacatgcataagtcagtaaatataaacattaaaatttgcccaagactcttaactcagttgtatttcataattaaagtgtacattaaaaagccaaactagtcatgaaagtattacatacagcaagggcagtttagataagttaatgttgctatgggaaccccagcagatctccttgtgtctccgtttaaaaatcatggcccaaggtggtttcaaaaacaacagaaggtaaaattattctcacattctcacacatgtaaattgtactgtctctctcagttctaaatagcggattcaagccagcctcttgactggcacagtaaaattcggcttcgtgtctttctataatgtattacagcatgtgagttaacctttagaagcttcaaaaatacatcaaccaaatttggactgtgagacacaaactggtctcttttgggctctgtccagcatagccttcctattccacatggctgcgcagcagggccatttccaccagtgtcttctgcttgcctggtcagtctttctgtctcttaacctacctacaacaacttccttctcggggtttgctgctagatagaaatgtagattttggcacagaaagaaaagggaaagacctatttggaattttgtctatagatgttaagaaatcatgaagcgttgcaaatgtaactgcttgggtattagtttaaaatatttgataactgcatgaaattctaatttacccctcacatccataaagctaggaccagttggttaggcagagtttgatatttaaaaattcatcttctgagagagctgaatttcaaaaggaccattttctttccaggagtaaaaggtatattctttcatcttcttacagtacagaaacaatggaatatattgtttaaatgcacccttcatttttttctccatttctaaaaattcacttttgagcatcgtccaaatgtaaaaattctcacacatgaggaactgtttccgaaggttgtgagaaagtcaagataacagtttctattattaaaagttttgcattcggtatgacacatttgcctgtattgaaacacccatttaacattgacttctgagaacttatttgctttgcctctctcgattccatatgctttgtctacaaattgtgaacacgtcccggtttctacccgtgtgtgattctaagtcgttgctgtactctagcttgtacgtgaaaattcacccatatgcagatagctgccctcttggaggcaaaacttaaagctatcagaaccatctggattgttaaaccccaaaacttccaactcatcaaagtcctgaagcctgaatagatcacacattgttacttctaattggttttgatgtttgttatgctcctcacaagtgcagataacttcacatttgcatcactaatcgacctctttcaaagcctctgctcctcctgcttcctgcctctgttagtcatcaggagacttagtgttggcgtgggtattttccccgcttgtgaaagtgcattgtcaattctagagcattaaatatatgtgaggtattgttattaatctacaaggcagtacacacagtattccagcaacagtgactttttcaaaggttttatgagacattgtaagaaagacagtatctttccatggaaaaaagtgttgcctcagagtcaaacaggaagcatgggtcctagttcctattgaactgcttagctactcttaatttagctctgaatgctagattttgtgtatactatacacattatttaatcctcaaactcctaggaattcattttgatgataaccatttacagaagagatgttgggtaacttgctcaggataccacatctagtaagtagcagagtcacaactcggacccagaactctctgattccaaaacctctacttgctgctcttgtaatggatgggcccaaatgctgctgggaaaggcaccagggaagaaagagctttctgagtcaagcagaaaacgatagcagtggagaggagtttgtttcagacgaccttcaaggttatggctcattctagatccaatcattctagcaaataagtaggttacacttgtccacaattacaaattggaaaagaagagaaggaaaggaactgagaggaatgacaaagcaaaaagctttcaatcagttcttttcagcattctgcttctgcctagttctgcactcgccccaccccctcaggcttcagccttccacttggcatccctcctcgcagagcactctcacttgcatactcctcgcttaaagaaaaaaagcattctgtactgcagtggggaaaaaaaacccttaaaatgtcttcaaaaggattcagctctagggtaatgtaaaatatgtgaaatcaggaggtgtccataataaaatatgagtgaaaacatcgttatttaaaacattgtatgtacattaatgccacattaataccaattcaggcatgaaatgttgagcatttcttggaatacggtttcttggaatatggttggggatttgagaggcgcaaaggtacccgcaagatggctttggtgtagttataaatataaatagaagtaaaataacagttgcatcttcatttataatgaatctatattgtggcctcaaagctacagagaaaagtggatgccaaaatctgtctttcattaacatatgtcttaaatgacaaggaagaggtgttgaagataaaattactttttcctatgagtatgaatcagcaacatgcagtaacaagcaagtaataatagttctgcgtgtgagtgcctacagagggtaagaaaaatagcatcagattgaaaaagcaagtgcacctgcagaagggacccaggaggctgcagagcacagctcccttgagcatcatctcaaagtgtctcagagcacagtgaccctaattctggcaagtcaggttggcatgagatggatggagcacactgaaatctccagatggtcagacagcccaccctcagctgcccctggagctcggcaaaggcaagctacaaggcactgctacttggccaagagtttaaaacaacagcttctgattctacagtgtctgtggtttcacaaccacttaaccttaagtaaggaacagctagagttagctgaatgaataaatacacgttaacgttacataaagagggaaaaaaagcaatacttgagcacatagacttcaaatagtgtccagctagctgtgtccttggcatcccagtgatctgggtctttatctttgattttctccagcaggtaggcactgagtagatccagggcccagggcgggaaatgcttctgtatcagatgttacctatcaaataaaatgagcctttgattgcctcct

SEQ ID NO: 153604 - DNA, 3256 bp, Homo sapiens
  Payload ID: 10210
  Gene Symbol: METTL9
  Gene Name: methyltransferase like 9
  Uniprot ID: Q9H1A3
  ENST ID: ENST00000358154
  CDS Start-End: 259-1215
ggccgctcgtaagtgctccggatggaaactggtgcagggggcagcggcgttccgcggccggaagggaagggggaggtgccgaggctgcgcgccggctgctcctccccacccccagcctttgccctgaagggggctggatgggcaaggcggccgcgatggctcgagctcgggcggtggcggcggtggccggaggcggcggtgcctcctcctcctcgccccggcgccggcggtgatccgagcgagcggccgcggcccccgatgagactgctggcgggctggctgtgcctgagcctggcgtccgtgtggctggcgcggaggatgtggacgctgcggagcccgctcacccgctccctgtacgtgaacatgactagcggcccgggtgggccggcggcggccgcgggcggcaggaaggagaaccaccagtggtatgtgtgcaacagagagaaattatgcgaatcactccaggctgtctttgttcagagttaccttgatcaaggaacacagatcttcttaaacaacagcattgagaaatcgggctggctatttatccaattatatcattcttttgtgtcatctgtttttagcctgtttatgtctagaacatctatcaatgggttgctaggaagaggctcaatgtttgtgttttcaccagatcagtttcagagactgcttaaaattaatccagactggaaaacccacagacttcttgatttaggtgctggagatggagaagtcacaaaaatcatgagccctcattttgaagaaatctatgccactgagctttctgaaactatgatatggcagcttcagaaaaagaaatacagagtccttggtataaatgaatggcagaatacggggttccagtatgatgtcatcagctgcctgaacttgctggaccgctgtgatcagcccctgactttgttaaaagatatcagaagtgtcttggagccaactagaggcagggtcatccttgcccttgtcctcccctttcatccctatgtggaaaacgtaggtggcaagtgggagaaaccatcagaaattttggaaatcaaaggacagaactgggaagaacaagtgaatagtctgcctgaagttttcagaaaagctggttttgttatcgaagctttcaccagactaccatacctgtgtgaaggcgacatgtataatgactactacgttctggatgacgctgtctttgttctcaaaccagtataaacacgtggaggtcgaagtcttcagagtccgcaccctccgggatgtgcccttggaagagggtctgtgttcacaattacgtgaagggaggacccttggggaccgccattctaaatatcatgtaggaatttaaaaagccaaaatactaattatttctttgtagtgtgtaaaggaatgtttttaaaagacaaaaacccaactctttgtggatttttatcaactctttactcagagccactctccaatgcaggtcacactccaattatgatggaagatattttttatacttaattgcagtagggactcattcccagacaaagcaatagtcacgacttcatggaaccaatcaatggattgttttttgaagactggcaataaagctgtccattcaattccaaatactggttttaaggtatagccactgatattctttcatgtttagaaattctttctgttattattcaagaaaatgtttttaatcatgctaataaacttttttggagatgactttggcatcatgtttgaattcatataaagctcccctagcattttttattggtttggcttcaggagtacccaaatagtagcattatgagaatgacgcagacaatttgaataggggggaaggaaggcttcagacttgggggaaggggagattattgcaaattgcagtgaacactgagtcagtaaaaaaaaaaaacagaaacaaaaacccagcctcattcagatacagaacttcagggacccctccccccacccccccagttaatgctgctgtgaaaaatgcaaaataacctggttctgactttgtgatcactcatgtcccatacactgaactttgtttttttctggacaatctcaggttctcagaattgaaacattcagttttgtctactgacaaaatgcaactaaaaatgttttaattcaacttcttactctacacttatatacctctctcccagagcttggctcttccctgaaatccttaaaggagtttattatttgccaagaatatggtttgatgaagaccgtgtcagactcatgcattctggaatccgtgagtgcctccaaccataaacccagaaatgctgccatagaggaacccattagcaagatcaataaccatcgtggatattccaaagagcagagcatttaacccagaatctgaaatctcagtaataacagaaatgtcaatatgagattgtggttattaacaatatgttatcctcactactttatttcttttttcatccaggtgtttcattaagtattctcatttatatgctcatagaagtcatcagatcaacacattcactccaacacctgggtataaaggcgaattaaaacctgaagaattactttattattcattaagaactgcattcccacatcctcacaccaatatcttccactgttactgtgcagtcataataagagttgggttatgtgatttatgcaaaattgttattggtgtgttctaatgatttttttccaggaattcaagtaagtgaagtacaaatacttagcaccatagattgtaaaaatagaaagaggaaatgagaaaacttaatgtcgttcttgtacagttgagttttgcttctttataaactgtctgttaaaatcaggggttgctgttagactgtcaagcagaagtgatggatgttcaaggaggcaggttgccccaaagtgttttctaactttcaagtagagaactttatgctctaataagaaaaatacaactcattcttaaccacccccccaaaacagagaaaacacatacatttatgcattttaaagataaaaagtagtttctcaaaaaaatctgaagttctctgaaaaccagcttattaaaagtgctgttttgtggtgaaaattgaaaccaaatccactcacatttcctatcgggtcttgaaattcttggtggtgtgtcaccattccactagatggcagtgttgcttactgagtgtcaatggcttttttccccgtaaatggaatcatgtttttctcccccaaagtacaataaagctgccttgtctgcaccatt

SEQ ID NO: 153605 - DNA, 1817 bp, Homo sapiens
  Payload ID: 10210
  Gene Symbol: METTL9
  Gene Name: methyltransferase like 9
  Uniprot ID: Q9H1A3
  ENST ID: ENST00000396014
  CDS Start-End: 177-1130
ggctgcgcgccggctgctcctccccacccccagcctttgccctgaagggggctggatgggcaaggcggccgcgatggctcgagctcgggcggtggcggcggtggccggaggcggcggtgcctcctcctcctcgccccggcgccggcggtgatccgagcgagcggccgcggcccccgatgagactgctggcgggctggctgtgcctgagcctggcgtccgtgtggctggcgcggaggatgtggacgctgcggagcccgctcacccgctccctgtacgtgaacatgactagcggcccgggtgggccggcggcggccgcgggcggcaggaaggagaaccaccagtggtatgtgtgcaacagagagaaattatgcgaatcactccaggctgtctttgttcagagttaccttgatcaaggaacacagatcttcttaaacaacagcattgagaaatcgggctggctatttatccaattatatcattcttttgtgtcatctgtttttagcctgtttatgtctagaacatctatcaatgggttgctaggaagaggctcaatgtttgtgttttcaccagatcagtttcagagactgcttaaaattaatccagactggaaaacccacagacttcttgatttaggtgctggagatggagaagtcacaaaaatcatgagccctcattttgaagaaatctatgccactgagctttctgaaactatgatatggcagcttcagaaaaagaaatacagagtccttggtataaatgaatggcagaatacggggttccagtatgatgtcatcagctgcctgaacttgctggaccgctgtgatcagcccctgactttgttaaaagatatcagaagtgtcttggagccaactagaggcagggtcatccttgcccttgtcctcccctttcatccctatgtggaaaacggtggcaagtgggagaaaccatcagaaattttggaaatcaaaggacagaactgggaagaacaagtgaatagtctgcctgaagttttcagaaaagctggttttgttatcgaagctttcaccagactaccatacctgtgtgaaggcgacatgtataatgactactacgttctggatgacgctgtctttgttctcaaaccagtataaacacgtggaggtcgaagtcttcagagtccgcaccctccgggatgtgcccttggaagagggtctgtgttcacaattacgtgaagggaggacccttggggaccgccattctaaatatcatgtaggaatttaaaaagccaaaatactaattatttctttgtagtgtgtaaaggaatgtttttaaaagacaaaaacccaactctttgtggatttttatcaactctttactcagagccactctccaatgcaggtcacactccaattatgatggaagatattttttatacttaattgcagtagggactcattcccagacaaagcaatagtcacgacttcatggaaccaatcaatggattgttttttgaagactggcaataaagctgtccattcaattccaaatactggttttaaggtatagccactgatattctttcatgtttagaaattctttctgttattattcaagaaaatgtttttaatcatgctaataaacttttttggagatgactttggcatcatgtttgaattcatataaagctcccctagcattttttattggtttggcttcaggagtacccaaatagtagcattatgagaatgacgcagacaatttgaataggggggaaggaaggcttcagacttgggggaaggggagattattgcaaattgcagtgaacactgagtcagtaa

SEQ ID NO: 153606 - DNA, 785 bp, Homo sapiens
  Payload ID: 10210
  Gene Symbol: METTL9
  Gene Name: methyltransferase like 9
  ENST ID: ENST00000562961
  CDS Start-End: 368-785
ggaaaggcaacttaatctggtcactggagtgttaaattctgttgcttactttgctatttgggtttgtttggtgattttgagttaaggcattggattatgtgactgttttcttgtctaaaaacaaggatgctgctagctgtttgccttctgatgttgaatctcagtgaaagagaggccagcagagctttctaaatctcggtggtatgtgtgcaacagagagaaattatgcgaatcactccaggctgtctttgttcagagttaccttgatcaaggaacacagatcttcttaaacaacagcattgagaaatcgggctggctatttatccaattatatcattcttttgtgtcatctgtttttagcctgtttatgtctagaacatctatcaatgggttgctaggaagaggctcaatgtttgtgttttcaccagatcagtttcagagactgcttaaaattaatccagactggaaaacccacagacttcttgatttaggtgctggagatggagaagtcacaaaaatcatgagccctcattttgaagaaatctatgccactgagctttctgaaactatgatatggcagcttcagaaaaagaaatacagagtccttggtataaatgaatggcagaatacggggttccagtatgatgtcatcagctgcctgaacttgctggaccgctgtgatcagcccctgactttgttaaaagatatcagaagtgtcttggagccaactagaggcagggtcatccttgcccttgtcctcccctttcatccctatgtggaaaacg

SEQ ID NO: 153607 - DNA, 763 bp, Homo sapiens
  Payload ID: 10210
  Gene Symbol: METTL9
  Gene Name: methyltransferase like 9
  ENST ID: ENST00000567404
  CDS Start-End: 35-763
aggctctctgagaagagacagcaaagcttcttagatggatcgaaagaccacgagctgggataccaagttctatgaaaagtggtatgtgtgcaacagagagaaattatgcgaatcactccaggctgtctttgttcagagttaccttgatcaaggaacacagatcttcttaaacaacagcattgagaaatcgggctggctatttatccaattatatcattcttttgtgtcatctgtttttagcctgtttatgtctagaacatctatcaatgggttgctaggaagaggctcaatgtttgtgttttcaccagatcagtttcagagactgcttaaaattaatccagactggaaaacccacagacttcttgatttaggtgctggagatggagaagtcacaaaaatcatgagccctcattttgaagaaatctatgccactgagctttctgaaactatgatatggcagcttcagaaaaagaaatacagagtccttggtataaatgaatggcagaatacggggttccagtatgatgtcatcagctgcctgaacttgctggaccgctgtgatcagcccctgactttgttaaaagatatcagaagtgtcttggagccaactagaggcagggtcatccttgcccttgtcctcccctttcatccctatgtggaaaacgtaggtggcaagtgggagaaaccatcagaaattttggaaatcaaaggacagaactgggaagaacaagtgaatagtctgcctgaagttttcagaaaagct

SEQ ID NO: 153608 - DNA, 376 bp, Homo sapiens
  Payload ID: 10210
  Gene Symbol: METTL9
  Gene Name: methyltransferase like 9
  ENST ID: ENST00000568826
  CDS Start-End: 1-376
agagttaccttgatcaaggaacacagatcttcttaaacaacagcattgagaaatcgggctggctatttatccaattatatcattcttttgtgtcatctgtttttagcctgtttatgtctagaacatctatcaatggagtccttggtataaatgaatggcagaatacggggttccagtatgatgtcatcagctgcctgaacttgctggaccgctgtgatcagcccctgactttgttaaaagatatcagaagtgtcttggagccaactagaggcagggtcatccttgcccttgtcctcccctttcatccctatgtggaaaacgtaggtggcaagtgggagaaaccatcagaaattttggaaatcaaaggacagaactg

SEQ ID NO: 153609 - DNA, 480 bp, Homo sapiens
  Payload ID: 10210
  Gene Symbol: METTL9
  Gene Name: methyltransferase like 9
  ENST ID: ENST00000569290
  CDS Start-End: 1-385
accagatcagtttcagagactgcttaaaattaatccagactggaaaacccacagacttcttgatttaggtgctggagatggagaagtcacaaaaatcatgagccctcattttgaagaaatctatgccactgagctttctgaaactatgatatggcagcttcagaaaaagaaatacagagtccttggtataaatgaatggcagaatacggggttccagtatgatgtcatcagctgcctgaacttgctggaccgctgtgatcagcccctgactttgttaaaagatatcagaagtgtcttggagccaactagaggcagggtcatccttgcccttgtcctcccctttcatccctatgtggaaaacggtaagtgtggtcagtcaggctagctcttactgaggatagctgtttattggtatttgtgattttgtgctgtgtacaattaaatattgtctagtatgtcttataatagcctgcagtttaa

SEQ ID NO: 153610 - DNA, 447 bp, Homo sapiens
  Payload ID: 10210
  Gene Symbol: METTL9
  Gene Name: methyltransferase like 9
  ENST ID: ENST00000570074
  CDS Start-End: 17-202
gcggccgcggcccccgatgagactgctggcgggctggctgtgcctgagcctggcgtccgtgtggctggcgcggaggatgtggacgctgcggagcccgctcacccgctcccttggtatgtgtgcaacagagagaaattatgcgaatcactccaggctgtctttgttcagagttaccttgatcaaggaacacagatcttcttaaacaacagcattgagaaatcgggctggctatttatccaattatatcattcttttgtgtcatctgtttttagcctgtttatgtctagaacatctatcaatgggttgctaggaagaggctcaatgtttgtgttttcaccagatcagtttcagagactgcttaaaattaatccagactggaaaacccacagacttcttgatttaggtgctggagatggagaagtcacaaaaatcatgagccctcatttt

SEQ ID NO: 153611 - DNA, 701 bp, Homo sapiens
  Payload ID: 10210
  Gene Symbol: METTL9
  Gene Name: methyltransferase like 9
  ENST ID: ENST00000562379
  CDS Start-End: 143-367
ctttgccctgaagggggctggatgggcaaggcggccgcgatggctcgagctcgggcggtggcggcggtggccggaggcggcggtgcctcctcctcctcgccccggcgccggcggtgatccgagcgagcggccgcggcccccgatgagactgctggcgggctggctgtgcctgagcctggcgtccgtgtggctggcgcggaggatgtggacgctgcggagcccgctcacccgctccctgtacgtgaacatgactagcggcccgggtgggccggcggcggccgcgggcggcaggaaggagaaccaccaggttgctaggaagaggctcaatgtttgtgttttcaccagatcagtttcagagactgcttaaaattaatccagactggaaaacccacagacttcttgatttaggtgctggagatggagaagtcacaaaaatcatgagccctcattttgaagaaatctatgccactgagctttctgaaactatgatatggcagcttcagaaaaagaaatacagagtccttggtataaatgaatggcagaatacggggttccagtatgatgtcatcagctgcctgaacttgctggaccgctgtgatcagcccctgactttgttaaaagatatcagaagtgtcttggagccaactagaggcagggtcatccttgcccttgtcctcccctttcatccctatgtggaaaac

SEQ ID NO: 153612 - DNA, 2890 bp, Homo sapiens
  Payload ID: 10210
  Gene Symbol: METTL9
  Gene Name: methyltransferase like 9
  ENST ID: ENST00000615720
  CDS Start-End: 1-849
atgtggacgctgcggagcccgctcacccgctccctgtacgtgaaggagaaccaccagtggtatgtgtgcaacagagagaaattatgcgaatcactccaggctgtctttgttcagagttaccttgatcaaggaacacagatcttcttaaacaacagcattgagaaatcgggctggctatttatccaattatatcattcttttgtgtcatctgtttttagcctgtttatgtctagaacatctatcaatgggttgctaggaagaggctcaatgtttgtgttttcaccagatcagtttcagagactgcttaaaattaatccagactggaaaacccacagacttcttgatttaggtgctggagatggagaagtcacaaaaatcatgagccctcattttgaagaaatctatgccactgagctttctgaaactatgatatggcagcttcagaaaaagaaatacagagtccttggtataaatgaatggcagaatacggggttccagtatgatgtcatcagctgcctgaacttgctggaccgctgtgatcagcccctgactttgttaaaagatatcagaagtgtcttggagccaactagaggcagggtcatccttgcccttgtcctcccctttcatccctatgtggaaaacgtaggtggcaagtgggagaaaccatcagaaattttggaaatcaaaggacagaactgggaagaacaagtgaatagtctgcctgaagttttcagaaaagctggttttgttatcgaagctttcaccagactaccatacctgtgtgaaggcgacatgtataatgactactacgttctggatgacgctgtctttgttctcaaaccagtataaacacgtggaggtcgaagtcttcagagtccgcaccctccgggatgtgcccttggaagagggtctgtgttcacaattacgtgaagggaggacccttggggaccgccattctaaatatcatgtaggaatttaaaaagccaaaatactaattatttctttgtagtgtgtaaaggaatgtttttaaaagacaaaaacccaactctttgtggatttttatcaactctttactcagagccactctccaatgcaggtcacactccaattatgatggaagatattttttatacttaattgcagtagggactcattcccagacaaagcaatagtcacgacttcatggaaccaatcaatggattgttttttgaagactggcaataaagctgtccattcaattccaaatactggttttaaggtatagccactgatattctttcatgtttagaaattctttctgttattattcaagaaaatgtttttaatcatgctaataaacttttttggagatgactttggcatcatgtttgaattcatataaagctcccctagcattttttattggtttggcttcaggagtacccaaatagtagcattatgagaatgacgcagacaatttgaataggggggaaggaaggcttcagacttgggggaaggggagattattgcaaattgcagtgaacactgagtcagtaaaaaaaaaaaacagaaacaaaaacccagcctcattcagatacagaacttcagggacccctccccccacccccccagttaatgctgctgtgaaaaatgcaaaataacctggttctgactttgtgatcactcatgtcccatacactgaactttgtttttttctggacaatctcaggttctcagaattgaaacattcagttttgtctactgacaaaatgcaactaaaaatgttttaattcaacttcttactctacacttatatacctctctcccagagcttggctcttccctgaaatccttaaaggagtttattatttgccaagaatatggtttgatgaagaccgtgtcagactcatgcattctggaatccgtgagtgcctccaaccataaacccagaaatgctgccatagaggaacccattagcaagatcaataaccatcgtggatattccaaagagcagagcatttaacccagaatctgaaatctcagtaataacagaaatgtcaatatgagattgtggttattaacaatatgttatcctcactactttatttcttttttcatccaggtgtttcattaagtattctcatttatatgctcatagaagtcatcagatcaacacattcactccaacacctgggtataaaggcgaattaaaacctgaagaattactttattattcattaagaactgcattcccacatcctcacaccaatatcttccactgttactgtgcagtcataataagagttgggttatgtgatttatgcaaaattgttattggtgtgttctaatgatttttttccaggaattcaagtaagtgaagtacaaatacttagcaccatagattgtaaaaatagaaagaggaaatgagaaaacttaatgtcgttcttgtacagttgagttttgcttctttataaactgtctgttaaaatcaggggttgctgttagactgtcaagcagaagtgatggatgttcaaggaggcaggttgccccaaagtgttttctaactttcaagtagagaactttatgctctaataagaaaaatacaactcattcttaaccacccccccaaaacagagaaaacacatacatttatgcattttaaagataaaaagtagtttctcaaaaaaatctgaagttctctgaaaaccagcttattaaaagtgctgttttgtggtgaaaattgaaaccaaatccactcacatttcctatcgggtcttgaaattcttggtggtgtgtcaccattccactagatggcagtgttgcttactgagtgtcaatggcttttttccccgtaaatggaatcatgtttttctcccccaaagtacaataaagctgccttgtctgcaccatt

SEQ ID NO: 153613 - DNA, 1823 bp, Homo sapiens
  Payload ID: 10211
  Gene Symbol: MVD
  Gene Name: mevalonate (diphospho) decarboxylase
  Uniprot ID: P53602
  ENST ID: ENST00000301012
  CDS Start-End: 31-1233
gtggagctggggtcactgcgcggtgggaccatggcctcggagaagccgctggcggcagtcacttgtacagcgccggtcaacatcgcggtcatcaagtactggggcaagcgcgatgaagagctggttctgcccatcaactcctccctgagcgtcactctgcaccaggaccagttaaaaaccaccacaacagccgtcatcagcaaggacttcaccgaggaccggatttggctgaatggccgggaggaggatgtggggcagccgcggctgcaggcctgcctgcgggagatccgctgcctggcccggaagcggaggaactcacgggatggggacccgctgccctccagcctcagctgcaaggtgcacgtggcatcggtgaacaacttccccacggctgcgggcctggcctcctcagcggcgggctatgcctgcctagcctacaccctggcccgtgtctacggcgtggagagtgacctctcagaagtggctcgccggggctcaggcagcgcctgccggagcctgtatgggggctttgtggagtggcagatgggagagcaggccgacgggaaggacagcatcgctcggcaagtggcccccgagtcacactggcctgaactccgcgtgctcatccttgtggtgagcgctgagaagaagctgacaggcagtaccgtgggcatgcgggccagtgtggagaccagccccctgcttcggttccgggccgagtccgtggtgcccgcgcgcatggcggagatggcccgctgcatccgggagcgagacttccccagcttcgcccagctgaccatgaaggacagcaaccagttccacgccacctgcctcgacaccttcccgcccatctcttacctcaatgccatctcctggcgcatcatccacctggtgcaccgcttcaacgcccaccacggggacaccaaggtggcgtacacctttgacgcgggccccaatgccgtgatcttcaccctggacgacactgtggctgagtttgtggctgctgtgtggcacggctttcccccaggctcgaatggagacacgtttctgaaggggctgcaggtgaggccggcccctctctcagctgagcttcaggctgcgctggccatggagccgacccccggtggggtcaaatacatcattgtcactcaggtggggccagggcctcaaatcctggatgacccctgcgcccacctcctgggtcctgacggcctgccgaagccagctgcctgactgcctcagcagggaccgcatgccgcttggagaaggggtggcctcgccggagctagggagcggatgtggtgggctggccggactcctgggacatgtgggtggtggcttgaccccgggcccatgggcagcttgctgtggggcagtgcagggagtcctgcggccgcccaggtgtcaggagaggtccccgccgagtgcttcagctgccctaagctgcaccagcgctttgccaagatgggatggggagggggtatgagaactggcagagcctcggtgcagcagggctgaagggctttctcaccccagctctggctatgcccagttctctgagaaaggagctcagtggggaggtggtccctccagcggaccagggaaggggtcaccgtgctgggagcagcctccttgggcctcaggaaaccaccaagtgcctcggatggtggctgcccacggcgcttctgctgagaccctgcccccggcccaggtgtctcggagggtggctgcccacggcctgggtgtggctggaatggtggcaggagtgggcaccagtgcggccccggtggccatggggaataaaccagcattgctgcctccgg

SEQ ID NO: 153614 - DNA, 870 bp, Homo sapiens
  Payload ID: 10211
  Gene Symbol: MVD
  Gene Name: mevalonate (diphospho) decarboxylase
  ENST ID: ENST00000569177
  CDS Start-End: 58-870
gggtgggatcgcgggccgtaagtggctgtggagctggggtcactgcgcggtgggaccatggcctcggagaagccgctggcggcagtcacttgtacagcgccggtcaacatcgcggtcatcaagtactggggcaagcgcgatgaagagctggttctgcccatcaactcctccctgagcgtcactctgcaccaggaccagttaaaaaccaccacaacagccgtcatcagcaaggacttcaccgaggaccggatttggctgaatggccgggaggaggatgtggggcagccgcggctgcaggcctgcctgcgggagatccgctgcctggcccggaagcggaggaactcacgggatggggacccgctgccctccagcctcagctgcaaggtgcacgtggcatcggtgaacaacttccccacggctgcgggcctggcctcctcagcggcgggctatgcctgcctagttgcagctggcgtggggctctcgcctgtaatcccagtacttaagaggctgatgggggagaagcactgtaggccaggagttcaagaccagcctgggcaacatacctacaccctggcccgtgtctacggcgtggagagtgacctctcagaagtggctcgccggggctcaggcagcgcctgccggagcctgtatgggggctttgtggagtggcagatgggagagcaggccgacgggaaggacagcatcgctcggcaagtggcccccgagtcacactggcctgaactccgcgtgctcatccttgtggtgagcgctgagaagaagctgacaggcagtaccgtgggcatgcgggccagtgtggagaccagccccctgcttcggttccgggccgagtccgtggtgcccgcgcgcatg

SEQ ID NO: 153615 - DNA, 853 bp, Homo sapiens
  Payload ID: 10211
  Gene Symbol: MVD
  Gene Name: mevalonate (diphospho) decarboxylase
  ENST ID: ENST00000568133
  CDS Start-End: 3-278
ccatggcctcggagaagccgctggcggcagtcacttgtacagcgccggtcaacatcgcggtcatcaagtactggggcaagcgcgatgaagagctggttctgcccatcaactcctccctgagcgtcactctgcaccaggaccagttaaaaaccaccacaacagccgtcatcagcaaggacttcaccgaggaccggatttggctgaatggccgggaggaggatgtggggcagccgcggctgcaggcctgcctgcgggagagtgagctggggtccccataagcccatccctccctgttgtcagcagggtccgagcatccagaaagtgcttctgcctctgtgcccctcctgaggcagcaggcggggtggctgggaaccagacatgcccgctgggccgccagctccagggcagtggcccacctcaatgaccagctgggcttggtccgctgcctggcccggaagcggaggaactcacgggatggggacccgctgccctccagcctcagctgcaaggtgcacgtggcatcggtgaacaacttccccacggctgcgggcctggcctcctcagcggcgggctatgcctgcctagcctacaccctggcccgtgtctacggcgtggagagtgacctctcagaagtggctcgccggggctcaggcagcgcctgccggagcctgtatgggggctttgtggagtggcagatgggagagcaggccgacgggaaggacagcatcgctcggcaagtggcccccgagtcacactggcctgaactccgcgtgctcatccttgtggtgagcgctgagaagaagctgacaggcagtaccgtgggcatgcgggccagtgtggagaccagccccct

SEQ ID NO: 153616 - DNA, 507 bp, Homo sapiens
  Payload ID: 10211
  Gene Symbol: MVD
  Gene Name: mevalonate (diphospho) decarboxylase
  ENST ID: ENST00000565610
  CDS Start-End: 69-194
agaggcctctggggtgggatcgcgggccgtaagtggctgtggagctggggtcactgcgcggtgggaccatggcctcggagaagccgctggcggcagtcacttgtacagcgccggtcaacatcgcggtcatcaagtacttagagatggggtttcaccgtgttagccaggctggtctgaagctcctgacctcgtgatctgcccacctcagcctcccaaagtgctgggattacagactgtcactgcgacacccaggctggagtgcaatggcgtgatctcggctcactgcaacctccgcttcccgggttcaaccgattctcctgcctcagcctctcgagtagctgggactacagggggcaagcgcgatgaagagctggttctgcccatcaactcctccctgagcgtcactctgcaccaggaccagttaaaaaccaccacaacagccgtcatcagcaaggacttcaccgaggaccggatttggctgaatggccgggaggaggatgtggggca

SEQ ID NO: 153617 - DNA, 758 bp, Homo sapiens
  Payload ID: 10211
  Gene Symbol: MVD
  Gene Name: mevalonate (diphospho) decarboxylase
  ENST ID: ENST00000567064
  CDS Start-End: 12-167
gcggtgggaccatggcctcggagaagccgctggcggcagtcacttgtacagcgccggtcaacatcgcggtcatcaagtactggtcgcccggcgcctgcccattagcgattaccgaactatcgaaatcatcaatcatcgattcccatgaatcggggcaagcgcgatgaagagctggttctgcccatcaactcctccctgagcgtcactctgcaccaggaccagttaaaaaccaccacaacagccgtcatcagcaaggacttcaccgaggaccggatttggctgaatggccgggaggaggatgtggggcagccgcggctgcaggcctgcctgcgggagatccgctgcctggcccggaagcggaggaactcacgggatggggacccgctgccctccagcctcagctgcaaggtgcacgtggcatcggtgaacaacttccccacggctgcgggcctggcctcctcagcggcgggctatgcctgcctagcctacaccctggcccgtgtctacggcgtggagagtgacctctcagaagtggctcgccggggctcaggcagcgcctgccggagcctgtatgggggctttgtggagtggcagatgggagagcaggccgacgggaaggacagcatcgctcggcaagtggcccccgagtcacactggcctgaactccgcgtgctcatccttgtggtgagcgctgagaagaagctgacaggcagtaccgtgggcatgcgggccagtgtggagaccagccccctgcttcg

SEQ ID NO: 153618 - DNA, 1814 bp, Homo sapiens
  Payload ID: 10211
  Gene Symbol: MVD
  Gene Name: mevalonate (diphospho) decarboxylase
  ENST ID: ENST00000620002
  CDS Start-End: 544-960
gtggagctggggtcactgcgcggtgggaccatggcctcggagaagccgctggcggcagtcacttgtacagcgccggtcaacatcgcggtcatcaagtactggggcaagcgcgatgaagagctggttctgcccatcaactcctccctgagcgtcactctgcaccaggaccagttaaaaaccaccacaacagccgtcatcagcaaggacttcaccgaggaccggatttggctgaatggccgggaggaggatgtggggcagccgcggctgcaggcctgcctgcgggagatccgctgcctggcccggaagcggaggaactcacgggatggggacccgctgccctccagcctcagctgcaaggtgcacgtggcatcggtgaacaacttccccacggctgcgggcctggcctcctcagcggcgggctatgcctgcctagcctacaccctggcccgtgtctacggcgtggagagtgacctctcagaagtggctcgccggggctcaggcagcgcctgccggagcctgtatgggggctttgtggagtggcagatgggagagcaggccgacgggaaggacagcatcgctcggcaagtggcccccgagtcacactggcctgaactccgcgtgctcatccttgtggtgagcgctgagaagaagctgacaggcagtaccgtgggcatgcgggccagtgtggagaccagccccctgcttcggttccgggccgagtccgtggtgcccgcgcatggcggagatggcccgctgcatccgggagcgagacttccccagcttcgcccagctgaccatgaaggacagcaaccagttccacgccacctgcctcgacaccttcccccatctcttacctcaatgccatctcctggcgcatcatccacctggtgcaccgcttcaacgcccaccacggggacaccaaggtggcgtacacctttgacgcgggccccaatgccgtgatcttcaccctggacgacactgtggctgagtttgtggctgctgtgtggcacggctttcccccaggctcgaatggagacacgtttctgaaggggctgcaggtgaggccggcccctctctcagctgagcttcaggctgcgctggccatggagccgacccccggtggggtcaaatacatcattgtcactcaggtggggccagggcctcaaatcctggatgacccctgcgcccacctcctgggtcctgacggcctgccgaagccagctgcctgactgcctcagcagggaccgcatgccgcttggagaaggggtggcctcgccggagctagggagcggatgtggtgggctggccggactcctgggacatgtgggtggtggcttgaccccgggcccatgggcagcttgctgtggggcagtgcagggagtcctgcggccgcccaggtgtcaggagaggtccccgccgagtgcttcagctgccctaagctgcaccagcgctttgccaagatgggatggggagggggtatgagaactggcagagcctcggtgcagcagggctgaagggctttctcaccccagctctggctatgcccagttctctgagaaaggagctcagtggggaggtggtccctccagcggaccagggaaggggtcaccgtgctgggagcagcctccttgggcctcaggaaaccaccaagtgcctcggatggtggctgcccacggcgcttctgctgagaccctgcccccggcccaggtgtctcggagggtggctgcccacggcctgggtgtggctggaatggtggcaggagtgggcaccagtgcggccccggtggccatggggaataaaccagcattgctgcc

SEQ ID NO: 153619 - DNA, 1956 bp, Homo sapiens
  Payload ID: 10212
  Gene Symbol: MVK
  Gene Name: mevalonate kinase
  Uniprot ID: Q03426
  ENST ID: ENST00000228510
  CDS Start-End: 77-1267
tggggagctgctccggcttcggcgcggaggggcggcggccggggaggcggcggcggcggcaggattcccaggagccatgttgtcagaagtcctactggtgtctgctccggggaaagtcatccttcatggagaacatgccgtggtacatggcaaggtagcactggctgtatccttgaacttgagaacattcctccggcttcaaccccacagcaatgggaaagtggacctcagcttacccaacattggtatcaagcgggcctgggatgtggccaggcttcagtcactggacacaagctttctggagcaaggtgatgtcacaacacccacctcagagcaagtggagaagctaaaggaggttgcaggcttgcctgacgactgtgctgtcaccgagcgcctggctgtgctggcctttctttacttatacctgtccatctgccggaagcagagggccctgccgagcctggatatcgtagtgtggtcggagctgccccccggggcgggcttgggctccagcgccgcctactcggtgtgtctggcagcagccctcctgactgtgtgcgaggagatcccaaacccgctgaaggacggggattgcgtcaacaggtggaccaaggaggatttggagctaattaacaagtgggccttccaaggggagagaatgattcacgggaacccctccggagtggacaatgctgtcagcacctggggaggagccctccgataccatcaagggaagatttcatccttaaagaggtcgccagctctccagatcctgctgaccaacaccaaagtccctcgcaataccagggcccttgtggctggcgtcagaaacaggctgctcaagttcccagagatcgtggcccccctcctgacctcaatagatgccatctccctggagtgtgagcgcgtgctgggagagatgggggaagccccagccccggagcagtacctcgtgctggaagagctcattgacatgaaccagcaccatctgaatgccctcggcgtgggccacgcctctctggaccagctctgccaggtgaccagggcccgcggacttcacagcaagctgactggcgcaggcggtggtggctgtggcatcacactcctcaagccagggctggagcagccagaagtggaggccacgaagcaggccctgaccagctgtggctttgactgcttggaaaccagcatcggtgcccccggcgtctccatccactcagccacctccctggacagccgagtccagcaagccctggatggcctctgagaggagcccacgacactgcagccccacccagatgcccctttctggattattctgggggctgcagttcgactctgtgctggccagcgagcgcccagctcctgacactgctggagaggccccagccgcttggcgatgccagccaagctctgcagtcccagcggtgggacctagggaggcatggtctgccctctgcatcctctggagccagccgagcaggaggcctaggagggtcctctgagactccagacctgaggcgagaagggctgcttccctgaagctcccacagtcccatctgcttcaggcccccgccttggcctgtgttcttcctggccgcctgggtccaatgctcaggtgctggggcctggttcccggagaagtgtgccttctctctcccttttcagggaccgccccctgtctctcagggccaggcctctccctcctccaggaagccttcccctaccccttgtcgcccctccctcccagagcacctgctgtctgggtggctcactcagcacttggtgtggccttcccttctacctagcgggatggggctcccccaggggctgtcccggaggcggtgggcctggttaaataaggcagggtttatatgcactttcttccgatctgtacctgagaggtttgtggaaaagatggcaaatggggaataaaaagattttgtgtcaacagta

SEQ ID NO: 153620 - DNA, 1770 bp, Homo sapiens
  Payload ID: 10212
  Gene Symbol: MVK
  Gene Name: mevalonate kinase
  ENST ID: ENST00000392727
  CDS Start-End: 52-1086
ggaggggcggcggccggggaggcggcggcggcggcaggattcccaggagccatgttgtcagaagtcctactggtgtctgctccggggaaagtcatccttcatggagaacatgccgtggtacatggcaaggtagcactggctgtatccttgaacttgagaacattcctccggcttcaaccccacagcaatgggaaagtggacctcagcttacccaacattggtatcaagcgggcctgggatgtggccaggcttcagtcactggacacaagctttctggagcaaggtgatgtcacaacacccacctcagagcaagtggagaagctaaaggaggttgcaggcttgcctgacgactgtgctgtcaccgagcgcctggctgtgctggcctttctttacttatacctgtccatctgccggaagcagaggtggaccaaggaggatttggagctaattaacaagtgggccttccaaggggagagaatgattcacgggaacccctccggagtggacaatgctgtcagcacctggggaggagccctccgataccatcaagggaagatttcatccttaaagaggtcgccagctctccagatcctgctgaccaacaccaaagtccctcgcaataccagggcccttgtggctggcgtcagaaacaggctgctcaagttcccagagatcgtggcccccctcctgacctcaatagatgccatctccctggagtgtgagcgcgtgctgggagagatgggggaagccccagccccggagcagtacctcgtgctggaagagctcattgacatgaaccagcaccatctgaatgccctcggcgtgggccacgcctctctggaccagctctgccaggtgaccagggcccgcggacttcacagcaagctgactggcgcaggcggtggtggctgtggcatcacactcctcaagccagggctggagcagccagaagtggaggccacgaagcaggccctgaccagctgtggctttgactgcttggaaaccagcatcggtgcccccggcgtctccatccactcagccacctccctggacagccgagtccagcaagccctggatggcctctgagaggagcccacgacactgcagccccacccagatgcccctttctggattattctgggggctgcagttcgactctgtgctggccagcgagcgcccagctcctgacactgctggagaggccccagccgcttggcgatgccagccaagctctgcagtcccagcggtgggacctagggaggcatggtctgccctctgcatcctctggagccagccgagcaggaggcctaggagggtcctctgagactccagacctgaggcgagaagggctgcttccctgaagctcccacagtcccatctgcttcaggcccccgccttggcctgtgttcttcctggccgcctgggtccaatgctcaggtgctggggcctggttcccggagaagtgtgccttctctctcccttttcagggaccgccccctgtctctcagggccaggcctctccctcctccaggaagccttcccctaccccttgtcgcccctccctcccagagcacctgctgtctgggtggctcactcagcacttggtgtggccttcccttctacctagcgggatggggctcccccaggggctgtcccggaggcggtgggcctggttaaataaggcagggtttatatgcactttcttccgatctgtacctgagaggtttgtggaaaagatggcaaatggggaataaaaagattttgtgtcaa

SEQ ID NO: 153621 - DNA, 1644 bp, Homo sapiens
  Payload ID: 10212
  Gene Symbol: MVK
  Gene Name: mevalonate kinase
  ENST ID: ENST00000447878
  CDS Start-End: 96-347
cgctctgggttgtgggagttggggagctgctccggcttcggcgcggaggggcggcggccggggaggcggcggcggcggcaggattcccaggagccatgttgtcagaagtcctactggtgtctgctccggggaaagtcatccttcatggagaacatgccgtggtacatggcaaggtagcactggctgtatccttgaacttgagaacattcctccggcttcaaccccacagcaatgggaaagtggacctcagcttacccaacattggtatcaagcgggcctgggatgtggccaggcttcagtcactggacacaagctttctgggtggaccaaggaggatttggagctaattaacaagtgggccttccaaggggagagaatgattcacgggaacccctccggagtggacaatgctgtcagcacctggggaggagccctccgataccatcaagggaagatttcatccttaaagaggtcgccagctctccagatcctgctgaccaacaccaaagtccctcgcaataccagggcccttgtggctggcgtcagaaacaggctgctcaagttcccagagatcgtggcccccctcctgacctcaatagatgccatctccctggagtgtgagcgcgtgctgggagagatgggggaagccccagccccggagcagtacctcgtgctggaagagctcattgacatgaaccagcaccatctgaatgccctcggcgtgggccacgcctctctggaccagctctgccaggtgaccagggcccgcggacttcacagcaagctgactggcgcaggcggtggtggctgtggcatcacactcctcaagccagggctggagcagccagaagtggaggccacgaagcaggccctgaccagctgtggctttgactgcttggaaaccagcatcggtgcccccggcgtctccatccactcagccacctccctggacagccgagtccagcaagccctggatggcctctgagaggagcccacgacactgcagccccacccagatgcccctttctggattattctgggggctgcagttcgactctgtgctggccagcgagcgcccagctcctgacactgctggagaggccccagccgcttggcgatgccagccaagctctgcagtcccagcggtgggacctagggaggcatggtctgccctctgcatcctctggagccagccgagcaggaggcctaggagggtcctctgagactccagacctgaggcgagaagggctgcttccctgaagctcccacagtcccatctgcttcaggcccccgccttggcctgtgttcttcctggccgcctgggtccaatgctcaggtgctggggcctggttcccggagaagtgtgccttctctctcccttttcagggaccgccccctgtctctcagggccaggcctctccctcctccaggaagccttcccctaccccttgtcgcccctccctcccagagcacctgctgtctgggtggctcactcagcacttggtgtggccttcccttctacctagcgggatggggctcccccaggggctgtcccggaggcggtgggcctggttaaataaggcagggtttatatgcactttcttccgatctgtacctgagaggtttgtggaaaagatggcaaat

SEQ ID NO: 153622 - DNA, 886 bp, Homo sapiens
  Payload ID: 10212
  Gene Symbol: MVK
  Gene Name: mevalonate kinase
  ENST ID: ENST00000546277
  CDS Start-End: 285-886
gattcacggcaggtgttcgagttgcccttcccgccagccactcacctgtccccgtcttccacgccctgagggccgcggctctggaaacggggatacaggagcctggcggcgccgaagcacccgcgcaggccaagacggctccccaggccaagacggctccccaggccgcacacagccatgagccaggctgcttgacgggacctgaccccgccaggttcccgtccagtccgcggggtgactccacccacagctggccgcgccaccgctcaggattcccaggagccatgttgtcagaagtcctactggtgtctgctccggggaaagtcatccttcatggagaacatgccgtggtacatggcaaggtagcactggctgtatccttgaacttgagaacattcctccggcttcaaccccacagcaatgggaaagtggacctcagcttacccaacattggtatcaagcgggcctgggatgtggccaggcttcagtcactggacacaagctttctggagcaaggtgatgtcacaacacccacctcagagcaagtggagaagctaaaggaggttgcaggcttgcctgacgactgtgctgtcaccgagcgcctggctgtgctggcctttctttacttatacctgtccatctgccggaagcagagggccctgccgagcctggatatcgtagtgtggtcggagctgccccccggggcgggcttgggctccagcgccgcctactcggtgtgtctggcagcagccctcctgactgtgtgcgaggagatcccaaacccgctgaaggacggggattgcgtcaacaggtggaccaaggaggatttggagctaattaacaagtgggccttccaaggggagagaatgattcacgggaacccctc

SEQ ID NO: 153623 - DNA, 608 bp, Homo sapiens
  Payload ID: 10212
  Gene Symbol: MVK
  Gene Name: mevalonate kinase
  ENST ID: ENST00000539696
  CDS Start-End: 161-508
tgggagttggggagctgctccggcttcggcgcggaggggcggcggccggggaggcggcggcggcggcagaaacaggctgctcaagttcccagagatcgtggcccccctcctgacctcaatagatgccatctccctggagtgtgagcgcgtgctgggagagatgggggaagccccagccccggagcagtacctcgtgctggaagagctcattgacatgaaccagcaccatctgaatgccctcggcgtgggccacgcctctctggaccagctctgccaggtgaccagggcccgcggacttcacagcaagctgactggcgcaggcggtggtggctgtggcatcacactcctcaagccagggctggagcagccagaagtggaggccacgaagcaggccctgaccagctgtggctttgactgcttggaaaccagcatcggtgcccccggcgtctccatccactcagccacctccctggacagccgagtccagcaagccctggatggcctctgagaggagcccacgacactgcagccccacccagatgcccctttctggattattctgggggctgcagttcgactctgtgctggccagcgagcgcccagctcct

SEQ ID NO: 153624 - DNA, 834 bp, Homo sapiens
  Payload ID: 10212
  Gene Symbol: MVK
  Gene Name: mevalonate kinase
  ENST ID: ENST00000539335
  CDS Start-End: 323-834
cgcggtgacctcacggcggtgtgacgtacccatggcgacgacaccacgattcacggcaggtgttcgagttgcccttcccgccagccactcacctgtccccgtcttccacgccctgagggccgcggctctggaaacggggatacaggagcctggcggcgccgaagcacccgcgcaggccaagacggctccccaggccaagacggctccccaggccgcacacagccatgagccaggctgcttgacgggacctgaccccgccaggttcccgtccagtccgcggggtgactccacccacagctggccgcgccaccgctcaggagccatgttgtcagaagtcctactggtgtctgctccggggaaagtcatccttcatggagaacatgccgtggtacatggcaaggtagcactggctgtatccttgaacttgagaacattcctccggcttcaaccccacagcaatgggaaagtggacctcagcttacccaacattggtatcaagcgggcctgggatgtggccaggcttcagtcactggacacaagctttctggagcaaggtgatgtcacaacacccacctcagagcaagtggagaagctaaaggaggttgcaggcttgcctgacgactgtgctgtcaccgagcgcctggctgtgctggcctttctttacttatacctgtccatctgccggaagcagagggccctgccgagcctggatatcgtagtgtggtcggagctgccccccggggcgggcttgggctccagcgccgcctactcggtgtgtctggcagcagccctcctgactgtgtgcgaggagatcccaaacccgctgaaggacgg

SEQ ID NO: 153625 - DNA, 2747 bp, Homo sapiens
  Payload ID: 10212
  Gene Symbol: MVK
  Gene Name: mevalonate kinase
  Uniprot ID: Q03426
  ENST ID: ENST00000539575
  CDS Start-End: 17-1207
aggattcccaggagccatgttgtcagaagtcctactggtgtctgctccggggaaagtcatccttcatggagaacatgccgtggtacatggcaaggtagcactggctgtatccttgaacttgagaacattcctccggcttcaaccccacagcaatgggaaagtggacctcagcttacccaacattggtatcaagcgggcctgggatgtggccaggcttcagtcactggacacaagctttctggagcaaggtgatgtcacaacacccacctcagagcaagtggagaagctaaaggaggttgcaggcttgcctgacgactgtgctgtcaccgagcgcctggctgtgctggcctttctttacttatacctgtccatctgccggaagcagagggccctgccgagcctggatatcgtagtgtggtcggagctgccccccggggcgggcttgggctccagcgccgcctactcggtgtgtctggcagcagccctcctgactgtgtgcgaggagatcccaaacccgctgaaggacggggattgcgtcaacaggtggaccaaggaggatttggagctaattaacaagtgggccttccaaggggagagaatgattcacgggaacccctccggagtggacaatgctgtcagcacctggggaggagccctccgataccatcaagggaagatttcatccttaaagaggtcgccagctctccagatcctgctgaccaacaccaaagtccctcgcaataccagggcccttgtggctggcgtcagaaacaggctgctcaagttcccagagatcgtggcccccctcctgacctcaatagatgccatctccctggagtgtgagcgcgtgctgggagagatgggggaagccccagccccggagcagtacctcgtgctggaagagctcattgacatgaaccagcaccatctgaatgccctcggcgtgggccacgcctctctggaccagctctgccaggtgaccagggcccgcggacttcacagcaagctgactggcgcaggcggtggtggctgtggcatcacactcctcaagccagggctggagcagccagaagtggaggccacgaagcaggccctgaccagctgtggctttgactgcttggaaaccagcatcggtgcccccggcgtctccatccactcagccacctccctggacagccgagtccagcaagccctggatggcctctgagaggagcccacgacactgcagccccacccagatgcccctttctggattattctgggggctgcagttcgactctgtgctggccagcgagcgcccagctcctgacactgctggagaggccccagccgcttggcgatgccagccaagctctgcagtcccagcggtgggacctagggaggcatggtctgccctctgcatcctctggagccagccgagcaggaggcctaggagggtcctctgagactccagacctgaggcgagaagggctgcttccctgaagctcccacagtcccatctgcttcaggcccccgccttggcctgtgttcttcctggccgcctgggtccaatgctcaggtgctggggcctggttcccggagaagtgtgccttctctctcccttttcagggaccgccccctgtctctcagggccaggcctctccctcctccaggaagccttcccctaccccttgtcgcccctccctcccagagcacctgctgtctgggtggctcactcagcacttggtgtggccttcccttctacctagcgggatggggctcccccaggggctgtcccggaggcggtgggcctggttaaataaggcagggtttatatgcactttcttccgatctgtacctgagaggtttgtggaaaagatggcaaatggggaataaaaagattttgtgtcaacagtagagactccaggccaccagcacctccctctgtccctgtcccctctccagctgtttcctccatggagctcttcagcaatggagggaaatagggtttggggtcactttgttgtgcgtcttggggatgaggtggcttttcccagatggcccttgctggagagggactgggacacggctctcagtccatcagcacaactctaggctgctgctgcggagggagaagttgagcttcctagctccagaatcacaagcacccacgagagcacagacctgtgtaagacaggaaagcagaacctgccatcgctcctggggcgcgccttcctttctgaaatgaactggctggatggagaaaacagactcaaatgttctggcccgggtgcctggcactccccacccccgccccccaccggccctatttgaactttatattgcagtcagcttggtgctttccgaaatgccattagccatcaggaaacccttgtagttggtgccttgccagccagaacctctgggacccacggacctgcaaagaggccgagtggaaaggtgggggccggcgcagggatttcaggatgaggtgaaagcgattcagtgcgcgtctgcccttggccactagggggcagctggcggccttccctgctgttgtcttcctgcagggtgagaggagcaggagccgagctccacccccacgccagccttgggcccggcctgggatcactgctgggaacgtgagagtgaagggaggacgcctaccccagcttaacttgtagaaatggccccagatcactgatggctgttccctgccccttcccttcaaaacacaacgcataaagcagtaatactaattaatactg

SEQ ID NO: 153626 - DNA, 702 bp, Homo sapiens
  Payload ID: 10212
  Gene Symbol: MVK
  Gene Name: mevalonate kinase
  ENST ID: ENST00000545774
  CDS Start-End: 57-308
ggcgcggaggggcggcggccggggaggcggcggcggcggcaggattcccaggagccatgttgtcagaagtcctactggtgtctgctccggggaaagtcatccttcatggagaacatgccgtggtacatggcaaggtagcactggctgtatccttgaacttgagaacattcctccggcttcaaccccacagcaatgggaaagtggacctcagcttacccaacattggtatcaagcgggcctgggatgtggccaggcttcagtcactggacacaagctttctgggtggaccaaggaggatttggagctaattaacaagtgggccttccaaggggagagaatgattcacgggaacccctccggagtggacaatgctgtcagcacctggggaggagccctccgataccatcaagggaagatttcatccttaaagaggtaacctgggggtggagcagcacattcagccatggctgcattgatgtgtgcagggggcagagctctgcacctttgggaagtaccataggaggcaggtgtccctggctcttcatcccccaatgtggccctcacagtgcactagctgcaaggaagcaggggtggtggggaagacctgctctctccttctccccttcagctcttaaattgcagagatatcagaaagggaaagtcatgcatggctgtgcccgtagactctcagctgctcattca

SEQ ID NO: 153627 - DNA, 1296 bp, Homo sapiens
  Payload ID: 10212
  Gene Symbol: MVK
  Gene Name: mevalonate kinase
  ENST ID: ENST00000537237
  CDS Start-End: 75-428
gggagctgctccggcttcggcgcggaggggcggcggccggggaggcggcggcggcggcaggattcccaggagccatgttgtcagaagtcctactggtgtctgctccggggaaagtcatccttcatggagaacatgccgtggtacatggcaaggtagcactggctgtatccttgaacttgagaacattcctccggcttcaaccccacagcaatgggaaagtggacctcagcttacccaacattggtatcaagcgggcctgggatgtggccaggcttcagtcactggacacaagctttctggggtctcactctgttatgcagcctggagtacagtggtgcgaccacagctcactgtttcttcaacctcctgggctcaagcgatcctcctgcctcagccttctgagtagctgggaccacagagcaaggtgatgtcacaacacccacctcagagcaagtggagaagctaaaggaggttgcaggcttgcctgacgactgtgctgtcaccgagcgcctggctgtgctggcctttctttacttatacctgtccatctgccggaagcagagggccctgccgagcctggatatcgtagtgtggtcggagctgccccccggggcgggcttgggctccagcgccgcctactcggtgtgtctggcagcagccctcctgactgtgtgcgaggagatcccaaacccgctgaaggacggggattgcgtcaacaggtggaccaaggaggatttggagctaattaacaagtgggccttccaaggggagagaatgattcacgggaacccctccggagtggacaatgctgtcagcacctggggaggagccctccgataccatcaagggaagatttcatccttaaagagttcccagagatcgtggcccccctcctgacctcaatagatgccatctccctggagtgtgagcgcgtgctgggagagatgggggaagccccagccccggagcagtacctcgtgctggaagagctcattgacatgaaccagcaccatctgaatgccctcggcgtgggccacgcctctctggaccagctctgccaggtgaccagggcccgcggacttcacagcaagctgactggcgcaggcggtggtggctgtggcatcacactcctcaagccagggctggagcagccagaagtggaggccacgaagcaggccctgaccagctgtggctttgactgcttggaaaccagcatcggtgcccccggcgtctccatccactcagccacctccctggacagccgagtccagcaagccctggatggcctctgagagg

SEQ ID NO: 153628 - DNA, 1591 bp, Homo sapiens
  Payload ID: 10212
  Gene Symbol: MVK
  Gene Name: mevalonate kinase
  ENST ID: ENST00000629016
  CDS Start-End: 17-268
aggattcccaggagccatgttgtcagaagtcctactggtgtctgctccggggaaagtcatccttcatggagaacatgccgtggtacatggcaaggtagcactggctgtatccttgaacttgagaacattcctccggcttcaaccccacagcaatgggaaagtggacctcagcttacccaacattggtatcaagcgggcctgggatgtggccaggcttcagtcactggacacaagctttctgggtggaccaaggaggatttggagctaattaacaagtgggccttccaaggggagagaatgattcacgggaacccctccggagtggacaatgctgtcagcacctggggaggagccctccgataccatcaagggaagatttcatccttaaagaggtcgccagctctccagatcctgctgaccaacaccaaagtccctcgcaataccagggcccttgtggctggcgtcagaaacaggctgctcaagttcccagagatcgtggcccccctcctgacctcaatagatgccatctccctggagtgtgagcgcgtgctgggagagatgggggaagccccagccccggagcagtacctcgtgctggaagagctcattgacatgaaccagcaccatctgaatgccctcggcgtgggccacgcctctctggaccagctctgccaggtgaccagggcccgcggacttcacagcaagctgactggcgcaggcggtggtggctgtggcatcacactcctcaagccagggctggagcagccagaagtggaggccacgaagcaggccctgaccagctgtggctttgactgcttggaaaccagcatcggtgcccccggcgtctccatccactcagccacctccctggacagccgagtccagcaagccctggatggcctctgagaggagcccacgacactgcagccccacccagatgcccctttctggattattctgggggctgcagttcgactctgtgctggccagcgagcgcccagctcctgacactgctggagaggccccagccgcttggcgatgccagccaagctctgcagtcccagcggtgggacctagggaggcatggtctgccctctgcatcctctggagccagccgagcaggaggcctaggagggtcctctgagactccagacctgaggcgagaagggctgcttccctgaagctcccacagtcccatctgcttcaggcccccgccttggcctgtgttcttcctggccgcctgggtccaatgctcaggtgctggggcctggttcccggagaagtgtgccttctctctcccttttcagggaccgccccctgtctctcagggccaggcctctccctcctccaggaagccttcccctaccccttgtcgcccctccctcccagagcacctgctgtctgggtggctcactcagcacttggtgtggccttcccttctacctagcgggatggggctcccccaggggctgtcccggaggcggtgggcctggttaaataaggcagggtttatatgcactttcttccgatctgtacctgagaggtttgtggaaaagatggcaaatggggaataaaaagattttgtgtcaac

SEQ ID NO: 153629 - DNA, 2591 bp, Homo sapiens
  Payload ID: 10212
  Gene Symbol: MVK
  Gene Name: mevalonate kinase
  ENST ID: ENST00000625889
  CDS Start-End: 17-1051
aggattcccaggagccatgttgtcagaagtcctactggtgtctgctccggggaaagtcatccttcatggagaacatgccgtggtacatggcaaggtagcactggctgtatccttgaacttgagaacattcctccggcttcaaccccacagcaatgggaaagtggacctcagcttacccaacattggtatcaagcgggcctgggatgtggccaggcttcagtcactggacacaagctttctggagcaaggtgatgtcacaacacccacctcagagcaagtggagaagctaaaggaggttgcaggcttgcctgacgactgtgctgtcaccgagcgcctggctgtgctggcctttctttacttatacctgtccatctgccggaagcagaggtggaccaaggaggatttggagctaattaacaagtgggccttccaaggggagagaatgattcacgggaacccctccggagtggacaatgctgtcagcacctggggaggagccctccgataccatcaagggaagatttcatccttaaagaggtcgccagctctccagatcctgctgaccaacaccaaagtccctcgcaataccagggcccttgtggctggcgtcagaaacaggctgctcaagttcccagagatcgtggcccccctcctgacctcaatagatgccatctccctggagtgtgagcgcgtgctgggagagatgggggaagccccagccccggagcagtacctcgtgctggaagagctcattgacatgaaccagcaccatctgaatgccctcggcgtgggccacgcctctctggaccagctctgccaggtgaccagggcccgcggacttcacagcaagctgactggcgcaggcggtggtggctgtggcatcacactcctcaagccagggctggagcagccagaagtggaggccacgaagcaggccctgaccagctgtggctttgactgcttggaaaccagcatcggtgcccccggcgtctccatccactcagccacctccctggacagccgagtccagcaagccctggatggcctctgagaggagcccacgacactgcagccccacccagatgcccctttctggattattctgggggctgcagttcgactctgtgctggccagcgagcgcccagctcctgacactgctggagaggccccagccgcttggcgatgccagccaagctctgcagtcccagcggtgggacctagggaggcatggtctgccctctgcatcctctggagccagccgagcaggaggcctaggagggtcctctgagactccagacctgaggcgagaagggctgcttccctgaagctcccacagtcccatctgcttcaggcccccgccttggcctgtgttcttcctggccgcctgggtccaatgctcaggtgctggggcctggttcccggagaagtgtgccttctctctcccttttcagggaccgccccctgtctctcagggccaggcctctccctcctccaggaagccttcccctaccccttgtcgcccctccctcccagagcacctgctgtctgggtggctcactcagcacttggtgtggccttcccttctacctagcgggatggggctcccccaggggctgtcccggaggcggtgggcctggttaaataaggcagggtttatatgcactttcttccgatctgtacctgagaggtttgtggaaaagatggcaaatggggaataaaaagattttgtgtcaacagtagagactccaggccaccagcacctccctctgtccctgtcccctctccagctgtttcctccatggagctcttcagcaatggagggaaatagggtttggggtcactttgttgtgcgtcttggggatgaggtggcttttcccagatggcccttgctggagagggactgggacacggctctcagtccatcagcacaactctaggctgctgctgcggagggagaagttgagcttcctagctccagaatcacaagcacccacgagagcacagacctgtgtaagacaggaaagcagaacctgccatcgctcctggggcgcgccttcctttctgaaatgaactggctggatggagaaaacagactcaaatgttctggcccgggtgcctggcactccccacccccgccccccaccggccctatttgaactttatattgcagtcagcttggtgctttccgaaatgccattagccatcaggaaacccttgtagttggtgccttgccagccagaacctctgggacccacggacctgcaaagaggccgagtggaaaggtgggggccggcgcagggatttcaggatgaggtgaaagcgattcagtgcgcgtctgcccttggccactagggggcagctggcggccttccctgctgttgtcttcctgcagggtgagaggagcaggagccgagctccacccccacgccagccttgggcccggcctgggatcactgctgggaacgtgagagtgaagggaggacgcctaccccagcttaacttgtagaaatggccccagatcactgatggctgttccctgccccttcccttcaaaacacaacgcataaagcagtaatactaattaatactg

SEQ ID NO: 153630 - DNA, 6124 bp, Homo sapiens
  Payload ID: 10213
  Gene Symbol: MEX3A
  Gene Name: mex-3 RNA binding family member A
  Uniprot ID: A1L020
  ENST ID: ENST00000532414
  CDS Start-End: 1-1563
atgcctagtctagtggtatctggaataatggaaagaaatgggggctttggagaactaggatgtttcgggggaagcgctaaggaccgagggctgctggaagacgagcgcgcccttcagctggctctcgatcaactctgcctcctgggtttgggggagccccccgcccccacggcgggcgaggacgggggaggtggggggggcggcgcccccgcgcagccggccgcccccccgcagccggccccgccgccgccgcccgcggcgcccccggccgccccgacggcggcccccgcagcgcagacgccccagccccccaccgcccccaaaggggcgagcgacgccaagctctgcgctctctacaaagaggccgagctgcgcctgaagggcagcagcaacaccacggagtgtgttcccgtgcccacctccgagcacgtggccgagatcgtgggcaggcaaggctgcaagattaaggccttgagggccaagaccaacacctacatcaagacaccggtgaggggcgaggaaccagtgttcatggtgacagggcgacgggaggacgtggccacagcccggcgggaaatcatctcagcagcggagcacttctccatgatccgtgcctcccgcaacaagtcaggcgccgcctttggtgtggctcctgctctgcccggccaggtgaccatccgtgtgcgggtgccctaccgcgtggtggggctggtggtgggccccaaaggggcaaccatcaagcgcatccagcagcaaaccaacacatacattatcacaccaagccgtgaccgcgaccccgtgttcgagatcacgggtgccccaggcaacgtggagcgtgcgcgcgaggagatcgagacgcacatcgcggtgcgcactggcaagatcctcgagtacaacaatgaaaacgacttcctggcggggagccccgacgcagcaatcgatagccgctactccgacgcctggcgggtgcaccagcccggctgcaagcccctctccaccttccggcagaacagcctgggctgcatcggcgagtgcggagtggactctggctttgaggccccacgcctgggtgagcagggcggggactttggctacggcgggtacctctttccgggctatggcgtgggcaagcaggatgtgtactacggcgtggccgagactagccccccgctgtgggcgggccaggagaacgccacgcccacctccgtgctcttctcctctgcctcctcctcctcctcctcttccgccaaggcccgcgctgggcccccgggcgcacaccgctcccctgccacttccgcgggacccgagctggccggactcccgaggcgccccccgggagagccgctccagggcttctctaaacttggtgggggcggcctgcggagccccggcggcgggcgggattgcatggtctgctttgagagcgaagtgactgccgcccttgtgccctgcggacacaacctgttctgcatggagtgtgcagtacgcatctgcgagaggacggacccagagtgtcccgtctgccacatcacagccacgcaagccatccgaatattctcctaagccccgtgccccatgcctccggggcccactccactgggcccaccctggacctgttttccactaaagccttttggaaagcggtgatttgaggggcaaggtgcttagagatactcgctcgctggggaaggggggagggaggcagtggtggctggagggtgcgccactttcagagcctctggtcaccctgtcctggaaagattgggagggggccagactgaaaattttactagagttacaactctgatacctcaacacacccttaaatctggaagcagctaagagaaacttttgttttgccagaggtggccactaaggcattctgacgccctctgcccacctcccccgctgtgtgtcactccaccccttcttccgaggagggggtgggtaaaagggagagggagaattaccacctgtatctagaggtgctctttgcaatccctaagccctctggtcctgacctccgacctcctaacatgaccctttacctcccaccccacccccatatcctgtttgggaaactgtcaccagtttccagcagtgtaagggagttggagtcctatcagaagttgcatagatcttctaggggttggggagagaagcatgtcaatcgtttctgtggctgaaaggctcagaagccatctgtccccacaaagctgggctagaggaatctggagaggagtcctcctctctgcccctgtcccctgcagtgtttcccttcactctctccgcctatcttcccttcctttgggatcttccctttcctcaactctttcctttccctccagctctttgctttgctttcttttggtggctgtcactcccagctctgtcttgttccttgtctttgtctttcttcccttccccctgcccctgcccctaccagcccagctttggggacaccatccttctggggagaagtagggggaggaatatttggatggtccctccattcctcttcaggcatctggaggccctctcccccactcctccaaagaaacatctcaaattattgatggaatgtatccccattctcagtgaaaatgtgaggaggggactaatactggggtaaagggtcaaacccccaccttcatcactatgggcattatatttagggagtagttcttgggctggattttctggttgtggaagtgggggcgccagagtagtgtgtctgctatttaaaggagcaggaaagggcgtgaggcaggaggagagactggtggagggaagagctgctcctcccatgcagtgcccgactccctgcacccctctcaacctgacctgaacctttattgaatccttattagcttgaatccttattagcttgaatcctccatgcaaatcatggagtctgtgtcccacctgatgtggttgaggagaagccaggtcttcaaagaggggtcagcctggggcaaagcaggactggggggaggtgggcagcagggcctattctgagaatcacatattgttacaggccttgcaccccctttgctgcttccctcctgctcatttggggctgccaccagctctccaccctcctggttccgctggccgggccaagagaggatggagggatgggagtcccaggagatccttgtaaatagtggggtgggactgttctgagtgatcacccgagcacttaaagctccagagtcccattcttcctggatggagcaggtggaggtgcagaggggatttcctcctctccttcctcctgtcgagaattaacacctctccacagccttcccctccagaacaccagccagggaggggtggggaaggaggtcacagccaagaaaactgccctgtgacgacttccctccttcccgcctatgtgagccatcctgagatgtctgtacaatagaaaccaaaccaaatgggcaccctcggttgccggggggcaggtggggaggggggtgggaagaagggatgtctgtctgtcgtccccctccccctctccactctttacccacaaaggcagaagactgttacactagggggctcagcaaattcaatcccacccttaccaattgagccaaacctagaaacaaacacaaaacacgaatagtgagagacaaaatagaggagagaaagagagcatgagagggagcgagacaggcgaccaacacagaggagagaaaacaaaaatagcaaaaaaaaaaaaaaaaagcagttctttataatttaatattctattttaataaaggcgtttattaccatataaatgtagcaaagaacctgggctaatatgaaaaaaaaagactttttattaggtaatttattatatgaaaaggatattttattttatgataaagtgatccttaaaaaaataaaaaaactttagaaggtttagaatatatgtagggagagaagaagaaaaaaatacatttgtattcagagttaaatcttaaaaaaaaaaagtgtttttaatatatgtttgggtttacgttgcttttttcccccactttttttttggggaggaatgtcatttgcttttcttgggggagcatcccgggggtgaatggtggagagaggagctgggggaacccggtccctcctgggacccttccagtagattggatttcactccatggactcctcctcccctctccccctccccctcaggggagccggcagagccaaacaaagaaagggattaacaagaaaggaagaagctgtaggactaaggactgaggatcctggggtgtcccccaccactttcccctgccctgtcgcaggggcaagtgaggagggggaatccagaattaaggcctagcaggcctataggaaccctcagagatgtgtgagatttaagagatctagatttttttttaaccaaaaacaagagagaaagagaagaaaaagagaaaccgaggggtttaaaagaaaagaatactacaaaataataattattaataataataattcaaatttatttcatataatcctagagagagaaagaaacaattactagttacttagtagacaatattaagatagcttaaagtttagtagcattgagggcccctgggtccagtagaatgtataaaagttgtaaggaaaagataaatagaggagggaagtggctgagtccaccctgagttgcccaatcttcagataccagggttggatcaggttgctagtttaagattgggagcttccagtctgctggggttgattctgagaatccttggatttttaaattgtaggacaaagaaatgaggggttcatttcccagggtcttggaaaggatgcacactgatcatctcaataagacaggggctgggttgggggcagcagaggaggccaagcacattcacctgcacccctagtacctgggcagcccatactccaatgtggtatgtcccctcctggggctcccagctcaaaccctcccatgcctgcttcccccaggcctaactgaggaagtccttcttgaagtgtgacctcggtccacttctctacagattgatttaagagcctgggaagtcattccacaaacagacacacatgcacacacgcttctcaccttcagagcttcaagagcactgaggcgatcagtcccctacccctgttcccatccagctttccacttagctttgacctccatggcagcagtagcagtaacaatctcagtaattgttctttaaagctgactcgttcttcacctacttgcaaagtgctttcttgtctcataaaagttagattccaagaaggacttcccacggagtggagtggaaacactgtccttgaaggcctgggagaaaggcatccccatgggcacagaggctggggaaaggcacagggactttgggtgaccctaaccctgaccctctgctccagttcacctccatctatatgtgttcaggtaggggtcatctactgtaccctggcctgggaacacattgccctccccacacaaaactggagggcttggcttctgcgtgtgagaaatcaacatttttaaagcacttgccttctaccaaccccagcttgcaatcactgggccttcccctcctatccaaggggttggaggggccccttggctctccttttggcaggaggagcctgcttcattacaccaatgactctgccatccccctccctggccctagaccccaaacacatctccctctacccaatttactcttctcgccccacctagggacagattccccctgctctttttgtcctagaaaccccgctagtttgggatggtagcgtctggggtggggagggcttccccttccccactcgagggtgcgggtggggaagggggggtgggtggagacagccctggggcagggaggatggtctctccactgtagaaagtagagtaggattgtggtcagacttaatttgaggcatctagtgaagacacgtacaaatccaccaaggaaaaagatttcaaaagcaaaataaaagcgggaaataaaacagacccaagaataatcaagtcaaagtgatgttgcacaaaatgcagagaaaccaagaagggggagggttaatgtattaaatgtgctattaagaacttaattttattaaaagtactattacttaa

SEQ ID NO: 153631 - DNA, 3528 bp, Homo sapiens
  Payload ID: 10214
  Gene Symbol: MEX3B
  Gene Name: mex-3 RNA binding family member B
  Uniprot ID: Q6ZN04
  ENST ID: ENST00000329713
  CDS Start-End: 437-2146
tcaagaggcggggaggagaggaggaaaaagcgctgagtgagggcgggcgggcgggcgggagggagggagtggaggagccggggaggggctccttaaagaaacgcttctgtcgctcgcctgctcgcttttcgctcggcattgcggccagccagccgggcactcggggggcacgcgcggccaccgctagagctctgcccccaccccacccgccagcaggtctggggtggggacccaggtgggggctcctgcagccactgcccggtgcggaccgcacggagcgacccactcctcccagcaccgaggaagaagcaacggagccctcagcaggcgaccggcctccccgcccctgaccacccgcttcccggctgcctttgtggccgcagcttctcgccgccgagccgagggccggcgggggcgcggcgcgcacggccgagcgatgcccagctcgctgttcgcagacctggagcgcaacggcagcggcggcggcggcggcggcagcagcggagggggagagaccctggatgaccaaagagccctgcagctcgcgctcgaccagctctccctgctggggctggacagtgacgagggcgcctctctgtacgacagcgagccgcgcaagaagagcgtgaacatgaccgagtgcgtgccagtacccagttctgagcatgtcgccgagatcgtggggcggcaaggttgtaaaatcaaagcgctgcgggcgaagaccaatacttacatcaagaccccagttcgcggggaggagcctgtctttgttgtgacgggcaggaaggaggatgtggccatggctcggagggagatcatctctgctgccgagcacttctccatgatccgcgcctcccggaataagaacacggcactcaacggcgcggtgcctgggccgcccaacctgcccgggcagaccaccatccaagtgcgggtaccctaccgcgtggtggggctcgtggtggggcccaaaggcgccacaatcaagcgcatccagcagcagacgcacacgtacatcgtgacgcccagccgggataaggagccggtgttcgaggtgaccggcatgccagagaacgtggatcgcgctcgagaggagattgaggcgcacattgctctgcgtaccggcggcatcattgagctcacagacgagaacgacttccacgccaacggcaccgatgtgggcttcgatctgcatcatgggtccggcgggtccggcccaggcagcctctggagcaagcccacccccagcatcacgcccacccccggccgcaagcctttctctagctaccgcaacgacagctccagctcgcttggcagtgcttccacagactcttatttcggcggcgggaccagcagcagcgcagcggctacccagcgcctggcggactacagcccccctagccccgccctgagctttgcgcacaacggaaacaataacaataacggcaatgggtacacctacacagcggggggagaagcctcagtgccatcccccgacggctgccccgagctgcagcccacttttgacccggctcccgctcccccacctggggcaccacttatctgggcccagttcgagcggtccccgggaggcggacctgcagctccggtatcttcttcctgctcttcttctgcatcttcgtctgcttcttcctcctccgtggtcttccccgggggtggcgccagtgcgccctccaacgccaacctggggctattggtgcaccgccggctgcaccctggcaccagctgcccgcgcctgtctccacccttgcacatggccccgggggcgggagagcaccacctggctcgccgggtgcgcagcgacccgggtggaggaggcctggcctacgccgcttatgccaacgggctgggggcacagctgcctggcttgcagccgtcggacacgtcgggctcctcctcttcgtccagctcctcctccagctcttcatcctcttcctccgggcttcggcgtaaaggcagccgcgactgctccgtgtgcttcgagagcgaagtgattgccgcgctggtgccctgtggccacaacctcttctgcatggagtgcgccaatcgcatctgtgagaagagcgagcccgagtgcccggtctgccacaccgcggtcactcaggccatccgcatcttttcttaaaggcagcgggcgctgctagtgcgcaccgtgctgggggaagggggaacccctccccaccctctttccccagcgctcgcctgcctccctgggtgccccccctctcccttctccttcccggccccaccaacactctgagatccgagaggagcttggaaagctgtagtatccgctcatttttaaaatttaatttttaagtaaaggaatttgccaggatatctgcatcaagagtactgtagcctgggaaacctgaacacctgaaatgcatgctctataaataataggaacggcgacattctagtaatgatagtttttacactgtacttaataggaagcttccaaaagaagaaaaccccacaagttttccattttcttaaagtaggaaaaaatgaacagtaataattatgatgaagatgatagtagtgctatgggatgtgtggactgtttagtgtgttcccctttgtgggtgggttcctatgatacttattatagaacacagtggatcctttttgaatgttcgtggaagggccaggagttcctgtgaaaccaggatactgcagctttattaaagttaaagaaactgtaacatatctcttatatattaaaaacgtttaaaagttttaaagagaaattgcattaatacagattgaagtattttattcttttttgacttgaaaaattatatttcatattgcaaagatgtttacaagtattttaatttaagttcagtgaacttttttgtagctgggttaaatctttttattttagtatggccttatggcaaagaacactgtattattttaataatcacacaattgtgacggaattacaaccataaaatgtgtaatgttttgaacagtattctgttgggatggagattttataggttcagacaaatcttctagatctgcttcacccagcatattttctattcagtgatataaagcatattttattctatattattacaaaaacggaaatgtataaacatgtcaaaaagaactgttgatgctttctaacatttgtataaatagaattcagtgcaagttacaaaaattctgttgcaccactctagttttagtatttctattttaatacatttgtttaccacttgtttatgtatatgtaggtgatgttacttgagcttaaatgtactttactgagcaaagtttaaaaaacaaagtatattttattttatgataaagggcctttaacctcatggtcaaatactaatattatatttgctgagacaagatttgaaattgtatcaagagttttatttttctgacatttaaagttctacataataaaggtaaaacttaagtaatggtgctacttcattttttaagtatttctatataaataaaatattgaagaaaatctta

SEQ ID NO: 153632 - DNA, 4333 bp, Homo sapiens
  Payload ID: 10214
  Gene Symbol: MEX3B
  Gene Name: mex-3 RNA binding family member B
  Uniprot ID: Q6ZN04
  ENST ID: ENST00000558133
  CDS Start-End: 415-891
ggaaaaagcgctgagtgagggcgggcgggcgggcgggagggagggagtggaggagccggggaggggctccttaaagaaacgcttctgtcgctcgcctgctcgcttttcgctcggcattgcggccagccagccgggcactcggggggcacgcgcggccaccgctagagctctgcccccaccccacccgccagcaggtctggggtggggacccaggtgggggctcctgcagccactgcccggtgcggaccgcacggagcgacccactcctcccagcaccgaggaagaagcaacggagccctcagcaggcgaccggcctccccgcccctgaccacccgcttcccggctgcctttgtggccgcagcttctcgccgccgagccgagggccggcgggggcgcggcgcgcacggccgagcgatgcccagctcgctgttcgcagacctggagcgcaacggcagcggcggcggcggcggcggcagcagcggagggggagagaccctggatgaccaaagagccctgcagctcgcgctcgaccagctctccctgctggggctggacagtgacgagggcgcctctctgtacgacagcgagccgcgcaagaagagcgtgaacatgaccgagtgcgtgccagtacccagttctgagcatgtcgccgagatcgtggggcggcaaggtaggtcgaggagggatggggaggtgggtgggggtggtgtagggtctcaggccactgcctcgaggggaaggcgtgttcagtatcgggatccgcggcgtggggtgccttggggagagaggaagagccgcgcgatgggccggcgccccagacaaagaaagtgcaggcaggctgtctcccggagccgcgccgctgccctggcgggatgcactttcttctgctaaaatcactgccttctcccctaacgccccccaaccagcccacctccagaaagacaatttaaatgtaagatgcttgggggagggggcctttgatcagtcctttgggaggaggaaggaggaggagtgagcataggatgggaggaggattctggatttctgcaaagcggaatggagcccagaggaggaacaatgggtcccgggactcacaccccaccccctacccccagtcgaccagcgctgaggcatcgcgacttcagctgccttccccgagccccttccccgtgtcttcagagctgacggcgcgcccagctggatcccagcggcatctccccagatgacttttctgggattctcgggtttggttcgggacgactgcagtcactgggggagggccaggcagccaatgggctgttcctcgagcgcctcgcgggtgggatccgctgcccagcccgtggcgcggcccgaggtcagtgagggagacgccccctttccgcccatctcttgtcctgccgtctcgctgtcctggacgcgggctgtccccggtccccgcggttaccccaggataatgggcgtgtctgtctctctctcccactccctcctccgcaccctggttcgtaggttgtaaaatcaaagcgctgcgggcgaagaccaatacttacatcaagaccccagttcgcggggaggagcctgtctttgttgtgacgggcaggaaggaggatgtggccatggctcggagggagatcatctctgctgccgagcacttctccatgatccgcgcctcccggaataagaacacggcactcaacggcgcggtgcctgggccgcccaacctgcccgggcagaccaccatccaagtgcgggtaccctaccgcgtggtggggctcgtggtggggcccaaaggcgccacaatcaagcgcatccagcagcagacgcacacgtacatcgtgacgcccagccgggataaggagccggtgttcgaggtgaccggcatgccagagaacgtggatcgcgctcgagaggagattgaggcgcacattgctctgcgtaccggcggcatcattgagctcacagacgagaacgacttccacgccaacggcaccgatgtgggcttcgatctgcatcatgggtccggcgggtccggcccaggcagcctctggagcaagcccacccccagcatcacgcccacccccggccgcaagcctttctctagctaccgcaacgacagctccagctcgcttggcagtgcttccacagactcttatttcggcggcgggaccagcagcagcgcagcggctacccagcgcctggcggactacagcccccctagccccgccctgagctttgcgcacaacggaaacaataacaataacggcaatgggtacacctacacagcggggggagaagcctcagtgccatcccccgacggctgccccgagctgcagcccacttttgacccggctcccgctcccccacctggggcaccacttatctgggcccagttcgagcggtccccgggaggcggacctgcagctccggtatcttcttcctgctcttcttctgcatcttcgtctgcttcttcctcctccgtggtcttccccgggggtggcgccagtgcgccctccaacgccaacctggggctattggtgcaccgccggctgcaccctggcaccagctgcccgcgcctgtctccacccttgcacatggccccgggggcgggagagcaccacctggctcgccgggtgcgcagcgacccgggtggaggaggcctggcctacgccgcttatgccaacgggctgggggcacagctgcctggcttgcagccgtcggacacgtcgggctcctcctcttcgtccagctcctcctccagctcttcatcctcttcctccgggcttcggcgtaaaggcagccgcgactgctccgtgtgcttcgagagcgaagtgattgccgcgctggtgccctgtggccacaacctcttctgcatggagtgcgccaatcgcatctgtgagaagagcgagcccgagtgcccggtctgccacaccgcggtcactcaggccatccgcatcttttcttaaaggcagcgggcgctgctagtgcgcaccgtgctgggggaagggggaacccctccccaccctctttccccagcgctcgcctgcctccctgggtgccccccctctcccttctccttcccggccccaccaacactctgagatccgagaggagcttggaaagctgtagtatccgctcatttttaaaatttaatttttaagtaaaggaatttgccaggatatctgcatcaagagtactgtagcctgggaaacctgaacacctgaaatgcatgctctataaataataggaacggcgacattctagtaatgatagtttttacactgtacttaataggaagcttccaaaagaagaaaaccccacaagttttccattttcttaaagtaggaaaaaatgaacagtaataattatgatgaagatgatagtagtgctatgggatgtgtggactgtttagtgtgttcccctttgtgggtgggttcctatgatacttattatagaacacagtggatcctttttgaatgttcgtggaagggccaggagttcctgtgaaaccaggatactgcagctttattaaagttaaagaaactgtaacatatctcttatatattaaaaacgtttaaaagttttaaagagaaattgcattaatacagattgaagtattttattcttttttgacttgaaaaattatatttcatattgcaaagatgtttacaagtattttaatttaagttcagtgaacttttttgtagctgggttaaatctttttattttagtatggccttatggcaaagaacactgtattattttaataatcacacaattgtgacggaattacaaccataaaatgtgtaatgttttgaacagtattctgttgggatggagattttataggttcagacaaatcttctagatctgcttcacccagcatattttctattcagtgatataaagcatattttattctatattattacaaaaacggaaatgtataaacatgtcaaaaagaactgttgatgctttctaacatttgtataaatagaattcagtgcaagttacaaaaattctgttgcaccactctagttttagtatttctattttaatacatttgtttaccacttgtttatgtatatgtaggtgatgttacttgagcttaaatgtactttactgagcaaagtttaaaaaacaaagtatattttattttatgataaagggcctttaacctcatggtcaaatactaatattatatttgctgagacaagatttgaaattgtatcaagagttttatttttctgacatttaaagttctacataataaaggtaaaacttaagtaatggtgctacttcattttttaagtatttctatataaataaaatattgaag

SEQ ID NO: 153633 - DNA, 3781 bp, Homo sapiens
  Payload ID: 10215
  Gene Symbol: MEX3C
  Gene Name: mex-3 RNA binding family member C
  Uniprot ID: Q5U5Q3
  ENST ID: ENST00000406189
  CDS Start-End: 1-1980
atgcccagcggcagctccgcggccctggccctggcggcggccccggcccccctgccgcagccgcccccgccgccgccgccgccaccgccgcctctgccgccgccctcgggcggcccggagctcgagggggacgggctcctgctgagggagcgcttggccgcgctaggcctcgacgaccccagcccggcggagcccggcgccccggcgcttcgggccccggcagcggcggcgcagggccaggcccggcgggcggcggagctgtctccagaggagcgggctccgcccggccggcccggggccccggaggcggccgagctggagctggaagaggacgaggaggagggggaggaagcggagctggacggagacctgctggaggaggaggagctggaggaagcagaggaggaggaccggtcgtcgctgctgctgctgtcgccgcccgcggccaccgcctctcagacccagcagatcccgggcgggtccctggggtctgtgctgctgccagccgccaggttcgatgcccgggaggcggcggccgcggcggcggcggcgggggtgctgtacggaggggacgatgcccagggcatgatggcggcgatgctgtcccacgcctacggccccggcggttgtggggcggcggcggccgccctgaacggggagcaggcggccctgctccggagaaagagcgtcaacaccaccgagtgcgtcccggtgcccagctccgagcacgtcgccgagatcgtcggccgccagggttgtaaaattaaagcactgagagccaagacaaacacgtatatcaagactcctgttcgtggtgaagagcccatttttgttgtcactggaaggaaagaagatgttgccatggccaaaagagagatcctctcagctgcagagcacttctccatgattcgtgcatctcgaaacaaaaatgggcctgccctgggaggattatcatgtagtcctaatctgcccggtcaaaccaccgtccaagtcagggtcccttatcgtgtggtaggattagtggttggacccaaaggagcaactattaaaagaattcagcagcagacccacacctacatagtaactccgagcagagataaggaacctgtctttgaagtgacagggatgcctgaaaatgttgaccgagcacgggaagaaatagaaatgcatattgccatgcgtacaggaaactatatagagctcaatgaagagaatgatttccattacaatggtaccgatgtaagctttgaaggtggcactcttggctctgcgtggctctcctccaatcctgttcctcctagccgcgcaagaatgatatccaattatcgaaatgatagttccagttctctaggaagtggctctacagattcctactttggaagcaataggctggctgactttagtccaacaagcccatttagcacaggaaacttctggtttggagatacactaccatctgtaggctcagaagacctagcagttgactctcctgcctttgactctttaccaacatctgctcaaactatctggactccatttgaaccagttaacccactctctggctttgggagtgatccttctggtaacatgaagactcagcgcagaggaagtcagccatctactcctcgtctgtctcctacatttcctgagagcatagaacatccacttgctcggagggttaggagcgacccacctagtacaggcaaccatgttggccttccaatatatatccctgctttttctaatggtaccaatagttactcctcttccaatggtggttccacctctagctcacctccagaatcaagacgaaagcacgactgtgtgatttgctttgagaatgaggttattgctgccctagttccatgtggccacaacctcttctgcatggaatgtgccaacaagatctgtgaaaagagaacgccatcatgtccagtttgccagacagctgttactcaggcaatccaaattcactcttaactatatatatatacataaatactatatctctatatggactcgtaaaggcatgggtataatggtaccccccagtaaacttcctaatgatttcttatgactgttatcaggctttattgggattaggctaaagttgttagtaaacttataaaaggctgctatggtaacactaaacctaagtggtctcttgtctattagtttggtttgaattattagtactatcctgtagacccagagacatagtttatataagaattgctaaagctgaagttcaacttggctgagtgaagataatcataggttgtgtgagcctatgaaaaagtgtatacgtctaagatttcaaaacaatgggtcccaaagcctaaccactttaagagtttatggagggtacttggcattacagacgattcatacacttccagtgctgccttctttacactgccagttttgacaaaacaggtttgttttttattttacaacaacatatgcctaattctgcaggattgcaagtaactttttaatgcattgtgattacttattggtaatgatagggctgatggcagtttactagatcactggttataatttgggacaaaaactgctacatcaactttcatctcgcccagagtgctcaaggctggtatgatcagtggatcaggaatgcaattgtgaattcctgcccattgcctctcttggtgaatgtggaaatggccacctgggttttcccatatcaggaagggctttgggatggcacctatattggctgataattgaggatgcaaacattccattcattagtgtgatcgagctgttaatttttagactatagatcaaaatgtgaaacattttatgttcaatccatatttgtcttgcacattataaatatatttttattttttagtaatttaggggagggaggagggagaaagggataatgatgcccttggcataattcacaaaagcagctgtgacaacctccaatcagtttacttcatttcaaaactatttccaatcacaaggaaagatttatttaaaatatactcgtacatttcacctgtggatgtctataacttcatcctcagtatgttcccaaatctgtgctggcattgaaaggacaaaacattatactagtgggtttttctactaattattttttgaagcattattttcccaacacaaaagagcttttttctcggtataatgaaaattgaaatcctatgtgtattcaatagtaaatagacaaattttattttttatttccacttgaagagttacatttcgtataaaagtttacaaataacggtttttattttgattttttcagtataaaaaaagttgccttgatggcatattatgatgtaatgctaattgcttgtaggatagtaaatggtcagtattgaaacctaatctctagctgccgtcttgtagatatgaacgaatgttcaccaagcatgtattttgtattttgttgcattgtacactgcaactaataagccaaggaatcgacatatattaggtgcgtgtactgtttctaaaaaccacaaactaagaatgataaattatcaatatagtttagtatttgctaattttactacactcttttgttatgtatatgtagggaagtcatagggattataaattcaatttgagtaaaatttaaaaccatatattttatgataaagggcctttaacttaagatggccaaagcactgatattatatatttgctgtaaagagaattataagagttttatttttctgatattaaaagttacttaataaagacttgtttccattaacttgaa

SEQ ID NO: 153634 - DNA, 3850 bp, Homo sapiens
  Payload ID: 10215
  Gene Symbol: MEX3C
  Gene Name: mex-3 RNA binding family member C
  ENST ID: ENST00000592416
  CDS Start-End: 1-348
tacggaggggacgatgcccagggcatgatggcggcgatgctgtcccacgcctacggccccggcggttgtggggcggcggcggccgccctgaacggggagcaggcggccctgctccggagaaagagcgtcaacaccaccgagtgcgtcccggtgcccagctccgagcacgtcgccgagatcgtcggccgccagggtgagtgcaggggtggggaggtccagctgggcatggccccgggcgtgggtggggagacgagagaaaggagcgtgggacggaaaaggcgaacccggcgaggcccccaagtccaccgcgaaggggtctgggaggagccgagggtcgaccagatgtgaagatgggtcaccttgcgaaaacccacgcttttccgcccgtcttgcctggtaaaaagtgtgaagtttctcgggcgacccagtccggtggtgttcacgttacttgggctgtattcgtggaacaccaggctggcgtggcaccagaaacctcagtgaggtggtaaaaggtcgggctcgaggagttgtgggttcgctgttgggtacggaaagcttcgagattgcaagtttgcgccgccgagtgtcttctaaaagcgttcagcctcccttacaagaacttgttcagatggagaaaagaacagaaatggaggcctgtagacagagctcactggggagggaaggggtgttcaaatggtcggtatcaccgccatcccctgcccctccgctgttgagaaacttagctttggaaaagcagcccaactcactgccgcctatcttaactgtatttctctcggtacgtttcaactctcggaaagacacactgacacactggctgtcttttaaaactgttcagtgtgcaggatgaagaaaaaatggacactaaggtaattaagaaacttcatcggtttatacagttttcagttaattctcctcttcacttgccagcacaccagtactgcagacagactcctcccacattgttcagacaaaggacctgtgtctcagattccaggagtagatttgtgaaggtgggggaaggggatgcctggggtacctctgtatccgacatttttagggaaggtcctaagttctttatggtagcatttcccctttatgaaaggggcagatgttacctgctgccaccgcatgacaatgtggtttagcctggttgttgcatgcctctttactgttaggttgagagcattgttggggtcaaataaagagagatgatggcgctgccgcttaaatgatctcatctttcccaggtggtctaaagtacacataaataagagctctgtcgaaatggtggtttcacatatcagacttggcttatttctttcctatctgtaggattttaataaaaactcatctgaaatctggataaaggagatagcttagttcagactgcctgatgattggcacttacagacactgttcaaagctggacctttcaattgaaaggtagcttatgcttgtcgttcttctggttaatgagtttcagattcctggattgtttggttttggcgatacttagagtaataatccaggagaaaacttttgtttacatgggataaaattacaacatctcaatttggatcagaatgagttgaccattcatgtaagaacactgaggaatcgctatgtaccaagcttgtattttgccaggttttgagtttgtggtattgagaatgtgaagttaattcagactttctgcccttaagaagataacagtctaataaacagtagaatggcactaactatagtgtatttagtatgacaaagtctcaggtaagagaacatctatggagagggccttggaaaatgggtaggaaggagtctaacaaatggagattgaaaaactgtggaggaacaatgtgaggaggggtgtggaggactagcctaggtataattgccaagtagtgttgttttgatacttgaggtctgtaaaggggagtggtggaaaagggggaaggcaggcgttcacaccagaatgtgaagaagcctgaatgccatatgaagatgccacttctcaggacaagttgcttccgtgtgcttatggtaacagtctagggtaacaaaggaagaaaacatttacgtgccagttttactgaaggacaagataacatattttatagatttagtttaatacaaactttagtccttcattatagtagacaccccttaaagcactgctaaatggcccttacttgtgtatgttgttaatctttatagaaatcagttttttaaaagtaaagtgaattccaagtttttattttgtaccagctattacgtgataggaaatgagataaagccttagtttttcttttgagggctgtgtttatttggttaataaggaaatgttgaatttaattatgtcttagatcatggagacaaattgctggctcttccatttaaaccttgtattttcccagagttgacaatactgttaaaagtatgtcatcatcctctatcttaaaagcagaaaatctggtccttttgctgttctgaaccatacaacttgtggatcattgacccctttgccacccccatgtcccagcagcatagtaataaacctgtaaagtgtttgctcactcgtatggagaacgaagtgacttctaatgttcacattcttttacagtattatatttccccacgggagagaatctgtcctaagtaagtaaaacagggcaaatcatttcattttcttgtttgctttgaaggagctaaactttcatccttaagattaaattatccatttctgccattttatgtattacctgaagccataattttctatttgacatctcttaattgattttggaaataattatgtcacagatggagacatttatgacttcagctctgaagcaaagagcaggacaaatggaattctgagtcacatagactagcaactcatgtagatggcctctgagttccagtgtttttctaaaacacaaactaccgcttttgatactgatgaaagttggcagagtgtttgacctcgaatttatactccccagtagcatatggtcatttgtaaatgttaaattggccttgttttttaaagcattgcatctgttgtgaaacaacaatactgtaaaataaagccaggaactgaagaggcttgttgatataatcaaagaagttttagaatatggacatcaaaaataaacctgacaacagattttaagacctaattttataaacttagaacgtctctgtttttaagtatagtacctgcaagacatattaacagtgattaacaggtctaattttagtcagcaggttttgttccaatttgtacagtcatttatatccatttagactaaaaagtgaattaaaatagaactgtatacccattcttaatacattataaattaatactaaatgtcataaattcagttgtttagagacttgtaacccaagattttgtattactattaggataaatgtgtatctttcattagactttaattaatggtctatgtgtgttctctagccacatagtctagaaaagtcgtctctagcttctttttattgtacaccctgtccaaaaaaaatgtgcatactcccaatatctggatatttatgtatgaatagtaagtgtgcttaatatattacacattataaaacaaaattctttattaacaattaatactttacactgtttcaatttgtcttcccaatttcttagggtggaaccacccttcaagctctaacacaactgaaatagggtttatacgtctgtgaccaggagaaaaagagaaagcttggtcttgctgtacataaattttctcttcaaggagaagtacatatttcatgagaataaatagtttcagaatgatgc

SEQ ID NO: 153635 - DNA, 3269 bp, Homo sapiens
  Payload ID: 10215
  Gene Symbol: MEX3C
  Gene Name: mex-3 RNA binding family member C
  ENST ID: ENST00000616921
  CDS Start-End: 1-1470
atgcccagcggcagctccgcggccctggccctggcggcggcgggggtgctgtacggaggggacgatgcccagggcatgatggcggcgatgctgtcccacgcctacggccccggcggttgtggggcggcggcggccgccctgaacggggagcaggcggccctgctccggagaaagagcgtcaacaccaccgagtgcgtcccggtgcccagctccgagcacgtcgccgagatcgtcggccgccagggttgtaaaattaaagcactgagagccaagacaaacacgtatatcaagactcctgttcgtggtgaagagcccatttttgttgtcactggaaggaaagaagatgttgccatggccaaaagagagatcctctcagctgcagagcacttctccatgattcgtgcatctcgaaacaaaaatgggcctgccctgggaggattatcatgtagtcctaatctgcccggtcaaaccaccgtccaagtcagggtcccttatcgtgtggtaggattagtggttggacccaaaggagcaactattaaaagaattcagcagcagacccacacctacatagtaactccgagcagagataaggaacctgtctttgaagtgacagggatgcctgaaaatgttgaccgagcacgggaagaaatagaaatgcatattgccatgcgtacaggaaactatatagagctcaatgaagagaatgatttccattacaatggtaccgatgtaagctttgaaggtggcactcttggctctgcgtggctctcctccaatcctgttcctcctagccgcgcaagaatgatatccaattatcgaaatgatagttccagttctctaggaagtggctctacagattcctactttggaagcaataggctggctgactttagtccaacaagcccatttagcacaggaaacttctggtttggagatacactaccatctgtaggctcagaagacctagcagttgactctcctgcctttgactctttaccaacatctgctcaaactatctggactccatttgaaccagttaacccactctctggctttgggagtgatccttctggtaacatgaagactcagcgcagaggaagtcagccatctactcctcgtctgtctcctacatttcctgagagcatagaacatccacttgctcggagggttaggagcgacccacctagtacaggcaaccatgttggccttccaatatatatccctgctttttctaatggtaccaatagttactcctcttccaatggtggttccacctctagctcacctccagaatcaagacgaaagcacgactgtgtgatttgctttgagaatgaggttattgctgccctagttccatgtggccacaacctcttctgcatggaatgtgccaacaagatctgtgaaaagagaacgccatcatgtccagtttgccagacagctgttactcaggcaatccaaattcactcttaactatatatatatacataaatactatatctctatatggactcgtaaaggcatgggtataatggtaccccccagtaaacttcctaatgatttcttatgactgttatcaggctttattgggattaggctaaagttgttagtaaacttataaaaggctgctatggtaacactaaacctaagtggtctcttgtctattagtttggtttgaattattagtactatcctgtagacccagagacatagtttatataagaattgctaaagctgaagttcaacttggctgagtgaagataatcataggttgtgtgagcctatgaaaaagtgtatacgtctaagatttcaaaacaatgggtcccaaagcctaaccactttaagagtttatggagggtacttggcattacagacgattcatacacttccagtgctgccttctttacactgccagttttgacaaaacaggtttgttttttattttacaacaacatatgcctaattctgcaggattgcaagtaactttttaatgcattgtgattacttattggtaatgatagggctgatggcagtttactagatcactggttataatttgggacaaaaactgctacatcaactttcatctcgcccagagtgctcaaggctggtatgatcagtggatcaggaatgcaattgtgaattcctgcccattgcctctcttggtgaatgtggaaatggccacctgggttttcccatatcaggaagggctttgggatggcacctatattggctgataattgaggatgcaaacattccattcattagtgtgatcgagctgttaatttttagactatagatcaaaatgtgaaacattttatgttcaatccatatttgtcttgcacattataaatatatttttattttttagtaatttaggggagggaggagggagaaagggataatgatgcccttggcataattcacaaaagcagctgtgacaacctccaatcagtttacttcatttcaaaactatttccaatcacaaggaaagatttatttaaaatatactcgtacatttcacctgtggatgtctataacttcatcctcagtatgttcccaaatctgtgctggcattgaaaggacaaaacattatactagtgggtttttctactaattattttttgaagcattattttcccaacacaaaagagcttttttctcggtataatgaaaattgaaatcctatgtgtattcaatagtaaatagacaaattttattttttatttccacttgaagagttacatttcgtataaaagtttacaaataacggtttttattttgattttttcagtataaaaaaagttgccttgatggcatattatgatgtaatgctaattgcttgtaggatagtaaatggtcagtattgaaacctaatctctagctgccgtcttgtagatatgaacgaatgttcaccaagcatgtattttgtattttgttgcattgtacactgcaactaataagccaaggaatcgacatatattaggtgcgtgtactgtttctaaaaaccacaaactaagaatgataaattatcaatatagtttagtatttgctaattttactacactcttttgttatgtatatgtagggaagtcatagggattataaattcaatttgagtaaaatttaaaaccatatattttatgataaagggcctttaacttaagatggccaaagcactgatattatatatttgctgtaaagagaattataagagttttatttttctgatattaaaagttacttaataaagacttgtttccattaacttg

SEQ ID NO: 153636 - DNA, 2850 bp, Homo sapiens
  Payload ID: 10216
  Gene Symbol: MEX3D
  Gene Name: mex-3 RNA binding family member D
  Uniprot ID: Q86XN8
  ENST ID: ENST00000402693
  CDS Start-End: 1-1956
atgcccagctcgctcggccagcccgacggcggcgggggcgggggcggcggcggcggcggcgtgggggcggcgggggaggaccccggacccggacctgcgcccccgcccgagggcgcccaggaggccgcgcccgcgccccggccgccgcccgaacccgacgacgcggccgccgcgctccgcctggcgctggaccagctgtcggcgctcgggctggggggcgctggcgacacggacgaggagggggcggccggggacggcgcagcggcggcggggggcgcggacggcggggcggctccggagcctgtgccccccgacggacctgaggccggcgcgcccccgaccctggcccccgccgtggcccccgggtcgctgccgctgctggaccccaacgcgagtcccccgccgccgccgccgccccggccgtcgccccccgacgtgttcgcgggcttcgcgccccaccccgcggccctggggcccccgacgctgctggccgaccagatgagcgtgatcggcagccgcaagaaaagcgtcaacatgaccgagtgcgtcccggtgcccagctccgagcacgtcgccgagatcgtgggtcgccagggctgcaagatcaaggccctgcgggccaagacaaacacctacatcaagaccccagtgcggggcgaggagccggtcttcatcgtgaccggccggaaggaggacgtggagatggccaagcgtgagatcctgtcggcggccgaacacttctccatcatccgcgccacgcgcagcaaggccgggggtctgcccggcgccgcccagggcccgcccaaccttcccggacagaccaccatccaggtgcgcgtgccctaccgggtggtggggctggtggtggggcccaagggcgccaccatcaagcgcatccagcagcggacgcacacctacatcgtgacgcccgggcgcgacaaggagccggtgttcgcggtcactgggatgcccgagaacgtggaccgcgcgcgcgaggagatcgaggcgcacatcacgctgcgcactggcgccttcaccgacgcgggccccgacagcgacttccacgccaacggcaccgacgtctgcctggacctgctcggggcggccgccagcctctgggccaagacccccaaccagggacgacggccccccacggccacggccggcctccgcggggacacggccctgggcgcccccagcgcccccgaggccttctacgcgggcagccgcggcggcccctccgtgccggacccaggccccgccagcccctacagcggctccggcaacgggggcttcgccttcggcgcggagggtcccggtgccccggtggggacggccgcccccgacgactgcgacttcggcttcgacttcgacttcctggcgctggacctgaccgtgcccgccgcggccaccatctgggcgccttttgagcgcgccgcccccttgcccgccttcagcggctgctccacggtcaacggagccccgggacctcccgccgccggcgcccggcgcagcagtggggccgggaccccccgccactcgcccacgctgcccgagcccggcggcctccgcctggagctcccgctgtctcgccgtggcgccccggacccggtgggcgcgctgtcctggcgacccccgcagggccccgtatccttcccaggcggcgccgccttctccacggccacctcgctgcccagcagccccgcggccgccgcctgcgcccccctggactccggcgcctccgagaacagccgcaagcccccttcggcgtcctcggccccggccctggcgcgagagtgcgtggtgtgcgccgagggcgaggtgatggctgcgctggtcccctgcggccacaacctcttctgcatggactgcgccgtccgcatctgcggcaagagcgagcccgagtgtcccgcctgccgcacgccggccacccaggccattcatatcttttcctagagcgcggaccaccacgtggccggggccatctgcgggggccaggggtgggcgcgggagacggggcgggacccggggtgggagagggacggggagggggcgaggggcggaggccgagggggcaggggggtgggcggcggccagtgtttacagatgagctttaactgccgcctcaggcgtggagacggagaccccgcagcccggcggcgcctcagcccttcaacgacagtattgagtggtcaggttacaataaaccggagagaaaaggtccgcttgcactttttttagttttcttatttttagacacccctcccctccagggtgatctttaaaaaagcaaaacaaaaaacacgacttttccagcgctcagcgttttttcctttcgtccgaagccgttttctgatttgacttttctcgccggccggtctcaggccgcacagacgttccagaggaggagggtgacatttttactccctttttggggctaaccatttatgcttttgtacatcaaccgtgcgcggccggagggggcaggggggcgggggcgaggggcgttccaatcaaatttctaactttctgttaattattaatcccctttttactgcggtttctgttgtcatttttaaaatttttttaatttttttttttttttacttttactttttacctcttgtgtatatgtagggaatttatagggaaatatgtactttatggaataaattttaagaactaaaatatattttattttaaataaagtaatggacctttaatcttacacagctaaattactgattatatatttgctgagctgatttaagggttaaaaaaattgtatcaagagttttattttttgacttcaaagccttcttaataaagcctcttttctacatgtgagca

SEQ ID NO: 153637 - DNA, 2132 bp, Homo sapiens
  Payload ID: 10216
  Gene Symbol: MEX3D
  Gene Name: mex-3 RNA binding family member D
  ENST ID: ENST00000605173
  CDS Start-End: 1-1473
gtcaacatgaccgagtgcgtcccggtgcccagctccgagcacgtcgccgagatcgtgggtcgccagggctgcaagatcaaggccctgcgggccaagacaaacacctacatcaagaccccagtgcggggcgaggagccggtcttcatcgtgaccggccggaaggaggacgtggagatggccaagcgtgagatcctgtcggcggccgaacacttctccatcatccgcgccacgcgcagcaaggccgggggtctgcccggcgccgcccagggcccgcccaaccttcccggacagaccaccatccaggtgcgcgtgccctaccgggtggtggggctggtggtggggcccaagggcgccaccatcaagcgcatccagcagcggacgcacacctacatcgtgacgcccgggcgcgacaaggagccggtgttcgcggtcactgggatgcccgagaacgtggaccgcgcgcgcgaggagatcgaggcgcacatcacgctgcgcactggcgccttcaccgacgcgggccccgacagcgacttccacgccaacggcaccgacgtctgcctggacctgctcggggcggccgccagcctctgggccaagacccccaaccagggacgacggccccccacggccacggccggcctccgcggggacacggccctgggcgcccccagcgcccccgaggccttctacgcgggcagccgcggcggcccctccgtgccggacccaggccccgccagcccctacagcggctccggcaacgggggcttcgccttcggcgcggagggtcccggtgccccggtggggacggccgcccccgacgactgcgacttcggcttcgacttcgacttcctggcgctggacctgaccgtgcccgccgcggccaccatctgggcgccttttgagcgcgccgcccccttgcccgccttcagcggctgctccacggtcaacggagccccgggacctcccgccgccggcgcccggcgcagcagtggggccgggaccccccgccactcgcccacgctgcccgagcccggcggcctccgcctggagctcccgctgtctcgccgtggcgccccggacccggtgggcgcgctgtcctggcgacccccgcagggccccgtatccttcccaggcggcgccgccttctccacggccacctcgctgcccagcagccccgcggccgccgcctgcgcccccctggactccggcgcctccgagaacagccgcaagcccccttcggcgtcctcggccccggccctggcgcgagagtgcgtggtgtgcgccgagggcgaggtgatggctgcgctggtcccctgcggccacaacctcttctgcatggactgcgccgtccgcatctgcggcaagagcgagcccgagtgtcccgcctgccgcacgccggccacccaggccattcgcgtggagacggagaccccgcagcccggcggcgcctcagcccttcaacgacagtattgagtggtcaggttacaataaaccggagagaaaaggtccgcttgcactttttttagttttcttatttttagacacccctcccctccagggtgatctttaaaaaagcaaaacaaaaaacacgacttttccagcgctcagcgttttttcctttcgtccgaagccgttttctgatttgacttttctcgccggccggtctcaggccgcacagacgttccagaggaggagggtgacatttttactccctttttggggctaaccatttatgcttttgtacatcaaccgtgcgcggccggagggggcaggggggcgggggcgaggggcgttccaatcaaatttctaactttctgttaattattaatcccctttttactgcggtttctgttgtcatttttaaaatttttttaatttttttttttttttacttttactttttacctcttgtgtatatgtagggaatttatagggaaatatgtactttatggaataaattttaagaactaaaatatattttattttaaataaagtaatggacctttaatcttacacagctaaattactgattatatatttgctgagctgatttaagggttaaaaaaattgtatcaagagttttattttttgacttcaaagccttcttaataaagcctcttttctacatgtga

SEQ ID NO: 153638 - DNA, 2088 bp, Homo sapiens
  Payload ID: 10217
  Gene Symbol: MFNG
  Gene Name: MFNG O-fucosylpeptide 3-beta-N-acetylglucosaminyltransferase
  Uniprot ID: O00587
  ENST ID: ENST00000356998
  CDS Start-End: 225-1190
gcaggccggacagcgggagcaggtggaggactggcggcggtcgagatcgtgctgccatggctcagcctctgggtccagagcctcagctcctacctcttccctccttgccagcccctgatgcctgccagacttttgcctctgctggagcccctgcctgaccagcttcccctccctgtctggttgggatttgggggctgagctgtctggggtcccagggccaaccaatgcagtgccggctcccgcggggcctggctggagccctcctcaccctcctgtgcatggggctcctgtgtctgcggtaccacttgaacctgtccccgcagcgggtacaagggacccccgagctgagccagccgaacccggggccccctaagctacagctacacgatgtcttcattgcagtgaagacgacccgggctttccaccgcttgcgcctggagctgctgcttgacacgtgggtttccaggaccagggaacagacatttgtcttcaccgacagcccagacaaaggcctccaggagagactggggtcccaccttgtggtcaccaactgctccgcggaacacagccacccagctctgtcctgcaagatggctgctgagttcgacaccttcttggccagtgggcttaggtggttctgccatgtggacgatgacaactatgtgaacccaagggcgctgctgcagcttctgagagccttcccgctggcccgcgacgtctatgtgggaaggcccagcctgaaccggcccatccatgcctcagagccacagccccacaaccgcacgaggctggtacagttctggtttgccactgggggtgctggcttctgcatcaatcgcaaactggctttgaagatggctccgtgggccagtggctcccgtttcatggacacatctgctctcatccggctgcctgatgactgcaccatgggctatatcattgagtgcaagctgggcggccgcctgcagcccagccccctctttcactcccacctggagaccctgcagctgctgaggactgcacagctcccagaacaggtcaccctcagctacggtgtctttgaggggaaactcaacgtcattaagctacagggccccttctccccggaggaggacccctccagatttcgctccctccattgtctgctctatccagatacaccctggtgtccccagctgggtgcccgatgaatcctgaactgctgggcaaaggttgggcagagacttctgggtgtgccttggctcccaaggtggcactgtgggtccctggcaagtgtcttgtgataggcagtccctggcagggccttcgggtggttggcaagcccaggatctgagtggcaattggcactgaaggcaccccaggcccctgggaggtgagttagacagcccaggggaccaggtggaccaggtggtggccagagaggctccaggggctagactccctcaggaggctgaattgaaaaagggcagggggcacttgagctgggctggggctcaggggtcctaaccctttaggcagtgacatggcctctgggtggggtctggccgttggccctggctaatgtctctcagtcattcccctggggctcaagcgctgggccgcccactcctgcctccctcatctgtgtcccgagttcctgaagggacatgggtggaatgatggcagaatccagggtctgcagcacctgctgttgttgccaaccagtctcccaaagctccttgctccccaccccttgcgaacaggaccagattttgtttggagcctcagcatgccggggcccagatgatggagcataacgggtcccagccaattgtgatgatcctttttgctcatttcccagcctttcttgctgttaggggctaccatgggaccagctctggccagagggaactaagcaaatccaatagagatgtttctggggaaggttttgcagcccactccccatcttcctgctataaatgtgggtgtgatggctggatctggggcagccaccttgctaccatgaaggaaaggccaagacaatcatccacagctattccctccagcatctggttctgtacaaaaattaaatgcttatttgtttaagtc

SEQ ID NO: 153639 - DNA, 524 bp, Homo sapiens
  Payload ID: 10217
  Gene Symbol: MFNG
  Gene Name: MFNG O-fucosylpeptide 3-beta-N-acetylglucosaminyltransferase
  ENST ID: ENST00000442496
  CDS Start-End: 397-524
tttcctgtcttatctccatcaccgcggtggtgcccttgccccggatgaggaaactgaggccagagagaggaagtgctggctggcgtggtgtcacgcagaaggcctgaggggacagagcccagtgggacctagaaccttgctcctggttgggtgcttttctcccctgctgagacttgggaacccttttccccatctgcacggggcaggagtgtctggaccgggcctgagctggttaactgcagcgctgggcgcccgcctggctggttaagggcggtcgggtggcagacatttgtcttcaccgacagcccagacaaaggcctccaggagagactggggtcccaccttgtggtcaccaactgctccgcggaacacagccacccagctctgtcctgcaagatggctgctgagttcgacaccttcttggccagtgggcttaggtggttctgccatgtggacgatgacaactatgtgaacccaagggcgctgctgcagcttctgagagccttcccgctggcccgcgacgt

SEQ ID NO: 153640 - DNA, 644 bp, Homo sapiens
  Payload ID: 10217
  Gene Symbol: MFNG
  Gene Name: MFNG O-fucosylpeptide 3-beta-N-acetylglucosaminyltransferase
  ENST ID: ENST00000436341
  CDS Start-End: 249-644
gaacagatgacaacgcctgcctcgtgaggtttgagggtcgttgcgggcaagtgcatgtccaatctgggagagccggactgggttgtgaggcagcatttccgagatggcttgcacagggggtttgtgtggctgtgaagacatttgtcttcaccgacagcccagacaaaggcctccaggagagactggggtcccaccttgtggtcaccaactgctccgcggaacacagccacccagctctgtcctgcaagatggctgctgagttcgacaccttcttggccagtgggcttaggtggttctgccatgtggacgatgacaactatgtgaacccaagggcgctgctgcagcttctgagagccttcccgctggcccgcgacgtctatgtgggaaggcccagcctgaaccggcccatccatgcctcagagccacagccccacaaccgcacgaggctggtacagttctggtttgccactgggggtgctggcttctgcatcaatcgcaaactggctttgaagatggctccgtgggccagtggctcccgtttcatggacacatctgctctcatccggctgcctgatgactgcaccatgggctatatcattgagtgcaagctgggcggccgcctgcagcccagccccctctttcac

SEQ ID NO: 153641 - DNA, 570 bp, Homo sapiens
  Payload ID: 10217
  Gene Symbol: MFNG
  Gene Name: MFNG O-fucosylpeptide 3-beta-N-acetylglucosaminyltransferase
  ENST ID: ENST00000454291
  CDS Start-End: 1-263
actcccacctggagaccctgcagctgctgaggactgcacagctcccagaacagatttcgctccctccattgtctgctctatccagatacaccctggtgtccccagctgggtgcccgatgaatcctgaactgctgggcaaaggttgggcagagacttctgggtgtgccttggctcccaaggtggcactgtgggtccctggcaagtgtcttgtgataggcagtccctggcagggccttcgggtggttggcaagcccaggatctgagtggcaattggcactgaaggcaccccaggcccctgggaggtgagttagacagcccaggggaccaggtggaccaggtggtggccagagaggctccaggggctagactccctcaggaggctgaattgaaaaagggcagggggcacttgagctgggctggggctcaggggtcctaaccctttaggcagtgacatggcctctgggtggggtctggccgttggccctggctaatgtctctcagtcattcccctggggctcaagcgctgggccgcccactcctgcctccctcatctgtgtcccgagttcctga

SEQ ID NO: 153642 - DNA, 570 bp, Homo sapiens
  Payload ID: 10217
  Gene Symbol: MFNG
  Gene Name: MFNG O-fucosylpeptide 3-beta-N-acetylglucosaminyltransferase
  ENST ID: ENST00000424765
  CDS Start-End: 217-570
gacagcgggagcaggtggaggactggcggcggtcgagatcgtgctgccatggctcagcctctgggtccagagcctcagctcctacctcttccctccttgccagcccctgatgcctgccagacttttgcctctgctggagcccctgcctgaccagcttcccctccctgtctggttgggatttgggggctgagctgtctggggtcccagggccaaccaatgcagtgccggctcccgcggggcctggctggagccctcctcaccctcctgtgcatggggctcctgtgtctgcggtaccacttgaacctgtccccgcagcgggtacaagggacccccgagctgagccagccgaacccggggccccctaagctacagctacacgatgtcttcattgcagtgaagacgacccgggctttccaccgcttgcgcctggagctgctgcttgacacgtgggtttccaggaccagggaacagacatttgtcttcaccgacagcccagacaaaggcctccaggagagactggggtcccctgactcctcctcacttctccagggtcccaccttgtggtcacca

SEQ ID NO: 153643 - DNA, 2034 bp, Homo sapiens
  Payload ID: 10217
  Gene Symbol: MFNG
  Gene Name: MFNG O-fucosylpeptide 3-beta-N-acetylglucosaminyltransferase
  Uniprot ID: O00587
  ENST ID: ENST00000416983
  CDS Start-End: 211-1134
gggagcaggtggaggactggcggcggtcgagatcgtgctgccatggctcagcctctgggtccagagcctcagctcctacctcttccctccttgccagcccctgatgcctgccagacttttgcctctgctggagcccctgcctgaccagcttcccctccctgtctggttgggatttgggggctgagctgtctggggtcccagggccaaccaatgcagtgccggctcccgcggggcctggctggagccctcctcaccctcctgtgcatggggctcctgtgtctgcggtaccacttgaacctgtccccgcagcgggtacaagggacccccgagctgagccagccgaacccggggccccctaagctacagctacacgatgtcttcattgcagtgaagacgacccgggctttccaccgcttgcgcctggagctgctgcttgacacgtgggtttccaggaccagggaacaggtgacaaggtcccaccttgtggtcaccaactgctccgcggaacacagccacccagctctgtcctgcaagatggctgctgagttcgacaccttcttggccagtgggcttaggtggttctgccatgtggacgatgacaactatgtgaacccaagggcgctgctgcagcttctgagagccttcccgctggcccgcgacgtctatgtgggaaggcccagcctgaaccggcccatccatgcctcagagccacagccccacaaccgcacgaggctggtacagttctggtttgccactgggggtgctggcttctgcatcaatcgcaaactggctttgaagatggctccgtgggccagtggctcccgtttcatggacacatctgctctcatccggctgcctgatgactgcaccatgggctatatcattgagtgcaagctgggcggccgcctgcagcccagccccctctttcactcccacctggagaccctgcagctgctgaggactgcacagctcccagaacaggtcaccctcagctacggtgtctttgaggggaaactcaacgtcattaagctacagggccccttctccccggaggaggacccctccagatttcgctccctccattgtctgctctatccagatacaccctggtgtccccagctgggtgcccgatgaatcctgaactgctgggcaaaggttgggcagagacttctgggtgtgccttggctcccaaggtggcactgtgggtccctggcaagtgtcttgtgataggcagtccctggcagggccttcgggtggttggcaagcccaggatctgagtggcaattggcactgaaggcaccccaggcccctgggaggtgagttagacagcccaggggaccaggtggaccaggtggtggccagagaggctccaggggctagactccctcaggaggctgaattgaaaaagggcagggggcacttgagctgggctggggctcaggggtcctaaccctttaggcagtgacatggcctctgggtggggtctggccgttggccctggctaatgtctctcagtcattcccctggggctcaagcgctgggccgcccactcctgcctccctcatctgtgtcccgagttcctgaagggacatgggtggaatgatggcagaatccagggtctgcagcacctgctgttgttgccaaccagtctcccaaagctccttgctccccaccccttgcgaacaggaccagattttgtttggagcctcagcatgccggggcccagatgatggagcataacgggtcccagccaattgtgatgatcctttttgctcatttcccagcctttcttgctgttaggggctaccatgggaccagctctggccagagggaactaagcaaatccaatagagatgtttctggggaaggttttgcagcccactccccatcttcctgctataaatgtgggtgtgatggctggatctggggcagccaccttgctaccatgaaggaaaggccaagacaatcatccacagctattccctccagcatctggttctgtacaaaaattaaatgcttatttgtttaagtctc

SEQ ID NO: 153644 - DNA, 966 bp, Homo sapiens
  Payload ID: 10217
  Gene Symbol: MFNG
  Gene Name: MFNG O-fucosylpeptide 3-beta-N-acetylglucosaminyltransferase
  ENST ID: ENST00000438891
  CDS Start-End: 203-595
gtggaggactggcggcggtcgagatcgtgctgccatggctcagcctctgggtccagagcctcagctcctacctcttccctccttgccagcccctgatgcctgccagacttttgcctctgctggagcccctgcctgaccagcttcccctccctgtctggttgggatttgggggctgagctgtctggggtcccagggccaaccaatgcagtgccggctcccgcggggcctggctggagccctcctcaccctcctgtgcatggggctcctgtgtctgcggtaccacttgaacctgtccccgcagcgggtacaagggacccccgagctgagccagccgaacccggggccccctaagctacagctacacgatgtcttcattgcagtgaagacgacccgggctttccaccgcttgcgcctggagctgctgcttgacacgtgggtttccaggaccagggaacagggtcccaccttgtggtcaccaactgctccgcggaacacagccacccagctctgtcctgcaagatggctgctgagttcgacaccttcttggccagtgggcttaggtggttctgccatgtggacgatgacaactatgtgaacccaagggcgctgctgcagcttctgagagccttcccgctggcccgcgacgtctatgtgggaaggcccagcctgaaccggcccatccatgcctcagagccacagccccacaaccgcacgaggctggtacagttctggtttgccactgggggtgctggcttctgcatcaatcgcaaactggctttgaagatggctccgtgggccagtggctcccgtttcatggacacatctgctctcatccggctgcctgatgactgcaccatgggctatatcattgagtgcaagctgggcggccgcctgcagcccagccccctctttcactcccacctggagaccctgcagctgctgaggactgcacagctcccagaacag

SEQ ID NO: 153645 - DNA, 864 bp, Homo sapiens
  Payload ID: 10217
  Gene Symbol: MFNG
  Gene Name: MFNG O-fucosylpeptide 3-beta-N-acetylglucosaminyltransferase
  ENST ID: ENST00000430411
  CDS Start-End: 211-594
gggagcaggtggaggactggcggcggtcgagatcgtgctgccatggctcagcctctgggtccagagcctcagctcctacctcttccctccttgccagcccctgatgcctgccagacttttgcctctgctggagcccctgcctgaccagcttcccctccctgtctggttgggatttgggggctgagctgtctggggtcccagggccaaccaatgcagtgccggctcccgcggggcctggctggagccctcctcaccctcctgtgcatggggctcctgtgtctgcggtaccacttgaacctgtccccgcagcgggtacaagggacccccgagctgagccagccgaacccggggccccctaagctacagctacacgatgtcttcattgcagtgaagacgacccgggctttccaccgcttgcgcctggagctgctgcttgacacgtgggtttccaggaccagggaacaggtgacaaacatttgtcttcaccgacagcccagacaaaggcctccaggagagactggggtcccaccttgtggtcaccaactgctccgcggaacacagccacccagctctgtcctgcaagatggctgctgagttcgacaccttcttggccagtgggcttaggtggttctgccatgtggacgatgacaactatgtgaacccaagggcgctgctgcagcttctgagagccttcccgctggcccgcgacgtctatgtgggaaggcccagcctgaaccggcccatccatgcctcagagccacagccccacaaccgcacgaggctggtacagttctggtttgccactgggggtgctggcttctgcatcaatcgcaaactggctttgaagatggctccgtgggccag

SEQ ID NO: 153646 - DNA, 12042 bp, Homo sapiens
  Payload ID: 10218
  Gene Symbol: MGA
  Gene Name: MGA, MAX dimerization protein
  Uniprot ID: Q8IWI9
  ENST ID: ENST00000219905
  CDS Start-End: 182-9379
gcgcgcgcgcaggctcttcagctggagcggacacacggtgtgcgaaccgaacagaataacccgcccccagcgggatgtgaaggactccgggtgaggccggccacgccccgcacggatgggaaggccattgtgactatgtggtgattacagttgtcttactactgagtttcctactgaaatcatggaggagaaacagcagattatattggctaatcaagatggtggaacagtggcaggagcagcacctaccttctttgtcatcttaaagcagccaggaaatggcaaaactgatcaaggaattttggttactaatcaggatgcctgtgctttggctagtagtgtgtcatcaccagtaaaatctaaagggaagatttgccttccagctgattgtactgtgggtggaatcactgttaccctcgataacaatagtatgtggaatgagttctatcatcgaagcacagagatgattctgaccaagcaaggaagacgcatgtttccttactgtcgttattggataacaggtttagattcaaatttgaagtatattcttgtcatggatatatctcctgtggataaccatcgttataagtggaatggtcgttggtgggaacctagtgggaaggctgaacctcatgttttggggagggttttcattcatccagaatctccttccacaggtcattattggatgcatcaaccagtatctttctataaactcaaacttaccaacaatacactggaccaagaagggcatatcatcttgcactctatgcatcgttacctgccgaggcttcatttggtgcctgcagaaaaggctgtggaggtgatacaattaaatggccctggtgtccacacttttaccttcccacagactgaattctttgcagtaacagcttatcagaacattcagattactcagctgaaaatagattacaatccatttgccaaaggctttcgggatgatgggctgaataataagccccagagagatggaaaacaaaagaacagctctgaccaagaagggaataatatttccagttcttctggtcatcgggtccgtcttacagaaggtcaggggtcagagatacaaccaggtgatttggatcctttgtcaaggggtcatgaaacatcaggcaagggtttggagaagacttcccttaatataaaacgagactttcttggtttcatggatactgattcagcacttagtgaagttcctcaattgaagcaagagatttctgaatgtcttattgccagcagttttgaagatgactcccgtgtagcctcaccgttagaccagaacggaagcttcaatgttgttattaaagaggaacctctagatgattatgactacgaacttggtgagtgcccagaaggggtcactgtgaaacaggaagagacagatgaagagacggatgtatactcaaacagtgatgatgatcctatactagagaaacagctaaagaggcacaataaagttgacaacccagaagctgaccatctatcttctaaatggcttccaagcagcccatcaggtgttgctaaagctaaaatgttcaaattagacactggaaagatgccagtagtctatctggagccctgtgctgtcaccagaagcacagttaagatttctgaactccccgataacatgctttccacatctcgaaaggataaatcttctatgttggcagaattggaatatttgcctacatacattgaaaattccaatgagactgccttctgcttaggcaaggaatcagaaaatggtcttagaaaacattcaccagatctcagagtggtacaaaaatatcccttactgaaagagcctcagtggaaatatcctgatatatctgacagcattagcacagaaagaatactcgacgattcaaaggattcagttggagactcactttcaggaaaagaggacttgggcagaaagagaacaactatgcttaagattgcaacagccgcaaaggtagtgaatgctaatcagaatgcctctccaaatgtccctggaaaaagaggaaggccacgaaaattgaaactctgtaaggcaggacgaccacctaagaacacaggaaagtctttaatttctacaaagaatacacctgtaagccctgggagtacctttccagatgtgaagcctgatctggaagatgtggatggtgttctctttgtttcctttgaatcaaaggaagctctagacattcatgcagttgatgggacaacagaagaatcttctagtctccaggcatcaaccacaaatgactcaggttacagagcaagaatttcccagttggaaaaggaattgatagaagatttgaagactttgcggcacaagcaggtgatacatcctggtcttcaagaagtgggcttaaaattgaattcagtggatccaacaatgagcattgatcttaaatacttgggagtacagttacctttggctccagctactagctttcctttttggaaccttacaggaaccaaccctgcctctcctgatgcgggatttccctttgtttctaggacagggaaaaccaatgatttcactaagatcaagggatggaggggaaaatttcatagtgcttctgcatctaggaatgaaggtggaaattcagaaagttcactgaaaaatcgttctgctttctgtagtgataagctagatgaatacttggaaaatgaaggcaagctgatggaaacaagcatgggtttttcttctaatgctcccacatctcctgtggtgtaccagcttcccactaagagtaccagttatgtacgaacacttgatagtgtactaaagaagcaatctactatttccccttctacctcttattctttgaaacctcattctgtaccccctgtctctcgaaaggcaaagtctcaaaacagacaggcaactttcagtggccgaactaaatcatcttataaatccattttaccataccctgtttcaccaaagcagaaatactctcatgtgattctaggagataaggttaccaagaattcttcaggcatcatctcagaaaatcaggcgaataactttgttgtgccaactttggatgaaaatatatttccaaagcagattagtttgcggcaggcacagcagcagcagcaacagcaacagggaagtcgccctccaggcttgtctaaatctcaggtgaagctaatggacctggaagactgtgcactttgggaaggaaaaccaaggacatacatcacagaagagcgagcagatgtatccttaacaactctacttacagctcaagcatccctcaaaactaaacctatccacacaatcataaggaaacgagcccctccctgcaacaatgacttctgtcgactgggttgtgtatgttccagtctagctttggagaagcgccaacctgctcactgccgccgaccagactgcatgtttggttgtacttgtttgaaaagaaaagttgtacttgttaaaggaggatccaaaactaagcattttcagaggaaggctgctcatcgagatccagtattttatgatactctgggagaggaggcaagggaggaggaagaaggaatcagggaggaggaggaacaattgaaagagaaaaagaagagaaagaagctagaatacactatatgtgagacagagcctgaacagcctgttcgacattacccattatgggtaaaagtagaaggtgaagtagatccagaaccagtttatatccccacgccttctgtcattgagcctatgaaaccattgttattgcctcagccagaagttttatctcctactgtgaagggcaaactgctcactggaattaaatctccacggtcatatactcccaaacccaatcctgtgattcgggaagaggacaaagatccagtctacttgtactttgaaagtatgatgacttgtgctcgagttcgagtatatgagcgaaaaaaagaggaccagagacaaccatcttcctcctcctccccatctccatcatttcagcagcaaacttcatgtcattctagccctgagaaccataataatgcaaaggaacctgattctgaacagcagcccttaaaacaactcacctgtgacttggaggatgattctgataaattacaagaaaagagctggaagtcttcctgcaatgaaggagaatcctcttctacttcttatatgcatcagaggtcacctggtggtcccaccaaactgattgagatcatctcagactgcaactgggaggaagatcggaacaagattttgagcatcttatcccagcacatcaatagcaacatgccacaatcacttaaggtgggcagcttcatcattgagttggcttctcagcgaaagagccggggtgagaagaaccctcctgtttattcttctcgtgtgaaaatctctatgccatcatgtcaagaccaagatgatatggctgagaaatctggatcagagactcctgatggtccattgtcccctgggaaaatggaggatatctctcctgtgcagacagatgccctggattcagtgagggagagattacatggaggcaaaggtctgcctttttatgcagggctttctcctgcagggaagcttgtggcctataaacgtaaacccagttcaagtacatctgggcttatccaggtagcatccaatgccaaggtggctgcatccaggaaaccacgtaccctgttgccttcaacatccaattccaaaatggcatcctcctctggcactgcaacaaatcgccctgggaagaatctgaaggcgtttgtcccagcaaaacggccaattgcggctcgaccctctcctggtggtgtgttcacacagtttgtgatgagtaaagttggagccttgcagcagaagatacctggagttagcacaccccaaaccctggcagggacacagaagttcagtatcagaccttctccagtaatggtcgtcacacctgtggtttcttctgagccagttcaggtgtgcagccctgtgactgctgctgtcactactaccacccctcaagtgtttttagaaaatactactgctgtgacacctatgactgctatttctgacgtggaaactaaagaaactacttattcttctggtgccaccactacaggggttgttgaggtctctgaaactaataccagcacctctgtaacatctacccagtctacagccactgtgaaccttaccaaaaccactgggataactacccctgtggcttcagttgcttttcctaagtctttggtagcatctccttcaaccataactcttcctgttgcttccactgcttccacctccttagtcgtggtgactgcagctgcatcttcctccatggtgaccacaccaacttcatctctgggctctgttcctattatactctcaggaattaatgggagtccaccagtgagccagagaccagaaaatgctgctcaaattccagtggctactccacaggtctctcctaacacagtgaaacgtgctggacctcgattgttgttgattccagtgcagcagggttctcctactcttagacctgtctcaaacacacaacttcagggacatcggatggtcttgcagcctgttaggagtccaagtggaatgaacttattcaggcaccctaatgggcagattgtccagcttctacctttgcatcagcttcgaggctctaatacccagcccaacttacagcctgtcatgtttcggaacccagggtctgtgatgggaatccggttacctgctccttccaaaccctctgagactccgccatcttccacttcgtcctctgctttctctgtcatgaatcctgtaattcaagctgttgggtcttcttcagcagtgaatgttatcactcaggcaccatcattgctttcctctggagctagttttgtgtctcaggctggtacattgaccctgaggatttctcctcctgaaccacaaagctttgcaagtaaaacaggctctgaaaccaaaataacttatagctcaggaggacagcctgttggtacagccagtcttattcctctccagtctggtagttttgccttgttacagctcccaggacaaaagcctgttcctagctccattcttcagcatgttgcttcccttcagatgaagagagaatctcagaatccagaccagaaagatgaaacaaactcaataaaaagagagcaagaaacgaagaaggttctacagtcagaaggagaggctgtagaccctgaggctaatgtaataaaacaaaactcaggagctgctacctcagaagaaactctgaatgattccttggaagataggggtgatcatttggatgaagaatgccttccagaagaaggttgtgcaactgtcaaaccatctgagcattcctgtatcactgggtcacatacagatcaagattataaagatgttaatgaagaatatggggctaggaatcgtaagagttccaaagaaaaagtggctgttctggaagttaggaccatttctgaaaaagccagtaataagacagtccaaaatttaagtaaagtacagcatcaaaaacttggtgatgtgaaggtggaacagcagaaaggatttgacaatccagaagaaaactcaagtgaatttccagtcacctttaaggaagaaagtaaatttgaattgtcaggaagcaaagttatggagcagcaatctaatctacagccagaggccaaagagaaggaatgtggagactctctggagaaagacagggaaagatggagaaaacatctgaagggccccttaaccaggaaatgtgttggagcttcacaggaatgtaagaaagaggcagacgagcagttaattaaagaaacaaagacatgtcaggaaaattcagatgtgtttcagcaagaacaaggcatctctgacttacttggaaaaagtggaattactgaagatgccagagttttgaaaactgaatgtgattcttggagtaggatttctaatccttcagccttctccattgttcctaggagagctgcaaaaagcagcagagggaatggacattttcagggtcacttactgctacctggagaacagatacaaccaaagcaagagaagaagggtgggagaagcagtgctgacttcactgttttggatttggaagaagatgatgaagatgataatgagaaaactgatgattctattgatgaaattgtggatgttgtttctgactaccagagtgaggaggttgatgatgtagaaaagaataactgtgtagaatacattgaggatgatgaggagcacgtggacattgagactgtagaagagctctcagaggaaattaatgttgctcacctgaagaccacagcggcccacacacagtcattcaaacagccgtcctgtactcacatctctgcagatgaaaaagcagctgaaaggagtcgaaaggctccaccaattcctctaaaactgaagcctgattactggagtgacaaactacagaaagaagcagaagcgtttgcttattatcgccggacacacactgccaatgagcggcggcggcgtggtgaaatgagggatctctttgagaaattaaagatcacattgggattacttcattcttccaaggtttccaaaagtctcattcttactcgagccttcagtgaaattcagggactaacagatcaggcagacaaattgataggacagaaaaatctcctgactcgaaaacggaatattctgatacggaaagtatcgtctctttcaggtaagacagaagaagtggtcctgaagaagctagagtatatttatgcaaaacagcaagcactagaggcacaaaaaagaaaaaagaagatgggatcagatgagtttgacatatctcccagaattagcaaacagcaggaaggatcttctgcatcatctgtagatcttggacagatgtttataaataacaggagggggaaacctttgattctttccagaaaaaaagaccaggccacagaaaatacctcacccttgaacactccacacacctctgccaaccttgtgatgactccgcaagggcaattgctcaccctaaaaggtcccctattctcaggaccagtggtagctgtttctcctgatctcttagaatctgatcttaagcctcaagttgccggtagtgctgtggctctaccagaaaatgacgacttatttatgatgccacgaattgttaatgtgacatcattggccacagagggaggtttggtagatatgggtggcagcaaatatcctcatgaagttcctgatagcaagccatctgaccatctgaaagacaccgtcaggaatgaagataattccttagaggataagggtagaatctcttccagaggaaacagagatggcagagtgacgttgggtccaacgcaggtttttctggcaaacaaagattctggttatccacaaatagttgacgtttccaatatgcagaaagcacaagagttcttacctaaaaagatttctggtgatatgagagggattcagtataaatggaaagagagtgaatcaagaggggagagagtgaagtcaaaggattcttcatttcataaattaaagatgaaagatctcaaggactcaagcatagagatggaactgaggaaagtaacatcagctatagaggaagcagctcttgattccagtgaactgctgactaacatggaagatgaggatgatactgatgagacactgacttcactgctcaatgaaattgcctttcttaatcaacaactaaatgatgactctgttggcctggctgaactacccagctctatggatacagagttcccaggggatgctcggcgggcttttattagtaaggttcctcctggaagcagagcaactttccaggttgagcacttgggaactggtttgaaagagttgcctgatgttcaaggggagagtgactctatcagtcccctcctcttgcacttggaagacgatgacttttctgagaatgaaaaacaacttgcagaaccagcctctgagccagatgtccttaagattgttattgactctgaaataaaggattccctcctttccaacaagaaagctattgatggagggaagaatacttctggcctccctgcagagcccgaaagtgtgtcctcaccccccaccctacacatgaagactggcttggagaacagcaacagcacagacactttgtggaggcctatgccaaagttggcccctctaggtttaaaagtagctaatccttccagtgatgcagatggtcagagtctcaaggtgatgccttgtttggcacctatagctgccaaagttgggtcagttggacacaaaatgaacttaacagggaatgaccaggaaggccgggaaagcaaggtgatgcctacattggcacctgttgtggctaaattgggcaactcgggggcctcaccaagttctgcagggaaatgaacttacttgtccttaagcagaagccaggctgtgaggggaaatagatctcacctcctttctctgcaggcatctgtttgtttgtgtcttagaacttggatccttgacttcaatgatgcagtggataatgatgggagaaagggggtagggtgctgaccctggtataagaagtactctgaaattctgatcatgttaaaatgtgttacctcacttgtggtgctgggtcccctcatcctctctaagaagatgtgatccattactgaacatgaggtgcccctcttacccaaggaatttataacatgactctggctccacagtggtttctagttcttcccccacaagcgaaagagctgtttgcaactttggagttgctgtagactgaactgtagcttgtagctgttgaattaagtccaaaatctaaggaatgcgatggacttgtgcaaagggatccagaagagacactttttagttgatgtttcaagaatagggagagagaggatgggtaccatggaataccaaagtgaaggactttgtgtcattcagtaaaattttcttttttcatatcctaagtagctcccattccctcaccttttcaatcagaattaacaaattcaagccttcagtaaagtagggatgcttttaacttttattattaattattttgagatcttaaaaaaatagtagttctcccttattatttttgtgggcattgaaaagctcatttcacagtaccagagatttttactgggagtatatattttggaggtaggcatagagggagccctaccccttccacaaattacgttactcaagagacagctaaaataaaatgcattatctccccagaccagagacagtggccaaaataaaaaatcatggggctggaaatttcccaaatcaaaccagcctcctggtgcttgaaggtttcattcactattacctgcacaggatgtaaagaaaagtcacagtaggcactctttaccagggaaataaggcagtatttgaatcacaagatatattttttatctgcaaccatggatccaatgatctgtagagctttttcactcattaactgtcaggatatgaaggactgacagtctgtaaagatatttatatttttgtatagttgttttcatagatttctcaaaggctgaagttttcaacctagaagatgagatttgtattgagtatagaaatgatgtttcctatctagtttgtaaataatcatggtgcacttgaggggtctcttggaaactcctagggggtcaagaatcactattctgaaactgtatagactgggatttagctgctgcattttgcctttcttaaataattatattttggaatgtaacccctgttctgtcttcattgacaggatttgcttgtgttgttaaaacactaacacaagagcttccagtgcctgggccgtgcctaggtgatgctatttcttctatatctcctgtcttctttatcccaaatcccactcagcatatcttcagacctaggttgtaagaccaactttggattggatctagccagtgaattattatttccatggttggttccctttctgttaactctggtaatcaacagattgaaaacggtggaagaacttctgaaaattgcagtgggagcaaattcttgttggttttgtgctgcttgcctttctagatctgctcatcagcacttaaccttccctcctctaaaggttactaaagaagcctgaagtaggtaaagagtgctcctcagcttcttatccttccactctttacccagcagatttcattcaatgccttagccaaggagtccagcacctgtctcccctgctaataattgtccttagagatgctagtactttaatccaggtatagcagtttcccgttattttcttgcttgtcgttcccctacatttcctcctgatttcccaagactctctttgtggcttttgagggtcagccaaggagcaggcaagtgagtgaacaatcctcaggaaaagaaggaccattttagcttaacacttccttttttttttttttttttttaagaagaatataggtaaacaggtaatgattcttgattggagataccatttgactcttgatgagagttgtacgaagatggaaatgagggatgattccaggcgttttagggggaaggctgcagataccattctaacccccaagatactgtgttctcaagacctcttagaactaggtgttgtcagggataatttgaggagggcttagtcttcagaacaatcctgcagtcttgacagaaatctaaaatctccaaaaactcctaccctttaaccttaccctagggggaactgatctatgaatattacatgtgtgattatgaaaggtgaagttgagtgagaggagttgaggaacgtggaagacagtgagctctcaccctaacactataagaagcatgatctcaatagaccaataattcacctttttatacatctgtaaataaatggaatgtttttaagaatataattatgtcagatttagcattttcttttatatattaaatatatatatctttccttttctgctttcgaaaagtgactatttttttagaaatctaagaacagaagtttggtgattgaaaggtagaatatataaacctgaaataaagcagttaaaacaattaaagcagaa

SEQ ID NO: 153647 - DNA, 11413 bp, Homo sapiens
  Payload ID: 10218
  Gene Symbol: MGA
  Gene Name: MGA, MAX dimerization protein
  Uniprot ID: Q8IWI9
  ENST ID: ENST00000545763
  CDS Start-End: 182-8752
gcgcgcgcgcaggctcttcagctggagcggacacacggtgtgcgaaccgaacagaataacccgcccccagcgggatgtgaaggactccgggtgaggccggccacgccccgcacggatgggaaggccattgtgactatgtggtgattacagttgtcttactactgagtttcctactgaaatcatggaggagaaacagcagattatattggctaatcaagatggtggaacagtggcaggagcagcacctaccttctttgtcatcttaaagcagccaggaaatggcaaaactgatcaaggaattttggttactaatcaggatgcctgtgctttggctagtagtgtgtcatcaccagtaaaatctaaagggaagatttgccttccagctgattgtactgtgggtggaatcactgttaccctcgataacaatagtatgtggaatgagttctatcatcgaagcacagagatgattctgaccaagcaaggaagacgcatgtttccttactgtcgttattggataacaggtttagattcaaatttgaagtatattcttgtcatggatatatctcctgtggataaccatcgttataagtggaatggtcgttggtgggaacctagtgggaaggctgaacctcatgttttggggagggttttcattcatccagaatctccttccacaggtcattattggatgcatcaaccagtatctttctataaactcaaacttaccaacaatacactggaccaagaagggcatatcatcttgcactctatgcatcgttacctgccgaggcttcatttggtgcctgcagaaaaggctgtggaggtgatacaattaaatggccctggtgtccacacttttaccttcccacagactgaattctttgcagtaacagcttatcagaacattcagattactcagctgaaaatagattacaatccatttgccaaaggctttcgggatgatgggctgaataataagccccagagagatggaaaacaaaagaacagctctgaccaagaagggaataatatttccagttcttctggtcatcgggtccgtcttacagaaggtcaggggtcagagatacaaccaggtgatttggatcctttgtcaaggggtcatgaaacatcaggcaagggtttggagaagacttcccttaatataaaacgagactttcttggtttcatggatactgattcagcacttagtgaagttcctcaattgaagcaagagatttctgaatgtcttattgccagcagttttgaagatgactcccgtgtagcctcaccgttagaccagaacggaagcttcaatgttgttattaaagaggaacctctagatgattatgactacgaacttggtgagtgcccagaaggggtcactgtgaaacaggaagagacagatgaagagacggatgtatactcaaacagtgatgatgatcctatactagagaaacagctaaagaggcacaataaagttgacaacccagaagctgaccatctatcttctaaatggcttccaagcagcccatcaggtgttgctaaagctaaaatgttcaaattagacactggaaagatgccagtagtctatctggagccctgtgctgtcaccagaagcacagttaagatttctgaactccccgataacatgctttccacatctcgaaaggataaatcttctatgttggcagaattggaatatttgcctacatacattgaaaattccaatgagactgccttctgcttaggcaaggaatcagaaaatggtcttagaaaacattcaccagatctcagagtggtacaaaaatatcccttactgaaagagcctcagtggaaatatcctgatatatctgacagcattagcacagaaagaatactcgacgattcaaaggattcagttggagactcactttcaggaaaagaggacttgggcagaaagagaacaactatgcttaagattgcaacagccgcaaaggtagtgaatgctaatcagaatgcctctccaaatgtccctggaaaaagaggaaggccacgaaaattgaaactctgtaaggcaggacgaccacctaagaacacaggaaagtctttaatttctacaaagaatacacctgtaagccctgggagtacctttccagatgtgaagcctgatctggaagatgtggatggtgttctctttgtttcctttgaatcaaaggaagctctagacattcatgcagttgatgggacaacagaagaatcttctagtctccaggcatcaaccacaaatgactcaggttacagagcaagaatttcccagttggaaaaggaattgatagaagatttgaagactttgcggcacaagcaggtgatacatcctggtcttcaagaagtgggcttaaaattgaattcagtggatccaacaatgagcattgatcttaaatacttgggagtacagttacctttggctccagctactagctttcctttttggaaccttacaggaaccaaccctgcctctcctgatgcgggatttccctttgtttctaggacagggaaaaccaatgatttcactaagatcaagggatggaggggaaaatttcatagtgcttctgcatctaggaatgaaggtggaaattcagaaagttcactgaaaaatcgttctgctttctgtagtgataagctagatgaatacttggaaaatgaaggcaagctgatggaaacaagcatgggtttttcttctaatgctcccacatctcctgtggtgtaccagcttcccactaagagtaccagttatgtacgaacacttgatagtgtactaaagaagcaatctactatttccccttctacctcttattctttgaaacctcattctgtaccccctgtctctcgaaaggcaaagtctcaaaacagacaggcaactttcagtggccgaactaaatcatcttataaatccattttaccataccctgtttcaccaaagcagaaatactctcatgtgattctaggagataaggttaccaagaattcttcaggcatcatctcagaaaatcaggcgaataactttgttgtgccaactttggatgaaaatatatttccaaagcagattagtttgcggcaggcacagcagcagcagcaacagcaacagggaagtcgccctccaggcttgtctaaatctcaggtgaagctaatggacctggaagactgtgcactttgggaaggaaaaccaaggacatacatcacagaagagcgagcagatgtatccttaacaactctacttacagctcaagcatccctcaaaactaaacctatccacacaatcataaggaaacgagcccctccctgcaacaatgacttctgtcgactgggttgtgtatgttccagtctagctttggagaagcgccaacctgctcactgccgccgaccagactgcatgtttggttgtacttgtttgaaaagaaaagttgtacttgttaaaggaggatccaaaactaagcattttcagaggaaggctgctcatcgagatccagtattttatgatactctgggagaggaggcaagggaggaggaagaaggaatcagggaggaggaggaacaattgaaagagaaaaagaagagaaagaagctagaatacactatatgtgagacagagcctgaacagcctgttcgacattacccattatgggtaaaagtagaaggtgaagtagatccagaaccagtttatatccccacgccttctgtcattgagcctatgaaaccattgttattgcctcagccagaagttttatctcctactgtgaagggcaaactgctcactggaattaaatctccacggtcatatactcccaaacccaatcctgtgattcgggaagaggacaaagatccagtctacttgtactttgaaagtatgatgacttgtgctcgagttcgagtatatgagcgaaaaaaagaggaccagagacaaccatcttcctcctcctccccatctccatcatttcagcagcaaacttcatgtcattctagccctgagaaccataataatgcaaaggaacctgattctgaacagcagcccttaaaacaactcacctgtgacttggaggatgattctgataaattacaagaaaagagctggaagtcttcctgcaatgaaggagaatcctcttctacttcttatatgcatcagaggtcacctggtggtcccaccaaactgattgagatcatctcagactgcaactgggaggaagatcggaacaagattttgagcatcttatcccagcacatcaatagcaacatgccacaatcacttaaggtgggcagcttcatcattgagttggcttctcagcgaaagagccggggtgagaagaaccctcctgtttattcttctcgtgtgaaaatctctatgccatcatgtcaagaccaagatgatatggctgagaaatctggatcagagactcctgatggtccattgtcccctgggaaaatggaggatatctctcctgtgcagacagatgccctggattcagtgagggagagattacatggaggcaaaggtctgcctttttatgcagggctttctcctgcagggaagcttgtggcctataaacgtaaacccagttcaagtacatctgggcttatccaggtagcatccaatgccaaggtggctgcatccaggaaaccacgtaccctgttgccttcaacatccaattccaaaatggcatcctcctctggcactgcaacaaatcgccctgggaagaatctgaaggcgtttgtcccagcaaaacggccaattgaaaatgctgctcaaattccagtggctactccacaggtctctcctaacacagtgaaacgtgctggacctcgattgttgttgattccagtgcagcagggttctcctactcttagacctgtctcaaacacacaacttcagggacatcggatggtcttgcagcctgttaggagtccaagtggaatgaacttattcaggcaccctaatgggcagattgtccagcttctacctttgcatcagcttcgaggctctaatacccagcccaacttacagcctgtcatgtttcggaacccagggtctgtgatgggaatccggttacctgctccttccaaaccctctgagactccgccatcttccacttcgtcctctgctttctctgtcatgaatcctgtaattcaagctgttgggtcttcttcagcagtgaatgttatcactcaggcaccatcattgctttcctctggagctagttttgtgtctcaggctggtacattgaccctgaggatttctcctcctgaaccacaaagctttgcaagtaaaacaggctctgaaaccaaaataacttatagctcaggaggacagcctgttggtacagccagtcttattcctctccagtctggtagttttgccttgttacagctcccaggacaaaagcctgttcctagctccattcttcagcatgttgcttcccttcagatgaagagagaatctcagaatccagaccagaaagatgaaacaaactcaataaaaagagagcaagaaacgaagaaggttctacagtcagaaggagaggctgtagaccctgaggctaatgtaataaaacaaaactcaggagctgctacctcagaagaaactctgaatgattccttggaagataggggtgatcatttggatgaagaatgccttccagaagaaggttgtgcaactgtcaaaccatctgagcattcctgtatcactgggtcacatacagatcaagattataaagatgttaatgaagaatatggggctaggaatcgtaagagttccaaagaaaaagtggctgttctggaagttaggaccatttctgaaaaagccagtaataagacagtccaaaatttaagtaaagtacagcatcaaaaacttggtgatgtgaaggtggaacagcagaaaggatttgacaatccagaagaaaactcaagtgaatttccagtcacctttaaggaagaaagtaaatttgaattgtcaggaagcaaagttatggagcagcaatctaatctacagccagaggccaaagagaaggaatgtggagactctctggagaaagacagggaaagatggagaaaacatctgaagggccccttaaccaggaaatgtgttggagcttcacaggaatgtaagaaagaggcagacgagcagttaattaaagaaacaaagacatgtcaggaaaattcagatgtgtttcagcaagaacaaggcatctctgacttacttggaaaaagtggaattactgaagatgccagagttttgaaaactgaatgtgattcttggagtaggatttctaatccttcagccttctccattgttcctaggagagctgcaaaaagcagcagagggaatggacattttcagggtcacttactgctacctggagaacagatacaaccaaagcaagagaagaagggtgggagaagcagtgctgacttcactgttttggatttggaagaagatgatgaagatgataatgagaaaactgatgattctattgatgaaattgtggatgttgtttctgactaccagagtgaggaggttgatgatgtagaaaagaataactgtgtagaatacattgaggatgatgaggagcacgtggacattgagactgtagaagagctctcagaggaaattaatgttgctcacctgaagaccacagcggcccacacacagtcattcaaacagccgtcctgtactcacatctctgcagatgaaaaagcagctgaaaggagtcgaaaggctccaccaattcctctaaaactgaagcctgattactggagtgacaaactacagaaagaagcagaagcgtttgcttattatcgccggacacacactgccaatgagcggcggcggcgtggtgaaatgagggatctctttgagaaattaaagatcacattgggattacttcattcttccaaggtttccaaaagtctcattcttactcgagccttcagtgaaattcagggactaacagatcaggcagacaaattgataggacagaaaaatctcctgactcgaaaacggaatattctgatacggaaagtatcgtctctttcaggtaagacagaagaagtggtcctgaagaagctagagtatatttatgcaaaacagcaagcactagaggcacaaaaaagaaaaaagaagatgggatcagatgagtttgacatatctcccagaattagcaaacagcaggaaggatcttctgcatcatctgtagatcttggacagatgtttataaataacaggagggggaaacctttgattctttccagaaaaaaagaccaggccacagaaaatacctcacccttgaacactccacacacctctgccaaccttgtgatgactccgcaagggcaattgctcaccctaaaaggtcccctattctcaggaccagtggtagctgtttctcctgatctcttagaatctgatcttaagcctcaagttgccggtagtgctgtggctctaccagaaaatgacgacttatttatgatgccacgaattgttaatgtgacatcattggccacagagggaggtttggtagatatgggtggcagcaaatatcctcatgaagttcctgatagcaagccatctgaccatctgaaagacaccgtcaggaatgaagataattccttagaggataagggtagaatctcttccagaggaaacagagatggcagagtgacgttgggtccaacgcaggtttttctggcaaacaaagattctggttatccacaaatagttgacgtttccaatatgcagaaagcacaagagttcttacctaaaaagatttctggtgatatgagagggattcagtataaatggaaagagagtgaatcaagaggggagagagtgaagtcaaaggattcttcatttcataaattaaagatgaaagatctcaaggactcaagcatagagatggaactgaggaaagtaacatcagctatagaggaagcagctcttgattccagtgaactgctgactaacatggaagatgaggatgatactgatgagacactgacttcactgctcaatgaaattgcctttcttaatcaacaactaaatgatgactctgttggcctggctgaactacccagctctatggatacagagttcccaggggatgctcggcgggcttttattagtaaggttcctcctggaagcagagcaactttccaggttgagcacttgggaactggtttgaaagagttgcctgatgttcaaggggagagtgactctatcagtcccctcctcttgcacttggaagacgatgacttttctgagaatgaaaaacaacttgcagaaccagcctctgagccagatgtccttaagattgttattgactctgaaataaaggattccctcctttccaacaagaaagctattgatggagggaagaatacttctggcctccctgcagagcccgaaagtgtgtcctcaccccccaccctacacatgaagactggcttggagaacagcaacagcacagacactttgtggaggcctatgccaaagttggcccctctaggtttaaaagtagctaatccttccagtgatgcagatggtcagagtctcaaggtgatgccttgtttggcacctatagctgccaaagttgggtcagttggacacaaaatgaacttaacagggaatgaccaggaaggccgggaaagcaaggtgatgcctacattggcacctgttgtggctaaattgggcaactcgggggcctcaccaagttctgcagggaaatgaacttacttgtccttaagcagaagccaggctgtgaggggaaatagatctcacctcctttctctgcaggcatctgtttgtttgtgtcttagaacttggatccttgacttcaatgatgcagtggataatgatgggagaaagggggtagggtgctgaccctggtataagaagtactctgaaattctgatcatgttaaaatgtgttacctcacttgtggtgctgggtcccctcatcctctctaagaagatgtgatccattactgaacatgaggtgcccctcttacccaaggaatttataacatgactctggctccacagtggtttctagttcttcccccacaagcgaaagagctgtttgcaactttggagttgctgtagactgaactgtagcttgtagctgttgaattaagtccaaaatctaaggaatgcgatggacttgtgcaaagggatccagaagagacactttttagttgatgtttcaagaatagggagagagaggatgggtaccatggaataccaaagtgaaggactttgtgtcattcagtaaaattttcttttttcatatcctaagtagctcccattccctcaccttttcaatcagaattaacaaattcaagccttcagtaaagtagggatgcttttaacttttattattaattattttgagatcttaaaaaaatagtagttctcccttattatttttgtgggcattgaaaagctcatttcacagtaccagagatttttactgggagtatatattttggaggtaggcatagagggagccctaccccttccacaaattacgttactcaagagacagctaaaataaaatgcattatctccccagaccagagacagtggccaaaataaaaaatcatggggctggaaatttcccaaatcaaaccagcctcctggtgcttgaaggtttcattcactattacctgcacaggatgtaaagaaaagtcacagtaggcactctttaccagggaaataaggcagtatttgaatcacaagatatattttttatctgcaaccatggatccaatgatctgtagagctttttcactcattaactgtcaggatatgaaggactgacagtctgtaaagatatttatatttttgtatagttgttttcatagatttctcaaaggctgaagttttcaacctagaagatgagatttgtattgagtatagaaatgatgtttcctatctagtttgtaaataatcatggtgcacttgaggggtctcttggaaactcctagggggtcaagaatcactattctgaaactgtatagactgggatttagctgctgcattttgcctttcttaaataattatattttggaatgtaacccctgttctgtcttcattgacaggatttgcttgtgttgttaaaacactaacacaagagcttccagtgcctgggccgtgcctaggtgatgctatttcttctatatctcctgtcttctttatcccaaatcccactcagcatatcttcagacctaggttgtaagaccaactttggattggatctagccagtgaattattatttccatggttggttccctttctgttaactctggtaatcaacagattgaaaacggtggaagaacttctgaaaattgcagtgggagcaaattcttgttggttttgtgctgcttgcctttctagatctgctcatcagcacttaaccttccctcctctaaaggttactaaagaagcctgaagtaggtaaagagtgctcctcagcttcttatccttccactctttacccagcagatttcattcaatgccttagccaaggagtccagcacctgtctcccctgctaataattgtccttagagatgctagtactttaatccaggtatagcagtttcccgttattttcttgcttgtcgttcccctacatttcctcctgatttcccaagactctctttgtggcttttgagggtcagccaaggagcaggcaagtgagtgaacaatcctcaggaaaagaaggaccattttagcttaacacttccttttttttttttttttttttaagaagaatataggtaaacaggtaatgattcttgattggagataccatttgactcttgatgagagttgtacgaagatggaaatgagggatgattccaggcgttttagggggaaggctgcagataccattctaacccccaagatactgtgttctcaagacctcttagaactaggtgttgtcagggataatttgaggagggcttagtcttcagaacaatcctgcagtcttgacagaaatctaaaatctccaaaaactcctaccctttaaccttaccctagggggaactgatctatgaatattacatgtgtgattatgaaaggtgaagttgagtgagaggagttgaggaacgtggaagacagtgagctctcaccctaacactataagaagcatgatctcaatagaccaataattcacctttttatacatctgtaaataaatggaatgtttttaagaatataattatgtcagatttagcattttcttttatatattaaatatatatatctttccttttctgctttcgaaaagtgactatttttttagaaatctaagaacagaagtttggtgattgaaaggtagaatatataaacctgaaataaagcagttaaaacaattaaagcag

SEQ ID NO: 153648 - DNA, 3439 bp, Homo sapiens
  Payload ID: 10218
  Gene Symbol: MGA
  Gene Name: MGA, MAX dimerization protein
  ENST ID: ENST00000566718
  CDS Start-End: 182-3439
gcgcgcgcgcaggctcttcagctggagcggacacacggtgtgcgaaccgaacagaataacccgcccccagcgggatgtgaaggactccgggtgaggccggccacgccccgcacggatgggaaggccattgtgactatgtggtgattacagttgtcttactactgagtttcctactgaaatcatggaggagaaacagcagattatattggctaatcaagatggtggaacagtggcaggagcagcacctaccttctttgtcatcttaaagcagccaggaaatggcaaaactgatcaaggaattttggttactaatcaggatgcctgtgctttggctagtagtgtgtcatcaccagtaaaatctaaagggaagatttgccttccagctgattgtactgtgggtggaatcactgttaccctcgataacaatagtatgtggaatgagttctatcatcgaagcacagagatgattctgaccaagcaaggaagacgcatgtttccttactgtcgttattggataacaggtttagattcaaatttgaagtatattcttgtcatggatatatctcctgtggataaccatcgttataagtggaatggtcgttggtgggaacctagtgggaaggctgaacctcatgttttggggagggttttcattcatccagaatctccttccacaggtcattattggatgcatcaaccagtatctttctataaactcaaacttaccaacaatacactggaccaagaagggcatatcatcttgcactctatgcatcgttacctgccgaggcttcatttggtgcctgcagaaaaggctgtggaggtgatacaattaaatggccctggtgtccacacttttaccttcccacagactgaattctttgcagtaacagcttatcagaacattcagattactcagctgaaaatagattacaatccatttgccaaaggctttcgggatgatgggctgaataataagccccagagagatggaaaacaaaagaacagctctgaccaagaagggaataatatttccagttcttctggtcatcgggtccgtcttacagaaggtcaggggtcagagatacaaccaggtgatttggatcctttgtcaaggggtcatgaaacatcaggcaagggtttggagaagacttcccttaatataaaacgagactttcttggtttcatggatactgattcagcacttagtgaagttcctcaattgaagcaagagatttctgaatgtcttattgccagcagttttgaagatgactcccgtgtagcctcaccgttagaccagaacggaagcttcaatgttgttattaaagaggaacctctagatgattatgactacgaacttggtgagtgcccagaaggggtcactgtgaaacaggaagagacagatgaagagacggatgtatactcaaacagtgatgatgatcctatactagagaaacagctaaagaggcacaataaagttgacaacccagaagctgaccatctatcttctaaatggcttccaagcagcccatcaggtgttgctaaagctaaaatgttcaaattagacactggaaagatgccagtagtctatctggagccctgtgctgtcaccagaagcacagttaagatttctgaactccccgataacatgctttccacatctcgaaaggataaatcttctatgttggcagaattggaatatttgcctacatacattgaaaattccaatgagactgccttctgcttaggcaaggaatcagaaaatggtcttagaaaacattcaccagatctcagagtggtacaaaaatatcccttactgaaagagcctcagtggaaatatcctgatatatctgacagcattagcacagaaagaatactcgacgattcaaaggattcagttggagactcactttcaggaaaagaggacttgggcagaaagagaacaactatgcttaagattgcaacagccgcaaaggtagtgaatgctaatcagaatgcctctccaaatgtccctggaaaaagaggaaggccacgaaaattgaaactctgtaaggcaggacgaccacctaagaacacaggaaagtctttaatttctacaaagaatacacctgtaagccctgggagtacctttccagatgtgaagcctgatctggaagatgtggatggtgttctctttgtttcctttgaatcaaaggaagctctagacattcatgcagttgatgggacaacagaagaatcttctagtctccaggcatcaaccacaaatgactcaggttacagagcaagaatttcccagttggaaaaggaattgatagaagatttgaagactttgcggcacaagcaggtgatacatcctggtcttcaagaagtgggcttaaaattgaattcagtggatccaacaatgagcattgatcttaaatacttgggagtacagttacctttggctccagctactagctttcctttttggaaccttacaggaaccaaccctgcctctcctgatgcgggatttccctttgtttctaggacagggaaaaccaatgatttcactaagatcaagggatggaggggaaaatttcatagtgcttctgcatctaggaatgaaggtggaaattcagaaagttcactgaaaaatcgttctgctttctgtagtgataagctagatgaatacttggaaaatgaaggcaagctgatggaaacaagcatgggtttttcttctaatgctcccacatctcctgtggtgtaccagcttcccactaagagtaccagttatgtacgaacacttgatagtgtactaaagaagcaatctactatttccccttctacctcttattctttgaaacctcattctgtaccccctgtctctcgaaaggcaaagtctcaaaacagacaggcaactttcagtggccgaactaaatcatcttataaatccattttaccataccctgtttcaccaaagcagaaatactctcatgtgattctaggagataaggttaccaagaattcttcaggcatcatctcagaaaatcaggcgaataactttgttgtgccaactttggatgaaaatatatttccaaagcagattagtttgcggcaggcacagcagcagcagcaacagcaacagggaagtcgccctccaggcttgtctaaatctcaggtgaagctaatggacctggaagactgtgcactttgggaaggaaaaccaaggacatacatcacagaagagcgagcagatgtatccttaacaactctacttacagctcaagcatccctcaaaactaaacctatccacacaatcataaggaaacgagcccctccctgcaacaatgacttctgtcgactgggttgtgtatgttccagtctagctttggagaagcgccaacctgctcactgccgccgaccagactgcatgtttggttgtacttgtttgaaaagaaaa

SEQ ID NO: 153649 - DNA, 14439 bp, Homo sapiens
  Payload ID: 10218
  Gene Symbol: MGA
  Gene Name: MGA, MAX dimerization protein
  Uniprot ID: Q8IWI9
  ENST ID: ENST00000566586
  CDS Start-End: 68-8638
gatgggaaggccattgtgactatgtggtgattacagttgtcttactactgagtttcctactgaaatcatggaggagaaacagcagattatattggctaatcaagatggtggaacagtggcaggagcagcacctaccttctttgtcatcttaaagcagccaggaaatggcaaaactgatcaaggaattttggttactaatcaggatgcctgtgctttggctagtagtgtgtcatcaccagtaaaatctaaagggaagatttgccttccagctgattgtactgtgggtggaatcactgttaccctcgataacaatagtatgtggaatgagttctatcatcgaagcacagagatgattctgaccaagcaaggaagacgcatgtttccttactgtcgttattggataacaggtttagattcaaatttgaagtatattcttgtcatggatatatctcctgtggataaccatcgttataagtggaatggtcgttggtgggaacctagtgggaaggctgaacctcatgttttggggagggttttcattcatccagaatctccttccacaggtcattattggatgcatcaaccagtatctttctataaactcaaacttaccaacaatacactggaccaagaagggcatatcatcttgcactctatgcatcgttacctgccgaggcttcatttggtgcctgcagaaaaggctgtggaggtgatacaattaaatggccctggtgtccacacttttaccttcccacagactgaattctttgcagtaacagcttatcagaacattcagattactcagctgaaaatagattacaatccatttgccaaaggctttcgggatgatgggctgaataataagccccagagagatggaaaacaaaagaacagctctgaccaagaagggaataatatttccagttcttctggtcatcgggtccgtcttacagaaggtcaggggtcagagatacaaccaggtgatttggatcctttgtcaaggggtcatgaaacatcaggcaagggtttggagaagacttcccttaatataaaacgagactttcttggtttcatggatactgattcagcacttagtgaagttcctcaattgaagcaagagatttctgaatgtcttattgccagcagttttgaagatgactcccgtgtagcctcaccgttagaccagaacggaagcttcaatgttgttattaaagaggaacctctagatgattatgactacgaacttggtgagtgcccagaaggggtcactgtgaaacaggaagagacagatgaagagacggatgtatactcaaacagtgatgatgatcctatactagagaaacagctaaagaggcacaataaagttgacaacccagaagctgaccatctatcttctaaatggcttccaagcagcccatcaggtgttgctaaagctaaaatgttcaaattagacactggaaagatgccagtagtctatctggagccctgtgctgtcaccagaagcacagttaagatttctgaactccccgataacatgctttccacatctcgaaaggataaatcttctatgttggcagaattggaatatttgcctacatacattgaaaattccaatgagactgccttctgcttaggcaaggaatcagaaaatggtcttagaaaacattcaccagatctcagagtggtacaaaaatatcccttactgaaagagcctcagtggaaatatcctgatatatctgacagcattagcacagaaagaatactcgacgattcaaaggattcagttggagactcactttcaggaaaagaggacttgggcagaaagagaacaactatgcttaagattgcaacagccgcaaaggtagtgaatgctaatcagaatgcctctccaaatgtccctggaaaaagaggaaggccacgaaaattgaaactctgtaaggcaggacgaccacctaagaacacaggaaagtctttaatttctacaaagaatacacctgtaagccctgggagtacctttccagatgtgaagcctgatctggaagatgtggatggtgttctctttgtttcctttgaatcaaaggaagctctagacattcatgcagttgatgggacaacagaagaatcttctagtctccaggcatcaaccacaaatgactcaggttacagagcaagaatttcccagttggaaaaggaattgatagaagatttgaagactttgcggcacaagcaggtgatacatcctggtcttcaagaagtgggcttaaaattgaattcagtggatccaacaatgagcattgatcttaaatacttgggagtacagttacctttggctccagctactagctttcctttttggaaccttacaggaaccaaccctgcctctcctgatgcgggatttccctttgtttctaggacagggaaaaccaatgatttcactaagatcaagggatggaggggaaaatttcatagtgcttctgcatctaggaatgaaggtggaaattcagaaagttcactgaaaaatcgttctgctttctgtagtgataagctagatgaatacttggaaaatgaaggcaagctgatggaaacaagcatgggtttttcttctaatgctcccacatctcctgtggtgtaccagcttcccactaagagtaccagttatgtacgaacacttgatagtgtactaaagaagcaatctactatttccccttctacctcttattctttgaaacctcattctgtaccccctgtctctcgaaaggcaaagtctcaaaacagacaggcaactttcagtggccgaactaaatcatcttataaatccattttaccataccctgtttcaccaaagcagaaatactctcatgtgattctaggagataaggttaccaagaattcttcaggcatcatctcagaaaatcaggcgaataactttgttgtgccaactttggatgaaaatatatttccaaagcagattagtttgcggcaggcacagcagcagcagcaacagcaacagggaagtcgccctccaggcttgtctaaatctcaggtgaagctaatggacctggaagactgtgcactttgggaaggaaaaccaaggacatacatcacagaagagcgagcagatgtatccttaacaactctacttacagctcaagcatccctcaaaactaaacctatccacacaatcataaggaaacgagcccctccctgcaacaatgacttctgtcgactgggttgtgtatgttccagtctagctttggagaagcgccaacctgctcactgccgccgaccagactgcatgtttggttgtacttgtttgaaaagaaaagttgtacttgttaaaggaggatccaaaactaagcattttcagaggaaggctgctcatcgagatccagtattttatgatactctgggagaggaggcaagggaggaggaagaaggaatcagggaggaggaggaacaattgaaagagaaaaagaagagaaagaagctagaatacactatatgtgagacagagcctgaacagcctgttcgacattacccattatgggtaaaagtagaaggtgaagtagatccagaaccagtttatatccccacgccttctgtcattgagcctatgaaaccattgttattgcctcagccagaagttttatctcctactgtgaagggcaaactgctcactggaattaaatctccacggtcatatactcccaaacccaatcctgtgattcgggaagaggacaaagatccagtctacttgtactttgaaagtatgatgacttgtgctcgagttcgagtatatgagcgaaaaaaagaggaccagagacaaccatcttcctcctcctccccatctccatcatttcagcagcaaacttcatgtcattctagccctgagaaccataataatgcaaaggaacctgattctgaacagcagcccttaaaacaactcacctgtgacttggaggatgattctgataaattacaagaaaagagctggaagtcttcctgcaatgaaggagaatcctcttctacttcttatatgcatcagaggtcacctggtggtcccaccaaactgattgagatcatctcagactgcaactgggaggaagatcggaacaagattttgagcatcttatcccagcacatcaatagcaacatgccacaatcacttaaggtgggcagcttcatcattgagttggcttctcagcgaaagagccggggtgagaagaaccctcctgtttattcttctcgtgtgaaaatctctatgccatcatgtcaagaccaagatgatatggctgagaaatctggatcagagactcctgatggtccattgtcccctgggaaaatggaggatatctctcctgtgcagacagatgccctggattcagtgagggagagattacatggaggcaaaggtctgcctttttatgcagggctttctcctgcagggaagcttgtggcctataaacgtaaacccagttcaagtacatctgggcttatccaggtagcatccaatgccaaggtggctgcatccaggaaaccacgtaccctgttgccttcaacatccaattccaaaatggcatcctcctctggcactgcaacaaatcgccctgggaagaatctgaaggcgtttgtcccagcaaaacggccaattgaaaatgctgctcaaattccagtggctactccacaggtctctcctaacacagtgaaacgtgctggacctcgattgttgttgattccagtgcagcagggttctcctactcttagacctgtctcaaacacacaacttcagggacatcggatggtcttgcagcctgttaggagtccaagtggaatgaacttattcaggcaccctaatgggcagattgtccagcttctacctttgcatcagcttcgaggctctaatacccagcccaacttacagcctgtcatgtttcggaacccagggtctgtgatgggaatccggttacctgctccttccaaaccctctgagactccgccatcttccacttcgtcctctgctttctctgtcatgaatcctgtaattcaagctgttgggtcttcttcagcagtgaatgttatcactcaggcaccatcattgctttcctctggagctagttttgtgtctcaggctggtacattgaccctgaggatttctcctcctgaaccacaaagctttgcaagtaaaacaggctctgaaaccaaaataacttatagctcaggaggacagcctgttggtacagccagtcttattcctctccagtctggtagttttgccttgttacagctcccaggacaaaagcctgttcctagctccattcttcagcatgttgcttcccttcagatgaagagagaatctcagaatccagaccagaaagatgaaacaaactcaataaaaagagagcaagaaacgaagaaggttctacagtcagaaggagaggctgtagaccctgaggctaatgtaataaaacaaaactcaggagctgctacctcagaagaaactctgaatgattccttggaagataggggtgatcatttggatgaagaatgccttccagaagaaggttgtgcaactgtcaaaccatctgagcattcctgtatcactgggtcacatacagatcaagattataaagatgttaatgaagaatatggggctaggaatcgtaagagttccaaagaaaaagtggctgttctggaagttaggaccatttctgaaaaagccagtaataagacagtccaaaatttaagtaaagtacagcatcaaaaacttggtgatgtgaaggtggaacagcagaaaggatttgacaatccagaagaaaactcaagtgaatttccagtcacctttaaggaagaaagtaaatttgaattgtcaggaagcaaagttatggagcagcaatctaatctacagccagaggccaaagagaaggaatgtggagactctctggagaaagacagggaaagatggagaaaacatctgaagggccccttaaccaggaaatgtgttggagcttcacaggaatgtaagaaagaggcagacgagcagttaattaaagaaacaaagacatgtcaggaaaattcagatgtgtttcagcaagaacaaggcatctctgacttacttggaaaaagtggaattactgaagatgccagagttttgaaaactgaatgtgattcttggagtaggatttctaatccttcagccttctccattgttcctaggagagctgcaaaaagcagcagagggaatggacattttcagggtcacttactgctacctggagaacagatacaaccaaagcaagagaagaagggtgggagaagcagtgctgacttcactgttttggatttggaagaagatgatgaagatgataatgagaaaactgatgattctattgatgaaattgtggatgttgtttctgactaccagagtgaggaggttgatgatgtagaaaagaataactgtgtagaatacattgaggatgatgaggagcacgtggacattgagactgtagaagagctctcagaggaaattaatgttgctcacctgaagaccacagcggcccacacacagtcattcaaacagccgtcctgtactcacatctctgcagatgaaaaagcagctgaaaggagtcgaaaggctccaccaattcctctaaaactgaagcctgattactggagtgacaaactacagaaagaagcagaagcgtttgcttattatcgccggacacacactgccaatgagcggcggcggcgtggtgaaatgagggatctctttgagaaattaaagatcacattgggattacttcattcttccaaggtttccaaaagtctcattcttactcgagccttcagtgaaattcagggactaacagatcaggcagacaaattgataggacagaaaaatctcctgactcgaaaacggaatattctgatacggaaagtatcgtctctttcaggtaagacagaagaagtggtcctgaagaagctagagtatatttatgcaaaacagcaagcactagaggcacaaaaaagaaaaaagaagatgggatcagatgagtttgacatatctcccagaattagcaaacagcaggaaggatcttctgcatcatctgtagatcttggacagatgtttataaataacaggagggggaaacctttgattctttccagaaaaaaagaccaggccacagaaaatacctcacccttgaacactccacacacctctgccaaccttgtgatgactccgcaagggcaattgctcaccctaaaaggtcccctattctcaggaccagtggtagctgtttctcctgatctcttagaatctgatcttaagcctcaagttgccggtagtgctgtggctctaccagaaaatgacgacttatttatgatgccacgaattgttaatgtgacatcattggccacagagggaggtttggtagatatgggtggcagcaaatatcctcatgaagttcctgatagcaagccatctgaccatctgaaagacaccgtcaggaatgaagataattccttagaggataagggtagaatctcttccagaggaaacagagatggcagagtgacgttgggtccaacgcaggtttttctggcaaacaaagattctggttatccacaaatagttgacgtttccaatatgcagaaagcacaagagttcttacctaaaaagatttctggtgatatgagagggattcagtataaatggaaagagagtgaatcaagaggggagagagtgaagtcaaaggattcttcatttcataaattaaagatgaaagatctcaaggactcaagcatagagatggaactgaggaaagtaacatcagctatagaggaagcagctcttgattccagtgaactgctgactaacatggaagatgaggatgatactgatgagacactgacttcactgctcaatgaaattgcctttcttaatcaacaactaaatgatgactctgttggcctggctgaactacccagctctatggatacagagttcccaggggatgctcggcgggcttttattagtaaggttcctcctggaagcagagcaactttccaggttgagcacttgggaactggtttgaaagagttgcctgatgttcaaggggagagtgactctatcagtcccctcctcttgcacttggaagacgatgacttttctgagaatgaaaaacaacttgcagaaccagcctctgagccagatgtccttaagattgttattgactctgaaataaaggattccctcctttccaacaagaaagctattgatggagggaagaatacttctggcctccctgcagagcccgaaagtgtgtcctcaccccccaccctacacatgaagactggcttggagaacagcaacagcacagacactttgtggaggcctatgccaaagttggcccctctaggtttaaaagtagctaatccttccagtgatgcagatggtcagagtctcaaggtgatgccttgtttggcacctatagctgccaaagttgggtcagttggacacaaaatgaacttaacagggaatgaccaggaaggccgggaaagcaaggtgatgcctacattggcacctgttgtggctaaattgggcaactcgggggcctcaccaagttctgcagggaaatgaacttacttgtccttaagcagaagccaggctgtgaggggaaatagatctcacctcctttctctgcaggcatctgtttgtttgtgtcttagaacttggatccttgacttcaatgatgcagtggataatgatgggagaaagggggtagggtgctgaccctggtataagaagtactctgaaattctgatcatgttaaaatgtgttacctcacttgtggtgctgggtcccctcatcctctctaagaagatgtgatccattactgaacatgaggtgcccctcttacccaaggaatttataacatgactctggctccacagtggtttctagttcttcccccacaagcgaaagagctgtttgcaactttggagttgctgtagactgaactgtagcttgtagctgttgaattaagtccaaaatctaaggaatgcgatggacttgtgcaaagggatccagaagagacactttttagttgatgtttcaagaatagggagagagaggatgggtaccatggaataccaaagtgaaggactttgtgtcattcagtaaaattttcttttttcatatcctaagtagctcccattccctcaccttttcaatcagaattaacaaattcaagccttcagtaaagtagggatgcttttaacttttattattaattattttgagatcttaaaaaaatagtagttctcccttattatttttgtgggcattgaaaagctcatttcacagtaccagagatttttactgggagtatatattttggaggtaggcatagagggagccctaccccttccacaaattacgttactcaagagacagctaaaataaaatgcattatctccccagaccagagacagtggccaaaataaaaaatcatggggctggaaatttcccaaatcaaaccagcctcctggtgcttgaaggtttcattcactattacctgcacaggatgtaaagaaaagtcacagtaggcactctttaccagggaaataaggcagtatttgaatcacaagatatattttttatctgcaaccatggatccaatgatctgtagagctttttcactcattaactgtcaggatatgaaggactgacagtctgtaaagatatttatatttttgtatagttgttttcatagatttctcaaaggctgaagttttcaacctagaagatgagatttgtattgagtatagaaatgatgtttcctatctagtttgtaaataatcatggtgcacttgaggggtctcttggaaactcctagggggtcaagaatcactattctgaaactgtatagactgggatttagctgctgcattttgcctttcttaaataattatattttggaatgtaacccctgttctgtcttcattgacaggatttgcttgtgttgttaaaacactaacacaagagcttccagtgcctgggccgtgcctaggtgatgctatttcttctatatctcctgtcttctttatcccaaatcccactcagcatatcttcagacctaggttgtaagaccaactttggattggatctagccagtgaattattatttccatggttggttccctttctgttaactctggtaatcaacagattgaaaacggtggaagaacttctgaaaattgcagtgggagcaaattcttgttggttttgtgctgcttgcctttctagatctgctcatcagcacttaaccttccctcctctaaaggttactaaagaagcctgaagtaggtaaagagtgctcctcagcttcttatccttccactctttacccagcagatttcattcaatgccttagccaaggagtccagcacctgtctcccctgctaataattgtccttagagatgctagtactttaatccaggtatagcagtttcccgttattttcttgcttgtcgttcccctacatttcctcctgatttcccaagactctctttgtggcttttgagggtcagccaaggagcaggcaagtgagtgaacaatcctcaggaaaagaaggaccattttagcttaacacttccttttttttttttttttttttaagaagaatataggtaaacaggtaatgattcttgattggagataccatttgactcttgatgagagttgtacgaagatggaaatgagggatgattccaggcgttttagggggaaggctgcagataccattctaacccccaagatactgtgttctcaagacctcttagaactaggtgttgtcagggataatttgaggagggcttagtcttcagaacaatcctgcagtcttgacagaaatctaaaatctccaaaaactcctaccctttaaccttaccctagggggaactgatctatgaatattacatgtgtgattatgaaaggtgaagttgagtgagaggagttgaggaacgtggaagacagtgagctctcaccctaacactataagaagcatgatctcaatagaccaataattcacctttttatacatctgtaaataaatggaatgtttttaagaatataattatgtcagatttagcattttcttttatatattaaatatatatatctttccttttctgctttcgaaaagtgactatttttttagaaatctaagaacagaagtttggtgattgaaaggtagaatatataaacctgaaataaagcagttaaaacaattaaagcagaacttggtgttgggaggtttgtgccaacttggagtggagaattctaattccctaagacatatttgagagaggtgccactgaagtggttttatcataggaatcctttccttttctctaagtttctgatatgccatttgggggaggttttcgatgttctaatccttgtagcatgttttacatggaggcttcaaaattgtgtgcaacctgatggcaagtatttgttttagaagtcattctaaaatcattctggtgtcagtatgagcaaggcagttcacctgttaaccttggggagtaaaggtacacaaacacagtcttttagtggtaaaggacagtaggtgttcttaagggaagatatgttaaagagtttgacagttaacaaaaacgtttaaaggaatcctttagacatccaactactcctatctattaaggtcactaacagatcaagtccagttatataagcttcatacaaattgttcactttgtgtgattttatagtacatacaatagttttttcgtggaattacagatgaaatacctgatgctaggctcttctataacaagtttgaaaatgttttgaacacacaagaaaggcagacaatccatatgttatttttggtttagtggtttagataattttttttctaactatactggttgagatatttgaaatcaaatagggtgatgcactttaaaaacgggtctagaaaatagtgacagcccttgtccctcactccagaattaaacaacaacaaaccatacacagcacattttccaggtacttttatagagaatgactgataaccaagaatcagaatacatttcttgcacaaaactgttggttttgaagaaggtgctgtaaaggcatcagtacttcatgtcactgtattatcactaatgaaatttttatttttattttttttgaggcagagtctcactctgtcgcccaggctggagtgcagtggtgccgtcttggctcactgcaagctctgcctcccgggtttacgccattgtcctgcctcagcctccggagtagctgggactacaggcgcccgacactgtgcccggctaatttttttgtatttttttgtagagacagggtttcaccatgttagccaggatggtctcaatctcctgaccttgtgatccgcccgcctcggcctcccaaagtgctgggattacaggcgtgagccactgcgcccggcctactaatgaaattttacatggacacaaatatctaggtgcagggaaaattaaagctgagatattcagactcactgccagttggaggaaaaaaatcagttataacgcattttttggaatagagggaaataatttgataagtacaactttttgtttgaggtgtagctaatgttagacatgactgagctgttctacacataagtgttgaatagtgatggtggtgcattaagaggatgggaagactatgggatgagttggaaattttgagacaaatctaaactctactaatttctattgttgtaaactctgctggtagaaaagatattaagtaggaaagcagtcttggaagcatggttttgagatccattgtgtttccaactgcaatcattgatctcagctgttgcacagtgcctttgcatgtaaaggtgctcaataaatatttgaattgatgagcaaatgtttagactgtttcccaggaacttataccttatttgcatgttatgcctagggtgaattttaaaatttgatctaatgagtatagtgctaaacagacaactatataacgtctattccccagacatctagaatttcagaagctggcaaacactatgtatagatgtttaggacatataaaagtagaataaagtgttaaatagtgtatggatgatgaaatacttatgaagagttaactgcattttggaggattgggatggcaagtagagtcatgcgtcacttaatgatggggatacgttctgagaaatgcaccttgggtggttttgttctgcaaacatcatagagtgtactgtacttaaacaaacctagatggtgttgcttaaccacacacctaggctgtgttgctcctaggctacaactctgtacagcatgttaactgcactgaatatcataggcagttgtaacacgtggtgtttgtgtgtctacacataggaaaggtatggtaaaaatatgatattataatttaatgggatcatgtggtcattgaaatgtatacagtgcatgactgtaaatctgagtggagaaaagtgaataatgcttctgttcacattagacctgggactgttattttctgaggaattaatgaagaatgggaatagcctatatagcttattcctatattggtatctcaaaggcagtgtagtacctagacaataaaagttggactgaattgtgaagaattaaaaatgtgtgggccgggcatggtggctcacgcctgtaatcctggcactttgggaggccaaggcaggcggatcacgaggtcaggagatcgagacctcctggccaacatggtgaaaccccatctttactaaaaatacaaaaattaactgggtgtggtggcgcgtgcctgtaatcccagctactcgggaggctgaggcaagagaatggcttgaaaccaggagtcggaggttgcagtgagctgagatcgccactgcagtccagtctggggacagagcaagactctgtttaaaaaaaaaaaaaaaaaaaaaaaaaaagcgtggctttggcctaagactggaagtacccagattccagacttaagaaatcctcattaaaatgctttcagttgtttttcatgaaagaaatgaccagtgatactttgtaaaccatttatctggccatgagtgatcaggtgagaaaaccgttagcggacaccagaatgatctggagaggattagggacggctcttgtgggcacatttttactctagtttcatgggtggagatggcatctgccgtggtctgcagcatgcaagtaaagacaccaggtggcaccatttattagctttcaatcccatggagaggtcccatcatgtaactaccaagaggttgaaggaaccaactacctcttgcatattgtagctaatggttcttgccttcttcttccagacttgggaaataaatttgaaaatcgtattttctgtttca

SEQ ID NO: 153650 - DNA, 11859 bp, Homo sapiens
  Payload ID: 10218
  Gene Symbol: MGA
  Gene Name: MGA, MAX dimerization protein
  Uniprot ID: Q8IWI9
  ENST ID: ENST00000570161
  CDS Start-End: 1-9198
atggaggagaaacagcagattatattggctaatcaagatggtggaacagtggcaggagcagcacctaccttctttgtcatcttaaagcagccaggaaatggcaaaactgatcaaggaattttggttactaatcaggatgcctgtgctttggctagtagtgtgtcatcaccagtaaaatctaaagggaagatttgccttccagctgattgtactgtgggtggaatcactgttaccctcgataacaatagtatgtggaatgagttctatcatcgaagcacagagatgattctgaccaagcaaggaagacgcatgtttccttactgtcgttattggataacaggtttagattcaaatttgaagtatattcttgtcatggatatatctcctgtggataaccatcgttataagtggaatggtcgttggtgggaacctagtgggaaggctgaacctcatgttttggggagggttttcattcatccagaatctccttccacaggtcattattggatgcatcaaccagtatctttctataaactcaaacttaccaacaatacactggaccaagaagggcatatcatcttgcactctatgcatcgttacctgccgaggcttcatttggtgcctgcagaaaaggctgtggaggtgatacaattaaatggccctggtgtccacacttttaccttcccacagactgaattctttgcagtaacagcttatcagaacattcagattactcagctgaaaatagattacaatccatttgccaaaggctttcgggatgatgggctgaataataagccccagagagatggaaaacaaaagaacagctctgaccaagaagggaataatatttccagttcttctggtcatcgggtccgtcttacagaaggtcaggggtcagagatacaaccaggtgatttggatcctttgtcaaggggtcatgaaacatcaggcaagggtttggagaagacttcccttaatataaaacgagactttcttggtttcatggatactgattcagcacttagtgaagttcctcaattgaagcaagagatttctgaatgtcttattgccagcagttttgaagatgactcccgtgtagcctcaccgttagaccagaacggaagcttcaatgttgttattaaagaggaacctctagatgattatgactacgaacttggtgagtgcccagaaggggtcactgtgaaacaggaagagacagatgaagagacggatgtatactcaaacagtgatgatgatcctatactagagaaacagctaaagaggcacaataaagttgacaacccagaagctgaccatctatcttctaaatggcttccaagcagcccatcaggtgttgctaaagctaaaatgttcaaattagacactggaaagatgccagtagtctatctggagccctgtgctgtcaccagaagcacagttaagatttctgaactccccgataacatgctttccacatctcgaaaggataaatcttctatgttggcagaattggaatatttgcctacatacattgaaaattccaatgagactgccttctgcttaggcaaggaatcagaaaatggtcttagaaaacattcaccagatctcagagtggtacaaaaatatcccttactgaaagagcctcagtggaaatatcctgatatatctgacagcattagcacagaaagaatactcgacgattcaaaggattcagttggagactcactttcaggaaaagaggacttgggcagaaagagaacaactatgcttaagattgcaacagccgcaaaggtagtgaatgctaatcagaatgcctctccaaatgtccctggaaaaagaggaaggccacgaaaattgaaactctgtaaggcaggacgaccacctaagaacacaggaaagtctttaatttctacaaagaatacacctgtaagccctgggagtacctttccagatgtgaagcctgatctggaagatgtggatggtgttctctttgtttcctttgaatcaaaggaagctctagacattcatgcagttgatgggacaacagaagaatcttctagtctccaggcatcaaccacaaatgactcaggttacagagcaagaatttcccagttggaaaaggaattgatagaagatttgaagactttgcggcacaagcaggtgatacatcctggtcttcaagaagtgggcttaaaattgaattcagtggatccaacaatgagcattgatcttaaatacttgggagtacagttacctttggctccagctactagctttcctttttggaaccttacaggaaccaaccctgcctctcctgatgcgggatttccctttgtttctaggacagggaaaaccaatgatttcactaagatcaagggatggaggggaaaatttcatagtgcttctgcatctaggaatgaaggtggaaattcagaaagttcactgaaaaatcgttctgctttctgtagtgataagctagatgaatacttggaaaatgaaggcaagctgatggaaacaagcatgggtttttcttctaatgctcccacatctcctgtggtgtaccagcttcccactaagagtaccagttatgtacgaacacttgatagtgtactaaagaagcaatctactatttccccttctacctcttattctttgaaacctcattctgtaccccctgtctctcgaaaggcaaagtctcaaaacagacaggcaactttcagtggccgaactaaatcatcttataaatccattttaccataccctgtttcaccaaagcagaaatactctcatgtgattctaggagataaggttaccaagaattcttcaggcatcatctcagaaaatcaggcgaataactttgttgtgccaactttggatgaaaatatatttccaaagcagattagtttgcggcaggcacagcagcagcagcaacagcaacagggaagtcgccctccaggcttgtctaaatctcaggtgaagctaatggacctggaagactgtgcactttgggaaggaaaaccaaggacatacatcacagaagagcgagcagatgtatccttaacaactctacttacagctcaagcatccctcaaaactaaacctatccacacaatcataaggaaacgagcccctccctgcaacaatgacttctgtcgactgggttgtgtatgttccagtctagctttggagaagcgccaacctgctcactgccgccgaccagactgcatgtttggttgtacttgtttgaaaagaaaagttgtacttgttaaaggaggatccaaaactaagcattttcagaggaaggctgctcatcgagatccagtattttatgatactctgggagaggaggcaagggaggaggaagaaggaatcagggaggaggaggaacaattgaaagagaaaaagaagagaaagaagctagaatacactatatgtgagacagagcctgaacagcctgttcgacattacccattatgggtaaaagtagaaggtgaagtagatccagaaccagtttatatccccacgccttctgtcattgagcctatgaaaccattgttattgcctcagccagaagttttatctcctactgtgaagggcaaactgctcactggaattaaatctccacggtcatatactcccaaacccaatcctgtgattcgggaagaggacaaagatccagtctacttgtactttgaaagtatgatgacttgtgctcgagttcgagtatatgagcgaaaaaaagaggaccagagacaaccatcttcctcctcctccccatctccatcatttcagcagcaaacttcatgtcattctagccctgagaaccataataatgcaaaggaacctgattctgaacagcagcccttaaaacaactcacctgtgacttggaggatgattctgataaattacaagaaaagagctggaagtcttcctgcaatgaaggagaatcctcttctacttcttatatgcatcagaggtcacctggtggtcccaccaaactgattgagatcatctcagactgcaactgggaggaagatcggaacaagattttgagcatcttatcccagcacatcaatagcaacatgccacaatcacttaaggtgggcagcttcatcattgagttggcttctcagcgaaagagccggggtgagaagaaccctcctgtttattcttctcgtgtgaaaatctctatgccatcatgtcaagaccaagatgatatggctgagaaatctggatcagagactcctgatggtccattgtcccctgggaaaatggaggatatctctcctgtgcagacagatgccctggattcagtgagggagagattacatggaggcaaaggtctgcctttttatgcagggctttctcctgcagggaagcttgtggcctataaacgtaaacccagttcaagtacatctgggcttatccaggtagcatccaatgccaaggtggctgcatccaggaaaccacgtaccctgttgccttcaacatccaattccaaaatggcatcctcctctggcactgcaacaaatcgccctgggaagaatctgaaggcgtttgtcccagcaaaacggccaattgcggctcgaccctctcctggtggtgtgttcacacagtttgtgatgagtaaagttggagccttgcagcagaagatacctggagttagcacaccccaaaccctggcagggacacagaagttcagtatcagaccttctccagtaatggtcgtcacacctgtggtttcttctgagccagttcaggtgtgcagccctgtgactgctgctgtcactactaccacccctcaagtgtttttagaaaatactactgctgtgacacctatgactgctatttctgacgtggaaactaaagaaactacttattcttctggtgccaccactacaggggttgttgaggtctctgaaactaataccagcacctctgtaacatctacccagtctacagccactgtgaaccttaccaaaaccactgggataactacccctgtggcttcagttgcttttcctaagtctttggtagcatctccttcaaccataactcttcctgttgcttccactgcttccacctccttagtcgtggtgactgcagctgcatcttcctccatggtgaccacaccaacttcatctctgggctctgttcctattatactctcaggaattaatgggagtccaccagtgagccagagaccagaaaatgctgctcaaattccagtggctactccacaggtctctcctaacacagtgaaacgtgctggacctcgattgttgttgattccagtgcagcagggttctcctactcttagacctgtctcaaacacacaacttcagggacatcggatggtcttgcagcctgttaggagtccaagtggaatgaacttattcaggcaccctaatgggcagattgtccagcttctacctttgcatcagcttcgaggctctaatacccagcccaacttacagcctgtcatgtttcggaacccagggtctgtgatgggaatccggttacctgctccttccaaaccctctgagactccgccatcttccacttcgtcctctgctttctctgtcatgaatcctgtaattcaagctgttgggtcttcttcagcagtgaatgttatcactcaggcaccatcattgctttcctctggagctagttttgtgtctcaggctggtacattgaccctgaggatttctcctcctgaaccacaaagctttgcaagtaaaacaggctctgaaaccaaaataacttatagctcaggaggacagcctgttggtacagccagtcttattcctctccagtctggtagttttgccttgttacagctcccaggacaaaagcctgttcctagctccattcttcagcatgttgcttcccttcagatgaagagagaatctcagaatccagaccagaaagatgaaacaaactcaataaaaagagagcaagaaacgaagaaggttctacagtcagaaggagaggctgtagaccctgaggctaatgtaataaaacaaaactcaggagctgctacctcagaagaaactctgaatgattccttggaagataggggtgatcatttggatgaagaatgccttccagaagaaggttgtgcaactgtcaaaccatctgagcattcctgtatcactgggtcacatacagatcaagattataaagatgttaatgaagaatatggggctaggaatcgtaagagttccaaagaaaaagtggctgttctggaagttaggaccatttctgaaaaagccagtaataagacagtccaaaatttaagtaaagtacagcatcaaaaacttggtgatgtgaaggtggaacagcagaaaggatttgacaatccagaagaaaactcaagtgaatttccagtcacctttaaggaagaaagtaaatttgaattgtcaggaagcaaagttatggagcagcaatctaatctacagccagaggccaaagagaaggaatgtggagactctctggagaaagacagggaaagatggagaaaacatctgaagggccccttaaccaggaaatgtgttggagcttcacaggaatgtaagaaagaggcagacgagcagttaattaaagaaacaaagacatgtcaggaaaattcagatgtgtttcagcaagaacaaggcatctctgacttacttggaaaaagtggaattactgaagatgccagagttttgaaaactgaatgtgattcttggagtaggatttctaatccttcagccttctccattgttcctaggagagctgcaaaaagcagcagagggaatggacattttcagggtcacttactgctacctggagaacagatacaaccaaagcaagagaagaagggtgggagaagcagtgctgacttcactgttttggatttggaagaagatgatgaagatgataatgagaaaactgatgattctattgatgaaattgtggatgttgtttctgactaccagagtgaggaggttgatgatgtagaaaagaataactgtgtagaatacattgaggatgatgaggagcacgtggacattgagactgtagaagagctctcagaggaaattaatgttgctcacctgaagaccacagcggcccacacacagtcattcaaacagccgtcctgtactcacatctctgcagatgaaaaagcagctgaaaggagtcgaaaggctccaccaattcctctaaaactgaagcctgattactggagtgacaaactacagaaagaagcagaagcgtttgcttattatcgccggacacacactgccaatgagcggcggcggcgtggtgaaatgagggatctctttgagaaattaaagatcacattgggattacttcattcttccaaggtttccaaaagtctcattcttactcgagccttcagtgaaattcagggactaacagatcaggcagacaaattgataggacagaaaaatctcctgactcgaaaacggaatattctgatacggaaagtatcgtctctttcaggtaagacagaagaagtggtcctgaagaagctagagtatatttatgcaaaacagcaagcactagaggcacaaaaaagaaaaaagaagatgggatcagatgagtttgacatatctcccagaattagcaaacagcaggaaggatcttctgcatcatctgtagatcttggacagatgtttataaataacaggagggggaaacctttgattctttccagaaaaaaagaccaggccacagaaaatacctcacccttgaacactccacacacctctgccaaccttgtgatgactccgcaagggcaattgctcaccctaaaaggtcccctattctcaggaccagtggtagctgtttctcctgatctcttagaatctgatcttaagcctcaagttgccggtagtgctgtggctctaccagaaaatgacgacttatttatgatgccacgaattgttaatgtgacatcattggccacagagggaggtttggtagatatgggtggcagcaaatatcctcatgaagttcctgatagcaagccatctgaccatctgaaagacaccgtcaggaatgaagataattccttagaggataagggtagaatctcttccagaggaaacagagatggcagagtgacgttgggtccaacgcaggtttttctggcaaacaaagattctggttatccacaaatagttgacgtttccaatatgcagaaagcacaagagttcttacctaaaaagatttctggtgatatgagagggattcagtataaatggaaagagagtgaatcaagaggggagagagtgaagtcaaaggattcttcatttcataaattaaagatgaaagatctcaaggactcaagcatagagatggaactgaggaaagtaacatcagctatagaggaagcagctcttgattccagtgaactgctgactaacatggaagatgaggatgatactgatgagacactgacttcactgctcaatgaaattgcctttcttaatcaacaactaaatgatgactctgttggcctggctgaactacccagctctatggatacagagttcccaggggatgctcggcgggcttttattagtaaggttcctcctggaagcagagcaactttccaggttgagcacttgggaactggtttgaaagagttgcctgatgttcaaggggagagtgactctatcagtcccctcctcttgcacttggaagacgatgacttttctgagaatgaaaaacaacttgcagaaccagcctctgagccagatgtccttaagattgttattgactctgaaataaaggattccctcctttccaacaagaaagctattgatggagggaagaatacttctggcctccctgcagagcccgaaagtgtgtcctcaccccccaccctacacatgaagactggcttggagaacagcaacagcacagacactttgtggaggcctatgccaaagttggcccctctaggtttaaaagtagctaatccttccagtgatgcagatggtcagagtctcaaggtgatgccttgtttggcacctatagctgccaaagttgggtcagttggacacaaaatgaacttaacagggaatgaccaggaaggccgggaaagcaaggtgatgcctacattggcacctgttgtggctaaattgggcaactcgggggcctcaccaagttctgcagggaaatgaacttacttgtccttaagcagaagccaggctgtgaggggaaatagatctcacctcctttctctgcaggcatctgtttgtttgtgtcttagaacttggatccttgacttcaatgatgcagtggataatgatgggagaaagggggtagggtgctgaccctggtataagaagtactctgaaattctgatcatgttaaaatgtgttacctcacttgtggtgctgggtcccctcatcctctctaagaagatgtgatccattactgaacatgaggtgcccctcttacccaaggaatttataacatgactctggctccacagtggtttctagttcttcccccacaagcgaaagagctgtttgcaactttggagttgctgtagactgaactgtagcttgtagctgttgaattaagtccaaaatctaaggaatgcgatggacttgtgcaaagggatccagaagagacactttttagttgatgtttcaagaatagggagagagaggatgggtaccatggaataccaaagtgaaggactttgtgtcattcagtaaaattttcttttttcatatcctaagtagctcccattccctcaccttttcaatcagaattaacaaattcaagccttcagtaaagtagggatgcttttaacttttattattaattattttgagatcttaaaaaaatagtagttctcccttattatttttgtgggcattgaaaagctcatttcacagtaccagagatttttactgggagtatatattttggaggtaggcatagagggagccctaccccttccacaaattacgttactcaagagacagctaaaataaaatgcattatctccccagaccagagacagtggccaaaataaaaaatcatggggctggaaatttcccaaatcaaaccagcctcctggtgcttgaaggtttcattcactattacctgcacaggatgtaaagaaaagtcacagtaggcactctttaccagggaaataaggcagtatttgaatcacaagatatattttttatctgcaaccatggatccaatgatctgtagagctttttcactcattaactgtcaggatatgaaggactgacagtctgtaaagatatttatatttttgtatagttgttttcatagatttctcaaaggctgaagttttcaacctagaagatgagatttgtattgagtatagaaatgatgtttcctatctagtttgtaaataatcatggtgcacttgaggggtctcttggaaactcctagggggtcaagaatcactattctgaaactgtatagactgggatttagctgctgcattttgcctttcttaaataattatattttggaatgtaacccctgttctgtcttcattgacaggatttgcttgtgttgttaaaacactaacacaagagcttccagtgcctgggccgtgcctaggtgatgctatttcttctatatctcctgtcttctttatcccaaatcccactcagcatatcttcagacctaggttgtaagaccaactttggattggatctagccagtgaattattatttccatggttggttccctttctgttaactctggtaatcaacagattgaaaacggtggaagaacttctgaaaattgcagtgggagcaaattcttgttggttttgtgctgcttgcctttctagatctgctcatcagcacttaaccttccctcctctaaaggttactaaagaagcctgaagtaggtaaagagtgctcctcagcttcttatccttccactctttacccagcagatttcattcaatgccttagccaaggagtccagcacctgtctcccctgctaataattgtccttagagatgctagtactttaatccaggtatagcagtttcccgttattttcttgcttgtcgttcccctacatttcctcctgatttcccaagactctctttgtggcttttgagggtcagccaaggagcaggcaagtgagtgaacaatcctcaggaaaagaaggaccattttagcttaacacttccttttttttttttttttttttaagaagaatataggtaaacaggtaatgattcttgattggagataccatttgactcttgatgagagttgtacgaagatggaaatgagggatgattccaggcgttttagggggaaggctgcagataccattctaacccccaagatactgtgttctcaagacctcttagaactaggtgttgtcagggataatttgaggagggcttagtcttcagaacaatcctgcagtcttgacagaaatctaaaatctccaaaaactcctaccctttaaccttaccctagggggaactgatctatgaatattacatgtgtgattatgaaaggtgaagttgagtgagaggagttgaggaacgtggaagacagtgagctctcaccctaacactataagaagcatgatctcaatagaccaataattcacctttttatacatctgtaaataaatggaatgtttttaagaatataattatgtcagatttagcattttcttttatatattaaatatatatatctttccttttctgctttcgaaaagtgactatttttttagaaatctaagaacagaagtttggtgattgaaaggtagaatatataaacctgaaataaagcagttaaaacaattaaagcag

SEQ ID NO: 153651 - DNA, 3537 bp, Homo sapiens
  Payload ID: 10218
  Gene Symbol: MGA
  Gene Name: MGA, MAX dimerization protein
  ENST ID: ENST00000563576
  CDS Start-End: 122-3537
tccgggacccgcgagcggagcggcgcgtgggtcggttgcggtcggccccggcaggatgggaaggccattgtgactatgtggtgattacagttgtcttactactgagtttcctactgaaatcatggaggagaaacagcagattatattggctaatcaagatggtggaacagtggcaggagcagcacctaccttctttgtcatcttaaagcagccaggaaatggcaaaactgatcaaggaattttggttactaatcaggatgcctgtgctttggctagtagtgtgtcatcaccagtaaaatctaaagggaagatttgccttccagctgattgtactgtgggtggaatcactgttaccctcgataacaatagtatgtggaatgagttctatcatcgaagcacagagatgattctgaccaagcaaggaagacgcatgtttccttactgtcgttattggataacaggtttagattcaaatttgaagtatattcttgtcatggatatatctcctgtggataaccatcgttataagtggaatggtcgttggtgggaacctagtgggaaggctgaacctcatgttttggggagggttttcattcatccagaatctccttccacaggtcattattggatgcatcaaccagtatctttctataaactcaaacttaccaacaatacactggaccaagaagggcatatcatcttgcactctatgcatcgttacctgccgaggcttcatttggtgcctgcagaaaaggctgtggaggtgatacaattaaatggccctggtgtccacacttttaccttcccacagactgaattctttgcagtaacagcttatcagaacattcagattactcagctgaaaatagattacaatccatttgccaaaggctttcgggatgatgggctgaataataagccccagagagatggaaaacaaaagaacagctctgaccaagaagggaataatatttccagttcttctggtcatcgggtccgtcttacagaaggtcaggggtcagagatacaaccaggtgatttggatcctttgtcaaggggtcatgaaacatcaggcaagggtttggagaagacttcccttaatataaaacgagactttcttggtttcatggatactgattcagcacttagtgaagttcctcaattgaagcaagagatttctgaatgtcttattgccagcagttttgaagatgactcccgtgtagcctcaccgttagaccagaacggaagcttcaatgttgttattaaagaggaacctctagatgattatgactacgaacttggtgagtgcccagaaggggtcactgtgaaacaggaagagacagatgaagagacggatgtatactcaaacagtgatgatgatcctatactagagaaacagctaaagaggcacaataaagttgacaacccagaagctgaccatctatcttctaaatggcttccaagcagcccatcaggtgttgctaaagctaaaatgttcaaattagacactggaaagatgccagtagtctatctggagccctgtgctgtcaccagaagcacagttaagatttctgaactccccgataacatgctttccacatctcgaaaggataaatcttctatgttggcagaattggaatatttgcctacatacattgaaaattccaatgagactgccttctgcttaggcaaggaatcagaaaatggtcttagaaaacattcaccagatctcagagtggtacaaaaatatcccttactgaaagagcctcagtggaaatatcctgatatatctgacagcattagcacagaaagaatactcgacgattcaaaggattcagttggagactcactttcaggaaaagaggacttgggcagaaagagaacaactatgcttaagattgcaacagccgcaaaggtagtgaatgctaatcagaatgcctctccaaatgtccctggaaaaagaggaaggccacgaaaattgaaactctgtaaggcaggacgaccacctaagaacacaggaaagtctttaatttctacaaagaatacacctgtaagccctgggagtacctttccagatgtgaagcctgatctggaagatgtggatggtgttctctttgtttcctttgaatcaaaggaagctctagacattcatgcagttgatgggacaacagaagaatcttctagtctccaggcatcaaccacaaatgactcaggttacagagcaagaatttcccagttggaaaaggaattgatagaagatttgaagactttgcggcacaagcaggtgatacatcctggtcttcaagaagtgggcttaaaattgaattcagtggatccaacaatgagcattgatcttaaatacttgggagtacagttacctttggctccagctactagctttcctttttggaaccttacaggaaccaaccctgcctctcctgatgcgggatttccctttgtttctaggacagggaaaaccaatgatttcactaagatcaagggatggaggggaaaatttcatagtgcttctgcatctaggaatgaaggtggaaattcagaaagttcactgaaaaatcgttctgctttctgtagtgataagctagatgaatacttggaaaatgaaggcaagctgatggaaacaagcatgggtttttcttctaatgctcccacatctcctgtggtgtaccagcttcccactaagagtaccagttatgtacgaacacttgatagtgtactaaagaagcaatctactatttccccttctacctcttattctttgaaacctcattctgtaccccctgtctctcgaaaggcaaagtctcaaaacagacaggcaactttcagtggccgaactaaatcatcttataaatccattttaccataccctgtttcaccaaagcagaaatactctcatgtgattctaggagataaggttaccaagaattcttcaggcatcatctcagaaaatcaggcgaataactttgttgtgccaactttggatgaaaatatatttccaaagcagattagtttgcggcaggcacagcagcagcagcaacagcaacagggaagtcgccctccaggcttgtctaaatctcaggtgaagctaatggacctggaagactgtgcactttgggaaggaaaaccaaggacatacatcacagaagagcgagcagatgtatccttaacaactctacttacagctcaagcatccctcaaaactaaacctatccacacaatcataaggaaacgagcccctccctgcaacaatgacttctgtcgactgggttgtgtatgttccagtctagctttggagaagcgccaacctgctcactgccgccgaccagactgcatgtttggttgtacttgtttgaaaagaaaagttgtacttgttaaaggaggatccaaaactaagcattttcagaggaaggctgctcatcgagatccagtattttatgatactctgggagaggaggcaagggaggaggaagaaggaatcagggaggaggaggaacaattgaaagagaaaaagaagagaaa

SEQ ID NO: 153652 - DNA, 532 bp, Homo sapiens
  Payload ID: 10218
  Gene Symbol: MGA
  Gene Name: MGA, MAX dimerization protein
  ENST ID: ENST00000561532
  CDS Start-End: 1-251
ctgaccaagaagggaataatatttccagttcttctggtcatcgggtccgtcttacagaaggtcaggggtcagagatacaaccaggtgatttggatcctttgtcaaggggtcatgaaacatcaggcaagggtttggagaagacttcccttaatataaaacgagactttcttggtttcatggatactgattcagcacttagtgaagttcctcaattgaagcaagagatttctgaatggtattcttttgcctaatttatttggatagaagagacttctcagaagaatgaaacttaactgtttgtgaaattttttccccaaggcaagatttcattcatcatgtataaagtttttgttggaaaatagaagaaatcctttctgagagtgtttataacttaccaagttcaatttctcaggaagatgtgaaagcagttattgcagtagcagcccagatctagcctcagaggtttcccagctactgcgaacaaatgcatgttgtgtgctaaatgaaaagaagataaaaaatttttttctac

SEQ ID NO: 153653 - DNA, 3521 bp, Homo sapiens
  Payload ID: 10218
  Gene Symbol: MGA
  Gene Name: MGA, MAX dimerization protein
  ENST ID: ENST00000564190
  CDS Start-End: 1-3521
actcacctgtgacttggaggatgattctgataaattacaagaaaagagctggaagtcttcctgcaatgaaggagaatcctcttctacttcttatatgcatcagaggtcacctggtggtcccaccaaactgattgagatcatctcagactgcaactgggaggaagatcggaacaagattttgagcatcttatcccagcacatcaatagcaacatgccacaatcacttaaggttaatggtaagagttacccgcaggctaagttgctattgggacagatgggggcattgcatccagccaataggctagctgcttatatcacaggcaggttgcgaccctcagtcctggacctctcaaccctcagtactgtcatctccaaggtagcatccaatgccaaggtggctgcatccaggaaaccacgtaccctgttgccttcaacatccaattccaaaatggcatcctcctctggcactgcaacaaatcgccctgggaagaatctgaaggcgtttgtcccagcaaaacggccaattgcggctcgaccctctcctggtggtgtgttcacacagtttgtgatgagtaaagttggagccttgcagcagaagatacctggagttagcacaccccaaaccctggcagggacacagaagttcagtatcagaccttctccagtaatggtcgtcacacctgtggtttcttctgagccagttcaggtgtgcagccctgtgactgctgctgtcactactaccacccctcaagtgtttttagaaaatactactgctgtgacacctatgactgctatttctgacgtggaaactaaagaaactacttattcttctggtgccaccactacaggggttgttgaggtctctgaaactaataccagcacctctgtaacatctacccagtctacagccactgtgaaccttaccaaaaccactgggataactacccctgtggcttcagttgcttttcctaagtctttggtagcatctccttcaaccataactcttcctgttgcttccactgcttccacctccttagtcgtggtgactgcagctgcatcttcctccatggtgaccacaccaacttcatctctgggctctgttcctattatactctcaggaattaatgggagtccaccagtgagccagagaccagaaaatgctgctcaaattccagtggctactccacaggtctctcctaacacagtgaaacgtgctggacctcgattgttgttgattccagtgcagcagggttctcctactcttagacctgtctcaaacacacaacttcagggacatcggatggtcttgcagcctgttaggagtccaagtggaatgaacttattcaggcaccctaatgggcagattgtccagcttctacctttgcatcagcttcgaggctctaatacccagcccaacttacagcctgtcatgtttcggaacccagggtctgtgatgggaatccggttacctgctccttccaaaccctctgagactccgccatcttccacttcgtcctctgctttctctgtcatgaatcctgtaattcaagctgttgggtcttcttcagcagtgaatgttatcactcaggcaccatcattgctttcctctggagctagttttgtgtctcaggctggtacattgaccctgaggatttctcctcctgaaccacaaagctttgcaagtaaaacaggctctgaaaccaaaataacttatagctcaggaggacagcctgttggtacagccagtcttattcctctccagtctggtagttttgccttgttacagctcccaggacaaaagcctgttcctagctccattcttcagcatgttgcttcccttcagatgaagagagaatctcagaatccagaccagaaagatgaaacaaactcaataaaaagagagcaagaaacgaagaaggttctacagtcagaaggagaggctgtagaccctgaggctaatgtaataaaacaaaactcaggagctgctacctcagaagaaactctgaatgattccttggaagataggggtgatcatttggatgaagaatgccttccagaagaaggttgtgcaactgtcaaaccatctgagcattcctgtatcactgggtcacatacagatcaagattataaagatgttaatgaagaatatggggctaggaatcgtaagagttccaaagaaaaagtggctgttctggaagttaggaccatttctgaaaaagccagtaataagacagtccaaaatttaagtaaagtacagcatcaaaaacttggtgatgtgaaggtggaacagcagaaaggatttgacaatccagaagaaaactcaagtgaatttccagtcacctttaaggaagaaagtaaatttgaattgtcaggaagcaaagttatggagcagcaatctaatctacagccagaggccaaagagaaggaatgtggagactctctggagaaagacagggaaagatggagaaaacatctgaagggccccttaaccaggaaatgtgttggagcttcacaggaatgtaagaaagaggcagacgagcagttaattaaagaaacaaagacatgtcaggaaaattcagatgtgtttcagcaagaacaaggcatctctgacttacttggaaaaagtggaattactgaagatgccagagttttgaaaactgaatgtgattcttggagtaggatttctaatccttcagccttctccattgttcctaggagagctgcaaaaagcagcagagggaatggacattttcagggtcacttactgctacctggagaacagatacaaccaaagcaagagaagaagggtgggagaagcagtgctgacttcactgttttggatttggaagaagatgatgaagatgataatgagaaaactgatgattctattgatgaaattgtggatgttgtttctgactaccagagtgaggaggttgatgatgtagaaaagaataactgtgtagaatacattgaggatgatgaggagcacgtggacattgagactgtagaagagctctcagaggaaattaatgttgctcacctgaagaccacagcggcccacacacagtcattcaaacagccgtcctgtactcacatctctgcagatgaaaaagcagctgaaaggagtcgaaaggctccaccaattcctctaaaactgaagcctgattactggagtgacaaactacagaaagaagcagaagcgtttgcttattatcgccggacacacactgccaatgagcggcggcggcgtggtgaaatgagggatctctttgagaaattaaagatcacattgggattacttcattcttccaaggtttccaaaagtctcattcttactcgagccttcagtgaaattcagggactaacagatcaggcagacaaattgataggacagaaaaatctcctgactcgaaaacggaatattctgatacggaaagtatcgtctctttcaggtaagacagaagaagtggtcctgaagaagctagagtatatttatgcaaaacagcaagcactagaggcac

SEQ ID NO: 153654 - DNA, 1496 bp, Homo sapiens
  Payload ID: 10218
  Gene Symbol: MGA
  Gene Name: MGA, MAX dimerization protein
  ENST ID: ENST00000619521
  CDS Start-End: 897-1082
agaacttggtgttgggaggtttgtgccaacttggagtggagaattctaattccctaagacatatttgagagaggtgccactgaagtggttttatcataggaatcctttccttttctctaagtttctgatatgccatttgggggaggttttcgatgttctaatccttgtagcatgttttacatggaggcttcaaaattgtgtgcaacctgatggcaagtatttgttttagaagtcattctaaaatcattctggtgtcagtatgagcaaggcagttcacctgttaaccttggggagtaaaggtacacaaacacagtcttttagtggtaaaggacagtaggtgttcttaagggaagatatgttaaagagtttgacagttaacaaaaacgtttaaaggaatcctttagacatccaactactcctatctattaaggtcactaacagatcaagtccagttatataagcttcatacaaattgttcactttgtgtgattttatagtacatacaatagttttttcgtggaattacagatgaaatacctgatgctaggctcttctataacaagtttgaaaatgttttgaacacacaagaaaggcagacaatccatatgttatttttggtttagtggtttagataattttttttctaactatactggttgagatatttgaaatcaaatagggtgatgcactttaaaaacgggtctagaaaatagtgacagcccttgtccctcactccagaattaaacaacaacaaaccatacacagcacattttccaggtacttttatagagaatgactgataaccaagaatcagaatacatttcttgcacaaaactgttggttttgaagaaggtgctgtaaaggcatcagtacttcatgtcactgtattatcactaatgaaatttttatttttattttttttgaggcagagtctcactctgtcgcccaggctggagtgcagtggtgccgtcttggctcactgcaagctctgcctcccgggtttacgccattgtcctgccccagctactcgggaggctgaggcaagagaatggcttgaaaccaggagtcggaggttgcagtgagctgagatcgccactgcagtccagtctggggacagagcaagactctgtttaaaaaaaaaaaaaaaaaaaaaaaaaaagcgtggctttggcctaagactggaagtacccagattccagacttaagaaatcctcattaaaatgctttcagttgtttttcatgaaagaaatgaccagtgatactttgtaaaccatttatctggccatgagtgatcaggtgagaaaaccgttagcggacaccagaatgatctggagaggattagggacggctcttgtgggcacatttttactctagtttcatgggtggagatggcatctgccgtggtctgcagcatgcaagtaaagacaccaggtggcaccatttattagctttcaatcccatggagaggtcccatcatgtaactaccaagaggttga

SEQ ID NO: 153655 - DNA, 1937 bp, Homo sapiens
  Payload ID: 10219
  Gene Symbol: MGAT4C
  Gene Name: MGAT4 family, member C
  Uniprot ID: Q9UBM8
  ENST ID: ENST00000552808
  CDS Start-End: 225-1661
actcatgcttccaggctgcacagagcactgttggatctagctgaacgaattgttttctctgtctctgggtatcaacggtttctgtacagcacagattatgacagcgtctttcttaagatggaatcttggaacgtctcatgcttgggaaggacatggtcagatttgttgtaagaaagactgtgcagaggagtgtggcaaagggatccagaagatgcaagaagagaatgtttaaatttcatcaaatgaaacatatttttgaaatacttgataaaatgagatgcctgagaaaacgttctacagtgtcattcttgggagttcttgtcatttttctcctttttatgaacttgtacattgaagatagctatgttctggaaggagacaaacaacttataagggaaacatccacacatcaactgaattcagaacgctatgttcatactttcaaggatttatctaatttctcaggagccataaatgtcacctatcgctacctagctgccacacctttacaaagaaagcggtatcttacaattggactttcttcagtaaagcgaaaaaaaggaaactatttacttgagacaattaagtcaatttttgagcaatccagctatgaagagctgaaggaaatttcagtggtggttcacctagcagactttaattcttcctggcgtgatgccatggtccaggatattacacagaaatttgcgcaccatattattgcaggaagattaatggttatacatgctccagaggagtattacccaatcctagatggccttaaaagaaattacaatgatccagaagatagagtcaaatttcgttccaagcaaaatgtagattatgcttttctgcttaatttttgtgccaatacttcagactattatgtaatgcttgaagatgatgttcgatgttcaaaaaatttcttaactgccatcaagaaagtcattgcatccctagaaggaacttactgggtaactcttgaattctctaagcttggctacattggtaaactctatcattctcatgatctcccacgtttggcccattttttattaatgttttatcaagaaatgccttgtgattggctattgactcatttccgtggtctgttggctcagaaaaatgtgatccgttttaaaccatctctctttcagcacatgggctattattcatcatacaaagggacggagaataagctgaaggatgatgattttgaagaggagtcatttgacattcctgataacccccctgcaagtctgtacaccaacatgaatgtgtttgaaaattatgaagcaagcaaggcttacagtagtgttgatgagtacttttgggggaaaccaccttcaacaggagatgtttttgtgattgtatttgaaaatccaattataataaaaaaaattaaagtaaatactggaacagaagatcggcaaaatgatattttgcatcatggagccctagatgttggggaaaacgttatgcctagcaaacaaaggagacaatgttctacttacttaagactaggagaattcaaaaatggaaactttgaaatgtcaggtgtaaatcaaaaaattccatttgatatacattgtatgaggatatatgtcaccaaaacacaaaaggaatggctaattattaggagtattagcatttggacttcttagccaattaaatcagtatgttcagtttctgaagcagttcttcctgcttcgtcttttgctacctttgtcttttggagggaaagcaatggatgggatatgttaaaagaaacattaattacattggcagttttcatttatacattgttgacataattttactcttaatacacacttgtatttattttaacgtctgaagttgaatatcagtctatagctaatgctactttcatttatatttttaaatgttcttagttttaaaatttcaactgattgtcgaaa

SEQ ID NO: 153656 - DNA, 2159 bp, Homo sapiens
  Payload ID: 10219
  Gene Symbol: MGAT4C
  Gene Name: MGAT4 family, member C
  Uniprot ID: Q9UBM8
  ENST ID: ENST00000548651
  CDS Start-End: 179-1615
agggtatcaacggtttctgtacagcacagattatgacagcgtctttcttaagcagatggaatcttggaacgtctcatgcttgggaaggacatggtcagatttgttgtaagaaagactgtgcagaggagtgtggcaaagggatccagaagatgcaaggtattatttagaaaagaagagaatgtttaaatttcatcaaatgaaacatatttttgaaatacttgataaaatgagatgcctgagaaaacgttctacagtgtcattcttgggagttcttgtcatttttctcctttttatgaacttgtacattgaagatagctatgttctggaaggagacaaacaacttataagggaaacatccacacatcaactgaattcagaacgctatgttcatactttcaaggatttatctaatttctcaggagccataaatgtcacctatcgctacctagctgccacacctttacaaagaaagcggtatcttacaattggactttcttcagtaaagcgaaaaaaaggaaactatttacttgagacaattaagtcaatttttgagcaatccagctatgaagagctgaaggaaatttcagtggtggttcacctagcagactttaattcttcctggcgtgatgccatggtccaggatattacacagaaatttgcgcaccatattattgcaggaagattaatggttatacatgctccagaggagtattacccaatcctagatggccttaaaagaaattacaatgatccagaagatagagtcaaatttcgttccaagcaaaatgtagattatgcttttctgcttaatttttgtgccaatacttcagactattatgtaatgcttgaagatgatgttcgatgttcaaaaaatttcttaactgccatcaagaaagtcattgcatccctagaaggaacttactgggtaactcttgaattctctaagcttggctacattggtaaactctatcattctcatgatctcccacgtttggcccattttttattaatgttttatcaagaaatgccttgtgattggctattgactcatttccgtggtctgttggctcagaaaaatgtgatccgttttaaaccatctctctttcagcacatgggctattattcatcatacaaagggacggagaataagctgaaggatgatgattttgaagaggagtcatttgacattcctgataacccccctgcaagtctgtacaccaacatgaatgtgtttgaaaattatgaagcaagcaaggcttacagtagtgttgatgagtacttttgggggaaaccaccttcaacaggagatgtttttgtgattgtatttgaaaatccaattataataaaaaaaattaaagtaaatactggaacagaagatcggcaaaatgatattttgcatcatggagccctagatgttggggaaaacgttatgcctagcaaacaaaggagacaatgttctacttacttaagactaggagaattcaaaaatggaaactttgaaatgtcaggtgtaaatcaaaaaattccatttgatatacattgtatgaggatatatgtcaccaaaacacaaaaggaatggctaattattaggagtattagcatttggacttcttagccaattaaatcagtatgttcagtttctgaagcagttcttcctgcttcgtcttttgctacctttgtcttttggagggaaagcaatggatgggatatgttaaaagaaacattaattacattggcagttttcatttatacattgttgacataattttactcttaatacacacttgtatttattttaacgtctgaagttgaatatcagtctatagctaatgctactttcatttatatttttaaatgttcttagttttaaaatttcaactgattgtcgaaagggtaatatgaaagattttaaatgaaaaaaatttgttggatgatgatttttgaaaaatagtcaccaactgtatatacttcctcaagaactgataattcattatatcatcagatagcttttattaagcatctgtgggaatatacagttgggtggaatgataatctggtttattttttctgtaaacttaagtttccgttgacttctgtacatctacaatgaatacctcctcatagaagtggtgtctttacataattttttgtgtaggtga

SEQ ID NO: 153657 - DNA, 550 bp, Homo sapiens
  Payload ID: 10219
  Gene Symbol: MGAT4C
  Gene Name: MGAT4 family, member C
  ENST ID: ENST00000552435
  CDS Start-End: 196-531
agtgccattatgatggatgtttacatctcttcattgagagccaattatctcgcttttgtgtgaggcccaaggatcactcatgcttccaggctgcacagagcactgttggatctagctgaacgaattgttttctctgtctctgggtatcaacggtttctgtacagcacagattatgacagcgtctttcttaagagaatgtttaaatttcatcaaatgaaacatatttttgaaatacttgataaaatgagatgcctgagaaaacgttctacagtgtcattcttgggagttcttgtcatttttctcctttttatgaacttgtacattgaagatagctatgttctggaaggagacaaacaacttataagggaaacatccacacatcaactgaattcagaacgctatgttcatactttcaaggatttatctaatttctcaggagccataaatgtcacctatcgctacctagctgccacacctttacaaagaaagccacatgggctattattcatcatacaaagggacggagaataagctgaaggatgatgatttt

SEQ ID NO: 153658 - DNA, 1423 bp, Homo sapiens
  Payload ID: 10219
  Gene Symbol: MGAT4C
  Gene Name: MGAT4 family, member C
  ENST ID: ENST00000547225
  CDS Start-End: 231-1423
gcccaaggatcactcatgcttccaggctgcacagagcactgttggatctagctgaacgaattgttttctctgtctctgggtatcaacggtttctgtacagcacagattatgacagcgtctttcttaagagacaagttctcactacgttgcccaggctggtgtcaagctccgggcctcaagcgatcctcccacctcagcctcccaaagcgctgaaattacagacgaagagaatgtttaaatttcatcaaatgaaacatatttttgaaatacttgataaaatgagatgcctgagaaaacgttctacagtgtcattcttgggagttcttgtcatttttctcctttttatgaacttgtacattgaagatagctatgttctggaaggagacaaacaacttataagggaaacatccacacatcaactgaattcagaacgctatgttcatactttcaaggatttatctaatttctcaggagccataaatgtcacctatcgctacctagctgccacacctttacaaagaaagcggtatcttacaattggactttcttcagtaaagcgaaaaaaaggaaactatttacttgagacaattaagtcaatttttgagcaatccagctatgaagagctgaaggaaatttcagtggtggttcacctagcagactttaattcttcctggcgtgatgccatggtccaggatattacacagaaatttgcgcaccatattattgcaggaagattaatggttatacatgctccagaggagtattacccaatcctagatggccttaaaagaaattacaatgatccagaagatagagtcaaatttcgttccaagcaaaatgtagattatgcttttctgcttaatttttgtgccaatacttcagactattatgtaatgcttgaagatgatgttcgatgttcaaaaaatttcttaactgccatcaagaaagtcattgcatccctagaaggaacttactgggtaactcttgaattctctaagcttggctacattggtaaactctatcattctcatgatctcccacgtttggcccattttttattaatgttttatcaagaaatgccttgtgattggctattgactcatttccgtggtctgttggctcagaaaaatgtgatccgttttaaaccatctctctttcagcacatgggctattattcatcatacaaagggacggagaataagctgaaggatgatgattttgaagaggagtcatttgacattcctgataacccccctgcaagtctgtacaccaacatgaatgtgtttgaaaattatgaagcaagcaaggcttacagtagtgttgatgagtacttttgggggaaaccaccttcaacaggagatgtttttgtgattgtatttgaaaatccaattataataaaaaaaattaaagtaaatactggaac

SEQ ID NO: 153659 - DNA, 3194 bp, Homo sapiens
  Payload ID: 10219
  Gene Symbol: MGAT4C
  Gene Name: MGAT4 family, member C
  Uniprot ID: Q9UBM8
  ENST ID: ENST00000620241
  CDS Start-End: 1206-2642
agctgaacgaattgttttctctgtctctgggtatcaacggtttctgtacagcacagattatgacagcgtctttcttaagattctgtggacctgactgacactagaaaagccgcagtagcatgtgacatggaagtttatattatcagggtgtgctcacctggttgcaaatttgagaccaaagttttactttaacacttggagctggtaaaggatgttttattcattgtgtttctgacagatggaacaagttaaggttaccttctcaatatgaggactaaagcttttagccaatatttgtggagaagacacatttaagattttcttttgcccatacatgcaatgttatggaggctgtgaccacattttaggcaagaaactgaaagaacatcaagcacctatctggatgtctccaaagcctcatctggataaaatatccaatctatttttcaatcagcctttttttttcctttttcaacctcagacaattgcttttggggtcctagagtcccttgaaagttatgatggaaataggagacctaaagttcaggtgactgaagggctgaagcaggaaggaaaaacgtctgggaggacaggtagacagaggaaagaggtctgaagaggcacatatcaaaagattcaagaaagctgaagggaagattgaaggtagtaaaaggatgaaggaggagcagaagcaatgggaaggaagagatctcagaggactcacttcgggaaaatcttcagtttcccaaagagatcctgaagtctcaaattatccttaacaaaaccatgaccacaagaaaggaagtggagtatacgatcagtgagagtttaagaagggggtttccgttgactaaaaagttaccgtgggagaaataggatcaaatagaacagagttgcctcacaaagaaccaaggaaaatatttcagctcagggattcaagaagtaaattcccactcaaagacagaaacaggaagtaagatttacaattcagccagtaccttcctaacagagaagcatgtgactataccaacttcttacaaaaagaaacaggactaactcagcctctgtatagtgtactcaggctctctcagccctcactgtgcttcaacagacttatcatttggagcactggctcaggagtcgaaatcaccaatggctcatccatcaatcaaccagaagtgaagacgaaagcttcaaagaagagaatgtttaaatttcatcaaatgaaacatatttttgaaatacttgataaaatgagatgcctgagaaaacgttctacagtgtcattcttgggagttcttgtcatttttctcctttttatgaacttgtacattgaagatagctatgttctggaaggagacaaacaacttataagggaaacatccacacatcaactgaattcagaacgctatgttcatactttcaaggatttatctaatttctcaggagccataaatgtcacctatcgctacctagctgccacacctttacaaagaaagcggtatcttacaattggactttcttcagtaaagcgaaaaaaaggaaactatttacttgagacaattaagtcaatttttgagcaatccagctatgaagagctgaaggaaatttcagtggtggttcacctagcagactttaattcttcctggcgtgatgccatggtccaggatattacacagaaatttgcgcaccatattattgcaggaagattaatggttatacatgctccagaggagtattacccaatcctagatggccttaaaagaaattacaatgatccagaagatagagtcaaatttcgttccaagcaaaatgtagattatgcttttctgcttaatttttgtgccaatacttcagactattatgtaatgcttgaagatgatgttcgatgttcaaaaaatttcttaactgccatcaagaaagtcattgcatccctagaaggaacttactgggtaactcttgaattctctaagcttggctacattggtaaactctatcattctcatgatctcccacgtttggcccattttttattaatgttttatcaagaaatgccttgtgattggctattgactcatttccgtggtctgttggctcagaaaaatgtgatccgttttaaaccatctctctttcagcacatgggctattattcatcatacaaagggacggagaataagctgaaggatgatgattttgaagaggagtcatttgacattcctgataacccccctgcaagtctgtacaccaacatgaatgtgtttgaaaattatgaagcaagcaaggcttacagtagtgttgatgagtacttttgggggaaaccaccttcaacaggagatgtttttgtgattgtatttgaaaatccaattataataaaaaaaattaaagtaaatactggaacagaagatcggcaaaatgatattttgcatcatggagccctagatgttggggaaaacgttatgcctagcaaacaaaggagacaatgttctacttacttaagactaggagaattcaaaaatggaaactttgaaatgtcaggtgtaaatcaaaaaattccatttgatatacattgtatgaggatatatgtcaccaaaacacaaaaggaatggctaattattaggagtattagcatttggacttcttagccaattaaatcagtatgttcagtttctgaagcagttcttcctgcttcgtcttttgctacctttgtcttttggagggaaagcaatggatgggatatgttaaaagaaacattaattacattggcagttttcatttatacattgttgacataattttactcttaatacacacttgtatttattttaacgtctgaagttgaatatcagtctatagctaatgctactttcatttatatttttaaatgttcttagttttaaaatttcaactgattgtcgaaagggtaatatgaaagattttaaatgaaaaaaatttgttggatgatgatttttgaaaaatagtcaccaactgtatatacttcctcaagaactgataattcattatatcatcagatagcttttattaagcatctgtgggaatatacagttgggtggaatgataatctggtttattttttctgtaaacttaagtttccgttgacttctgtacatctacaatgaatacctcctcatagaagtggtgtctttacataattttttgtgtaggtgacactatgg

SEQ ID NO: 153660 - DNA, 2582 bp, Homo sapiens
  Payload ID: 10219
  Gene Symbol: MGAT4C
  Gene Name: MGAT4 family, member C
  Uniprot ID: Q9UBM8
  ENST ID: ENST00000621808
  CDS Start-End: 602-2038
cacaggaacaccagattgccatccctggggaacagaatgcaacccgggatctagagagctgtcacattccaagaaatatttaaattgtgctgattttcttctggagaactgagcccagggaatgaaactctccatcaagtcatggctttgcgggcaatagatcagaggatattgccagttttctaatggattattgttatcgggcaggttttctctgaagcttctcagctgctgttacattctacttggatgggaactggagatcagccagatcacttgtatgcacaaagctgctgtggatctgtctttcaaacaagagctgcagaaaacgctatagcaaggttgaagctttatccactctgactcacccagaaagcacagccctgattctgcgtgagaaaggctatctctacagaaactaaaacggtatcaacggtttctgtacagcacagattatgacagcgtctttcttaagcagatggaatcttggaacgtctcatgcttgggaaggacatggtcagatttgttgtaagaaagactgtgcagaggagtgtggcaaagggatccagaagatgcaaggtattatttagaaaagaagagaatgtttaaatttcatcaaatgaaacatatttttgaaatacttgataaaatgagatgcctgagaaaacgttctacagtgtcattcttgggagttcttgtcatttttctcctttttatgaacttgtacattgaagatagctatgttctggaaggagacaaacaacttataagggaaacatccacacatcaactgaattcagaacgctatgttcatactttcaaggatttatctaatttctcaggagccataaatgtcacctatcgctacctagctgccacacctttacaaagaaagcggtatcttacaattggactttcttcagtaaagcgaaaaaaaggaaactatttacttgagacaattaagtcaatttttgagcaatccagctatgaagagctgaaggaaatttcagtggtggttcacctagcagactttaattcttcctggcgtgatgccatggtccaggatattacacagaaatttgcgcaccatattattgcaggaagattaatggttatacatgctccagaggagtattacccaatcctagatggccttaaaagaaattacaatgatccagaagatagagtcaaatttcgttccaagcaaaatgtagattatgcttttctgcttaatttttgtgccaatacttcagactattatgtaatgcttgaagatgatgttcgatgttcaaaaaatttcttaactgccatcaagaaagtcattgcatccctagaaggaacttactgggtaactcttgaattctctaagcttggctacattggtaaactctatcattctcatgatctcccacgtttggcccattttttattaatgttttatcaagaaatgccttgtgattggctattgactcatttccgtggtctgttggctcagaaaaatgtgatccgttttaaaccatctctctttcagcacatgggctattattcatcatacaaagggacggagaataagctgaaggatgatgattttgaagaggagtcatttgacattcctgataacccccctgcaagtctgtacaccaacatgaatgtgtttgaaaattatgaagcaagcaaggcttacagtagtgttgatgagtacttttgggggaaaccaccttcaacaggagatgtttttgtgattgtatttgaaaatccaattataataaaaaaaattaaagtaaatactggaacagaagatcggcaaaatgatattttgcatcatggagccctagatgttggggaaaacgttatgcctagcaaacaaaggagacaatgttctacttacttaagactaggagaattcaaaaatggaaactttgaaatgtcaggtgtaaatcaaaaaattccatttgatatacattgtatgaggatatatgtcaccaaaacacaaaaggaatggctaattattaggagtattagcatttggacttcttagccaattaaatcagtatgttcagtttctgaagcagttcttcctgcttcgtcttttgctacctttgtcttttggagggaaagcaatggatgggatatgttaaaagaaacattaattacattggcagttttcatttatacattgttgacataattttactcttaatacacacttgtatttattttaacgtctgaagttgaatatcagtctatagctaatgctactttcatttatatttttaaatgttcttagttttaaaatttcaactgattgtcgaaagggtaatatgaaagattttaaatgaaaaaaatttgttggatgatgatttttgaaaaatagtcaccaactgtatatacttcctcaagaactgataattcattatatcatcagatagcttttattaagcatctgtgggaatatacagttgggtggaatgataatctggtttattttttctgtaaacttaagtttccgttgacttctgtacatctacaatgaatacctcctcatagaagtggtgtctttacataattttttgtgtaggtga

SEQ ID NO: 153661 - DNA, 25116 bp, Homo sapiens
  Payload ID: 10219
  Gene Symbol: MGAT4C
  Gene Name: MGAT4 family, member C
  Uniprot ID: Q9UBM8
  ENST ID: ENST00000611864
  CDS Start-End: 57-1493
ggtatcaacggtttctgtacagcacagattatgacagcgtctttcttaagaagagaatgtttaaatttcatcaaatgaaacatatttttgaaatacttgataaaatgagatgcctgagaaaacgttctacagtgtcattcttgggagttcttgtcatttttctcctttttatgaacttgtacattgaagatagctatgttctggaaggagacaaacaacttataagggaaacatccacacatcaactgaattcagaacgctatgttcatactttcaaggatttatctaatttctcaggagccataaatgtcacctatcgctacctagctgccacacctttacaaagaaagcggtatcttacaattggactttcttcagtaaagcgaaaaaaaggaaactatttacttgagacaattaagtcaatttttgagcaatccagctatgaagagctgaaggaaatttcagtggtggttcacctagcagactttaattcttcctggcgtgatgccatggtccaggatattacacagaaatttgcgcaccatattattgcaggaagattaatggttatacatgctccagaggagtattacccaatcctagatggccttaaaagaaattacaatgatccagaagatagagtcaaatttcgttccaagcaaaatgtagattatgcttttctgcttaatttttgtgccaatacttcagactattatgtaatgcttgaagatgatgttcgatgttcaaaaaatttcttaactgccatcaagaaagtcattgcatccctagaaggaacttactgggtaactcttgaattctctaagcttggctacattggtaaactctatcattctcatgatctcccacgtttggcccattttttattaatgttttatcaagaaatgccttgtgattggctattgactcatttccgtggtctgttggctcagaaaaatgtgatccgttttaaaccatctctctttcagcacatgggctattattcatcatacaaagggacggagaataagctgaaggatgatgattttgaagaggagtcatttgacattcctgataacccccctgcaagtctgtacaccaacatgaatgtgtttgaaaattatgaagcaagcaaggcttacagtagtgttgatgagtacttttgggggaaaccaccttcaacaggagatgtttttgtgattgtatttgaaaatccaattataataaaaaaaattaaagtaaatactggaacagaagatcggcaaaatgatattttgcatcatggagccctagatgttggggaaaacgttatgcctagcaaacaaaggagacaatgttctacttacttaagactaggagaattcaaaaatggaaactttgaaatgtcaggtgtaaatcaaaaaattccatttgatatacattgtatgaggatatatgtcaccaaaacacaaaaggaatggctaattattaggagtattagcatttggacttcttagccaattaaatcagtatgttcagtttctgaagcagttcttcctgcttcgtcttttgctacctttgtcttttggagggaaagcaatggatgggatatgttaaaagaaacattaattacattggcagttttcatttatacattgttgacataattttactcttaatacacacttgtatttattttaacgtctgaagttgaatatcagtctatagctaatgctactttcatttatatttttaaatgttcttagttttaaaatttcaactgattgtcgaaagggtaatatgaaagattttaaatgaaaaaaatttgttggatgatgatttttgaaaaatagtcaccaactgtatatacttcctcaagaactgataattcattatatcatcagatagcttttattaagcatctgtgggaatatacagttgggtggaatgataatctggtttattttttctgtaaacttaagtttccgttgacttctgtacatctacaatgaatacctcctcatagaagtggtgtctttacataattttttgtgtaggtgacactatggaaaaagaaaaaaaagacttaaaaatatctctcccctgattatttatatgaaaggggatattgttcattgtttaaaaacatttaattgagcacctattgttgataaattttctgggggaagcagtctttttcaagtttcccttttgaaaaaaaaaaagaagagttaagctcaatattttcaggttacattgagtacccacatttaatagaataaattagggaaggcctatagtagttagctcattcgtacagacattttcagtatatgcagaaaatttttggaaattgattttatacattttgtattaaaatccatgtgattgaaattattgtgatttatcatatacctttttggaatttaaatgggtatattataaaggagaaaagtaagaaccatagaaattagttgacttttctagaatcaaagatctatttcctagcaaggccagaatgagagatctgatattctgataaccagacaatgctctttttctcgtatgatttctcctgacagatttatgctttgtgttctatttgctacatgcctgtcagataataagttataccatctggaaataggtggtacaattcctgcataaataatattatcctaaataatgtcctaaatgatgcttttttggtataagcacccaaatagtaagcaaacttgactaaacttttcctaatagggattggagagtgtgtctttacaatgtgtccgttaaagtaattcaggacaccttagtgtgtcctaaagacattggttttcagaatgtcctgagcttgtctcttcctttttgttttttaatgaacagcaaaaactaagggatttattataaagggaaatggaaggtgcttcatatatgtttaagaaactcaagtacgtgttcatatagatgactctgtgtgtgtgtgtgtgtgtgtgtgtgtgtgtgtgtgtgtgtgtgtgtgtgtgtgaaggctagacttttgctggtaagacagaatgaggaaatcttcctgctcttccttttcatactgaaacacaatccttaagatttactggtatgctgtggtgcaaacaacactaggatatttttattttattcgttctctgcaaataaatgagaaactcagataaaaaatggaaactttttatttcatttataaacagctgttgtgtattttctttgtattcagctactaaagtgttagaagaaaaacgaacctttcataagaggctaaatattaatattttgtgaggcacctaaatcttacagtcataggaaaatatgaacactgccactaaattattatctttaccttgatttagaggatacttgccagacacctaaaaatgttctattttctttatttttcttatcttttattaaccggctagttgatagtattgtgtgtatatctcagaagttacaaatggcattattttcttcactgtcaatgataaaaggtacacaattgtatgccaaagacatgtaatatcaagagctaggcagactccctgaaatgagttgtaaccccttacatattcttctgggaatggctttctaaagatcagctattggtgtctatcaatgtcttaaaaatgtttcaagaaacattgctgagggtagcagtgaagttggatgtttgctaggaaattatgaaaacaaatgtgactcagagaggtcatttcacattttatctttatatcctctctttactaaacctgtgtttggataagttggtcaatcatccaaggatcctctatgttttctttacagttgacactgggtcaattttctaaggaaaacaccttgacaaataaagcatcttcattagaggtcaggaggaaaaataactattctctttcaaaagaaaatctgaacaatttttttagcatggcccaatgttctatttcctatatttagaaactttgaataagggtctagtaatcttgtctcagaggcatagaaacaaaagtacagttattaggtttaactatactcaaactatttgctatttttaaacatttttgctgtaagtttatatatatatacatatataatacatatatacatatatataatatatatatacatatatatataattttctttgttaaaaataacaattgaaaaagactggcatgagacatgaatggctgagtcatttaattgccatacaaataaaatgctgacaggtttcaagcaaaaaatacagtatgcaccttaaataatgcctcagaattgtataatttaagctcactaaaaaccttacttagtcttaaaattctccttaggggagccttttcagcagttatggacatcaaagaaaaaagtatcttgtaaaagcacaatgaaatttagaaaatacacattttagtggcaatcacaaatgtcaatataaaagatacataaaatatgttaatgcaagaactttttcatattcattgaaaactataactttgtgctatttataaagtagatattttccaggtatgaaaatataatttggaaaccaacctgtcgtttagatctatttctttcatatagctacactatgagttgtgaacattccatttcttactgggccagtattctctgggaatttttataatgctatcatagaaaaactgttctgtataataattatataaaaaatgaaacaaacattttcaaattgtaatatatgatgtggtatggaaagtacctacatttttagatgctcaaatattggcatatttcatgtcagtatttgccaatttgtcaacaagtttatggcaaagaacatgataccaggattaacattgaaaacactacatccagtgccatctaacaattgaaggaaacagtgtgtaattctcttctttttccttgacaatacatccatcaacacagtaatggcatcatattactgagtaatagagctcacacttaaactttataatatttattatgggatctactgataaaatgatttaccgttttgtacaaattcaactgattttggggggtttcttgtaagatttaatattaattttaggataattttatcctgtttcttttgattcatgatcccaaactttctagatcttgcttctgtcattccacgtcttattatgcctcctcagctttgtgtttcaacaaattttatatgcatgccttttgtcttcatgggagacaaaacagaaggttcatacagacttgattttgacacccagttctgcattaccagcctcccaatatgaggaaatttacttaaccttcttgaaactcagtttctacatctgtgaataggaataattttacctcatatgtttttaaaggtagcaattttaccttgtagctccttgtagagctggaattgagataacataaactaggcacacaataaatatttgtttcctttttatccatgtcacgtatatgtaacaggatatgaccctggaaaacattaccagaggccttcattgtaatcaataacaattataaaatttactgccctttaaaaatgttattcagcctaccttttcatattttgtccagagaatatcatgtggaattatacagacactttcctaaaatcaatatatattcctgtcattctaatttattactctagaaaccttatcaaaaatatcaaaattgcccctagtgctctcatcacaaataataatattcatttctgttttaagaaatcttgatccatttacattgaaaaacaaagaaacataaagtcatttcctagtttctaagatgttgtttagaatctaccttaagctcagaaatgcagtcttcagaatctttttactttttttttttaatgtcaggatccggttctctggcatcttttctatcattggcaaaagttatcaatgcactgacctataaattaccttggcactgatgtttgaaataggtatcttatctgctagtctactttgagtttcattgttgagttttccattactttgaatttctttgttcagattggggttattctttttaggaagaaaaaggccataacaaaattcaatgtgattagttattgccatttattttttgtttgcttttaaactttttttttatttatcccaaacagaggatatatcttttattactttttggcatgctttgaaatgatttcattattgcatatgtgcatgtgtgtatctacatatggttaatctctcaatctgtgtgtatgtatatatacatatgtgtatgtacatatgtgtatatatgtatacatacttgaatattatgtgaatatgtgtgtatatttgtgtatatatatacatatatacatgtatgtatttgtatatgtgttgtgtaagtgtgtctgtgtgtatgagagaaagacagaaggatatgcaccatttgcattattttttagcctttacacctccacttattcttggattttcctgacacactgtcctcctggttgtgttcctcttctgaacttgcttttgctttcatgttctcactcaaatcttttatacatgacatcctttgaaaatcacagcacattagagatctttgtgcatccttttagatactttaaatttattaaaagtgtactagaggaggccatctctctcaaaacagaatttttcttttagagtttcaggtttatggtttttatttgaattctttaacattaaaagatcaaaatatgagttgcatagcattctctttctaagctataaaaatattaagataacaaggttgcactttcccaaagttctagtcccttccacctcattaatctgttcatcacatttactccaagtccagggtagaatttgcttcaataatcccaatattttctgagatgtttaatatcctatttttaacattgaaattgaaatgtatgtttgagaccatttgccagataactggatctgaatatcttttctgaaaaacatggatttgagaccaaagcagtttttgatttgactgttgtttcagctttcatttcactctgtctagacggtctcttagaagatttaccaaaaagttaaattgattatgtgagaaagtgataggtaaattgtatatgaccatagaagtacaattaaattaagaatatagcatgatcaaattttcacattatattggattaaaaagtaccctaagtagccatctccttaaagtaggtgagccaaagacataataataaaatattcaatatttttctataaaatacaaatttccatgaggcacacatacattaaatttaatataaagagaatcattactttatttaagagttgtttaaaggtgcacaacaacagtgagttaccaatattcagaaccttagtctataatttcaatgtactgtaagttactacagctttaaccacaatagctggcataacctaaatcattctgcccaaatacaggtaattatagttttgatgtataaaaattaccaaaataaatgcatatataaagcaatagaggctgagagtgttcataattgaaagctaactattgcaaaaatattttaaatatttaatttatagtgcactcgaagttctggaagagacgtaggatttgtctcttccaccctttccctcactttaccgtttattatgaaggtaccaaaagtatggcacagagatatgtggcagttccacatatctcaatcaacaaagctctaactctattagaaactagacatttaaaaagtactttttttgtaacttcatctgagtcaggtttctcattgaataataatctgtcagttttgtctatagtatgttccaattggaaaatgtttaaggtagtacatgcctcttttctccataaaataccccacatttgtttaactatttgacatagtcctattttttccatctttaataattgataaaattttccctacttttaaacatatgtatgtattttctgccacacttaaactttgttattccacgttgtaacttacttcatcaatgagtgaaagtatagttccaaaaagttagaataattatctcagatcctttatcataattgtccaattatctcagatcctttatcataattgtccatcctttaatgtaatccggttttcaatacaagtaacacttgcattcttacaactgtgcatttttggtcactaaaggaccatgtgacgatatcagtagttgtcaggagttattcactacccttagaaaataaactcggtaatgtaaactatatcccacactttaacaattaatactgttgaatgacattgaaggattgtatctttttttaataaagaagcaatatattaaaaataattaaaactcctaaagtctttttttttgttttagaaatcagtctcaattttcaaaagggcatttgatatctgctaataaaatgaacaaatagtttttctttaaatgaaaatatctataagcttagctgtgtgtagaagtacataataaataagttgtccattttgaataaaaattaaaatcctattaatgcagttgtaacttctcttcttaacatttcttaagctctaaaacaaacataattagacacattttctgttgcatgtggcatctttacccaccataatttggtaatcagtcatatcaaaatcacttacaagaaccaactatttttggaaaaacatttagaaaatttgtcacaaattgtcaagaagattttcaagacatatatatgaattgtctgtaatgtaatggttggggatattttcattaaatccataaaccaatgtatgtatgctgccctctaactttctgctgagttactgtagtcaatggtaaatatagtcaaagtagaaaagacacattcaccctgaatattcccaacaacctatctctcattcaattctgactattgacaaagtactcctttcaattattgtggtaaggaggcctttctgagcatccagatgtgtaaaaataacaacaggggaaatgttacaaacatgaggtaaaaggatgcagaggaaaagttgtacttcatgattttgcctcaagcaagttcttctttcctgtcagcattgcaaattaccatagctcgacttgcttgtattcaagcaaatcaaaacttgactccctgagagggtcaaaagacaattttggtacgtatctagtgtttttacttactagaacaaacaggtcaagtttattcttaatgaagttaaaatttcaaattaaacctgaagctctagtgttttccattttactaagtggataaacacttttctgccatgggatgaactacaatgagatgtttgaattgatttgggcaattgatttgggcaatgatgagtcatgtgtttgctacaaaagtgatacaaaatataagtgtccttcaagttaaagcaatctaaaccgatcatctttgaaaagttaacaacatattttgtaatatttgtttcctagcaaatttttcagttgtccaaaccaaggtaatgtagataaagctacatattttcactcagcgtaccaccaaataactgggtgcccaatagtgttgatctgatgcactactaaaattagttaccataaaaattattttcttttataagaagaaagtgaaatttgtttaattattttgatatcttttatccttatgaatatatatatcaatgttaattttttatgaataattaaatttattataaatgcactaatttttcaacattcttctgattttcatcagtaaattgaataaccattgttgcaatgaaatttacatattgctctcataatatgaaattttacaaggtataatttcacttaacacaaacaatagtcctcataccactttttcattttaactttaatctcattatttatgtgattaagtttgcaattttagccactcatgtgttaggagcaatagagattgacattatgtaggtaggaaaatacatttttagtaacttaagaaacaagttgtacatactatatcaacatttcacattagtgaatttattatcttgctgtataaactttaataaaaacaattatttttatttaaattatttaaggttcctctatttgacttcaaagcaaaataatatctgaattgtacaagcactgtgaatttgtaatagtctaatcacagtctaatcactaaattcaattagtactttactaaatttcttacagtatgctcaggacaaataatttattgaaatgagtatactcaggatggagttattttcatgcaaacttaaaaattacaagacatgtttagaagaattatagctggataacactaaacattcacaagttttaagttagcataaggggatttataagtaatgtgcctacgttcataatcaatttaacagttttcactaacttgacccaataatttagggtgtatttccagaccacaagataaaactaaattttgtccatttttaccagatgattcaaaatttaccatttgattcatttcttaataaaactgcctgtcaatctactagactaaataagaatataaataattcaatattatttatataaacaaaatcaatggaaaatgacaattttatctaatttaatcaatgcctgtgacttagcaaagatattcagttcaatttaacaatctttatgaattaatatttccttaggaattatgtagctaaattatattaataatccatatttattgaagggtaaaggccacagagtgagactaaattatctaggtccagagaaaaggcatctagggcaataaggaaacgaaacaaatataacaaataacttctaatttacagatcacttaatgtaagctcagccaagaacaatgcttactacataaatatgttccaagcaactatgagacactgtgtgaagatttcatgtgcatttcactgtctatttaatagattaaacaaccatataaggtaagaggtattaaaaaagctaaagagcatatgaaaaatagggttttactaacttgtccaaggtcacataactaataaatgaaagagagagcattggatttcaggtttgtgtaattcaaaatctatgccccttatcactattatacattgcctcctaactataataataatttattgaaaacccatttgtctaagatgggattttctggatgatatgactatattaaaataacattaaatagttgaaaaatgaatttaaataattagtttcttcatgtaaaacatttttttctcattttttaaacttgaacatctaaaacacttgcttctgtaattccactgaaccacaacctaatttctgttattccaaaaagaaaataaaaactcatgggctctgggtacactaaaagactccaaaaattataactttgtattaatcatataatagtctttcataacaccagccccaaacataccaaactggtagttagacagtatgtatgcaacattttttgtgtgattaactatgtttctaaatttcagctattatttcggatgttggaaaacatcagtaaaccccaaagttgtgtttattggcctatagcttacatgaactgagtgtttaatatgtatttggtactctcctaatcggtacttccattacctatgaaagtaatgattataacaagtcatcatgcaaaagaatcatcttttcaatatattgaaaatgtgtgtttcagactactgaattcttccctgtaaatctaggatagatctaggaattggcactttcaatgtattttagttaacactgatgcagattgtccattcactccttttagaaacactacattacatccttacaagtctatgaagtattaaaacagaaatgactattattattgctacttcagtgatgaagaatctcaaagtttgagttaagtgatgtatcaaaactctgaccttgttagtgaaatattaagcccagttcatctcaacattattaacctctgctcacacttgtctaaattactagtttttaagtctggctgttcattaacatctctggggaagaatttcacccattcctgagctccatgctcagagttatcataattgttctggagtttccaggcatcagcatacttttaaaattcttcctaagtgatcctaatgtgcagacagatttgacaaccacggagcaactaagactgtaccacagtaaaattccaaaacttcccatttatccagtttgaaagattatagattagaaaacatgatgacaagcgtagattattctgtgttgtttcctgccctttttaggtatttcaatactattattgttgtactgaaaaataaaagttccagtcaatttttatggttttgctgggtttatagagaacactctgcatgccttcctattgaatctgggactctcgtttttggagaactacgtaagtgatctgttttcctgagtcttgacatatgcaccttattaattagagactataaatccactttttaacacataaaatctaatgatgacatctttgtagatattgaaattcaagaatataaacagcattgccttcaacccactgctgtttgtaaactgagctgccttcctctttccacaaaattaactaaacatattcaagaaagaaggagaaaaactatcagttttccacagtggactttttttcataaatccttcaaatgtcagcatgtatgccttgtctcatttagtcatagcccatatgatccaaatctccaatttatttgtttttctttttccaagaactgggtactttaaaaatttgtcaaatttttaaatttcagatagctgaaacagaacaagtcatattgacttgctctaagtgtttaaaaggtttgaggttattgatataggcctcaatatatttccacaaatgaaataatgtatttacatagagatctaaaaagtgtacgaaacttgagatagctatttgagtcaagaaaaacaaggactgtgaatagtgtaaattatgtaaatatacacagataattcacacacacatattcacacatagttccaaggattcccctatatcaattccaactcaaaatttctcagtcatttctggctaaagagaaacatgtccatttaattaaaatcacttttaaaaaatctgatcatctattctttatgagatcaatgaatacattattttaatgctctgtcttatttaaaatatttttctacatagtgttgctagctaaaatgaggcttttttaaataaatggatacacctcaaaataataatttgagatcagtttcatcttggacttatatgattttcagattttatctgcataaaattagattttctggaaaactaatttgtattacttattttctctgtataaaccttgctgaaaatgaaaactaataagcttgaatttatgggttttatgtattttaaaacgtaatgtatagagatttcttataattatttgacagcttcaagataaccagttttttctttaaacattccactgattaatacaaaaagtaacatttttttcatgagatgaaatgaaacttgttcttaggcaaacatcacttaattaaagcaatttatagtgaatacactcaattaactgattatgaacctgcaacaccaaaagatttaccagatttgttcacaattttactgctagctgatatcaaataagaaaaagacaaatcaatgttatatcttcaggaactaataacttttttcatcctgcaagtttgtgaattcaaaaaaactattttcaaataactaagaatttttttattattatactttaagttttagggtacatgtgcacaacttgcaggtttgttacatatgtatacctgtgccatgttggtgtgctgcacccattaactcgtcatttaacattaggtatatctcctaatgctatccctcccccctcccctgaccccacaacaggcccagtgtgtgatgttccccttcctgtgtctatgtgttctcaatgttcagttcccacctatgagaacatgcagtgtttggtttttttgtcgttgcaatagtttgctgagaatgatggtttccagcttcatccatgtccctacaaaggacatgaactcatcattttttatggctgcatagtattccatggtgtatatgtgccacattttcttaatccagtctatcattgttggacatttggattggttccaagtctttgctattgtgaatagtgccgcaataaacatacgtgtgcatgtgtctttatagaagcatgatttataatcctttgggtatatacccagtaatgggatggctgggtcaaatggtatttctaaaagaactaagaatttttaaaaagattttggttatgtaattagagtgcacaatagaataaaacagccaggttttatattttcactggcaaatgataaagagacaactttgattaaatactcataatttttataaaacctccaaagtttcaaagtaggtagatgatgggtaataattaaatagagtgacagtgttatatgccaggttaaaaaaaaaagagacatgcggcttcatccacaagcttagcaaaatatgagaaagtaagaaactgtggccaaatcagataaacataaatgagaataagttgtagaaactgaccttcaagttaataattaaatcagatggtatcattttcctccatctggttattattgtttagatttttaatagtacaaaaataaatgttttatgaattattttggatgcaattacagtaaataaccataatataaaatgtctcataataggaaaataatgcctgacacttttaattacttaacatacctttttatacattttttaatgtcatttatttggcagctatttaaggagtgccctctgtatcctgggccatctctttctatccagagtcctacaagtcaccttgtatcattattaggatatagtataaaaatttgtccacttttaaatggagaaataatacagataagtaaaaaaatgatgtaataatttgagttctgtacatgactcagagacttggacagaattgacaattctaagtttttaagttaaaccaaagctgaaatttctaatcatttagaagctaggaaaagttctgtttcaaattcaattgatcacttcatgaacagtttgttcataattacttcttctctgcctttcagcgtagtcttgttcaattgttcagagtgtccttttttttttttttttttttttttgagacagagtctcactcttttgcccaggccggactgcagtggcactatctccgctcactgcaagttccacctcctggggtcacgccattctcctgcctcagcctcccgagtagctgggagtacaggcgcccgccaccacgcccggctaattttttgtatttttagtagagacggggtttcaccttgttagccaggatgctctcgatctcctgacctcgtgatcctcccgcctcggcctcacaaagtgctgggattacatgcgtgagccaccgcgccgggcccagagtgtccttattcccaagttcgtgattttcataatagtaagagaacaaaaaacaaatcttacaagcaataaattttataaatagtcttctcttaagatgcagaacaccaacatggcacatgtatacatatgtaacaaacctgcacgttatgcacatgtaccctaaaacttaaagtataataaaaataaacaaataaataaatattcaacacctcactctaattggaaaggaaatgtgcctacagaagttaaagcacattctatgagttttaatcttaggtgccaagaaggatccatgacctccacatttgacagagaatagaaagactccacggttttcatcataatccaagggaggtcagtaatagtttatttgcatttctcgagggctctctggggcctcactatcttacataaaagtgagtttaatcataggactttcagacattagcccacagatgggacatatattttgggatggagaacttttaataaatcacattacctaggtggcctctcattctacttctccatatggcagactctgtaggaaaaaaaaatgcttcctataatgtttcttctttaccacagaactgtcagaggaaacagccgagaaaaacttaaaactaagctacaatatttggcaaaaataatggtagttttcagaggagaagcaatttttctggcgtatatgtaggataagagtatcttaccttccttaaataatgttatctttaccagtaaacatgatgtatttgccttaacctagtcaatttcctttacctgaattcccttaagtttaaaatcataatttttcaagataaggttctagtcttaggaatgttgcttaagaacctgaaatagaatgatactattatttcatcctggtattaaaatctctaaaattttctacaaaactaacattctatgtgttctgtggccaatgtgataataaatccttgcataacaacagagaaaaatatcctatacatttgtcttacatttttgcaaaataaagaaaatattttggaattaaactaatttcaaaatccaagaatttctatgaaagaattttttagcagtaaccacagatgaaaagaatatcatttagtatctcttcatagtgtctttataacataatctaatcattggtgttttataatctttcataatttttcatatatttgataaatcctgatgttgggtttatttctgttgaaacaccagtaattgttttatgtcactttgacttttttctatagttttgttttctgcttgtttatctaaattatcatcatagttgtaatctgagaactaggcaaacataggtacttttgactatcactttggggtgatactatttacccaatatgattttttcccattttactcttgaagtatcctgttgcttactcttttgtgtatgcatacatttgaaacatatgacctcccaagcattctactttctcttattttacttattgtgttggctttactgtttatgtatgatttaacataaataattattttgttttctctctcccatcacccaccccatttacacgttacaacaagacttcatcagccctggggtcatgatttgaattatattatctgtgccattaaacaaccttgagcctcaataatatctgttcagattttttcaatggctattgttcattgataattacattctggggacatgccagaatgaaatctcatggtttctcagccacaaagatttgttaagaatcaaattcaaaggtatttgacttggtatttatgattcatggcaaacccaagcataatctttagcagatctttaagcttcctgagcttataagcaaactctgtgtgtgtctgtgtgtatgtgtgtgtgttcctatgtgggtaaatttttcttgatagcatctctgtgctttcatcattatcaaaaagtttcaggaccccaaaatggttaagaaacactgactatgtgctagttacatttcaagaatatatttctacataaaaatgttgtatttattctaaaggcaaaagccatggaacaatgtgtacttttaaaatatttatgaggaattaaaaattcaattattataatttttccattttaaaattttaggatgtgattttgtaatagcctccaaaaaacatttaaagcacccaagtaattaaactagtaaaagttccttataaaccagaaagcaaaactattttccaaatgggcaataaaaatattacttttgcatgtaaatagttgtttaagtgaatttattgtttatattaattaaattcttttggacaatttgccacttaaaaagatcagtgtttgaactctaggaaatacttgtttatgtaattttttttgcaagtaggtaagaaaagtatatttcattatcaaatagctaccctgcaatactaacataaacagctatttacccatttagacttaactattcagtcaattacacaacagtcttaccatgttatttaatgagtggaacaaaaataaaggtctttataacagataaaatatttcatttatataatgaaataaaatatcttgggattaataaaaataatgatttttttcatcctatgtaaaatgtagttgatagcactgatatattaataatgttatgggtgaagtttacagttcattacaagttgaatgtacttaaacaatctacatccttcactccttcattcaatcatttaattcagccattccttatttgacaaatgtgatttgtcaaatcacattactaaatgtattatacatttagtaataaccatacatatcatgttgaattgttgtgaggataaaaaagtaaacaatgttcaattattgttaatattttattttataattaattataaaattttatataattatataattatataattaattatataattttacttcattggatgttgtaaattgctctggtttagcctttagacatttgaatcaaaatggtcaaattagtctctaaattcagacattgactttgttctgcagatctcaaaacgaaagatatgttgggatatttagaccagaatgcatgtgaaaatactacatgaatgaatgtatttgacactgatcttgagatgacaatctacagtcctacaataattattctaactccatgttctctttcgtgcacactagctagagcacatctcacccactgacattggaatctatcctttcgtaagttatttttaacgtcttaggatgacttttataaattgaagatttaagagtttctaaggggactgtaggtatattctactgttgtgtttaccacatgttccattcagatacacaaaagaaatgaataaaactggacatagcacacagtctcactgctttgatgggcaatgatttttgacaatgggtaattaactcttacatcattaagttccatcgtcacagaataaccttagaatcctaataaaatcccacggcttcaaattgtatttaatagctgccaatccaagcctcctgactatgctaatctattatttagaataaatgaaaagtgtgtatcaatttgcctattataatacaaagtgggaactctcatgccaacaaggttaggccagaaaaattcaaataaattggagatgtgttttgatacattttcttccgttgctcttattgtatctgacatggaaatttccttagggtgaagtttatatagtgacaagcatatacaatattcttgaggtattaggccacagtcagaaaaagagaatataggaggaattatgtggtagaggatgataaaagattagaagttgaaactataccatatataattttatatatatacataattatcttgattataacctaaattgtaaaatctcaatattattagtaccatccccagacacattccctttgtttcttaaatttttactctccaaaaatgggaatcacagaaacagaagatgcttaaatgttcatgttaggcatttttttctgagctcataaaagattatttgatcatttaatgtgtttttctctccaataagactgtaaaaagttcagtgtttcgaggctgctaaacaatgcccatagagttgacagtctcaagaatgactggaaaatgatggagttggatgctataggtcatactttataaatctgactgaaggagaattagaatactaatgagagtcaacaacaattttcttacctgctcccaatttgtaattcttgccctggtggcacatatattacaaggagaatattgttttcaaatttatagtcagaaagtcatttaggtgactgactttgttttttaaatagtaagttgactgtcttgtttaaaaatgcatagtgccctggaaagttatgtgaatacaatgatttattttaagtaaagggtagttttataaaataaagtgccaaacatcatataaataaatatttacaggctcagtatcaatcaaatcagtggtaagagtgaattttttcaatgtatgactttcatatcaaatttttttttggtgattcagcttaataggagtttatggtatgggcccattcacgttatatccaaataaacaaaaattatctagagttgttcatgccatcatttccttcagcacagtcttcaaagtagttttctcattacccactttgaaagatatttccaaggagaggataatgcaacccattctatatgtgaataatgggtgggacacaggccaataatcatgatccaaattagtctgaaaatcaaaggagtaaggggagaaaaaaagaatgaaggattaattgatttgctgagagcatgtcacatgctaattgttgttttacatttttcatctatgtctctcatgtgattcagaccacaaatctgtgtgataagtattgttatccttattctaccaatgacgacacagtagtgaagtcataattcagacttgaaattctgtcttctctcaattttcatcccaaaattagatatcctcgatgccagttcggattctcttattcaatgagaaaatcacttccttttcggcccttgtcatctttgtctgtataacaaggggataagacaaagacgtttgatgaaaatttcttcaagttgtatcatgtttttattcttagtgggtagtcctttgtaagtctgcatacggctggctggtgacacaatgtgggcaccatagaccgaaaaataaaattactgaaaaggcgaagtatactttccaaaaattagactctaatcaatgtagtccgtgcaacaattttctttaataccgaattgcattttatatagctatttgcacagatcttcacaataaaaccataagaaaaggagaataggatattatcttcacagttctacagaggagtaaaaaaactgaccttgatctaaataagtttagaggtggattttaatcctttaataagcaaaagacatataataaaattgataaatgacaatatcaatactttatctaaaagtaatttcataaagaaacaaagccaaaattgattcagttaacataaaaaagagttaacccagaagaaaacaatgaatattgatctcgatttcagcaagcagaaaataaaaaaaaaaaaaaagcagaaaaaagtgagaaattgttaaggtgagtgaaagatgagcggcggttgctctgagaaactacaacacaacttatttattcaagtggctgggtcagatttaaagatgtgatttcaataacttttttgaatagagtgttgtacctttgtctaaagtagtaaaattcatttgaattaaagctgaatatgggttttcctcctcaaatccaattcaattccaaggtttgaaattgcaggggctcctgagaagaaatggcaaaaataaaaaagagaaagagagagaaaggggaagagaaaaggaaaaaagaaaaatctataacttgaagccctgtaaagcaaagatttaccaaactttagattttataccccctcttttttcagcatatccaaataaatttacatgatcttatgagtgtaaatcttctagtcttcatgagatttttccagcttttctgccttttagattgacatttctagttgcttaaggtttcttcttcaaagcaatgggtataaaacatgtgattattattaaacagttatggaaaataccatctttattccaccactttatcaggtagaacttgaaggtaaaataaagtttggatgctgagtctacatgtattgtattgtattgtattgtattgtattgtattgtattgtattgtattgtattgtattgtatagtggttaccagagatttaataacatagcagaagtaactgaatcgcctcctctgccctatgcacttgtattttttttatttcaaaaatgccaggaagataagtgtatgcaaaaatataaagtttgtaaaattttatacaacttaatctatttgatcattagttaagtaagcttaactaaattaaaaatgtattttattgctactttttttaactctctaaagaatacatttatgtttttgaaggagctttaatttagtaacagttaatctttttattaattttagtaaaaataatcatacccttttaataataaaaattaaactttaagtctttaaaattgctagttgtaagtgaatttgtcaaagattaattcatagttgccaacacttactgaacaggtagataaaattaactttgtttatttaacaaataacttggtgctttctagttagtttaaaaatatcaataattgtttcctcacatgtatttatgtccttccttcacagcatatagtcaaccatagagactcaatgtaaagtattatgataatttatatgtctgagaaaataagaagattgattcattgaaaagttaaatgaatttgagatacaggtatttctgactgcctagttacactgtatgaaatactttaaaaactggccaggcgtggtggctcatgcctgtaatcccggtactttgagaggccaagaactcctgaaatcaggagctcaagaccagcctgaccaacaaggtgaaactccatctctactaaaaatacaaaacattatctgagtgtggtagagcacgcctgtggtcctagctactcaggcggccgaggcaggataatcacttgaatctgggagtcggaggttttggtaagcagagattatgccactgcactccagcctggacaacagagcaagactctgtctcaaaacaaaaacaagcaaacaaacacacacacacacacacacacacacacacaaaaacacttagaaaaactgtaaacaattcagtcttgtatttggaagaatggtgacttgtaaattttgctgtacattaatgacaagtctctcactcaaataaagataacctaagtaaaataatttatgtcagatgaaaacattccaaattttcttggagaaaaagcaacaaaagccaataaataaaggtggttcccattacctatttaattatttaatatcttaaactattattaaatgcatgcaccacctgcactaccctgaccgattaaccccttagctgaaggagttcagtttgtatttttaccatatgatctgtctagattcactcttttcaggattgatagattttttttttcttttttcttttttttttttttttgctttcttattcaactctacagtaaaagaaaatctgtggttttatttgacataacagagctatcttcagccatagctagaaggaggatagtaggataaaggtcaatttttgtcttccttcacagctaacagatatatgtagcatgcttaataataactctcaaagtctgttgctcaacctcccaaaccattaatttccttctagccactgctagagttcatgcatgtcatgaaaggaaggctagagggacaatttctgtatgcatatctctggcccatgcccttcaatgagacccaaatataattaatttctgggatttttgcaataaataatatgagatgacctcattatagaatgaggggcaagatccttggccttggtctttcacaaataatatgactttatttacagatgaagaaaataaaataaaaattaaacataaactttcctcaacttcctgcttttagcccaggtagcatgttattactatttcttttataaacaactgagttctgactaacagtctttaagaggagctgctatgaggaaatatagataataacaaaataataacatatttttaaagctttgccagcagcaaagggctcgcatctacatactctcattttatgtgtccaaccaatggttccacatagccatgaaatcagctgttacaataggaagaccaccactgaacagttttgtaactcatttcagaattgactttggtatgtgcttattggtgtatttctgtgcttgtgtcaattcaacaaagcttcccaagcaaggttacttcaaacattacttgggccacggtaaaagaaaaataaaattctgttgattcagagtcaccttcaatctcatgtcataaattatgtttctctagtctttgatattgtttcacatgtgcatgattagattggttgaggatagactttgggctcatgatttattgactaattatgtggttttcccactgtagcttgggttaaatcttacaagacaggctgaaaactgaaattgttatgacatttttgttttctctacaccataccaagtaatgctgtttgattgaatcaaatattttctaaagactaaatgtaatccaaaaaatgatctgtaaatgttcccaacaggtgtcccaaaaccatattttagtaagtttttcaattggtccaacagttctataaattttaccttgaggtaactaaaatggaaacataatgaatatattatctctattgtctaaggacaaacaaaacaccgaagttattgagaatcagattcccatgttagcataaatgagtcacctagttttttcaacaaaaccaagtaataaataaatcaacactttcagttttctgccagtgtcacagatggcagccaattggtttgattaaaaatctgatgcttgcatgtttgcatagtaaaagacagggttttcaggaaaaaatcattatacttctcactgtgttccacacaatgttgaaggttatgtccaaatttgaaaaacaaatccaattaaactagctaccatacaaatatatcttttgttattgaaagagtgatttcagtcgtgatttttcattaatctagttttgtaaaaatcagacttcctgtaaaccaattgaaaacctctacattttactatatgtattcatggacttaatttcatcaaaaataccaatattctctgtgccctaacaagtgtaattgcactaaccttgtagttgatatttactgattgaaatgtatatacacaaaaattatgtaaaactgattatctagaggtttcttcattagctagcacaaatagttattgtaaacctttgtcctgtatttttttaaagtctgcaacatggtgaaccagtatgcttgatggctttaatacctgtgtctgcaatttattattcatttgaagcaacaaattcagaattgtttgaaattatgaaggctaaacagcataaatacattgtggtttcttttataaat

SEQ ID NO: 153662 - DNA, 1125 bp, Homo sapiens
  Payload ID: 10220
  Gene Symbol: MGAT4D
  Gene Name: MGAT4 family, member D
  Uniprot ID: A6NG13
  ENST ID: ENST00000511113
  CDS Start-End: 1-1125
atgaggaccaagcaggtgaacttgctgatcaccctggtcgccgtcgcgttgttcagcttctcttgcttctccatctacaggataactcaaaccaataatcaattaattaactgtagaaaccatattttggagtttaaagaaaatatgctacacttaagaaacaaaactgaaaaaaatacccaagagatgatgaaagttttgaatcgaatgaagtatgaaattacaaagagagaaattttgtcaggaaacttagttgcacagaaagcagacatattaaataaaaatgaaacagtatctaatacatttgaagacttaaagttcttttttcctcatctaaggaaagaaggtagaatttatcctgatgtaatcattggcaaagggaaaactggtgtttcttttgcgctgggtatttccactgttaacagaggaaattatagttacctgaaacagacactgacctctgttgtctccaggatgacgctctcccaagagaaggattctgtagtgattgtcttggttgcagatagtaatgaagattatttacattctgttgttaaaatgattacaaaaaaattcaaaaggcaagtgaggtctggatccttagaggtcatttcaatacctgcctttttatactcaagcatgttaaatgccaagcacttagctgaggcctcacaaaaattagccagttggcgaatcaaacaggtattggatttttgcattttgttgctgtatgcccaacccaaggccaagtattatttacagctagaagatgatatcatagctaaagagatgtactttacaaaaataacagattttgtaggtaatatcagttcaaataattggttttttattgagttttcaatgcttggattcataggaaagctgtttagatctgaggacttaactcactttgtacggttttttttaatgttctacaaagagaaacccatagactggctcttgaatgacatttttcaggtaaaggtgtgtgacgcaggagaagatcttagaaactgtatgaaacgaaagaagcaaatacgtattcagtataaaccttctcttttccagcatgtgggtatacattcatcattccctagaaaagaacaatatgaaaaaaaaatatga

SEQ ID NO: 153663 - DNA, 492 bp, Homo sapiens
  Payload ID: 10220
  Gene Symbol: MGAT4D
  Gene Name: MGAT4 family, member D
  ENST ID: ENST00000513018
  CDS Start-End: 1-274
taatatcagttcaaataattggttttttattgagttttcaatgcttggattcataggaaagctgtttagatctgaggacttaactcactttgtacggttttttttaatgttctacaaagagaaacccatagactggctcttgaatgacatttttcagagaaactgtatgaaacgaaagaagcaaatacgtattcagtataaaccttctcttttccagcatgtgggtatacattcatcattccctagaaaagaacaatatgaaaaaaaaatatgaagataaataagaagaaactctgtaatacctggaacctcagataaccttgatatctaatggcatgtttcagaaattgtagtaatgaaaatacataattatctagcagataagtaaacaatgcataaactagtagacttgaaagtactaaatgacttcttatgtcaagacaaggtagaacatttatattgcttttaccctattacaatttaatttaaaaa

SEQ ID NO: 153664 - DNA, 1806 bp, Homo sapiens
  Payload ID: 10220
  Gene Symbol: MGAT4D
  Gene Name: MGAT4 family, member D
  ENST ID: ENST00000515354
  CDS Start-End: 132-632
aggcggcttcccagggcgggtgtgctggggacccacgcggcaccgcggggagggggctctgcgcgctcaaccccgtccctggcattatccgccgcctccacccgccggcctcccgcagcctggccagggccatgaggaccaagcaggtgaacttgctgatcaccctggtcgccgtcgcgttgttcagcttctcttgcttctccatctacaggataactcaaaccaataatcaattaattaactgtagaaaccatattttggagtttaaagaaaatatgctacacttaagaaacaaaactgaaaaaaatacccaagagatgatgaaagttttgaatcgaatgaagtatgaaattacaaagagagaaattttgtcaggaaacttaggaaagctgtttagatctgaggacttaactcactttgtacggttttttttaatgttctacaaagagaaacccatagactggctcttgaatgacatttttcaggtaaaggtgtgtgacgcaggagaagatcttagaaactgtatgaaacgaaagaagcaaatacgtattcagtataaaccttctcttttccagcatgtgggtatacattcatcattccctagaaaagaacaatatgaaaaaaaaatatgaagataaataagaagaaactctgtaatacctggaacctcagataaccttgatatctaatggcatgtttcagaaattgtagtaatgaaaatacataattatctagcagataagtaaacaatgcataaactagtagacttgaaagtactaaatgacttcttatgtcaagacaaggtagaacatttatattgcttttaccctattacaatttaatttaaaaatactaaaggcaaggaagttttttttaaattaagaactgcactttattgacttcgatagtgagaccatcacataatctcaataaacagttaaaagttcgaaagcttgctattgtcagggagaagtttggggtgaattggtatatgccgttatccattttgttaagacacctaaagaaatagaaagcacaaatttaaacaagcctggatctgacagtgccacaatgtcttcttgtctattaatagatgcatttaaaactataaacttatccctatgtgccatttgaaccgattatcaaacatcttgatatatatgtattcttatagtcatttagttctaaagatttcatagtttctctcatcattgccttcttaacacacagattatttgggagtttttttcccaaatatattggttttctccatcttttattgttaatttctaaattacttgcatagtggttatagaactttacctgtgtgataaaattttgagaattgttgtgaatccttgtgttccatatgactttggaaagaatgtatagtttctgtatactcccttttaaatatgttatattcatttgtttttaaaagtgttggttttgtgctttaaaaatatctcttaaaagtattcctatctattgggtgcaaaattctcttatatcaggctttctaatttggttgttgaaaacttttcactccttactaatttctatatgcttgatccatcagtttctacaggggcccattaaaatctatttttcttcttgatgttattctgtaaggtattacttattttgagcaataataagtgatatttatttgttatcctttaatcaaatattgtgaaattcttcatttcccattgttgccttattcttgagtgccaagatctcacacattcgcctcagtatgaactgtatcaaataccaatttataaagataatatgaaagacgaa

SEQ ID NO: 153665 - DNA, 448 bp, Homo sapiens
  Payload ID: 10220
  Gene Symbol: MGAT4D
  Gene Name: MGAT4 family, member D
  ENST ID: ENST00000515402
  CDS Start-End: 109-448
gctggggacccacgcggcaccgcggggagggggctctgcgcgctcaaccccgtccctggcattatccgccgcctccacccgccggcctcccgcagcctggccagggccatgaggaccaagcaggtgaacttgctgatcaccctggtcgccgtcgcgttgttcagcttctcttgcttctccatctacaggataactcaaaccatttcttttgcgctgggtatttccactgttaacagaggaaattatagttacctgaaacagacactgacctctgttgtctccaggatgacgctctcccaagagaaggattctgtagtgattgtcttggttgcagatagtaatgaagattatttacattctgttgttaaaatgattacaaaaaaattcaaaaggcaagtgaggtctggatccttagaggtcatttcaatacctgcctttttatactcaa

SEQ ID NO: 153666 - DNA, 810 bp, Homo sapiens
  Payload ID: 10220
  Gene Symbol: MGAT4D
  Gene Name: MGAT4 family, member D
  ENST ID: ENST00000515121
  CDS Start-End: 149-259
gcagaagttctgtggcaaggcggcttcccagggcgggtgtgctggggacccacgcggcaccgcggggagggggctctgcgcgctcaaccccgtccctggcattatccgccgcctccacccgccggcctcccgcagcctggccagggccatgaggaccaagcaggtgaacttgctgatcaccctggtcgccgtcgcgttgttcagcttctcttgcttctccatctacaggataactcaaaccaattcaaaaggcaagtgaggtctggatccttagaggtcatttcaatacctgcctttttatactcaagcatgttaaatgccaagcacttagctgaggcctcacaaaaattagccagttggcgaatcaaacaggtattggatttttgcattttgttgctgtatgcccaacccaaggccaagtattatttacagctagaagatgatatcatagctaaagagatgtactttacaaaaataacagattttgtaggtaatatcagttcaaataattggttttttattgagttttcaatgcttggattcataggaaagctgtttagatctgaggacttaactcactttgtacggttttttttaatgttctacaaagagaaacccatagactggctcttgaatgacatttttcaggtaaaggtgtgtgacgcaggagaagatcttagaaactgtatgaaacgaaagaagcaaatacgtattcagtataaaccttctcttttccagcatgtgggtatacattcatcattccctagaaaagaacaatatgaaaaaaaaatatgaagataaataagaaga

SEQ ID NO: 153667 - DNA, 1281 bp, Homo sapiens
  Payload ID: 10220
  Gene Symbol: MGAT4D
  Gene Name: MGAT4 family, member D
  ENST ID: ENST00000503109
  CDS Start-End: 1-1128
atgaggaccaagcaggtgaacttgctgatcaccctggtcgccgtcgcgttgttcagcttctcttgcttctccatctacaggataactcaaaccaataatcaattaattaactgtagaaaccatattttggagtttaaagaaaatatgctacacttaagaaacaaaactgaaaaaaatacccaagagatgatgaaagttttgaatcgaatgaagtatgaaattacaaagagagaaattttgtcaggaaacttagttgcacagaaagcagacatattaaataaaaatgaaacagtatctaatacatttgaagacttaaagttcttttttcctcatctaaggaaagaaggtagaatttatcctgatgtaatcattggcaaagggaaaactggtgtttcttttgcgctgggtatttccactgttaacagaggaaattatagttacctgaaacagacactgacctctgttgtctccaggatgacgctctcccaagagaaggattctgtagtgattgtcttggttgcagatagtaatgaagattatttacattctgttgttaaaatgattacaaaaaaattcaaaaggcaagtgaggtctggatccttagaggtcatttcaatacctgcctttttatactcaagcatgttaaatgccaagcacttagctgaggcctcacaaaaattagccagttggcgaatcaaacaggtattggatttttgcattttgttgctgtatgcccaacccaaggccaagtattatttacagctagaagatgatatcatagctaaagagatgtactttacaaaaataacagattttgtaggtaatatcagttcaaataattggttttttattgagttttcaatgcttggattcataggaaagctgtttagatctgaggacttaactcactttgtacggttttttttaatgttctacaaagagaaacccatagactggctcttgaatgacatttttcaggtaaaggtgtgtgacgcaggagaagatcttagaaactgtatgaaacgaaagaagcaaatacgtattcagtataaaccttctcttttccagcatgtgggtatacattcatcattccctagaaaagaacaatatgaaaaagatgtctattaggagtttcatgtttctaaagctttaaaaagtatcaaaatcattctttggaaataatgacataataagaattagactatttctcaactttcttaagcgactacatcatattttaaaatattaatccttcaataaagtggcaagtataagaaaatt

SEQ ID NO: 153668 - DNA, 2010 bp, Homo sapiens
  Payload ID: 10221
  Gene Symbol: MICA
  Gene Name: MHC class I polypeptide-related sequence A
  ENST ID: ENST00000400322
  CDS Start-End: 1153-1890
gtatcatttcagtgaaggtcactccagtctttcatggaggccaaactaagggtgtaaattaggatcctcactgaagtggcgggaccctaagaggctttttcctggccccttagttgtgggttttcctgcgggcggcgcagccggtttccatcagaaccgcccagaggcggacgctgccttcctggggtgacggagcagcaggaagcgttttcggatcctggaatacgtgggcggcccgtgggaggggctgaggcgcagtttcctactcacccggatccgaatcctccgcggtgctgtttcaagagagccggattccagatcgcgctccagcccggactcggaattcctgccctgcgggtctgcattttcataacgggcaggtgtgagtgccctgcagctggagaccagaagcctgaaggcagctcggccctccccagcccacagcgccgttattccgtttctatatcagtaaacacatttcattttccgtagaccagggcggggtgacgggtgatcccagtcctcgcagtgaattccgggcagcaaaattcaaaacacatgcggccaaggccgggcacggtggttcacgcctgtaatcccagcactttgggaggtcgaggcgggcgatcacctgaggtcgggagctcgagaccaacctgaccaacatggggaaatcccgtctctactaaaaatataaaattagacgggcttggtggtgaatgcctgtaatcccagctagtcgggaggctgaggcaggagaatcgcttaaaccttggaggcggaggttgcggtgagccgagatcgcgccattgcacttcagcctgggcaacaagagggaaaactccgtcgcaaaaactttcgggggcggagcggagccccgccctgggttatgtaagcgaccgcgctgggccgtttctctttcttttccggaccctgcagtggcgcctaaagtctgagagagggaagtcgcctctgtgctcagccccacagtcttcgttataacctcacggtgctgtcctgggatggatctgtgcagtcagggtttctcactgaggtacatctggatggtcagcccttcctgcgctgtgacaggcagaaatgcagggcaaagccccagggacagtgggcagaagatgtcctgggaaataagacatgggacagagagaccagagacttgacagggaacggaaaggacctcaggatgaccctggctcatatcaaggaccagaaagaaggaatttcttgaaggaagatgccatgaagaccaagacacactatcacgctatgcatgcagactgcctgcaggaactacggcgatatctaaaatccggcgtagtcctgaggagaacagtgccccccatggtgaatgtcacccgcagcgaggcctcagagggcaacattaccgtgacatgcagggcttctggcttctatccctggaatatcacactgagctggcgtcaggatggggtatctttgagccacgacacccagcagtggggggatgtcctgcctgatgggaatggaacctaccagacctgggtggccaccaggatttgccaaggagaggagcagaggttcacctgctacatggaacacagcgggaatcacagcactcaccctgtgccctctgggaaagtgctggtgcttcagagtcattggcagacattccatgtttctgctgttgctgctgctgctatttttgttattattattttctatgtccgttgttgtaagaagaaaacatcagctgcagagggtccagagctcgtgagcctgcaggtcctggatcaacacccagttgggacgagtgaccacagggatgccacacagctcggatttcagcctctgatgtcagatcttgggtccactggctccactgagggcgcctagactctacagccaggcagctgggattcaattccctgcctggatctcacgagcactttccctcttggtgcctcagtttcctgacctatgaaacagagaaaataaaagcacttatttattgtt

SEQ ID NO: 153669 - DNA, 1675 bp, Homo sapiens
  Payload ID: 10221
  Gene Symbol: MICA
  Gene Name: MHC class I polypeptide-related sequence A
  Uniprot ID: Q29983
  ENST ID: ENST00000400325
  CDS Start-End: 404-1555
gtcgcctctgtgctcgctagtcaagtgaaacagtgggagtgaagaagaaacaaagacatctataactggttgtgatcaattagttgtaaacactgcactcagaccagcctgggaagattttaaggatatggtgtggtctgatgggttccaaggcagaggttacaatagcctggaagagggagactgcttaggcagtggcatcctggtgggatagggtctccagcccactggaattttctcttccaagcgtggccccgccctctccgctcgtgattggccctaagttccgggccccagtttcattggatgagcggtcgggggaccgggccaggtgactaagtttccgcggcgccttctccccggccactgcttgagccgctgagagggtggcgacgtcggggccatggggctgggcccggtcttcctgcttctggctggcatcttcccttttgcacctccgggagctgctgctgagccccacagtcttcgttataacctcacggtgctgtcctgggatggatctgtgcagtcagggtttctcactgaggtacatctggatggtcagcccttcctgcgctgtgacaggcagaaatgcagggcaaagccccagggacagtgggcagaagatgtcctgggaaataagacatgggacagagagaccagagacttgacagggaacggaaaggacctcaggatgaccctggctcatatcaaggaccagaaagaaggcttgcattccctccaggagattagggtctgtgagatccatgaagacaacagcaccaggagctcccagcatttctactacgatggggagctcttcctctcccaaaacctggagactaaggaatggacaatgccccagtcctccagagctcagaccttggccatgaacgtcaggaatttcttgaaggaagatgccatgaagaccaagacacactatcacgctatgcatgcagactgcctgcaggaactacggcgatatctaaaatccggcgtagtcctgaggagaacagtgccccccatggtgaatgtcacccgcagcgaggcctcagagggcaacattaccgtgacatgcagggcttctggcttctatccctggaatatcacactgagctggcgtcaggatggggtatctttgagccacgacacccagcagtggggggatgtcctgcctgatgggaatggaacctaccagacctgggtggccaccaggatttgccaaggagaggagcagaggttcacctgctacatggaacacagcgggaatcacagcactcaccctgtgccctctgggaaagtgctggtgcttcagagtcattggcagacattccatgtttctgctgttgctgctgctgctatttttgttattattattttctatgtccgttgttgtaagaagaaaacatcagctgcagagggtccagagctcgtgagcctgcaggtcctggatcaacacccagttgggacgagtgaccacagggatgccacacagctcggatttcagcctctgatgtcagatcttgggtccactggctccactgagggcgcctagactctacagccaggcagctgggattcaattccctgcctggatctcacgagcactttccctcttggtgcctcagtttcctgacctatgaaacagagaaaataaaagcacttatttattgtt

SEQ ID NO: 153670 - DNA, 1735 bp, Homo sapiens
  Payload ID: 10221
  Gene Symbol: MICA
  Gene Name: MHC class I polypeptide-related sequence A
  ENST ID: ENST00000427477
  CDS Start-End: 404-1402
gtcgcctctgtgctcgctagtcaagtgaaacagtgggagtgaagaagaaacaaagacatctataactggttgtgatcaattagttgtaaacactgcactcagaccagcctgggaagattttaaggatatggtgtggtctgatgggttccaaggcagaggttacaatagcctggaagagggagactgcttaggcagtggcatcctggtgggatagggtctccagcccactggaattttctcttccaagcgtggccccgccctctccgctcgtgattggccctaagttccgggccccagtttcattggatgagcggtcgggggaccgggccaggtgactaagtttccgcggcgccttctccccggccactgcttgagccgctgagagggtggcgacgtcggggccatggggctgggcccggtcttcctgcttctggctggcatcttcccttttgcacctccgggagctgctgctgagccccacagtcttcgttataacctcacggtgctgtcctgggatggatctgtgcagtcagggtttcttgctgaggtacatctggatggtcagcccttcctgcgctatgacaggcagaaatgcagggcaaagccccagggacagtgggcagaagatgtcctgggaaataagacatgggacagagagaccagggacttgacagggaacggaaaggacctcaggatgaccctggctcatatcaaggaccagaaagaaggcttgcattccctccaggagattagggtctgtgagatccatgaagacaacagcaccaggagctcccagcatttctactacgatggggagctcttcctctcccaaaacctggagactgaggaatggacagtgccccagtcctccagagctcagaccttggccatgaacgtcaggaatttcttgaaggaagatgccatgaagaccaagacacactatcacgctatgcatgcagactgcctgcaggaactacggcgatatctagaatccggcgtagtcctgaggagaacagtgccccccatggtgaatgtcacccgcagcgaggcctcagagggcaacatcaccgtgacatgcagggcttccagcttctatccccggaatatcatactgacctggcgtcaggatggggtatctttgagccacgacacccagcagtggggggatgtcctgcctgatgggaatggaacctaccagacctgggtggccaccaggatttgccgaggagaggagcagaggttcacctgctacatggaacacagcgggaatcacagcactcaccctgtgccctctgggaaagtgctggtgcttcagagtcattggcagacattccatgtttctgctgttgctgctggctgctgctatttttgttattattattttctatgtccgttgttgtaagaagaaaacatcagctgcagagggtccagagctcgtgagcctgcaggtcctggatcaacacccagttgggacgagtgaccacagggatgccacacagctcggatttcagcctctgatgtcagctcttgggtccactggctccactgagggcacctagactctacagccaggcggctggaattgaattccctgcctggatctcacaagcactttccctcttggtgcctcagtttcctgacctatgaaacagagaaaataaaagcacttatttattgttgttggaggctgcaaaatgttagtagatatgaggcatttgcagctgtgccatattaa

SEQ ID NO: 153671 - DNA, 2223 bp, Homo sapiens
  Payload ID: 10221
  Gene Symbol: MICA
  Gene Name: MHC class I polypeptide-related sequence A
  ENST ID: ENST00000432479
  CDS Start-End: 95-1123
agcggtcgggggaccgggccaggtgactaagtttccgcggcgccttctccccggccactgcttgagccgctgagagggtggcgacgtcggggccatggggctgggcccggtcttcctgcttctggctggcatcttcccttttgcacctccgggagctgctgctgagccccacagtcttcgttataacctcacggtgctgtcctgggatggatctgtgcagtcagggtttcttgctgaggtacatctggatggtcagcccttcctgcgctatgacaggcagaaatgcagggcaaagccccagggacagtgggcagaagatgtcctgggaaataagacatgggacagagagaccagggacttgacagggaacggaaaggacctcaggatgaccctggctcatatcaaggaccagaaagaagtgccccagtcctccagagctcagaccttggccatgaacgtcaggaatttcttgaaggaagatgccatgaagaccaagacacactatcacgctatgcatgcagactgcctgcaggaactacggcgatatctagaatccagcgtagtcctgaggagaagagtgccccccatggtgaatgtcacccgcagcgaggcctcagagggcaacatcaccgtgacatgcagggcttccagcttctatccccggaatatcacactgacctggcgtcaggatggggtatctttgagccacgacacccagcagtggggggatgtcctgcctgatgggaatggaacctaccagacctgggtggccaccaggatttgccaaggagaggagcagaggttcacctgctacatggaacacagcgggaatcacagcactcaccctgtgccctctgggaaagtgctggtgcttcagagtcattggcagacattccatgtttctgctgttgctgctgctgctgctgctatttttgttattattattttctatgtccgttgttgtaagaagaaaacatcagctgcagagggtccagagctcgtgagcctgcaggtcctggatcaacacccagttgggacgagtgaccacagggatgccacacagctcggatttcagcctctgatgtcagctcttgggtccactggctccactgagggcgcctagactctacagccaggcggctggaattgaattccctgcctggatctcacaagcactttccctcttggtgcctcagtttcctgacctatgaaacagagaaaataaaagcacttatttattgttgttggaggctgcaaaatgttagtagatatgaggcatttgcagctgtgccatattaattggtgtcattgtttttgttgttttcgtattattattttttttttttaagacagagtctcaggccaggcacggtggctcacgcctgtaatcccaacactttgggaggccgaggcgggcggatcacaaggtcaagagatcgagaccatcctgatcaacatggtgaaaccctgtctctactaaaaatacaaaaaattagctgggcctggtggcgtgtgcctgtagtcccagctactcaggagctgaggcaggaaaatcacttgaacctgggaggtggaggttgcagtgagctgagatcacaccactgcactccagcctggcgacagagcgagactctgtctcaaaaaaaaaaaaaaaaaaggacagagtctcactctgtcacccaggctgcagttcagtgacatgatctcagctcgttgcagcctccgcctcccgggttcaagcacttctcttgcctcagcctcccgagtagctggggttacagacatgcaccaccatacccggctaatttttgcatttttcatagagacaggattttgccatgttggccaggctggtctcaaactcctgacctcaggtgatctgcctgcctcaggctcccaaagtgctgggattacaagcatgagccaccatacccggcctattttattacattttaatttattttattttattatatcatccaccatgtctggcctattttattatattttaagatattttaatatattacgtgtgttgtaattggattatcatcagtgagctttgtgagtgagtgtcttggagatgactcctcctgaccagcccaggaccagctttcttgtcaccttgaggtcccctcgccccatcacactcttacgcattactctatgtctactgttatgggtgtgtaattttataccatagatgtttactctttaaacaga

SEQ ID NO: 153672 - DNA, 2221 bp, Homo sapiens
  Payload ID: 10221
  Gene Symbol: MICA
  Gene Name: MHC class I polypeptide-related sequence A
  ENST ID: ENST00000414473
  CDS Start-End: 95-964
agcggtcgggggaccgggccaggtgactaagtttccgcggcgccttctccccggccactgcttgagccgctgagagggtggcgacgtcggggccatggggctgggcccggtcttcctgcttctggctggcatcttcccttttgcacctccgggagctgctgctgagccccacagtcttcgttataacctcacggtgctgtcctgggatggatctgtgcagtcagggtttcttgctgaggtacatctggatggtcagcccttcctgcgctatgacaggcagaaatgcagggcaaagccccagggacagtgggcagaagatgtcctgggaaataagacatgggacagagagaccagggacttgacagggaacggaaaggacctcaggatgaccctggctcatatcaaggaccagaaagaagtgccccagtcctccagagctcagaccttggccatgaacgtcaggaatttcttgaaggaagatgccatgaagaccaagacacactatcacgctatgcatgcagactgcctgcaggaactacggcgatatctagaatccggcgtagtcctgaggagaacagtgccccccatggtgaatgtcacccgcagcgaggcctcagagggcaacatcaccgtgacatgcagggcttccagcttctatccccggaatatcatactgacctggcgtcaggatggggtatctttgagccacgacacccagcagtggggggatgtcctgcctgatgggaatggaacctaccagacctgggtggccaccaggatttgccgaggagaggagcagaggttcacctgctacatggaacacagcgggaatcacagcactcaccctgtgccctctgggaaagtgctggtgcttcagagtcattggcagacattccatgtttctgctgttgctgctggctgctgctatttttgttattattattttctatgtccgttgttgtaagaagaaaacatcagctgcagagggtccagagctcgtgagcctgcaggtcctggatcaacacccagttgggacgagtgaccacagggatgccacacagctcggatttcagcctctgatgtcagctcttgggtccactggctccactgagggcacctagactctacagccaggcggctggaattgaattccctgcctggatctcacaagcactttccctcttggtgcctcagtttcctgacctatgaaacagagaaaataaaagcacttatttattgttgttggaggctgcaaaatgttagtagatatgaggcatttgcagctgtgccatattaattggtgtcattgtttttgttgttttcgtattattattttttttttttaagacagagtctcaggccaggcacggtggctcacgcctgtaatcccaacactttgggaggccgaggcgggcggatcacaaggtcaagagatcgagaccatcctgatcaacatggtgaaaccctgtctctactaaaaatacaaaaaattagctgggcctggtggcgtgtgcctgtagtcccagctactcaggagctgaggcaggaaaatcacttgaacctgggaggtggaggttgcagtgagctgagatcacaccactgcactccagcctggcgacagagcgagactctgtctcaaaaaaaaaaaaaaaaaaagacagagtctcactctgtcacccaggctgcagttcagtgacatgatctcagctcgttgcagcctccgcctcccgggttcaagcacttctcttgcctcagcctcccgagtagctggggttacagacatgcaccaccatacccggctaatttttgcatttttcatagagacaggattttgccatgttggccaggctggtctcaaactcctgacctcaggtgatctgcctgcctcagcctcccaaagtgctgggattacaagcatgagccaccatacccggcctattttattacattttaatttattttattttattatatcatccaccatgtctggcctattttattatattttaagatattttaatatattacgtgtgttgtaattggattatcatcggtgagctttgtgagtgagtgtcttggagatgactcctcctgaccagcccaggaccagctttcttgtcaccttgaggtcccctcgccccatcacactcttacgcattactctatgtctactgttatgggtgtgtaattttataccatagatgtttactctttaaacaga

SEQ ID NO: 153673 - DNA, 1007 bp, Homo sapiens
  Payload ID: 10221
  Gene Symbol: MICA
  Gene Name: MHC class I polypeptide-related sequence A
  ENST ID: ENST00000417943
  CDS Start-End: 1-831
ttcccttttgcacctccgggagctgctgctgagccccacagtcttcgttataacctcacggtgctgtcctgggatggatctgtgcagtcagggtttcttgctgaggtacatctggatggtcagcccttcctgcgctatgacaggcagaaatgcagggcaaagccccagggacagtgggcagaagatgtcctgggaaataagacatgggacagagagaccagggacttgacagggaacggaaaggacctcaggatgaccctggctcatatcaaggaccagaaagaagtgccccccatggtgaatgtcacccgcagcgaggcctcagagggcaacatcaccgtgacatgcagggcttccagcttctatccccggaatatcacactgacctggcgtcaggatggggtatctttgagccacgacacccagcagtggggggatgtcctgcctgatgggaatggaacctaccagacctgggtggccaccaggatttgccaaggagaggagcagaggttcacctgctacatggaacacagcgggaatcacagcactcaccctgtgccctctgggaaagtgctggtgcttcagagtcattggcagacattccatgtttctgctgttgctgctgctgctgctgctatttttgttattattattttctatgtccgttgttgtaagaagaaaacatcagctgcagagggtccagagctcgtgagcctgcaggtcctggatcaacacccagttgggacgagtgaccacagggatgccacacagctcggatttcagcctctgatgtcagctcttgggtccactggctccactgagggcgcctagactctacagccaggcggctggaattgaattccctgcctggatctcacaagcactttccctcttggtgcctcagtttcctgacctatgaaacagagaaaataaaagcacttatttattgttgttggaggctgcaaaatgttagtagatatgaggcatttgcagctgtgccatattaa

SEQ ID NO: 153674 - DNA, 1737 bp, Homo sapiens
  Payload ID: 10221
  Gene Symbol: MICA
  Gene Name: MHC class I polypeptide-related sequence A
  Uniprot ID: Q29983
  ENST ID: ENST00000418465
  CDS Start-End: 404-1561
gtcgcctctgtgctggctagtcaagtgaaacagtgggagtgaagaagaaacaaagacatctataactggttgtgatcaattagttgtacacactgcactcagaccagcctgggaagattttaaggatatggtgtggtctgatgggttccaaggcagaggttacaatagcctggaagagggagactgcttaggcagtggcatcctggtgggatagggtctccagcccactggaattttctcttccaagcgtggccccgccctctccgctcgtgattggccctaagttccgggccccagtttcattggatgagcggtcgggggaccgggccaggtgactaagtttccgcggcgccttctccccggccactgcttgagccgctgagagggtggcgacgtcggggccatggggctgggcccggtcttcctgcttctggctggcatcttcccttttgcacctccgggagctgctgctgagccccacagtcttcgttataacctcacggtgctgtcctgggatggatctgtgcagtcagggtttcttgctgaggtacatctggatggtcagcccttcctgcgctatgacaggcagaaatgcagggcaaagccccagggacagtgggcagaagatgtcctgggaaataagacatgggacagagagaccagggacttgacagggaacggaaaggacctcaggatgaccctggctcatatcaaggaccagaaagaaggcttgcattccctccaggagattagggtctgtgagatccatgaagacaacagcaccaggagctcccagcatttctactacgatggggagctcttcctctcccaaaacgtggagactgaggaatggacagtgccccagtcctccagagctcagaccttggccatgaacgtcaggaatttcttgaaggaagatgccatgaagaccaagacacactatcacgctatgcatgcagactgcctgcaggaactacggcgatatctagaatccagcgtagtcctgaggagaagagtgccccccatggtgaatgtcacccgcagcgaggcctcagagggcaacatcaccgtgacatgcagggcttccagcttctatccccggaatatcacactgacctggcgtcaggatggggtatctttgagccacgacacccagcagtggggggatgtcctgcctgatgggaatggaacctaccagacctgggtggccaccaggatttgccaaggagaggagcagaggttcacctgctacatggaacacagcgggaatcacagcactcaccctgtgccctctgggaaagtgctggtgcttcagagtcattggcagacattccatgtttctgctgttgctgctgctgctgctgctatttttgttattattattttctatgtccgttgttgtaagaagaaaacatcagctgcagagggtccagagctcgtgagcctgcaggtcctggatcaacacccagttgggacgagtgaccacagggatgccacacagctcggatttcagcctctgatgtcagctcttgggtccactggctccactgagggcgcctagactctacagccaggcggctggaattgaattccctgcctggatctcacaagcactttccctcttggtgcctcagtttcctgacctatgaaacagagaaaataaaagcacttatttattgttgttggaggctgcaaaatgttagtagatatgaggcatttgcagctgtgccatattaa

SEQ ID NO: 153675 - DNA, 1005 bp, Homo sapiens
  Payload ID: 10221
  Gene Symbol: MICA
  Gene Name: MHC class I polypeptide-related sequence A
  ENST ID: ENST00000421350
  CDS Start-End: 1-672
ttcccttttgcacctccgggagctgctgctgagccccacagtcttcgttataacctcacggtgctgtcctgggatggatctgtgcagtcagggtttcttgctgaggtacatctggatggtcagcccttcctgcgctatgacaggcagaaatgcagggcaaagccccagggacagtgggcagaagatgtcctgggaaataagacatgggacagagagaccagggacttgacagggaacggaaaggacctcaggatgaccctggctcatatcaaggaccagaaagaagtgccccccatggtgaatgtcacccgcagcgaggcctcagagggcaacatcaccgtgacatgcagggcttccagcttctatccccggaatatcatactgacctggcgtcaggatggggtatctttgagccacgacacccagcagtggggggatgtcctgcctgatgggaatggaacctaccagacctgggtggccaccaggatttgccgaggagaggagcagaggttcacctgctacatggaacacagcgggaatcacagcactcaccctgtgccctctgggaaagtgctggtgcttcagagtcattggcagacattccatgtttctgctgttgctgctggctgctgctatttttgttattattattttctatgtccgttgttgtaagaagaaaacatcagctgcagagggtccagagctcgtgagcctgcaggtcctggatcaacacccagttgggacgagtgaccacagggatgccacacagctcggatttcagcctctgatgtcagctcttgggtccactggctccactgagggcacctagactctacagccaggcggctggaattgaattccctgcctggatctcacaagcactttccctcttggtgcctcagtttcctgacctatgaaacagagaaaataaaagcacttatttattgttgttggaggctgcaaaatgttagtagatatgaggcatttgcagctgtgccatattaa

SEQ ID NO: 153676 - DNA, 1001 bp, Homo sapiens
  Payload ID: 10221
  Gene Symbol: MICA
  Gene Name: MHC class I polypeptide-related sequence A
  ENST ID: ENST00000436191
  CDS Start-End: 1-825
ttcccttttgcacctccgggagctgctgctgagccccacagtcttcgttataacctcacggtgctgtcctgggatggatctgtgcagtcagggtttctcactgaggtacatctggatggtcagcccttcctgcgctgtgacaggcagaaatgcagggcaaagccccagggacagtgggcagaagatgtcctgggaaataagacatgggacagagagaccagagacttgacagggaacggaaaggacctcaggatgaccctggctcatatcaaggaccagaaagaagtgccccccatggtgaatgtcacccgcagcgaggcctcagagggcaacattaccgtgacatgcagggcttctggcttctatccctggaatatcacactgagctggcgtcaggatggggtatctttgagccacgacacccagcagtggggggatgtcctgcctgatgggaatggaacctaccagacctgggtggccaccaggatttgccaaggagaggagcagaggttcacctgctacatggaacacagcgggaatcacagcactcaccctgtgccctctgggaaagtgctggtgcttcagagtcattggcagacattccatgtttctgctgttgctgctgctgctatttttgttattattattttctatgtccgttgttgtaagaagaaaacatcagctgcagagggtccagagctcgtgagcctgcaggtcctggatcaacacccagttgggacgagtgaccacagggatgccacacagctcggatttcagcctctgatgtcagatcttgggtccactggctccactgagggcgcctagactctacagccaggcagctgggattcaattccctgcctggatctcacgagcactttccctcttggtgcctcagtttcctgacctatgaaacagagaaaataaaagcacttatttattgttgttggaggctgcaaaatgttagtagatatgaggcgtttgcagctgtaccatattaa

SEQ ID NO: 153677 - DNA, 2070 bp, Homo sapiens
  Payload ID: 10221
  Gene Symbol: MICA
  Gene Name: MHC class I polypeptide-related sequence A
  ENST ID: ENST00000417899
  CDS Start-End: 1153-1737
gtatcatttcagtgaaggtcactccagtctttcatggaggccaaactaagggtgtaaattaggatcctcactgaagtggcgggaccctaagaggctttttcctggccccttagttgtgggttttcctgcgggcggcgcagccggtttccatcagaaccgcccagaggcggacgctgccttcctggggtgacggagcagcaggaagcgttttcggatcctggaatacgtgggcggcccgtgggaggggctgaggcgcagtttcctactcacccggatccgaatcctccgcggtgctgtttcaagaaagccggattccagatcgcgctccagcccggactcggaattcctgccctgcgggtctgcattttcataacgggcaggtgtgagtgccctgcagctggagaccagaagcctgaaggcagctcggccctccccagcccacagcgccgttattccgtttctatatcagtaaacacatttcattttccgtagaccagggcggggtgacgggtgatcccagtcctcgcagtgaattccgggcagcaaaattcaaaacacatgcggccaaggccgggcacggtggttcacgcctgtaatcccagcactttgggaggtcgaggcgggcgatcacctgaggtcgggagctcgagaccaacctgaccaacatggggaaatcccgtctctactaaaaatataaaattagacgggcttggtggtgaatgcctgtaatcccagctagtcgggaggctgaggcaggagaatcgcttaaaccttggaggcggaggttgcggtgagccgagatcgcgccattgcacttcagcctgggcaacaagagggaaaactccgtcgcaaaaactttcgggggcggagcggagccccgccctgggttatgtaagcgaccgcgctgggccgtttctctttcttttccggaccctgcagtggcgcctaaagtctgagagagggaagtcgcctctgtgctcagccccacagtcttcgttataacctcacggtgctgtcctgggatggatctgtgcagtcagggtttcttgctgaggtacatctggatggtcagcccttcctgcgctatgacaggcagaaatgcagggcaaagccccagggacagtgggcagaagatgtcctgggaaataagacatgggacagagagaccagggacttgacagggaacggaaaggacctcaggatgaccctggctcatatcaaggaccagaaagaaggaatttcttgaaggaagatgccatgaagaccaagacacactatcacgctatgcatgcagactgcctgcaggaactacggcgatatctagaatccggcgtagtcctgaggagaacagtgccccccatggtgaatgtcacccgcagcgaggcctcagagggcaacatcaccgtgacatgcagggcttccagcttctatccccggaatatcatactgacctggcgtcaggatggggtatctttgagccacgacacccagcagtggggggatgtcctgcctgatgggaatggaacctaccagacctgggtggccaccaggatttgccgaggagaggagcagaggttcacctgctacatggaacacagcgggaatcacagcactcaccctgtgccctctgggaaagtgctggtgcttcagagtcattggcagacattccatgtttctgctgttgctgctggctgctgctatttttgttattattattttctatgtccgttgttgtaagaagaaaacatcagctgcagagggtccagagctcgtgagcctgcaggtcctggatcaacacccagttgggacgagtgaccacagggatgccacacagctcggatttcagcctctgatgtcagctcttgggtccactggctccactgagggcacctagactctacagccaggcggctggaattgaattccctgcctggatctcacaagcactttccctcttggtgcctcagtttcctgacctatgaaacagagaaaataaaagcacttatttattgttgttggaggctgcaaaatgttagtagatatgaggcatttgcagctgtgccatattaa

SEQ ID NO: 153678 - DNA, 2070 bp, Homo sapiens; identical to SEQ ID NO: 153677
  Payload ID: 10221
  Gene Symbol: MICA
  Gene Name: MHC class I polypeptide-related sequence A
  ENST ID: ENST00000438928
  CDS Start-End: 1153-1737

SEQ ID NO: 153679 - DNA, 2072 bp, Homo sapiens
  Payload ID: 10221
  Gene Symbol: MICA
  Gene Name: MHC class I polypeptide-related sequence A
  ENST ID: ENST00000420259
  CDS Start-End: 1153-1896
gtatcatttcagtgaaggtcactccagtctttcatggaggccaaactaagggtgtaaattaggatcctcactgaagtggcgggaccctaagaggctttttcctggccccttagttgtgggttttcctgcgggcggcgcagccggttcccatcagaaccgcccagaggcggacgctgccttcctggggtgacggagcagcaggaagcgttttcggatcctggaatacgtgggcggcccgtgggaggggctgaggcgcagtttcctactcacccggatcagaatcctccgcggtgctgtttcaagagagccggattccagatcgcgctccagcccggactcggaattcctgccctgcgggtctgcattttcataacgggcaggtgtgagtgccctgcagctggagaccagaagcctgaaggcagctcggccctccccagcccacagcgccgttattccgtttctatatcagtaaacacatttcattttccgtagaccagggcggggtgacgggtgatcccagtcctcgcagtgaattccgggcagcaaaattcaaaacacatgcgggcaaggccgggcacggtggttcacgcctgcaatcccagcactttgggaggtcgaggcgggcgatcacctgaggtcgggagctcgagaccaacctgaccaacatggggaaatcccgtctctactaaaaatataaaattagacgggcttggtggtgaatgcctgtaatcccagctagtcgggaggctgaggcaggagaatcgcttaaaccttggaggcggaggttgcggtgagccgagatcgcgccactgcacttcagcctgggcaacaagagggaaaactccgtcgcaaaaactttcgggggcggagcggagccccgccctgggttatgtaagcgaccgcgctgggccgtttctctttcttttccggaccctgcagtggcgcctaaagtctgagagagggaagtcgcctctgtgctgagccccacagtcttcgttataacctcacggtgctgtcctgggatggatctgtgcagtcagggtttcttgctgaggtacatctggatggtcagcccttcctgcgctatgacaggcagaaatgcagggcaaagccccagggacagtgggcagaagatgtcctgggaaataagacatgggacagagagaccagggacttgacagggaacggaaaggacctcaggatgaccctggctcatatcaaggaccagaaagaaggaatttcttgaaggaagatgccatgaagaccaagacacactatcacgctatgcatgcagactgcctgcaggaactacggcgatatctagaatccagcgtagtcctgaggagaagagtgccccccatggtgaatgtcacccgcagcgaggcctcagagggcaacatcaccgtgacatgcagggcttccagcttctatccccggaatatcacactgacctggcgtcaggatggggtatctttgagccacgacacccagcagtggggggatgtcctgcctgatgggaatggaacctaccagacctgggtggccaccaggatttgccaaggagaggagcagaggttcacctgctacatggaacacagcgggaatcacagcactcaccctgtgccctctgggaaagtgctggtgcttcagagtcattggcagacattccatgtttctgctgttgctgctgctgctgctgctatttttgttattattattttctatgtccgttgttgtaagaagaaaacatcagctgcagagggtccagagctcgtgagcctgcaggtcctggatcaacacccagttgggacgagtgaccacagggatgccacacagctcggatttcagcctctgatgtcagctcttgggtccactggctccactgagggcgcctagactctacagccaggcggctggaattgaattccctgcctggatctcacaagcactttccctcttggtgcctcagtttcctgacctatgaaacagagaaaataaaagcacttatttattgttgttggaggctgcaaaatgttagtagatatgaggcatttgcagctgtgccatattaa

SEQ ID NO: 153680 - DNA, 1005 bp, Homo sapiens; identical to SEQ ID NO: 153675
  Payload ID: 10221
  Gene Symbol: MICA
  Gene Name: MHC class I polypeptide-related sequence A
  ENST ID: ENST00000423443
  CDS Start-End: 1-672

SEQ ID NO: 153681 - DNA, 1005 bp, Homo sapiens; identical to SEQ ID NO: 153675
  Payload ID: 10221
  Gene Symbol: MICA
  Gene Name: MHC class I polypeptide-related sequence A
  ENST ID: ENST00000420744
  CDS Start-End: 1-672

SEQ ID NO: 153682 - DNA, 2221 bp, Homo sapiens; identical to SEQ ID NO: 153672
  Payload ID: 10221
  Gene Symbol: MICA
  Gene Name: MHC class I polypeptide-related sequence A
  ENST ID: ENST00000446505
  CDS Start-End: 95-964

SEQ ID NO: 153683 - DNA, 1386 bp, Homo sapiens
  Payload ID: 10221
  Gene Symbol: MICA
  Gene Name: MHC class I polypeptide-related sequence A
  ENST ID: ENST00000449934
  CDS Start-End: 55-1053
cgccttctccccggccactgcttgagccgctgagagggtggcgacgtcggggccatggggctgggcccggtctttctgcttctggctggcatcttcccttttgcacctccgggagctgctgctgagccccacagtcttcgttataacctcacggtgctgtcctgggatggatctgtgcagtcagggtttcttgctgaggtacatctggatggtcagcccttcctgcgctatgacaggcagaaatgcagggcaaagccccagggacagtgggcagaagatgtcctgggaaataagacatgggacagagagaccagggacttgacagggaacggaaaggacctcaggatgaccctggctcatatcaaggaccagaaagaaggcttgcattccctccaggagattagggtctgtgagatccatgaagacaacagcaccaggagctcccagcatttctactacgatggggagctcttcctctcccaaaacctggagactgaggaatggacagtgccccagtcctccagagctcagaccttggccatgaacgtcaggaatttcttgaaggaagatgccatgaagaccaagacacactatcacgctatgcatgcagactgcctgcaggaactacggcgatatctagaatccggcgtagtcctgaggagaacagtgccccccatggtgaatgtcacccgcagcgaggcctcagagggcaacatcaccgtgacatgcagggcttccagcttctatccccggaatatcatactgacctggcgtcaggatggggtatctttgagccacgacacccagcagtggggggatgtcctgcctgatgggaatggaacctaccagacctgggtggccaccaggatttgccgaggagaggagcagaggttcacctgctacatggaacacagcgggaatcacagcactcaccctgtgccctctgggaaagtgctggtgcttcagagtcattggcagacattccatgtttctgctgttgctgctggctgctgctatttttgttattattattttctatgtccgttgttgtaagaagaaaacatcagctgcagagggtccagagctcgtgagcctgcaggtcctggatcaacacccagttgggacgagtgaccacagggatgccacacagctcggatttcagcctctgatgtcagctcttgggtccactggctccactgagggcacctagactctacagccaggcggctggaattgaattccctgcctggatctcacaagcactttccctcttggtgcctcagtttcctgacctatgaaacagagaaaataaaagcacttatttattgttgttggaggctgcaaaatgttagtagatatgaggcatttgcagctgtgccatattaa

SEQ ID NO: 153684 - DNA, 1735 bp, Homo sapiens; identical to SEQ ID NO: 153670
  Payload ID: 10221
  Gene Symbol: MICA
  Gene Name: MHC class I polypeptide-related sequence A
  ENST ID: ENST00000415525
  CDS Start-End: 404-1402

SEQ ID NO: 153685 - DNA, 2211 bp, Homo sapiens
  Payload ID: 10221
  Gene Symbol: MICA
  Gene Name: MHC class I polypeptide-related sequence A
  ENST ID: ENST00000460798
  CDS Start-End: 95-733
agcggtcgggggaccgggccaggtgactaagtttccgcggcgccttctccccggccactgcttgagccgctgagagggtggcgacgtcggggccatggggctgggcccggtcttcctgcttctggctggcatcttcccttttgcacctccgggagctgctgctgagccccacagtcttcgttataacctcacggtgctgtcctgggatggatctgtgcagtcagggtttctcactgaggtacatctggatggtcagcccttcctgcgctgtgacaggcagaaatgcagggcaaagccccagggacagtgggcagaagatgtcctgggaaataagacatgggacagagagaccagagacttgacagggaacggaaaggacctcaggatgaccctggctcatatcaaggaccagaaagaagtcctccagagctcagaccttggccatgaacgtcaggaatttcttgaaggaagatgccatgaagaccaagacacactatcacgctatgcatgcagactgcctgcaggaactacggcgatatctaaaatccggcgtagtcctgaggagaacagtgccccccatggtgaatgtcacccgcagcgaggcctcagagggcaacattaccgtgacatgcagggcttctggcttctatccctggaatatcacactgagctggcgtcaggatggggtatctttgagccacgacacccagcagtggggggatgtcctgcctgatgggaatggaacctaccagacctgggtggccaccaggatttgccaaggagaggagcagaggttcacctgctacatggaacacagcgggaatcacagcactcaccctgtgccctctgggaaagtgctggtgcttcagagtcattggcagacattccatgtttctgctgttgctgctgctgctatttttgttattattattttctatgtccgttgttgtaagaagaaaacatcagctgcagagggtccagagctcgtgagcctgcaggtcctggatcaacacccagttgggacgagtgaccacagggatgccacacagctcggatttcagcctctgatgtcagatcttgggtccactggctccactgagggcgcctagactctacagccaggcagctgggattcaattccctgcctggatctcacgagcactttccctcttggtgcctcagtttcctgacctatgaaacagagaaaataaaagcacttatttattgttgttggaggctgcaaaatgttagtagatatgaggcgtttgcagctgtaccatattaattggtgtcactgtttctgttgttttcgtattattattattttttttaagacagagtctcaggccaggcacggtggctcacgcctgtaatcccagcactttgggaggccgaggcgggcggatcacaaggtcaagagatcgagaccatcctgatcaacatggtgaaaccctgtctctactaaaaatacaaaaaattagctgggcctggtggcatgtgcctgtagtcccagctactcaggagctgaggcaggaaaatcacttgaacctgggaggtggaggttgcagtgagctgagatcgcgccactgcactccagcctggcgacagagcgagactctgtctcaaaaaaaaaaaaaaaaaaaaaagacagagtctcactctgtcacccaggctgcagttcagtgacatgatctcagctcgttgcagcctccgcctcccgggttcaagcacttcttgtgcctcagcctcccgagtagctggggttacagacatgcaccaccatacccagctaatttttgcatttttcatagagacaggattttgccatgttggccaggctggtctcaaactcctgacctcaggtgatctgcctgcctcagcctcccaaagtgctgggattacaagcatgagccaccatacccggcctattttattacattttactatattttattttattatatcatccaccatgtctggcctattttattatattttaagatattttaatatattacatgtgttgtaattggattatcatcggtgagctttgtgagtgagtgtcttggagatgactcctcctgaccagcccaggaccagctttcttgtcaccttgaggtcccctcgccccatcacactcttacgcattactctatgtctactgttatgggtgcataattttataccatagatgtttactctttaaacaga

SEQ ID NO: 153686 - DNA, 1396 bp, Homo sapiens
  Payload ID: 10221
  Gene Symbol: MICA
  Gene Name: MHC class I polypeptide-related sequence A
  ENST ID: ENST00000546529
  CDS Start-End: 67-1065
aagtttccgcggcgccttctccccggccactgcttgagccgctgagagggtggcgacgtcggggccatggggctgggcccggtcttcctgcttctggctggcatcttcccttttgcacctccgggagctgctgctgagccccacagtcttcgttataacctcacggtgctgtcctgggatggatctgtgcagtcagggtttcttgctgaggtacatctggatggtcagcccttcctgcgctatgacaggcagaaatgcagggcaaagccccagggacagtgggcagaagatgtcctgggaaataagacatgggacagagagaccagggacttgacagggaacggaaaggacctcaggatgaccctggctcatatcaaggaccagaaagaaggcttgcattccctccaggagattagggtctgtgagatccatgaagacaacagcaccaggagctcccagcatttctactacgatggggagctcttcctctcccaaaacctggagactgaggaatggacagtgccccagtcctccagagctcagaccttggccatgaacgtcaggaatttcttgaaggaagatgccatgaagaccaagacacactatcacgctatgcatgcagactgcctgcaggaactacggcgatatctagaatccggcgtagtcctgaggagaacagtgccccccatggtgaatgtcacccgcagcgaggcctcagagggcaacatcaccgtgacatgcagggcttccagcttctatccccggaatatcatactgacctggcgtcaggatggggtatctttgagccacgacacccagcagtggggggatgtcctgcctgatgggaatggaacctaccagacctgggtggccaccaggatttgccgaggagaggagcagaggttcacctgctacatggaacacagcgggaatcacagcactcaccctgtgccctctgggaaagtgctggtgcttcagagtcattggcagacattccatgtttctgctgttgctgctggctgctgctatttttgttattattattttctatgtccgttgttgtaagaagaaaacatcagctgcagagggtccagagctcgtgagcctgcaggtcctggatcaacacccagttgggacgagtgaccacagggatgccacacagctcggatttcagcctctgatgtcagctcttgggtccactggctccactgagggcacctagactctacagccaggcggctggaattgaattccctgcctggatctcacaagcactttccctcttggtgcctcagtttcctgacctatgaaacagagaaaataaaagcacttatttattgttgttggaggctgcaaaatgttagtagatatgaggcatttgcagctgtgccatatt

SEQ ID NO: 153687 - DNA, 1392 bp, Homo sapiens
  Payload ID: 10221
  Gene Symbol: MICA
  Gene Name: MHC class I polypeptide-related sequence A
  Uniprot ID: Q29983
  ENST ID: ENST00000547609
  CDS Start-End: 67-1218
aagtttccgcggcgccttctccccggccactgcttgagccgctgagagggtggcgacgtcggggccatggggctgggcccggtcttcctgcttctggctggcatcttcccttttgcacctccgggagctgctgctgagccccacagtcttcgttataacctcacggtgctgtcctgggatggatctgtgcagtcagggtttctcactgaggtacatctggatggtcagcccttcctgcgctgtgacaggcagaaatgcagggcaaagccccagggacagtgggcagaagatgtcctgggaaataagacatgggacagagagaccagagacttgacagggaacggaaaggacctcaggatgaccctggctcatatcaaggaccagaaagaaggcttgcattccctccaggagattagggtctgtgagatccatgaagacaacagcaccaggagctcccagcatttctactacgatggggagctcttcctctcccaaaacctggagactaaggaatggacaatgccccagtcctccagagctcagaccttggccatgaacgtcaggaatttcttgaaggaagatgccatgaagaccaagacacactatcacgctatgcatgcagactgcctgcaggaactacggcgatatctaaaatccggcgtagtcctgaggagaacagtgccccccatggtgaatgtcacccgcagcgaggcctcagagggcaacattaccgtgacatgcagggcttctggcttctatccctggaatatcacactgagctggcgtcaggatggggtatctttgagccacgacacccagcagtggggggatgtcctgcctgatgggaatggaacctaccagacctgggtggccaccaggatttgccaaggagaggagcagaggttcacctgctacatggaacacagcgggaatcacagcactcaccctgtgccctctgggaaagtgctggtgcttcagagtcattggcagacattccatgtttctgctgttgctgctgctgctatttttgttattattattttctatgtccgttgttgtaagaagaaaacatcagctgcagagggtccagagctcgtgagcctgcaggtcctggatcaacacccagttgggacgagtgaccacagggatgccacacagctcggatttcagcctctgatgtcagatcttgggtccactggctccactgagggcgcctagactctacagccaggcagctgggattcaattccctgcctggatctcacgagcactttccctcttggtgcctcagtttcctgacctatgaaacagagaaaataaaagcacttatttattgttgttggaggctgcaaaatgttagtagatatgaggcgtttgcagctgtaccatatt

SEQ ID NO: 153688 - DNA, 1396 bp, Homo sapiens; identical to SEQ ID NO: 153686
  Payload ID: 10221
  Gene Symbol: MICA
  Gene Name: MHC class I polypeptide-related sequence A
  ENST ID: ENST00000547767
  CDS Start-End: 67-1065

SEQ ID NO: 153689 - DNA, 2260 bp, Homo sapiens
  Payload ID: 10221
  Gene Symbol: MICA
  Gene Name: MHC class I polypeptide-related sequence A
  ENST ID: ENST00000614103
  CDS Start-End: 1222-1929
gtatcatttcagtgaaggtcactccagtctttcatggaggccaaactaagggtgtaaattaggatcctcactgaagtggcgggaccctaagaggctttttcctggccccttagttgtgggttttcctgcgggcggcgcagccggtttccatcagaaccgcccagaggcggacgctgccttcctggggtgacggagcagcaggaagcgttttcggatcctggaatacgtgggcggcccgtgggaggggctgaggcgcagtttcctactcacccggatccgaatcctccgcggtgctgtttcaagaaagccggattccagatcgcgctccagcccggactcggaattcctgccctgcgggtctgcattttcataacgggcaggtgtgagtgccctgcagctggagaccagaagcctgaaggcagctcggccctccccagcccacagcgccgttattccgtttctatatcagtaaacacatttcattttccgtagaccagggcggggtgacgggtgatcccagtcctcgcagtgaattccgggcagcaaaattcaaaacacatgcggccaaggccgggcacggtggttcacgcctgtaatcccagcactttgggaggtcgaggcgggcgatcacctgaggtcgggagctcgagaccaacctgaccaacatggggaaatcccgtctctactaaaaatataaaattagacgggcttggtggtgaatgcctgtaatcccagctagtcgggaggctgaggcaggagaatcgcttaaaccttggaggcggaggttgcggtgagccgagatcgcgccattgcacttcagcctgggcaacaagagggaaaactccgtcgcaaaaactttcgggggcggagcggagccccgccctgggttatgtaagcgaccgcgctgggccgtttctctttcttttccggaccctgcagtggcgcctaaagtctgagagagggaagtcgcctctgtgctcgtgagtgcatggggtataagagccccacagtcttcgttataacctcacggtgctgtcctgggatggatctgtgcagtcagggtttcttgctgaggtacatctggatggtcagcccttcctgcgctatgacaggcagaaatgcagggcaaagccccagggacagtgggcagaagatgtcctgggaaataagacatgggacagagagaccagggacttgacagggaacggaaaggacctcaggatgaccctggctcatatcaaggaccagaaagaaggcttgcattccctccaggagattagggtctgtgagatccatgaagacaacagcaccaggagctcccagcatttctactacgatggggagctcttcctctcccaaaacctggagactgaggaatggacagtgccccagtcctccagagctcagaccttggccatgaacgtcaggaatttcttgaaggaagatgccatgaagaccaagacacactatcacgctatgcatgcagactgcctgcaggaactacggcgatatctagaatccggcgtagtcctgaggagaacagtgccccccatggtgaatgtcacccgcagcgaggcctcagagggcaacatcaccgtgacatgcagggcttccagcttctatccccggaatatcatactgacctggcgtcaggatggggtatctttgagccacgacacccagcagtggggggatgtcctgcctgatgggaatggaacctaccagacctgggtggccaccaggatttgccgaggagaggagcagaggttcacctgctacatggaacacagcgggaatcacagcactcaccctgtgccctctgggaaagtgctggtgcttcagagtcattggcagacattccatgtttctgctgttgctgctggctgctgctatttttgttattattattttctatgtccgttgttgtaagaagaaaacatcagctgcagagggtccagagctcgtgagcctgcaggtcctggatcaacacccagttgggacgagtgaccacagggatgccacacagctcggatttcagcctctgatgtcagctcttgggtccactggctccactgagggcacctagactctacagccaggcggctggaattgaattccctgcctggatctcacaagcactttccctcttggtgcctcagtttcctgacctatgaaacagagaaaataaaagcacttatttattgttgttggaggctgcaaaatgttagtagatatgaggcatttgcagctgtgccatatt

SEQ ID NO: 153690 - DNA, 2260 bp, Homo sapiens
  Payload ID: 10221
  Gene Symbol: MICA
  Gene Name: MHC class I polypeptide-related sequence A
  ENST ID: ENST00000616296
  CDS Start-End: 1222-1929
gtatcatttcagtgaaggtcactccagtctttcatggaggccaaactaagggtgtaaattaggatcctcactgaagtggcgggaccctaagaggctttttcctggccccttagttgtgggttttcctgcgggcggcgcagccggtttccatcagaaccgcccagaggcggacgctgccttcctggggtgacggagcagcaggaagcgttttcggatcctggaatacgtgggcggcccgtgggaggggctgaggcgcagtttcctactcacccggatccgaatcctccgcggtgctgtttcaagagagccggattccagatcacgctccagcccggactcggaattcctgccctgcgggtctgcattttcataacgggcaggtgtgagtgccctgcagctggagaccagaagcctgaaggcagctcggccctccccagcccacagcgccgttattccgtttctatatcagtaaacacatttcattttccgtagaccagggcggggtgacgggtgatcccagtcctcgcagtgaattccgggcagcaaaattcaaaacacatgcggccaaggccgggcacggtggttcacgcctgtaatcccagcactttgggaggtcgaggcgggcgatcacctgaggtcgggagctcgagaccaacctgaccaacatggggaaatcccgtctctactaaaaatataaaattagacgggcttggtggtgaatgcctgtaatcccagctagtcgggaggctgaggcaggagaatcgcttaaaccttggaggcggaggttgcggtgagccgagatcgcgccattgcacttcagcctgggcaacaagagggaaaactccgtcgcaaaaactttcgggggcggagcggagccccgccctgggttatgtaagcgaccgcgctgggccgtttctctttcttttccggaccctgcagtggcgcctaaagtctgagagagggaagtcgcctctgtgctcgtgagtgcatggggtataagagccccacagtcttcgttataacctcacggtgctgtcctgggatggatctgtgcagtcagggtttcttgctgaggtacatctggatggtcagcccttcctgcgctatgacaggcagaaatgcagggcaaagccccagggacagtgggcagaagatgtcctgggaaataagacatgggacagagagaccagggacttgacagggaacggaaaggacctcaggatgaccctggctcatatcaaggaccagaaagaaggcttgcattccctccaggagattagggtctgtgagatccatgaagacaacagcaccaggagctcccagcatttctactacgatggggagctcttcctctcccaaaacctggagactgaggaatggacagtgccccagtcctccagagctcagaccttggccatgaacgtcaggaatttcttgaaggaagatgccatgaagaccaagacacactatcacgctatgcatgcagactgcctgcaggaactacggcgatatctagaatccggcgtagtcctgaggagaacagtgccccccatggtgaatgtcacccgcagcgaggcctcagagggcaacatcaccgtgacatgcagggcttccagcttctatccccggaatatcatactgacctggcgtcaggatggggtatctttgagccacgacacccagcagtggggggatgtcctgcctgatgggaatggaacctaccagacctgggtggccaccaggatttgccgaggagaggagcagaggttcacctgctacatggaacacagcgggaatcacagcactcaccctgtgccctctgggaaagtgctggtgcttcagagtcattggcagacattccatgtttctgctgttgctgctggctgctgctatttttgttattattattttctatgtccgttgttgtaagaagaaaacatcagctgcagagggtccagagctcgtgagcctgcaggtcctggatcaacacccagttgggacgagtgaccacagggatgccacacagctcggatttcagcctctgatgtcagctcttgggtccactggctccactgagggcacctagactctacagccaggcggctggaattgaattccctgcctggatctcacaagcactttccctcttggtgcctcagtttcctgacctatgaaacagagaaaataaaagcacttatttattgttgttggaggctgcaaaatgttagtagatatgaggcatttgcagctgtgccatatt

SEQ ID NO: 153691 - DNA, 2260 bp, Homo sapiens; identical to SEQ ID NO: 153689
  Payload ID: 10221
  Gene Symbol: MICA
  Gene Name: MHC class I polypeptide-related sequence A
  ENST ID: ENST00000616968
  CDS Start-End: 1222-1929

SEQ ID NO: 153692 - DNA, 2446 bp, Homo sapiens
  Payload ID: 10222
  Gene Symbol: MICB
  Gene Name: MHC class I polypeptide-related sequence B
  ENST ID: ENST00000252229
  CDS Start-End: 80-1231
aaatttcgacggggtcttctcacgggtttcattcagttggccactgctgagcagctgagaaggtggcgacgtaggggccatggggctgggccgggtcctgctgtttctggccgtcgccttcccttttgcacccccggcagccgccgctgagccccacagtcttcgttacaacctcatggtgctgtcccaggatggatctgtgcagtcagggtttctcgctgagggacatctggatggtcagcccttcctgcgctatgacaggcagaaacgcagggcaaagccccagggacagtgggcagaaaatgtcctgggagctaagacctgggacacagagaccgaggacttgacagagaatgggcaagacctcaggaggaccctgactcatatcaaggaccagaaaggaggcttgcattccctccaggagattagggtctgtgagatccatgaagacagcagcaccaggggctcccggcatttctactacgatggggagctcttcctctcccaaaacctggagactcaagaatcgacagtgccccagtcctccagagctcagaccttggctatgaacgtcacaaatttctggaaggaagatgccatgaagaccaagacacactatcgcgctatgcaggcagactgcctgcagaaactacagcgatatctgaaatccggggtggccatcaggagaacagtgccccccatggtgaatgtcacctgcagcgaggtctcagagggcaacatcaccgtgacatgcagggcttccagcttctatccccggaatatcacactgacctggcgtcaggatggggtatctttgagccacaacacccagcagtggggggatgtcctgcctgatgggaatggaacctaccagacctgggtggccaccaggattcgccaaggagaggagcagaggttcacctgctacatggaacacagcgggaatcacggcactcaccctgtgccctctgggaaggcgctggtgcttcagagtcaacggacagactttccatatgtttctgctgctatgccatgttttgttattattattattctctgtgtcccttgttgcaagaagaaaacatcagcggcagagggtccagagcttgtgagcctgcaggtcctggatcaacacccagttgggacaggagaccacagggatgcagcacagctgggatttcagcctctgatgtcagctactgggtccactggttccactgagggcacctagactctacagccaggcggccaggattcaactccctgcctggatctcaccagcactttccctctgtttcctgacctatgaaacagagaaaataacatcacttatttattgttgttggatgctgcaaagtgttagtaggtatgaggtgtttgctgctctgccacgtagagagccagcaaagggatcatgaccaactcaacattccattggaggctatatgatcaaacagcaaattgtttatcatgaatgcaggatgtgggcaaactcacgactgctcctgccaacagaaggtttgctgagggcattcactccatggtgctcattggagttatctactgggtcatctagagcctattgtttgaggaatgcagtcttacaagcctactctggacccagcagctgactccttcttccacccctcttcttgctatctcctataccaataaatacgaagggctgtggaagatcagagcccttgttcacgagaagcaagaagccccctgaccccttgttccaaatatactcttttgtctttctctttattcccacgttcgccctttgttcagtccaatacagggttgtggggcccttaacagtgccatattaattggtatcattatttctgttgtttttgtttttgtttttgtttttgtttttgagacagagtctcactctgtcacccaggctgcagttcactggtgtgatctcagctcactgcaacctctgcctcccaggttcaagcacttctcgtacctcagactcccgaatagctgggattacagacaggcaccaccacacccagctaatttttgtattttttgtagagacggggtttcgccaagttgaccagcccagtttcaaactcctgacctcaggtgatctgcctgccttggcatcccaaagtgctgggattacaagaatgagccaccgtgcctggcctattttattatattgtaatatattttattatattagccaccatgcctgtcctattttcttatgttttaatatattttaatatattacatgtgcagtaattagattatcatgggtgaactttatgagtgagtatcttggtgatgactcctcctgaccagcccaggaccagctttcttgtcaccttgaggtcccctcgccccgtcacaccgttatgcattactctgtgtctactattatgtgtgcataatttataccgtaaatgtttactctttaaataga

SEQ ID NO: 153693 - DNA, 2446 bp, Homo sapiens
  Payload ID: 10222
  Gene Symbol: MICB
  Gene Name: MHC class I polypeptide-related sequence B
  ENST ID: ENST00000383514
  CDS Start-End: 80-1231
aaatttccacggggtcttctcaccgttttcattcagttggccactgctgagcagctgagaaggtggcgacgtaggggccatggggctgggccgggtcctgctgtttctggccgtcgccttcccttttgcacccccggcagccgccgctgagccccacagtcttcgttacaacctcatggtgctgtcccaggatggatctgtgcagtcagggtttctcgctgagggacatctggatggtcagcccttcctgcgctatgacaggcagaaacgcagggcaaagccccagggacagtgggcagaagatgtcctgggagctaagacctgggacacagagaccgaggacttgacagagaatgggcaagacctcaggaggaccctgactcatatcaaggaccagaaaggaggcttgcattccctccaggagattagggtctgtgagatccatgaagacagcagcaccaggggctcccggcatttctactacgatggggagctcttcctctcccaaaacctggagactcaagaatcgacagtgccccagtcctccagagctcagaccttggctatgaacgtcacaaatttctggaaggaagatgccatgaagaccaagacacactatcgcgctatgcaggcagactgcctgcagaaactacagcgatatctgaaatccggggtggccatcaggagaacagtgccccccatggtgaatgtcatctgcagcgaggtctcagagggcaacatcaccgtgacatgcagggcttccagcttctatccccggaatatcacactgacctggcgtcaggatggggtatctttgagccacaacacccagcagtggggggatgtcctgcctgatgggaatggaacctaccagacctgggtggccaccaggattcgccaaggagaggagcagaggttcacctgctacatggaacacagcgggaatcacggcactcaccctgtgccctctgggaaggcgctggtgcttcagagtcaacggacagactttccatatgtttctgctgctatgccatgttttgttattattattattctctgtgtcccttgttgcaagaagaaaacatcagcggcagagggtccagagcttgtgagcctgcaggtcctggatcaacacccagttgggacaggagaccacagggatgcagcacagctgggatttcagcctctgatgtcagctactgggtccactggttccactgagggcacctagactctacagccaggcggccaggattcaactccctgcctggatctcaccagcactttccctctgtttcctgacctatgaaacagagaaaataacatcacttatttattgttgttggatgctgcaaagtgttagtaggtatgaggtgtttgctgctctgccacgtagagagccagcaaagggatcatgaccaactcaacattccattggaggctatatgatcaaacagcaaattgtttatcatgaatgcaggatgtgggcaaactcacgactgctcctgccaacagaaggtttgctgagggcattcactccatggtgctcattggagttatctactgggtcatctagagcctattgtttgaggaatgcagtcttacaagcctactctggacccagcagctgactccttcttccacccctcttcttgctatctcctataccaataaatacgaagggctgtggaagatcagagcccttgttcacgagaagcaagaagccccctgaccccttgttccaaatatactcttttgtctttctctttattcccacgttcgccctttgttcagtccaatacagggttgtggggcccttaacagtgccatattaattggtatcattatttctgttgtttttgtttttgtttttgtttttgtttttgagacagagtctcactctgtcacccaggctgcagttcactggtgtgatctcagctcactgcaacctctgcctcccaggttcaagcacttctcgtacctcagactcccgaatagctgggattacagacaggcaccaccacacccagctaatttttgtattttttgtagagacggggtttcgccaagttgaccagcccagtttcaaactcctgacctcaggtgatctgcctgccttggcatcccaaagtgctgggattacaagaatgagccaccgtgcctggcctattttattatattgtaatatattttattatattagccaccatgcctgtcctattttcttatgttttaatatattttaatatattacatgtgcagtaattagattatcatgggtgaactttatgagtgagtatcttggtgatgactcctcctgaccagcccaggaccagctttcttgtcaccttgaggtcccctcgccccgtcacaccgttatgcattactctgtgtctactattatgtgtgcataatttataccgtaaatgtttactctttaaataga

SEQ ID NO: 153694 - DNA, 2346 bp, Homo sapiens
  Payload ID: 10222
  Gene Symbol: MICB
  Gene Name: MHC class I polypeptide-related sequence B
  Uniprot ID: Q29980
  ENST ID: ENST00000399150
  CDS Start-End: 109-1131
agcggtcgctgagcggggcgcaggtgactaaatttcgacggggtcttctcacgggtttcattcagttggccactgctgagcagctgagaaggtggcgacgtaggggccatggggctgggccgggtcctgctgtttctggccgtcgccttcccttttgcacccccggcagccgccgctgagccccacagtcttcgttacaacctcatggtgctgtcccaggatggatctgtgcagtcagggtttctcgctgagggacatctggatggtcagcccttcctgcgctatgacaggcagaaacgcagggcaaagccccagggacagtgggcagaaaatgtcctgggagctaagacctgggacacagagaccgaggacttgacagagaatgggcaagacctcaggaggaccctgactcatatcaaggaccagaaaggagtgccccagtcctccagagctcagaccttggctatgaacgtcacaaatttctggaaggaagatgccatgaagaccaagacacactatcgcgctatgcaggcagactgcctgcagaaactacagcgatatctgaaatccggggtggccatcaggagaacagtgccccccatggtgaatgtcacctgcagcgaggtctcagagggcaacatcaccgtgacatgcagggcttccagcttctatccccggaatatcacactgacctggcgtcaggatggggtatctttgagccacaacacccagcagtggggggatgtcctgcctgatgggaatggaacctaccagacctgggtggccaccaggattcgccaaggagaggagcagaggttcacctgctacatggaacacagcgggaatcacggcactcaccctgtgccctctgggaaggcgctggtgcttcagagtcaacggacagactttccatatgtttctgctgctatgccatgttttgttattattattattctctgtgtcccttgttgcaagaagaaaacatcagcggcagagggtccagagcttgtgagcctgcaggtcctggatcaacacccagttgggacaggagaccacagggatgcagcacagctgggatttcagcctctgatgtcagctactgggtccactggttccactgagggcacctagactctacagccaggcggccaggattcaactccctgcctggatctcaccagcactttccctctgtttcctgacctatgaaacagagaaaataacatcacttatttattgttgttggatgctgcaaagtgttagtaggtatgaggtgtttgctgctctgccacgtagagagccagcaaagggatcatgaccaactcaacattccattggaggctatatgatcaaacagcaaattgtttatcatgaatgcaggatgtgggcaaactcacgactgctcctgccaacagaaggtttgctgagggcattcactccatggtgctcattggagttatctactgggtcatctagagcctattgtttgaggaatgcagtcttacaagcctactctggacccagcagctgactccttcttccacccctcttcttgctatctcctataccaataaatacgaagggctgtggaagatcagagcccttgttcacgagaagcaagaagccccctgaccccttgttccaaatatactcttttgtctttctctttattcccacgttcgccctttgttcagtccaatacagggttgtggggcccttaacagtgccatattaattggtatcattatttctgttgtttttgtttttgtttttgtttttgtttttgagacagagtctcactctgtcacccaggctgcagttcactggtgtgatctcagctcactgcaacctctgcctcccaggttcaagcacttctcgtacctcagactcccgaatagctgggattacagacaggcaccaccacacccagctaatttttgtattttttgtagagacggggtttcgccaagttgaccagcccagtttcaaactcctgacctcaggtgatctgcctgccttggcatcccaaagtgctgggattacaagaatgagccaccgtgcctggcctattttattatattgtaatatattttattatattagccaccatgcctgtcctattttcttatgttttaatatattttaatatattacatgtgcagtaattagattatcatgggtgaactttatgagtgagtatcttggtgatgactcctcctgaccagcccaggaccagctttcttgtcaccttgaggtcccctcgccccgtcacaccgttatgcattactctgtgtctactattatgtgtgcataatttataccgtaaatgtttactctttaaataga

SEQ ID NO: 153695 - DNA, 2338 bp, Homo sapiens
  Payload ID: 10222
  Gene Symbol: MICB
  Gene Name: MHC class I polypeptide-related sequence B
  ENST ID: ENST00000400313
  CDS Start-End: 109-1131
agcggtcgctgagcggggcgcaggtgactaaatttcgacggggtcttctcaccggtttcattcagttggccactgctgagcagctgagaaggtggcgacgtaggggccatggggctgggccgggtcctgctgtttctggccgtcgccttcccttttgcacccccggcagccgccgctgagccccacagtcttcgttacaacctcatggtgctgtcccaggatggatctgtgcagtcagggtttctcgctgagggacatctggatggtcagcccttcctgcgctatgacaggcagaaacgcagggcaaagccccagggacagtgggcagaagatgtcctgggagctaagacctgggacacagagaccgaggacttgacagagaatgggcaagacctcaggaggaccctgactcatatcaaggaccagaaaggagtgccccagtcctccagagctcagaccttggctatgaacgtcacaaatttctggaaggaagatgccatgaagaccaagacacactatcgcgctatgcaggcagactgcctgcagaaactacagcgatatctgaaatccggggtggccatcaggagaacagtgccccccatggtgaatgtcacctgcagcgaggtctcagagggcaacatcaccgtgacatgcagggcttccagcttctatccccggaatatcacactgacctggcgtcaggatggggtatctttgagccacaacacccagcagtggggggatgtcctgcctgatgggaatggaacctaccagacctgggtggccaccaggattcgccaaggagaggagcagaggttcacctgctacatggaacacagcgggaatcacggcactcaccctgtgccctctgggaaggcgctggtgcttcagagtcaacggacagactttccatatgtttctgctgctatgccatgttttgttattattattattctctgtgtcccttgttgcaagaagaaaacatcagcggcagagggtccagagcttgtgagcctgcaggtcctggatcaacacccagttgggacaggagaccacagggatgcagcacagctgggatttcagcctctgatgtcagctactgggtccactggttccactgagggcgcctagactctacagccaggcggccaggattcaactccctgcctggatctcaccagcactttccctctgtttcctgacctatgaaacagaaaataacatcacttatttattgttgttggatgctgcaaagtgttagtaggtatgaggtgtttgctgctctgccacgtagagagccagcaaagggatcatgaccaactcaacattccattggaggctatatgatcaaacagcaaattgtttatcatgaatgcaggatgtgggcaaactcacgactgctcctgccaacagaaggtttgctgagggcattcactccatggtgctcattggagttatctactgggtcatctagagcctattgtttgaggaatgcagtcttacaagcctactctggacccagcagctgactccttcttccacccctcttcttgctatctcctataccaataaatacgaagggctgtggaagatcagagcccttgttcacgagaagcaagaagccccctgaccccttgttccaaatatactcttttgtctttctctttattcccacgttcgccctttgttcagtccaatacagggttgtggggcccttaacagtgccatattaattggtatcattatttctgttgtttttgtttttgtttttgtttttgagacagagtctcactctgtcacccaggctgcagttcactggtgtgatctcagctcactgcaacctctgcctcccaggttcaagcacttctcgtacctcagactcccgaatagctgggattacagacaggcaccaccacacccagctaatttttgtattttttgtagagacgggatttcgccaagttgaccagcccagtttcaaactcctgacctcaggtgatctgcctgccttggcatcccaaagtgctgggattacaagaatgagccaccgtgcctggcctattttattatattgtaatatattttattatattagccaccatgcctgtcctattttcttatgttttaatatattttaatatattacatgtgcagtaattagattatcatgggtgaactttatgagtgagtatcttggtgatgactcctcctgaccagcccaggaccagctttcttgtcaccttgaggtcccctcgccccgtcacaccgttatgcattactctgtgtctactattatgtgtgcataatttataccgtaaatgtttactctttaaataga

SEQ ID NO: 153696 - DNA, 2346 bp, Homo sapiens; identical to SEQ ID NO: 153694
  Payload ID: 10222
  Gene Symbol: MICB
  Gene Name: MHC class I polypeptide-related sequence B
  ENST ID: ENST00000442104
  CDS Start-End: 109-1131

SEQ ID NO: 153697 - DNA, 2450 bp, Homo sapiens
  Payload ID: 10222
  Gene Symbol: MICB
  Gene Name: MHC class I polypeptide-related sequence B
  Uniprot ID: Q29980
  ENST ID: ENST00000443156
  CDS Start-End: 80-1231
aaatttcgacggggtcttctcaccggtttcattcagttggccactgctgagcagctgagaaggtggcgacgtaggggccatggggctgggccgggtcctgctgtttctggccgtcgccttcccttttgcacccccggcagccgccgctgagccccacagtcttcgttacaacctcatggtgctgtcccaggatggatctgtgcagtcagggtttctcgctgagggacatctggatggtcagcccttcctgcgctatgacaggcagaaacgcagggcaaagccccagggacagtgggcagaagatgtcctgggagctaagacctgggacacagagaccgaggacttgacagagaatgggcaagacctcaggaggaccctgactcatatcaaggaccagaaaggaggcttgcattccctccaggagattagggtctgtgagatccatgaagacagcagcaccaggggctcccggcatttctactacgatggggagctcttcctctcccaaaacctggagactcaagaatcgacagtgccccagtcctccagagctcagaccttggctatgaacgtcacaaatttctggaaggaagatgccatgaagaccaagacacactatcgcgctatgcaggcagactgcctgcagaaactacagcgatatctgaaatccggggtggccatcaggagaacagtgccccccatggtgaatgtcacctgcagcgaggtctcagagggcaacatcaccgtgacatgcagggcttccagcttctatccccggaatatcacactgacctggcgtcaggatggggtatctttgagccacaacacccagcagtggggggatgtcctgcctgatgggaatggaacctaccagacctgggtggccaccaggattcgccaaggagaggagcagaggttcacctgctacatggaacacagcgggaatcacggcactcaccctgtgccctctgggaaggcgctggtgcttcagagtcaacggacagactttccatatgtttctgctgctatgccatgttttgttattattattattctctgtgtcccttgttgcaagaagaaaacatcagcggcagagggtccagagcttgtgagcctgcaggtcctggatcaacacccagttgggacaggagaccacagggatgcagcacagctgggatttcagcctctgatgtcagctactgggtccactggttccactgagggcgcctagactctacagccaggcggccaggattcaactccctgcctggatctcaccagcactttccctctgtttcctgacctatgaaacagaaaataacatcacttatttattgttgttggatgctgcaaagtgttagtaggtatgaggtgtttgctgctctgccacgtagagagccagcaaagggatcatgaccaactcaacattccattggaggctatatgatcaaacagcaaattgtttatcatgaatgcaggatgtgggcaaactcacgactgctcctgccaacagaaggtttgctgagggcattcactccatggtgctcattggagttatctactgggtcatctagagcctattgtttgaggaatgcagtcttacaagcctactctggacccagcagctgactccttcttccacccctcttcttgctatctcctataccaataaatacgaagggctgtggaagatcagagcccttgttcacgagaagcaagaagccccctgaccccttgttccaaatatactcttttgtctttctctttattcccacgttcgccctttgttcagtccaatacagggttgtggggcccttaacagtgccatattaattggtatcattatttctgttgtttttgtttttgtttttgtttttgtttttgtttttgagacagagtctcactctgtcacccaggctgcagttcactggtgtgatctcagctcactgcaacctctgcctcccaggttcaagcacttctcgtacctcagactcccgaatagctgggattacagacaggcaccaccacacccagctaatttttgtattttttgtagagacggggtttcgccaagttgaccagcccagtttcaaactcctgacctcaggtgatctgcctgccttggcatcccaaagtgctgggattacaagaatgagccaccgtgcctggcctattttattatattgtaatatattttattatattagccaccatgcctgtcctattttcttatgttttaatatattttaatatattacatgtgcagtaattagattatcatgggtgaactttatgagtgagtatcttggtgatgactcctcctgaccagcccaggaccagctttcttgtcaccttgaggtcccctcgccccgtcacaccgttatgcattactctgtgtctactattatgtgtgcataatttataccgtaaatgtttactctttaaataga

SEQ ID NO: 153698 - DNA, 2295 bp, Homo sapiens
  Payload ID: 10222
  Gene Symbol: MICB
  Gene Name: MHC class I polypeptide-related sequence B
  ENST ID: ENST00000428059
  CDS Start-End: 1-1082
agccccacagtcttcgttacaacctcatggtgctgtcccaggatggatctgtgcagtcagggtttctcgctgagggacatctggatggtcagcccttcctgcgctatgacaggcagaaacgcagggcaaagccccagggacagtgggcagaagatgtcctgggagctaagacctgggacacagagaccgaggacttgacagagaatgggcaagacctcaggaggaccctgactcatatcaaggaccagaaaggaggcttgcattccctccaggagattagggtctgtgagatccatgaagacagcagcaccaggggctcccggcatttctactacgatggggagctcttcctctcccaaaacctggagactcaagaatcgacagtgccccagtcctccagagctcagaccttggctatgaacgtcacaaatttctggaaggaagatgccatgaagaccaagacacactatcgcgctatgcaggcagactgcctgcagaaactacagcgatatctgaaatccggggtggccatcaggagaacagtgccccccatggtgaatgtcacctgcagcgaggtctcagagggcaacatcaccgtgacatgcagggcttccagcttctatccccggaatatcacactgacctggcgtcaggatggggtatctttgagccacaacacccagcagtggggggatgtcctgcctgatgggaatggaacctaccagacctgggtggccaccaggattcgccaaggagaggagcagaggttcacctgctacatggaacacagcgggaatcacggcactcaccctgtgccctctgggaaggcgctggtgcttcagagtcaacggacagactttccatatgtttctgctgctatgccatgttttgttattattattattctctgtgtcccttgttgcaagaagaaaacatcagcggcagagggtccagagcttgtgagcctgcaggtcctggatcaacacccagttgggacaggagaccacagggatgcagcacagctgggatttcagcctctgatgtcagctactgggtccactggttccactgagggcgcctagactctacagccaggcggccaggattcaactccctgcctggatctcaccagcactttccctctgtttcctgacctatgaaacagaaaataacatcacttatttattgttgttggatgctgcaaagtgttagtaggtatgaggtgtttgctgctctgccacgtagagagccagcaaagggatcatgaccaactcaacattccattggaggctatatgatcaaacagcaaattgtttatcatgaatgcaggatgtgggcaaactcacgactgctcctgccaacagaaggtttgctgagggcattcactccatggtgctcattggagttatctactgggtcatctagagcctattgtttgaggaatgcagtcttacaagcctactctggacccagcagctgactccttcttccacccctcttcttgctatctcctataccaataaatacgaagggctgtggaagatcagagcccttgttcacgagaagcaagaagccccctgaccccttgttccaaatatactcttttgtctttctctttattcccacgttcgccctttgttcagtccaatacagggttgtggggcccttaacagtgccatattaattggtatcattatttctgttgtttttgtttttgtttttgtttttgtttttgagacagagtctcactctgtcacccaggctgcagttcactggtgtgatctcagctcactgcaacctctgcctcccaggttcaagcacttctcgtacctcagactcccgaatagctgggattacagacaggcaccaccacacccagctaatttttgtattttttgtagagacggggtttcgccaagttgaccagcccagtttcaaactcctgacctcaggtgatctgcctgccttggcatcccaaagtgctgggattacaagaatgagccaccgtgcctggcctattttattatattgtaatatattttattatattagccaccatgcctgtcctattttcttatgttttaatatattttaatatattacatgtgcagtaattagattatcatgggtgaactttatgagtgagtatcttggtgatgactcctcctgaccagcccaggaccagctttcttgtcaccttgaggtcccctcgccccgtcacaccgttatgcattactctgtgtctactattatgtgtgcataatttataccgtaaatgtttactctttaaataga

SEQ ID NO: 153699 - DNA, 2344 bp, Homo sapiens
  Payload ID: 10222
  Gene Symbol: MICB
  Gene Name: MHC class I polypeptide-related sequence B
  Uniprot ID: Q29980
  ENST ID: ENST00000438954
  CDS Start-End: 109-1131
agcggtcgctgagcggggcgcaggtgactaaatttcgacggggtcttctcaccggtttcattcagttggccactgctgagcagctgagaaggtggcgacgtaggggccatggggctgggccgggtcctgctgtttctggccgtcgccttcccttttgcacccccggcagccgccgctgagccccacagtcttcgttacaacctcatggtgctgtcccaggatggatctgtgcagtcagggtttctcgctgagggacatctggatggtcagcccttcctgcgctatgacaggcagaaacgcagggcaaagccccagggacagtgggcagaagatgtcctgggagctgagacctgggacacagagaccgaggacttgacagagaatgggcaagacctcaggaggaccctgactcatatcaaggaccagaaaggagtgccccagtcctccagagctcagaccttggctatgaacgtcacaaatttctggaaggaagatgccatgaagaccaagacacactatcgcgctatgcaggcagactgcctgcagaaactacagcgatatctgaaatccggggtggccatcaggagaacagtgccccccatggtgaatgtcacctgcagcgaggtctcagagggcaacatcaccgtgacatgcagggcttccagcttctatccccggaatatcacactgacctggcgtcaggatggggtatctttgagccacaacacccagcagtggggggatgtcctgcctgatgggaatggaacctaccagacctgggtggccaccaggattcgccaaggagaggagcagaggttcacctgctacatggaacacagcgggaatcacggcactcaccctgtgccctctgggaaggcgctggtgcttcagagtcaacggacagactttccatatgtttctgctgctatgccatgttttgttattattattattctctgtgtcccttgttgcaagaagaaaacatcagcggcagagggtccagagcttgtgagcctgcaggtcctggatcaacacccagttgggacaggagaccacagggatgcagcacagctgggatttcagcctctgatgtcagctactgggtccactggttccactgagggcgcctagactctacagccaggcggccaggattcaactccctgcctggatctcaccagcactttccctctgtttcctgacctatgaaacagaaaataacatcacttatttattgttgttggatgctgcaaagtgttagtaggtatgaggtgtttgctgctctgccacgtagagagccagcaaagggatcatgaccaactcaacattccattggaggctatatgatcaaacagcaaattgtttatcatgaatgcaggatgtgggcaaactcacgactgctcctgccaacagaaggtttgctgagggcattcactccatggtgctcattggagttatctactgggtcatctagagcctattgtttgaggaatgcagtcttacaagcctactctggacccagcagctgactccttcttccacccctcttcttgctatctcctataccaataaatacgaagggctgtggaagatcagagcccttgttcacgagaagcaagaagccccctgaccccttgttccaaatatactcttttgtctttctctttattcccacgttcgccctttgttcagtccaatacagggttgtggggcccttaacagtgccatattaattggtatcattatttctgttgtttttgtttttgtttttgtttttgtttttgagacagagtctcactctgtcacccaggctgcagttcactggtgtgatctcagctcactgcaacctctgcctcccaggttcaagcacttctcgtacctcagactcccgaatagctgggattacagacaggcaccaccacacccagctaatttttgtattttttgtagagacggggtttcgccaagttgaccagcccagtttcaaactcctgacctcaggtgatctgcctgccttggcatcccaaagtgctgggattacaagaatgagccaccgtgcctggcctattttattatattgtaatatattttattatattagccaccatgcctgtcctattttcttatgttttaatatattttaatatattacatgtgcagtaattagattatcatgggtgaactttatgagtgagtatcttggtgatgactcctcctgaccagcccaggaccagctttcttgtcaccttgaggtcccctcgccccgtcacaccgttatgcattactctgtgtctactattatgtgtgcataatttataccgtaaatgtttactctttaaataga

SEQ ID NO: 153700 - DNA, 2438 bp, Homo sapiens
  Payload ID: 10222
  Gene Symbol: MICB
  Gene Name: MHC class I polypeptide-related sequence B
  Uniprot ID: Q29980
  ENST ID: ENST00000428416
  CDS Start-End: 80-1231
aaatttcgacggggtcttctcaccggtttcattcagttggccactgctgagcagctgagaaggtggcgacgtaggggccatggggctgggccgggtcctgctgtttctggccgtcgccttcccttttgcacccccggcagccgccgctgagccccacagtcttcgttacaacctcatggtgctgtcccaggatggatctgtgcagtcagggtttctcgctgagggacatctggatggtcagcccttcctgcgctatgacaggcagaaacgcagggcaaagccccagggacagtgggcagaagatgtcctgggagctaagacctgggacacagagaccgaggacttgacagagaatgggcaagacctcaggaggaccctgactcatatcaaggaccagaaaggaggcttgcattccctccaggagattagggtctgtgagatccatgaagacagcagcaccaggggctcccggcatttctactacgatggggagctcttcctctcccaaaacctggagactcaagaatcgacagtgccccagtcctccagagctcagaccttggctatgaacgtcacaaatttctggaaggaagatgccatgaagaccaagacacactatcgcgctatgcaggcagactgcctgcagaaactacagcgatatctgaaatccggggtggccatcaggagaacagtgccccccatggtgaatgtcacctgcagcgaggtctcagagggcaacatcaccgtgacatgcagggcttccagcttctatccccggaatatcacactgacctggcgtcaggatggggtatctttgagccacaacacccagcagtggggggatgtcctgcctgatgggaatggaacctaccagacctgggtggccaccaggattcgccaaggagaggagcagaggttcacctgctacatggaacacagcgggaatcacggcactcaccctgtgccctctgggaaggcgctggtgcttcagagtcaacggacagactttccatatgtttctgctgctatgccatgttttgttattattattattctctgtgtcccttgttgcaagaagaaaacatcagcggcagagggtccagagcttgtgagcctgcaggtcctggatcaacacccagttgggacaggagaccacagggatgcagcacagctgggatttcagcctctgatgtcagctactgggtccactggttccactgagggcgcctagactctacagccaggcggccaggattcaactccctgcctggatctcaccagcactttccctctgtttcctgacctatgaaacagaaaataacatcacttatttattgttgttggatgctgcaaagtgttagtaggtatgaggtgtttgctgctctgccacgtagagagccagcaaagggatcatgaccaactcaacattccattggaggctatatgatcaaacagcaaattgtttatcatgaatgcaggatgtgggcaaactcacgactgctcctgccaacagaaggtttgctgagggcattcactccatggtgctcattggagttatctactgggtcatctagagcctattgtttgaggaatgcagtcttacaagcctactctggacccagcagctgactccttcttccacccctcttcttgctatctcctataccaataaatacgaagggctgtggaagatcagagcccttgttcacgagaagcaagaagccccctgaccccttgttccaaatatactcttttgtctttctctttattcccacgttcgccctttgttcagtccaatacagggttgtggggcccttaacagtgccatattaattggtatcattatttctgttgtttttgtttttgtttttgtttttgagacagagtctcactctgtcacccaggctgcagttcactggtgtgatctcagctcactgcaacctctgcctcccaggttcaagcacttctcgtacctcagactcccgaatagctgggattacagacaggcaccaccacacccagctaatttttgtattttttgtagagacgggatttcgccaagttgaccagcccagtttcaaactcctgacctcaggtgatctgcctgccttggcatcccaaagtgctgggattacaagaatgagccaccgtgcctggcctattttattatattgtaatatattttattatattagccaccatgcctgtcctattttcttatgttttaatatattttaatatattacatgtgcagtaattagattatcatgggtgaactttatgagtgagtatcttggtgatgactcctcctgaccagcccaggaccagctttcttgtcaccttgaggtcccctcgccccgtcacaccgttatgcattactctgtgtctactattatgtgtgcataatttataccgtaaatgtttactctttaaataga

SEQ ID NO: 153701 - DNA, 2346 bp, Homo sapiens
  Payload ID: 10222
  Gene Symbol: MICB
  Gene Name: MHC class I polypeptide-related sequence B
  ENST ID: ENST00000437651
  CDS Start-End: 109-1131
agcggtcgctgagcggggcgcaggtgactaaatttccacggggtcttctcaccgttttcattcagttggccactgctgagcagctgagaaggtggcgacgtaggggccatggggctgggccgggtcctgctgtttctggccgtcgccttcccttttgcacccccggcagccgccgctgagccccacagtcttcgttacaacctcatggtgctgtcccaggatggatctgtgcagtcagggtttctcgctgagggacatctggatggtcagcccttcctgcgctatgacaggcagaaacgcagggcaaagccccagggacagtgggcagaagatgtcctgggagctaagacctgggacacagagaccgaggacttgacagagaatgggcaagacctcaggaggaccctgactcatatcaaggaccagaaaggagtgccccagtcctccagagctcagaccttggctatgaacgtcacaaatttctggaaggaagatgccatgaagaccaagacacactatcgcgctatgcaggcagactgcctgcagaaactacagcgatatctgaaatccggggtggccatcaggagaacagtgccccccatggtgaatgtcatctgcagcgaggtctcagagggcaacatcaccgtgacatgcagggcttccagcttctatccccggaatatcacactgacctggcgtcaggatggggtatctttgagccacaacacccagcagtggggggatgtcctgcctgatgggaatggaacctaccagacctgggtggccaccaggattcgccaaggagaggagcagaggttcacctgctacatggaacacagcgggaatcacggcactcaccctgtgccctctgggaaggcgctggtgcttcagagtcaacggacagactttccatatgtttctgctgctatgccatgttttgttattattattattctctgtgtcccttgttgcaagaagaaaacatcagcggcagagggtccagagcttgtgagcctgcaggtcctggatcaacacccagttgggacaggagaccacagggatgcagcacagctgggatttcagcctctgatgtcagctactgggtccactggttccactgagggcacctagactctacagccaggcggccaggattcaactccctgcctggatctcaccagcactttccctctgtttcctgacctatgaaacagagaaaataacatcacttatttattgttgttggatgctgcaaagtgttagtaggtatgaggtgtttgctgctctgccacgtagagagccagcaaagggatcatgaccaactcaacattccattggaggctatatgatcaaacagcaaattgtttatcatgaatgcaggatgtgggcaaactcacgactgctcctgccaacagaaggtttgctgagggcattcactccatggtgctcattggagttatctactgggtcatctagagcctattgtttgaggaatgcagtcttacaagcctactctggacccagcagctgactccttcttccacccctcttcttgctatctcctataccaataaatacgaagggctgtggaagatcagagcccttgttcacgagaagcaagaagccccctgaccccttgttccaaatatactcttttgtctttctctttattcccacgttcgccctttgttcagtccaatacagggttgtggggcccttaacagtgccatattaattggtatcattatttctgttgtttttgtttttgtttttgtttttgtttttgagacagagtctcactctgtcacccaggctgcagttcactggtgtgatctcagctcactgcaacctctgcctcccaggttcaagcacttctcgtacctcagactcccgaatagctgggattacagacaggcaccaccacacccagctaatttttgtattttttgtagagacggggtttcgccaagttgaccagcccagtttcaaactcctgacctcaggtgatctgcctgccttggcatcccaaagtgctgggattacaagaatgagccaccgtgcctggcctattttattatattgtaatatattttattatattagccaccatgcctgtcctattttcttatgttttaatatattttaatatattacatgtgcagtaattagattatcatgggtgaactttatgagtgagtatcttggtgatgactcctcctgaccagcccaggaccagctttcttgtcaccttgaggtcccctcgccccgtcacaccgttatgcattactctgtgtctactattatgtgtgcataatttataccgtaaatgtttactctttaaataga

SEQ ID NO: 153702 - DNA, 2444 bp, Homo sapiens
  Payload ID: 10222
  Gene Symbol: MICB
  Gene Name: MHC class I polypeptide-related sequence B
  Uniprot ID: Q29980
  ENST ID: ENST00000436655
  CDS Start-End: 80-1231
aaatttcgacggggtcttctcaccggtttcattcagttggccactgctgagcagctgagaaggtggcgacgtaggggccatggggctgggccgggtcctgctgtttctggccgtcgccttcccttttgcacccccggcagccgccgctgagccccacagtcttcgttacaacctcatggtgctgtcccaggatggatctgtgcagtcagggtttctcgctgagggacatctggatggtcagcccttcctgcgctatgacaggcagaaacgcagggcaaagccccagggacagtgggcagaagatgtcctgggagctgagacctgggacacagagaccgaggacttgacagagaatgggcaagacctcaggaggaccctgactcatatcaaggaccagaaaggaggcttgcattccctccaggagattagggtctgtgagatccatgaagacagcagcaccaggggctcccggcatttctactacaatggggagctcttcctctcccaaaacctggagactcaagaatcgacagtgccccagtcctccagagctcagaccttggctatgaacgtcacaaatttctggaaggaagatgccatgaagaccaagacacactatcgcgctatgcaggcagactgcctgcagaaactacagcgatatctgaaatccggggtggccatcaggagaacagtgccccccatggtgaatgtcacctgcagcgaggtctcagagggcaacatcaccgtgacatgcagggcttccagcttctatccccggaatatcacactgacctggcgtcaggatggggtatctttgagccacaacacccagcagtggggggatgtcctgcctgatgggaatggaacctaccagacctgggtggccaccaggattcgccaaggagaggagcagaggttcacctgctacatggaacacagcgggaatcacggcactcaccctgtgccctctgggaaggcgctggtgcttcagagtcaacggacagactttccatatgtttctgctgctatgccatgttttgttattattattattctctgtgtcccttgttgcaagaagaaaacatcagcggcagagggtccagagcttgtgagcctgcaggtcctggatcaacacccagttgggacaggagaccacagggatgcagcacagctgggatttcagcctctgatgtcagctactgggtccactggttccactgagggcgcctagactctacagccaggcggccaggattcaactccctgcctggatctcaccagcactttccctctgtttcctgacctatgaaacagaaaataacatcacttatttattgttgttggatgctgcaaagtgttagtaggtatgaggtgtttgctgctctgccacgtagagagccagcaaagggatcatgaccaactcaacattccattggaggctatatgatcaaacagcaaattgtttatcatgaatgcaggatgtgggcaaactcacgactgctcctgccaacagaaggtttgctgagggcattcactccatggtgctcattggagttatctactgggtcatctagagcctattgtttgaggaatgcagtcttacaagcctactctggacccagcagctgactccttcttccacccctcttcttgctatctcctataccaataaatacgaagggctgtggaagatcagagcccttgttcacgagaagcaagaagccccctgaccccttgttccaaatatactcttttgtctttctctttattcccacgttcgccctttgttcagtccaatacagggttgtggggcccttaacagtgccatattaattggtatcattatttctgttgtttttgtttttgtttttgtttttgtttttgagacagagtctcactctgtcacccaggctgcagttcactggtgtgatctcagctcactgcaacctctgcctcccaggttcaagcacttctcgtacctcagactcccgaatagctgggattacagacaggcaccaccacacccagctaatttttgtattttttgtagagacggggtttcgccaagttgaccagcccagtttcaaactcctgacctcaggtgatctgcctgccttggcatcccaaagtgctgggattacaagaatgagccaccgtgcctggcctattttattatattgtaatatattttattatattagccaccatgcctgtcctattttcttatgttttaatatattttaatatattacatgtgcagtaattagattatcatgggtgaactttatgagtgagtatcttggtgatgactcctcctgaccagcccaggaccagctttcttgtcaccttgaggtcccctcgccccgtcacaccgttatgcattactctgtgtctactattatgtgtgcataatttataccgtaaatgtttactctttaaataga

SEQ ID NO: 153703 - DNA, 2166 bp, Homo sapiens
  Payload ID: 10222
  Gene Symbol: MICB
  Gene Name: MHC class I polypeptide-related sequence B
  ENST ID: ENST00000456351
  CDS Start-End: 1-953
agccccacagtcttcgttacaacctcatggtgctgtcccaggatggatctgtgcagtcagggtttctcgctgagggacatctggatggtcagcccttcctgcgctatgacaggcagaaacgcagggcaaagccccagggacagtgggcagaagatgtcctgggagctaagacctgggacacagagaccgaggacttgacagagaatgggcaagacctcaggaggaccctgactcatatcaaggaccagaaaggagtgccccagtcctccagagctcagaccttggctatgaacgtcacaaatttctggaaggaagatgccatgaagaccaagacacactatcgcgctatgcaggcagactgcctgcagaaactacagcgatatctgaaatccggggtggccatcaggagaacagtgccccccatggtgaatgtcacctgcagcgaggtctcagagggcaacatcaccgtgacatgcagggcttccagcttctatccccggaatatcacactgacctggcgtcaggatggggtatctttgagccacaacacccagcagtggggggatgtcctgcctgatgggaatggaacctaccagacctgggtggccaccaggattcgccaaggagaggagcagaggttcacctgctacatggaacacagcgggaatcacggcactcaccctgtgccctctgggaaggcgctggtgcttcagagtcaacggacagactttccatatgtttctgctgctatgccatgttttgttattattattattctctgtgtcccttgttgcaagaagaaaacatcagcggcagagggtccagagcttgtgagcctgcaggtcctggatcaacacccagttgggacaggagaccacagggatgcagcacagctgggatttcagcctctgatgtcagctactgggtccactggttccactgagggcgcctagactctacagccaggcggccaggattcaactccctgcctggatctcaccagcactttccctctgtttcctgacctatgaaacagaaaataacatcacttatttattgttgttggatgctgcaaagtgttagtaggtatgaggtgtttgctgctctgccacgtagagagccagcaaagggatcatgaccaactcaacattccattggaggctatatgatcaaacagcaaattgtttatcatgaatgcaggatgtgggcaaactcacgactgctcctgccaacagaaggtttgctgagggcattcactccatggtgctcattggagttatctactgggtcatctagagcctattgtttgaggaatgcagtcttacaagcctactctggacccagcagctgactccttcttccacccctcttcttgctatctcctataccaataaatacgaagggctgtggaagatcagagcccttgttcacgagaagcaagaagccccctgaccccttgttccaaatatactcttttgtctttctctttattcccacgttcgccctttgttcagtccaatacagggttgtggggcccttaacagtgccatattaattggtatcattatttctgttgtttttgtttttgtttttgtttttgtttttgagacagagtctcactctgtcacccaggctgcagttcactggtgtgatctcagctcactgcaacctctgcctcccaggttcaagcacttctcgtacctcagactcccgaatagctgggattacagacaggcaccaccacacccagctaatttttgtattttttgtagagacggggtttcgccaagttgaccagcccagtttcaaactcctgacctcaggtgatctgcctgccttggcatcccaaagtgctgggattacaagaatgagccaccgtgcctggcctattttattatattgtaatatattttattatattagccaccatgcctgtcctattttcttatgttttaatatattttaatatattacatgtgcagtaattagattatcatgggtgaactttatgagtgagtatcttggtgatgactcctcctgaccagcccaggaccagctttcttgtcaccttgaggtcccctcgccccgtcacaccgttatgcattactctgtgtctactattatgtgtgcataatttataccgtaaatgtttactctttaaataga

SEQ ID NO: 153704 - DNA, 2444 bp, Homo sapiens
  Payload ID: 10222
  Gene Symbol: MICB
  Gene Name: MHC class I polypeptide-related sequence B
  ENST ID: ENST00000458032
  CDS Start-End: 80-1231
aaatttcgacggggtcttctcaccggtttcattcagttggccactgctgagcagctgagaaggtggcgacgtaggggccatggggctgggccgggtcctgctgtttctggccgtcgccttcccttttgcacccccggcagccgccgctgagccccacagtcttcgttacaacctcatggtgctgtcccaggatggatctgtgcagtcagggtttctcgctgagggacatctggatggtcagcccttcctgcgctatgacaggcagaaacgcagggcaaagccccagggacagtgggcagaagatgtcctgggagctgagacctgggacacagagaccgaggacttgacagagaatgggcaagacctcaggaggaccctgactcatatcaaggaccagaaaggaggcttgcattccctccaggagattagggtctgtgagatgcatgaagacagcagcaccaggggctcccggcatttctactacaatggggagctcttcctctcccaaaacctggagactcaagaatcgacagtgccccagtcctccagagctcagaccttggctatgaacgtcacaaatttctggaaggaagatgccatgaagaccaagacacactatcgcgctatgcaggcagactgcctgcagaaactacagcgatatctgaaatccggggtggccatcaggagaacagtgccccccatggtgaatgtcacctgcagcgaggtctcagagggcaacatcaccgtgacatgcagggcttccagcttctatccccggaatatcacactgacctggcgtcaggatggggtatctttgagccacaacacccagcagtggggggatgtcctgcctgatgggaatggaacctaccagacctgggtggccaccaggattcgccaaggagaggagcagaggttcacctgctacatggaacacagcgggaatcacggcactcaccctgtgccctctgggaaggcgctggtgcttcagagtcaacggacagactttccatatgtttctgctgctatgccatgttttgttattattattattctctgtgtcccttgttgcaagaagaaaacatcagcggcagagggtccagagcttgtgagcctgcaggtcctggatcaacacccagttgggacaggagaccacagggatgcagcacagctgggatttcagcctctgatgtcagctactgggtccactggttccactgagggcgcctagactctacagccaggcggccaggattcaactccctgcctggatctcaccagcactttccctctgtttcctgacctatgaaacagaaaataacatcacttatttattgttgttggatgctgcaaagtgttagtaggtatgaggtgtttgctgctctgccacgtagagagccagcaaagggatcatgaccaactcaacattccattggaggctatatgatcaaacagcaaattgtttatcatgaatgcaggatgtgggcaaactcacgactgctcctgccaacagaaggtttgctgagggcattcactccatggtgctcattggagttatctactgggtcatctagagcctattgtttgaggaatgcagtcttacaagcctactctggacccagcagctgactccttcttccacccctcttcttgctatctcctataccaataaatacgaagggctgtggaagatcagagcccttgttcacgagaagcaagaagccccctgaccccttgttccaaatatactcttttgtctttctctttattcccacgttcgccctttgttcagtccaatacagggttgtggggcccttaacagtgccatattaattggtatcattatttctgttgtttttgtttttgtttttgtttttgtttttgagacagagtctcactctgtcacccaggctgcagttcactggtgtgatctcagctcactgcaacctctgcctcccaggttcaagcacttctcgtacctcagactcccgaatagctgggattacagacaggcaccaccacacccagctaatttttgtattttttgtagagacggggtttcgccaagttgaccagcccagtttcaaactcctgacctcaggtgatctgcctgccttggcatcccaaagtgctgggattacaagaatgagccaccgtgcctggcctattttattatattgtaatatattttattatattagccaccatgcctgtcctattttcttatgttttaatatattttaatatattacatgtgcagtaattagattatcatgggtgaactttatgagtgagtatcttggtgatgactcctcctgaccagcccaggaccagctttcttgtcaccttgaggtcccctcgccccgtcacaccgttatgcattactctgtgtctactattatgtgtgcataatttataccgtaaatgtttactctttaaataga

SEQ ID NO: 153705 - DNA, 2446 bp, Homo sapiens; identical to SEQ ID NO: 153692
  Payload ID: 10222
  Gene Symbol: MICB
  Gene Name: MHC class I polypeptide-related sequence B
  ENST ID: ENST00000451603
  CDS Start-End: 80-1231

SEQ ID NO: 153706 - DNA, 2350 bp, Homo sapiens
  Payload ID: 10222
  Gene Symbol: MICB
  Gene Name: MHC class I polypeptide-related sequence B
  ENST ID: ENST00000451789
  CDS Start-End: 109-1131
agcggtcgctgagcggggcgcaggtgactaaatttcgacggggtcttctcaccggtttcattcagttggccactgctgagcagctgagaaggtggcgacgtaggggccatggggctgggccgggtcctgctgtttctggccgtcgccttcccttttgcacccccggcagccgccgctgagccccacagtcttcgttacaacctcatggtgctgtcccaggatggatctgtgcagtcagggtttctcgctgagggacatctggatggtcagcccttcctgcgctatgacaggcagaaacgcagggcaaagccccagggacagtgggcagaagatgtcctgggagctaagacctgggacacagagaccgaggacttgacagagaatgggcaagacctcaggaggaccctgactcatatcaaggaccagaaaggagtgccccagtcctccagagctcagaccttggctatgaacgtcacaaatttctggaaggaagatgccatgaagaccaagacacactatcgcgctatgcaggcagactgcctgcagaaactacagcgatatctgaaatccggggtggccatcaggagaacagtgccccccatggtgaatgtcacctgcagcgaggtctcagagggcaacatcaccgtgacatgcagggcttccagcttctatccccggaatatcacactgacctggcgtcaggatggggtatctttgagccacaacacccagcagtggggggatgtcctgcctgatgggaatggaacctaccagacctgggtggccaccaggattcgccaaggagaggagcagaggttcacctgctacatggaacacagcgggaatcacggcactcaccctgtgccctctgggaaggcgctggtgcttcagagtcaacggacagactttccatatgtttctgctgctatgccatgttttgttattattattattctctgtgtcccttgttgcaagaagaaaacatcagcggcagagggtccagagcttgtgagcctgcaggtcctggatcaacacccagttgggacaggagaccacagggatgcagcacagctgggatttcagcctctgatgtcagctactgggtccactggttccactgagggcgcctagactctacagccaggcggccaggattcaactccctgcctggatctcaccagcactttccctctgtttcctgacctatgaaacagaaaataacatcacttatttattgttgttggatgctgcaaagtgttagtaggtatgaggtgtttgctgctctgccacgtagagagccagcaaagggatcatgaccaactcaacattccattggaggctatatgatcaaacagcaaattgtttatcatgaatgcaggatgtgggcaaactcacgactgctcctgccaacagaaggtttgctgagggcattcactccatggtgctcattggagttatctactgggtcatctagagcctattgtttgaggaatgcagtcttacaagcctactctggacccagcagctgactccttcttccacccctcttcttgctatctcctataccaataaatacgaagggctgtggaagatcagagcccttgttcacgagaagcaagaagccccctgaccccttgttccaaatatactcttttgtctttctctttattcccacgttcgccctttgttcagtccaatacagggttgtggggcccttaacagtgccatattaattggtatcattatttctgttgtttttgtttttgtttttgtttttgtttttgtttttgagacagagtctcactctgtcacccaggctgcagttcactggtgtgatctcagctcactgcaacctctgcctcccaggttcaagcacttctcgtacctcagactcccgaatagctgggattacagacaggcaccaccacacccagctaatttttgtattttttgtagagacggggtttcgccaagttgaccagcccagtttcaaactcctgacctcaggtgatctgcctgccttggcatcccaaagtgctgggattacaagaatgagccaccgtgcctggcctattttattatattgtaatatattttattatattagccaccatgcctgtcctattttcttatgttttaatatattttaatatattacatgtgcagtaattagattatcatgggtgaactttatgagtgagtatcttggtgatgactcctcctgaccagcccaggaccagctttcttgtcaccttgaggtcccctcgccccgtcacaccgttatgcattactctgtgtctactattatgtgtgcataatttataccgtaaatgtttactctttaaataga

SEQ ID NO: 153707 - DNA, 2344 bp, Homo sapiens; identical to SEQ ID NO: 153699
  Payload ID: 10222
  Gene Symbol: MICB
  Gene Name: MHC class I polypeptide-related sequence B
  Uniprot ID: Q29980
  ENST ID: ENST00000436531
  CDS Start-End: 109-1131

SEQ ID NO: 153708 - DNA, 2411 bp, Homo sapiens
  Payload ID: 10222
  Gene Symbol: MICB
  Gene Name: MHC class I polypeptide-related sequence B
  ENST ID: ENST00000538442
  CDS Start-End: 142-1197
gaattttgtgagcgaccgcgctgggccgtttctctttcttttccggaccctgcagtggcgcctaaagtctgcgaggaggaagtcgcctctgtgctcgtgagtccagggatctaagagccccacagtcttcgttacaacctcatggtgctgtcccaggatggatctgtgcagtcagggtttctcgctgagggacatctggatggtcagcccttcctgcgctatgacaggcagaaacgcagggcaaagccccagggacagtgggcagaaaatgtcctgggagctaagacctgggacacagagaccgaggacttgacagagaatgggcaagacctcaggaggaccctgactcatatcaaggaccagaaaggaggcttgcattccctccaggagattagggtctgtgagatccatgaagacagcagcaccaggggctcccggcatttctactacgatggggagctcttcctctcccaaaacctggagactcaagaatcgacagtgccccagtcctccagagctcagaccttggctatgaacgtcacaaatttctggaaggaagatgccatgaagaccaagacacactatcgcgctatgcaggcagactgcctgcagaaactacagcgatatctgaaatccggggtggccatcaggagaacagtgccccccatggtgaatgtcacctgcagcgaggtctcagagggcaacatcaccgtgacatgcagggcttccagcttctatccccggaatatcacactgacctggcgtcaggatggggtatctttgagccacaacacccagcagtggggggatgtcctgcctgatgggaatggaacctaccagacctgggtggccaccaggattcgccaaggagaggagcagaggttcacctgctacatggaacacagcgggaatcacggcactcaccctgtgccctctgggaaggcgctggtgcttcagagtcaacggacagactttccatatgtttctgctgctatgccatgttttgttattattattattctctgtgtcccttgttgcaagaagaaaacatcagcggcagagggtccagagcttgtgagcctgcaggtcctggatcaacacccagttgggacaggagaccacagggatgcagcacagctgggatttcagcctctgatgtcagctactgggtccactggttccactgagggcacctagactctacagccaggcggccaggattcaactccctgcctggatctcaccagcactttccctctgtttcctgacctatgaaacagagaaaataacatcacttatttattgttgttggatgctgcaaagtgttagtaggtatgaggtgtttgctgctctgccacgtagagagccagcaaagggatcatgaccaactcaacattccattggaggctatatgatcaaacagcaaattgtttatcatgaatgcaggatgtgggcaaactcacgactgctcctgccaacagaaggtttgctgagggcattcactccatggtgctcattggagttatctactgggtcatctagagcctattgtttgaggaatgcagtcttacaagcctactctggacccagcagctgactccttcttccacccctcttcttgctatctcctataccaataaatacgaagggctgtggaagatcagagcccttgttcacgagaagcaagaagccccctgaccccttgttccaaatatactcttttgtctttctctttattcccacgttcgccctttgttcagtccaatacagggttgtggggcccttaacagtgccatattaattggtatcattatttctgttgtttttgtttttgtttttgtttttgtttttgagacagagtctcactctgtcacccaggctgcagttcactggtgtgatctcagctcactgcaacctctgcctcccaggttcaagcacttctcgtacctcagactcccgaatagctgggattacagacaggcaccaccacacccagctaatttttgtattttttgtagagacggggtttcgccaagttgaccagcccagtttcaaactcctgacctcaggtgatctgcctgccttggcatcccaaagtgctgggattacaagaatgagccaccgtgcctggcctattttattatattgtaatatattttattatattagccaccatgcctgtcctattttcttatgttttaatatattttaatatattacatgtgcagtaattagattatcatgggtgaactttatgagtgagtatcttggtgatgactcctcctgaccagcccaggaccagctttcttgtcaccttgaggtcccctcgccccgtcacaccgttatgcattactctgtgtctactattatgtgtgcataatttataccgtaaatgtttactctttaaatag

SEQ ID NO: 153709 - DNA, 2411 bp, Homo sapiens; identical to SEQ ID NO: 153708
  Payload ID: 10222
  Gene Symbol: MICB
  Gene Name: MHC class I polypeptide-related sequence B
  ENST ID: ENST00000619506
  CDS Start-End: 142-1197

SEQ ID NO: 153710 - DNA, 2363 bp, Homo sapiens
  Payload ID: 10222
  Gene Symbol: MICB
  Gene Name: MHC class I polypeptide-related sequence B
  ENST ID: ENST00000614843
  CDS Start-End: 6-1157
gggccatggggctgggcccggtcttcctgcttctggctggcatcttcccttttgcacctccgggagctgctgctgagccccacagtcttcgttacaacctcatggtgctgtcccaggatggatctgtgcagtcagggtttctcgctgagggacatctggatggtcagcccttcctgcgctatgacaggcagaaacgcagggcaaagccccagggacagtgggcagaagatgtcctgggagctaagacctgggacacagagaccgaggacttgacagagaatgggcaagacctcaggaggaccctgactcatatcaaggaccagaaaggaggcttgcattccctccaggagattagggtctgtgagatccatgaagacagcagcaccaggggctcccggcatttctactacgatggggagctcttcctctcccaaaacctggagactcaagaatcgacagtgccccagtcctccagagctcagaccttggctatgaacgtcacaaatttctggaaggaagatgccatgaagaccaagacacactatcgcgctatgcaggcagactgcctgcagaaactacagcgatatctgaaatccggggtggccatcaggagaacagtgccccccatggtgaatgtcacctgcagcgaggtctcagagggcaacatcaccgtgacatgcagggcttccagcttctatccccggaatatcacactgacctggcgtcaggatggggtatctttgagccacaacacccagcagtggggggatgtcctgcctgatgggaatggaacctaccagacctgggtggccaccaggattcgccaaggagaggagcagaggttcacctgctacatggaacacagcgggaatcacggcactcaccctgtgccctctgggaaggcgctggtgcttcagagtcaacggacagactttccatatgtttctgctgctatgccatgttttgttattattattattctctgtgtcccttgttgcaagaagaaaacatcagcggcagagggtccagagcttgtgagcctgcaggtcctggatcaacacccagttgggacaggagaccacagggatgcagcacagctgggatttcagcctctgatgtcagctactgggtccactggttccactgagggcgcctagactctacagccaggcggccaggattcaactccctgcctggatctcaccagcactttccctctgtttcctgacctatgaaacagaaaataacatcacttatttattgttgttggatgctgcaaagtgttagtaggtatgaggtgtttgctgctctgccacgtagagagccagcaaagggatcatgaccaactcaacattccattggaggctatatgatcaaacagcaaattgtttatcatgaatgcaggatgtgggcaaactcacgactgctcctgccaacagaaggtttgctgagggcattcactccatggtgctcattggagttatctactgggtcatctagagcctattgtttgaggaatgcagtcttacaagcctactctggacccagcagctgactccttcttccacccctcttcttgctatctcctataccaataaatacgaagggctgtggaagatcagagcccttgttcacgagaagcaagaagccccctgaccccttgttccaaatatactcttttgtctttctctttattcccacgttcgccctttgttcagtccaatacagggttgtggggcccttaacagtgccatattaattggtatcattatttctgttgtttttgtttttgtttttgtttttgtttttgagacagagtctcactctgtcacccaggctgcagttcactggtgtgatctcagctcactgcaacctctgcctcccaggttcaagcacttctcgtacctcagactcccgaatagctgggattacagacaggcaccaccacacccagctaatttttgtattttttgtagagacggggtttcgccaagttgaccagcccagtttcaaactcctgacctcaggtgatctgcctgccttggcatcccaaagtgctgggattacaagaatgagccaccgtgcctggcctattttattatattgtaatatattttattatattagccaccatgcctgtcctattttcttatgttttaatatattttaatatattacatgtgcagtaattagattatcatgggtgaactttatgagtgagtatcttggtgatgactcctcctgaccagcccaggaccagctttcttgtcaccttgaggtcccctcgccccgtcacaccgttatgcattactctgtgtctactattatgtgtgcataatttataccgtaaatgtttactcttt

SEQ ID NO: 153711 - DNA, 1229 bp, Homo sapiens
  Payload ID: 10223
  Gene Symbol: MIA-RAB4B
  Gene Name: MIA-RAB4B readthrough (NMD candidate)
  ENST ID: ENST00000600729
  CDS Start-End: 423-818
aggtagacagaaaagttctccaagtcctcaccggcccagaggcccagccatcttcacctctcaagctgtctgtagaggtccacgtgtcaagaaaactgaggacagaggccctcagtccagttcccacaagcaactgcatctccccaacagctgcctgaatgagtttggaagcagtcctcccaccattcagccttcagatgaaactgcacccctggctgacaggctgattgcagccttatagcagaccttaagcctgagacattcgacccacagaaaaggtgataattttggtctttttttttctaaacaggttcttgctctagagtgcagtggcacgatcatggctcactgcggcctctacatcctgggttcaagtggtcctcccacctcaacctcctgagtggctgggactacagtccacgatggcccggtccctggtgtgccttggtgtcatcatcttgctgtctgccttctccggacctggtgtcaggggtggtcctatgcccaagctggctgaccggaagctgtgtgcggaccaggagtgcagccaccctatctccatggctgtggcccttcaggactacatggcccccgactgccgattcctgaccattcaccggggccaagtggtgtatgtcttctccaagctgaagggccgtgggcggctcttctggggaggcagcgttcagggagattactatggagatctggctgctcgcctgggctatttccccagtagcattgtccgagaggaccagaccctgaaacctggcaaagtcgatgtgaagacagacacttcctcttcaaattcctggtgattggcagtgcaggaactggcaaatcatgtctccttcatcagttcattgagaataagttcaaacaggactccaaccacacaatcggcgtggagtttggatcccgggtggtcaacgtgggtgggaagactgtgaagctacagatttgggacacggctggccaggagcggtttcggtcagtgacgcggagttattaccgaggggcggctggagccctgctggtgtacgacatcaccagccgggagacatacaactcactggctgcctggctgacggatgcccgcaccctggccagccccaacatcgtggtcatcctctgtggcaacaagaaggacctggaccctgagcgggaggtcactttcctggaggcctcccgctttgcccaggagaatgagctgatgttcctggagacca

SEQ ID NO: 153712 - DNA, 3044 bp, Homo sapiens
  Payload ID: 10224
  Gene Symbol: MICALCL
  Gene Name: MICAL C-terminal like
  Uniprot ID: Q6ZW33
  ENST ID: ENST00000256186
  CDS Start-End: 292-2379
aagtttggtagagtgtgttgtggggacagcagtatggtgtgagggaaggagagagttcagtctattataatcattagtctattgacttgtggtaattgagctataggagataaattcctacttactctacacatttaatggactcttcctcccaccccatcttccctgtccctttctttttccacagcagctctgcaacgggccaatagcttccagtctccaaccccaagcaaataccagaactggaggagagaattctggtggagtttgacgccagtgaacaaaagaactatgtcacctcctaaggacccttctccttctcttcctcttccttcatcgtcttcccattcatcttccccaccatcttcttcttcaaccagtgtttctgggaatgctccagatggttcctccccgcctcagatgacagcttctgagcccctctcgcaagtctcgagaggtcatccaagtcctcccaccccaaactttcggaggcgagccgtagcccaaggagcacccagggaaattcccctgtatctgcctcatcacccaaagccagagtgggcagagtactgcctggtgagccctggtgaagatggcctctcagaccctgcagagatgacttctgatgagtgccagccagcagaggcccctcttggggacatcggaagcaaccacagagacccacaccccatctgggggaaggacaggagctggacagggcaagagctatctcccttggctggagaagaccgggaaaaagggagtactggagccaggaaggaagaagagggagggccagtgctggtaaaggagaagttgggcctgaagaagttagtcctcactcaggagcagaagaccatgttgttggattggaatgactccatccctgagagtgtgcacctcaaagctggggagcgaatttcccagaaaagtgctgagaatggtagaggaggccgtgtgctaaaaccagtccgccccctgctgctccctagggcagcaggagagcccctgccaacccagagaggggcccaggagaagatggggacccctgcggaacaagctcaaggggagcgaaacgtgcctccacccaagtccccactgcggctcatagccaatgccatccgaaggtctctagagcccctcctttccaactctgaaggcgggaagaaggcctgggccaagcaagaatccaaaactttgcccgcacaggcctgcactcgctcattcagccttcggaaaaccaattccaataaagacggggaccagcattcccctgggagaaaccagtcctcagcctttagccctcctgaccctgccctccgcacccacagtttgcccaatcggccatccaaggtctttcctgcacttaggtccccaccctgcagcaagattgaagatgtccccacactcctcgagaaagtgagtttgcaagagaacttcccagatgcttctaagcctccaaagaaaagaatctcacttttttcctccctcagactcaaagacaaatcttttgagagtttcctccaagaatccagacaaagaaaggacatcagggacctctttggcagccccaagaggaaggtgctgcctgaagatagtgcgcaggccctggagaagctgctgcagcctttcaaaagcacctccctgcgccaggcagctcctcctcctcctcctcctcctcctcctcctcctcctcctcctacagcgggaggtgcagactccaagaactttcccctcagagcacaggtaacagaggcttcctcttctgcctcttcaacctcctcctcctctgcagatgaagaatttgatccccagctttccttgcagttaaaggagaagaagacacttagaagaagaaagaagctagaaaaagcaatgaagcagttggttaagcaagaagaattgaaaagactctataaggctcaggccatccagaggcagctggaggaggtggaggagcggcagagggcttctgagatccagggtgtgaggctggagaaggcgttgcgaggagaagcagattcaggcacacaggatgaagcacagcttttgcaggaatggtttaagctggttctggagaagaataaattaatgcgatatgagtcggagctcctaatcatggcccaggaactggaattagaagatcatcaaagcagactggagcagaaactgagagagaaaatgctcaaggaggagagccagaaagatgagaaggatctaaacgaagagcaagaagtattcaccgagctgatgcaagtgattgagcaaagggacaaactcgtcgattccttagaggaacaacgcatcagagaaaaagccgaggaccagcactttgaaagcttcgtattctccagaggctgtcagctgagcaggacttgaggaggcccgtagtccctctccctggctgcacgttgggaccggatcaggccaagtgcaccacacaccctcatgggtctttctgcaggatttatcatccctggaacttgttataccttactgcattttttaaaattaaaattctcttgcacgcatggcagcttcccaaggttcttccagagattcaaatgaagaaaacccaaagactctttggcaattggcagtcaacttcagccaggctctcagactggaggtgttgttggcagatgaccagcattgttttccctagaaagtgacacaaagacttgactttcctgctacttttatcattttccttcccaattcattgagttacatactttaagatttttgagaagctgccttttcattaatatatccatatttgccttttttgtatggatgaccagtttccaaatgtcagaaagaagcagccgcagtttaaagattaggttaatatttaaattgtgtttccagagaaagaggagaaaccttgagattactgattacataaagcaaataactcatatagcaggtgttaattcaatccagggtgaatttaatttaccaggtgcatttataagccttaatataatatacataagcaatgagagcttaatagaacatttgagccttaattttattttaag

SEQ ID NO: 153713 - DNA, 343 bp, Homo sapiens
  Payload ID: 10224
  Gene Symbol: MICALCL
  Gene Name: MICAL C-terminal like
  ENST ID: ENST00000533534
  CDS Start-End: 257-343
gtctgactatggtggcagcgagggctcccacacagaaccctgtgaagagaaaccctggcggccaggatccccgcatctaccgcacacgtccctaggggaggccctgagcagggcagtctctccacagtgccctgaggagcccagagctgtgcacgctctgcaacgggccaatagcttccagtctccaaccccaagcaaataccagaactggaggagagaattctggtggagtttgacgccagtgaacaaaagaactatgtcacctcctaaggacccttctccttctcttcctcttccttcatcgtcttcccattcatcttccccaccatcttcttcttcaacc

SEQ ID NO: 153714 - DNA, 4710 bp, Homo sapiens
  Payload ID: 10225
  Gene Symbol: MICALL1
  Gene Name: MICAL-like 1
  Uniprot ID: Q8N3F8
  ENST ID: ENST00000215957
  CDS Start-End: 127-2718
gcctgccggtcggcgcccgagctcggagccgcagccgcagccggaaaccgggcccgcgcggcggccgccgtcccggccaagccggggccccgaagccagagccggagccgggcgggccgcggggtcatggctgggccgcggggcgcgctgctggcctggtgccgccgccagtgcgagggctaccgcggcgtggagatccgcgacctgagcagctccttccgggacggcctggccttctgcgccatcctgcaccggcaccggcccgacctgctagattttgattcgctttccaaggacaatgtcttcgagaataaccgtttggcctttgaagtggctgagaaggagctggggatccccgctctcctggaccccaatgacatggtctccatgagcgtccctgactgcctcagcatcatgacctatgtgtcccagtattacaaccacttctgcagtcctggccaagctggtgtctcgccacccagaaagggccttgcaccctgttccccgccgtctgtagcacccactccagtggaaccagaagatgtggctcagggcgaggagctctcctcaggcagcctgtcagagcagggcaccggccagacccccagcagcacgtgcgcagcctgccagcagcatgtgcacttggtgcagcgctacctggctgacggcaggctgtaccatcgccactgcttccggtgtcggcggtgctccagcaccctgctccctggggcttatgagaatgggcctgaggagggcacctttgtgtgtgcagaacactgtgccaggctgggcccggggacacggtcggggaccaggcctgggcccttctcacagccaaagcagcagcaccagcagcaactcgcagaagatgccaaggatgttccaggaggcggccccagctccagtgctcctgcaggggctgaggccgatggacccaaggccagccctgaggcccggccgcagatccctaccaagccccgggttcctggcaaactacaggagctggccagcccccctgcgggccgccccacccctgcccccaggaaggcctctgagagcaccaccccagcaccccccacgccccggccccgctccagtctgcagcaggagaacctggtggagcaggctggcagcagcagcctggtgaacgggagactgcacgaactgcctgtccccaagccgagggggacaccgaagccgtccgaggggacaccagcccccaggaaggaccccccatggatcacgctggtgcaggcagaaccaaagaagaagccagccccacttcccccaagcagcagcccggggccaccaagccaggacagcaggcaggtggagaatggaggcaccgaggaggtggcccagccgagcccaacggccagcctggagtccaaaccctataacccctttgaggaggaggaggaggacaaggaggaagaggctccagctgcacccagcctggccaccagccctgccctgggccacccggagtccacacccaagtccctgcacccctggtacggcatcacccctaccagcagccccaagacaaagaagcgccctgccccgcgcgcacccagcgcgtccccactggctctccacgcctcccgcctctcgcactcggagccgccctcggccacaccatcgccagcgctcagcgtggagagcctgtcgtctgagagcgccagccagactgcaggtgcagagcttctggagccgccagctgtgcccaagagctcctcagagcctgctgtccatgcccctggtacccctggaaaccctgtcagcctctctaccaactcctccctggcctcctctggggaactagtggagcctagagtggaacaaatgcctcaagccagccctggccttgcccccaggaccaggggcagctcaggtccccagccagccaagccctgcagtggcgccaccccaacgcctctcttgttggttggagacaggagcccggtgccttcccctggaagctcgtccccacagctgcaggtaaagtcctcctgcaaggagaatccttttaaccggaagccatcacctgcagcgtccccagccacaaagaaggccaccaagggatccaagccagtgaggccacctgcccctggacacggctttccactcatcaaacgcaaggtccaggctgaccagtacatccctgaggaggacatccatggagagatggataccattgagcgccggctggatgccctggagcaccgtggggtgctgctggaggagaagctgcgtggcggcctgaatgagggccgtgaggatgacatgctggtggactggttcaagctcatccacgagaagcacctactggtgcggcgagagtccgagctcatctatgtcttcaagcagcagaacctggagcagcgccaggctgatgtcgagtatgagctccggtgcctcctcaataagccagaaaaggactggacggaggaggaccgggcccgggagaaggtgctgatgcaggagcttgtgaccctcattgagcagcgcaacgctatcatcaactgcctggatgaggaccggcagagggaggaagaggaagacaagatgttggaagccatgatcaagaagaaagagttccagagggaggctgaacctgagggcaagaagaaggggaagttcaagaccatgaagatgttgaaactgctaggaaacaaacgtgatgccaagagcaagtcccccagagacaagagctaacagcacgagaagccagttggggactgccccctcctggagcagctcctgggctgtgctctgtttgaagggggcgccctgctcccctcagatcagtcaggaggaagatgactaaggggagggatcctctgggtgatggcctcttcctcctcagggacctctgactgctctgggccaaagaatctcttgtttcttctccgagccccaggcagcggtgattcagccctgcccaacctgattctgatgactgcggatgctgtgacggacccaaggggcaaatagggtcccagggtccagggaggggcgcctgctgagcacttccgcccctcaccctgcccagcccctgccatgagctctgggctgggtctccgcctccagggttctgctcttccaggcaggccagcaagtggcgctgggccacactggcttcttcctgccccatccctggctctgagtctctgtcttcctgtcctgtgcaggcgcccttggatctcagtttccctcactcaggaactctgtttctgaagtcttcagttaagtttgagtttatgactgagtggcctgtactgtcagacgtgaatgggcctgacgggcaaatccatccctctctccctcacagttccaggagcggcttccctcgtctccccttactccacagggagcctcccttgccaggaccagggctgcgacggccatgctggggcaggtgagtgctctgttagctgctcccagtgctgtccccaggctgcagttctggtccctggttgtcaggtaggaagggtgcacttgaagcaggtgctcatctcggttccttaacgtttatagtctgacccctcacttaggctttcctctgccaccccggtccagggaagaggctcgctcccgcccatggtcatcactggtctgtctgctctgttgtctgttctttccctgactccctcccaccgaaggcctgatggctactcacccctctgggatggctatgggagaggaggagtgatggggaccgccaccttttctgcaggaaatgtgcccagcagctcttggtcaaagcactgttgctataagctatctctgggatgcctctaggcccccttccctctacacacctctgggaaaagattacactgtattaactctcgaggagtttcctcaccaataaacagacaacctcaactgccagtgccctgcagcctcgggccacagcggcagccttgtttgccttcccacctgcctctgccacacctggtggctgaacatctctggtcgcccagaggccatgttggggccatcctccaagagggatctctgccctcaccgcctgccactgggcaggatccctttcctctgcagggagaggtggctcctcggccatgcagcccctggcaggctccttctaaacatgcctgttgacctggagctggcgccaccaactccagggcctttccagggccagacaggtaacacgcatgaacccgagtgacagctctgacgggctgtttcggtgtcaggagacaaagctggcaggggcaggggtgaactggaggcaagtcaagtcacctgtggcctgtggggctgaatgtgggcccggtgttgccagatcctttgtcataagaagctagaaatccagattttatgtgtgtgtaatttgtaaatgctgaaagctagcctgaattttttttttttttttttgagacagagtctcgctctgtcgcccaggctggagtgcagtggcgcgatctcagctcactgcaagctccgcctcctgggttcacgccatcctcctgcctcggcctcctgagcagctgggactacaggcgcatgctacgacgcctggctaattttttgtatttttagtagagacggggtttcaccgtgttaaccaggatggtctcgatctcctgaccttgtgatccacccaccttggcctcccaaagtgctgggattacaggcgtgagccaccacgcccggccactagcctgaatttcaatcaag

SEQ ID NO: 153715 - DNA, 808 bp, Homo sapiens
  Payload ID: 10225
  Gene Symbol: MICALL1
  Gene Name: MICAL-like 1
  ENST ID: ENST00000445494
  CDS Start-End: 177-808
gggtctccctgccaagctatgggggaggggatggtggacatgacaacttccagctcagcggtgctttaggagattttgattcgctttccaaggacaatgtcttcgagaataaccgtttggcctttgaagtggctgagaaggagctggggatccccgctctcctggaccccaatgacatggtctccatgagcgtccctgactgcctcagcatcatgacctatgtgtcccagtattacaaccacttctgcagtcctggccaagctggtgtctcgccacccagaaagggccttgcaccctgttccccgccgtctgtagcacccactccagtggaaccagaagatgtggctcagggcgaggagctctcctcaggcagcctgtcagagcagggcaccggccagacccccagcagcacgtgcgcagcctgccagcagcatgtgcacttggtgcagcgctacctggctgacggcaggctgtaccatcgccactgcttccggtgtcggcggtgctccagcaccctgctccctggggcttatgagaatgggcctgaggagggcacctttgtgtgtgcagaacactgtgccaggctgggcccggggacacggtcggggaccaggcctgggcccttctcacagccaaagcagcagcaccagcagcaactcgcagaagatgccaaggatgttccaggaggcggccccagctccagtgctcctgcaggggctgaggccgatggacccaaggccagccctgaggcccggccgcagatccctaccaagccccgggttcctggcaaactacaggagctggccag

SEQ ID NO: 153716 - DNA, 1108 bp, Homo sapiens
  Payload ID: 10225
  Gene Symbol: MICALL1
  Gene Name: MICAL-like 1
  ENST ID: ENST00000454685
  CDS Start-End: 1-1108
ctataacccctttgaggaggaggaggaggacaaggaggaagaggctccagctgcacccagcctggccaccagccctgccctgggccacccggagtccacacccaagtccctgcacccctggtacggcatcacccctaccagcagccccaagacaaagaagcgccctgccccgcgcgcacccagcgcgtccccactggctctccacgcctcccgcctctcgcactcggagccgccctcggccacaccatcgccagcgctcagcgtggagagcctgtcgtctgagagcgccagccagactgcaggtgcagagcttctggagccgccagctgtgcccaagagctcctcagagcctgctgtccatgcccctggtacccctggaaaccctgtcagcctctctaccaactcctccctggcctcctctggggaactagtggagcctagagtggaacaaatgcctcaagccagccctggccttgcccccaggaccaggggcagctcaggtccccagccagccaagccctgcagtggcgccaccccaacgcctctcttgttggttggagacaggagcccggtgccttcccctggaagctcgtccccacagctgcagtcctcctgcaaggagaatccttttaaccggaagccatcacctgcagcgtccccagccacaaagaaggccaccaagggatccaagccagtgaggccacctgcccctggacacggctttccactcatcaaacgcaaggtccaggctgaccagtacatccctgaggaggacatccatggagagatggataccattgagcgccggctggatgccctggagcaccgtggggtgctgctggaggagaagctgcgtggcggcctgaatgagggccgtgaggatgacatgctggtggactggttcaagctcatccacgagaagcacctactggtgcggcgagagtccgagctcatctatgtcttcaagcagcagaacctggagcagcgccaggctgatgtcgagtatgagctccggtgcctcctcaataagccagaaaaggactggacggaggaggaccgggcccgggagaaggtgctgatgcaggagcttgtgaccctcattgagcag

SEQ ID NO: 153717 - DNA, 918 bp, Homo sapiens
  Payload ID: 10225
  Gene Symbol: MICALL1
  Gene Name: MICAL-like 1
  ENST ID: ENST00000424008
  CDS Start-End: 1-561
gagatggataccattgagcgccggctggatgccctggagcaccgtggggtgctgctggaggagaagctgcgtggcggcctgaatgagggccgtgaggatgacatgctggtggactggttcaagctcatccacgagaagcacctactggtgcggcgagagtccgagctcatctatgtcttcaagcagcagaacctggagcagcgccaggctgatgtcgagtatgagctccggtgcctcctcaataagccagaaaaggactggacggaggaggaccgggcccgggagaaggtgctgatgcaggagcttgtgaccctcattgagcagcgcaacgctatcatcaactgcctggatgaggaccggcagagggaggaagaggaagacaagatgttggaagccatgatcaagaagaaaggtgaggcccttgctggggatgaggctgagttccagagggaggctgaacctgagggcaagaagaaggggaagttcaagaccatgaagatgttgaaactgctaggaaacaaacgtgatgccaagagcaagtcccccagagacaagagctaacagcacgagaagccagttggggactgccccctcctggagcagctcctgggctgtgctctgtttgaagggggcgccctgctcccctcagatcagtcaggaggaagatgactaaggggagggatcctctgggtgatggcctcttcctcctcagggacctctgactgctctgggccaaagaatctcttgtttcttctccgagccccaggcagcggtgattcagccctgcccaacctgattctgatgactgcggatgctgtgacggacccaaggggcaaatagggtcccagggtccagggaggggcgcctgctgagcacttccgcccctcaccctgcccagcccctgccatgagctctggg

SEQ ID NO: 153718 - DNA, 3121 bp, Homo sapiens
  Payload ID: 10226
  Gene Symbol: MICALL2
  Gene Name: MICAL-like 2
  Uniprot ID: Q8IY33
  ENST ID: ENST00000297508
  CDS Start-End: 177-2891
cttctcttagggacccggcactcgtcgccctcagtccggctcagctggggctgggcgccgtgggtctggcggttccgtagcggtcccagcgtctgtcccgccggccgggcggtcgcggcacagccgcgggaaggtgtcggagggcggttccgccgcgcggcgggcgcgccgcccacatggcggccatcagggcgctgcaacagtggtgccggcagcagtgcgagggctaccgcgacgtgaatatctgcaacatgaccacgtcgttccgcgacggcctggctttctgcgccatcctgcaccgccaccggcccgacctcataaacttcagtgctctcaagaaggaaaatatttatgaaaacaataaactggccttccgcgtggccgaggagcacttgggcatcccagccttgctggatgccgaggacatggtggccttgaaggtgcctgaccggctgagcatcttgacctacgtgtcccagtattacaactacttccacggccgctcccccattgggggcatggcaggcgtgaagagggcctcggaggactctgaggaggagccgtcagggaagaaggctccagtccaggcggccaagctgccctcgcccgccccagcccggaagcctccactatctccagcccagacaaaccctgtggtccagaggaggaatgagggtgcagggggcccgccccccaagactgaccaggcattggcgggcagcttggtcagcagcacctgcggggtctgcggcaagcacgtgcacctggtacagcggcacctggccgacgggaggctttaccaccggagctgcttcaggtgtaagcagtgctcctgcacgctgcactcgggggcctacaaggccacaggagagccgggcaccttcgtctgcaccagccacctccccgcagccgcctctgcaagccccaagttgacgggtctggtcccccgacagccaggggccatgggtgtggattccaggacctcctgttccccacagaaggcccaggaggcaaacaaggccagaccgtcggcctgggagcctgctgcgggcaactcgcctgccagggcttccgttccagctgcacccaaccctgcagccaccagcgccacgtccgtccacgtgaggagcccagccaggccctctgagagccgcctggcccccactcccacggaggggaaagtccgccctcgtgtgaccaatagctccccgatgggctggtcgtcagctgccccgtgcacagcagcggctgcctcccatcccgccgtgcccccgagtgccccagaccctcgcccggccacaccccagggtgggggagccccccgagtggcagctcctcaaaccacactcagttcaagctccacatctgcagccacggtggaccccccagcctggaccccgtccgcctccaggacccagcaggcccggaataagtttttccaaacatcagcagtgccccccggcaccagcctttctggcagaggtcccaccccgtcacttgttctatccaaggacagcagcaaggagcaggcgcggaacttcctcaagcaggccctctcagcgctggaagaggctggcgctccggcgcctggcaggccctccccagccactgccgctgttcccagttctcagcccaaaactgaagcaccacaagcaagtcccttagccaagccgttacagtcctcgtctccccgggtgcttggcctcccttcgaggatggaaccgccagccccgctgagcacgagcagtacctctcaggcatccgcgttgcccccggcaggcaggaggaacttggcggaatcctcaggggtcggcagggtgggtgctggctccaggccgaagccagaggccccgatggcaaagggtaaaagcaccaccttaacgcaggacatgagcaccagcctccaggaaggccaggaggacgggccggcaggatggagagcgaatctgaagcccgtggacaggagaagcccagctgagaggactctgaagcccaaggaaccacgggccctggcagagccgagggcgggggaggcccccaggaaggtctcaggcagctttgctgggagtgtccacatcaccctgacccccgtgaggcctgacaggaccccacgcccagccagcccaggacccagcctcccagccaggtccccctccccaccccgccgcaggagactggccgtccctgccagcctcgacgtttgtgacaactggcttcggccggagccccctggccaggaagcccgagtgcagagctggaaggaggaggagaagaaacctcaccttcagggcaaaccagggagacccttgtccccggccaatgtccctgctctgcctggcgagacggtgacctccccagtcaggctgcaccccgactacctctccccggaggagatacagaggcagctgcaggacatcgagaggcggctggacgccctggagctccgcggcgtggagctggagaagcgactgcgggcggccgagggagatgacgctgaggatagcctcatggtggactggttctggctcattcacgagaagcagcttctgctgagacaggagtcagagctgatgtacaagtccaaggcccagcgtctggaggagcagcagctggacatcgagggcgagctgcgccggctcatggccaagcccgaggctctgaagtcactgcaggagcggcggcgggagcaggagctgctggagcagtacgtgagcaccgtgaacgaccgcagtgacatcgtggactcgctggacgaggaccggctccgggaacaagaggaggatcagatgctgcgggacatgattgagaagctgggcctccagaggaagaagtccaagttccgcttgtccaagatctggtcaccaaaaagcaaaagcagcccctcccagtagtagccagtagggccgtgggctcggcccggacctggcatccggacttggactcggggccatgggcttggcccggacccggaacccggacttgtactcggggccgtgggctcggcccggacccggcattcggacttggactcgggaagggcctcctgtccctacaaggggcatgtggacagcagggacctgcgctaccgtctgtggtctcaataaagaaaccgaccacatgg

SEQ ID NO: 153719 - DNA, 3046 bp, Homo sapiens
  Payload ID: 10226
  Gene Symbol: MICALL2
  Gene Name: MICAL-like 2
  Uniprot ID: Q8IY33
  ENST ID: ENST00000413446
  CDS Start-End: 232-2274
tgtcagggtacaggaggtgaagctggggccgtctgatgtcgtactacggtcccagcagcatcaccgtggccggagcagggccgggagccctggcctctgcccacctgtggtcctgtgccacctcattccttcacagccccccatcctggcctcggtttctctgtttgggcaagatgacctctgaggccctccagcccctcccttcgtggactctgagctgctttggacatcatgtttttatcttccagaaacttcagtgctctcaagaaggaaaatatttatgaaaacaataaactggccttccgcgtggccgaggagcacttgggcatcccagccttgctggatgccgaggacatggtggccttgaaggtgcctgaccggctgagcatcttgacctacgtgtcccagtattacaactacttccacggccgctcccccattgggggcatggcaggcgtgaagagggcctcggaggactctgaggaggagccgtcagggaagaaggctccagtccaggcggccaagctgccctcgcccgccccagcccggaagcctccactatctccagcccagacaaaccctgtggtccagaggaggaatgagggtgcagggggcccgccccccaagactgaccaggcattggcgggcagcttggtcagcagcacctgcggggtctgcggcaagcacgtgcacctggtacagcggcacctggccgacgggaggctttaccaccggagctgcttcaggtgtaagcagtgctcctgcacgctgcactcgggggcctacaaggccacaggagagccgggcaccttcgtctgcaccagccacctccccgcagccgcctctgcaagccccaagttgacgggtctggtcccccgacagccaggggccatgggtgtggattccaggacctcctgttccccacagaaggcccaggaggcaaacaaggccagaccgtcggcctgggagcctgctgcgggcaactcgcctgccagggcttccgttccagctgcacccaaccctgcagccaccagcgccacgtccgtccacgtgaggagcccagccaggccctctgagagccgcctggcccccactcccacggaggggaaagtccgccctcgtgtgaccaatagctccccgatgggctggtcgtcagctgccccgtgcacagcagcggctgcctcccatcccgccgtgcccccgagtgccccagaccctcgcccggccacaccccagggtgggggagccccccgagtggcagctcctcaaaccacactcagttcaagctccacatctgcagccacggtggaccccccagcctggaccccgtccgcctccaggacccagcaggcccggaataagtttttccaaacatcagcagtgccccccggcaccagcctttctggcagaggtcccaccccgtcacttgttctatccaaggacagcagcaaggagcaggcgcggaacttcctcaagcaggccctctcagcgctggaagaggctggcgctccggcgcctggcaggccctccccagccactgccgctgttcccagttctcagcccaaaactgaagcaccacaagcaagtcccttagccaagccgttacagtcctcgtctccccgggtgcttggcctcccttcgaggatggaaccgccagccccgctgagcacgagcagtacctctcaggcatccgcgttgcccccggcaggcaggaggaacttggcggaatcctcaggggtcggcagggtgggtgctggctccaggccgaagccagaggccccgatggcaaagggtaaaagcaccaccttaacgcaggacatgagcaccagcctccaggaaggccaggaggacgggccggcaggatggagagcgaatctgaagcccgtggacaggagaagcccagctgagaggactctgaagcccaaggaaccacgggccctggcagagccgagggcgggggaggcccccaggaaggtctcaggcagctttgctgggagtgtccacatcaccctgacccccgtgaggcctgacaggaccccacgcccagccagcccaggacccagcctcccaggtccccctccccaccccgccgcaggagactggccgtccctgccagcctcgacgtttgtgacaactggcttcggccggagccccctggccaggaagcccgagtgcagagctggaaggaggaggagaagaaacctcaccttcagggcaaaccagggagacccttgtccccggccaatgtccctgctctgcctggcgagacggtgacctccccagtcaggctgcaccccgactacctctccccggaggagatacagaggcagctgcaggacatcgagaggcggctggacgccctggagctccgcggcgtggagctggagaagcgactgcgggcggccgagggagatgacgctgaggatagcctcatggtggactggttctggctcattcacgagaagcagcttctgctgagacaggagtcagagctgatgtacaagtccaaggcccagcgtctggaggagcagcagctggacatcgagggcgagctgcgccggctcatggccaagcccgaggctctgaagtcactgcaggagcggcggcgggagcaggagctgctggagcagtacgtgagcaccgtgaacgaccgcagtgacatcgtggactcgctggacgaggaccggctccgggaacaagaggaggatcagatgctgcgggacatgattgagaagctgggcctccagaggaagaagtccaagttccgcttgtccaagatctggtcaccaaaaagcaaaagcagcccctcccagtagtagccagtagggccgtgggctcggcccggacctggcatccggacttggactcggggccatgggcttggcccggacccggaacccggacttgtactcggggccgtgggctcggcccggacccggcattcggacttggactcgggaagggcctcctgtccctacaaggggcatgtggacagcagggacctgcgctaccgtctgtggtctcaataaagaaaccgaccacatgg

SEQ ID NO: 153720 - DNA, 8039 bp, Homo sapiens
  Payload ID: 10227
  Gene Symbol: MCPH1
  Gene Name: microcephalin 1
  ENST ID: ENST00000344683
  CDS Start-End: 77-2584
gcatgcccagtgcccgcgcgcgccgccaggctcgcaagcaccgcgtaggccagctggccggatcccgccgtctgtcatggcggcccccatcctgaaagatgtagtggcctatgttgaagtgtggtcatccaatggaacagaaaattattcaaagacatttacaacacagcttgtggatatgggggcaaaggtttcaaaaacttttaacaaacaagtaactcacgttatcttcaaagatggctaccagagcacttgggacaaagctcagaagagaggcgtaaagctcgtttcggtgctctgggtggaaaaatgcaggacagctggagcacacattgatgaatcattgttccctgcagctaatatgaatgaacacttatcaagcctaattaaaaaaaaacgtaaatgtatgcagcccaaagattttaattttaaaacaccagaaaatgataagagatttcagaagaaatttgagaaaatggctaaagagctacaaaggcaaaaaacaaatctagatgatgatgtacctattctcttatttgaatctaatggttcattaatatatactcccacaattgaaattaatagtaggcaccacagcgcaatggagaagagattacaagagatgaaggagaaaagggaaaatctttcccccacctcttcccaaatgattcagcagtctcatgataatccaagtaactctctgtgtgaagcacctttgaacatttcacgtgatactttgtgttcagatgaatactttgctggtggcttacactcatcttttgatgatctttgtggaaactcaggatgtggaaatcaggaaaggaagttggaaggatccattaatgacattaaaagtgatgtgtgtatttcttcacttgtattgaaagcaaataatattcattcatcaccatctttcactcacctcgataaatcaagtcctcagaaatttctgagtaatctttcaaaggaagaaataaacttgcaaagaaatattgcaggtaaagtagtcacccctgaccaaaagcaggctgcaggtatgtctcaggagacgtttgaagagaagtatcgtttgtctcctaccttatcttcaacaaaaggccaccttttgatacattcaagacccaggagttcctcagtaaagagaaaaagagtatcacatggctcccattcacctccgaaggaaaaatgcaagagaaagaggagcaccaggagatctatcatgccgaggctgcagctgtgcaggtcggaagacaggctgcagcacgtggcgggacctgccctggaggctcttagctgtggggagtcttcatatgatgactatttttcacctgataatcttaaggaaaggtattcagagaatcttcctcctgaatctcagctgccatcaagccctgctcagttgagctgcagaagtctttctaagaaggagagaacaagcatatttgaaatgtctgatttttcctgcgttggcaaaaaaaccagaacagttgacattaccaatttcacagcaaaaaccatctccagtcctcggaaaactggaaatggtgaaggccgtgcaacttcgagttgcgtgacttctgcccctgaagaagccctaaggtgttgtagacaggctgggaaagaagacgcatgcccagagggaaatggcttttcttacaccattgaggaccctgctcttccaaaaggacatgatgatgatttaactcctttggaaggaagccttgaagaaatgaaagaagcggttggtctgaaaagcacacagaacaaaggtaccacttccaaaatatcaaactcctctgaaggcgaagcccagagtgaacatgagccatgttttatagttgactgtaacatggagacgtctacagaagagaaggaaaacttacccggaggatacagtggaagtgttaaaaatagaccaacaaggcatgatgttttagatgactcatgtgacggctttaaggacctcatcaaacctcatgaggaattgaagaaaagtgggagaggcaaaaagccaacaagaacattagtcatgacaagcatgccatctgaaaagcagaatgtcgtcatccaggttgtggataaattgaaaggcttttcaattgcaccagacgtctgtgagaccacgactcacgtgctttccgggaagccacttcgcaccctgaatgtgctgctgggaattgcgcgtggctgctgggttctctcttatgattgggtgctatggtctttagaattgggtcactggatttctgaggagccgttcgaactgtctcaccacttccctgcagctcccctgtgccgaagcgagtgccacttgtctgcagggccgtaccgcggaaccctctttgccgaccagccagcgatgtttgtctcgcctgccagcagccccccagtggccaagctctgtgaactagtccacctgtgcggaggccgggtcagccaagtcccccgccaggccagcatcgtcatcgggccctacagcggaaagaagaaagccacagtcaagtatctgtctgagaaatgggtcttagattccatcacccagcacaaggtctgtgcccctgaaaactacctattgtcacaatgacagtgacctcactggcctgtggtgactgcacacagctcgcaaaactgtctttggatgttcaaatgagaaacaaaactgtgaagagaaggaactggcgtatacaagatgacttctgatatcatgtttgccatgtgttgtggttcttaagaactcataggtgactttctgatgactgaatgtctgtttcagagacgcttcgggcctttttatttttattttattttttattttttgagacggagtcctgccctgtttcccaggctggagtgcaatggcacaatctcggctcactgcaacctccacctcccaggttcaagcgattctgctgcctcagcctcctgagtagctgggattacagatgtgtgccaccatgcctggctaatttttgtagttttagtagagacagggtttcgccatgttggccaggctggtctcaaacgcctgagctcaggtgatctgtcaggcctcttctatagaattccagtctttgtgtcttagtcatgatcataattgaaaggtcacagaacctttgtcattagagcacagtactgccaaataaagaatggaaattcaatgacattgttttattactgagaacaactagagaactctgcaagtttcttggcttagactcgatctttattaatacattatctattaggtaggaaagacatttgtcagctattaaggtgacttttatctagcggagattcctctcttaaagtaatgaaaggagataggtatggggggtgttatacaggataattggtgacatctgagtgtcttacttctgcaagcctgctttatggtgagcaaagcatcaccagcaagtgatcacaatgtccactggccgctttttgcctgccgtcctcgagatgaaattggcagttggggctgattcacagaaacaccgatttgtggctgagcacggtggctcacacctgtcatcccagccctttgggaggctgaggtggacagatcacttgaggtcaggagttcgagaccagcctgaccaacgcagcaaaacccatctctactaaaaatacaaaaatcagctgggtgtggtggcacacacctgtggtcccagctcctcaggagtctgaggcagaagaatcgcttgaacccaagaggcagaggttgcagtgagccaaggttgcagtgaatcaagattgctccactgcactccagcctgggcaacagagtaactctccttctcaaataaataaataaataaataagaaacactgatgtgtctgtcaccttctaaagaaatgaaatgctaggaagtcctagccagagtgatcaggcaagaataagccataaaaggcatccaaataggaaaagaagtcaaactgtctctcttcactgccgatatgattctatacctagaaaaccctaaagactctgccaaaaggctcctggaaccgataaatgacttaagtaaagtttcaggatagtaaatccatgtacaaaaatcagcatttccaaacacagtaacattcaagctgagcaccaaatcaagaacgcaatcccatttccaatagccacggaatgaaatacctaggaacacgtataaccaaggaggcaaaggatctctacaaggagaaccataaacgagatgctgagtcccagcgaggtcggaggtgccactgagccctcatcgtggtgccgttcccgctctgggttatttatctgttgctcatctcagctgttgttcctacctcaaatttcaagtccctcaacaaatataacagaaccacttctagaatgaacctttgagaagggaggtagcagtgcattgtataggaattggcattctatagaaaaccacagaaactggaaataatgaagggttgtctcttggttttaaaataatgtatacacctaaatcatccccttatgatactcatcctctaacagcaattgaacttcaatacaatgagtcattcctgagttcactcgcttcacattacatatgtttctctataaccacaagcatcctggcttggtagtgctcccacagcaccaaaaatccctgaggaggctgacaaacattgtgctgactcatgctggagacaagccacagagaacttccatcccccaccacatcagccacggagccagcccagcctctgcccacccaggcctcagtccccagtgttaagttctgatccctgatgctggcctgccagtggccagtcaagattctctttctgaaagctagtattttatgaggactgactgttgctagacattacactaagcacattatatgttgtacttcattttaccctttcaacaatcctattagtagcttactgtgggtctgcaaagccttactcaaaacatatagggctagaggttctcaggattctgaattttaaaaaaaatttgtaaaggcttatggctctcaccactgttattcaacgttgcattaaagtttctacccagagaaggcaataaaaggaaattaaagctatacagattggaagtgaagaaataaaagtctttattctcaagaatacaagacactatgtatagaaattgtaaggaatgcaaaaaaaaaaaaaaaaaaaagccctacaagaacttataacaagtttagcaagattgcaatatacaatcttgcaatcttcctaaagattatatacaaacctaacagaattgtatttatatatactgtcaataagcaattcaaaatgaaattaagaccacgattccatttaaaattgcatctaaaaataaacaaaataggaatagacttggcaacagttgtaacatctgtatactgaaacctgtaaaacattgctgaaagaagttaaagacttctttaaatagagacatatacaaagttcatagattagaagatgcaatattgttaagatgatagtcctcaaattgacgtatagattcaatgcaatccattaaaatctcagatggctttttatagaatttgaaaagctgatgctaaatcttttatgaaaatgcaaagaacctctagtagacaaaacaatttttttaagagcaaagttggaggatttatagaacctgattccaaaactgtcagtaaaactacaataattacaaagtatcagccaggtgccgtggctcacatctgtaataccagctctctgggaggctgaggcgggtggatcacttgaagtcgggagtttaagaccagcctggccaacttggtgaaaccttgtctctactagaaatacaaaaaattagccaggcatgatggcacacacctgtaatctcagttactcaggaggctgaagcagaatagcttgaacccaagagagtccagctcaaaaacaacaacaagaacaaaagtatcacattggcataagaatagacatgtaaatcaaataacaaaatagagaattcaggtataaatcttcatatttatggctgattgactttgaacaaaggtgacgaggcaagtcagtatagcagcatattcttttcaacaaatggtgctggcagaagaaaaaaaaagtacttggatccttacctcacaccatgcacaaaaattagctcaacgtggactatatcagggtttctcaacatcagcagtgttggcgtttgctggggtggataattctttcctgtggagagctgtcctgtgcactgtagaatgtttagctgcatcctggcctctgcctattagatgccagtggcatccctcccctgacacacacctagttttgacaatctctgtctccagatattcccaaatgtgccctggagagcaaaactgtttccagttgagaaccattgacctaatgtaaaaaataaaatgtacagaagaaagcatagcaggaaatcattctgacctcaggttaggcaaagctttcttagatatgacactaaaggcataattcattaaaaaaataagttgggctttgtcaaaattttaagttttgctcttctgaagaaaccattaaaaaaaaatgaaaagacaagccacagactatgaaaaaatacttgcaaatcatatatctgataaaggacttgtacccagaccatgtaaagaactcataactcattaataaaaggataaagaaaaagctgaagacaattcatgcaagaagatatacaaatattaagcacattaaaatgctcaatattattagtcactagggaaatacaaattaaaggcccaatgaaatacctattacacacccattagaatgactgtaaacaacaagactgataattccaacatctgaccaagatatggagaaactagaactctcctacattgctggcatgagtgcaaaatgatacagccactttgaaacaccatttggcagttgcttaaaaaattgaacattcaactaccatatgacccagcaatttcactctcaggtatataaccaaaatacatgaaaacatggatctgcacaaggtcttgtatacaaatgttcatagcaacattattcataataaccaaaaattagcccatcaactgaaaagtagataaacaaaatgtatatccacaccatggaacgctactcagcaaacttctaaaaagcaacaaactactaaacacgtgcaacaacatgaatgagcctcagaaacataagtgaaagaggtcagacacaaaagactacaaattgtaagattccatttagataccatttctacaaaccgcaaaactgtagaggcacgaaacagattcatggtctgctgcagctggggatgggagtgggaacagagagcaaacattttgggatgatggaaacattctaaaactggattgtgattttggttacacaactgtatacatttactaaaatcaatgaacagaacacttttaatgggtaagccttaaggcatgtgaattatacaccaataaagctattttttttaaaaaaaagagagagagagaacgagagctacatggcagccccagggcaatagctctcagatctcccttagagaaagaactttctcttccacagcaatgagtgcaggtagctaacactgaccaacctgcatctggtagttcatttaaggtcggccttggctttcaagttaaggccatggtctttctctgcagtccccagccaatacgtgggcacagaaaggcacagggcatggctgattcagcccaacatgaggctccacaccctagaactccctgtggagttggccgatactgcctgtgacctgcaatgtggtctaagctgtcagacctccacagtggccagaaggttttccatacctgagcctgcttctacccacttttatttttcccaggagtcacgcttagtcatctcttgctctttgaactccatgtctgtatcagctacccagaggacccatcagacagaaagtaatatgcagataacagcccaggggaatctgggcagcactgtgaaaccaacatttcttcagtgaaacctagaacaaaagtggaataaataaaaactaactgtctcatttc

SEQ ID NO: 153721 - DNA, 2049 bp, Homo sapiens
  Payload ID: 10227
  Gene Symbol: MCPH1
  Gene Name: microcephalin 1
  Uniprot ID: Q8NEM0
  ENST ID: ENST00000522905
  CDS Start-End: 26-1714
agctggccggatcccgccgtctgtcatggcggcccccatcctgaaagatgtagtggcctatgttgaagtgtggtcatccaatggaacagaaaattattcaaagacatttacaacacagcttgtggatatgggggcaaaggtttcaaaaacttttaacaaacaagtaactcacgttatcttcaaagatggctaccagagcacttgggacaaagctcagaagagaggcgtaaagctcgtttcggtgctctgggtggaaaaatgcaggacagctggagcacacattgatgaatcattgttccctgcagctaatatgaatgaacacttatcaagcctaattaaaaaaaaacgtaaatgtatgcagcccaaagattttaattttaaaacaccagaaaatgataagagatttcagaagaaatttgagaaaatggctaaagagctacaaaggcaaaaaacaaatctagcttcccaaatgattcagcagtctcatgataatccaagtaactctctgtgtgaagcacctttgaacatttcacgtgatactttgtgttcagatgaatactttgctggtggcttacactcatcttttgatgatctttgtggaaactcaggatgtggaaatcaggaaaggaagttggaaggatccattaatgacattaaaagtgatgtgtgtatttcttcacttgtattgaaagcaaataatattcattcatcaccatctttcactcacctcgataaatcaagtcctcagaaatttctgagtaatctttcaaaggaagaaataaacttgcaaagaaatattgcaggtaaagtagtcacccctgaccaaaagcaggctgcaggtatgtctcaggagacgtttgaagagaagtatcgtttgtctcctaccttatcttcaacaaaaggccaccttttgatacattcaagacccaggagttcctcagtaaagagaaaaagagtatcacatggctcccattcacctccgaaggaaaaatgcaagagaaagaggagcaccaggagatctatcatgccgaggctgcagctgtgcaggtcggaagacaggctgcagcacgtggcgggacctgccctggaggctcttagctgtggggagtcttcatatgatgactatttttcacctgataatcttaaggaaaggtattcagagaatcttcctcctgaatctcagctgccatcaagccctgctcagttgagctgcagaagtctttctaagaaggagagaacaagcatatttgaaatgtctgatttttcctgcgttggcaaaaaaaccagaacagttgacattaccaatttcacagcaaaaaccatctccagtcctcggaaaactggaaatggtgaaggccgtgcaacttcgagttgcgtgacttctgcccctgaagaagccctaaggtgttgtagacaggctgggaaagaagacgcatgcccagagggaaatggcttttcttacaccattgaggaccctgctcttccaaaaggacatgatgatgatttaactcctttggaaggaagccttgaagaaatgaaagaagcggttggtctgaaaagcacacagaacaaaggtaccacttccaaaatatcaaactcctctgaaggcgaagcccagagtgaacatgagccatgttttatagttgactgtaacatggagacgtctacagaagagaaggaaaacttacccggaggatacagtggaagtatgtgaatctccttttccaagtcaccttcgctaaataaacatgtaacagtgcatccatattttaaatttatcacaactttttcataacttatttccccatttactcctctttttacttaaagaatgtgcatttgatcattccaatgataaactctttaggaatagatgacttgctgtcttgtggaacttctagacttattggttaagtctgttaggaatctatttctccaagacttttccttcttataggtcaaaaggataagtagtccatagtatgaataactgaggggagtgaagtctttttccttattccattggagtcttggcgctgcagcgtgtgt

SEQ ID NO: 153722 - DNA, 2917 bp, Homo sapiens
  Payload ID: 10227
  Gene Symbol: MCPH1
  Gene Name: microcephalin 1
  Uniprot ID: Q8NEM0
  ENST ID: ENST00000519480
  CDS Start-End: 73-1905
gcccagtgcccgcgcgcgccgccaggctcgcaagcaccgcgtaggccagctggccggatcccgccgtctgtcatggcggcccccatcctgaaagatgtagtggcctatgttgaagtgtggtcatccaatggaacagaaaattattcaaagacatttacaacacagcttgtggatatgggggcaaaggtttcaaaaacttttaacaaacaagtaactcacgttatcttcaaagatggctaccagagcacttgggacaaagctcagaagagaggcgtaaagctcgtttcggtgctctgggtggaaaaatgcaggacagctggagcacacattgatgaatcattgttccctgcagctaatatgaatgaacacttatcaagcctaattaaaaaaaaacgtaaatgtatgcagcccaaagattttaattttaaaacaccagaaaatgataagagatttcagaagaaatttgagaaaatggctaaagagctacaaaggcaaaaaacaaatctagatgatgatgtacctattctcttatttgaatctaatggttcattaatatatactcccacaattgaaattaatagtaggcaccacagcgcaatggagaagagattacaagagatgaaggagaaaagggaaaatctttcccccacctcttcccaaatgattcagcagtctcatgataatccaagtaactctctgtgtgaagcacctttgaacatttcacgtgatactttgtgttcagatgaatactttgctggtggcttacactcatcttttgatgatctttgtggaaactcaggatgtggaaatcaggaaaggaagttggaaggatccattaatgacattaaaagtgatgtgtgtatttcttcacttgtattgaaagcaaataatattcattcatcaccatctttcactcacctcgataaatcaagtcctcagaaatttctgagtaatctttcaaaggaagaaataaacttgcaaagaaatattgcaggtaaagtagtcacccctgaccaaaagcaggctgcaggtatgtctcaggagacgtttgaagagaagtatcgtttgtctcctaccttatcttcaacaaaaggccaccttttgatacattcaagacccaggagttcctcagtaaagagaaaaagagtatcacatggctcccattcacctccgaaggaaaaatgcaagagaaagaggagcaccaggagatctatcatgccgaggctgcagctgtgcaggtcggaagacaggctgcagcacgtggcgggacctgccctggaggctcttagctgtggggagtcttcatatgatgactatttttcacctgataatcttaaggaaaggtattcagagaatcttcctcctgaatctcagctgccatcaagccctgctcagttgagctgcagaagtctttctaagaaggagagaacaagcatatttgaaatgtctgatttttcctgcgttggcaaaaaaaccagaacagttgacattaccaatttcacagcaaaaaccatctccagtcctcggaaaactggaaatggtgaaggccgtgcaacttcgagttgcgtgacttctgcccctgaagaagccctaaggtgttgtagacaggctgggaaagaagacgcatgcccagagggaaatggcttttcttacaccattgaggaccctgctcttccaaaaggacatgatgatgatttaactcctttggaaggaagccttgaagaaatgaaagaagcggttggtctgaaaagcacacagaacaaaggtaccacttccaaaatatcaaactcctctgaaggcgaagcccagagtgaacatgagccatgttttatagttgactgtaacatggagacgtctacagaagagaaggaaaacttacccggaggatacagtggaagtatgtgaatctccttttccaagtcaccttcgctaaataaacatgtaacagtgcatccatattttaaatttatcacaactttttcataacttatttccccatttactcctctttttacttaaagaatgtgcatttgatcattccaatgataaactctttaggaatagatgacttgctgtcttgtggaacttctagacttattggttaagtctgttaggaatctatttctccaagacttttccttcttataggtcaaaaggataagtagtccatagtatgaataactgaggggagtgaagtctttttccttattccattggagtcttggcgctgcagcgtgtgtaaagatgtatacgatagagagttttttaaaacctaggttcttaatagtgaggctatttaaagaaagaaattaaggtagattaagccatcgattgtatcatagagaaagtgtgaaaaactacttttagaaatctgttgtcaatattgatttttgaagaaactttggtcagtgttaactatgaagaaacatttaaacatttttgatcatttgtaacaagccttgtttaacttgtacttattttgcttgaagcatcacttgaaaaggtttactcctattcataatttaattgtaattataataaaccatatcattttattaaaagtcaaaacaataaaaaattttgcacttcacagttataagcacaaataggttccagcaaccaaaattgaagaaatcttgaactttgaccgtctttacctaaagattaggttaaaatttgagtgagaacgcattctctctgcatgatttctctgctctacaaatgttttaactgcctctttgaaggtggagaagtcatggtagcgtttgaaatcatcacagacatgttacataccttttccttgagtatacgctccccaaaattgtttcacaaaaagaatgaaaataattttatgtttttggcctgctatttatatcttggctttctgaacatatattaaatttgacaagaaactgta

SEQ ID NO: 153723 - DNA, 2845 bp, Homo sapiens
  Payload ID: 10228
  Gene Symbol: MFAP5
  Gene Name: microfibrillar associated protein 5
  Uniprot ID: Q13361
  ENST ID: ENST00000359478
  CDS Start-End: 189-710
tctacgcctagcctggctttcttgctctccctcatctcattgtttcagcggaggccaaatctgaagtcctttccagggagtggctctgttcatcttattcgccagccaaagtaggaacagcgtaagaggagagagacacattcagcagccaaaggactcggtggaaagagcagaacaccatagacaatatgtcgctcttgggacccaaggtgctgctgtttcttgctgcattcatcatcacctctgactggatacccctgggggtcaatagtcaacgaggagacgatgtgactcaagcgactccagaaacattcacagaagatcctaatctggtgaatgatcccgctacagatgaaacagttttggctgttttggctgatattgcaccttccacagatgacttggcctccctcagtgaaaaaaataccactgcagagtgctgggatgagaaatttacctgcacaaggctctactctgtgcatcggccggttaaacaatgcattcatcagttatgcttcaccagtttacgacgtatgtacatcgtcaacaaggagatctgctctcgtcttgtctgtaaggaacacgaagctatgaaagatgagctttgccgtcagatggctggtctgccccctaggagactccgtcgctccaattacttccgacttcctccctgtgaaaatgtggatttgcagagacccaatggtctgtgatcattgaaaaagaggaaagaagaaaaaatgtatgggtgagaggaaggaggatctccttcttctccaaccattgacagctaacccttagacagtatttcttaaaccaatccttttgcaatgtccagcttttacccctactctctactttttcacccaaactgataacatttatctcattttctagcacttaaaatacaaagtctatattattgcataattttgctgcttctcaatatcatagacacagtgaatagatgatgactatatggcttatatacaaacattctatgtacaatttcaagggagactaaactttaggctaataatctttactattgaatctgtctgatatagatcttagggttgaagaagctatctttgtctatttgggctaaccatagaatttcatttattttcctcacaatattttcctagaccaactccccatcattcacgtgttcctctttactcttactttaactattttgctggcttgcccgaaaatttgcctggcaagtcttccttataagacacatcatggtaagttttgtagtcctgtaagattctgcaacacagtcaagaattatacaatcctactagcaatatataaggacccaaaatgtcttctgctaagctcagaggctggggctaaagcatgaggactatgccagctatagaacttggactcataattcgctatccaatttttcatgcagttgtctagtcgggaagtaaggttggaaactaagtctcatttactgattcgtttatgggtagtaccgggatgaacccaccaccacaaagcaaattagacaacttaatgtgaaatcataccattggttgacgtttccttgagttgctacttcgttcatcttcacaacttaacaagtgcacggtcgaattattgtgcaagtggcttttggatatcctgattggggcctaagaagggcattcagacttgaattttaataggcagacagaaagtttgcctaatagttaatacgaaagagtgaaagaaacacaatattcagacaacccacattcttatcctggctctagcagtaaccacgtagccttggataagccattttccttcattaggtcctggtttaatttcctcatctttaaaatgagaaggttaaatttatcttagtactgctgggcgcagtggctcatgcctgtaatctgagcactttgggaagctgaggcgggtggatcacttgaggtcagaaatttgagacgagcctggccaacatggtgaaaccccatctctactaaaaatacaaaaattagctgggcgtggtggcacgtgcctgtaatcccagctactcgggaggctgaggcaggagaatcaattgaacctgggaggcagaggttgcagtgagccgagatggcgccattgcactccagcctgggtgacaaaagcaaaagtccatcttaagaaatatatatatatattatatatattcttagttctaagatttcctttaattctatgattctctggatttaaatgcattattcatatttcttgaagcttagatacagtctaattcatagcaaccatatctgctttatcctaggtgagggtagcagtccacaatggaatagaagaaaatcccattataacaaatgacaaattatatatcatgaatccttctgtctgactaactcaataactttctataaaagccaatggaattcaaataggagctaggagacaacaagttatatatgacagtggaggttgtattccttttatattgctgagaaaactagttaaatgatcagattcttgctgttaagaaacaatttcgtttaatgggatctgtacaactgattttaaaaaaatgctacaaaaagccccaaagcatataatctctactccttacagtctctagaattaaatgtactcatttagacaacatattaaatgcatattttagccactttagagaaacctcataggcacagagtttccaagattaattttaagaatatcttcacgaacttgaccctcctactccacattgcaacatttccatcagacagcatttcaattccagtattatgtatattgcaaattaaacattttaaaatatttttttccaatttatttctcaaaataaaatgtc

SEQ ID NO: 153724 - DNA, 1195 bp, Homo sapiens
  Payload ID: 10228
  Gene Symbol: MFAP5
  Gene Name: microfibrillar associated protein 5
  Uniprot ID: Q13361
  ENST ID: ENST00000396549
  CDS Start-End: 203-694
attgtaacacacattctacgcctagcctggctttcttgctctccctcatctcattgtttcagcggaggccaaatctgaagtcctttccagggagtggctctgttcatcttattcgccagccaaagtaggaacagcgtaagaggagagagacacattcagcagccaaaggactcggtggaaagagcagaacaccatagacaatatgtcgctcttgggacccaaggtgctgctgtttcttgctgcattcatcatcacctctgactggatacccctgggggtcaatagtcaacgaggagacgatgtgactcaagcgactccagaaacattcacagaagatcctaatctggtgaatgatcccgctacagatgaaacagttttggctgttttggctgatattgcaccttccacagatgacttggagtgctgggatgagaaatttacctgcacaaggctctactctgtgcatcggccggttaaacaatgcattcatcagttatgcttcaccagtttacgacgtatgtacatcgtcaacaaggagatctgctctcgtcttgtctgtaaggaacacgaagctatgaaagatgagctttgccgtcagatggctggtctgccccctaggagactccgtcgctccaattacttccgacttcctccctgtgaaaatgtggatttgcagagacccaatggtctgtgatcattgaaaaagaggaaagaagaaaaaatgtatgggtgagaggaaggaggatctccttcttctccaaccattgacagctaacccttagacagtatttcttaaaccaatccttttgcaatgtccagcttttacccctactctctactttttcacccaaactgataacatttatctcattttctagcacttaaaatacaaagtctatattattgcataattttgctgcttctcaatatcatagacacagtgaatagatgatgactatatggcttatatacaaacattctatgtacaatttcaagggagactaaactttaggctaataatctttactattgaatctgtctgatatagatcttagggttgaagaagctatctttgtctatttgggctaaccatagaatttcatttattttcctcacaatattttcctagaccaactccccatcattcacgtgttcctctttactcttactttaactattttgctggcttgcccga

SEQ ID NO: 153725 - DNA, 2308 bp, Homo sapiens
  Payload ID: 10228
  Gene Symbol: MFAP5
  Gene Name: microfibrillar associated protein 5
  ENST ID: ENST00000433590
  CDS Start-End: 261-707
atttggaatgagggtgtgagcaactgcaaattcccatctcccttctcattccagcctcattgtaacacacattctacgcctagcctggctttcttgctctccctcatctcattgtttcagcggaggccaaatctgaagtcctttccagggagtggctctgttcatcttattcgccagccaaagtaggaacagcgtaagaggagagagacacattcagcagccaaaggactcggtggaaagagcagaacaccatagacaatatgtcgctcttgggacccaaggtgctgctgtttcttgctgcattcatcatcacctctgactggatacccctgggggtcaatagtcaacgaggagacgatgtgactcaagcgactccagaaacattcacagaagatcctaatctggtgaatgatcccgctacagatgaaacagagtgctgggatgagaaatttacctgcacaaggctctactctgtgcatcggccggttaaacaatgcattcatcagttatgcttcaccagtttacgacgtatgtacatcgtcaacaaggagatctgctctcgtcttgtctgtaaggaacacgaagctatgaaagatgagctttgccgtcagatggctggtctgccccctaggagactccgtcgctccaattacttccgacttcctccctgtgaaaatgtggatttgcagagacccaatggtctgtgatcattgaaaaagaggaaagaagaaaaaatgtatgggtgagaggaaggaggatctccttcttctccaaccattgacagctaacccttagacagtatttcttaaaccaatccttttgcaatgtccagcttttacccctactctctactttttcacccaaactgataacatttatctcattttctagcacttaaaatacaaagtctatattattgcataattttgctgcttctcaatatcatagacacagtgaatagatgatgactatatggcttatatacaaacattctatgtacaatttcaagggagactaaactttaggctaataatctttactattgaatctgtctgatatagatcttagggttgaagaagctatctttgtctatttgggctaaccatagaatttcatttattttcctcacaatattttcctagaccaactccccatcattcacgtgttcctctttactcttactttaactattttgctggcttgcccgaaaatttgcctggcaagtcttccttataagacacatcatggtaagttttgtagtcctgtaagattctgcaacacagtcaagaattatacaatcctactagcaatatataaggacccaaaatgtcttctgctaagctcagaggctggggctaaagcatgaggactatgccagctatagaacttggactcataattcgctatccaatttttcatgcagttgtctagtcgggaagtaaggttggaaactaagtctcatttactgattcgtttatgggtagtaccgggatgaacccaccaccacaaagcaaattagacaacttaatgtgaaatcataccattggttgacgtttccttgagttgctacttcgttcatcttcacaacttaacaagtgcacggtcgaattattgtgcaagtggcttttggatatcctgattggggcctaagaagggcattcagacttgaattttaataggcagacagaaagtttgcctaatagttaatacgaaagagtgaaagaaacacaatattcagacaacccacattcttatcctggctctagcagtaaccacgtagccttggataagccattttccttcattaggtcctggtttaatttcctcatctttaaaatgagaaggttaaatttatcttagtactgctgggcgcagtggctcatgcctgtaatctgagcactttgggaagctgaggcgggtggatcacttgaggtcagaaatttgagacgagcctggccaacatggtgaaaccccatctctactaaaaatacaaaaattagctgggcgtggtggcacgtgcctgtaatcccagctactcgggaggctgaggcaggagaatcaattgaacctgggaggcagaggttgcagtgagccgagatggcgccattgcactccagcctgggtgacaaaagcaaaagtccatcttaagaaatatatatatatattatatatattcttagttctaagatttcctttaattctatgattctctggatttaaatgcattattcatatttcttgaagcttagatacagtctaattcatagcaaccatatctgctttatcctaggtgagggtagcagtccac

SEQ ID NO: 153726 - DNA, 566 bp, Homo sapiens
  Payload ID: 10228
  Gene Symbol: MFAP5
  Gene Name: microfibrillar associated protein 5
  ENST ID: ENST00000535336
  CDS Start-End: 102-431
gttcatcttattcgccagccaaagtaggaacagcgtaagaggagagagacacattcagcagccaaaggactcggtggaaagagcagaacaccatagacaatatgtcgctcttgggacccaaggtgctgctgtttcttgctgcattcatcatcacctctgactggatacccctgggggtcaatagtcaacgaggagacgatgtgactcaagcgactccagaaacattcacagaagatcctaatctggtgaatgatcccgctacagatgaaacagttttggctgttttggctgatattgcaccttccacagatgacttggatgagctttgccgtcagatggctggtctgccccctaggagactccgtcgctccaattacttccgacttcctccctgtgaaaatgtggatttgcagagacccaatggtctgtgatcattgaaaaagaggaaagaagaaaaaatgtatgggtgagaggaaggaggatctccttcttctccaaccattgacagctaacccttagacagtatttcttaaaccaatccttttgcaatgtccagcttttacccc

SEQ ID NO: 153727 - DNA, 620 bp, Homo sapiens
  Payload ID: 10228
  Gene Symbol: MFAP5
  Gene Name: microfibrillar associated protein 5
  ENST ID: ENST00000537009
  CDS Start-End: 79-495
gtaggaacagcgtaagaggagagagacacattcagcagccaaaggactcggtggaaagagcagaacaccatagacaatatgtcgctcttgggacccaaggtgctgctgtttcttgctgcattcatcatcacctctgactggatacccctgggggtcaatagtcaacgaggagacgatgtgactcaagcgactccagaaacattcacagaagatcctaatctggtgaatgatcccgctacagatgaaacagttttggctgttttggctgatattgcaccttccacagatgacttggcctccctcagtgaaaaaaataccactgcagagtgctgggatgagaaatttacctgcacaaggctctactctgtgcatcggccggttaaacaatgcattcatcagttatgcttcaccagtttacgacgtatgtacatcgtcaacaaggagatctgctctcgtcttgtctgtaaggaacacgaagctatgaaagatccatgattagaagaattggcagctggatatataaaggaaactaacatttactgctcacctgtgctagatgagctttgccgtcagatggctggtctgccccctaggagactccgtcgctccaattacttccg

SEQ ID NO: 153728 - DNA, 492 bp, Homo sapiens
  Payload ID: 10228
  Gene Symbol: MFAP5
  Gene Name: microfibrillar associated protein 5
  Uniprot ID: Q13361
  ENST ID: ENST00000540087
  CDS Start-End: 1-492
atgtcgctcttgggacccaaggtgctgctgtttcttgctgcattcatcatcacctctgactggatacccctgggggtcaatagtcaacgaggagacgatgtgactcaagcgactccagaaacattcacagaagatcctaatctggtgaatgatcccgctacagatgaaacagttttggctgttttggctgatattgcaccttccacagatgacttggagtgctgggatgagaaatttacctgcacaaggctctactctgtgcatcggccggttaaacaatgcattcatcagttatgcttcaccagtttacgacgtatgtacatcgtcaacaaggagatctgctctcgtcttgtctgtaaggaacacgaagctatgaaagatgagctttgccgtcagatggctggtctgccccctaggagactccgtcgctccaattacttccgacttcctccctgtgaaaatgtggatttgcagagacccaatggtctgtga

SEQ ID NO: 153729 - DNA, 585 bp, Homo sapiens
  Payload ID: 10228
  Gene Symbol: MFAP5
  Gene Name: microfibrillar associated protein 5
  ENST ID: ENST00000535411
  CDS Start-End: 1-491
ttcttgctgcattcatcatcacctctgactggatacccctgggggtcaatagtcaacgaggagacgatgtgactcaagcgactccagaaacattcacagaagatcctaatctggtgaatgatcccgctacagatgaaacagttttggctgttttggctgatattgcaccttccacagatgacttggcctccctcagtgaaaaaaataccactgcagagtgctgggatgagaaatttacctgcacaaggctctactctgtgcatcggccggttaaacaatgcattcatcagttatgcttcaccagtttacgacgtatgtacatcgtcaacaaggagatctgctctcgtcttgtctgtaaggaacacgaagctatgaaagatgagctttgccgtcagatggctggtctgccccctaggagactccgtcgctccaattacttccgacttcctccctgtgaaaatgtggatttgcagagacccaatggtctgtgatcattgaaaaagaggaaagaagaaaaaatgtgtggccaagatcccctctcgcaggcacatgactgcctcattcacaaatcttgtcaccaggcgg

SEQ ID NO: 153730 - DNA, 972 bp, Homo sapiens
  Payload ID: 10228
  Gene Symbol: MFAP5
  Gene Name: microfibrillar associated protein 5
  ENST ID: ENST00000543369
  CDS Start-End: 64-519
gaggagagagacacattcagcagccaaaggactcggtggaaagagcagaacaccatagacaatatgtcgctcttgggacccaaggtgctgctgtttcttgctgcattcatcatcacctctgacgatgtgactcaagcgactccagaaacattcacagaagatcctaatctggtgaatgatcccgctacagatgaaacagttttggctgttttggctgatattgcaccttccacagatgacttggagtgctgggatgagaaatttacctgcacaaggctctactctgtgcatcggccggttaaacaatgcattcatcagttatgcttcaccagtttacgacgtatgtacatcgtcaacaaggagatctgctctcgtcttgtctgtaaggaacacgaagctatgaaagatgagctttgccgtcagatggctggtctgccccctaggagactccgtcgctccaattacttccgacttcctccctgtgaaaatgtggatttgcagagacccaatggtctgtgatcattgaaaaagaggaaagaagaaaaaatgtatgggtgagaggaaggaggatctccttcttctccaaccattgacagctaacccttagacagtatttcttaaaccaatccttttgcaatgtccagcttttacccctactctctactttttcacccaaactgataacatttatctcattttctagcacttaaaatacaaagtctatattattgcataattttgctgcttctcaatatcatagacacagtgaatagatgatgactatatggcttatatacaaacattctatgtacaatttcaagggagactaaactttaggctaataatctttactattgaatctgtctgatatagatcttagggttgaagaagctatctttgtctatttgggctaaccatagaatttcatttattttcctcacaatattttcctagaccaactccccatcattc

SEQ ID NO: 153731 - DNA, 840 bp, Homo sapiens
  Payload ID: 10228
  Gene Symbol: MFAP5
  Gene Name: microfibrillar associated protein 5
  ENST ID: ENST00000544211
  CDS Start-End: 66-452
aagaggagagagacacattcagcagccaaaggactcggtggaaagagcagaacaccatagacaatatgtcgctcttgggacccaaggtgctgctgtttcttgctgcattcatcatcacctctgactggatacccctgggggtcaatagtcaacgaggagacgatgtgactcaagcgactccagaaacattcacagaagatcctaatctggtgaatgatcccgctacagatgaaacagttttggctgttttggctgatattgcaccttccacagatgacttggagtgctgggatgagaaatttacctgcacaaggctctactctgtgcatcggccggttaaacaatgcattcatcagttatgcttcaccagtttacgacgtatgtacatcgtcaacaaggagatctgctctcgtcttgtctgtaaggaacacgaagctatgaaagatccatgattagaagaattggcagctggatatataaaggaaactaacatttactgctcacctgtgctagatgagctttgccgtcagatggctggtctgccccctaggagactccgtcgctccaattacttccgacttcctccctgtgaaaatgtggatttgcagagacccaatggtctgtgatcattgaaaaagaggaaagaagaaaaaatgtatgggtgagaggaaggaggatctccttcttctccaaccattgacagctaacccttagacagtatttcttaaaccaatccttttgcaatgtccagcttttacccctactctctactttttcacccaaactgataacatttatctcattttctagcacttaaaatacaaagtctatattattgca

SEQ ID NO: 153732 - DNA, 388 bp, Homo sapiens
  Payload ID: 10228
  Gene Symbol: MFAP5
  Gene Name: microfibrillar associated protein 5
  ENST ID: ENST00000543467
  CDS Start-End: 1-240
tactctgtgcatcggccggttaaacaatgcattcatcagttatgcttcaccagtttacgacgtatgtacatcgtcaacaaggagatctgctctcgtcttgtctgtaaggaacacgaagctatgaaagatgagctttgccgtcagatggctggtctgccccctaggagactccgtcgctccaattacttccgacttcctccctgtgaaaatgtggatttgcagagacccaatggtctgtgatcattgaaaaagaggaaagaagaaaaaattttgcttgcacttgctgtccttccaccatgggatgactctcatcagatgatggcaccatgttcttggacttctcagcctccagaactgtgagaaataaatttcttttctttataaatta

SEQ ID NO: 153733 - DNA, 582 bp, Homo sapiens
  Payload ID: 10228
  Gene Symbol: MFAP5
  Gene Name: microfibrillar associated protein 5
  ENST ID: ENST00000544889
  CDS Start-End: 310-582
atttgattacctgaaaccctaaagagacagagggaatgtgtgtatgtctgtgtgtgtgtgaaagggctggagggggcaatggggaatgtcactgaacttagtcttgagcagacctcccaaataaccgtggaattctgatgaaggagacgccaagatgagcagatgatatgaaaaagtcacgcatatgagaaaggaagattccacatcaggggtgaaagaggccaaagggtagggccaagtacggaccatgtagaatgtaaaatttcctctgacttggtagcagagaataataaaagcaagaataatgatatgtcgctcttgggacccaaggtgctgctgtttcttgctgcattcatcatcacctctgactggatacccctgggggtcaatagtcaacgaggagacgatgtgactcaagcgactccagaaacattcacagaagatcctaatctggtgaatgatcccgctacagatgaaacagttttggctgttttggctgatattgcaccttccacagatgacttggcctccctcagtgaaaaaaataccactgcagagtgctgggatgagaaatttacctgc

SEQ ID NO: 153734 - DNA, 2155 bp, Homo sapiens
  Payload ID: 10229
  Gene Symbol: MFAP1
  Gene Name: microfibrillar-associated protein 1
  Uniprot ID: P55081
  ENST ID: ENST00000267812
  CDS Start-End: 234-1553
gcagaaaccgactcgacttcctagctgtgggcgcccaaacgtcgtccaccatcccacaatcctctcgtcacgtatttccggtttatctagctcagccgtaagtagtttctctatcagtcgcgcagctgtgttcgcggactcaggtggaaggaatttcttctcttcgttgacgttgctggtgttcactgtttggaattagtcaagtttcgggaatcaccgtcgctgccatcaacatgtcggtcccaagcgctctcatgaagcaaccgcccattcagtctacggctggggccgtcccagttcgcaatgagaaaggtgagatttcaatggaaaaagtgaaggtaaagcgttatgtgtccggaaaaaggccagactatgcccctatggagtcctcagatgaggaggatgaagaatttcagttcattaagaaagccaaagaacaagaagcagagcctgaggaacaggaggaggattcatccagtgacccccggctacggcgtttacagaaccgtattagtgaagatgtggaagagagattggctcgacatcgaaaaatagtggaacctgaagtggtaggagagagtgactcagaagtagaaggagatgcttggcgcatggaacgagaagacagcagtgaagaagaggaggaggaaattgatgatgaggaaatagagcggcggcgtggcatgatgcgtcagcgagcacaggagagaaaaaatgaagagatggaagtcatggaagtggaagatgagggtcgttctggagaggagtcagaatcagagtctgagtatgaagagtacacagacagtgaagatgagatggagcctcgccttaagccagtcttcattcgaaagaaggaccgagtgacagttcaagaacgtgaagccgaagcattgaaacagaaggagctggagcaggaagcaaaacgcatggctgaggaaaggcgcaagtacacactcaagattgtcgaagaggaaaccaaaaaagagctggaagagaacaagcgatccctggctgcattggatgcactcaatactgatgatgaaaatgatgaggaggaatatgaggcatggaaagttcgagagctaaaaagaatcaagagggacagagaagatcgagaagcgcttgagaaggagaaagcagaaattgaacgcatgcgaaacctgactgaggaagagaggagagctgaacttcgggcaaacggcaaagtcattaccaacaaagctgttaagggcaaatacaagttcttacagaagtattatcaccggggtgccttcttcatggatgaggatgaagaagtatacaagagagatttcagcgctcctaccctggaggatcatttcaataaaaccattcttcctaaagtcatgcaggtcaagaactttggacgctcaggtcgcaccaaatacactcaccttgtggatcaagataccacctcctttgactcagcttggggccaagagagtgcccagaacacaaagttcttcaaacaaaaggcagctggggtacgagatgtatttgagcggccatctgccaagaagcggaaaactacctagggtccaactgcttattcttccaactgtggaacacaaggggagtctcagcatctggtccttgatttggttttttcattgtttccttggcccctgtatccagatattggacttactgctatacttgtgatactgggtagcccagactttgaaggtgctttgtgaggtttggactcatgctgagaaacccacaggaaagcactgtccaggtaggattagaggcttcccacttaaaactatttctgagaaatcttaggttttatcactgctatggtttcccatatttacttgggactgttctgactttctttttccagcccttagcttgggttagaaaagtggacatgtaagtgaacaatgcattacttctaccttaggtttaggagtaatatacccggaaatctaagctcatggaaacatgttttccatttttgcttggagtccgtttttctagttgtacatactttttgatccatatatgtgtgcatgtcaagaaataaaagaatcacacaacaaggagatttttagcatgatactggaaataaaatgtccaagctgacaagtattaattgcctattaaagtaaaagataacaattgtcaggca

SEQ ID NO: 153735 - DNA, 970 bp, Homo sapiens
  Payload ID: 10230
  Gene Symbol: MFAP2
  Gene Name: microfibrillar-associated protein 2
  Uniprot ID: P55001
  ENST ID: ENST00000375534
  CDS Start-End: 4-552
gccatgagagctgcctacctcttcctgctattcctgcctggcttgctggctcagggccagtatgacctggacccgctgccgccgttccctgaccacgtccagtacacccactatagcgaccagatcgacaacccagactactatgattatcaagaggtgactcctcggccctccgaggaacagttccagttccagtcccagcagcaagtccaacaggaagtcatcccagccccaaccccagaaccaggaaatgcagagctggagcccacagagcctgggcctcttgactgccgtgaggaacagtacccgtgcacccgcctctactccatacacaggccttgcaaacagtgtctcaacgaggtctgcttctacagcctccgccgtgtgtacgtcattaacaaggagatctgtgttcgtacagtgtgtgcccatgaggagctcctccgagctgacctctgtcgggacaagttctccaaatgtggcgtgatggccagcagcggcctgtgccaatccgtggcggcctcctgtgccaggagctgtgggagctgctagggtggtgctggcatcctgagtcctggccctcctgggatctggggccctcgggccctgcctgacctggtgcttttttccccatccccatgttccttttattctgtaaaaagttagtggactgcagccctgggggttgcaggctgcggtgcctcaggcccctccttcagcctgtggccacctctggggcacaatgggggctccccactgcccagtctgcccctcgggttgggggagtatcccaggcctctctgtgggacctgggcccctgacgggccttctcagcccgttttgaggacagacagtcccccgaggtaggctacatccccccaccccagctggtctgcttggatttcctacagcccccgtgggcatggaccacctttattttatacaaaattaaaaacaagtttttacaaaa

SEQ ID NO: 153736 - DNA, 1260 bp, Homo sapiens
  Payload ID: 10230
  Gene Symbol: MFAP2
  Gene Name: microfibrillar-associated protein 2
  Uniprot ID: P55001
  ENST ID: ENST00000375535
  CDS Start-End: 291-842
gaggaagctttgcacagacgtgaggacggccccgggcgcctctaccccggggacacccccccccccaggagatggaaccccgagggcacggcgtggcggcccatgcgggcagctcgcgttaggacccagcggctccggggctggagggcgggcgccagccccgtcgggggcccggagggggactcggagcgggccaaggggcggctccggcgggcggactcggagcgggcggcggagtgacccggacagctgtcctctctgacaccaccccggcctgcctctttgttgccatgagagctgcctacctcttcctgctattcctgcctgcaggcttgctggctcagggccagtatgacctggacccgctgccgccgttccctgaccacgtccagtacacccactatagcgaccagatcgacaacccagactactatgattatcaagaggtgactcctcggccctccgaggaacagttccagttccagtcccagcagcaagtccaacaggaagtcatcccagccccaaccccagaaccaggaaatgcagagctggagcccacagagcctgggcctcttgactgccgtgaggaacagtacccgtgcacccgcctctactccatacacaggccttgcaaacagtgtctcaacgaggtctgcttctacagcctccgccgtgtgtacgtcattaacaaggagatctgtgttcgtacagtgtgtgcccatgaggagctcctccgagctgacctctgtcgggacaagttctccaaatgtggcgtgatggccagcagcggcctgtgccaatccgtggcggcctcctgtgccaggagctgtgggagctgctagggtggtgctggcatcctgagtcctggccctcctgggatctggggccctcgggccctgcctgacctggtgcttttttccccatccccatgttccttttattctgtaaaaagttagtggactgcagccctgggggttgcaggctgcggtgcctcaggcccctccttcagcctgtggccacctctggggcacaatgggggctccccactgcccagtctgcccctcgggttgggggagtatcccaggcctctctgtgggacctgggcccctgacgggccttctcagcccgttttgaggacagacagtcccccgaggtaggctacatccccccaccccagctggtctgcttggatttcctacagcccccgtgggcatggaccacctttattttatacaaaattaaaaacaagtttttacaaaa

SEQ ID NO: 153737 - DNA, 2891 bp, Homo sapiens
  Payload ID: 10231
  Gene Symbol: MFAP3
  Gene Name: microfibrillar-associated protein 3
  Uniprot ID: P55082
  ENST ID: ENST00000322602
  CDS Start-End: 483-1571
ggagctagacggcggtcgggtaggtgacggcttggttggggtcgctgcgaggggactactaggagcgccgaggcgtgagtcgtagcctgtggcttggggtcgggagtgcaggaggcgaaaatgtttgccattcttttgaaagtctggcctgggtgtgggagttcggtcatcgaacacttactgagagccagatacctgccaggcactgccctgggctccagggacacatcagtcaacgaacggaagggccctgctctcaagcagtgcgaaaagcagattataaacaagtcaacaaacgggattatctaaggtggtagttctctactcacatcttttaatcttgaagactagaaaatataactggatctaccacttgtttggaaaatttctctaccaagcaataaattacccgctgtgcttttgttgtagtgtagaagtttttgagttctccaaatctaaacaagattttgtcccattttcccatgaagctacattgttgcttattcactttagtggcaagtattattgtgccagctgcttttgttttggaagatgtggacttcgaccaaatggtttcactggaagcaaatcgtagttcttacaatgcatcctttccctcaagctttgaactctcagcaagttcccactcggatgatgatgtcatcatagccaaagagggaactagcgtttcaattgagtgtcttctcacagccagtcactatgaagatgtccattggcacaattcaaaaggacagcaactggatggcagaagcagaggtggaaagtggttggtttctgataacttcctaaacatcaccaatgtagcttttgatgaccgtgggctctatacctgtttcgtcacctctccaattcgtgcctcctactctgtcaccctacgtgttatcttcacctcgggagacatgagtgtctattacatgattgtttgcctgattgcctttacaatcacactcatcttgaatgtcacacggctgtgcatgatgagcagccatcttcgcaagactgagaaggctatcaatgagttctttagaactgaaggggctgagaaacttcagaaggcctttgagattgcaaaacgtatccccatcattacctcagccaaaactctggagctcgccaaagtcacacaatttaagaccatggagtttgctcgttatattgaagaactggcaagaagtgtccctcttccacctcttattctaaactgtcgagcctttgttgaggagatgtttgaggctgtgcgagtggacgaccctgatgacctgggtgaaagaattaaagagagacctgccttgaatgctcaaggtggcatctatgtcattaacccagagatgggacggagtaattcaccaggaggagattcagatgatggctctctgaatgaacaaggccaggaaatagcagttcaggtttctgtccaccttcagtcagaaaccaaaagtattgatacagagtctcaaggcagcagtcatttcagtccacctgatgatataggatctgcagaatctaactgtaactacaaagatggggcatatgaaaactgtcagctgtaacctacaatgctgtaacccagtacctacaaaatcagctcgctctcagaaaaggaacctgtttcttagaagaagtaacatttttgccaaaagatgactggggttttccgtttgttaatattaagcacatcagaacgtgaattgccaaagtcttcattagaaggcagcatttttcctctctgatacttttcagtcattttccttagagctttattaaattatgcatgctaagatttaaaggagccccagataaacatgatggggaaaagcactgaactaagagtcccatggtttctcttctggtcacagttcttccattggttggatctgatacttatcttgggacttcagtttttccgtcaataagatgagggattaggtgagatctgaagttgtttctagctctatagcttcttaacccatcacctttaaattaccagaatcttcactcatctctaagtaaacctttcccgggacttttactcgcttcttttggaaaggattaagctgagatctaaatttccacaccaatgtcataatgcacagaggtttttgaaaaacatctgagtgtttttcagatgttttgccatgtggagcatataatgatatgtgcaagattgaatcttttcaatgtagcacatgtctgtagggttatacagatgtcagagagctaactgctctgtaaactactttccatgagtaaattggtccttggtgggggtgtatcatatttttaacttactgagatatcattttagttcattgaggttggcagggattgcctaactgatcttccaaagtgagcagtttatttctaaggtataacgtctttgatgcttttagaataagaacagtgtcaaatcatctgtcttctggaaaatcatggattttcatatttctgttaacagaatttctcaggctttccctttttaaaagtattggactctacaaataggttctatatttgggatctcatcctaggagaaaacccaaaactggattcctcttaagacctctgtcaaccctcctgccctttgtggtcttaggtatggtgctataggttgcatgcgtctttatcttgtttgtttggttaatattttgttgttgaggtttttatttttgtttacttcagatacataattctgagctatggctgcttttgtagcctttccaagaagcactaacctgaaataagattagataattgtgagggtgtgttactatattaaaatacacacacaactgatctagacatcaagaggaagaaaaatgatggatgatgccacctgcttcaactgtatataataaacacttatgatgaca

SEQ ID NO: 153738 - DNA, 1186 bp, Homo sapiens
  Payload ID: 10231
  Gene Symbol: MFAP3
  Gene Name: microfibrillar-associated protein 3
  Uniprot ID: P55082
  ENST ID: ENST00000439768
  CDS Start-End: 197-847
aaacttccgagttaagccgccgctgaggccggaaggagctagacggcggtcgggtggaaagtggttggtttctgataacttcctaaacatcaccaatgtagcttttgatgaccgtgggctctatacctgtttcgtcacctctccaattcgtgcctcctactctgtcaccctacgtgttatcttcacctcgggagacatgagtgtctattacatgattgtttgcctgattgcctttacaatcacactcatcttgaatgtcacacggctgtgcatgatgagcagccatcttcgcaagactgagaaggctatcaatgagttctttagaactgaaggggctgagaaacttcagaaggcctttgagattgcaaaacgtatccccatcattacctcagccaaaactctggagctcgccaaagtcacacaatttaagaccatggagtttgctcgttatattgaagaactggcaagaagtgtccctcttccacctcttattctaaactgtcgagcctttgttgaggagatgtttgaggctgtgcgagtggacgaccctgatgacctgggtgaaagaattaaagagagacctgccttgaatgctcaaggtggcatctatgtcattaacccagagatgggacggagtaattcaccaggaggagattcagatgatggctctctgaatgaacaaggccaggaaatagcagttcaggtttctgtccaccttcagtcagaaaccaaaagtattgatacagagtctcaaggcagcagtcatttcagtccacctgatgatataggatctgcagaatctaactgtaactacaaagatggggcatatgaaaactgtcagctgtaacctacaatgctgtaacccagtacctacaaaatcagctcgctctcagaaaaggaacctgtttcttagaagaagtaacatttttgccaaaagatgactggggttttccgtttgttaatattaagcacatcagaacgtgaattgccaaagtcttcattagaaggcagcatttttcctctctgatacttttcagtcattttccttagagctttattaaattatgcatgctaagatttaaaggagccccagataaacatgatggggaaaagcactgaactaagagtcccatggtttctcttctggtcacagttcttccattggttggatctgatacttatcttg

SEQ ID NO: 153739 - DNA, 520 bp, Homo sapiens
  Payload ID: 10231
  Gene Symbol: MFAP3
  Gene Name: microfibrillar-associated protein 3
  ENST ID: ENST00000520899
  CDS Start-End: 471-520
agacggcggtcgggtaggtgacggcttggttggggtcgctgcgaggggactactaggagcgccgaggcgtgagtcgtagcctgtggcttggggtcgggagtgcaggaggcgaaaatgtttgccattcttttgaaagtctggcctgggtgtgggagttcggtcatcgaacacttactgagagccagatacctgccaggcactgccctgggctccagggacacatcagtcaacgaacggaagggccctgctctcaagcagtgcgaaaagcagattataaacaagtcaacaaacgggattatctaaggttctctactcacatcttttaatcttgaagactagaaaatataactggatctaccacttgtttggaaaatttctctaccaagcaataaattacccgctgtgcttttgttgtagtgtagaagtttttgagttctccaaatctaaacaagattttgtcccattttcccatgaagctacattgttgcttattcactttagtggcaagtattattgtgcc

SEQ ID NO: 153740 - DNA, 567 bp, Homo sapiens
  Payload ID: 10231
  Gene Symbol: MFAP3
  Gene Name: microfibrillar-associated protein 3
  ENST ID: ENST00000522177
  CDS Start-End: 240-567
gagctagacggcggtcgggtaggtgacggcttggttggggtcgctgcgaggggactactaggagcgccgaggcgttctctactcacatcttttaatcttgaagactagaaaatataactggatctaccacttgtttggaaaatttctctaccaagcaataaattacccgctgtgcttttgttgtagtgtagaagtttttgagttctccaaatctaaacaagattttgtcccattttcccatgaagctacattgttgcttattcactttagtggcaagtattattgtgccagctgcttttgttttggaagatgtggacttcgaccaaatggtttcactggaagcaaatcgtagttcttacaatgcatcctttccctcaagctttgaactctcagcaagttcccactcggatgatgatgtcatcatagccaaagagggaactagcgtttcaattgagtgtcttctcacagccagtcactatgaagatgtccattggcacaattcaaaaggacagcaactggatggcagaagcagaggtggaaagtggttggtttctgataacttcctaa

SEQ ID NO: 153741 - DNA, 643 bp, Homo sapiens
  Payload ID: 10231
  Gene Symbol: MFAP3
  Gene Name: microfibrillar-associated protein 3
  ENST ID: ENST00000522782
  CDS Start-End: 273-643
ctactgccccggaagtgctccttcagcgcagaggcgtgccggtgtgtccgagaaaacttccgagttaagccgccgctgaggccggaaggagctagacggcggtcgggttctctactcacatcttttaatcttgaagactagaaaatataactggatctaccacttgtttggaaaatttctctaccaagcaataaattacccgctgtgcttttgttgtagtgtagaagtttttgagttctccaaatctaaacaagattttgtcccattttcccatgaagctacattgttgcttattcactttagtggcaagtattattgtgccagctgcttttgttttggaagatgtggacttcgaccaaatggtttcactggaagcaaatcgtagttcttacaatgcatcctttccctcaagctttgaactctcagcaagttcccactcggatgatgatgtcatcatagccaaagagggaactagcgtttcaattgagtgtcttctcacagccagtcactatgaagatgtccattggcacaattcaaaaggacagcaactggatggcagaagcagaggtggaaagtggttggtttctgataacttcctaaacatcaccaatgtagcttttgatgaccgtgggctctatacctg

SEQ ID NO: 153742 - DNA, 6318 bp, Homo sapiens
  Payload ID: 10232
  Gene Symbol: MFAP3L
  Gene Name: microfibrillar-associated protein 3-like
  Uniprot ID: O75121
  ENST ID: ENST00000361618
  CDS Start-End: 309-1538
ccgcgctcccggcagccggcggcgcagctcgcaacgctgtgaggcgccggcggaggcggctcgcccgcagtaggcgctaccgggcgtccggcgcagagtgcggcgcagcggccgctgtcgggctggccatggcgaggggtgcacggcggccacctgagtggcgcggcggtgtcaggttcttgctcaagtaccaactctatggacccaggacaggtttgtcccatgacctgctgtgaacagtgtgttgtctgatagaagattcggttggcaaaccatctctctattgccttacagagcaagcaaagaagatggatcgattgaagagccatctgactgtgtgctttctaccttctgtgccctttttaatcctagtatccactctagccaccgctaagagtgtgactaacagcactttaaatggcactaacgtggtcttgggctctgtgcccgtaatcattgccagaactgaccatatcatagtcaaggaagggaacagtgccttgattaactgtagtgtttatggcatccctgacccacagttcaagtggtataattccattggcaagctgctgaaagaagaagaggatgagaaggagagaggaggaggaaaatggcaaatgcacgacagcggcctcctgaacatcaccaaggtatccttctcagaccgaggtaaatacacgtgtgtggcttctaacatctacggcaccgtgaacaacacggtgaccttgcgcgtcatcttcacttctggagacatgggtgtctactacatggtcgtgtgcctggtggccttcaccatcgtcatggtcctcaatatcacccgcctgtgcatgatgagcagccatctaaagaagactgagaaggccatcaatgagttctttaggaccgaaggtgcagagaagctgcagaaggcatttgagatcgccaagcgcatccccatcatcacctccgccaaaactctagagcttgccaaagtcacccagttcaaaaccatggagttcgcccgctacatcgaagagcttgccaggagcgtgcctctgccgcctctcattatgaactgcaggactatcatggaggagattatggaggtggttgggctggaggagcaggggcagaattttgtgaggcatactccagagggccaggaggccgcagacagggatgaggtctacacaatccccaactctctgaagcggagcgactcccctgccgctgactcggacgcctcatcgctgcacgagcaacctcagcaaattgccatcaaggtgtcagttcacccgcagtccaaaaaagagcatgcagatgaccaagagggtggacagtttgaagtcaaagatgtagaggagacagaactgtcggcggaacattcccccgaaactgcagaaccttctaccgatgtcacgtccaccgagctaacatctgaagagccaacacctgttgaggtaccagataaggtactgccgccagcttacctggaagccacagagccagcagtgacacatgacaaaaacacctgcattatttacgaaagccatgtctaataccaaccccgaaaagctatgcatatcaagaaaatcaggggctgctccttgtaatacagatgtagtacgcacttgccgctaagccttaccaggagactctcatcccttaggtaggagtgatgccactttaaaaggagaaacacctgcctgcagtgaatgggactggaatttccccagtagagaagggtgcgagaaacatcagggtgcagaattgataccagacagaaggtgtctatgtgataatgagtttcagaggctgatctctgccaaataccttaattggtgatgccttcttggcaaagagtacaccactgtaagatattctgagttcaagaaccctgtccagtgccccctgcattgcttttccttttaaaaagtataggtctgctacaatagcaaatgcacgtacgtgggttttttgcagtttcttctcagttttaattttgcttttcctttataatggggtcattgttattaatactaattgttctttctggtttagtcctcattgccacttttgtccttatgtttccctagaacacgtacctcagagactttggtatcagtcaccagtaccagggctgatatctacaagtcacattacatttgtcatgttccaaagtagttacgaggcttgttatttttttttcattccccaggcctatttccatagatagctttttttgtttgtttccaacgaagctgctgttaaacgaaactgagaaaaactttgccccggaatagcactttaatagtcaaaaatgtgtttacctgtctgattgagtgagccttttggtgagctcagctgagatgtagagggagattgtaaaaggttaaatatacccacaccacccatgaaagtcactgtttaagttacatcatcctccaaataaagactgattctttacctggaaaatatattgcttccaaagacatcagattcagtggattcctgtaggttatagaatattggcttccaaacaggcttgcagggaccatatgctgttggatgacatataaccaggtccacttttatgaactgcatagctgacttggttgtccttaaagaggaaagcgaaaggttagggtaatagcaaagggaactgtgccatcagattttatgccaaaactgttgaataattatgcagtcctgcaagaaagtggttatatgtgaggtgcgtgatgttatggaaagaagacaaaattagtcatccaaaggcttaatacccactgtgccaataaccagctgcctggctttggacaagtctggacctcaggtcccttatctgtagaaggggcagatgacatgagctctgagcactgttgaaatggtatcactgtcacacagaaccaaaccaatattcacatccttgctccttttcacaatgactttaaagatttttgctttcatctcttggtccacctaacattttcatgcttcattacttaaataagaatgttggttttgagaaatagcattttaaacaaattgtggatcttctccttccaaaaaaaccattaggaccacatctgcaattaagatttaatattggtgagaatgagtggttttatttaattttcccttaaaagcaaaggagacagtaatcttaataaattcataggggccgtggccacatcaggtaatggggttatgatgtccaagattgcatggatcacattggtgatgagagcagacccagatgtttagtcctcactctgtcaccatctgaggaggtgaccttggacaactcccttcctctctctgggatttaatctttttcatctgtaaaatatgcaggtagtactcgagggtctacaggatcccttctagttgaaacatttatagttcacagaaagtttgcagtcttccaggataaccaacccccgttgcatgagacaagcaaaaaatgggtccatgaaattggatacttttgccatccaaactttacaacaaacattatctggctctgtaattgagagcagtgggcttggttttaaacctagccttgattagtttgtttatagataactgttgtggaaggtgatagaactagtcatggagtttgatgagacatctcttgaaaaggactgaactgttgacttctggttagaagtgctttgggcagtcacataaagaaatgagcagtgagaaatcaggagaaattatgactcctgttgggctttctggactagcattgtatgtttttgggttgcagaaaagttttaacaccacctcttagaatataaaaattttccagttgtcatggaggtccacagattcattaccatgggtttatatgcccaaagcaacaacagaggacttaagttcattttgtgatactgtatggatgttaccccatcctattcagttgtcattccacccaaacccatgtgtaggtttccacatggaaaggagaaggcatccattccacctagacattgaatagtgataataagctaaaagtgggcagattttcagtggagcaagagcagaaatatgcggccaaagaatgtttcctgattggttttgctgctttagactgcagtggggagagcttatgtagattttcaaaactttctccctctttaaggcatcataatgctctcggttttgataacaactgacataaagggaggttgacttaaaatgggaatttctccttccaaaaatgctacactcttcctatccatcctacagcttctttatgaaatgagaggccctcctgctagaatatgaaatgcagaagacctcatgactttcagctgatttttcaaagataaagtgaactgttcagcttcatagaaattcatgcgagtgtgactgaacgtgtgtgcatacacactcgtgcacattggactcatttgggcagttttaaaagcttcacactaaatccaaagcctcgtcctttgggtcgtatgtagtcgtttgtaaaatcaatttctggcttctgagtcatcctggtcatatctctagcaatgtttttcttgaaattctgaaaatgattcacatatgtgtgtacatttaattcacttagatgatctgtaaacttggatggtatttattctaaatggggaaaacaattttatatggaaaaatctatgtaatttataatggttttgttttatatattatattttcatatctctagggcacatctatcctcatctttttgtataccatacttagcaaaaagaaatactaatacttgactaaaatctctaggaaccaaacgtgatacatgtgatatatagcttctagaaatcgctctaaaaatctctgaatgtctcatccatcccaagcattattgtgctgtgtcattatgtccagaatgatttgtcttggatgcttatgagcatttgtttttcacaactaaggttgaaagacctgacatctcacacaatggggttctggaattcccctttcctcctttatctgtttttattgtttgtttcatttttaattgcaccagtctatgttgtcgaaactttgttttgaagggcaaatgtgagataacaagaaagcaatgtgatggaaagactggatgaatttacctatggctatgtaaattattttaatggactgataagatgtttcaagtctcatgcttggatctttatttattggtgatctaggatctgctcagctctttagcacatgaagaaaatcaggtacaaaggacatttgcatgtttggaacagcatgctctaagccccgtgcagccaacacaaattaacttgactgtagaaacaccaattccagctgctggaagaaatggtttagaaaggcaaaccagataccttttattctgccctaggaaatacagtgttgatcagtgctaaaactcttcagtggcagtcactgtggttcttttaactggggatttcctttcagtgtttcatttggtaccaaaacagaacatttaccttacatttcagatactctgttttctcagcattgttcagatactttcctttaccgctcttcacgtacccttttggcattgagtaattctataaatgtttctatccttggtttttaaaccaagttattcatactcttaaaatatctaccaaatctcattgtattttcacatattttgagcatcaagatactggtcattttaaaaaatccttcagtaaatagcacagtttattttcctaatgacatttttagggtttcttcattgatcaaccaggtttgggttacacaaatcaattgtgggggaaaaatcaaataaaacaattgcttattatattttccaaaggactgagcatttatcttttattcacgaagatatcatatgaggatgataatgatctttaacagattttttagagatagaatttataaagaggctgatactaagaatactacaatcaaaattgaagctagagaatgtaaaaatagaaagtaaatagttctaagaatattctggcataaattatttttatttagccaataaaatagcctccaaatgtatatctcagacaccatagagctgctaacaatgagaatcaaggaagatgcttgcacttagatttcgtttgttgtatttcagtagttctggatgtcctttgttaaaattggaaaatggaaaaatgtctcgacagaaatgtcaatctggtgattctgtgaactgtaaaatgttcacttttaaaaataaagttgtaaacaagttactcatataagttggtattacagtagcaaaaacagaaaaccatgtgatccatcctgtattttgattgatgctttaataaagggtttgcacagctgtgtgga

SEQ ID NO: 153743 - DNA, 1505 bp, Homo sapiens
  Payload ID: 10232
  Gene Symbol: MFAP3L
  Gene Name: microfibrillar-associated protein 3-like
  Uniprot ID: O75121
  ENST ID: ENST00000393702
  CDS Start-End: 619-927
gaggagaagaagccactaacattgcaggatcgtgtagcgaaacttctgtaggtacttaataattttagagtactctactttttaattaaaaaatcaacttatggttcattagaaaaaacgtggaaattacaaataatatttttaaagaaaatgaaaaaaaaattcctggaaccccaccactcagaaagtcaccagggaacggcccgctgggtttttttccagactcttccatctgtggactttgctttaagagacgtttaagacttacagcgcagtcgcccgggaaggcctgagaagctttcggaagcaaggtggtttgctcgtgattgcatttgattgcaaggagacaggagcccaagctgtgaccagtgacgcagactggaagtcccgtttactgggagagaagaggttaaggaacacccaggtgaacaattaggtcctccacaatgaagacaggtaatgtggaggaaagagagcttgtcatggttcttgctcaagtaccaactctatggacccaggacaggtttgtcccatgacctgctgtgaacagtgtgttgtctgatagaagattcggttggcaaaccatctctctattgccttacagagcaagcaaagaagatggatcgattgaagagccatctgactgtgtgctttctaccttctgtgccctttttaatcctagtatccactctagccaccgctaagagtgtgactaacagcactttaaatggcactaacgtggtcttgggctctgtgcccgtaatcattgccagaactgaccatatcatagtcaaggaagggaacagtgccttgattaactgtagtgtttatggcatccctgacccacagttcaagtggtataattccattggcaagctgctgaaagaagaagaggatgagaaggagagaggaggaggtaggctttaaagttgtatcaaatgtcataataaaatataaacaggagctttggagccagcacccgtgatgttagttcttctcatgcaaatgatttaaagatctcatcttgtcttgtttttctaaggcaggagagaatatatatccttaaggattcaaagaagcaattaattcatttttttccctcattgacacagaagacaaaggacaaacacagaagtctttttaaaggcttcttggaattttgtaatataatacatccaatacattatagagacaaatgtaaaatggattttcctaaataatatattcaatttttaagggagttttgttttctttcatggagatggctggaataaacaatatagccattgtttatcattaaatgtccatttaattcattggccgtggatttaaagaccacacttctgaaagaaacctcagtgcaagtctcagccactggctgggattcctggagacctggctgcagtttctaggctgaggcagggagggagggaggatgcaataacaaggaaggatgtgggacaacaggagactgcttggtttttaataaatgcatttctgaccaa

SEQ ID NO: 153744 - DNA, 5827 bp, Homo sapiens
  Payload ID: 10232
  Gene Symbol: MFAP3L
  Gene Name: microfibrillar-associated protein 3-like
  Uniprot ID: O75121
  ENST ID: ENST00000393704
  CDS Start-End: 126-1046
ttagcaggtctttctgcagggctgagctatcgctagggaacccacggtgactgaatcaaagggaagaaagacccaagacctggatctcccttttacatggaccctaaagcaaaggaaaatggcaaatgcacgacagcggcctcctgaacatcaccaaggtatccttctcagaccgaggtaaatacacgtgtgtggcttctaacatctacggcaccgtgaacaacacggtgaccttgcgcgtcatcttcacttctggagacatgggtgtctactacatggtcgtgtgcctggtggccttcaccatcgtcatggtcctcaatatcacccgcctgtgcatgatgagcagccatctaaagaagactgagaaggccatcaatgagttctttaggaccgaaggtgcagagaagctgcagaaggcatttgagatcgccaagcgcatccccatcatcacctccgccaaaactctagagcttgccaaagtcacccagttcaaaaccatggagttcgcccgctacatcgaagagcttgccaggagcgtgcctctgccgcctctcattatgaactgcaggactatcatggaggagattatggaggtggttgggctggaggagcaggggcagaattttgtgaggcatactccagagggccaggaggccgcagacagggatgaggtctacacaatccccaactctctgaagcggagcgactcccctgccgctgactcggacgcctcatcgctgcacgagcaacctcagcaaattgccatcaaggtgtcagttcacccgcagtccaaaaaagagcatgcagatgaccaagagggtggacagtttgaagtcaaagatgtagaggagacagaactgtcggcggaacattcccccgaaactgcagaaccttctaccgatgtcacgtccaccgagctaacatctgaagagccaacacctgttgaggtaccagataaggtactgccgccagcttacctggaagccacagagccagcagtgacacatgacaaaaacacctgcattatttacgaaagccatgtctaataccaaccccgaaaagctatgcatatcaagaaaatcaggggctgctccttgtaatacagatgtagtacgcacttgccgctaagccttaccaggagactctcatcccttaggtaggagtgatgccactttaaaaggagaaacacctgcctgcagtgaatgggactggaatttccccagtagagaagggtgcgagaaacatcagggtgcagaattgataccagacagaaggtgtctatgtgataatgagtttcagaggctgatctctgccaaataccttaattggtgatgccttcttggcaaagagtacaccactgtaagatattctgagttcaagaaccctgtccagtgccccctgcattgcttttccttttaaaaagtataggtctgctacaatagcaaatgcacgtacgtgggttttttgcagtttcttctcagttttaattttgcttttcctttataatggggtcattgttattaatactaattgttctttctggtttagtcctcattgccacttttgtccttatgtttccctagaacacgtacctcagagactttggtatcagtcaccagtaccagggctgatatctacaagtcacattacatttgtcatgttccaaagtagttacgaggcttgttatttttttttcattccccaggcctatttccatagatagctttttttgtttgtttccaacgaagctgctgttaaacgaaactgagaaaaactttgccccggaatagcactttaatagtcaaaaatgtgtttacctgtctgattgagtgagccttttggtgagctcagctgagatgtagagggagattgtaaaaggttaaatatacccacaccacccatgaaagtcactgtttaagttacatcatcctccaaataaagactgattctttacctggaaaatatattgcttccaaagacatcagattcagtggattcctgtaggttatagaatattggcttccaaacaggcttgcagggaccatatgctgttggatgacatataaccaggtccacttttatgaactgcatagctgacttggttgtccttaaagaggaaagcgaaaggttagggtaatagcaaagggaactgtgccatcagattttatgccaaaactgttgaataattatgcagtcctgcaagaaagtggttatatgtgaggtgcgtgatgttatggaaagaagacaaaattagtcatccaaaggcttaatacccactgtgccaataaccagctgcctggctttggacaagtctggacctcaggtcccttatctgtagaaggggcagatgacatgagctctgagcactgttgaaatggtatcactgtcacacagaaccaaaccaatattcacatccttgctccttttcacaatgactttaaagatttttgctttcatctcttggtccacctaacattttcatgcttcattacttaaataagaatgttggttttgagaaatagcattttaaacaaattgtggatcttctccttccaaaaaaaccattaggaccacatctgcaattaagatttaatattggtgagaatgagtggttttatttaattttcccttaaaagcaaaggagacagtaatcttaataaattcataggggccgtggccacatcaggtaatggggttatgatgtccaagattgcatggatcacattggtgatgagagcagacccagatgtttagtcctcactctgtcaccatctgaggaggtgaccttggacaactcccttcctctctctgggatttaatctttttcatctgtaaaatatgcaggtagtactcgagggtctacaggatcccttctagttgaaacatttatagttcacagaaagtttgcagtcttccaggataaccaacccccgttgcatgagacaagcaaaaaatgggtccatgaaattggatacttttgccatccaaactttacaacaaacattatctggctctgtaattgagagcagtgggcttggttttaaacctagccttgattagtttgtttatagataactgttgtggaaggtgatagaactagtcatggagtttgatgagacatctcttgaaaaggactgaactgttgacttctggttagaagtgctttgggcagtcacataaagaaatgagcagtgagaaatcaggagaaattatgactcctgttgggctttctggactagcattgtatgtttttgggttgcagaaaagttttaacaccacctcttagaatataaaaattttccagttgtcatggaggtccacagattcattaccatgggtttatatgcccaaagcaacaacagaggacttaagttcattttgtgatactgtatggatgttaccccatcctattcagttgtcattccacccaaacccatgtgtaggtttccacatggaaaggagaaggcatccattccacctagacattgaatagtgataataagctaaaagtgggcagattttcagtggagcaagagcagaaatatgcggccaaagaatgtttcctgattggttttgctgctttagactgcagtggggagagcttatgtagattttcaaaactttctccctctttaaggcatcataatgctctcggttttgataacaactgacataaagggaggttgacttaaaatgggaatttctccttccaaaaatgctacactcttcctatccatcctacagcttctttatgaaatgagaggccctcctgctagaatatgaaatgcagaagacctcatgactttcagctgatttttcaaagataaagtgaactgttcagcttcatagaaattcatgcgagtgtgactgaacgtgtgtgcatacacactcgtgcacattggactcatttgggcagttttaaaagcttcacactaaatccaaagcctcgtcctttgggtcgtatgtagtcgtttgtaaaatcaatttctggcttctgagtcatcctggtcatatctctagcaatgtttttcttgaaattctgaaaatgattcacatatgtgtgtacatttaattcacttagatgatctgtaaacttggatggtatttattctaaatggggaaaacaattttatatggaaaaatctatgtaatttataatggttttgttttatatattatattttcatatctctagggcacatctatcctcatctttttgtataccatacttagcaaaaagaaatactaatacttgactaaaatctctaggaaccaaacgtgatacatgtgatatatagcttctagaaatcgctctaaaaatctctgaatgtctcatccatcccaagcattattgtgctgtgtcattatgtccagaatgatttgtcttggatgcttatgagcatttgtttttcacaactaaggttgaaagacctgacatctcacacaatggggttctggaattcccctttcctcctttatctgtttttattgtttgtttcatttttaattgcaccagtctatgttgtcgaaactttgttttgaagggcaaatgtgagataacaagaaagcaatgtgatggaaagactggatgaatttacctatggctatgtaaattattttaatggactgataagatgtttcaagtctcatgcttggatctttatttattggtgatctaggatctgctcagctctttagcacatgaagaaaatcaggtacaaaggacatttgcatgtttggaacagcatgctctaagccccgtgcagccaacacaaattaacttgactgtagaaacaccaattccagctgctggaagaaatggtttagaaaggcaaaccagataccttttattctgccctaggaaatacagtgttgatcagtgctaaaactcttcagtggcagtcactgtggttcttttaactggggatttcctttcagtgtttcatttggtaccaaaacagaacatttaccttacatttcagatactctgttttctcagcattgttcagatactttcctttaccgctcttcacgtacccttttggcattgagtaattctataaatgtttctatccttggtttttaaaccaagttattcatactcttaaaatatctaccaaatctcattgtattttcacatattttgagcatcaagatactggtcattttaaaaaatccttcagtaaatagcacagtttattttcctaatgacatttttagggtttcttcattgatcaaccaggtttgggttacacaaatcaattgtgggggaaaaatcaaataaaacaattgcttattatattttccaaaggactgagcatttatcttttattcacgaagatatcatatgaggatgataatgatctttaacagattttttagagatagaatttataaagaggctgatactaagaatactacaatcaaaattgaagctagagaatgtaaaaatagaaagtaaatagttctaagaatattctggcataaattatttttatttagccaataaaatagcctccaaatgtatatctcagacaccatagagctgctaacaatgagaatcaaggaagatgcttgcacttagatttcgtttgttgtatttcagtagttctggatgtcctttgttaaaattggaaaatggaaaaatgtctcgacagaaatgtcaatctggtgattctgtgaactgtaaaatgttcacttttaaaaataaagttgtaaacaagttactcatataagttggtattacagtagcaaaaacagaaaaccatgtgatccatcctgtattttgattgatgctttaataaagggtttgcacagctgtgtggaa

SEQ ID NO: 153745 - DNA, 548 bp, Homo sapiens
  Payload ID: 10232
  Gene Symbol: MFAP3L
  Gene Name: microfibrillar-associated protein 3-like
  Uniprot ID: O75121
  ENST ID: ENST00000506110
  CDS Start-End: 204-512
agcctagaaaattacagtcgacttcatgagcttcatttggatttctcatcatgcaatagcaaagtcacagttattcctactgagatcacaatgatgctgccagagcctcccctgagcttgagagccctcctcttctaagcagcatttggaggttcttgctcaagtaccaactctatggacccaggacagagcaagcaaagaagatggatcgattgaagagccatctgactgtgtgctttctaccttctgtgccctttttaatcctagtatccactctagccaccgctaagagtgtgactaacagcactttaaatggcactaacgtggtcttgggctctgtgcccgtaatcattgccagaactgaccatatcatagtcaaggaagggaacagtgccttgattaactgtagtgtttatggcatccctgacccacagttcaagtggtataattccattggcaagctgctgaaagaagaagaggatgagaaggagagaggaggaggtaggctttaaagttgtatcaaatgtcataataaaatataaacagga

SEQ ID NO: 153746 - DNA, 564 bp, Homo sapiens
  Payload ID: 10232
  Gene Symbol: MFAP3L
  Gene Name: microfibrillar-associated protein 3-like
  ENST ID: ENST00000512698
  CDS Start-End: 95-564
gcagagtgcggcgcagcggccgctgtcgggctggccatggcgaggggtgcacggcggccacctgagtggcgcggcggtgtcaggaaaatggcaaatgcacgacagcggcctcctgaacatcaccaaggtatccttctcagaccgaggtaaatacacgtgtgtggcttctaacatctacggcaccgtgaacaacacggtgaccttgcgcgtcatcttcacttctggagacatgggtgtctactacatggtcgtgtgcctggtggccttcaccatcgtcatggtcctcaatatcacccgcctgtgcatgatgagcagccatctaaagaagactgagaaggccatcaatgagttctttaggaccgaaggtgcagagaagctgcagaaggcatttgagatcgccaagcgcatccccatcatcacctccgccaaaactctagagcttgccaaagtcacccagttcaaaaccatggagttcgcccgctacatcgaagagcttgccaggagcgtgcctctgccgcctctcattatgaactgcaggactatcatggaggagattatggaggt

SEQ ID NO: 153747 - DNA, 725 bp, Homo sapiens
  Payload ID: 10232
  Gene Symbol: MFAP3L
  Gene Name: microfibrillar-associated protein 3-like
  ENST ID: ENST00000510306
  CDS Start-End: 507-725
ccgtaatgtctggtgatgttccccagcctgtgggaggcagatgagattgaaaccagggtgtacatgagtgacctggagcccgtaagtaacagtaacacagagcagagagcgctagatgaggtggagctcagaggagcatgggaagttgaatgagacagtaaggagcattctggaagctataatgggtagttaggagaatgccagagtgattctgatgcagtccttccaaatgccggcagagcccaagctgtgaccagtgacgcagactggaagtcccgtttactgggagagaagaggttaaggaacacccaggtgaacaattaggtcctccacaatgaagacaggtaatgtggaggaaagagagcttgtcatggttcttgctcaagtaccaactctatggacccaggacaggtttgtcccatgacctgctgtgaacagtgtgttgtctgatagaagattcggttggcaaaccatctctctattgccttacagagcaagcaaagaagatggatcgattgaagagccatctgactgtgtgctttctaccttctgtgccctttttaatcctagtatccactctagccaccgctaagagtgtgactaacagcactttaaatggcactaacgtggtcttgggctctgtgcccgtaatcattgccagaactgaccatatcatagtcaaggaagggaacagtgccttgattaactgtagtgtttatggcatc

SEQ ID NO: 153748 - DNA, 550 bp, Homo sapiens
  Payload ID: 10232
  Gene Symbol: MFAP3L
  Gene Name: microfibrillar-associated protein 3-like
  ENST ID: ENST00000502832
  CDS Start-End: 360-550
atcgctagggaacccacggtgactgaatcaaagggaagaaagacccaagacctggatctcccttttacatggaccctaaagcaaaggtcctgtaggtgaaaaatgttgaagagcctctcactcagactgagtgaatatgagaagaactagatggaaaaggcatcctcactaccgatagcaaggtcagacagtgttaggatttgtgccggaacatgtgtgtgtacatggcatgcacatgcacaaaaaggcgttcaaaaatcatcggtgagtcactcaaggagcacactgccattcactttgtgattagcctggaaaggagcaatttcatgtctcgtttctgctgaaaaggaaaatggcaaatgcacgacagcggcctcctgaacatcaccaaggtatccttctcagaccgaggtaaatacacgtgtgtggcttctaacatctacggcaccgtgaacaacacggtgaccttgcgcgtcatcttcacttctggagacatgggtgtctactacatggtcgtgtgcctggtggccttcaccatcgtcatggtcct

SEQ ID NO: 153749 - DNA, 551 bp, Homo sapiens
  Payload ID: 10232
  Gene Symbol: MFAP3L
  Gene Name: microfibrillar-associated protein 3-like
  ENST ID: ENST00000507601
  CDS Start-End: 418-551
gctgtcgggctggccatggcgaggggtgcacggcggccacctgagtggcgcggcggtgtcaggttcttgctcaagtaccaactctatggacccaggacaggtttgtcccatgacctgctgtgaacagtgtgttgtctgatagaagattcggttggcaaaccatctctctattgccttacagagcaagcaaagaagatggatcgattgaagagccatctgactgtgtgctttctaccttctgtgccctttttaatcctaatgatgattgtttccagaggaatctagtaatggactgaaaacgaaagagacgttttggtatccttgtcttccattggaaacaggaaattgctggcagagagagctgtgatgatctcatttaactagatggttacagctcatgctataggaaaatggcaaatgcacgacagcggcctcctgaacatcaccaaggtatccttctcagaccgaggtaaatacacgtgtgtggcttctaacatctacggcaccgtgaacaacacggtgaccttgcgcgtcatcttcacttctggaga

SEQ ID NO: 153750 - DNA, 667 bp, Homo sapiens
  Payload ID: 10232
  Gene Symbol: MFAP3L
  Gene Name: microfibrillar-associated protein 3-like
  ENST ID: ENST00000504999
  CDS Start-End: 374-667
gtaggcgctaccgggcgtccggcgcagagtgcggcgcagcggccgctgtcgggctggccatggcgaggggtgcacggcggccacctgagtggcgcggcggtgtcagagcccaagctgtgaccagtgacgcagactggaagtcccgtttactgggagagaagaggttaaggaacacccaggtgaacaattaggtcctccacaatgaagacaggtaatgtggaggaaagagagcttgtcatggttcttgctcaagtaccaactctatggacccaggacaggtttgtcccatgacctgctgtgaacagtgtgttgtctgatagaagattcggttggcaaaccatctctctattgccttacagagcaagcaaagaagatggatcgattgaagagccatctgactgtgtgctttctaccttctgtgccctttttaatcctagtatccactctagccaccgctaagagtgtgactaacagcactttaaatggcactaacgtggtcttgggctctgtgcccgtaatcattgccagaactgaccatatcatagtcaaggaagggaacagtgccttgattaactgtagtgtttatggcatccctgacccacagttcaagtggtataattccattggcaagctgctgaaagaagaagaggatgagaaggagagagga

SEQ ID NO: 153751 - DNA, 481 bp, Homo sapiens
  Payload ID: 10232
  Gene Symbol: MFAP3L
  Gene Name: microfibrillar-associated protein 3-like
  ENST ID: ENST00000506764
  CDS Start-End: 212-481
aggctcctgtaggtgggaagctccgcgctcccggcagccggcggcgcagctcgcaacgctgtgaggcgccggcggaggcggctcgcccgcagtaggcgctaccgggcgtccggcgcagagtgcggcgcagcggccgctgtcgggctggccatggcgaggggtgcacggcggccacctgagtggcgcggcggtgtcagagcaagcaaagaagatggatcgattgaagagccatctgactgtgtgctttctaccttctgtgccctttttaatcctagtatccactctagccaccgctaagagtgtgactaacagcactttaaatggcactaacgtggtcttgggctctgtgcccgtaatcattgccagaactgaccatatcatagtcaaggaagggaacagtgccttgattaactgtagtgtttatggcatccctgacccacagttcaagtggtataattccattggcaagctgctgaaagaa

SEQ ID NO: 153752 - DNA, 1873 bp, Homo sapiens
  Payload ID: 10233
  Gene Symbol: MFAP4
  Gene Name: microfibrillar-associated protein 4
  Uniprot ID: P55083
  ENST ID: ENST00000299610
  CDS Start-End: 86-853
cggctggcgggggcccagcgcataactctgggcggttgcagtctggggccgcagacacccagccactctgagcagaactgacagcatgaaggcactcctggccctgccgctgctgctgcttctctccacgcccccgtgtgccccccaggtctccgggatccgaggagatgctctggagaggttttgccttcagcaacccctggactgtgacgacatctatgcccagggctaccagtcagacggcgtgtacctcatctacccctcgggccccagtgtgcctgtgcccgtcttctgtgacatgaccaccgagggcgggaagtggacggttttccagaagagattcaatggctcagtaagtttcttccgcggctggaatgactacaagctgggcttcggccgtgctgatggagagtactggctggggctgcagaacatgcacctcctgacactgaagcagaagtatgagctgcgagtggacttggaggactttgagaacaacacggcctatgccaagtacgctgacttctccatctccccgaacgcggtcagcgcagaggaggatggctacaccctctttgtggcaggctttgaggatggcggggcaggtgactccctgtcctaccacagtggccagaagttctctaccttcgaccgggaccaggacctctttgtgcagaactgcgcagctctctcctcaggagccttctggttccgcagctgccactttgccaacctcaatggcttctacctaggtggctcccacctctcttatgccaatggcatcaactgggcccagtggaagggcttctactactccctcaaacgcactgagatgaaaatccgccgggcctgaagggctggccccctcaggcacctttcctcccctggacacccatggtctccatgagtgctccctctgctgcccctgatgcatgcttctgctgattcccgagcaccaactccttacaagggggccttgtggctctcagccatgccacatccctgtcacacacccagggcatccattcctaagccagacccggctcccctacacctgaagttacactgccagcagttccccaggcctcttccgagaggcacatggttctagcctggacctggctgggctccatgagaatgagttgcctccaacctgtcccaacagctgacagccaggagccactctcccagctgcaggcctttgtggtccatcttgtcctgcttcctcactgtggacccctgtctgggccaccctagtgtgctaagctgagcagtgcagtgtgaacagggcccatggtgtattctaggccacagcccagcactcctctgggctgctctcaaaccatgtcccatcttcagcatccctcccaccaacttactcccctgtggtgagtaccgtggaaccccagcccacctcactatcatactcagcttcccctgatggcccatcccagcccctgaagctctatgccaagaacacagctaccgcacaccaccctgaaacagccacagccaaggtaggcatgcatatgaggtcttccccataccctctgggtgttgagaggtttagccacatgagggagcagaggacaatctctgcagggctgggagtgggtagggactgaaggtctcaataaaccttcagaacctgaatgaactggcttcatacacacaaacatatttgtttatcccccaaatgtaggcacctggctcctccttgctcccctgctgatggtgtcctaccccgaactccaaaaattacacctggagtcaggtgcagaagggaaccttgtatttcacaggcctcattttgatggcaaaaagacagtgtaataataacataataataataaaaatataatactgaaaagga

SEQ ID NO: 153753 - DNA, 1932 bp, Homo sapiens
  Payload ID: 10233
  Gene Symbol: MFAP4
  Gene Name: microfibrillar-associated protein 4
  Uniprot ID: P55083
  ENST ID: ENST00000395592
  CDS Start-End: 73-912
gcagacacccagccactctgagcagaactgacagcatgaaggtacggggcccagggtcgggggactcatagcatgggggaactgagcccactccagaggcccctggccacagagggcactatgaaggcacaaggagttctcttgaaactcgcactcctggccctgccgctgctgctgcttctctccacgcccccgtgtgccccccaggtctccgggatccgaggagatgctctggagaggttttgccttcagcaacccctggactgtgacgacatctatgcccagggctaccagtcagacggcgtgtacctcatctacccctcgggccccagtgtgcctgtgcccgtcttctgtgacatgaccaccgagggcgggaagtggacggttttccagaagagattcaatggctcagtaagtttcttccgcggctggaatgactacaagctgggcttcggccgtgctgatggagagtactggctggggctgcagaacatgcacctcctgacactgaagcagaagtatgagctgcgagtggacttggaggactttgagaacaacacggcctatgccaagtacgctgacttctccatctccccgaacgcggtcagcgcagaggaggatggctacaccctctttgtggcaggctttgaggatggcggggcaggtgactccctgtcctaccacagtggccagaagttctctaccttcgaccgggaccaggacctctttgtgcagaactgcgcagctctctcctcaggagccttctggttccgcagctgccactttgccaacctcaatggcttctacctaggtggctcccacctctcttatgccaatggcatcaactgggcccagtggaagggcttctactactccctcaaacgcactgagatgaaaatccgccgggcctgaagggctggccccctcaggcacctttcctcccctggacacccatggtctccatgagtgctccctctgctgcccctgatgcatgcttctgctgattcccgagcaccaactccttacaagggggccttgtggctctcagccatgccacatccctgtcacacacccagggcatccattcctaagccagacccggctcccctacacctgaagttacactgccagcagttccccaggcctcttccgagaggcacatggttctagcctggacctggctgggctccatgagaatgagttgcctccaacctgtcccaacagctgacagccaggagccactctcccagctgcaggcctttgtggtccatcttgtcctgcttcctcactgtggacccctgtctgggccaccctagtgtgctaagctgagcagtgcagtgtgaacagggcccatggtgtattctaggccacagcccagcactcctctgggctgctctcaaaccatgtcccatcttcagcatccctcccaccaacttactcccctgtggtgagtaccgtggaaccccagcccacctcactatcatactcagcttcccctgatggcccatcccagcccctgaagctctatgccaagaacacagctaccgcacaccaccctgaaacagccacagccaaggtaggcatgcatatgaggtcttccccataccctctgggtgttgagaggtttagccacatgagggagcagaggacaatctctgcagggctgggagtgggtagggactgaaggtctcaataaaccttcagaacctgaatgaactggcttcatacacacaaacatatttgtttatcccccaaatgtaggcacctggctcctccttgctcccctgctgatggtgtcctaccccgaactccaaaaattacacctggagtcaggtgcagaagggaaccttgtatttcacaggcctcattttgatggcaaaaagacagtgtaataataacataataataataaaaatataatactgaaaagga

SEQ ID NO: 153754 - DNA, 1876 bp, Homo sapiens
  Payload ID: 10233
  Gene Symbol: MFAP4
  Gene Name: microfibrillar-associated protein 4
  ENST ID: ENST00000497081
  CDS Start-End: 14-856
agtatgtgcatgcatggtgggggcaaatgcaaagagaacaggggatctctggagctgggaaggggctgtgctgaccctgtctgcccatcgccaggcactcctggccctgccgctgctgctgcttctctccacgcccccgtgtgccccccaggtctccgggatccgaggagatgctctggagaggttttgccttcagcaacccctggactgtgacgacatctatgcccagggctaccagtcagacggcgtgtacctcatctacccctcgggccccagtgtgcctgtgcccgtcttctgtgacatgaccaccgagggcgggaagtggacggttttccagaagagattcaatggctcagtaagtttcttccgcggctggaatgactacaagctgggcttcggccgtgctgatggagagtactggctggggctgcagaacatgcacctcctgacactgaagcagaagtatgagctgcgagtggacttggaggactttgagaacaacacggcctatgccaagtacgctgacttctccatctccccgaacgcggtcagcgcagaggaggatggctacaccctctttgtggcaggctttgaggatggcggggcaggtgactccctgtcctaccacagtggccagaagttctctaccttcgaccgggaccaggacctctttgtgcagaactgcgcagctctctcctcaggagccttctggttccgcagctgccactttgccaacctcaatggcttctacctaggtggctcccacctctcttatgccaatggcatcaactgggcccagtggaagggcttctactactccctcaaacgcactgagatgaaaatccgccgggcctgaagggctggccccctcaggcacctttcctcccctggacacccatggtctccatgagtgctccctctgctgcccctgatgcatgcttctgctgattcccgagcaccaactccttacaagggggccttgtggctctcagccatgccacatccctgtcacacacccagggcatccattcctaagccagacccggctcccctacacctgaagttacactgccagcagttccccaggcctcttccgagaggcacatggttctagcctggacctggctgggctccatgagaatgagttgcctccaacctgtcccaacagctgacagccaggagccactctcccagctgcaggcctttgtggtccatcttgtcctgcttcctcactgtggacccctgtctgggccaccctagtgtgctaagctgagcagtgcagtgtgaacagggcccatggtgtattctaggccacagcccagcactcctctgggctgctctcaaaccatgtcccatcttcagcatccctcccaccaacttactcccctgtggtgagtaccgtggaaccccagcccacctcactatcatactcagcttcccctgatggcccatcccagcccctgaagctctatgccaagaacacagctaccgcacaccaccctgaaacagccacagccaaggtaggcatgcatatgaggtcttccccataccctctgggtgttgagaggtttagccacatgagggagcagaggacaatctctgcagggctgggagtgggtagggactgaaggtctcaataaaccttcagaacctgaatgaactggcttcatacacacaaacatatttgtttatcccccaaatgtaggcacctggctcctccttgctcccctgctgatggtgtcctaccccgaactccaaaaattacacctggagtcaggtgcagaagggaaccttgtatttcacaggcctcattttgatggcaaaaagacagtgtaataataacataataataataaaaatataatactgaaaagga

SEQ ID NO: 153755 - DNA, 4814 bp, Homo sapiens
  Payload ID: 10234
  Gene Symbol: MITF
  Gene Name: microphthalmia-associated transcription factor
  Uniprot ID: O75030
  ENST ID: ENST00000352241
  CDS Start-End: 164-1726
gtaaactccccgcgctggggcgggcggccgcgagccggcgagcgggcagagctcggcactgcgccggggcgcacggctcgggggacccaggcccagctaccttccctccgcccccgggctctgttctcactttccagcagtggaaggacgggaagcgggagccatgcagtccgaatcggggatcgtgccggatttcgaagtcggggaggagtttcatgaagagcccaaaacctattacgaactcaaaagtcaaccgctgaagagcagcagttccgccgagcatcctggggcctccaagcctccgataagctcctccagtatgacatcacgcatcttgctacgccagcaactcatgcgtgagcagatgcaggagcaggagcgcagggagcagcagcagaagctgcaggcggcccagttcatgcaacagagagtgcccgtgagtcagacaccagccataaacgtcagtgtgcccaccacccttccctctgccacgcaggtgccgatggaagtccttaaggtgcagacccacctcgaaaaccccaccaagtaccacatacagcaagcccaacggcagcaggtaaagcagtacctttctaccactttagcaaataaacatgccaaccaagtcctgagcttgccatgtccaaaccagcctggcgatcatgtcatgccaccggtgccggggagcagcgcacccaacagccccatggctatgcttacgcttaactccaactgtgaaaaagagggattttataagtttgaagagcaaaacagggcagagagcgagtgcccaggcatgaacacacattcacgagcgtcctgtatgcagatggatgatgtaatcgatgacatcattagcctagaatcaagttataatgaggaaatcttgggcttgatggatcctgctttgcaaatggcaaatacgttgcctgtctcgggaaacttgattgatctttatggaaaccaaggtctgcccccaccaggcctcaccatcagcaactcctgtccagccaaccttcccaacataaaaagggagctcacagagtctgaagcaagagcactggccaaagagaggcagaaaaaggacaatcacaacctgattgaacgaagaagaagatttaacataaatgaccgcattaaagaactaggtactttgattcccaagtcaaatgatccagacatgcgctggaacaagggaaccatcttaaaagcatccgtggactatatccgaaagttgcaacgagaacagcaacgcgcaaaagaacttgaaaaccgacagaagaaactggagcacgccaaccggcatttgttgctcagaatacaggaacttgaaatgcaggctcgagctcatggactttcccttattccatccacgggtctctgctctccagatttggtgaatcggatcatcaagcaagaacccgttcttgagaactgcagccaagacctccttcagcatcatgcagacctaacctgtacaacaactctcgatctcacggatggcaccatcaccttcaacaacaacctcggaactgggactgaggccaaccaagcctatagtgtccccacaaaaatgggatccaaactggaagacatcctgatggacgacaccctttctcccgtcggtgtcactgatccactcctttcctcagtgtcccccggagcttccaaaacaagcagccggaggagcagtatgagcatggaagagacggagcacacttgttagcgaatcctccctgcactgcattcgcacaaactgcttcctttcttgattcgtagatttaataacttacctgaaggggttttcttgataattttcctttaatatgaaattttttttcatgctttatcaatagcccaggatatattttatttttagaattttgtgaaacagacttgtatattctattttacaactacaaatgcctccaaagtattgtacaaataagtgtgcagtatctgtgaactgaattcaccacagactttagctttctgagcaagaggattttgcgtcagagaaatgtctgtccatttttattcaggggaaacttgatttgagatttttatgcctgtgacttccttggaaatcaaatgtaaagtttaattgaaagaatgtaaagcaaccaaaaagaaaaaaaaaaagaaagaaagaggaaaagaaatccatactaacccttttccattttataaatgtattgattcattggtactgccttaaagatacagtacccctctagctttgtttagtctttatactgcaaactatttaaagaaatatgtattctgtaaaagaaaaaaaaaatgcggccttttcatgaggatcgtctggttagaaaacataactgataccaaccgaaactgaagggagttagaccaaggctctgaaatataaagtctaatcttgctctcttttattctgtgctgttacagttttcttcatcaatgagtgtgatccagtttttcataagatattttattttgaaatggaaattaatgtcctctcaaagtaaaatattgaggagcactgaaagtatgttttactttttttttattttatttttgcttttgataagaaaaccgaactgggcatatttctaattggctttactatttttatttttaaattatgttttactgttcatttgatttgtacagattctttattatcattgttcttttcaatatatttgtattaatttgtaagaatatgcatcttaaaatggcaagttttccatatttttacaactcactggtggttttccgcattctttgtacacccatgaaagaaaacttttatgcaaggtcttgcatttaaaagacagctttgcgaatattttgtaaattacagtctcactcagaactgtttttggacacatttaaggtgtagtattaataggttaaaaccaggctttctagaaagaataaacttacatatttatttttaggacatgaaaatagcaatattcttggagattgataaccatagcattaatacgcccattatggtcatttaaattggggtttatttcagcaaacttgttgaatttatttttaagaaagaaatactgtattgggaagttactgttacttgataacaatgttttaacaagaagcaatgttataaagttagtttcagtgcattatctacttgtgtagtcctatgcaataacagtagtgttacatgtatcaagcctagatgttttatacagatgccatatagtgttatgagccaggctgttgaatggaatttctcagtagcagcctacaactgaatagcaagtggcataaagcatatccattcagaatgaagtgccttaaatatagcagtagtcttttttggactagcactgactgaactgtaatgtaggggaaagtttcatgatggtatctatagtcaagacgaacatgtagcatggtgcctatgtagacaatataagagcttccaattttccttcagatatttttaatattaaatatattttagtgacagagtgccaacttctttcatcaggaaaccttattcaggagggtttttaaaaagtgtttaaatgtcaaatgtgaattggtgatgggtgatggagggttcagagaggagtgatcgtcagatgtgtgaatggacggtttaggtgaaaataatcaactgcatagttcccatgcacgctgggcaatgagaatccttggaaacattggtgatgctatcagttttatagctttatttcttaagggggtagggaaaattagttcccattctttcaacccccttaactgtatagctcttttcctagaatagtgacgcaaatctgcatgaacagctaattgtaccatagtgttcattgatacaatcatagcattgtctatttttctcttcatatttatatgggggggagggcgctggatgcaaaagttgaagatcgtgatgctatgatgttagttttccttagctgattttgagggtttttaaaaataaagcaaggttgactaacctacggccacgggaacaggaccatggttaagcaaccatatagaaagctttgttgaaagaaagtatggcatcttgtaccactgccctgactgtcacaactcctaaccttgccattgcctgcctccccctccccttctccttaagagacaatttctgcaggtggcaggtgagcaagcccaggagaatgctgcaatcttgggggtggttttatttatttcttttttgccaaatagagtgtggattcatttcaggggctagctaagccaagaggcagtggtttgggcttgttgtttgtaacaagaaaatgatccacaccactcccccgattcccgggtgcagaattgtaactcggggttgggcctctatatggagtgaccaaaatgccaaaattgtccatctgcctctgagtagggcaatggaaataccaaaccttctgactttgccaaaaagcatacaagcaacctggtcatacataggatgacaaaattctttctggttgtttttaaacaataaagcaataagaacaaatacaatacataggaagttaaaagcacaaaggaatgaacttattaatatttttgaaaaatgcactgggaaaaagttgatgtcaataacagtataaaacagccctatttcttgataaaaaatgacaaatgactgtctcttgcggatgcttggtactgtaatgttaataatagtcacctgctgttggatgcagcaataatttctgtatggtccatagcactgtatattatggatcgatattaatgtatccaatgaaataatcgacttgttcttgatagcctcattaaagcatttggtttttcacata

SEQ ID NO: 153756 - DNA, 1798 bp, Homo sapiens
  Payload ID: 10234
  Gene Symbol: MITF
  Gene Name: microphthalmia-associated transcription factor
  Uniprot ID: O75030
  ENST ID: ENST00000314557
  CDS Start-End: 137-1378
tttccggtggtgtctcgggataccttgtttatagtaccttctctttgccagtccatcttcaaattggaattatagaaagtagagggagggatagtctaccgtctctcactggattggtgccacctaaaacattgttatgctggaaatgctagaatataatcactatcaggtgcagacccacctcgaaaaccccaccaagtaccacatacagcaagcccaacggcagcaggtaaagcagtacctttctaccactttagcaaataaacatgccaaccaagtcctgagcttgccatgtccaaaccagcctggcgatcatgtcatgccaccggtgccggggagcagcgcacccaacagccccatggctatgcttacgcttaactccaactgtgaaaaagagggattttataagtttgaagagcaaaacagggcagagagcgagtgcccaggcatgaacacacattcacgagcgtcctgtatgcagatggatgatgtaatcgatgacatcattagcctagaatcaagttataatgaggaaatcttgggcttgatggatcctgctttgcaaatggcaaatacgttgcctgtctcgggaaacttgattgatctttatggaaaccaaggtctgcccccaccaggcctcaccatcagcaactcctgtccagccaaccttcccaacataaaaagggagctcacagagtctgaagcaagagcactggccaaagagaggcagaaaaaggacaatcacaacctgattgaacgaagaagaagatttaacataaatgaccgcattaaagaactaggtactttgattcccaagtcaaatgatccagacatgcgctggaacaagggaaccatcttaaaagcatccgtggactatatccgaaagttgcaacgagaacagcaacgcgcaaaagaacttgaaaaccgacagaagaaactggagcacgccaaccggcatttgttgctcagaatacaggaacttgaaatgcaggctcgagctcatggactttcccttattccatccacgggtctctgctctccagatttggtgaatcggatcatcaagcaagaacccgttcttgagaactgcagccaagacctccttcagcatcatgcagacctaacctgtacaacaactctcgatctcacggatggcaccatcaccttcaacaacaacctcggaactgggactgaggccaaccaagcctatagtgtccccacaaaaatgggatccaaactggaagacatcctgatggacgacaccctttctcccgtcggtgtcactgatccactcctttcctcagtgtcccccggagcttccaaaacaagcagccggaggagcagtatgagcatggaagagacggagcacacttgttagcgaatcctccctgcactgcattcgcacaaactgcttcctttcttgattcgtagatttaataacttacctgaaggggttttcttgataattttcctttaatatgaaattttttttcatgctttatcaatagcccaggatatattttatttttagaattttgtgaaacagacttgtatattctattttacaactacaaatgcctccaaagtattgtacaaataagtgtgcagtatctgtgaactgaattcaccacagactttagctttctgagcaagaggattttgcgtcagagaaatgtctgtccatttttattcaggggaaacttgatttgagatttttatgcctgtgacttccttggaaatcaaatgtaaagtttaattgaaagaatgtaaagcaaccaaaaagaaaaaaaaaaagaaa

SEQ ID NO: 153757 - DNA, 1993 bp, Homo sapiens
  Payload ID: 10234
  Gene Symbol: MITF
  Gene Name: microphthalmia-associated transcription factor
  Uniprot ID: O75030
  ENST ID: ENST00000314589
  CDS Start-End: 80-1594
agtgacacagccagtgccagaactaactttgactttcactcttcgccaagggcttgcagaacaccttaaaggaaaaaagatggaggcgcttagagttcagatgttcatgccatgctcctttgaaagcttgtatctcagttccgccgagcatcctggggcctccaagcctccgataagctcctccagtatgacatcacgcatcttgctacgccagcaactcatgcgtgagcagatgcaggagcaggagcgcagggagcagcagcagaagctgcaggcggcccagttcatgcaacagagagtgcccgtgagtcagacaccagccataaacgtcagtgtgcccaccacccttccctctgccacgcaggtgccgatggaagtccttaaggtgcagacccacctcgaaaaccccaccaagtaccacatacagcaagcccaacggcagcaggtaaagcagtacctttctaccactttagcaaataaacatgccaaccaagtcctgagcttgccatgtccaaaccagcctggcgatcatgtcatgccaccggtgccggggagcagcgcacccaacagccccatggctatgcttacgcttaactccaactgtgaaaaagagggattttataagtttgaagagcaaaacagggcagagagcgagtgcccaggcatgaacacacattcacgagcgtcctgtatgcagatggatgatgtaatcgatgacatcattagcctagaatcaagttataatgaggaaatcttgggcttgatggatcctgctttgcaaatggcaaatacgttgcctgtctcgggaaacttgattgatctttatggaaaccaaggtctgcccccaccaggcctcaccatcagcaactcctgtccagccaaccttcccaacataaaaagggagctcacagagtctgaagcaagagcactggccaaagagaggcagaaaaaggacaatcacaacctgattgaacgaagaagaagatttaacataaatgaccgcattaaagaactaggtactttgattcccaagtcaaatgatccagacatgcgctggaacaagggaaccatcttaaaagcatccgtggactatatccgaaagttgcaacgagaacagcaacgcgcaaaagaacttgaaaaccgacagaagaaactggagcacgccaaccggcatttgttgctcagaatacaggaacttgaaatgcaggctcgagctcatggactttcccttattccatccacgggtctctgctctccagatttggtgaatcggatcatcaagcaagaacccgttcttgagaactgcagccaagacctccttcagcatcatgcagacctaacctgtacaacaactctcgatctcacggatggcaccatcaccttcaacaacaacctcggaactgggactgaggccaaccaagcctatagtgtccccacaaaaatgggatccaaactggaagacatcctgatggacgacaccctttctcccgtcggtgtcactgatccactcctttcctcagtgtcccccggagcttccaaaacaagcagccggaggagcagtatgagcatggaagagacggagcacacttgttagcgaatcctccctgcactgcattcgcacaaactgcttcctttcttgattcgtagatttaataacttacctgaaggggttttcttgataattttcctttaatatgaaattttttttcatgctttatcaatagcccaggatatattttatttttagaattttgtgaaacagacttgtatattctattttacaactacaaatgcctccaaagtattgtacaaataagtgtgcagtatctgtgaactgaattcaccacagactttagctttctgagcaagaggattttgcgtcagagaaatgtctgtccatttttattcaggggaaacttgatttgagatttttatgcctgtgacttccttggaaatcaaatgtaaagtttaattgaaagaatgtaaagcaacc

SEQ ID NO: 153758 - DNA, 4680 bp, Homo sapiens
  Payload ID: 10234
  Gene Symbol: MITF
  Gene Name: microphthalmia-associated transcription factor
  Uniprot ID: O75030
  ENST ID: ENST00000328528
  CDS Start-End: 32-1591
cagacctattccgctccatctctgaagtcaaatgggacaccttgaaaatacttcagtggttttcccacgagctattttctctctctgtgaaaaggaaaccaggaaattgactctgtgcctgttttcaagaagcagttccgccgagcatcctggggcctccaagcctccgataagctcctccagtatgacatcacgcatcttgctacgccagcaactcatgcgtgagcagatgcaggagcaggagcgcagggagcagcagcagaagctgcaggcggcccagttcatgcaacagagagtgcccgtgagtcagacaccagccataaacgtcagtgtgcccaccacccttccctctgccacgcaggtgccgatggaagtccttaaggtgcagacccacctcgaaaaccccaccaagtaccacatacagcaagcccaacggcagcaggtaaagcagtacctttctaccactttagcaaataaacatgccaaccaagtcctgagcttgccatgtccaaaccagcctggcgatcatgtcatgccaccggtgccggggagcagcgcacccaacagccccatggctatgcttacgcttaactccaactgtgaaaaagagggattttataagtttgaagagcaaaacagggcagagagcgagtgcccaggcatgaacacacattcacgagcgtcctgtatgcagatggatgatgtaatcgatgacatcattagcctagaatcaagttataatgaggaaatcttgggcttgatggatcctgctttgcaaatggcaaatacgttgcctgtctcgggaaacttgattgatctttatggaaaccaaggtctgcccccaccaggcctcaccatcagcaactcctgtccagccaaccttcccaacataaaaagggagctcacagagtctgaagcaagagcactggccaaagagaggcagaaaaaggacaatcacaacctgattgaacgaagaagaagatttaacataaatgaccgcattaaagaactaggtactttgattcccaagtcaaatgatccagacatgcgctggaacaagggaaccatcttaaaagcatccgtggactatatccgaaagttgcaacgagaacagcaacgcgcaaaagaacttgaaaaccgacagaagaaactggagcacgccaaccggcatttgttgctcagaatacaggaacttgaaatgcaggctcgagctcatggactttcccttattccatccacgggtctctgctctccagatttggtgaatcggatcatcaagcaagaacccgttcttgagaactgcagccaagacctccttcagcatcatgcagacctaacctgtacaacaactctcgatctcacggatggcaccatcaccttcaacaacaacctcggaactgggactgaggccaaccaagcctatagtgtccccacaaaaatgggatccaaactggaagacatcctgatggacgacaccctttctcccgtcggtgtcactgatccactcctttcctcagtgtcccccggagcttccaaaacaagcagccggaggagcagtatgagcatggaagagacggagcacacttgttagcgaatcctccctgcactgcattcgcacaaactgcttcctttcttgattcgtagatttaataacttacctgaaggggttttcttgataattttcctttaatatgaaattttttttcatgctttatcaatagcccaggatatattttatttttagaattttgtgaaacagacttgtatattctattttacaactacaaatgcctccaaagtattgtacaaataagtgtgcagtatctgtgaactgaattcaccacagactttagctttctgagcaagaggattttgcgtcagagaaatgtctgtccatttttattcaggggaaacttgatttgagatttttatgcctgtgacttccttggaaatcaaatgtaaagtttaattgaaagaatgtaaagcaaccaaaaagaaaaaaaaaaagaaagaaagaggaaaagaaatccatactaacccttttccattttataaatgtattgattcattggtactgccttaaagatacagtacccctctagctttgtttagtctttatactgcaaactatttaaagaaatatgtattctgtaaaagaaaaaaaaaatgcggccttttcatgaggatcgtctggttagaaaacataactgataccaaccgaaactgaagggagttagaccaaggctctgaaatataaagtctaatcttgctctcttttattctgtgctgttacagttttcttcatcaatgagtgtgatccagtttttcataagatattttattttgaaatggaaattaatgtcctctcaaagtaaaatattgaggagcactgaaagtatgttttactttttttttattttatttttgcttttgataagaaaaccgaactgggcatatttctaattggctttactatttttatttttaaattatgttttactgttcatttgatttgtacagattctttattatcattgttcttttcaatatatttgtattaatttgtaagaatatgcatcttaaaatggcaagttttccatatttttacaactcactggtggttttccgcattctttgtacacccatgaaagaaaacttttatgcaaggtcttgcatttaaaagacagctttgcgaatattttgtaaattacagtctcactcagaactgtttttggacacatttaaggtgtagtattaataggttaaaaccaggctttctagaaagaataaacttacatatttatttttaggacatgaaaatagcaatattcttggagattgataaccatagcattaatacgcccattatggtcatttaaattggggtttatttcagcaaacttgttgaatttatttttaagaaagaaatactgtattgggaagttactgttacttgataacaatgttttaacaagaagcaatgttataaagttagtttcagtgcattatctacttgtgtagtcctatgcaataacagtagtgttacatgtatcaagcctagatgttttatacagatgccatatagtgttatgagccaggctgttgaatggaatttctcagtagcagcctacaactgaatagcaagtggcataaagcatatccattcagaatgaagtgccttaaatatagcagtagtcttttttggactagcactgactgaactgtaatgtaggggaaagtttcatgatggtatctatagtcaagacgaacatgtagcatggtgcctatgtagacaatataagagcttccaattttccttcagatatttttaatattaaatatattttagtgacagagtgccaacttctttcatcaggaaaccttattcaggagggtttttaaaaagtgtttaaatgtcaaatgtgaattggtgatgggtgatggagggttcagagaggagtgatcgtcagatgtgtgaatggacggtttaggtgaaaataatcaactgcatagttcccatgcacgctgggcaatgagaatccttggaaacattggtgatgctatcagttttatagctttatttcttaagggggtagggaaaattagttcccattctttcaacccccttaactgtatagctcttttcctagaatagtgacgcaaatctgcatgaacagctaattgtaccatagtgttcattgatacaatcatagcattgtctatttttctcttcatatttatatgggggggagggcgctggatgcaaaagttgaagatcgtgatgctatgatgttagttttccttagctgattttgagggtttttaaaaataaagcaaggttgactaacctacggccacgggaacaggaccatggttaagcaaccatatagaaagctttgttgaaagaaagtatggcatcttgtaccactgccctgactgtcacaactcctaaccttgccattgcctgcctccccctccccttctccttaagagacaatttctgcaggtggcaggtgagcaagcccaggagaatgctgcaatcttgggggtggttttatttatttcttttttgccaaatagagtgtggattcatttcaggggctagctaagccaagaggcagtggtttgggcttgttgtttgtaacaagaaaatgatccacaccactcccccgattcccgggtgcagaattgtaactcggggttgggcctctatatggagtgaccaaaatgccaaaattgtccatctgcctctgagtagggcaatggaaataccaaaccttctgactttgccaaaaagcatacaagcaacctggtcatacataggatgacaaaattctttctggttgtttttaaacaataaagcaataagaacaaatacaatacataggaagttaaaagcacaaaggaatgaacttattaatatttttgaaaaatgcactgggaaaaagttgatgtcaataacagtataaaacagccctatttcttgataaaaaatgacaaatgactgtctcttgcggatgcttggtactgtaatgttaataatagtcacctgctgttggatgcagcaataatttctgtatggtccatagcactgtatattatggatcgatattaatgtatccaatgaaataatcgacttgttcttgatagcctcattaaagcatttggtttttcacatag

SEQ ID NO: 153759 - DNA, 1956 bp, Homo sapiens
  Payload ID: 10234
  Gene Symbol: MITF
  Gene Name: microphthalmia-associated transcription factor
  Uniprot ID: O75030
  ENST ID: ENST00000394351
  CDS Start-End: 121-1380
gggataccttgtttatagtaccttctctttgccagtccatcttcaaattggaattatagaaagtagagggagggatagtctaccgtctctcactggattggtgccacctaaaacattgttatgctggaaatgctagaatataatcactatcaggtgcagacccacctcgaaaaccccaccaagtaccacatacagcaagcccaacggcagcaggtaaagcagtacctttctaccactttagcaaataaacatgccaaccaagtcctgagcttgccatgtccaaaccagcctggcgatcatgtcatgccaccggtgccggggagcagcgcacccaacagccccatggctatgcttacgcttaactccaactgtgaaaaagagggattttataagtttgaagagcaaaacagggcagagagcgagtgcccaggcatgaacacacattcacgagcgtcctgtatgcagatggatgatgtaatcgatgacatcattagcctagaatcaagttataatgaggaaatcttgggcttgatggatcctgctttgcaaatggcaaatacgttgcctgtctcgggaaacttgattgatctttatggaaaccaaggtctgcccccaccaggcctcaccatcagcaactcctgtccagccaaccttcccaacataaaaagggagctcacagcgtgtatttttcccacagagtctgaagcaagagcactggccaaagagaggcagaaaaaggacaatcacaacctgattgaacgaagaagaagatttaacataaatgaccgcattaaagaactaggtactttgattcccaagtcaaatgatccagacatgcgctggaacaagggaaccatcttaaaagcatccgtggactatatccgaaagttgcaacgagaacagcaacgcgcaaaagaacttgaaaaccgacagaagaaactggagcacgccaaccggcatttgttgctcagaatacaggaacttgaaatgcaggctcgagctcatggactttcccttattccatccacgggtctctgctctccagatttggtgaatcggatcatcaagcaagaacccgttcttgagaactgcagccaagacctccttcagcatcatgcagacctaacctgtacaacaactctcgatctcacggatggcaccatcaccttcaacaacaacctcggaactgggactgaggccaaccaagcctatagtgtccccacaaaaatgggatccaaactggaagacatcctgatggacgacaccctttctcccgtcggtgtcactgatccactcctttcctcagtgtcccccggagcttccaaaacaagcagccggaggagcagtatgagcatggaagagacggagcacacttgttagcgaatcctccctgcactgcattcgcacaaactgcttcctttcttgattcgtagatttaataacttacctgaaggggttttcttgataattttcctttaatatgaaattttttttcatgctttatcaatagcccaggatatattttatttttagaattttgtgaaacagacttgtatattctattttacaactacaaatgcctccaaagtattgtacaaataagtgtgcagtatctgtgaactgaattcaccacagactttagctttctgagcaagaggattttgcgtcagagaaatgtctgtccatttttattcaggggaaacttgatttgagatttttatgcctgtgacttccttggaaatcaaatgtaaagtttaattgaaagaatgtaaagcaaccaaaaagaaaaaaaaaaagaaagaaagaggaaaagaaatccatactaacccttttccattttataaatgtattgattcattggtactgccttaaagatacagtacccctctagctttgtttagtctttatactgcaaactatttaaagaaatatgtattctgtaaaagaaaaaaaaaa

SEQ ID NO: 153760 - DNA, 382 bp, Homo sapiens
  Payload ID: 10234
  Gene Symbol: MITF
  Gene Name: microphthalmia-associated transcription factor
  ENST ID: ENST00000457080
  CDS Start-End: 32-382
cagacctattccgctccatctctgaagtcaaatgggacaccttgaaaatacttcagtggttttcccacgagctattttctctctctgtgaaaaggaaaccaggaaattgactctgtgcctgttttcaagaagcagttccgccgagcatcctggggcctccaagcctccgataagctcctccagtatgacatcacgcatcttgctacgccagcaactcatgcgtgagcagatgcaggagcaggagcgcagggagcagcagcagaagctgcaggcggcccagttcatgcaacagagagtgcccgtgagtcagacaccagccataaacgtcagtgtgcccaccacccttccctctgccacgcaggtgccgatggaagtccttaag

SEQ ID NO: 153761 - DNA, 2489 bp, Homo sapiens
  Payload ID: 10234
  Gene Symbol: MITF
  Gene Name: microphthalmia-associated transcription factor
  Uniprot ID: O75030
  ENST ID: ENST00000448226
  CDS Start-End: 128-1708
ggcgagcgggcagagctcggcactgcgccggggcgcacggctcgggggacccaggcccagctaccttccctccgcccccgggctctgttctcactttccagcagtggaaggacgggaagcgggagccatgcagtccgaatcggggatcgtgccggatttcgaagtcggggaggagtttcatgaagagcccaaaacctattacgaactcaaaagtcaaccgctgaagagcagcagttccgccgagcatcctggggcctccaagcctccgataagctcctccagtatgacatcacgcatcttgctacgccagcaactcatgcgtgagcagatgcaggagcaggagcgcagggagcagcagcagaagctgcaggcggcccagttcatgcaacagagagtgcccgtgagtcagacaccagccataaacgtcagtgtgcccaccacccttccctctgccacgcaggtgccgatggaagtccttaaggtgcagacccacctcgaaaaccccaccaagtaccacatacagcaagcccaacggcagcaggtaaagcagtacctttctaccactttagcaaataaacatgccaaccaagtcctgagcttgccatgtccaaaccagcctggcgatcatgtcatgccaccggtgccggggagcagcgcacccaacagccccatggctatgcttacgcttaactccaactgtgaaaaagagggattttataagtttgaagagcaaaacagggcagagagcgagtgcccaggcatgaacacacattcacgagcgtcctgtatgcagatggatgatgtaatcgatgacatcattagcctagaatcaagttataatgaggaaatcttgggcttgatggatcctgctttgcaaatggcaaatacgttgcctgtctcgggaaacttgattgatctttatggaaaccaaggtctgcccccaccaggcctcaccatcagcaactcctgtccagccaaccttcccaacataaaaagggagctcacagcgtgtatttttcccacagagtctgaagcaagagcactggccaaagagaggcagaaaaaggacaatcacaacctgattgaacgaagaagaagatttaacataaatgaccgcattaaagaactaggtactttgattcccaagtcaaatgatccagacatgcgctggaacaagggaaccatcttaaaagcatccgtggactatatccgaaagttgcaacgagaacagcaacgcgcaaaagaacttgaaaaccgacagaagaaactggagcacgccaaccggcatttgttgctcagaatacaggaacttgaaatgcaggctcgagctcatggactttcccttattccatccacgggtctctgctctccagatttggtgaatcggatcatcaagcaagaacccgttcttgagaactgcagccaagacctccttcagcatcatgcagacctaacctgtacaacaactctcgatctcacggatggcaccatcaccttcaacaacaacctcggaactgggactgaggccaaccaagcctatagtgtccccacaaaaatgggatccaaactggaagacatcctgatggacgacaccctttctcccgtcggtgtcactgatccactcctttcctcagtgtcccccggagcttccaaaacaagcagccggaggagcagtatgagcatggaagagacggagcacacttgttagcgaatcctccctgcactgcattcgcacaaactgcttcctttcttgattcgtagatttaataacttacctgaaggggttttcttgataattttcctttaatatgaaattttttttcatgctttatcaatagcccaggatatattttatttttagaattttgtgaaacagacttgtatattctattttacaactacaaatgcctccaaagtattgtacaaataagtgtgcagtatctgtgaactgaattcaccacagactttagctttctgagcaagaggattttgcgtcagagaaatgtctgtccatttttattcaggggaaacttgatttgagatttttatgcctgtgacttccttggaaatcaaatgtaaagtttaattgaaagaatgtaaagcaaccaaaaagaaaaaaaaaaagaaagaaagaggaaaagaaatccatactaacccttttccattttataaatgtattgattcattggtactgccttaaagatacagtacccctctagctttgtttagtctttatactgcaaactatttaaagaaatatgtattctgtaaaagaaaaaaaaaatgcggccttttcatgaggatcgtctggttagaaaacataactgataccaaccgaaactgaagggagttagaccaaggctctgaaatataaagtctaatcttgctctcttttattctgtgctgttacagttttcttcatcaatgagtgtgatccagtttttcataagatattttattttgaaatggaaattaatgtcctctcaaag

SEQ ID NO: 153762 - DNA, 1116 bp, Homo sapiens
  Payload ID: 10234
  Gene Symbol: MITF
  Gene Name: microphthalmia-associated transcription factor
  ENST ID: ENST00000451708
  CDS Start-End: 33-1116
aagggcttgcagaacaccttaaaggaaaaaagatggaggcgcttagagttcagatgttcatgccatgctcctttgaaagcttgtatctcagttccgccgagcatcctggggcctccaagcctccgataagctcctccagtatgacatcacgcatcttgctacgccagcaactcatgcgtgagcagatgcaggagcaggagcgcagggagcagcagcagaagctgcaggcggcccagttcatgcaacagagagtgcccgtgagtcagacaccagccataaacgtcagtgtgcccaccacccttccctctgccacgcaggtgccgatggaagtccttaaggtgcagacccacctcgaaaaccccaccaagtaccacatacagcaagcccaacggcagcaggtaaagcagtacctttctaccactttagcaaataaacatgccaaccaagtcctgagcttgccatgtccaaaccagcctggcgatcatgtcatgccaccggtgccggggagcagcgcacccaacagccccatggctatgcttacgcttaactccaactgtgaaaaagagggattttataagtttgaagagcaaaacagggcagagagcgagtgcccaggcatgaacacacattcacgagcgtcctgtatgcagatggatgatgtaatcgatgacatcattagcctagaatcaagttataatgaggaaatcttgggcttgatggatcctgctttgcaaatggcaaatacgttgcctgtctcgggaaacttgattgatctttatggaaaccaaggtctgcccccaccaggcctcaccatcagcaactcctgtccagccaaccttcccaacataaaaagggagctcacagcgtgtatttttcccacagagtctgaagcaagagcactggccaaagagaggcagaaaaaggacaatcacaacctgattgaacgaagaagaagatttaacataaatgaccgcattaaagaactaggtactttgattcccaagtcaaatgatccagacatgcgctggaacaagggaaccatcttaaaagcatccgtggactatatccgaaagttgcaacgagaacagcaacgcgcaaaagaacttgaaaaccgac

SEQ ID NO: 153763 - DNA, 542 bp, Homo sapiens
  Payload ID: 10234
  Gene Symbol: MITF
  Gene Name: microphthalmia-associated transcription factor
  ENST ID: ENST00000429090
  CDS Start-End: 331-542
gttgaataaagaatgacctagatggctgaagtgtttctggtgtgctagaagggatttattccaaatcttccttattactaaattctcagtggacctctctgggtttcgagcaagtgcggaaaattccatttggtgttcgccggctgatgtgcaagtaaaagcagggaatgtatgatggaaaatgtcataccctttatgatgacttttgatctgtgaagaatataattattctgtgtttaaaactacagaagggaaatgtttattcactctttttgaagcagttccgccgagcatcctggggcctccaagcctccgataagctcctccagtatgacatcacgcatcttgctacgccagcaactcatgcgtgagcagatgcaggagcaggagcgcagggagcagcagcagaagctgcaggcggcccagttcatgcaacagagagtgcccgtgagtcagacaccagccataaacgtcagtgtgcccaccacccttccctctgccacgcaggtgccgatggaagtccttaaggtgcagacccacct

SEQ ID NO: 153764 - DNA, 589 bp, Homo sapiens
  Payload ID: 10234
  Gene Symbol: MITF
  Gene Name: microphthalmia-associated transcription factor
  ENST ID: ENST00000433517
  CDS Start-End: 119-589
atctccctacagcagaagattgaatcctcatctctccatgagtctgagcatctaaagatgttagagcagttccgccgagcatcctggggcctccaagcctccgataagctcctccagtatgacatcacgcatcttgctacgccagcaactcatgcgtgagcagatgcaggagcaggagcgcagggagcagcagcagaagctgcaggcggcccagttcatgcaacagagagtgcccgtgagtcagacaccagccataaacgtcagtgtgcccaccacccttccctctgccacgcaggtgccgatggaagtccttaaggtgcagacccacctcgaaaaccccaccaagtaccacatacagcaagcccaacggcagcagggattttataagtttgaagagcaaaacagggcagagagcgagtgcccaggcatgaacacacattcacgagcgtcctgtatgcagatggatgatgtaatcgatgacatcattagcctagaatcaagttataatgaggaaatcttgggcttgatggatcctgctttgcaaatggcaaatacgttgcctgtctcgggaaacttgattgatctttat

SEQ ID NO: 153765 - DNA, 1995 bp, Homo sapiens
  Payload ID: 10234
  Gene Symbol: MITF
  Gene Name: microphthalmia-associated transcription factor
  Uniprot ID: O75030
  ENST ID: ENST00000472437
  CDS Start-End: 190-1596
aatttagccttcctagtgttgagagaaggtgcacgtaagcgtgtggcagaacgtctgcaatcgcatctttgtaataatctcctttctgagacggttcagtggactcaatgttccgccaaagggccaaggcagccctgcagttccgccgagcatcctggggcctccaagcctccgataagctcctccagtatgacatcacgcatcttgctacgccagcaactcatgcgtgagcagatgcaggagcaggagcgcagggagcagcagcagaagctgcaggcggcccagttcatgcaacagagagtgcccgtgagtcagacaccagccataaacgtcagtgtgcccaccacccttccctctgccacgcaggtgccgatggaagtccttaaggtgcagacccacctcgaaaaccccaccaagtaccacatacagcaagcccaacggcagcaggtaaagcagtacctttctaccactttagcaaataaacatgccaaccaagtcctgagcttgccatgtccaaaccagcctggcgatcatgtcatgccaccggtgccggggagcagcgcacccaacagccccatggctatgcttacgcttaactccaactgtgaaaaagagggattttataagtttgaagagcaaaacagggcagagagcgagtgcccaggcatgaacacacattcacgagcgtcctgtatgcagatggatgatgtaatcgatgacatcattagcctagaatcaagttataatgaggaaatcttgggcttgatggatcctgctttgcaaatggcaaatacgttgcctgtctcgggaaacttgattgatctttatggaaaccaaggtctgcccccaccaggcctcaccatcagcaactcctgtccagccaaccttcccaacataaaaagggagctcacagagtctgaagcaagagcactggccaaagagaggcagaaaaaggacaatcacaacctgattgaacgaagaagaagatttaacataaatgaccgcattaaagaactaggtactttgattcccaagtcaaatgatccagacatgcgctggaacaagggaaccatcttaaaagcatccgtggactatatccgaaagttgcaacgagaacagcaacgcgcaaaagaacttgaaaaccgacagaagaaactggagcacgccaaccggcatttgttgctcagaatacaggaacttgaaatgcaggctcgagctcatggactttcccttattccatccacgggtctctgctctccagatttggtgaatcggatcatcaagcaagaacccgttcttgagaactgcagccaagacctccttcagcatcatgcagacctaacctgtacaacaactctcgatctcacggatggcaccatcaccttcaacaacaacctcggaactgggactgaggccaaccaagcctatagtgtccccacaaaaatgggatccaaactggaagacatcctgatggacgacaccctttctcccgtcggtgtcactgatccactcctttcctcagtgtcccccggagcttccaaaacaagcagccggaggagcagtatgagcatggaagagacggagcacacttgttagcgaatcctccctgcactgcattcgcacaaactgcttcctttcttgattcgtagatttaataacttacctgaaggggttttcttgataattttcctttaatatgaaattttttttcatgctttatcaatagcccaggatatattttatttttagaattttgtgaaacagacttgtatattctattttacaactacaaatgcctccaaagtattgtacaaataagtgtgcagtatctgtgaactgaattcaccacagactttagctttctgagcaagaggattttgcgtcagagaaatgtctgtccatttttattcaggggaaacttgatttgagatttttatgcctgtgacttccttggaaatcaaatgtaaagtttaattgaaagaatgtaaagcaacc

SEQ ID NO: 153766 - DNA, 1642 bp, Homo sapiens
  Payload ID: 10234
  Gene Symbol: MITF
  Gene Name: microphthalmia-associated transcription factor
  ENST ID: ENST00000478490
  CDS Start-End: 96-413
tctttgccagtccatcttcaaattggaattatagaaagtagagggagggatagtctaccgtctctcactggattggtgccacctaaaacattgttatgctggaaatgctagaatataatcactatcaggtgcagacccacctcgaaaaccccaccaagtaccacatacagcaagcccaacggcagcaggtaaagcagtacctttctaccactttagcaaataaacatgccaaccaagtcctgagcttgccatgtccaaaccagcctggcgatcatgtcatgccaccggtgccggggagcagcgcacccaacagccccatggctatgcttacgcttaactccaactgtgaaaaagagggattttataagtttgaagagcaaaacagggcagagagcgagtgcccagatggatgatgtaatcgatgacatcattagcctagaatcaagttataatgaggaaatcttgggcttgatggatcctgctttgcaaatggcaaatacgttgcctgtctcgggaaacttgattgatctttatggaaaccaaggtctgcccccaccaggcctcaccatcagcaactcctgtccagccaaccttcccaacataaaaagggagctcacagcgtgtatttttcccacagagtctgaagcaagagcactggccaaagagaggcagaaaaaggacaatcacaacctgattgaacgaagaagaagatttaacataaatgaccgcattaaagaactaggtactttgattcccaagtcaaatgatccagacatgcgctggaacaagggaaccatcttaaaagcatccgtggactatatccgaaagttgcaacgagaacagcaacgcgcaaaagaacttgaaaaccgacagaagaaactggagcacgccaaccggcatttgttgctcagaatacaggaacttgaaatgcaggctcgagctcatggactttcccttattccatccacgggtctctgctctccagatttggtgaatcggatcatcaagcaagaacccgttcttgagaactgcagccaagacctccttcagcatcatgcagacctaacctgtacaacaactctcgatctcacggatggcaccatcaccttcaacaacaacctcggaactgggactgaggccaaccaagcctatagtgtccccacaaaaatgggatccaaactggaagacatcctgatggacgacaccctttctcccgtcggtgtcactgatccactcctttcctcagtgtcccccggagcttccaaaacaagcagccggaggagcagtatgagcatggaagagacggagcacacttgttagcgaatcctccctgcactgcattcgcacaaactgcttcctttcttgattcgtagatttaataacttacctgaaggggttttcttgataattttcctttaatatgaaattttttttcatgctttatcaatagcccaggatatattttatttttagaattttgtgaaacagacttgtatattctattttacaactacaaatgcctccaaagtattgtacaaataagtgtgcagtatctgtgaactgaattcaccacagactttagctttctgagcaagaggattttgcgtcagagaaatgtctgtccatttttattcaggggaaa

SEQ ID NO: 153767 - DNA, 1074 bp, Homo sapiens
  Payload ID: 10234
  Gene Symbol: MITF
  Gene Name: microphthalmia-associated transcription factor
  Uniprot ID: O75030
  ENST ID: ENST00000531774
  CDS Start-End: 1-1074
atgctggaaatgctagaatataatcactatcaggtgcagacccacctcgaaaaccccaccaagtaccacatacagcaagcccaacggcagcagggattttataagtttgaagagcaaaacagggcagagagcgagtgcccaggcatgaacacacattcacgagcgtcctgtatgcagatggatgatgtaatcgatgacatcattagcctagaatcaagttataatgaggaaatcttgggcttgatggatcctgctttgcaaatggcaaatacgttgcctgtctcgggaaacttgattgatctttatggaaaccaaggtctgcccccaccaggcctcaccatcagcaactcctgtccagccaaccttcccaacataaaaagggagctcacagagtctgaagcaagagcactggccaaagagaggcagaaaaaggacaatcacaacctgattgaacgaagaagaagatttaacataaatgaccgcattaaagaactaggtactttgattcccaagtcaaatgatccagacatgcgctggaacaagggaaccatcttaaaagcatccgtggactatatccgaaagttgcaacgagaacagcaacgcgcaaaagaacttgaaaaccgacagaagaaactggagcacgccaaccggcatttgttgctcagaatacaggaacttgaaatgcaggctcgagctcatggactttcccttattccatccacgggtctctgctctccagatttggtgaatcggatcatcaagcaagaacccgttcttgagaactgcagccaagacctccttcagcatcatgcagacctaacctgtacaacaactctcgatctcacggatggcaccatcaccttcaacaacaacctcggaactgggactgaggccaaccaagcctatagtgtccccacaaaaatgggatccaaactggaagacatcctgatggacgacaccctttctcccgtcggtgtcactgatccactcctttcctcagtgtcccccggagcttccaaaacaagcagccggaggagcagtatgagcatggaagagacggagcacacttgttag

SEQ ID NO: 153768 - DNA, 1069 bp, Homo sapiens
  Payload ID: 10234
  Gene Symbol: MITF
  Gene Name: microphthalmia-associated transcription factor
  ENST ID: ENST00000394348
  CDS Start-End: 95-370
ctttgccagtccatcttcaaattggaattatagaaagtagagggagggatagtctaccgtctctcactggattggtgccacctaaaacattgttatgctggaaatgctagaatataatcactatcaggtgcagacccacctcgaaaaccccaccaagtaccacatacagcaagcccaacggcagcaggtaaagcagtacctttctaccactttagcaaataaacatgccaaccaagtcctgagcttgccatgtccaaaccagcctggcgatcatgtcatgccaccggtgccggggagcagcgcacccaacagccccatggctatgcttacgcttaactccaactgtgaaaaagagtttatgaagcagtgagaatgcagagagaggagaaggggaggtggaaaaggaaaagcaaaaatagaagaggtgtgggacatgctgtttagaagttccgcttgttgtgaatgtctggaatattatttttatttctccctgagttgggggaagaaagaatggaatatgcatggatggatttgaatcatatagcacatgagactttaacggaaacgcaaaggtttaattgctggatacattctgtttcataataaaattgccactgcccgttaaatctgctttggtgaaggctggattggaaacaagactcaaactaccttcaagctaattggtgcatcaaaatttgcagcatacaaatacctgagagctgtgatttaatgctcattatttccaaattatgagatgatgagcttcatctcaatgggatttaccgtactatggactatgaagtgtttatgcaaattcggaggcaacttttctagagttggattgattttaatttctagagggactaaaatctttgcccctatgcccaaaccaactgctttatttttctctacccaaatttgtcatctagcaagatgatttgacacaagttcttccttcattatttcatcttttggtcagattccactttgtttgaaagcttagttcatcttgttgctgtgccatcagctttgtgtgaacaggtcattaaaaagtcatttgcaaatccaa

SEQ ID NO: 153769 - DNA, 386 bp, Homo sapiens
  Payload ID: 10235
  Gene Symbol: MSMB
  Gene Name: microseminoprotein, beta-
  Uniprot ID: P08118
  ENST ID: ENST00000581478
  CDS Start-End: 33-266
gtacctgtctataaggagtcctgcttatcacaatgaatgttctcctgggcagcgttgtgatctttgccaccttcgtgactttatgcaatgcatcatgctatttcatacctaatgagggagttccaggagattcaaccaggatgtttctacacctgtgggttatgacaaagacaactgccaaagaatcttcaagaaggaggactgcaagtatatcgtggtggagaagaaggacccaaaaaagacctgttctgtcagtgaatggataatctaatgtgcttctagtaggcacagggctcccaggccaggcctcattctcctctggcctctaatagtcaatgattgtgtagccatgcctatcagtaaaaagatttttgagcaaacacttg

SEQ ID NO: 153770 - DNA, 488 bp, Homo sapiens
  Payload ID: 10235
  Gene Symbol: MSMB
  Gene Name: microseminoprotein, beta-
  Uniprot ID: P08118
  ENST ID: ENST00000582163
  CDS Start-End: 33-377
gtacctgtctataaggagtcctgcttatcacaatgaatgttctcctgggcagcgttgtgatctttgccaccttcgtgactttatgcaatgcatcatgctatttcatacctaatgagggagttccaggagattcaaccaggaaatgcatggatctcaaaggaaacaaacacccaataaactcggagtggcagactgacaactgtgagacatgcacttgctacgaaacagaaatttcatgttgcacccttgtttctacacctgtgggttatgacaaagacaactgccaaagaatcttcaagaaggaggactgcaagtatatcgtggtggagaagaaggacccaaaaaagacctgttctgtcagtgaatggataatctaatgtgcttctagtaggcacagggctcccaggccaggcctcattctcctctggcctctaatagtcaatgattgtgtagccatgcctatcagtaaaaagatttttgagcaaaca

SEQ ID NO: 153771 - DNA, 670 bp, Homo sapiens
  Payload ID: 10236
  Gene Symbol: MSMP
  Gene Name: microseminoprotein, prostate associated
  Uniprot ID: Q1L6U9
  ENST ID: ENST00000436428
  CDS Start-End: 141-560
gggagatagtgtgagacaggagcccaggggagaaagacagaaactaagactcaaggagcaacgcaaagcaaagtcaaggagtcaagaccagagtagctgagcagaggccaagaagggtctgagagggctgtgcagcagcaatggccctaaggatgctctgggctggacaggccaaggggatcctaggaggctgggggatcatctgcttggtgatgtctctactcctccagcacccaggagtctacagcaagtgctacttccaagctcaagccccctgtcactatgaggggaaatattttaccctgggtgagtcttggctccgcaaggactgtttccattgcacctgtctgcatcctgttggcgtgggctgctgtgacacgtcccagcatcccatcgacttcccggctgggtgtgaggtacgtcaggaggcaggaacctgccagttctccttggtgcaaaaatctgaccctcggctgccctgcaaagggggagggcctgacccagaatggggctcagccaacacccctgttcctggggctcctgctccccactccagctaaactcaactgatcatccatctgctgactgctcactgctgctgccacttccagggaaaccactagcagctgccaatgtattctgaacaaataaattaatgctatagctgaaa

SEQ ID NO: 153772 - DNA, 901 bp, Homo sapiens
  Payload ID: 10237
  Gene Symbol: MGST1
  Gene Name: microsomal glutathione S-transferase 1
  Uniprot ID: P10620
  ENST ID: ENST00000010404
  CDS Start-End: 66-533
tcgtgacaaagcaaattgtctggtatcatgaatttggaacaccattccagaccaaaattgaaaaaatggttgacctcacccaggtaatggatgatgaagtattcatggcttttgcatcctatgcaacaattattctttcaaaaatgatgcttatgagtactgcaactgcattctatagattgacaagaaaggtttttgccaatccagaagactgtgtagcatttggcaaaggagaaaatgccaagaagtatcttcgaacagatgacagagtagaacgtgtacgcagagcccacctgaatgaccttgaaaatattattccatttcttggaattggcctcctgtattccttgagtggtcccgacccctctacagccatcctgcacttcagactatttgtcggagcacggatctaccacaccattgcatatttgacaccccttccccagccaaatagagctttgagtttttttgttggatatggagttactctttccatggcttacaggttgctgaaaagtaaattgtacctgtaaagaaaatcatacaactcagcatccagttggctttttaagaattctgtacttccaatttataatgaatactttcttagattttaggtaggaggggagcagaggaattatgaactggggtaaacccattttgaatattagcattgccaatatcctgtattcttgttttacatttggattagaaatttaacatagtaattcttaagtcttttgtctgatttttaaagtactttcttataaatttggatcatgttatgatttgtaacattcacacaacacctcacttttgaatctataaaagaattgcacgtatgagaaacctatatttcaatactgctgaaacagacatgaaataaagaatttaaagaatg

SEQ ID NO: 153773 - DNA, 909 bp, Homo sapiens
  Payload ID: 10237
  Gene Symbol: MGST1
  Gene Name: microsomal glutathione S-transferase 1
  Uniprot ID: P10620
  ENST ID: ENST00000396207
  CDS Start-End: 74-541
gaattcaagtcctaaagcctacagttttgaatactactgaaatgacaagttattccagaccaaaattgaaaaaatggttgacctcacccaggtaatggatgatgaagtattcatggcttttgcatcctatgcaacaattattctttcaaaaatgatgcttatgagtactgcaactgcattctatagattgacaagaaaggtttttgccaatccagaagactgtgtagcatttggcaaaggagaaaatgccaagaagtatcttcgaacagatgacagagtagaacgtgtacgcagagcccacctgaatgaccttgaaaatattattccatttcttggaattggcctcctgtattccttgagtggtcccgacccctctacagccatcctgcacttcagactatttgtcggagcacggatctaccacaccattgcatatttgacaccccttccccagccaaatagagctttgagtttttttgttggatatggagttactctttccatggcttacaggttgctgaaaagtaaattgtacctgtaaagaaaatcatacaactcagcatccagttggctttttaagaattctgtacttccaatttataatgaatactttcttagattttaggtaggaggggagcagaggaattatgaactggggtaaacccattttgaatattagcattgccaatatcctgtattcttgttttacatttggattagaaatttaacatagtaattcttaagtcttttgtctgatttttaaagtactttcttataaatttggatcatgttatgatttgtaacattcacacaacacctcacttttgaatctataaaagaattgcacgtatgagaaacctatatttcaatactgctgaaacagacatgaaataaagaatttaaagaatg

SEQ ID NO: 153774 - DNA, 979 bp, Homo sapiens
  Payload ID: 10237
  Gene Symbol: MGST1
  Gene Name: microsomal glutathione S-transferase 1
  Uniprot ID: P10620
  ENST ID: ENST00000396209
  CDS Start-End: 144-611
ggcagatggaagacttgggggggtctctgccagctggaagtgcttggctccacttagcagctaaacttagcttttcaatcgatcgcttttgaaagggaattgtatttctgtccccgtgcggattccagaccaaaattgaaaaaatggttgacctcacccaggtaatggatgatgaagtattcatggcttttgcatcctatgcaacaattattctttcaaaaatgatgcttatgagtactgcaactgcattctatagattgacaagaaaggtttttgccaatccagaagactgtgtagcatttggcaaaggagaaaatgccaagaagtatcttcgaacagatgacagagtagaacgtgtacgcagagcccacctgaatgaccttgaaaatattattccatttcttggaattggcctcctgtattccttgagtggtcccgacccctctacagccatcctgcacttcagactatttgtcggagcacggatctaccacaccattgcatatttgacaccccttccccagccaaatagagctttgagtttttttgttggatatggagttactctttccatggcttacaggttgctgaaaagtaaattgtacctgtaaagaaaatcatacaactcagcatccagttggctttttaagaattctgtacttccaatttataatgaatactttcttagattttaggtaggaggggagcagaggaattatgaactggggtaaacccattttgaatattagcattgccaatatcctgtattcttgttttacatttggattagaaatttaacatagtaattcttaagtcttttgtctgatttttaaagtactttcttataaatttggatcatgttatgatttgtaacattcacacaacacctcacttttgaatctataaaagaattgcacgtatgagaaacctatatttcaatactgctgaaacagacatgaaataaagaatttaaagaatg

SEQ ID NO: 153775 - DNA, 914 bp, Homo sapiens
  Payload ID: 10237
  Gene Symbol: MGST1
  Gene Name: microsomal glutathione S-transferase 1
  Uniprot ID: P10620
  ENST ID: ENST00000396210
  CDS Start-End: 85-552
cctgcattgcgcgcgacccggcggcgggacaggcttgctgcttcctcctcctcggcctcaccattccagaccaaaattgaaaaaatggttgacctcacccaggtaatggatgatgaagtattcatggcttttgcatcctatgcaacaattattctttcaaaaatgatgcttatgagtactgcaactgcattctatagattgacaagaaaggtttttgccaatccagaagactgtgtagcatttggcaaaggagaaaatgccaagaagtatcttcgaacagatgacagagtagaacgtgtacgcagagcccacctgaatgaccttgaaaatattattccatttcttggaattggcctcctgtattccttgagtggtcccgacccctctacagccatcctgcacttcagactatttgtcggagcacggatctaccacaccattgcatatttgacaccccttccccagccaaatagagctttgagtttttttgttggatatggagttactctttccatggcttacaggttgctgaaaagtaaattgtacctgtaaagaaaatcatacaactcagcatccagttggctttttaagaattctgtacttccaatttataatgaatactttcttagattttaggtaggaggggagcagaggaattatgaactggggtaaacccattttgaatattagcattgccaatatcctgtattcttgttttacatttggattagaaatttaacatagtaattcttaagtcttttgtctgatttttaaagtactttcttataaatttggatcatgttatgatttgtaacattcacacaacacctcacttttgaatctataaaagaattgcacgtatgagaaacctatatttcaatactgctgaaacagacatgaaataaagaatttaa

SEQ ID NO: 153776 - DNA, 546 bp, Homo sapiens
  Payload ID: 10237
  Gene Symbol: MGST1
  Gene Name: microsomal glutathione S-transferase 1
  ENST ID: ENST00000540056
  CDS Start-End: 144-284
ggcagatggaagacttgggggggtctctgccagctggaagtgcttggctccacttagcagctaaacttagcttttcaatcgatcgcttttgaaagggaattgtatttctgtccccgtgcggattccagaccaaaattgaaaaaatggttgacctcacccaggtaatggatgatgaagtattcatggcttttgcatcctatgcaacaattattctttcaaaaatgatgcttatgagtactgcaactgcattctatagattgacaagaaagagcccacctgaatgaccttgaaaatattattccatttcttggaattggcctcctgtattccttgagtggtcccgacccctctacagccatcctgcacttcagactatttgtcggagcacggatctaccacaccattgcatatttgacaccccttccccagccaaatagagctttgagtttttttgttggatatggagttactctttccatggcttacaggttgctgaaaagtaaattgtacctgtaaagaaaatcatacaactcagcatccagttgg

SEQ ID NO: 153777 - DNA, 1331 bp, Homo sapiens
  Payload ID: 10237
  Gene Symbol: MGST1
  Gene Name: microsomal glutathione S-transferase 1
  Uniprot ID: P10620
  ENST ID: ENST00000535309
  CDS Start-End: 40-303
tcctcctcggcctcaccattccagaccaaaattgaaaaaatggttgacctcacccaggtaatggatgatgaagtattcatggcttttgcatcctatgcaacaattattctttcaaaaatgatgcttatgagtactgcaactgcattctatagattgacaagaaaggtttttgccaatccagaagactgtgtagcatttggcaaaggagaaaatgccaagaagtatcttcgaacagatgacagagtagaacgtgtacgcagaatcaaacaaaccctgagcatttatcttgcctcttctatataaagtttaactcggcataaccaattgctgatgaagaagaaatgtttccttgtagaagcaaaccagtgaataattgaagaaaaaatttatcttttcaacatctaatgagttaatggattcaagcaaagattatccacggctgttaacaacacaaaaagacaatcggaaattagctattactgcgggaagtacccaataccatctatgaaactgtgtggacaaaaacactgacaaaaatctccacgaatctctaattttgaatacaaatttaaagaaaatgcaaaggattaaaatagaccatgatgaagtcagaaaaattcagacagagaaaaatgctccaggaccagaaacccatttcttccgcaaaagcttccaggtagagattgactgaccgagagaacagagacatagagagaacctagagattaaaagaaacttgagcgatttgtcagcattcagttgcaacgtatggatgtgatttgaattctaatttaaaaaccaaagtagaaagtggtaaacaattggggaaatgtgaacaatgatagaatatttaatattaatgaaatatgttaaatattttcagatatgataatggcattgagtatgtaaaaaagagcctgtttttaaagaaatacctctgaaatacagatgatataatatcatctgtatattagatgatattatatatatcagtatcatcagaataaagtaaggttagcatgaattgttaattgttgacactgtgcaataggtacgtggataattactatactgttctcattccttttatttatgtttgaaatgttctaaaattaaaagttaaagcatagagtgtaaagttgagcaaattcctccaagacctaaatatagcttatcaaaacttacattaattagatgctgactgttgagctaatacttttttttaatgatgtgtgcttcagtttattgcacttttcaaatactccagttttttgtgtgcgtgtgttttttaaattttattattattaaagttttagggtacatgtgcacaa

SEQ ID NO: 153778 - DNA, 202 bp, Homo sapiens
  Payload ID: 10237
  Gene Symbol: MGST1
  Gene Name: microsomal glutathione S-transferase 1
  ENST ID: ENST00000538885
  CDS Start-End: 77-202
gtacctgtgaaggggaagatgttaccctggagagatggttcattgactcatcagattccagaccaaaattgaaaaaatggttgacctcacccaggtaatggatgatgaagtattcatggcttttgcatcctatgcaacaattattctttcaaaaatgatgcttatgagtactgcaactgcattctatagattgacaagaaag

SEQ ID NO: 153779 - DNA, 298 bp, Homo sapiens
  Payload ID: 10237
  Gene Symbol: MGST1
  Gene Name: microsomal glutathione S-transferase 1
  ENST ID: ENST00000536371
  CDS Start-End: 66-298
tcgtgacaaagcaaattgtctggtatcatgaatttggaacaccattccagaccaaaattgaaaaaatggttgacctcacccaggtaatggatgatgaagtattcatggcttttgcatcctatgcaacaattattctttcaaaaatgatgcttatgagtactgcaactgcattctatagattgacaagaaaggtttttgccaatccagaagactgtgtagcatttggcaaaggagaaaatgccaagaagtatcttcgaacagatgacagagtagaacgtgtacgcagagcccacctgaa

SEQ ID NO: 153780 - DNA, 406 bp, Homo sapiens
  Payload ID: 10237
  Gene Symbol: MGST1
  Gene Name: microsomal glutathione S-transferase 1
  ENST ID: ENST00000543076
  CDS Start-End: 89-406
agtccctgcattgcgcgcgacccggcggcgggacaggcttgctgcttcctcctcctcggcctcaccattccagaccaaaattgaaaaaatggttgacctcacccaggtttttgccaatccagaagactgtgtagcatttggcaaaggagaaaatgccaagaagtatcttcgaacagatgacagagtagaacgtgtacgcagagcccacctgaatgaccttgaaaatattattccatttcttggaattggcctcctgtattccttgagtggtcccgacccctctacagccatcctgcacttcagactatttgtcggagcacggatctaccacaccattgcatatttgacaccccttccccagccaaatagagctttgagtttttttgttggatatggagttactctt

SEQ ID NO: 153781 - DNA, 365 bp, Homo sapiens
  Payload ID: 10237
  Gene Symbol: MGST1
  Gene Name: microsomal glutathione S-transferase 1
  ENST ID: ENST00000540126
  CDS Start-End: 125-365
ggggtctctgccagctggaagtgcttggctccacttagcagctaaacttagcttttcaatcgatcgcttttgaaagggaattgtatttctgtccccgtgcggattccagaccaaaattgaaaaaatggttgacctcacccaggtaatggatgatgaagtattcatggcttttgcatcctatgcaacaattattctttcaaaaatgatgcttatgagtactgcaactgcattctatagattgacaagaaaggtttttgccaatccagaagactgtgtagcatttggcaaaggagaaaatgccaagaagtatcttcgaacagatgacagagtagaacgtgtacgcagagcccacctgaatgaccttg

SEQ ID NO: 153782 - DNA, 801 bp, Homo sapiens
  Payload ID: 10238
  Gene Symbol: MGST2
  Gene Name: microsomal glutathione S-transferase 2
  Uniprot ID: Q99735
  ENST ID: ENST00000265498
  CDS Start-End: 253-696
gctggccgtgggagaggcttaaaacaaacgccggaagcaactcccagccccataaagatctgtgaccggcagccccagacctgcctgccttcctgacttctgttccagagcaaaggtcattcagccgcttgaatcagccttttccccccacccggtccccaactttgtttacccgataaggaaggtcagcattcaaagtcaagaagcgccatttatcttcccgtgcgctctacaaatagttccgtgagaaagatggccgggaactcgatcctgctggctgctgtctctattctctcggcctgtcagcaaagttattttgctttgcaagttggaaaggcaagattaaaatacaaagttacgcccccagcagtcactgggtcaccagagtttgagagagtatttcgggcacaacaaaactgtgtggagttttatcctatattcataattacattgtggatggctgggtggtatttcaaccaagtttttgctacttgtctgggtctggtgtacatatatggccgtcacctatacttctggggatattcagaagctgctaaaaaacggatcaccggtttccgactgagtctggggattttggccttgttgaccctcctaggtgccctgggaattgcaaacagctttctggatgaatatctggacctcaatattgccaagaaactgaggcggcaattctaactttttctcttccctttaatacttgcagaagctgttcccaccatgaaggtaatatggtatcatttgttaaataaaaataaagtctttattctgtttttcttgaaa

SEQ ID NO: 153783 - DNA, 1780 bp, Homo sapiens
  Payload ID: 10238
  Gene Symbol: MGST2
  Gene Name: microsomal glutathione S-transferase 2
  Uniprot ID: Q99735
  ENST ID: ENST00000503816
  CDS Start-End: 5-448
aaagatggccgggaactcgatcctgctggctgctgtctctattctctcggcctgtcagcaaagttattttgctttgcaagttggaaaggcaagattaaaatacaaagttacgcccccagcagtcactgggtcaccagagtttgagagagtatttcgggcacaacaaaactgtgtggagttttatcctatattcataattacattgtggatggctgggtggtatttcaaccaagtttttgctacttgtctgggtctggtgtacatatatggccgtcacctatacttctggggatattcagaagctgctaaaaaacggatcaccggtttccgactgagtctggggattttggccttgttgaccctcctaggtgccctgggaattgcaaacagctttctggatgaatatctggacctcaatattgccaagaaactgaggcggcaattctaactttttctcttccctttaatacttgcagaagctgttcccaccatgaagttattggtttcttgaactctttggggcacaatttcaagaggaagaagtaaaaaaaggataccatttcaaggaattgcccagggacaagtgcgaagagaatattctttctcttggctgaggaaggttctcttgtgatcctgggaaatgctagaccgtgagcatcttgatggaggatgtgaactgccacttcctcacaggcagcaggcaggtgctgaataagtgcttgctgaatgaatgaatgaatcacgccaaggggcatgttacctgttccgccaaaatctgctgctgctgctgctgctgctgctgcctttgctcccgcaggaactgttgcttctgctgctctatcaactgggcccgctgatcaatgagcatctgcttcatgatggctgcttggggctggctgcccaggaagccggggcctgcgggactggctcctgagaccatgccacctgagcctgggggcacggaggactgcatggggcctgtggttcggggaagtccaactggatgctgctcctgggaagacaagagagagggagatgcagggattccccatagagactcactgctgtttgaagggaagcccctggaaaaagggaacggggcagaagtcccagcttatggactggagggtttttgagtggcacgcattgcatttccataaacgtagcttcaaacccgaccttacctgagtagaatgagagaggccacaagggacagtaagagagcatggctctgggaagtccaaggccaagtccagtctgtttcggatgggactgactattgcatatagactggattttcaactaacatcctgtgttcctccaaggaaagggaataagccctcaggctgagctcacctaaagtctggaacacgagacacatcctgacctcacctgttaatccttatttcttactgtctacttggccaaaatggacgtcttctttgcaagtaggagggacatttgcagaaaactgcaggaatttgttaatcaacagatctgatatttgatggaattctaacgagttgcaacatttgagagcttagatatatgtcagaaagaaaaatcctcctggccagagttgttgatggtgagaactgggaatgttttacaccgatcaaagctatgtaatctcctaatatttttaaaaatagaattgagtcggccgggcgcggtgtctcacgcctgtaatcccagtactttgggaggcccagtactttgggtggatcacgaggtcagttcgagaccagcttggccaagatggtgaaaccctgtctctact

SEQ ID NO: 153784 - DNA, 634 bp, Homo sapiens
  Payload ID: 10238
  Gene Symbol: MGST2
  Gene Name: microsomal glutathione S-transferase 2
  Uniprot ID: Q99735
  ENST ID: ENST00000506797
  CDS Start-End: 186-419
ggcagccccagacctgcctgccttcctgacttctgttccagagcaaaggtcattcagccgcttgaatcagccttttccccccacccggtccccaactttgtttacccgataaggaaggtcagcattcaaagtcaagaagcgccatttatcttcccgtgcgctctacaaatagttccgtgagaaagatggccgggaactcgatcctgctggctgctgtctctattctctcggcctgtcagcaaagttattttgctttgcaagttggaaaggcaagattaaaatacaaagttacgcccccagcagtcactgggtcaccagagtttgagagagtatttcgggcacatttttgctacttgtctgggtctggtgtacatatatggccgtcacctatacttctggggatattcagaagctgctaaaaaacggatcaccggtttccgactgagtctggggattttggccttgttgaccctcctaggtgccctgggaattgcaaacagctttctggatgaatatctggacctcaatattgccaagaaactgaggcggcaattctaactttttctcttccctttaatacttgcagaagctgttcccaccatgaaggtaatatggtatcatttgttaaataaaa

SEQ ID NO: 153785 - DNA, 1278 bp, Homo sapiens
  Payload ID: 10238
  Gene Symbol: MGST2
  Gene Name: microsomal glutathione S-transferase 2
  Uniprot ID: Q99735
  ENST ID: ENST00000616265
  CDS Start-End: 253-696
gctggccgtgggagaggcttaaaacaaacgccggaagcaactcccagccccataaagatctgtgaccggcagccccagacctgcctgccttcctgacttctgttccagagcaaaggtcattcagccgcttgaatcagccttttccccccacccggtccccaactttgtttacccgataaggaaggtcagcattcaaagtcaagaagcgccatttatcttcccgtgcgctctacaaatagttccgtgagaaagatggccgggaactcgatcctgctggctgctgtctctattctctcggcctgtcagcaaagttattttgctttgcaagttggaaaggcaagattaaaatacaaagttacgcccccagcagtcactgggtcaccagagtttgagagagtatttcgggcacaacaaaactgtgtggagttttatcctatattcataattacattgtggatggctgggtggtatttcaaccaagtttttgctacttgtctgggtctggtgtacatatatggccgtcacctatacttctggggatattcagaagctgctaaaaaacggatcaccggtttccgactgagtctggggattttggccttgttgaccctcctaggtgccctgggaattgcaaacagctttctggatgaatatctggacctcaatattgccaagaaactgaggcggcaattctaactttttctcttccctttaatacttgcagaagctgttcccaccatgaaggcttgaagccacagtgcatggccagaaccagccagacctttggagttcaagaactcgagaggtgggtgaaaactgccattgcctccacagactgtcttctccgtggaaagaagacctgagtcaccagggctgggaaacctgcaccactgagacgagcacagcctctgccggcatgcaagtggccgctgtcaggacacatggactgaaagtggtttgtcagctgctccattaggttttttttacccatatgtttgctacctttctttccttgatttaaaaatagggagggggagcagtctcagctgtcttcagctgctagggagatttttttccccctcctgagctactgtttcccccaacccgagcctttctctcttattgtacccaccctttctgatgaagtcatcaaagcaaagattgcataactgatgcataggcctatcttgtgttatactgggagacaggccaatgtttccattaatagacaagagcaccaccacgctgccaaatggagctctctgctgcaaccactac

SEQ ID NO: 153786 - DNA, 706 bp, Homo sapiens
  Payload ID: 10239
  Gene Symbol: MGST3
  Gene Name: microsomal glutathione S-transferase 3
  ENST ID: ENST00000367883
  CDS Start-End: 90-590
attccccgaagttgtggcttctgctgatactttccttgagagtcacgagtttacaagctacataatagcgtcgggggcaaggacaggagatgccctggaggggaaggcgcttccggctctgcagacgcaagatggctgtcctctctaaggaatatggttttgtgcttctaactggtgctgccagctttataatggtggcccacctagccatcaatgtttccaaggcccgcaagaagtacaaagtggagtatcctatcatgtacagcacggaccctgaaaatgggcacatcttcaactgcattcagcgagcccaccagaacacgttggaagtgtatcctcccttcttattttttctagctgttggaggtgtttaccacccgcgtatagcttctggcctgggcttggcctggattgttggacgagttctttatgcttatggctattacacgggagaacccagcaagcgtagtcgaggagccctggggtccatcgccctcctgggcttggtgggcacaactgtgtgctctgctttccagcatcttggttgggttaaaagtggcttgggcagtggacccaaatgctgccattaaagaattataggggtttaaaaactctcattcattttaaatgacttacctttatttccagttacattttttttctaaatataataaaaacttacctggcatcagcctcatacctaaaa

SEQ ID NO: 153787 - DNA, 716 bp, Homo sapiens
  Payload ID: 10239
  Gene Symbol: MGST3
  Gene Name: microsomal glutathione S-transferase 3
  Uniprot ID: O14880
  ENST ID: ENST00000367884
  CDS Start-End: 142-600
gcagttttgttctgctccagctgttcgaaggtgatccaggacagatcttccatcctcctaacatatagttagcttccactctccaaatattccaccagcaacattgatgaatattgaagactatggactgtgagacgcaagatggctgtcctctctaaggaatatggttttgtgcttctaactggtgctgccagctttataatggtggcccacctagccatcaatgtttccaaggcccgcaagaagtacaaagtggagtatcctatcatgtacagcacggaccctgaaaatgggcacatcttcaactgcattcagcgagcccaccagaacacgttggaagtgtatcctcccttcttattttttctagctgttggaggtgtttaccacccgcgtatagcttctggcctgggcttggcctggattgttggacgagttctttatgcttatggctattacacgggagaacccagcaagcgtagtcgaggagccctggggtccatcgccctcctgggcttggtgggcacaactgtgtgctctgctttccagcatcttggttgggttaaaagtggcttgggcagtggacccaaatgctgccattaaagaattataggggtttaaaaactctcattcattttaaatgacttacctttatttccagttacattttttttctaaatataataaaaacttacctggcatcagcctcatacctaaaa

SEQ ID NO: 153788 - DNA, 680 bp, Homo sapiens
  Payload ID: 10239
  Gene Symbol: MGST3
  Gene Name: microsomal glutathione S-transferase 3
  ENST ID: ENST00000367885
  CDS Start-End: 64-564
cccacaccgcgctgcgcagttttgttctgctccagctgttcgaaggtgatccagggacaggagatgccctggaggggaaggcgcttccggctctgcagacgcaagatggctgtcctctctaaggaatatggttttgtgcttctaactggtgctgccagctttataatggtggcccacctagccatcaatgtttccaaggcccgcaagaagtacaaagtggagtatcctatcatgtacagcacggaccctgaaaatgggcacatcttcaactgcattcagcgagcccaccagaacacgttggaagtgtatcctcccttcttattttttctagctgttggaggtgtttaccacccgcgtatagcttctggcctgggcttggcctggattgttggacgagttctttatgcttatggctattacacgggagaacccagcaagcgtagtcgaggagccctggggtccatcgccctcctgggcttggtgggcacaactgtgtgctctgctttccagcatcttggttgggttaaaagtggcttgggcagtggacccaaatgctgccattaaagaattataggggtttaaaaactctcattcattttaaatgacttacctttatttccagttacattttttttctaaatataataaaaacttacctggcatcagcctcatacctaaaa

SEQ ID NO: 153789 - DNA, 778 bp, Homo sapiens
  Payload ID: 10239
  Gene Symbol: MGST3
  Gene Name: microsomal glutathione S-transferase 3
  ENST ID: ENST00000367888
  CDS Start-End: 89-478
agccccgccccaggcgagggcgccgcacccacaccgcgctgcgcagttttgttctgctccagctgttcgaaggtgatccagacgcaagatggctgtcctctctaaggaatatggttttgtgcttctaactggtgctgccagctttataatggtggcccacctagccatcaatgtttccaaggcccgcaagaagtacaaagtggagtatcctatcatgtacagcacggaccctgaaaatgggcacatcttcaactgcattcagcgagcccaccagaacacgttggaagtgtatcctcccttcttattttttctagctgttggaggtgtttaccacccgcgtatagcttctggcctgggcttggcctggattgttggacgagttctttatgcttatggctattacacgggagaggtgtccaatcgtttggcttccctgggccacactggaagaagaagaattgtcttgggccacacataaaatacactaacattaacgacagtcgatgagctaaaagaaaaaaatattgccaaaaaaaaaaaaaacccacgttttaagaaagtttacaaatttgtgtttggctgcattcaaagctgtcctgggctgcatatggactgtgggctgcggattggacaagcttgctttagagggactatcagaaacttatcttctcccaggcagctcctactgcttaaggtgcataggatccccttggacacagggtaacgctattggctttgtccagtatcacatatgtgtcctctgtgcaaagaaatacca

SEQ ID NO: 153790 - DNA, 1015 bp, Homo sapiens
  Payload ID: 10239
  Gene Symbol: MGST3
  Gene Name: microsomal glutathione S-transferase 3
  Uniprot ID: O14880
  ENST ID: ENST00000367889
  CDS Start-End: 441-899
atgcccgtgcttcgcccttacagcagagcgcctaaaaccgctacggtggctctgctggggacaaattattcacgtcccactgttctgcaaacccaatccgggaggtatgacctggctgggacagtttaggaagatggccacgaaggcacctgggggagtagatatatgtttttgagaatgagaggagtaaatcgctggacgaccatgagcaggaagaaaattaggcctccacctcccaaccagtggccctgagttggcaacttagacagcgcgcgccagcgccaggagccccgccttgggggcgtggccgcgcgctggtcggctggggcggggcctgcttctggcctcatctagccccgccccaggcgagggcgccgcacccacaccgcgctgcgcagttttgttctgctccagctgttcgaaggtgatccagacgcaagatggctgtcctctctaaggaatatggttttgtgcttctaactggtgctgccagctttataatggtggcccacctagccatcaatgtttccaaggcccgcaagaagtacaaagtggagtatcctatcatgtacagcacggaccctgaaaatgggcacatcttcaactgcattcagcgagcccaccagaacacgttggaagtgtatcctcccttcttattttttctagctgttggaggtgtttaccacccgcgtatagcttctggcctgggcttggcctggattgttggacgagttctttatgcttatggctattacacgggagaacccagcaagcgtagtcgaggagccctggggtccatcgccctcctgggcttggtgggcacaactgtgtgctctgctttccagcatcttggttgggttaaaagtggcttgggcagtggacccaaatgctgccattaaagaattataggggtttaaaaactctcattcattttaaatgacttacctttatttccagttacattttttttctaaatataataaaaacttacctggcatcagcctcatacctaaaa

SEQ ID NO: 153791 - DNA, 1130 bp, Homo sapiens
  Payload ID: 10239
  Gene Symbol: MGST3
  Gene Name: microsomal glutathione S-transferase 3
  ENST ID: ENST00000627653
  CDS Start-End: 1-501
atgccctggaggggaaggcgcttccggctctgcagacgcaagatggctgtcctctctaaggaatatggttttgtgcttctaactggtgctgccagctttataatggtggcccacctagccatcaatgtttccaaggcccgcaagaagtacaaagtggagtatcctatcatgtacagcacggaccctgaaaatgggcacatcttcaactgcattcagcgagcccaccagaacacgttggaagtgtatcctcccttcttattttttctagctgttggaggtgtttaccacccgcgtatagcttctggcctgggcttggcctggattgttggacgagttctttatgcttatggctattacacgggagaacccagcaagcgtagtcgaggagccctggggtccatcgccctcctgggcttggtgggcacaactgtgtgctctgctttccagcatcttggttgggttaaaagtggcttgggcagtggacccaaatgctgccattaaagaattataggggtttaaaaactctcattcattttaaatgacttacctttatttccagttacattttttttctaaatataataaaaacttacctggcatcagcctcatacctaaaactcctgactcttaccactcatttccgtttgagtctgtatctgaaatcagtagcctagtcctactagatgagaaaggagccacaagtattgtgccctctcctcacccttccagcagatgcttctgtagtatgtgaggttgagaaaaagtctgattgtggtgatgtaggtatagtcatgccacagtgatgaaaaattaaagaaaaatcttctagctctcaggatatgcattatcacttgctacagatactccaaggccaaaggaatgcttgagcctaaaagttcaagaccagcctgggcaacatagcaaaaccccatctctacaaaaaaatatacaacagttagccaggcatgatggcacatgtctgcagtcccagctacttgggaggctaaggtgggaggatcacttgagcccagggtgtcaaggctgcagtgagttatgatcacactgctgcactccagcgtgggtgacagagcaagaccctgtctcaaataaataaaaattaagtttctatt

SEQ ID NO: 153792 - DNA, 4037 bp, Homo sapiens
  Payload ID: 10240
  Gene Symbol: MTTP
  Gene Name: microsomal triglyceride transfer protein
  Uniprot ID: P55157
  ENST ID: ENST00000265517
  CDS Start-End: 204-2888
acctacgtttaatcattaatagtgagcccttcagtgaacttaggtcctgattttggagtttggagtctgacctttccccaaagataaacatgattgttgcaggttctgaagagggtcactccctcactggctgccattgaaagagtccacttctcagtgactcctagctgggcactggatgcagttgaggattgctggtcaatatgattcttcttgctgtgctttttctctgcttcatttcctcatattcagcttctgttaaaggtcacacaactggtctctcattaaataatgaccggctgtacaagctcacgtactccactgaagttcttcttgatcggggcaaaggaaaactgcaagacagcgtgggctaccgcatttcctccaacgtggatgtggccttactatggaggaatcctgatggtgatgatgaccagttgatccaaataacgatgaaggatgtaaatgttgaaaatgtgaatcagcagagaggagagaagagcatcttcaaaggaaaaagcccatctaaaataatgggaaaggaaaacttggaagctctgcaaagacctacgctccttcatctaatccatggaaaggtcaaagagttctactcatatcaaaatgaggcagtggccatagaaaatatcaagagaggtctggctagcctatttcagacacagttaagctctggaaccaccaatgaggtagatatctctggaaattgtaaagtgacctaccaggctcatcaagacaaagtgatcaaaattaaggccttggattcatgcaaaatagcgaggtctggatttacgaccccaaatcaggtcttgggtgtcagttcaaaagctacatctgtcaccacctataagatagaagacagctttgttatagctgtgcttgctgaagaaacacacaattttggactgaatttcctacaaaccattaaggggaaaatagtatcgaagcagaaattagagctgaagacaaccgaagcaggcccaagattgatgtctggaaagcaggctgcagccataatcaaagcagttgattcaaagtacacggccattcccattgtggggcaggtcttccagagccactgtaaaggatgtccttctctctcggagctctggcggtccaccaggaaatacctgcagcctgacaacctttccaaggctgaggctgtcagaaacttcctggccttcattcagcacctcaggactgcgaagaaagaagagatccttcaaatactaaagatggaaaataaggaagtattacctcagctggtggatgctgtcacctctgctcagacctcagactcattagaagccattttggactttttggatttcaaaagtgacagcagcattatcctccaggagaggtttctctatgcctgtggatttgcttctcatcccaatgaagaactcctgagagccctcattagtaagttcaaaggttctattggtagcagtgacatcagagaaactgttatgatcatcactgggacacttgtcagaaagttgtgtcagaatgaaggctgcaaactcaaagcagtagtggaagctaagaagttaatcctgggaggacttgaaaaagcagagaaaaaagaggacaccaggatgtatctgctggctttgaagaatgccctgcttccagaaggcatcccaagtcttctgaagtatgcagaagcaggagaagggcccatcagccacctggctaccactgctctccagagatatgatctccctttcataactgatgaggtgaagaagaccttaaacagaatataccaccaaaaccgtaaagttcatgaaaagactgtgcgcactgctgcagctgctatcattttaaataacaatccatcctacatggacgtcaagaacatcctgctgtctattggggagcttccccaagaaatgaataaatacatgctcgccattgttcaagacatcctacgttttgaaatgcctgcaagcaaaattgtccgtcgagttctgaaggaaatggtcgctcacaattatgaccgtttctccaggagtggatcttcttctgcctacactggctacatagaacgtagtccccgttcggcatctacttacagcctagacattctctactcgggttctggcattctaaggagaagtaacctgaacatctttcagtacattgggaaggctggtcttcacggtagccaggtggttattgaagcccaaggactggaagccttaatcgcagccacccctgacgagggggaggagaaccttgactcctatgctggtatgtcagccatcctctttgatgttcagctcagacctgtcacctttttcaacggatacagtgatttgatgtccaaaatgctgtcagcatctggcgaccctatcagtgtggtgaaaggacttattctgctaatagatcattctcaggaacttcagttacaatctggactaaaagccaatatagaggtccagggtggtctagctattgatatttcaggtgcaatggagtttagcttgtggtatcgtgagtctaaaacccgagtgaaaaatagggtgactgtggtaataaccactgacatcacagtggactcctcttttgtgaaagctggcctggaaaccagtacagaaacagaagcaggcttggagtttatctccacagtgcagttttctcagtacccattcttagtttgcatgcagatggacaaggatgaagctccattcaggcaatttgagaaaaagtacgaaaggctgtccacaggcagaggttatgtctctcagaaaagaaaagaaagcgtattagcaggatgtgaattcccgctccatcaagagaactcagagatgtgcaaagtggtgtttgcccctcagccggatagtacttccagcggatggttttgaaactgacctgtgatattttacttgaatttgtctccccgaaagggacacaatgtggcatgactaagtacttgctctctgagagcacagcgtttacatatttacctgtatttaagatttttgtaaaaagctacaaaaaactgcagtttgatcaaatttgggtatatgcagtatgctacccacagcgtcattttgaatcatcatgtgacgctttcaacaacgttcttagtttacttatacctctctcaaatctcatttggtacagtcagaatagttattctctaagaggaaactagtgtttgttaaaaacaaaaataaaaacaaaaccacacaaggagaacccaattttgtttcaacaatttttgatcaatgtatatgaagctcttgataggacttccttaagcatgacgggaaaaccaaacacgttccctaatcaggaaaaaaaaaaaaaaaaaaagtaagacacaaacaaaccattttttttctctttttttggagttgggggcccagggagaagggacaagacttttaaaagacttgttagccaacttcaagaattaatatttatgtctctgttattgttagttttaagccttaaggtagaaggcacatagaaataacatctcatctttctgctgaccattttagtgaggttgttccaaagacattcaggtctctacctccagccctgcaaaaatattggacctagcacagaggaatcaggaaaattaatttcagaaactccatttgatttttcttttgctgtgtctttttgagactgtaatatggtacactgtcctctaagggacatcctcattttatctcacctttttgggggtgagagctctagttcatttaactgtactctgcacaatagctaggatgactaagagaacattgcttcaagaaactggtggatttggatttccaaaatatgaaataaggaaaaaaatgtttttatttgtatgaattaaaagatccatgttgaacatttgcaaatatttattaataaacagatgtggtgataaacccaaaacaaatgacaggtccttattttccactaaacacagacacatgaaatgaaagtttagctagcccactatttgttgtaaattgaaaacgaagtgtgataaaataaatatgtagaaatca

SEQ ID NO: 153793 - DNA, 4092 bp, Homo sapiens
  Payload ID: 10240
  Gene Symbol: MTTP
  Gene Name: microsomal triglyceride transfer protein
  Uniprot ID: P55157
  ENST ID: ENST00000457717
  CDS Start-End: 257-2941
tttcgaacccgcaatggaagaaaggggaggggtttatgcggggcggggtctggagttagtgttttgggagtgggaggtagttacagtgatgtctgttttttcccgttcaagaattaagtgtgtacctgcagacgtgtattcattcatatattcttgttctgaagagggtcactccctcactggctgccattgaaagagtccacttctcagtgactcctagctgggcactggatgcagttgaggattgctggtcaatatgattcttcttgctgtgctttttctctgcttcatttcctcatattcagcttctgttaaaggtcacacaactggtctctcattaaataatgaccggctgtacaagctcacgtactccactgaagttcttcttgatcggggcaaaggaaaactgcaagacagcgtgggctaccgcatttcctccaacgtggatgtggccttactatggaggaatcctgatggtgatgatgaccagttgatccaaataacgatgaaggatgtaaatgttgaaaatgtgaatcagcagagaggagagaagagcatcttcaaaggaaaaagcccatctaaaataatgggaaaggaaaacttggaagctctgcaaagacctacgctccttcatctaatccatggaaaggtcaaagagttctactcatatcaaaatgaggcagtggccatagaaaatatcaagagaggtctggctagcctatttcagacacagttaagctctggaaccaccaatgaggtagatatctctggaaattgtaaagtgacctaccaggctcatcaagacaaagtgatcaaaattaaggccttggattcatgcaaaatagcgaggtctggatttacgaccccaaatcaggtcttgggtgtcagttcaaaagctacatctgtcaccacctataagatagaagacagctttgttatagctgtgcttgctgaagaaacacacaattttggactgaatttcctacaaaccattaaggggaaaatagtatcgaagcagaaattagagctgaagacaaccgaagcaggcccaagattgatgtctggaaagcaggctgcagccataatcaaagcagttgattcaaagtacacggccattcccattgtggggcaggtcttccagagccactgtaaaggatgtccttctctctcggagctctggcggtccaccaggaaatacctgcagcctgacaacctttccaaggctgaggctgtcagaaacttcctggccttcattcagcacctcaggactgcgaagaaagaagagatccttcaaatactaaagatggaaaataaggaagtattacctcagctggtggatgctgtcacctctgctcagacctcagactcattagaagccattttggactttttggatttcaaaagtgacagcagcattatcctccaggagaggtttctctatgcctgtggatttgcttctcatcccaatgaagaactcctgagagccctcattagtaagttcaaaggttctattggtagcagtgacatcagagaaactgttatgatcatcactgggacacttgtcagaaagttgtgtcagaatgaaggctgcaaactcaaagcagtagtggaagctaagaagttaatcctgggaggacttgaaaaagcagagaaaaaagaggacaccaggatgtatctgctggctttgaagaatgccctgcttccagaaggcatcccaagtcttctgaagtatgcagaagcaggagaagggcccatcagccacctggctaccactgctctccagagatatgatctccctttcataactgatgaggtgaagaagaccttaaacagaatataccaccaaaaccgtaaagttcatgaaaagactgtgcgcactgctgcagctgctatcattttaaataacaatccatcctacatggacgtcaagaacatcctgctgtctattggggagcttccccaagaaatgaataaatacatgctcgccattgttcaagacatcctacgttttgaaatgcctgcaagcaaaattgtccgtcgagttctgaaggaaatggtcgctcacaattatgaccgtttctccaggagtggatcttcttctgcctacactggctacatagaacgtagtccccgttcggcatctacttacagcctagacattctctactcgggttctggcattctaaggagaagtaacctgaacatctttcagtacattgggaaggctggtcttcacggtagccaggtggttattgaagcccaaggactggaagccttaatcgcagccacccctgacgagggggaggagaaccttgactcctatgctggtatgtcagccatcctctttgatgttcagctcagacctgtcacctttttcaacggatacagtgatttgatgtccaaaatgctgtcagcatctggcgaccctatcagtgtggtgaaaggacttattctgctaatagatcattctcaggaacttcagttacaatctggactaaaagccaatatagaggtccagggtggtctagctattgatatttcaggtgcaatggagtttagcttgtggtatcgtgagtctaaaacccgagtgaaaaatagggtgactgtggtaataaccactgacatcacagtggactcctcttttgtgaaagctggcctggaaaccagtacagaaacagaagcaggcttggagtttatctccacagtgcagttttctcagtacccattcttagtttgcatgcagatggacaaggatgaagctccattcaggcaatttgagaaaaagtacgaaaggctgtccacaggcagaggttatgtctctcagaaaagaaaagaaagcgtattagcaggatgtgaattcccgctccatcaagagaactcagagatgtgcaaagtggtgtttgcccctcagccggatagtacttccagcggatggttttgaaactgacctgtgatattttacttgaatttgtctccccgaaagggacacaatgtggcatgactaagtacttgctctctgagagcacagcgtttacatatttacctgtatttaagatttttgtaaaaagctacaaaaaactgcagtttgatcaaatttgggtatatgcagtatgctacccacagcgtcattttgaatcatcatgtgacgctttcaacaacgttcttagtttacttatacctctctcaaatctcatttggtacagtcagaatagttattctctaagaggaaactagtgtttgttaaaaacaaaaataaaaacaaaaccacacaaggagaacccaattttgtttcaacaatttttgatcaatgtatatgaagctcttgataggacttccttaagcatgacgggaaaaccaaacacgttccctaatcaggaaaaaaaaaaaaaaaaaaagtaagacacaaacaaaccattttttttctctttttttggagttgggggcccagggagaagggacaagacttttaaaagacttgttagccaacttcaagaattaatatttatgtctctgttattgttagttttaagccttaaggtagaaggcacatagaaataacatctcatctttctgctgaccattttagtgaggttgttccaaagacattcaggtctctacctccagccctgcaaaaatattggacctagcacagaggaatcaggaaaattaatttcagaaactccatttgatttttcttttgctgtgtctttttgagactgtaatatggtacactgtcctctaagggacatcctcattttatctcacctttttgggggtgagagctctagttcatttaactgtactctgcacaatagctaggatgactaagagaacattgcttcaagaaactggtggatttggatttccaaaatatgaaataaggaaaaaaatgtttttatttgtatgaattaaaagatccatgttgaacatttgcaaatatttattaataaacagatgtggtgataaacccaaaacaaatgacaggtccttattttccactaaacacagacacatgaaatgaaagtttagctagcccactatttgttgtaaattgaaaacgaagtgtgataaaataaatatgtagaaatcata

SEQ ID NO: 153794 - DNA, 1155 bp, Homo sapiens
  Payload ID: 10240
  Gene Symbol: MTTP
  Gene Name: microsomal triglyceride transfer protein
  Uniprot ID: P55157
  ENST ID: ENST00000422897
  CDS Start-End: 87-542
actccctcactggctgccattgaaagagtccacttctcagtgactcctagctgggcactggatgcagttgaggattgctggtcaatatgattcttcttgctgtgctttttctctgcttcatttcctcatattcagcttctgttaaaggtcacacaactggtctctcattaaataatgaccggctgtacaagctcacgtactccactgaagttcttcttgatcggggcaaaggaaaactgcaagacagcgtgggctaccgcatttcctccaacgtggatgtggccttactatggaggaatcctgatggtgatgatgaccagttgatccaaataacgatgaaggatgtaaatgttgaaaatgtgaatcagcagagaggagagaagagcatcttcaaaggaaaaagcccatctaaaataatgggaaaggaaaacttggaagctctgcaaagacctacgctccttcatctaatccatggaaaggtaaaggggcgtttagattccacaactttttctccaacttcatatttttcttcccttcagtagatattattttgaggtaatcacattgtaactacttttatggtaaatggaatttcttcaagaactaaagaacagaggttgtaaattaaatgtttccaaactgaatcaatgccctgagttcccttacatttactagccaatttgtttcctatttttctggaaatctttatagtggaatgaagtatttatttattgatgaaaggcattattaaaaggtaaatttctcatcaaattataagggattacaaacgtaatgtaacaaagcaagtcatcaaagcatgattggatgaattcaggaaaggagacaaattatgagactgaaatgatccaactgagattagtaatattgatttgttatgagattatcgatatctggctaaagtacaaggttaaagattttaaaagggtatgacaagtctaaagtagagtttttttaaagcctttagaaattattttaaaactatgacatggaaaagccttttatatattaaaataatgattgaacactttataatatatatttgaaaatctgttttaaaaattctatgtgtgcattacttatggcttgattctagtcaattgaaatggtctaaataaatttggaattgagaaacaa

SEQ ID NO: 153795 - DNA, 551 bp, Homo sapiens
  Payload ID: 10240
  Gene Symbol: MTTP
  Gene Name: microsomal triglyceride transfer protein
  ENST ID: ENST00000511610
  CDS Start-End: 14-232
tttcgaacccgcaatggaagaaaggggaggggtttatgcggggcggggtctggagttagtgttttgggagtgggaggtagttacagtgatgtctgttttttcccgttcaagaattaagtgtgtacctgcagacgtgtattcattcatatattcttgcaggcccagtataatcacaaggattcataaaacggaagagggagacagaagagatggtcagagtgatatgaagtaaaaaggattcagcttactcttgctggatttgtaaatgcaggaagggaccacgagtcaaggaatgcaggtagcttctagaagctagaaaaggttctgaagagggtcactccctcactggctgccattgaaagagtccacttctcagtgactcctagctgggcactggatgcagttgaggattgctggtcaatatgattcttcttgctgtgctttttctctgcttcatttcctcatattcagcttctgttaaaggtcacacaactggtctctcattaaataatgaccggctgtacaagctcacgtactccactgaagttctt

SEQ ID NO: 153796 - DNA, 555 bp, Homo sapiens
  Payload ID: 10240
  Gene Symbol: MTTP
  Gene Name: microsomal triglyceride transfer protein
  ENST ID: ENST00000504724
  CDS Start-End: 14-184
tttcgaacccgcaatggaagaaaggggaggggtttatgcggggcggggtctggagttagtgttttgggagtgggaggtagttacagtgatgtctgttttttcccgttcaagaattaagtgtgtacctgcagacgtgtattcattcatatattcttgtgagtattggatgaaggaattaagatagtcccactgttaaaaatgcaaaacaacgaagaaaggctcctaatttttctgtgttgaaaatgagagaaaaacatctcttgcctatattatttttaatttatacagaaaattaccatatcacatgattttacataactcaagtggaaaattaaattcaaaaagcaggcccagtataatcacaaggattcataaaacggaagagggagacagaagagatggtcagagtgatatgaagtaaaaaggattcagcttactcttgctggatttgtaaatgcaggaagggaccacgagtcaaggaatgcaggtagcttctagaagctagaaaaggttctgaagagggtcactccctcactggctgccattgaaagagtc

SEQ ID NO: 153797 - DNA, 554 bp, Homo sapiens
  Payload ID: 10240
  Gene Symbol: MTTP
  Gene Name: microsomal triglyceride transfer protein
  ENST ID: ENST00000505094
  CDS Start-End: 14-166
tttcgaacccgcaatggaagaaaggggaggggtttatgcggggcggggtctggagttagtgttttgggagtgggaggtagttacagtgatgtctgttttttcccgttcaagaattaagtgtgtacctgcagacgtgtattcattcatatattcttgcccagtataatcacaaggattcataaaacggaagagggagacagaagagatggtcagagtgatatgaagtaaaaaggattcagcttactcttgctggatttgtaaatgcaggaagggaccacgagtcaaggaatgcaggtagcttctagaagctagaaaaggtcacacaactggtctctcattaaataatgaccggctgtacaagctcacgtactccactgaagttcttcttgatcggggcaaaggaaaactgcaagacagcgtgggctaccgcatttcctccaacgtggatgtggccttactatggaggaatcctgatggtgatgatgaccagttgatccaaataacgatgaaggatgtaaatgttgaaaatgtgaatcagcagagaggagagaaga

SEQ ID NO: 153798 - DNA, 564 bp, Homo sapiens
  Payload ID: 10240
  Gene Symbol: MTTP
  Gene Name: microsomal triglyceride transfer protein
  ENST ID: ENST00000513404
  CDS Start-End: 81-209
agcaagagcgccgcaggaaaccacttccacaccactgctcccctctcccccggaagcccttgttgctagtagggggctgcatggcacgcgcccctttgcgtccagagaataccatagtgcgggggagcgccaaccagtgccaggacacttaccgagctgaagagttgacaggttctgaagagggtcactccctcactggctgccattgaaagagtccacttctcagtgactcctagctgggcactggatgcagttgaggattgctggtcaatatgattcttcttgctgtgctttttctctgcttcatttcctcatattcagcttctgttaaaggtcacacaactggtctctcattaaataatgaccggctgtacaagctcacgtactccactgaagttcttcttgatcggggcaaaggaaaactgcaagacagcgtgggctaccgcatttcctccaacgtggatgtggccttactatggaggaatcctgatggtgatgatgaccagttgatccaaataacgatgaaggatgtaaatgttgaaaatgtgaatcagcagagaggag

SEQ ID NO: 153799 - DNA, 608 bp, Homo sapiens
  Payload ID: 10240
  Gene Symbol: MTTP
  Gene Name: microsomal triglyceride transfer protein
  ENST ID: ENST00000515141
  CDS Start-End: 16-195
catttcgaacccgcaatggaagaaaggggaggggtttatgcggggcggggtctggagttagtgttttgggagtgggaggtagttacagtgatgtctgttttttcccgttcaagaattaagtgtgtacctgcagacgtgtattcattcatatattcttgttctgaagagggtcactccctcactggctgccattgaaagagtccacttctcagtgactcctagctgggcactggatgcagttgaggattgctggtcaatatgattcttcttgctgtgctttttctctgcttcatttcctcatattcagcttctgttaaaggtcacacaactggtctctcattaaataatgaccggctgtacaagctcacgtactccactgaagttcttcttgatcggggcaaaggaaaactgcaagacagcgtgggctaccgcatttcctccaacgtggatgtggccttactatggaggaatcctgatggtgatgatgaccagttgatccaaataacgatgaaggatgtaaatgttgaaaatgtgaatcagcagagaggagagaagagcatcttcaaaggaaaaagcccatctaaaataatgggaaaggaaaacttgga

SEQ ID NO: 153800 - DNA, 537 bp, Homo sapiens
  Payload ID: 10240
  Gene Symbol: MTTP
  Gene Name: microsomal triglyceride transfer protein
  ENST ID: ENST00000505142
  CDS Start-End: 17-184
gctagtagggggctgcatggcacgcgcccctttgcgtccagagaataccatagtgcgggggagcgccaaccagtgccaggacacttaccgagctgaagagttgacaggcaggcccagtataatcacaaggattcataaaacggaagagggagacagaagagatggtcagagtgatatgaagtaaaaaggattcagcttactcttgctggatttgtaaatgcaggaagggaccacgagtcaaggaatgcaggtagcttctagaagctagaaaaggttctgaagagggtcactccctcactggctgccattgaaagagtccacttctcagtgactcctagctgggcactggatgcagttgaggattgctggtcaatatgattcttcttgctgtgctttttctctgcttcatttcctcatattcagcttctgttaaaggtcacacaactggtctctcattaaataatgaccggctgtacaagctcacgtactccactgaagttcttcttgatcggggcaaaggaaaactgcaagacagcg

SEQ ID NO: 153801 - DNA, 549 bp, Homo sapiens
  Payload ID: 10240
  Gene Symbol: MTTP
  Gene Name: microsomal triglyceride transfer protein
  ENST ID: ENST00000506883
  CDS Start-End: 14-549
agtagggggctgcatggcacgcgcccctttgcgtccagagaataccatagtgcgggggagcgccaaccagtgccaggacacttaccgagctgaagagttgacaggtcacacaactggtctctcattaaataatgaccggctgtacaagctcacgtactccactgaagttcttcttgatcggggcaaaggaaaactgcaagacagcgtgggctaccgcatttcctccaacgtggatgtggccttactatggaggaatcctgatggtgatgatgaccagttgatccaaataacgatgaaggatgtaaatgttgaaaatgtgaatcagcagagaggagagaagagcatcttcaaaggaaaaagcccatctaaaataatgggaaaggaaaacttggaagctctgcaaagacctacgctccttcatctaatccatggaaaggtcaaagagttctactcatatcaaaatgaggcagtggccatagaaaatatcaagagaggtctggctagcctatttcagacacagttaagctctggaaccaccaatgaggtaga

SEQ ID NO: 153802 - DNA, 3154 bp, Homo sapiens
  Payload ID: 10240
  Gene Symbol: MTTP
  Gene Name: microsomal triglyceride transfer protein
  ENST ID: ENST00000511045
  CDS Start-End: 14-2779
tttcgaacccgcaatggaagaaaggggaggggtttatgcggggcggggtctggagttagtgttttgggagtgggaggtagttacagtgatgtctgttttttcccgttcaagaattaagtgtgtacctgcagacgtgtattcattcatatattcttgtcacacaactggtctctcattaaataatgaccggctgtacaagctcacgtactccactgaagttcttcttgatcggggcaaaggaaaactgcaagacagcgtgggctaccgcatttcctccaacgtggatgtggccttactatggaggaatcctgatggtgatgatgaccagttgatccaaataacgatgaaggatgtaaatgttgaaaatgtgaatcagcagagaggagagaagagcatcttcaaaggaaaaagcccatctaaaataatgggaaaggaaaacttggaagctctgcaaagacctacgctccttcatctaatccatggaaaggtcaaagagttctactcatatcaaaatgaggcagtggccatagaaaatatcaagagaggtctggctagcctatttcagacacagttaagctctggaaccaccaatgaggtagatatctctggaaattgtaaagtgacctaccaggctcatcaagacaaagtgatcaaaattaaggccttggattcatgcaaaatagcgaggtctggatttacgaccccaaatcaggtcttgggtgtcagttcaaaagctacatctgtcaccacctataagatagaagacagctttgttatagctgtgcttgctgaagaaacacacaattttggactgaatttcctacaaaccattaaggggaaaatagtatcgaagcagaaattagagctgaagacaaccgaagcaggcccaagattgatgtctggaaagcaggctgcagccataatcaaagcagttgattcaaagtacacggccattcccattgtggggcaggtcttccagagccactgtaaaggatgtccttctctctcggagctctggcggtccaccaggaaatacctgcagcctgacaacctttccaaggctgaggctgtcagaaacttcctggccttcattcagcacctcaggactgcgaagaaagaagagatccttcaaatactaaagatggaaaataaggaagtattacctcagctggtggatgctgtcacctctgctcagacctcagactcattagaagccattttggactttttggatttcaaaagtgacagcagcattatcctccaggagaggtttctctatgcctgtggatttgcttctcatcccaatgaagaactcctgagagccctcattagtaagttcaaaggttctattggtagcagtgacatcagagaaactgttatgatcatcactgggacacttgtcagaaagttgtgtcagaatgaaggctgcaaactcaaagcagtagtggaagctaagaagttaatcctgggaggacttgaaaaagcagagaaaaaagaggacaccaggatgtatctgctggctttgaagaatgccctgcttccagaaggcatcccaagtcttctgaagtatgcagaagcaggagaagggcccatcagccacctggctaccactgctctccagagatatgatctccctttcataactgatgaggtgaagaagaccttaaacagaatataccaccaaaaccgtaaagttcatgaaaagactgtgcgcactgctgcagctgctatcattttaaataacaatccatcctacatggacgtcaagaacatcctgctgtctattggggagcttccccaagaaatgaataaatacatgctcgccattgttcaagacatcctacgttttgaaatgcctgcaagcaaaattgtccgtcgagttctgaaggaaatggtcgctcacaattatgaccgtttctccaggagtggatcttcttctgcctacactggctacatagaacgtagtccccgttcggcatctacttacagcctagacattctctactcgggttctggcattctaaggagaagtaacctgaacatctttcagtacattgggaaggctggtcttcacggtagccaggtggttattgaagcccaaggactggaagccttaatcgcagccacccctgacgagggggaggagaaccttgactcctatgctggtatgtcagccatcctctttgatgttcagctcagacctgtcacctttttcaacggatacagtgatttgatgtccaaaatgctgtcagcatctggcgaccctatcagtgtggtgaaaggacttattctgctaatagatcattctcaggaacttcagttacaatctggactaaaagccaatatagaggtccagggtggtctagctattgatatttcaggtgcaatggagtttagcttgtggtatcgtgagtctaaaacccgagtgaaaaatagggtgactgtggtaataaccactgacatcacagtggactcctcttttgtgaaagctggcctggaaaccagtacagaaacagaagcaggcttggagtttatctccacagtgcagttttctcagtacccattcttagtttgcatgcagatggacaaggatgaagctccattcaggcaatttgagaaaaagtacgaaaggctgtccacaggcagaggttatgtctctcagaaaagaaaagaaagcgtattagcaggatgtgaattcccgctccatcaagagaactcagagatgtgcaaagtggtgtttgcccctcagccggatagtacttccagcggatggttttgaaactgacctgtgatattttacttgaatttgtctccccgaaagggacacaatgtggcatgactaagtacttgctctctgagagcacagcgtttacatatttacctgtatttaagatttttgtaaaaagctacaaaaaactgcagtttgatcaaatttgggtatatgcagtatgctacccacagcgtcattttgaatcatcatgtgacgctttcaacaacgttcttagtttacttatacctctctcaaatctcatttggtacagtcagaatagttattctctaagaggaaactagtgtttgttaaaaacaaaaataaaaacaaaaccacacaaggagaacccaattttgtttcaacaatttttgatcaatgtatatg

SEQ ID NO: 153803 - DNA, 3855 bp, Homo sapiens
  Payload ID: 10240
  Gene Symbol: MTTP
  Gene Name: microsomal triglyceride transfer protein
  ENST ID: ENST00000619629
  CDS Start-End: 25-1575
tgcagttgaggattgctggtcaatatgattcttcttgctgtgctttttctctgcttcatttcctcatattcagcttctgttaaaggtcacacaactggtctctcattaaataatgaccggctgtacaagctcacgtactccactgaagttcttcttgatcggggcaaaggaaaactgcaagacagcgtgggctaccgcatttcctccaacgtggatgtggccttactatggaggaatcctgatggtgatgatgaccagttgatccaaataacgatgaaggatgtaaatgttgaaaatgtgaatcagcagagaggagagaagagcatcttcaaaggaaaaagcccatctaaaataatgggaaaggaaaacttggaagctctgcaaagacctacgctccttcatctaatccatggaaaggtcaaagagttctactcatatcaaaatgaggcagtggccatagaaaatatcaagagaggtctggctagcctatttcagacacagttaagctctggaaccaccaatgaggtagatatctctggaaattgtaaagtgacctaccaggctcatcaagacaaagtgatcaaaattaaggccttggattcatgcaaaatagcgaggtctggatttacgaccccaaatcaggtcttgggtgtcagttcaaaagctacatctgtcaccacctataagatagaagacagctttgttatagctgtgcttgctgaagaaacacacaattttggactgaatttcctacaaaccattaaggggaaaatagtatcgaagcagaaattagagctgaagacaaccgaagcaggcccaagattgatgtctggaaagcaggctgcagccataatcaaagcagttgattcaaagtacacggccattcccattgtggggcaggtcttccagagccactgtaaaggatgtccttctctctcggagctctggcggtccaccaggaaatacctgcagcctgacaacctttccaaggctgaggctgtcagaaacttcctggccttcattcagcacctcaggactgcgaagaaagaagagatccttcaaatactaaagatggaaaataaggaagtattacctcagctggtggatgctgtcacctctgctcagacctcagactcattagaagccattttggactttttggatttcaaaagtgacagcagcattatcctccaggagaggtttctctatgcctgtggatttgcttctcatcccaatgaagaactcctgagagccctcattagtaagttcaaaggttctattggtagcagtgacatcagagaaactgttatgatcatcactgggacacttgtcagaaagttgtgtcagaatgaaggctgcaaactcaaagcagtagtggaagctaagaagttaatcctgggaggacttgaaaaagcagagaaaaaagaggacaccaggatgtatctgctggctttgaagaatgccctgcttccagaaggcatcccaagtcttctgaagtatgcagaagcaggagaagggcccatcagccacctggctaccactgctctccagagatatgatctctttcataactgatgaggtgaagaagaccttaaacagaatataccaccaaaaccgtaaagttcatgaaaagactgtgcgcactgctgcagctgctatcattttaaataacaatccatcctacatggacgtcaagaacatcctgctgtctattggggagcttccccaagaaatgaataaatacatgctcgccattgttcaagacatcctacgttttgaaatgcctgcaagcaaaattgtccgtcgagttctgaaggaaatggtcgctcacaattatgaccgtttctccaggagtggatcttcttctgcctacactggctacatagaacgtagtccccgttcggcatctacttacagcctagacattctctactcgggttctggcattctaaggagaagtaacctgaacatctttcagtacattgggaaggctggtcttcacggtagccaggtggttattgaagcccaaggactggaagccttaatcgcagccacccctgacgagggggaggagaaccttgactcctatgctggtatgtcagccatcctctttgatgttcagctcagacctgtcacctttttcaacggatacagtgatttgatgtccaaaatgctgtcagcatctggcgaccctatcagtgtggtgaaaggacttattctgctaatagatcattctcaggaacttcagttacaatctggactaaaagccaatatagaggtccagggtggtctagctattgatatttcaggtgcaatggagtttagcttgtggtatcgtgagtctaaaacccgagtgaaaaatagggtgactgtggtaataaccactgacatcacagtggactcctcttttgtgaaagctggcctggaaaccagtacagaaacagaagcaggcttggagtttatctccacagtgcagttttctcagtacccattcttagtttgcatgcagatggacaaggatgaagctccattcaggcaatttgagaaaaagtacgaaaggctgtccacaggcagaggttatgtctctcagaaaagaaaagaaagcgtattagcaggatgtgaattcccgctccatcaagagaactcagagatgtgcaaagtggtgtttgcccctcagccggatagtacttccagcggatggttttgaaactgacctgtgatattttacttgaatttgtctccccgaaagggacacaatgtggcatgactaagtacttgctctctgagagcacagcgtttacatatttacctgtatttaagatttttgtaaaaagctacaaaaaactgcagtttgatcaaatttgggtatatgcagtatgctacccacagcgtcattttgaatcatcatgtgacgctttcaacaacgttcttagtttacttatacctctctcaaatctcatttggtacagtcagaatagttattctctaagaggaaactagtgtttgttaaaaacaaaaataaaaacaaaaccacacaaggagaacccaattttgtttcaacaatttttgatcaatgtatatgaagctcttgataggacttccttaagcatgacgggaaaaccaaacacgttccctaatcaggaaaaaaaaaaaaaaaaaaagtaagacacaaacaaaccattttttttctctttttttggagttgggggcccagggagaagggacaagacttttaaaagacttgttagccaacttcaagaattaatatttatgtctctgttattgttagttttaagccttaaggtagaaggcacatagaaataacatctcatctttctgctgaccattttagtgaggttgttccaaagacattcaggtctctacctccagccctgcaaaaatattggacctagcacagaggaatcaggaaaattaatttcagaaactccatttgatttttcttttgctgtgtctttttgagactgtaatatggtacactgtcctctaagggacatcctcattttatctcacctttttgggggtgagagctctagttcatttaactgtactctgcacaatagctaggatgactaagagaacattgcttcaagaaactggtggatttggatttccaaaatatgaaataaggaaaaaaatgtttttatttgtatgaattaaaagatccatgttgaacatttgcaaatatttattaataaacagatgtggtgataaacccaaaacaaatgacaggtccttattttccactaaacacagacacatgaaatgaaagtttagctagcccactatttgttgtaaattgaaaacgaagtgtgataaaataaatatgtagaaatc

SEQ ID NO: 153804 - DNA, 1928 bp, Homo sapiens
  Payload ID: 10241
  Gene Symbol: MCRS1
  Gene Name: microspherule protein 1
  Uniprot ID: Q96EZ8
  ENST ID: ENST00000343810
  CDS Start-End: 217-1605
cctggttcgttaaccggaagtagacgtacctcacggaagccggctttggccctgcggctgctaccgtcgccgcggagaaattgttggatctggcagtctaggaatgaatctcctctcagcctttaagctcacctggtcagaatccttggatgagcctgtgggaccgttcctcctagcccggtggtttggaaccagtggctttgggactgtaagaggatggacaaagattctcaggggctgctagattcatccctgatggcatcaggcactgccagccgctcagaggatgaggagtcactggcagggcagaagcgagcctcctcccaggccttgggcaccatccctaaacggagaagctcctccaggttcatcaagaggaagaagttcgatgatgagctggtggagagcagcctggcaaaatcttctacccgggcaaagggggccagtggggtggaaccagggcgctgttcggggagtgaaccctcctccagtgagaagaagaaggtatccaaagcccccagcactcctgtgccacccagcccagccccagcccctggactcaccaagcgtgtgaagaagagtaaacagccacttcaggtgaccaaggatctgggccgctggaagcctgcagatgacctcctgctcataaatgctgtgttgcagaccaacgacctgacctccgtccacctgggcgtgaaattcagctgccgcttcacccttcgggaggtccaggagcgttggtacgccctgctctacgatcctgtcatctccaagttggcctgtcaggccatgaggcagctgcacccagaggctattgcagccatccagagcaaggccctgtttagcaaggctgaggagcagctgctgagcaaagtgggatcgaccagccagcccaccttggagaccttccaggacctgctgcacagacaccctgatgccttctacctggcccgtaccgcgaaggccctgcaggcccactggcagctcatgaagcagtattacctgctggaggaccagacagtgcagccgctgcccaaaggggaccaagtgctgaacttctctgatgcagaggacctgattgatgacagtaagctcaaggacatgcgagatgaggtcctggaacatgagctgatggtggctgaccggcgccagaagcgagagattcggcagctggaacaggaactgcataagtggcaggtgctagtggacagcatcacaggcatgagctctccggacttcgacaaccagacactggcagtgctgcggggccgcatggtgcggtacctgatgcgctcgcgtgagatcaccctgggcagagcaaccaaggataaccagattgatgtggacctgtctctggagggtccggcctggaagatatcccggaaacaaggtgtcatcaagctgaagaacaacggtgatttcttcattgccaatgagggtcgacggcccatctacatcgatggacggccggtgctctgtggctccaaatggcgcctcagcaacaactctgtggtggagatcgccagcctgcgattcgtcttccttatcaaccaggacctcattgccctcatcagggctgaggctgccaagatcacaccacagtgaggagtggtggcaggactcgtgggccctctccggcctgtttcccctgccactccagcccccttgagctgggaactcaggctcctggaaaaacctgggcagtgggaggctcagctgcgggccattgatttgagcctttgagggaggatagggctggcctttgtgaagccagcagaggctgagaacctcaggcttccctagatccagagcccctccccatcttcctctctctaaaaacaaccctaccccccattgccaccttcactcctgtgtctccagctgattagcctcagactcttcttttattgtttttcttttgtaaataa

SEQ ID NO: 153805 - DNA, 1428 bp, Homo sapiens
  Payload ID: 10241
  Gene Symbol: MCRS1
  Gene Name: microspherule protein 1
  Uniprot ID: Q96EZ8
  ENST ID: ENST00000357123
  CDS Start-End: 1-1428
atgacacgtggcaccgggggaactgcccagcgtggaaggtctgggccagattctcaggggctgctagattcatccctgatggcatcaggcactgccagccgctcagaggatgaggagtcactggcagggcagaagcgagcctcctcccaggccttgggcaccatccctaaacggagaagctcctccaggttcatcaagaggaagaagttcgatgatgagctggtggagagcagcctggcaaaatcttctacccgggcaaagggggccagtggggtggaaccagggcgctgttcggggagtgaaccctcctccagtgagaagaagaaggtatccaaagcccccagcactcctgtgccacccagcccagccccagcccctggactcaccaagcgtgtgaagaagagtaaacagccacttcaggtgaccaaggatctgggccgctggaagcctgcagatgacctcctgctcataaatgctgtgttgcagaccaacgacctgacctccgtccacctgggcgtgaaattcagctgccgcttcacccttcgggaggtccaggagcgttggtacgccctgctctacgatcctgtcatctccaagttggcctgtcaggccatgaggcagctgcacccagaggctattgcagccatccagagcaaggccctgtttagcaaggctgaggagcagctgctgagcaaagtgggatcgaccagccagcccaccttggagaccttccaggacctgctgcacagacaccctgatgccttctacctggcccgtaccgcgaaggccctgcaggcccactggcagctcatgaagcagtattacctgctggaggaccagacagtgcagccgctgcccaaaggggaccaagtgctgaacttctctgatgcagaggacctgattgatgacagtaagctcaaggacatgcgagatgaggtcctggaacatgagctgatggtggctgaccggcgccagaagcgagagattcggcagctggaacaggaactgcataagtggcaggtgctagtggacagcatcacaggcatgagctctccggacttcgacaaccagacactggcagtgctgcggggccgcatggtgcggtacctgatgcgctcgcgtgagatcaccctgggcagagcaaccaaggataaccagattgatgtggacctgtctctggagggtccggcctggaagatatcccggaaacaaggtgtcatcaagctgaagaacaacggtgatttcttcattgccaatgagggtcgacggcccatctacatcgatggacggccggtgctctgtggctccaaatggcgcctcagcaacaactctgtggtggagatcgccagcctgcgattcgtcttccttatcaaccaggacctcattgccctcatcagggctgaggctgccaagatcacaccacagtga

SEQ ID NO: 153806 - DNA, 1686 bp, Homo sapiens
  Payload ID: 10241
  Gene Symbol: MCRS1
  Gene Name: microspherule protein 1
  Uniprot ID: Q96EZ8
  ENST ID: ENST00000546244
  CDS Start-End: 523-1338
gttaaccggaagtagacgtacctcacggaagccggctttggccctgcggctgctaccgtcgccgcggagaaattgttggatctggcagtctaggaatggttcatcaagaggaagaagttcgatgatgagctggtggagagcagcctggcaaaatcttctacccgggcaaagggggccagtggggtggaaccagggcgctgttcggggagtgaaccctcctccagtgagaagaagaaggtatccaaagcccccagcactcctgtgccacccagcccagccccagcccctggactcaccaagcgtgtgaagaagagtaaacagccacttcaggtgaccaaggatctgggccgctggaagcctgcagatgacctcctgctcataaatgctgtgttgcagaccaacgacctgacctccgtccacctgggcgtgaaattcagctgccgcttcacccttcgggaggtccaggagcgttggtacgccctgctctacgatcctgtcatctccaagttggcctgtcaggccatgaggcagctgcacccagaggctattgcagccatccagagcaaggccctgtttagcaaggctgaggagcagctgctgagcaaagtgggatcgaccagccagcccaccttggagaccttccaggacctgctgcacagacaccctgatgccttctacctggcccgtaccgcgaaggccctgcaggcccactggcagctcatgaagcagtattacctgctggaggaccagacagtgcagccgctgcccaaaggggaccaagtgctgaacttctctgatgcagaggacctgattgatgacagtaagctcaaggacatgcgagatgaggtcctggaacatgagctgatggtggctgaccggcgccagaagcgagagattcggcagctggaacaggaactgcataagtggcaggtgctagtggacagcatcacaggcatgagctctccggacttcgacaaccagacactggcagtgctgcggggccgcatggtgcggtacctgatgcgctcgcgtgagatcaccctgggcagagcaaccaaggataaccagattgatgtggacctgtctctggagggtccggcctggaagatatcccggaaacaaggtgtcatcaagctgaagaacaacggtgatttcttcattgccaatgagggtcgacggcccatctacatcgatggacggccggtgctctgtggctccaaatggcgcctcagcaacaactctgtggtggagatcgccagcctgcgattcgtcttccttatcaaccaggacctcattgccctcatcagggctgaggctgccaagatcacaccacagtgaggagtggtggcaggactcgtgggccctctccggcctgtttcccctgccactccagcccccttgagctgggaactcaggctcctggaaaaacctgggcagtgggaggctcagctgcgggccattgatttgagcctttgagggaggatagggctggcctttgtgaagccagcagaggctgagaacctcaggcttccctagatccagagcccctccccatcttcctctctctaaaaacaaccctaccccccattgccaccttcactcctgtgtctccagctgattagcctcagactcttcttttattgtttttcttttgtaaataaaaagcaccaggttccaaagtagttt

SEQ ID NO: 153807 - DNA, 1037 bp, Homo sapiens
  Payload ID: 10241
  Gene Symbol: MCRS1
  Gene Name: microspherule protein 1
  ENST ID: ENST00000553173
  CDS Start-End: 83-1037
gcggctgctaccgtcgccgcggagaaattgttggatctggcagtctaggaatgattctcaggggctgctagattcatccctgatggcatcaggcactgccagccgctcagaggatgaggagtcactggcagggcagaagcgagcctcctcccaggccttgggcaccatccctaaacggagaagctcctccaggttcatcaagaggaagaagttcgatgatgagctggtggagagcagcctggcaaaatcttctacccgggcaaagggggccagtggggtggaaccagggcgctgttcggggagtgaaccctcctccagtgagaagaagaaggtatccaaagcccccagcactcctgtgccacccagcccagccccagcccctggactcaccaagcgtgtgaagaagagtaaacagccacttcaggtgaccaaggatctgggccgctggaagcctgcagatgacctcctgctcataaatgctgtgttgcagaccaacgacctgacctccgtccacctgggcgtgaaattcagctgccgcttcacccttcgggaggtccaggagcgttggtacgccctgctctacgatcctgtcatctccaagttggcctgtcaggccatgaggcagctgcacccagaggctattgcagccatccagagcaaggccctgtttagcaaggctgaggagcagctgctgagcaaagtgggatcgaccagccagcccaccttggagaccttccaggacctgctgcacagacaccctgatgccttctacctggcccgtaccgcgaaggccctgcaggcccactggcagctcatgaagcagtattacctgctggaggaccagacagtgcagccgctgcccaaaggggaccaagtgctgaacttctctgatgcagaggacctgattgatgacagtaagctcaaggacatgcgagatgaggtcctggaacatgagctgatggtggctgaccggcgccagaagcgagagattcggcagctggaacaggaactgcataagtggcaggtgctagtggaca

SEQ ID NO: 153808 - DNA, 646 bp, Homo sapiens
  Payload ID: 10241
  Gene Symbol: MCRS1
  Gene Name: microspherule protein 1
  ENST ID: ENST00000549528
  CDS Start-End: 214-646
ccgtggggtgagaatgggcttgcgagtttacccccacctccccagccaccagcctgtgggtctcaaaccaaggctacttggtgctctgctttgagttgcagagaatctcctctcagcctttaagctcacctggtcagaatccttggatgagcctgtgggaccgttcctcctagcccggtggtttggaaccagtggctttgggactgtaagaggatggacaaagattctcaggggctgctagattcatccctgatggcatcaggcactgccagccgctcagaggatgaggagtcactggcagggcagaagcgagcctcctcccaggccttgggcaccatccctaaacggagaagctcctccaggaccctttacaggttcatcaagaggaagaagttcgatgatgagctggtggagagcagcctggcaaaatcttctacccgggcaaagggggccagtggggtggaaccagggcgctgttcggggagtgaaccctcctccagtgagaagaagaaggtatccaaagcccccagcactcctgtgccacccagcccagccccagcccctggactcaccaagcgtgtgaagaagagtaaacagccacttcaggtgaccaaggatctgggccgctggaagcctgcagatgacc

SEQ ID NO: 153809 - DNA, 1666 bp, Homo sapiens
  Payload ID: 10241
  Gene Symbol: MCRS1
  Gene Name: microspherule protein 1
  ENST ID: ENST00000548602
  CDS Start-End: 108-293
gacgtacctcacggaagccggctttggccctgcggctgctaccgtcgccgcggagaaattgttggatctggcagtctaggaatggttcatcaagaggaagaagttcgatgatgagctggtggagagcagcctggcaaaatcttctacccgggcaaagggggccagtggggtggaaccagggcgctgttcggggagtgaaccctcctccagtgagaagaagaaggtatccaaagcccccagcactcctgtgccacccagcccagccccagcccctggactcaccaagcgtgtgaagaagagtaaacagccacttcaggtgaccaaggatctgggccgctggaagcctgcagatgacctcctgctcataaatgctgtgttgcagaccaacgacctgacctccgtccacctgggcgtgaaattcagctgccgcttcacccttcgggaggtccaggagcgttggtacgccctgctctacgatcctgtcatctccaagttggcctgtcaggccatgaggcagctgcacccagaggctattgcagccatccagagcaaggccctgtttagcaaggctgaggagcagctgctgagcaaagtgggatcgaccagccagcccaccttggagaccttccaggacctgctgcacagacaccctgatgccttctacctggcccgtaccgcgaaggccctgcaggcccactggcagctcatgaagcagtattacctgctggaggaccagacagtgcagccgctgcccaaaggggaccaagtgctgaacttctctgatgcagaggacctgattgatgacagtaagctcaaggacatgcgagatgaggtcctggaacatgagctgatggtggctgaccggcgccagaagcgagagattcggcagctggaacaggaactgcataagtggcaggtgctagtggacagcatcacaggcatgagctctccggacttcgacaaccagacactggcagtgctgcggggccgcatggtgcggtacctgatgcgctcgcgtgagatcaccctgggcagagcaaccaaggataaccagattgatgtggacctgtctctggagggtccggcctggaagatatcccggaaacaaggtgtcatcaagctgaagaacaacggtgatttcttcattgccaatgagggtcgacggcccatctacatcgatggacggccggtgctctgtggctccaaatggcgcctcagcaacaactctgtggtggagatcgccagcctgcgattcgtcttccttatcaaccaggacctcattgccctcatcagggctgaggctgccaagatcacaccacagtgaggagtggtggcaggactcgtgggccctctccggcctgtttcccctgccactccagcccccttgagctgggaactcaggctcctggaaaaacctgggcagtgggaggctcagctgcgggccattgatttgagcctttgagggaggatagggctggcctttgtgaagccagcagaggctgagaacctcaggcttccctagatccagagcccctccccatcttcctctctctaaaaacaaccctaccccccattgccaccttcactcctgtgtctccagctgattagcctcagactcttcttttattgtttttcttttgtaaataaaaagcaccaggttccaaag

SEQ ID NO: 153810 - DNA, 1936 bp, Homo sapiens
  Payload ID: 10241
  Gene Symbol: MCRS1
  Gene Name: microspherule protein 1
  Uniprot ID: Q96EZ8
  ENST ID: ENST00000550165
  CDS Start-End: 268-1656
tgcggctgctaccgtcgccgcggagaaattgttggatctggcagtctaggaatgaggtgacttcatcaatgctcctaccccgagttcttgagacagacctggaccgatcccctaccttgggtgtgcactcttgggagaacgaggggcggagggtccgaatctcctctcagcctttaagctcacctggtcagaatccttggatgagcctgtgggaccgttcctcctagcccggtggtttggaaccagtggctttgggactgtaagaggatggacaaagattctcaggggctgctagattcatccctgatggcatcaggcactgccagccgctcagaggatgaggagtcactggcagggcagaagcgagcctcctcccaggccttgggcaccatccctaaacggagaagctcctccaggttcatcaagaggaagaagttcgatgatgagctggtggagagcagcctggcaaaatcttctacccgggcaaagggggccagtggggtggaaccagggcgctgttcggggagtgaaccctcctccagtgagaagaagaaggtatccaaagcccccagcactcctgtgccacccagcccagccccagcccctggactcaccaagcgtgtgaagaagagtaaacagccacttcaggtgaccaaggatctgggccgctggaagcctgcagatgacctcctgctcataaatgctgtgttgcagaccaacgacctgacctccgtccacctgggcgtgaaattcagctgccgcttcacccttcgggaggtccaggagcgttggtacgccctgctctacgatcctgtcatctccaagttggcctgtcaggccatgaggcagctgcacccagaggctattgcagccatccagagcaaggccctgtttagcaaggctgaggagcagctgctgagcaaagtgggatcgaccagccagcccaccttggagaccttccaggacctgctgcacagacaccctgatgccttctacctggcccgtaccgcgaaggccctgcaggcccactggcagctcatgaagcagtattacctgctggaggaccagacagtgcagccgctgcccaaaggggaccaagtgctgaacttctctgatgcagaggacctgattgatgacagtaagctcaaggacatgcgagatgaggtcctggaacatgagctgatggtggctgaccggcgccagaagcgagagattcggcagctggaacaggaactgcataagtggcaggtgctagtggacagcatcacaggcatgagctctccggacttcgacaaccagacactggcagtgctgcggggccgcatggtgcggtacctgatgcgctcgcgtgagatcaccctgggcagagcaaccaaggataaccagattgatgtggacctgtctctggagggtccggcctggaagatatcccggaaacaaggtgtcatcaagctgaagaacaacggtgatttcttcattgccaatgagggtcgacggcccatctacatcgatggacggccggtgctctgtggctccaaatggcgcctcagcaacaactctgtggtggagatcgccagcctgcgattcgtcttccttatcaaccaggacctcattgccctcatcagggctgaggctgccaagatcacaccacagtgaggagtggtggcaggactcgtgggccctctccggcctgtttcccctgccactccagcccccttgagctgggaactcaggctcctggaaaaacctgggcagtgggaggctcagctgcgggccattgatttgagcctttgagggaggatagggctggcctttgtgaagccagcagaggctgagaacctcaggcttccctagatccagagcccctccccatcttcctctctctaaaaacaaccctaccccccattgccaccttcactcctgtgtctccagctga

SEQ ID NO: 153811 - DNA, 608 bp, Homo sapiens
  Payload ID: 10241
  Gene Symbol: MCRS1
  Gene Name: microspherule protein 1
  ENST ID: ENST00000548646
  CDS Start-End: 1-195
cagctggaacaggaactgcataagtggcaggtgctagtggacagcatcacaggcatgagctctccggacttcgacaaccagacactggcagtgctgcggggccgcatggtgcggtacctgatgcgctcgcgtgaggtcccagccctcacctgccccatttccccagatcaccctgggcagagcaaccaaggataaccagattgatgtggacctgtctctggagggtccggcctggaagatatcccggaaacaaggtgtcatcaagctgaagaacaacggtgatttcttcattgccaatgagggtcgacggcccatctacatcgatggacggccggtgctctgtggctccaaatggcgcctcagcaacaactctgtggtggagatcgccagcctgcgattcgtcttccttatcaaccaggacctcattgccctcatcagggctgaggctgccaagatcacaccacagtgaggagtggtggcaggactcgtgggccctctccggcctgtttcccctgccactccagcccccttgagctgggaactcaggctcctggaaaaacctgggcagtgggaggctcagctgcgggccattgatttgagcctttgag

SEQ ID NO: 153812 - DNA, 636 bp, Homo sapiens
  Payload ID: 10241
  Gene Symbol: MCRS1
  Gene Name: microspherule protein 1
  ENST ID: ENST00000551598
  CDS Start-End: 1-522
aagctcaaggacatgcgagatgaggtcctggaacatgagctgatggtggctgaccggcgccagaagcgagagattcggcagctggaacaggaactgcataagtggcaggtgctagtggacagcatcacaggcatgagctctccggacttcgacaaccagacactggcagtgctgcggggccgcatggtgcggtacctgatgcgctcgcgtgagatcaccctgggcagagcaaccaaggataaccagattgatgtggacctgtctctggagggtccggcctggaagatatcccggaaacaaggtgtcatcaagctgaagaacaacggtgatttcttcattgccaatgagggtcgacggcccatctacatcgatggacggccggtgctctgtggctccaaatggcgcctcagcaacaactctgtggtggagacaggaagctggggccagagaagccaaattcacactgctagaaagctgacagagcaaggatataaacccagttcctggctgcgtcgaaattaaagtgctggtcttcaccaccaaactcccctgcccgcacgacaccaaggggtagtggggtgagacggcctccaggcagtctgccagtttctctaacattgaaggctcagaggtcaa

SEQ ID NO: 153813 - DNA, 894 bp, Homo sapiens
  Payload ID: 10241
  Gene Symbol: MCRS1
  Gene Name: microspherule protein 1
  ENST ID: ENST00000548596
  CDS Start-End: 338-894
acgcatgcgcaaaggcatggagaccgtggggtgagaatgggcttgcgagtttacccccacctccccagccaccagcctgtgggtctcaaaccaaggctacttggtgctctgctttgagttgcagaggtgacttcatcaatgctcctaccccgagttcttgagacagacctggaccgatcccctaccttgggtgtgcactcttgggagaacgaggggcggagggtccgaatctcctctcagcctttaagctcacctggtcagaatccttggatgagcctgtgggaccgttcctcctagcccggtggtttggaaccagtggctttgggactgtaagaggatggacaaagattctcaggggctgctagattcatccctgatggcatcaggcactgccagccgctcagaggatgaggagtcactggcagggcagaagcgagcctcctcccaggccttgggcaccatccctaaacggagaagctcctccaggttcatcaagaggaagaagttcgatgatgagctggtggagagcagcctggcaaaatcttctacccgggcaaagggggccagtggggtggaaccagggcgctgttcggggagtgaaccctcctccagtgagaagaagaaggtatccaaagcccccagcactcctgtgccacccagcccagccccagcccctggactcaccaagcgtgtgaagaagagtaaacagccacttcaggtgaccaaggatctgggccgctggaagcctgcagatgacctcctgctcataaatgctgtgttgcagaccaacgacctgacctccgtccacctgggcgtgaaattcagctgccgcttcacccttcgggaggtccaggagcgttggtacgccctgctctacgatcctgtcatctccaa

SEQ ID NO: 153814 - DNA, 876 bp, Homo sapiens
  Payload ID: 10241
  Gene Symbol: MCRS1
  Gene Name: microspherule protein 1
  ENST ID: ENST00000548334
  CDS Start-End: 260-876
cttgcgagtttacccccacctccccagccaccagcctgtgggtctcaaaccaaggctacttggtgctctgctttgagttgcagaggtgacttcatcaatgctcctaccccgagttcttgagacagacctggaccgatcccctaccttggaatctcctctcagcctttaagctcacctggtcagaatccttggatgagcctgtgggaccgttcctcctagcccggtggtttggaaccagtggctttgggactgtaagaggatggacaaagattctcaggggctgctagattcatccctgatggcatcaggcactgccagccgctcagaggatgaggagtcactggcagggcagaagcgagcctcctcccaggccttgggcaccatccctaaacggagaagctcctccaggttcatcaagaggaagaagttcgatgatgagctggtggagagcagcctggcaaaatcttctacccgggcaaagggggccagtggggtggaaccagggcgctgttcggggagtgaaccctcctccagtgagaagaagaaggtatccaaagcccccagcactcctgtgccacccagcccagccccagcccctggactcaccaagcgtgtgaagaagagtaaacagccacttcaggtgaccaaggatctgggccgctggaagcctgcagatgacctcctgctcataaatgctgtgttgcagaccaacgacctgacctccgtccacctgggcgtgaaattcagctgccgcttcacccttcgggaggtccaggagcgttggtacgccctgctctacgatcctgtcatctccaagttggcctgtcaggccatgaggcagctgcacccagaggctattgcagccatccagagcaa

SEQ ID NO: 153815 - DNA, 3142 bp, Homo sapiens
  Payload ID: 10242
  Gene Symbol: MICAL1
  Gene Name: microtubule associated monooxygenase, calponin and LIM domain containing 1
  Uniprot ID: Q8TDZ2
  ENST ID: ENST00000358577
  CDS Start-End: 68-3013
cccctcccggcttcggagccgccgccactcatctctgcccagctgctgccctccccaggaggcctccatggcttcacctacctccaccaacccagcgcatgcccactttgagagcttcctgcaggcccagctgtgccaggacgtgctgagcagcttccaggagctgtgtggggccctggggctggaacccggtggggggctgccccagtaccacaagatcaaggaccagctcaactactggagcgccaagtcactgtggaccaagctggacaagcgagcaggccagcctgtctaccagcagggccgggcctgcaccagcaccaagtgcctggtggtgggtgctggaccttgcgggctgcgggtcgctgtggagctggcgctgctgggggcccgagtggtgctggtggaaaagcgcaccaagttctctcgccacaacgtgctccacctctggcccttcaccatccacgacctgcgggcactcggtgctaagaagttctacgggcgcttctgcaccggcaccctggaccacatcagcatcaggcagctccagctgcttctgctgaaggtagcattgctgctgggggtggaaattcactggggtgtcactttcactggcctccagccccctcctaggaaggggagtggctggcgtgcccagctccaacccaacccccctgcccagctggccaactatgaatttgacgtccttatctcggctgcaggaggtaaattcgtccctgaaggcttcaaagttcgagaaatgcgaggcaaactggccattggcatcacagccaactttgtgaatggacgcaccgtggaggagacacaggtgccggagatcagtggtgtagccaggatctacaaccagagcttcttccagagccttctcaaagccacaggcattgatctggagaacattgtgtactacaaggacgacacccactactttgtgatgacagccaagaagcagtgcctgctgcggctgggggtgctgcgccagcccttctggcccctgggcactggagtggcacggggcttcctggcagcctttgatgcagcctggatggtgaagcggtgggcagagggcgctgagtccctagaggtgttggctgagcgtgagagcctgtaccagcttctgtcacagacatccccagaaaacatgcatcgcaatgtggcccagtatgggctggacccagccacccgctaccccaacctgaacctccgggcagtgacccccaatcaggtacgagacctgtatgatgtgctagccaaggagcctgtgcagaggaacaacgacaagacagatacagggatgccagccaccgggtcggcaggcacccaggaggagctgctacgctggtgccaggagcagacagctgggtacccgggagtccacgtctccgatttgtcttcctcctgggctgatgggctagctctgtgtgccctggtgtaccggctgcagcctggcctgctggaaccctcagagctgcaggggctgggagctctggaagcaactgcttgggcactaaaggtggcagagaatgagctgggcatcacaccggtggtgtctgcacaggccgtggtagcagggagtgacccactgggcctcattgcctacctcagccacttccacagtgccttcaagagcatggcccacagcccaggccctgtcagccaggcctccccagggacctccagtgctgtattattccttagtaaacttcagaggaccctgcagcgatcccgggccaaggaaaatgcagaggatgctggtggcaagaagctgcgcttggagatggaggccgagaccccaagtactgaggtgccacctgacccagagcctggtgtacccctgacacccccatcccaacaccaggaggccggtgctggggacctgtgtgcactttgtggggaacacctctatgtcctggaacgcctctgtgtcaacggccatttcttccaccggagctgcttccgctgccatacctgtgaggccacactgtggccaggtggctacgagcagcacccaggagatggacatttctactgcctccagcacctgccccagacagaccacaaagcggaaggcagcgatagaggccctgagagtccggagctccccacaccaagtgagaatagcatgccaccaggcctctcaactcccacagcctcgcaggagggggccggtcctgttccagatcccagccagcccacccgtcggcagatccgcctctccagcccggagcgccagcggttgtcctcccttaaccttacccctgacccggaaatggagcctccacccaagcctccccgcagctgctccgccttggcccgccacgccctggagagcagctttgtgggctggggcctgccagtccagagccctcaagctcttgtggccatggagaaggaggaaaaagagagtcccttctccagtgaagaggaagaagaagatgtgcctttggactcagatgtggaacaggccctgcagacctttgccaagacctcaggcaccatgaataactacccaacatggcgtcggactctgctgcgccgtgcgaaggaggaggagatgaagaggttctgcaaggcccagaccatccaacggcgactaaatgagattgaggctgccttgagggagctagaggccgagggcgtgaagctggagctggccttgaggcgccagagcagttccccagaacagcaaaagaaactatgggtaggacagctgctacagctcgttgacaagaaaaacagcctggtggctgaggaggccgagctcatgatcacggtgcaggaattgaatctggaggagaaacagtggcagctggaccaggagctacgaggctacatgaaccgggaagaaaacctaaagacagctgctgatcggcaggctgaggaccaggtcctgaggaagctggtggatttggtcaaccagagagatgccctcatccgcttccaggaggagcgcaggctcagcgagctggccttggggacaggggcccagggctagacgagggtgggccgtctgctttcgttcccacaaagaaagcacctcaccccagcacagtgccacccctgttcatctgggctgcctggcagagagccttgctgtttacaattaaaatgtttctgccacaaa

SEQ ID NO: 153816 - DNA, 3645 bp, Homo sapiens
  Payload ID: 10242
  Gene Symbol: MICAL1
  Gene Name: microtubule associated monooxygenase, calponin and LIM domain containing 1
  Uniprot ID: Q8TDZ2
  ENST ID: ENST00000358807
  CDS Start-End: 313-3516
cccaagactgtccccgctggaggcggtagagggatccagaagtaatgagatgctaatgagtcgcgaataaagcccgggcggcgccccgcgcccctcgcggaagcccacactccgcgcgactccaggcgcacgccccgggccgccccgcatcccagcatccccgcccgatctcggcgtttccgcccccgcccccgcccccgccctcccacccgctcagacctggttgccagcccaacaggaagcggcccctcccggcttcggagccgccgccactcatctctgcccagctgctgccctccccaggaggcctccatggcttcacctacctccaccaacccagcgcatgcccactttgagagcttcctgcaggcccagctgtgccaggacgtgctgagcagcttccaggagctgtgtggggccctggggctggaacccggtggggggctgccccagtaccacaagatcaaggaccagctcaactactggagcgccaagtcactgtggaccaagctggacaagcgagcaggccagcctgtctaccagcagggccgggcctgcaccagcaccaagtgcctggtggtgggtgctggaccttgcgggctgcgggtcgctgtggagctggcgctgctgggggcccgagtggtgctggtggaaaagcgcaccaagttctctcgccacaacgtgctccacctctggcccttcaccatccacgacctgcgggcactcggtgctaagaagttctacgggcgcttctgcaccggcaccctggaccacatcagcatcaggcagctccagctgcttctgctgaaggtagcattgctgctgggggtggaaattcactggggtgtcactttcactggcctccagccccctcctaggaaggggagtggctggcgtgcccagctccaacccaacccccctgcccagctggccaactatgaatttgacgtccttatctcggctgcaggaggtaaattcgtccctgaaggcttcaaagttcgagaaatgcgaggcaaactggccattggcatcacagccaactttgtgaatggacgcaccgtggaggagacacaggtgccggagatcagtggtgtagccaggatctacaaccagagcttcttccagagccttctcaaagccacaggcattgatctggagaacattgtgtactacaaggacgacacccactactttgtgatgacagccaagaagcagtgcctgctgcggctgggggtgctgcgccaggactggccagacaccaatcggctgctgggcagtgccaatgtggtgcccgaggctctgcagcgctttacccgggcagctgctgactttgccacccatggcaagctcgggaaactagagtttgcccaggatgcccatgggcagcctgatgtctctgcctttgacttcacgagcatgatgcgggcagagagttctgctcgtgtgcaagagaagcatggcgcccgcctgctgctgggactggtgggggactgcctggtggagcccttctggcccctgggcactggagtggcacggggcttcctggcagcctttgatgcagcctggatggtgaagcggtgggcagagggcgctgagtccctagaggtgttggctgagcgtgagagcctgtaccagcttctgtcacagacatccccagaaaacatgcatcgcaatgtggcccagtatgggctggacccagccacccgctaccccaacctgaacctccgggcagtgacccccaatcaggtacgagacctgtatgatgtgctagccaaggagcctgtgcagaggaacaacgacaagacagatacagggatgccagccaccgggtcggcaggcacccaggaggagctgctacgctggtgccaggagcagacagctgggtacccgggagtccacgtctccgatttgtcttcctcctgggctgatgggctagctctgtgtgccctggtgtaccggctgcagcctggcctgctggaaccctcagagctgcaggggctgggagctctggaagcaactgcttgggcactaaaggtggcagagaatgagctgggcatcacaccggtggtgtctgcacaggccgtggtagcagggagtgacccactgggcctcattgcctacctcagccacttccacagtgccttcaagagcatggcccacagcccaggccctgtcagccaggcctccccagggacctccagtgctgtattattccttagtaaacttcagaggaccctgcagcgatcccgggccaaggaaaatgcagaggatgctggtggcaagaagctgcgcttggagatggaggccgagaccccaagtactgaggtgccacctgacccagagcctggtgtacccctgacacccccatcccaacaccaggaggccggtgctggggacctgtgtgcactttgtggggaacacctctatgtcctggaacgcctctgtgtcaacggccatttcttccaccggagctgcttccgctgccatacctgtgaggccacactgtggccaggtggctacgagcagcacccaggagatggacatttctactgcctccagcacctgccccagacagaccacaaagcggaaggcagcgatagaggccctgagagtccggagctccccacaccaagtgagaatagcatgccaccaggcctctcaactcccacagcctcgcaggagggggccggtcctgttccagatcccagccagcccacccgtcggcagatccgcctctccagcccggagcgccagcggttgtcctcccttaaccttacccctgacccggaaatggagcctccacccaagcctccccgcagctgctccgccttggcccgccacgccctggagagcagctttgtgggctggggcctgccagtccagagccctcaagctcttgtggccatggagaaggaggaaaaagagagtcccttctccagtgaagaggaagaagaagatgtgcctttggactcagatgtggaacaggccctgcagacctttgccaagacctcaggcaccatgaataactacccaacatggcgtcggactctgctgcgccgtgcgaaggaggaggagatgaagaggttctgcaaggcccagaccatccaacggcgactaaatgagattgaggctgccttgagggagctagaggccgagggcgtgaagctggagctggccttgaggcgccagagcagttccccagaacagcaaaagaaactatgggtaggacagctgctacagctcgttgacaagaaaaacagcctggtggctgaggaggccgagctcatgatcacggtgcaggaattgaatctggaggagaaacagtggcagctggaccaggagctacgaggctacatgaaccgggaagaaaacctaaagacagctgctgatcggcaggctgaggaccaggtcctgaggaagctggtggatttggtcaaccagagagatgccctcatccgcttccaggaggagcgcaggctcagcgagctggccttggggacaggggcccagggctagacgagggtgggccgtctgctttcgttcccacaaagaaagcacctcaccccagcacagtgccacccctgttcatctgggctgcctggcagagagccttgctgtttacaattaaaatgtttctgccacaaa

SEQ ID NO: 153817 - DNA, 887 bp, Homo sapiens
  Payload ID: 10242
  Gene Symbol: MICAL1
  Gene Name: microtubule associated monooxygenase, calponin and LIM domain containing 1
  ENST ID: ENST00000431946
  CDS Start-End: 156-887
gccggtaagtcgtccagcggagccggctgcgagccccgcggccgggtggggtgaggtggggtgcgcttccggggaaacgcagctgcggtcgctcgggaaccacgcctggcagccactcatctctgcccagctgctgccctccccaggaggcctccatggcttcacctacctccaccaacccagcgcatgcccactttgagagcttcctgcaggcccagctgtgccaggacgtgctgagcagcttccaggagctgtgtggggccctggggctggaacccggtggggggctgccccagtaccacaagatcaaggaccagctcaactactggagcgccaagtcactgtggaccaagctggacaagcgagcaggccagcctgtctaccagcagggccgggcctgcaccagcaccaagtgcctggtggtgggtgctggaccttgcgggctgcgggtcgctgtggagctggcgctgctgggggcccgagtggtgctggtggaaaagcgcaccaagttctctcgccacaacgtgctccacctctggcccttcaccatccacgacctgcgggcactcggtgctaagaagttctacgggcgcttctgcaccggcaccctggaccacatcagcatcaggcagctccagctgcttctgctgaaggtagcattgctgctgggggtggaaattcactggggtgtcactttcactggcctccagccccctcctaggaaggggagtggctggcgtgcccagctccaacccaacccccctgcccagctggccaactatgaatttgacgtccttatctcggctgcaggaggtaaattcgtccctgaaggcttcaaagttcgagaaatgcgaggcaaactggccattggcatcacagccaacttt

SEQ ID NO: 153818 - DNA, 754 bp, Homo sapiens
  Payload ID: 10242
  Gene Symbol: MICAL1
  Gene Name: microtubule associated monooxygenase, calponin and LIM domain containing 1
  ENST ID: ENST00000433205
  CDS Start-End: 1-754
tgagagcctgtaccagcttctgtcacagacatccccagaaaacatgcatcgcaatgtggcccagtatgggctggacccagccacccgctaccccaacctgaacctccgggcagtgacccccaatcaggtacgagacctgtatgatgtgctagccaaggagcctgtgcagaggaacaacgacaagacagatacagggatgccagccaccggcacccaggaggagctgctacgctggtgccaggagcagacagctgggtacccgggagtccacgtctccgatttgtcttcctcctgggctgatgggctagctctgtgtgccctggtgtaccggctgcagcctggcctgctggaaccctcagagctgcaggggctgggagctctggaagcaactgcttgggcactaaaggtggcagagaatgagctgggcatcacaccggtggtgtctgcacaggccgtggtagcagggagtgacccactgggcctcattgcctacctcagccacttccacagtgccttcaagagcatggcccacagcccaggccctgtcagccaggcctccccagggacctccagtgctgtattattccttagtaaacttcagaggaccctgcagcgatcccgggccaaggaaaatgcagaggatgctggtggcaagaagctgcgcttggagatggaggccgagaccccaagtactgaggtgccacctgacccagagcctggtgtacccctgacacccccatcccaacaccaggag

SEQ ID NO: 153819 - DNA, 3678 bp, Homo sapiens
  Payload ID: 10242
  Gene Symbol: MICAL1
  Gene Name: microtubule associated monooxygenase, calponin and LIM domain containing 1
  Uniprot ID: Q8TDZ2
  ENST ID: ENST00000630715
  CDS Start-End: 292-3552
tttagctacaagtacttcagatccagctcagcacctgcagctgacacaggagcctggtccgccaccacccactcaccacgtgccccagccaacgccacttggccaggagcagagctgacctgtaaacacgtttgactgcttgattgggctcttcttataagccagctctgactggattttgaacgcttgaaatcaggctctccacaccattgacttgcagatgcttctgtgagagctgtgatggctaactgatgtttataatgccctccatccaggtagcaagatgtgtgtatgtcttgtctaagccactcatctctgcccagctgctgccctccccaggaggcctccatggcttcacctacctccaccaacccagcgcatgcccactttgagagcttcctgcaggcccagctgtgccaggacgtgctgagcagcttccaggagctgtgtggggccctggggctggaacccggtggggggctgccccagtaccacaagatcaaggaccagctcaactactggagcgccaagtcactgtggaccaagctggacaagcgagcaggccagcctgtctaccagcagggccgggcctgcaccagcaccaagtgcctggtggtgggtgctggaccttgcgggctgcgggtcgctgtggagctggcgctgctgggggcccgagtggtgctggtggaaaagcgcaccaagttctctcgccacaacgtgctccacctctggcccttcaccatccacgacctgcgggcactcggtgctaagaagttctacgggcgcttctgcaccggcaccctggaccacatcagcatcaggcagctccagctgcttctgctgaaggtagcattgctgctgggggtggaaattcactggggtgtcactttcactggcctccagccccctcctaggaaggggagtggctggcgtgcccagctccaacccaacccccctgcccagctggccaactatgaatttgacgtccttatctcggctgcaggaggtaaattcgtccctgaaggcttcaaagttcgagaaatgcgaggcaaactggccattggcatcacagccaactttgtgaatggacgcaccgtggaggagacacaggtgccggagatcagtggtgtagccaggatctacaaccagagcttcttccagagccttctcaaagccacaggcattgatctggagaacattgtgtactacaaggacgacacccactactttgtgatgacagccaagaagcagtgcctgctgcggctgggggtgctgcgccaggactggccagacaccaatcggctgctgggcagtgccaatgtggtgcccgaggctctgcagcgctttacccgggcagctgctgactttgccacccatggcaagctcgggaaactagagtttgcccaggatgcccatgggcagcctgatgtctctgcctttgacttcacgagcatgatgcgggcagagagttctgctcgtgtgcaagagaagcatggcgcccgcctgctgctgggactggtgggggactgcctggtggagcccttctggcccctgggcactggagtggcacggggcttcctggcagcctttgatgcagcctggatggtgaagcggtgggcagagggcgctgagtccctagaggtgttggctgagcgtgagagcctgtaccagcttctgtcacagacatccccagaaaacatgcatcgcaatgtggcccagtatgggctggacccagccacccgctaccccaacctgaacctccgggcagtgacccccaatcaggtacgagacctgtatgatgtgctagccaaggagcctgtgcagaggaacaacgacaagacagatacagggatgccagccaccgggtcggcaggcacccaggaggagctgctacgctggtgccaggagcagacagctgggtacccgggagtccacgtctccgatttgtcttcctcctgggctgatgggctagctctgtgtgccctggtgtaccggctgcagcctggcctgctggaaccctcagagctgcaggggctgggagctctggaagcaactgcttgggcactaaaggtggcagagaatgagctgggcatcacaccggtggtgtctgcacaggccgtggtagcagggagtgacccactgggcctcattgcctacctcagccacttccacagtgccttcaagagcatggcccacagcccaggccctgtcagccaggcctccccagggacctccagtgctgtattattccttagtaaacttcagaggaccctgcagcgatcccgggccaaggaaaatgcagaggatgctggtggcaagaagctgcgcttggagatggaggccgagaccccaagtactgaggtgccacctgacccagagcctggtgtacccctgacacccccatcccaacaccaggaggccggtgctggggacctgtgtgcactttgtggggaacacctctatgtcctggaacgcctctgtgtcaacggccatttcttccaccggagctgcttccgctgccatacctgtgaggccacactgtggccaggtggctacgagcagcacccaggagatggacatttctactgcctccagcacctgccccagacagaccacaaagcggaaggcagcgatagaggccctgagagtccggagctccccacaccaagtgagaatagcatgccaccaggcctctcaactcccacagcctcgcaggagggggccggtcctgttccagatcccagccagcccacccgtcggcagatccgcctctccagcccggagcgccagcggttgtcctcccttaaccttacccctgacccggaaatggagcctccacccaagcctccccgcagctgctccgccttggcccgccacgccctggagagcagctttgtgggctggggcctgccagtccagagccctcaagctcttgtggccatggagaaggaggaaaaagagagtcccttctccagtgaagaggaagaagaagatgtgcctttggactcagatgtggaacaggccctgcagacctttgccaagacctcaggcaccatgaataactacccaacatggcgtcggactctgctgcgccgtgcgaaggaggaggagatgaagaggttctgcaaggcccagaccatccaacggcgactaaatgagattgaggctgccttgagggagctagaggccgagggcgtgaagctggagctggccttgaggcgccagagcagttccccagaacagcaaaagaaactatgggtaggacagctgctacagctcgttgacaagaaaaacagcctggtggctgaggaggccgagctcatgatcacggtgcaggaattgaatctggaggagaaacagtggcagctggaccaggagctacgaggctacatgaaccgggaagaaaacctaaagacagctgctgatcggcaggctgaggaccaggtcctgaggaagctggtggatttggtcaaccagagagatgccctcatccgcttccaggaggagcgcaggctcagcgagctggccttggggacaggggcccagggctagacgagggtgggccgtctgctttcgttcccacaaagaaagcacctcaccccagcacagtgccacccctgttcatctgggctgcctggcagagagccttgctgtttacaattaaaatgtttctgccac

SEQ ID NO: 153820 - DNA, 3906 bp, Homo sapiens
  Payload ID: 10243
  Gene Symbol: MICAL2
  Gene Name: microtubule associated monooxygenase, calponin and LIM domain containing 2
  Uniprot ID: O94851
  ENST ID: ENST00000256194
  CDS Start-End: 289-3663
ctcggctggctaagcctgcgccgggccgcctcgctcgctcccagctctgtcagtggcccgcggggcccgatcgctgcgcccgcggccagggccgaggcaggcctgacccggggccgggcagcccgcgcgactttcggaacatggcaacccgtgtgtgtctcatcccagaaagagaagactttaaccactgtgatgcctgagaatccagtgagtgtgacgtttctccagatacttcatgctgttcacctgtgtcctcgccgcaccactgccgcacacgactcctgaaccatgggggaaaacgaggatgagaagcaggcccaggcggggcaggtttttgagaactttgtccaggcatccacgtgcaaaggtaccctccaggccttcaacattctcacacgacacctggacctagaccctctggaccacagaaacttttattccaagctcaagtccaaggtgaccacctggaaagccaaagccctgtggtacaaattggataagcgtggttcccacaaagagtataagcgagggaagtcgtgcacgaacaccaagtgtctcatagttgggggaggaccctgtggcttgcgcactgccattgaacttgcctacctgggagccaaagtggtcgtggtggagaagagggactccttctcccggaacaacgtgctacacctctggcctttcaccatccatgaccttcgtggcctgggagccaagaagttctatgggaagttctgtgctggctccatcgaccatatcagtattcgccaactacagctcatcctattcaaggtggccctgatgctgggagttgaaatccatgtgaatgtggagttcgtgaaggttctagagcctcctgaagatcaagaaaatcaaaaaattggctggcgggcagaatttctccctacagaccattctctgtcggagtttgagtttgacgtcatcattggtgccgatggccgcaggaacaccctggaagggttcagaagaaaagaattccgtgggaagctggcgattgccatcaccgccaacttcataaacagaaacagcacagcggaagccaaggtggaagagattagtggtgtggctttcatcttcaatcagaaattttttcaggaccttaaagaagaaacaggcatagatcttgagaacattgtttactacaaggactgcacccactattttgtaatgacagccaagaagcagagcctgctcgacaaaggtgtcatcattaacgactacatcgacacagagatgctgctgtgtgcggagaacgtgaaccaagacaacctgctatcctatgcccgggaagctgcagactttgccaccaactaccagctgccatccttagactttgccatgaaccactatgggcagcctgatgtggccatgtttgactttacctgcatgtatgcctcagagaacgcggccctggtgcgggagcggcaggcgcaccagctgctcgtggcccttgtgggtgacagcttgcttgagccattttggcccatgggtacaggctgtgcccgtggcttcctggcagcctttgacacggcatggatggtgaagagctggaaccagggcacccctcccctggagctgctggctgaaagggaaagtctctaccggctgttacctcagacaaccccggagaacatcaacaagaactttgagcagtacacgttggacccagggacacggtacccaaacctcaactcacactgtgtcaggccccatcaggtgaagcatttgtatatcactaaggagctggagcactaccctctcgagagactgggctcggtgaggagatctgtcaacctctccaggaaggagtcagatatccggcccagcaagctcctgacctggtgccagcagcagacagagggctaccagcatgtcaacgtcaccgacctgaccacatcctggcgcagtgggttggccctgtgtgccatcatccaccgcttccggcctgagctcatcaactttgactctttgaatgaagatgatgctgtggagaacaaccagctcgcatttgatgtggccgagcgagagtttgggatccctccagtgaccacgggcaaagagatggcatctgcccaggagcctgacaagctcagcatggtcatgtacctctccaagttctacgagctcttccggggcaccccactgaggcccgtggattcttggcgcaaaaactatggagaaaatgctgacctcagcttggccaaatcatccatttctaataactatctcaacctcacatttccaaggaagaggactccacgggtggatggtcaaaccggagagaatgacatgaacaaacggagacggaagggcttcaccaacctggacgagccttcaaacttttccagccgtagcttgggctccaatcaagagtgtgggagcagtaaggaaggtggaaatcagaacaaagtcaagtccatggcgaatcagctgctggccaagtttgaggagagcactcggaacccctcactcatgaagcaggaacgccgtgtctcagggataggtaagccggtcctgtgctcttcctccggccctcctgttcactcttgctgccccaagccggaggaggccacacccagcccatcacctcctctgaaaaggcagttcccctctgtggtcgtgacggggcacgtgctcagagagctcaagcaagtgtctgctggcagtgagtgcctgagcagaccttggagagccagagccaagtctgacctacagctgggtgggacagaaaatttcgctaccctgccttctacccgcccgagggcgcaggctctttccggggtgctgtggcggctgcagcaagtggaggaaaagattctccagaagagggctcagaacttggccaacagggaatttcacacaaagaacattaaggagaaggcggctcaccttgcctccatgtttggacacggggatttcccgcagaataaactactctctaaaggcctgtctcatactcatcctccatctcctccctctcgccttccgtctcctgatccagctgcttcttcctctccatcaactgttgactctgcttctcctgccagaaaggaaaagaagtcaccttcagggttccattttcatcccagccatttgagaacagtgcatcctcagctgacggtagggaaagtgtccagcggaataggggctgcagctgaagtcctggtcaatctgtacatgaatgatcacagacctaaggcccaggccacctctccagacctggaatctatgcgaaagtcatttccccttaacctgggaggcagcgacacgtgttacttctgtaagaaacgtgtgtacgtgatggaacggctgagcgccgagggccacttcttccaccgggagtgtttccgctgcagcatctgtgccaccaccttgcgcctggccgcctacacctttgactgcgatgaaggcaaattttactgcaagcctcacttcattcactgtaaaaccaatagcaaacaacggaagagacgggcagagttgaagcaacaaagagaggaggaggcaacatggcaagagcaggaagcccctcggagagacactcccaccgaaagttcttgcgcagtggccgccattggcaccctggaaggcagccccccagttcatttcagccttccagtgctacacccacttcttggctgacacacttctgctctaagagtctccctccctttatagaatgtcaaccaaagagtgccctcctcccctctcagcctcctctttagctagcctccccatctcatcacaacgcatgtctgtgacctttggtaatcatttacagtgccacacggaaccctgtattttgcacacagcaaaacaaacaatgtttagctttatttatggtatttgatgctgtaaatggaaataaatattgttctttataaa

SEQ ID NO: 153821 - DNA, 3711 bp, Homo sapiens
  Payload ID: 10243
  Gene Symbol: MICAL2
  Gene Name: microtubule associated monooxygenase, calponin and LIM domain containing 2
  Uniprot ID: O94851
  ENST ID: ENST00000342902
  CDS Start-End: 153-3464
gaacatggcaacccgtgtgtgtctcatcccagaaagagaagactttaaccactgtgatgcctgagaatccagtgagtgtgacgtttctccagatacttcatgctgttcacctgtgtcctcgccgcaccactgccgcacacgactcctgaaccatgggggaaaacgaggatgagaagcaggcccaggcggggcaggtttttgagaactttgtccaggcatccacgtgcaaaggtaccctccaggccttcaacattctcacacgacacctggacctagaccctctggaccacagaaacttttattccaagctcaagtccaaggtgaccacctggaaagccaaagccctgtggtacaaattggataagcgtggttcccacaaagagtataagcgagggaagtcgtgcacgaacaccaagtgtctcatagttgggggaggaccctgtggcttgcgcactgccattgaacttgcctacctgggagccaaagtggtcgtggtggagaagagggactccttctcccggaacaacgtgctacacctctggcctttcaccatccatgaccttcgtggcctgggagccaagaagttctatgggaagttctgtgctggctccatcgaccatatcagtattcgccaactacagctcatcctattcaaggtggccctgatgctgggagttgaaatccatgtgaatgtggagttcgtgaaggttctagagcctcctgaagatcaagaaaatcaaaaaattggctggcgggcagaatttctccctacagaccattctctgtcggagtttgagtttgacgtcatcattggtgccgatggccgcaggaacaccctggaagggttcagaagaaaagaattccgtgggaagctggcgattgccatcaccgccaacttcataaacagaaacagcacagcggaagccaaggtggaagagattagtggtgtggctttcatcttcaatcagaaattttttcaggaccttaaagaagaaacaggcatagatcttgagaacattgtttactacaaggactgcacccactattttgtaatgacagccaagaagcagagcctgctcgacaaaggtgtcatcattaacgactacatcgacacagagatgctgctgtgtgcggagaacgtgaaccaagacaacctgctatcctatgcccgggaagctgcagactttgccaccaactaccagctgccatccttagactttgccatgaaccactatgggcagcctgatgtggccatgtttgactttacctgcatgtatgcctcagagaacgcggccctggtgcgggagcggcaggcgcaccagctgctcgtggcccttgtgggtgacagcttgcttgagccattttggcccatgggtacaggctgtgcccgtggcttcctggcagcctttgacacggcatggatggtgaagagctggaaccagggcacccctcccctggagctgctggctgaaagggaaagtctctaccggctgttacctcagacaaccccggagaacatcaacaagaactttgagcagtacacgttggacccagggacacggtacccaaacctcaactcacactgtgtcaggccccatcaggtgaagcatttgtatatcactaaggagctggagcactaccctctcgagagactgggctcggtgaggagatctgtcaacctctccaggaaggagtcagatatccggcccagcaagctcctgacctggtgccagcagcagacagagggctaccagcatgtcaacgtcaccgacctgaccacatcctggcgcagtgggttggccctgtgtgccatcatccaccgcttccggcctgagctcatcaactttgactctttgaatgaagatgatgctgtggagaacaaccagctcgcatttgatgtggccgagcgagagtttgggatccctccagtgaccacgggcaaagagatggcatctgcccaggagcctgacaagctcagcatggtcatgtacctctccaagttctacgagctcttccggggcaccccactgaggcccgtggattcttggcgcaaaaactatggagaaaatgctgacctcagcttggccaaatcatccatttctaataactatctcaacctcacatttccaaggaagaggactccacgggtggatggtcaaaccggagagaatgacatgaacaaacggagacggaagggcttcaccaacctggacgagccttcaaacttttccagccgtagcttgggctccaatcaagagtgtgggagcagtaaggaaggtggaaatcagaacaaagtcaagtccatggcgaatcagctgctggccaagtttgaggagagcactcggaacccctcactcatgaagcaggaacgccgtgtctcagggataggtaagccggtcctgtgctcttcctccggccctcctgttcactcttgctgccccaagccggaggaggccacacccagcccatcacctcctctgaaaaggcagttcccctctgtggtcgtgacggggcacgtgctcagagagctcaagcaagtgtctgctggcagtgagtgcctgagcagaccttggagagccagagccaagtctgacctacagctgggtgggacagaaaatttcgctaccctgccttctacccgcccgagggcgcaggctctttccggggtgctgtggcggctgcagcaagtggaggaaaagattctccagaagagggctcagaacttggccaacagggaatttcacacaaagaacattaaggagaaggcggctcaccttgcctccatgtttggacacggggatttcccgcagaataaactactctctaaaggcctgtctcatactcatcctccatctcctccctctcgccttccgtctcctgatccagctgcttcttcctctccatcaactgttgactctgcttctcctgccagaaagctgacggtagggaaagtgtccagcggaataggggctgcagctgaagtcctggtcaatctgtacatgaatgatcacagacctaaggcccaggccacctctccagacctggaatctatgcgaaagtcatttccccttaacctgggaggcagcgacacgtgttacttctgtaagaaacgtgtgtacgtgatggaacggctgagcgccgagggccacttcttccaccgggagtgtttccgctgcagcatctgtgccaccaccttgcgcctggccgcctacacctttgactgcgatgaaggcaaattttactgcaagcctcacttcattcactgtaaaaccaatagcaaacaacggaagagacgggcagagttgaagcaacaaagagaggaggaggcaacatggcaagagcaggaagcccctcggagagacactcccaccgaaagttcttgcgcagtggccgccattggcaccctggaaggcagccccccagttcatttcagccttccagtgctacacccacttcttggctgacacacttctgctctaagagtctccctccctttatagaatgtcaaccaaagagtgccctcctcccctctcagcctcctctttagctagcctccccatctcatcacaacgcatgtctgtgacctttggtaatcatttacagtgccacacggaaccctgtattttgcacacagcaaaacaaacaatgtttagctttatttatggtatttgatgctgtaaatggaaataaatattgttctttataaagctc

SEQ ID NO: 153822 - DNA, 6625 bp, Homo sapiens
  Payload ID: 10243
  Gene Symbol: MICAL2
  Gene Name: microtubule associated monooxygenase, calponin and LIM domain containing 2
  Uniprot ID: O94851
  ENST ID: ENST00000379612
  CDS Start-End: 78-3008
gtgtgacgtttctccagatacttcatgctgttcacctgtgtcctcgccgcaccactgccgcacacgactcctgaaccatgggggaaaacgaggatgagaagcaggcccaggcggggcaggtttttgagaactttgtccaggcatccacgtgcaaaggtaccctccaggccttcaacattctcacacgacacctggacctagaccctctggaccacagaaacttttattccaagctcaagtccaaggtgaccacctggaaagccaaagccctgtggtacaaattggataagcgtggttcccacaaagagtataagcgagggaagtcgtgcacgaacaccaagtgtctcatagttgggggaggaccctgtggcttgcgcactgccattgaacttgcctacctgggagccaaagtggtcgtggtggagaagagggactccttctcccggaacaacgtgctacacctctggcctttcaccatccatgaccttcgtggcctgggagccaagaagttctatgggaagttctgtgctggctccatcgaccatatcagtattcgccaactacagctcatcctattcaaggtggccctgatgctgggagttgaaatccatgtgaatgtggagttcgtgaaggttctagagcctcctgaagatcaagaaaatcaaaaaattggctggcgggcagaatttctccctacagaccattctctgtcggagtttgagtttgacgtcatcattggtgccgatggccgcaggaacaccctggaagggttcagaagaaaagaattccgtgggaagctggcgattgccatcaccgccaacttcataaacagaaacagcacagcggaagccaaggtggaagagattagtggtgtggctttcatcttcaatcagaaattttttcaggaccttaaagaagaaacaggcatagatcttgagaacattgtttactacaaggactgcacccactattttgtaatgacagccaagaagcagagcctgctcgacaaaggtgtcatcattaacgactacatcgacacagagatgctgctgtgtgcggagaacgtgaaccaagacaacctgctatcctatgcccgggaagctgcagactttgccaccaactaccagctgccatccttagactttgccatgaaccactatgggcagcctgatgtggccatgtttgactttacctgcatgtatgcctcagagaacgcggccctggtgcgggagcggcaggcgcaccagctgctcgtggcccttgtgggtgacagcttgcttgagccattttggcccatgggtacaggctgtgcccgtggcttcctggcagcctttgacacggcatggatggtgaagagctggaaccagggcacccctcccctggagctgctggctgaaagggaaagtctctaccggctgttacctcagacaaccccggagaacatcaacaagaactttgagcagtacacgttggacccagggacacggtacccaaacctcaactcacactgtgtcaggccccatcaggtgaagcatttgtatatcactaaggagctggagcactaccctctcgagagactgggctcggtgaggagatctgtcaacctctccaggaaggagtcagatatccggcccagcaagctcctgacctggtgccagcagcagacagagggctaccagcatgtcaacgtcaccgacctgaccacatcctggcgcagtgggttggccctgtgtgccatcatccaccgcttccggcctgagctcatcaactttgactctttgaatgaagatgatgctgtggagaacaaccagctcgcatttgatgtggccgagcgagagtttgggatccctccagtgaccacgggcaaagagatggcatctgcccaggagcctgacaagctcagcatggtcatgtacctctccaagttctacgagctcttccggggcaccccactgaggcccgtggattcttggcgcaaaaactatggagaaaatgctgacctcagcttggccaaatcatccatttctaataactatctcaacctcacatttccaaggaagaggactccacgggtggatggtcaaaccggagagaatgacatgaacaaacggagacggaagggcttcaccaacctggacgagccttcaaacttttccagccgtagcttgggctccaatcaagagtgtgggagcagtaaggaaggtggaaatcagaacaaagtcaagtccatggcgaatcagctgctggccaagtttgaggagagcactcggaacccctcactcatgaagcaggaaaagaagtcaccttcagggttccattttcatcccagccatttgagaacagtgcatcctcaggaatctatgcgaaagtcatttccccttaacctgggaggcagcgacacgtgttacttctgtaagaaacgtgtgtacgtgatggaacggctgagcgccgagggccacttcttccaccgggagtgtttccgctgcagcatctgtgccaccaccttgcgcctggccgcctacacctttgactgcgatgaaggcaaattttactgcaagcctcacttcattcactgtaaaaccaatagcaaacaacggaagagacgggcagagttgaagcaacaaagagaggaggaggcaacatggcaagagcaggaagcccctcggagagacactcccaccgaaagttcttgcgcagtggccgccattggcaccctggaaggcagccccccaggtatctccacctccttctttaggaaggtgctgggctggcccctcaggctgccgagggacctgtgtaactggatgcagggactcctgcaagctgctggcctccatatcagggacaatgcttacaactactgctacatgtacgagctcctgagcctggggctgccactcctctgggcgttctctgaggtcctggcagccatgtacagggaatctgagggctccctcgagagcatctgcaactgggtgctcaggtgcttcccagtcaagctccgctgacatggctggctgccccaaagtgccttcacatttccagggaggcttcagatggcagtgcgtttgcagtttgctcaggctctggccaggaagcctagcattctctaagcaattagctcaaagccaaagaatttcacatgggccacctccgcctggccttatcagggtgaacatctactcacggtgctagggccagggatgatatgaaggatcttttctatagctttgtgagccatacttctgggtttacatttcaatttttttaattttaattagcccagagaaagcatttttttctatgagtgtcaatttttctaaacatgggtttgaagcttataaccagttttataaaccccttgaacactgcagtgagttatcaaagccactgcctgcaaagtggatgatttaagattttacacgcatgaaaatgagtgtgccatctcctgaccagtgccttttgacttaggtacccagatgccacttgtcagcagcaggatactttttacaacacgaaagcataattattttagaagaagagagtagaagggcagaatagaattcaacttacagaagcacggagcagtgtgtggttggctgttatctgtccccctgggaggaggactgttttgctcccttgttttgatgttaaacagtagcttaaaggctttcccccccataccaactcacagccaaatgacaaagaaccgtggggtttcaacagattctacaaacatgcattttcccttcccactaatgggcactgcagggaaagcccattggcatttgaccatggagctgatgcagtgccaaagatgagctctttcaactgatggcattttagcccctgtggctcccagcggatcccccagcccgggctgcaggctgagccaaggctgtgcagggtccatattggtcaggccaagtggagtggaagactctgtccacttatgtggtgtcctttgggactgagggggtttgttagcacatcaggctattgctgggaagcgtggcctgcccagtgagcattgcctgtggacatcctgactgcttagctgctccgctgccacacatatgtggtcaaaacagaaaccaatttcacactgccctgggaaaggaatgggtctgacctccaggggaagctctaccatatcttgactggcagggaaggctgggagtggaagctatttatggactgatccaaaggacatatgcatgagtaagggtaaaaatgagcatgcaggtccacctgtgttcttactctgggtatctagaagagtcctcagctctccctactccacgctgcctagacatacacagctgcagggtctggctgaacaatcaaggggccgccagagaaaggccatctacggtgcgcagtgtatctggagttgctgggcccaagatagctctgtggagttatcactagagatgcctctggattaactaagaggtgtgcctgggtgtgggtgaggagtcagaacctttgagagctttgagatgacagtttctatggggcgggaagaaggaggtgcatttctacaaacacttccctgaaatccttgggaaaaacagaggcatggccgtggccaactctgtgggaactggcgcctctgtccttgttggcactgttctcagtccgatgacttgcattgtgttttctccaatttttgctgggattttaatgttcagcatggtgggaggaacccttgattccttttgtttgagtatagaaagtaaatttttgaggtcatgatgtgaacggccatgttattgtgattatcttcagctcaggataggctgagatgctttgtggagtgttccatgaagcccgagtcggaatctctgactgtcgtgtacagccataaggagactggtttgaattactgtggcgagacagggcgtgcctgtcagaaatctgagatgtttgtacgctctgagatgttgaacctttctggtgggcagcaccgacacccaggggtggacccccgaggatgaatgcctctaggcctccgcaacatattcaagaatgaatgggagacgctagagtaaaatgggggcagagaggatatcagggagcaagatgcaaactgtgtgcatccactctcgtaaacaagtagctggtcacaaccagaaaggttcatctctcctaagcaaacagcgactctttcagaggaagtttccctctttcaatcgtggccttattttcaactccggtgccttctcgtgatgttaatcatttccttttttccccacactaagctctcttttctatctttctctctctttccaatcttacgccatggccatcagttcatttcagccttccagtgctacacccacttcttggctgacacacttctgctctaaggtgactggttttcttgccaattttcaaagagtggtactaacccccaacccgctttccgcaccccgtcctctccgccagcagtactggttgcactaactgtgagtgtcttgcatactgatggactcatttggtggcatggttggctaacagcatggcggggggtgttcagcttgagacccatgcctgtgttcatttcccatggagctggcagcctggtctaccccaagtgcatgccccgcctctcctctctcccttgggtctgcctgcgtgcatgcttctccagttgcgtctgcgaagctacctactttcttgggagggtcgaccttgatcatgaaacaataccatgagggggcctctgtcacctttgaaaagaacactttttgagcagcctcaaaaagctcatacataccagcgccttcttaaattggctctaatgtaaagattgttaatgtcatttatcaaaaccataggtgattatttggagggatttaaaaaacttaattactctcaggcctcatcccaagcttgacacatgctctgtaggttgaacacataatcacaaatattctagcaaatgctgccttggttgcagcctgcactgtagacccaagggttttgctgtggctcttcttatctcccttggctcataaagccccagatgatgccagagcttcaattagagccatcatcatcccaggcagggatatctttgagaaatgactcagttcagccccaggcccctgtgactctgcttaaagcacacatttctgctgactcttgtacctggggcagcaggataatcaccaacacactcttaacgagaaacaacacaccaagcaccgtggagctgtcctaggcaacactcgcggtctcaggctgcggtgggcgtctgtcctgcatgtggcccagaccaccctgacccccgggcctgcctgcctggccctgcatgctgcacgctcactgtatttgtgcagatcctggccagtacaaagtcgttgctcttgtcttatcttctcttacagagtctccctccctttatagaatgtcaaccaaagagtgccctcctcccctctcagcctcctctttagctagcctccccatctcatcacaacgcatgtctgtgacctttggtaatcatttacagtgccacacggaaccctgtattttgcacacagcaaaacaaacaatgtttagctttatttatggtatttgatgctgtaaatggaaataaatattgttctttataaagctc

SEQ ID NO: 153823 - DNA, 593 bp, Homo sapiens
  Payload ID: 10243
  Gene Symbol: MICAL2
  Gene Name: microtubule associated monooxygenase, calponin and LIM domain containing 2
  ENST ID: ENST00000533389
  CDS Start-End: 289-593
ataggggaagagattacctgcaatgccacatcgacaggccaaaaggcacaattctgtatctgttataaatatttatgtttagtattgaacactaaatagtgtggttaatatttgaatgtcttaaagaaattgcatttttacttctcagcacccatcccccaccctaacctcatcgtccaaagctgacctctgcctccccctactttcacaggtgtgacgtttctccagatacttcatgctgttcacctgtgtcctcgccgcaccactgccgcacacgactcctgaaccatgggggaaaacgaggatgagaagcaggcccaggcggggcaggtttttgagaactttgtccaggcatccacgtgcaaaggtaccctccaggccttcaacattctcacacgacacctggacctagaccctctggaccacagaaacttttattccaagctcaagtccaaggtgaccacctggaaagccaaagccctgtggtacaaattggataagcgtggttcccacaaagagtataagcgagggaagtcgtgcacgaacaccaagtgtctcatagttgggggaggaccctgtggcttgcgcactgc

SEQ ID NO: 153824 - DNA, 566 bp, Homo sapiens
  Payload ID: 10243
  Gene Symbol: MICAL2
  Gene Name: microtubule associated monooxygenase, calponin and LIM domain containing 2
  ENST ID: ENST00000525119
  CDS Start-End: 165-566
agatggtgtgcttccagctgataccaggagcagaagttttgagaagagactgtttgtcatgtggatagtggaaagccctgctctctggtgtgacgtttctccagatacttcatgctgttcacctgtgtcctcgccgcaccactgccgcacacgactcctgaaccatgggggaaaacgaggatgagaagcaggcccaggcggggcaggtttttgagaactttgtccaggcatccacgtgcaaaggtaccctccaggccttcaacattctcacacgacacctggacctagaccctctggaccacagaaacttttattccaagctcaagtccaaggtgaccacctggaaagccaaagccctgtggtacaaattggataagcgtggttcccacaaagagtataagcgagggaagtcgtgcacgaacaccaagtgtctcatagttgggggaggaccctgtggcttgcgcactgccattgaacttgcctacctgggagccaaagtggtcgtggtggagaagagggactccttctcccggaacaacgtgctacacctctggcctttcaccatc

SEQ ID NO: 153825 - DNA, 516 bp, Homo sapiens
  Payload ID: 10243
  Gene Symbol: MICAL2
  Gene Name: microtubule associated monooxygenase, calponin and LIM domain containing 2
  ENST ID: ENST00000532420
  CDS Start-End: 253-516
aatgatgctgattctctcctctgcacagcctcacaatcacctgaatatccccttcaagtgcatcctgccctgggtttcctgtgtgcacattgagtttccttctctagttgaagagagagtttgcagaggctggcaaacctggagctggactgaatggcctggacaggtggagcaggtgtgacgtttctccagatacttcatgctgttcacctgtgtcctcgccgcaccactgccgcacacgactcctgaaccatgggggaaaacgaggatgagaagcaggcccaggcggggcaggtttttgagaactttgtccaggcatccacgtgcaaaggtaccctccaggccttcaacattctcacacgacacctggacctagaccctctggaccacagaaacttttattccaagctcaagtccaaggtgaccacctggaaagccaaagccctgtggtacaaattggataagcgtggttcccacaaagagtataagcgagggaagtcgtgcacgaacaccaag

SEQ ID NO: 153826 - DNA, 3358 bp, Homo sapiens
  Payload ID: 10243
  Gene Symbol: MICAL2
  Gene Name: microtubule associated monooxygenase, calponin and LIM domain containing 2
  Uniprot ID: O94851
  ENST ID: ENST00000527546
  CDS Start-End: 155-2959
aggaacatggcaacccgtgtgtgtctcatcccagaaagagaagactttaaccactgtgatgcctgagaatccagtgagtgtgacgtttctccagatacttcatgctgttcacctgtgtcctcgccgcaccactgccgcacacgactcctgaaccatgggggaaaacgaggatgagaagcaggcccaggcggggcaggtttttgagaactttgtccaggcatccacgtgcaaaggtaccctccaggccttcaacattctcacacgacacctggacctagaccctctggaccacagaaacttttattccaagctcaagtccaaggtgaccacctggaaagccaaagccctgtggtacaaattggataagcgtggttcccacaaagagtataagcgagggaagtcgtgcacgaacaccaagtgtctcatagttgggggaggaccctgtggcttgcgcactgccattgaacttgcctacctgggagccaaagtggtcgtggtggagaagagggactccttctcccggaacaacgtgctacacctctggcctttcaccatccatgaccttcgtggcctgggagccaagaagttctatgggaagttctgtgctggctccatcgaccatatcagtattcgccaactacagctcatcctattcaaggtggccctgatgctgggagttgaaatccatgtgaatgtggagttcgtgaaggttctagagcctcctgaagatcaagaaaatcaaaaaattggctggcgggcagaatttctccctacagaccattctctgtcggagtttgagtttgacgtcatcattggtgccgatggccgcaggaacaccctggaagggttcagaagaaaagaattccgtgggaagctggcgattgccatcaccgccaacttcataaacagaaacagcacagcggaagccaaggtggaagagattagtggtgtggctttcatcttcaatcagaaattttttcaggaccttaaagaagaaacaggcatagatcttgagaacattgtttactacaaggactgcacccactattttgtaatgacagccaagaagcagagcctgctcgacaaaggtgtcatcattaacgactacatcgacacagagatgctgctgtgtgcggagaacgtgaaccaagacaacctgctatcctatgcccgggaagctgcagactttgccaccaactaccagctgccatccttagactttgccatgaaccactatgggcagcctgatgtggccatgtttgactttacctgcatgtatgcctcagagaacgcggccctggtgcgggagcggcaggcgcaccagctgctcgtggcccttgtgggtgacagcttgcttgagccattttggcccatgggtacaggctgtgcccgtggcttcctggcagcctttgacacggcatggatggtgaagagctggaaccagggcacccctcccctggagctgctggctgaaagggaaagtctctaccggctgttacctcagacaaccccggagaacatcaacaagaactttgagcagtacacgttggacccagggacacggtacccaaacctcaactcacactgtgtcaggccccatcaggtgaagcatttgtatatcactaaggagctggagcactaccctctcgagagactgggctcggtgaggagatctgtcaacctctccaggaaggagtcagatatccggcccagcaagctcctgacctggtgccagcagcagacagagggctaccagcatgtcaacgtcaccgacctgaccacatcctggcgcagtgggttggccctgtgtgccatcatccaccgcttccggcctgagctcatcaactttgactctttgaatgaagatgatgctgtggagaacaaccagctcgcatttgatgtggccgagcgagagtttgggatccctccagtgaccacgggcaaagagatggcatctgcccaggagcctgacaagctcagcatggtcatgtacctctccaagttctacgagctcttccggggcaccccactgaggcccgtggattcttggcgcaaaaactatggagaaaatgctgacctcagcttggccaaatcatccatttctaataactatctcaacctcacatttccaaggaagaggactccacgggtggatggtcaaaccggagagaatgacatgaacaaacggagacggaagggcttcaccaacctggacgagccttcaaacttttccagccgtagcttgggctccaatcaagagtgtgggagcagtaaggaaggtggaaatcagaacaaagtcaagtccatggcgaatcagctgctggccaagtttgaggagagcactcggaacccctcactcatgaagcaggaaaagaagtcaccttcagggttccattttcatcccagccatttgagaacagtgcatcctcagctgacggtagggaaagtgtccagcggaataggggctgcagctgaagtcctggtcaatctgtacatgaatgatcacagacctaaggcccaggccacctctccagacctggaatctatgcgaaagtcatttccccttaacctgggaggcagcgacacgtgttacttctgtaagaaacgtgtgtacgtgatggaacggctgagcgccgagggccacttcttccaccgggagtgtttccgctgcagcatctgtgccaccaccttgcgcctggccgcctacacctttgactgcgatgaaggcaaattttactgcaagcctcacttcattcactgtaaaaccaatagcaaacaacggaagagacgggcagagttgaagcaacaaagagaggaggaggcaacatggcaagagcaggaagcccctcggagagacactcccaccgaaagttcttgcgcagtggccgccattggcaccctggaaggcagccccccagttcatttcagccttccagtgctacacccacttcttggctgacacacttctgctctaaggtgactggttttcttgccaattttcaaagagtggtactaacccccaacccgctttccgcaccccgtcctctccgccagcagtactggttgcactaactgtgagtgtcttgcatactgatggactcatttggtggcatggttggctaacagcatggcggggggtgttcagcttgagacccatgcctgtgttcatttcccatggagctggcagcctggtctaccccaagtgcatgccccgcctctcctctctcccttgggtctgcctgcgtgcatgcttctccagttgcgtctgcgaagctacctactttcttgggagggtcgaccttgatcatgaaacaataccatgagggggcctctgtcacctttgaaaagaacacttttt

SEQ ID NO: 153827 - DNA, 589 bp, Homo sapiens
  Payload ID: 10243
  Gene Symbol: MICAL2
  Gene Name: microtubule associated monooxygenase, calponin and LIM domain containing 2
  ENST ID: ENST00000532179
  CDS Start-End: 295-589
accaagactaatgaaggtccggccctccccagtgtaggaggcaggtaaatgatcacactgtgacaaatgctcaaacggggatgtgcttgcaaaggctagagacagcacgggaggaaggagcagtccattctgctgagagtgtgagtaccgagaaagcatggcactgggcttgaaggatgaggagttcgccagacacagaggatgaggagagcagcacgtgtgacgtttctccagatacttcatgctgttcacctgtgtcctcgccgcaccactgccgcacacgactcctgaaccatgggggaaaacgaggatgagaagcaggcccaggcggggcaggtttttgagaactttgtccaggcatccacgtgcaaaggtaccctccaggccttcaacattctcacacgacacctggacctagaccctctggaccacagaaacttttattccaagctcaagtccaaggtgaccacctggaaagccaaagccctgtggtacaaattggataagcgtggttcccacaaagagtataagcgagggaagtcgtgcacgaacaccaagtgtctcatagttgggggaggaccctgtggct

SEQ ID NO: 153828 - DNA, 473 bp, Homo sapiens
  Payload ID: 10243
  Gene Symbol: MICAL2
  Gene Name: microtubule associated monooxygenase, calponin and LIM domain containing 2
  ENST ID: ENST00000530823
  CDS Start-End: 463-473
gaacaaactttctttgcaggattgggtcaaccatggggtctgatttggagatgcttcccttctctgtcagctgctcatgtctcaaatgaagagccttttgtgatgaccatgtatggaatagtgtctgaagtaccactgcactgtacctgtctttgcgtctaaacatcactaccatcatcacgggacaaaccgcccatctcagtggtgtctggcagtgagctgaacatggcaacccgtgtgtgtctcatcccagaaagagaagactttaaccactgtgatgcctgagaatccaagacagagtctcactgcgttgcccaggctggtcttgaactcttggactcaagcaatcctcccaccttggcctcccaaagagcaggaattacaggtgtgacgtttctccagatacttcatgctgttcacctgtgtcctcgccgcaccactgccgcacacgactcctgaaccatgggggaaaa

SEQ ID NO: 153829 - DNA, 546 bp, Homo sapiens
  Payload ID: 10243
  Gene Symbol: MICAL2
  Gene Name: microtubule associated monooxygenase, calponin and LIM domain containing 2
  ENST ID: ENST00000526065
  CDS Start-End: 282-546
aatgaaggtccggccctccccagtgtaggaggcaggtaaatgatcacactgtgacaaatgctcaaacggggatgtgcttgcaaaggctagagacagcacgggaggaaggagcagtccattctgctgagagtgtagctcagttccaagaacacttattgatgcttacaccgggccaagccctgtgatgggccctgggttccagaggtgtgacgtttctccagatacttcatgctgttcacctgtgtcctcgccgcaccactgccgcacacgactcctgaaccatgggggaaaacgaggatgagaagcaggcccaggcggggcaggtttttgagaactttgtccaggcatccacgtgcaaaggtaccctccaggccttcaacattctcacacgacacctggacctagaccctctggaccacagaaacttttattccaagctcaagtccaaggtgaccacctggaaagccaaagccctgtggtacaaattggataagcgtggttcccacaaagagtataagcgagggaagtcgtgcacgaacaccaagg

SEQ ID NO: 153830 - DNA, 573 bp, Homo sapiens
  Payload ID: 10243
  Gene Symbol: MICAL2
  Gene Name: microtubule associated monooxygenase, calponin and LIM domain containing 2
  ENST ID: ENST00000524685
  CDS Start-End: 212-573
ggtagatggtgtgcttccagctgataccaggagcagaagttttgagaagagactgtttgtcatgtggatagtggaaagccctgctctctggtaacgaatgaagaaaggctttaaagctgggtgtctacggagaggtgtgacgtttctccagatacttcatgctgttcacctgtgtcctcgccgcaccactgccgcacacgactcctgaaccatgggggaaaacgaggatgagaagcaggcccaggcggggcaggtttttgagaactttgtccaggcatccacgtgcaaaggtaccctccaggccttcaacattctcacacgacacctggacctagaccctctggaccacagaaacttttattccaagctcaagtccaaggtgaccacctggaaagccaaagccctgtggtacaaattggataagcgtggttcccacaaagagtataagcgagggaagtcgtgcacgaacaccaagtgtctcatagttgggggaggaccctgtggcttgcgcactgccattgaacttgcctacctgggagccaaagtggtcgtggtggagaagagggactcctt

SEQ ID NO: 153831 - DNA, 3774 bp, Homo sapiens
  Payload ID: 10243
  Gene Symbol: MICAL2
  Gene Name: microtubule associated monooxygenase, calponin and LIM domain containing 2
  Uniprot ID: O94851
  ENST ID: ENST00000537344
  CDS Start-End: 153-3527
gaacatggcaacccgtgtgtgtctcatcccagaaagagaagactttaaccactgtgatgcctgagaatccagtgagtgtgacgtttctccagatacttcatgctgttcacctgtgtcctcgccgcaccactgccgcacacgactcctgaaccatgggggaaaacgaggatgagaagcaggcccaggcggggcaggtttttgagaactttgtccaggcatccacgtgcaaaggtaccctccaggccttcaacattctcacacgacacctggacctagaccctctggaccacagaaacttttattccaagctcaagtccaaggtgaccacctggaaagccaaagccctgtggtacaaattggataagcgtggttcccacaaagagtataagcgagggaagtcgtgcacgaacaccaagtgtctcatagttgggggaggaccctgtggcttgcgcactgccattgaacttgcctacctgggagccaaagtggtcgtggtggagaagagggactccttctcccggaacaacgtgctacacctctggcctttcaccatccatgaccttcgtggcctgggagccaagaagttctatgggaagttctgtgctggctccatcgaccatatcagtattcgccaactacagctcatcctattcaaggtggccctgatgctgggagttgaaatccatgtgaatgtggagttcgtgaaggttctagagcctcctgaagatcaagaaaatcaaaaaattggctggcgggcagaatttctccctacagaccattctctgtcggagtttgagtttgacgtcatcattggtgccgatggccgcaggaacaccctggaagggttcagaagaaaagaattccgtgggaagctggcgattgccatcaccgccaacttcataaacagaaacagcacagcggaagccaaggtggaagagattagtggtgtggctttcatcttcaatcagaaattttttcaggaccttaaagaagaaacaggcatagatcttgagaacattgtttactacaaggactgcacccactattttgtaatgacagccaagaagcagagcctgctcgacaaaggtgtcatcattaacgactacatcgacacagagatgctgctgtgtgcggagaacgtgaaccaagacaacctgctatcctatgcccgggaagctgcagactttgccaccaactaccagctgccatccttagactttgccatgaaccactatgggcagcctgatgtggccatgtttgactttacctgcatgtatgcctcagagaacgcggccctggtgcgggagcggcaggcgcaccagctgctcgtggcccttgtgggtgacagcttgcttgagccattttggcccatgggtacaggctgtgcccgtggcttcctggcagcctttgacacggcatggatggtgaagagctggaaccagggcacccctcccctggagctgctggctgaaagggaaagtctctaccggctgttacctcagacaaccccggagaacatcaacaagaactttgagcagtacacgttggacccagggacacggtacccaaacctcaactcacactgtgtcaggccccatcaggtgaagcatttgtatatcactaaggagctggagcactaccctctcgagagactgggctcggtgaggagatctgtcaacctctccaggaaggagtcagatatccggcccagcaagctcctgacctggtgccagcagcagacagagggctaccagcatgtcaacgtcaccgacctgaccacatcctggcgcagtgggttggccctgtgtgccatcatccaccgcttccggcctgagctcatcaactttgactctttgaatgaagatgatgctgtggagaacaaccagctcgcatttgatgtggccgagcgagagtttgggatccctccagtgaccacgggcaaagagatggcatctgcccaggagcctgacaagctcagcatggtcatgtacctctccaagttctacgagctcttccggggcaccccactgaggcccgtggattcttggcgcaaaaactatggagaaaatgctgacctcagcttggccaaatcatccatttctaataactatctcaacctcacatttccaaggaagaggactccacgggtggatggtcaaaccggagagaatgacatgaacaaacggagacggaagggcttcaccaacctggacgagccttcaaacttttccagccgtagcttgggctccaatcaagagtgtgggagcagtaaggaaggtggaaatcagaacaaagtcaagtccatggcgaatcagctgctggccaagtttgaggagagcactcggaacccctcactcatgaagcaggaacgccgtgtctcagggataggtaagccggtcctgtgctcttcctccggccctcctgttcactcttgctgccccaagccggaggaggccacacccagcccatcacctcctctgaaaaggcagttcccctctgtggtcgtgacggggcacgtgctcagagagctcaagcaagtgtctgctggcagtgagtgcctgagcagaccttggagagccagagccaagtctgacctacagctgggtgggacagaaaatttcgctaccctgccttctacccgcccgagggcgcaggctctttccggggtgctgtggcggctgcagcaagtggaggaaaagattctccagaagagggctcagaacttggccaacagggaatttcacacaaagaacattaaggagaaggcggctcaccttgcctccatgtttggacacggggatttcccgcagaataaactactctctaaaggcctgtctcatactcatcctccatctcctccctctcgccttccgtctcctgatccagctgcttcttcctctccatcaactgttgactctgcttctcctgccagaaaggaaaagaagtcaccttcagggttccattttcatcccagccatttgagaacagtgcatcctcagctgacggtagggaaagtgtccagcggaataggggctgcagctgaagtcctggtcaatctgtacatgaatgatcacagacctaaggcccaggccacctctccagacctggaatctatgcgaaagtcatttccccttaacctgggaggcagcgacacgtgttacttctgtaagaaacgtgtgtacgtgatggaacggctgagcgccgagggccacttcttccaccgggagtgtttccgctgcagcatctgtgccaccaccttgcgcctggccgcctacacctttgactgcgatgaaggcaaattttactgcaagcctcacttcattcactgtaaaaccaatagcaaacaacggaagagacgggcagagttgaagcaacaaagagaggaggaggcaacatggcaagagcaggaagcccctcggagagacactcccaccgaaagttcttgcgcagtggccgccattggcaccctggaaggcagccccccagttcatttcagccttccagtgctacacccacttcttggctgacacacttctgctctaagagtctccctccctttatagaatgtcaaccaaagagtgccctcctcccctctcagcctcctctttagctagcctccccatctcatcacaacgcatgtctgtgacctttggtaatcatttacagtgccacacggaaccctgtattttgcacacagcaaaacaaacaatgtttagctttatttatggtatttgatgctgtaaatggaaataaatattgttctttataaagctc

SEQ ID NO: 153832 - DNA, 2963 bp, Homo sapiens
  Payload ID: 10244
  Gene Symbol: MICAL3
  Gene Name: microtubule associated monooxygenase, calponin and LIM domain containing 3
  Uniprot ID: Q7RTP6
  ENST ID: ENST00000383094
  CDS Start-End: 16-2862
tgagagtgaggcagcatggaggagaggaagcatgagaccatgaacccagctcatgtcctctttgaccggtttgtccaggccaccacctgcaagggaaccctcaaggctttccaggagctctgtgaccacctggaactaaagccaaaggactaccgctccttctatcacaagctcaagtccaagcttaactactggaaagccaaagccctctgggcaaaattggacaaacggggcagtcacaaagactacaaaaagggaaaagcgtgcactaacaccaagtgtctcatcattggggctggcccctgtggtctccgtacagccatcgacttatccttactgggggccaaggtggttgttattgagaaacgagatgccttctcccgcaacaacgtcttgcatctctggccattcaccatacatgatctacgaggtctgggtgccaagaagttctatggcaagttctgtgctggagccatcgaccatatcagtatccgtcagctccaactaatacttttgaaagtagccttgatcctaggcattgaaatccacgtcaatgtggaattccaaggacttatacagcctcctgaggaccaagagaatgaacggataggctggcgggcactggtgcaccccaagactcatcctgtgtcagagtatgaatttgaagtgatcatcggtggggatggtcggaggaacaccttggaagggtttcgtcggaaagaattccgtggcaaactggccatcgccatcacggcaaattttatcaaccgaaatacaacagcagaagctaaagtggaagagatcagtggtgtggcttttatattcaaccaaaaatttttccaggaactgagggaagccacaggtattgacttggagaacatcgtttactacaaagatgacacacactatttcgttatgacagccaaaaagcagagtttgctggacaaaggagtgatactacatgactacgccgacacagagctcctgctttcccgagaaaacgtggaccaggaggctctgctcagctatgccagggaggcggcagacttctctacccagcagcagctgccgtctctggattttgccatcaatcactatgggcagcccgatgtggccatgtttgacttcacttgtatgtatgcctccgagaacgccgccttggtgcgggagcagaacggacaccagttactagtggctctggtcggggacagcctcctagagcctttctggccaatgggaacaggaatagcccggggctttctagctgctatggactctgcctggatggtccgaagttggtctctaggaacgagccctttggaagtgctggcagagagggaaagtatttacaggttgctgcctcagaccacccctgagaatgtgagtaagaacttcagccagtacagtatcgaccctgtcactcggtatcccaatatcaacgtcaacttcctccggccaagccaggtgcgccatttatatgatactggcgaaacaaaagatattcacctggaaatggagagcctggtgaattcccgaaccacccccaaattgactcgcaatgagtctgtagctcgttcaagcaaactgctgggttggtgccagaggcagacagatggctatgcaggggtaaacgtgacagatctcaccatgtcctggaaaagtggcttggccctttgtgcaattatccatagataccgccctgacctgatagattttgattctttggatgagcaaaatgtggagaagaataaccaactggcctttgacattgctgagaaggaattgggcatttctcccatcatgacaggcaaagaaatggcctccgtgggggagcctgataagctgtccatggtgatgtacctgactcagttctacgagatgtttaaggactccctcccctctagcgacaccttggacctaaatgccgaggagaaagcagtcctgatagccagcaccagatcccctatctccttcctaagcaaacttggccagaccatctctcggaagcgttctcccaaggataaaaaggaaaaggacttggatggtgctgggaagaggagaaagaccagtcaatcagaggaggaggaagctcctcggggccacagaggagaaagaccgaccctggtgagcactctgacagacaggaggatggacgttgccgttgggaaccagaacaaagtgaagtacatggcgacccagctgctggccaaatttgaagagaatgcgcccgcacagtccatcggcatacggagacagggctccatgaagaaggagttcccgcagaacctgggaggcagcgacacatgctacttctgccagaagcgggtctacgtgatggagaggctgagtgccgagggcaagttcttccaccggagctgcttcaagtgcgagtactgcgccaccaccctgcgcctctcggcctacgcctacgacatcgaggatggtaaattctactgtaagccacactactgctatcgactctctggctacgcacaaaggaagagaccggcagtggctcccctgtctggaaaggaggccaaaggacccctgcaggatggcgccaccacagatgcaaacggacgggccaacgccgtggccagctccactgagagaaccccaggttcaggcgtgaacggcctggaggagcccagcatcgccaagcgactgaggggcaccccagagcggatcgagctggagaactaccgcctgtccctgaggcaggctgaggcactgcaggaggtaccggaggagactcaggccgagcacaacctgagcagcgtgctggacacgggcgccgaggaggacgtcgccagcaggtcagcacgcagggctgcagggcgcccacccgccacacggccctaagagcctcctcacctctgtgtgtctcggtttcttctcagtgaagggaggcctcctgtctttcctgctgcccgcagtccattctccccagtcccttttaggtt

SEQ ID NO: 153833 - DNA, 3046 bp, Homo sapiens
  Payload ID: 10244
  Gene Symbol: MICAL3
  Gene Name: microtubule associated monooxygenase, calponin and LIM domain containing 3
  Uniprot ID: Q7RTP6
  ENST ID: ENST00000400561
  CDS Start-End: 24-2924
gggagtgctgagagtgaggcagcatggaggagaggaagcatgagaccatgaacccagctcatgtcctctttgaccggtttgtccaggccaccacctgcaagggaaccctcaaggctttccaggagctctgtgaccacctggaactaaagccaaaggactaccgctccttctatcacaagctcaagtccaagcttaactactggaaagccaaagccctctgggcaaaattggacaaacggggcagtcacaaagactacaaaaagggaaaagcgtgcactaacaccaagtgtctcatcattggggctggcccctgtggtctccgtacagccatcgacttatccttactgggggccaaggtggttgttattgagaaacgagatgccttctcccgcaacaacgtcttgcatctctggccattcaccatacatgatctacgaggtctgggtgccaagaagttctatggcaagttctgtgctggagccatcgaccatatcagtatccgtcagctccaactaatacttttgaaagtagccttgatcctaggcattgaaatccacgtcaatgtggaattccaaggacttatacagcctcctgaggaccaagagaatgaacggataggctggcgggcactggtgcaccccaagactcatcctgtgtcagagtatgaatttgaagtgatcatcggtggggatggtcggaggaacaccttggaagggtttcgtcggaaagaattccgtggcaaactggccatcgccatcacggcaaattttatcaaccgaaatacaacagcagaagctaaagtggaagagatcagtggtgtggcttttatattcaaccaaaaatttttccaggaactgagggaagccacaggtattgacttggagaacatcgtttactacaaagatgacacacactatttcgttatgacagccaaaaagcagagtttgctggacaaaggagtgatactacatgactacgccgacacagagctcctgctttcccgagaaaacgtggaccaggaggctctgctcagctatgccagggaggcggcagacttctctacccagcagcagctgccgtctctggattttgccatcaatcactatgggcagcccgatgtggccatgtttgacttcacttgtatgtatgcctccgagaacgccgccttggtgcgggagcagaacggacaccagttactagtggctctggtcggggacagcctcctagagcctttctggccaatgggaacaggaatagcccggggctttctagctgctatggactctgcctggatggtccgaagttggtctctaggaacgagccctttggaagtgctggcagagagggaaagtatttacaggttgctgcctcagaccacccctgagaatgtgagtaagaacttcagccagtacagtatcgaccctgtcactcggtatcccaatatcaacgtcaacttcctccggccaagccaggtgcgccatttatatgatactggcgaaacaaaagatattcacctggaaatggagagcctggtgaattcccgaaccacccccaaattgactcgcaatgagtctgtagctcgttcaagcaaactgctgggttggtgccagaggcagacagatggctatgcaggggtaaacgtgacagatctcaccatgtcctggaaaagtggcttggccctttgtgcaattatccatagataccgccctgacctgatagattttgattctttggatgagcaaaatgtggagaagaataaccaactggcctttgacattgctgagaaggaattgggcatttctcccatcatgacaggcaaagaaatggcctccgtgggggagcctgataagctgtccatggtgatgtacctgactcagttctacgagatgtttaaggactccctcccctctagcgacaccttggacctaaatgccgaggagaaagcagtcctgatagccagcaccagatcccctatctccttcctaagcaaacttggccagaccatctctcggaagcgttctcccaaggataaaaaggaaaaggacttggatggtgctgggaagaggagaaagaccagtcaatcagaggaggaggaagctcctcggggccacagaggagaaagaccgaccctggtgagcactctgacagacaggaggatggacgttgccgttgggaaccagaacaaagtgaagtacatggcgacccagctgctggccaaatttgaagagaatgcgcccgcacagtccatcggcatacggagacagggctccatgaagaaggagttcccgcagaacctgggaggcagcgacacatgctacttctgccagaagcgggtctacgtgatggagaggctgagtgccgagggcaagttcttccaccggagctgcttcaagtgcgagtactgcgccaccaccctgcgcctctcggcctacgcctacgacatcgaggatggtaaattctactgtaagccacactactgctatcgactctctggctacgcacaaaggaagagaccggcagtggctcccctgtctggaaaggaggccaaaggacccctgcaggatggcgccaccacagatgcaaacggacgggccaacgccgtggccagctccactgagagaaccccaggttcaggcgtgaacggcctggaggagcccagcatcgccaagcgactgaggggcaccccagagcggatcgagctggagaactaccgcctgtccctgaggcaggctgaggcactgcaggaggtaccggaggagactcaggccgagcacaacctgagcagcgtgctggacacgggcgccgaggaggacgtcgccagcagagactgggtctccccatggttgcccaggatggtctcaaactcctgggctcaaatgatccacccacctcagcctcccacagtgctgggatcacagatgtgagctactgggcccagctgagcataagagtcttttctgtgtcacctttgtgttccctacagtgtctagcaagtgcgttgtgaggggaagataattgaataaattttatccaggtaaatgaacaa

SEQ ID NO: 153834 - DNA, 4756 bp, Homo sapiens
  Payload ID: 10244
  Gene Symbol: MICAL3
  Gene Name: microtubule associated monooxygenase, calponin and LIM domain containing 3
  Uniprot ID: Q7RTP6
  ENST ID: ENST00000414725
  CDS Start-End: 1-2931
atggaggagaggaagcatgagaccatgaacccagctcatgtcctctttgaccggtttgtccaggccaccacctgcaagggaaccctcaaggctttccaggagctctgtgaccacctggaactaaagccaaaggactaccgctccttctatcacaagctcaagtccaagcttaactactggaaagccaaagccctctgggcaaaattggacaaacggggcagtcacaaagactacaaaaagggaaaagcgtgcactaacaccaagtgtctcatcattggggctggcccctgtggtctccgtacagccatcgacttatccttactgggggccaaggtggttgttattgagaaacgagatgccttctcccgcaacaacgtcttgcatctctggccattcaccatacatgatctacgaggtctgggtgccaagaagttctatggcaagttctgtgctggagccatcgaccatatcagtatccgtcagctccaactaatacttttgaaagtagccttgatcctaggcattgaaatccacgtcaatgtggaattccaaggacttatacagcctcctgaggaccaagagaatgaacggataggctggcgggcactggtgcaccccaagactcatcctgtgtcagagtatgaatttgaagtgatcatcggtggggatggtcggaggaacaccttggaagggtttcgtcggaaagaattccgtggcaaactggccatcgccatcacggcaaattttatcaaccgaaatacaacagcagaagctaaagtggaagagatcagtggtgtggcttttatattcaaccaaaaatttttccaggaactgagggaagccacaggtattgacttggagaacatcgtttactacaaagatgacacacactatttcgttatgacagccaaaaagcagagtttgctggacaaaggagtgatactacatgactacgccgacacagagctcctgctttcccgagaaaacgtggaccaggaggctctgctcagctatgccagggaggcggcagacttctctacccagcagcagctgccgtctctggattttgccatcaatcactatgggcagcccgatgtggccatgtttgacttcacttgtatgtatgcctccgagaacgccgccttggtgcgggagcagaacggacaccagttactagtggctctggtcggggacagcctcctagagcctttctggccaatgggaacaggaatagcccggggctttctagctgctatggactctgcctggatggtccgaagttggtctctaggaacgagccctttggaagtgctggcagagagggaaagtatttacaggttgctgcctcagaccacccctgagaatgtgagtaagaacttcagccagtacagtatcgaccctgtcactcggtatcccaatatcaacgtcaacttcctccggccaagccaggtgcgccatttatatgatactggcgaaacaaaagatattcacctggaaatggagagcctggtgaattcccgaaccacccccaaattgactcgcaatgagtctgtagctcgttcaagcaaactgctgggttggtgccagaggcagacagatggctatgcaggggtaaacgtgacagatctcaccatgtcctggaaaagtggcttggccctttgtgcaattatccatagataccgccctgacctgatagattttgattctttggatgagcaaaatgtggagaagaataaccaactggcctttgacattgctgagaaggaattgggcatttctcccatcatgacaggcaaagaaatggcctccgtgggggagcctgataagctgtccatggtgatgtacctgactcagttctacgagatgtttaaggactccctcccctctagcgacaccttggacctaaatgccgaggagaaagcagtcctgatagccagcaccagatcccctatctccttcctaagcaaacttggccagaccatctctcggaagcgttctcccaaggataaaaaggaaaaggacttggatggtgctgggaagaggagaaagaccagtcaatcagaggaggaggaagctcctcggggccacagaggagaaagaccgaccctggtgagcactctgacagacaggaggatggacgttgccgttgggaaccagaacaaagtgaagtacatggcgacccagctgctggccaaatttgaagagaatgcgcccgcacagtccatcggcatacggagacagctgacacaagagcgtggggccagccagccgtcctgctgcctgcctgggcaggttcgccctgcccccaccccccggtggaaacagggctccatgaagaaggagttcccgcagaacctgggaggcagcgacacatgctacttctgccagaagcgggtctacgtgatggagaggctgagtgccgagggcaagttcttccaccggagctgcttcaagtgcgagtactgcgccaccaccctgcgcctctcggcctacgcctacgacatcgaggatggtaaattctactgtaagccacactactgctatcgactctctggctacgcacaaaggaagagaccggcagtggctcccctgtctggaaaggaggccaaaggacccctgcaggatggcgccaccacagatgcaaacggacgggccaacgccgtggccagctccactgagagaaccccaggttcaggcgtgaacggcctggaggagcccagcatcgccaagcgactgaggggcaccccagagcggatcgagctggagaactaccgcctgtccctgaggcaggctgaggcactgcaggaggtaccggaggagactcaggccgagcacaacctgagcagcgtgctggacacgggcgccgaggaggacgtcgccagcaggtcagcacgcagggctgcagggcgcccacccgccacacggccctaagagcctcctcacctctgtgtgtctcggtttcttctcagtgaagggaggcctcctgtctttcctgctgcccgcagtccattctccccagtcccttttaggttcttagcctcatcttctagtcagtgaggactcctccatcagactcaattcagagattcaggaagtatttattccttgaggacctgacatgtccccagctccaagtctgtcattgggaaggaaagtggcaggctctgcccccgggttattcacagattcagcagagggaaggacgggcacacggggagggactctgggtgattcagccaccagtgcaccgggccgtcttgagggaggcctagtccgtcccccaggcatctttttttctcctgtaggtaaagaaagggactgaaaatgtgtgccccaggggccgcatgcagcaccagtggatgcatgcttaggcagttccagagctgtaatcacatccagctgggtgacacctttggggatgtgcatgctataaccctaggactccctatatccactgccctgcaccccagggcttccagtatcagcgaaggcttcaaagtgttcagccgattacagatgatcaagagagccaagaatcaaaagggggtccggtgtcctgtggggcttcaggacagaaacacaggctgcaaacccgaggggcagaggcctcaagtggccttggagagcatttgaatcacacaccttgatttagccatgatgaagggaacatgtggggataaggagagcagagcagtttttttaaggtccaagaacgctttccagaaggtgtttgctgggccgagctgctttcagctgcacccgccacctcagccctcatgtcagacaccctctgcctagattcattcttgggctgcctcacagaccgctcctccgtgcatgccgggggcagcctctgccttggtgtctgcagttccaaagctgtcactgatggtgcatcctcatccagaactctgcttccctatccagagcacccatggaggccccactctccccactgtgcccagatgagggggagcccactctctctctccactgaccctgcagtgagggtgagagatgctgtgtgtcaaaacacatttataaacccttgagcagagctactggcttgaccttgggctgagtgtgggtcagcaccattttctccactgtaatttataaattgtgagaggcagtggggcagcaagttcatgtaatgtagcaaggacattccaggaaggctaacccctggcatttatggcaggtatgacaggagggcagcacagaaaacatgaaatcagtcagcatctatgcaatgcaatacatgcctcatcttactcagattgaagttaaaaaaagattttaaaactagcattcatgctgggcgcagtggctcatgcctgtaatcccagcactttgggaggccaaggtgggcacatcacttaaggtcaggagttcaagaccagcctggccaacataatgaaaccctgtctctactaaaaatacaaaaattagctgggcatggtggtgcacacctgtaatcccagctacttgggagggtaaggcatgagaattgcttgaacctgggaggcggaggttgcagcgagccgagatcatgccactgcaccactgcactccagcctgtgtgacagaatgagactccatctcaaaaaaaattaaaattaaaatcaaaaaataaaataaaggccaggcacggtggctcacacaggagaatcacttgaacctgggaggcggaggttgcagtgatctgagatcacaccagtacactccagcctgggagatggtgagactccgtctc

SEQ ID NO: 153835 - DNA, 542 bp, Homo sapiens
  Payload ID: 10244
  Gene Symbol: MICAL3
  Gene Name: microtubule associated monooxygenase, calponin and LIM domain containing 3
  ENST ID: ENST00000424046
  CDS Start-End: 167-542
gcttataaccctgcgtccggccggcggggcgcgaggaagcccccgcctcgcgttcccgtgtggtcacctcccgccggaggatgcgtggccagattaacgtgacagtgtcaggtggacccacagccatcccacctccccctctggggagtgctgagagtgaggcagcatggaggagaggaagcatgagaccatgaacccagctcatgtcctctttgaccggtttgtccaggccaccacctgcaagggaaccctcaaggctttccaggagctctgtgaccacctggaactaaagccaaaggactaccgctccttctatcacaagctcaagtccaagcttaactactggaaagccaaagccctctgggcaaaattggacaaacggggcagtcacaaagactacaaaaagggaaaagcgtgcactaacaccaagtgtctcatcattggggctggcccctgtggtctccgtacagccatcgacttatccttactgggggccaaggtggttgttattgagaaacgagatgccttctcccgcaacaacg

SEQ ID NO: 153836 - DNA, 9445 bp, Homo sapiens
  Payload ID: 10244
  Gene Symbol: MICAL3
  Gene Name: microtubule associated monooxygenase, calponin and LIM domain containing 3
  Uniprot ID: Q7RTP6
  ENST ID: ENST00000441493
  CDS Start-End: 354-6362
cagcgcgcgctcctgcagccccggcggagtcccggcggggagcgcccgcgtaggcaggcacccggggcagccctccgtcctcgccgcgcggcctgagaacccctgggccctgggcgagggggctgggctgtgcagcccccgaggctaactgggcgggatcgcagctgcaggggttgtgcgagcagccacggcggcacctgtgccctgcgggcacccaccctgcccctgccgaggcaggcgcccaccgccggcggtgatgcggctgtgaagccctagtcgattaacgtgacagtgtcaggtggacccacagccatcccacctccccctctggggagtgctgagagtgaggcagcatggaggagaggaagcatgagaccatgaacccagctcatgtcctctttgaccggtttgtccaggccaccacctgcaagggaaccctcaaggctttccaggagctctgtgaccacctggaactaaagccaaaggactaccgctccttctatcacaagctcaagtccaagcttaactactggaaagccaaagccctctgggcaaaattggacaaacggggcagtcacaaagactacaaaaagggaaaagcgtgcactaacaccaagtgtctcatcattggggctggcccctgtggtctccgtacagccatcgacttatccttactgggggccaaggtggttgttattgagaaacgagatgccttctcccgcaacaacgtcttgcatctctggccattcaccatacatgatctacgaggtctgggtgccaagaagttctatggcaagttctgtgctggagccatcgaccatatcagtatccgtcagctccaactaatacttttgaaagtagccttgatcctaggcattgaaatccacgtcaatgtggaattccaaggacttatacagcctcctgaggaccaagagaatgaacggataggctggcgggcactggtgcaccccaagactcatcctgtgtcagagtatgaatttgaagtgatcatcggtggggatggtcggaggaacaccttggaagggtttcgtcggaaagaattccgtggcaaactggccatcgccatcacggcaaattttatcaaccgaaatacaacagcagaagctaaagtggaagagatcagtggtgtggcttttatattcaaccaaaaatttttccaggaactgagggaagccacaggtattgacttggagaacatcgtttactacaaagatgacacacactatttcgttatgacagccaaaaagcagagtttgctggacaaaggagtgatactacatgactacgccgacacagagctcctgctttcccgagaaaacgtggaccaggaggctctgctcagctatgccagggaggcggcagacttctctacccagcagcagctgccgtctctggattttgccatcaatcactatgggcagcccgatgtggccatgtttgacttcacttgtatgtatgcctccgagaacgccgccttggtgcgggagcagaacggacaccagttactagtggctctggtcggggacagcctcctagagcctttctggccaatgggaacaggaatagcccggggctttctagctgctatggactctgcctggatggtccgaagttggtctctaggaacgagccctttggaagtgctggcagagagggaaagtatttacaggttgctgcctcagaccacccctgagaatgtgagtaagaacttcagccagtacagtatcgaccctgtcactcggtatcccaatatcaacgtcaacttcctccggccaagccaggtgcgccatttatatgatactggcgaaacaaaagatattcacctggaaatggagagcctggtgaattcccgaaccacccccaaattgactcgcaatgagtctgtagctcgttcaagcaaactgctgggttggtgccagaggcagacagatggctatgcaggggtaaacgtgacagatctcaccatgtcctggaaaagtggcttggccctttgtgcaattatccatagataccgccctgacctgatagattttgattctttggatgagcaaaatgtggagaagaataaccaactggcctttgacattgctgagaaggaattgggcatttctcccatcatgacaggcaaagaaatggcctccgtgggggagcctgataagctgtccatggtgatgtacctgactcagttctacgagatgtttaaggactccctcccctctagcgacaccttggacctaaatgccgaggagaaagcagtcctgatagccagcaccagatcccctatctccttcctaagcaaacttggccagaccatctctcggaagcgttctcccaaggataaaaaggaaaaggacttggatggtgctgggaagaggagaaagaccagtcaatcagaggaggaggaagctcctcggggccacagaggagaaagaccgaccctggtgagcactctgacagacaggaggatggacgttgccgttgggaaccagaacaaagtgaagtacatggcgacccagctgctggccaaatttgaagagaatgcgcccgcacagtccatcggcatacggagacagggctccatgaagaaggagttcccgcagaacctgggaggcagcgacacatgctacttctgccagaagcgggtctacgtgatggagaggctgagtgccgagggcaagttcttccaccggagctgcttcaagtgcgagtactgcgccaccaccctgcgcctctcggcctacgcctacgacatcgaggatggtaaattctactgtaagccacactactgctatcgactctctggctacgcacaaaggaagagaccggcagtggctcccctgtctggaaaggaggccaaaggacccctgcaggatggcgccaccacagatgcaaacggacgggccaacgccgtggccagctccactgagagaaccccaggttcaggcgtgaacggcctggaggagcccagcatcgccaagcgactgaggggcaccccagagcggatcgagctggagaactaccgcctgtccctgaggcaggctgaggcactgcaggaggtaccggaggagactcaggccgagcacaacctgagcagcgtgctggacacgggcgccgaggaggacgtcgccagcagtagttccgagtctgagatggaggaggagggagaggaggaggaggaggagcctcgcctgcccccatctgacctgggtggtgttccgtggaaggaggccgtgcggatccatgcccttctgaaagggaaaagtgaagaggagctagaggcctcaaagagctttgggcctgggaatgaagaggaggaggaggaggaggaagaatatgaagaggaggaggaggaggactatgacgaggaggaggaagagtccagtgaagccgggaaccagaggctccagcaggtcatgcacgcggcggatcctctggagatccaggctgacgtgcactggactcatatccgtgagagagaggaggaagagaggatggcgccggcctctgagtcctctgcttccggagccccattggatgagaatgacctagaggaagatgtggactcagaaccagccgagatagaaggggaggcagcagaggatggggacccaggggacactggtgctgagctggatgatgatcagcactggtctgacagcccgtcggatgctgacagagagctgcgtttgccgtgcccagctgagggggaagcagagctggagctgagggtgtcggaagatgaggagaagctgcccgcctcaccgaagcaccaagagagaggtccctcccaagccaccagccccatccggtctccccaggaatcagctcttctgttcattccagtccacagcccctcaacagaggggccccaactcccacctgtccctgccgccacccaggagaaatcacctgaggagcgccttttccctgagcctttgctccccaaagagaagcccaaagctgatgccccctcggatctgaaagctgtgcactctcccatccgatcacagccagtgaccctgccagaagctaggactcctgtctcaccagggagcccgcagccccagccacccgtggcggcctccacgcccccacccagcccactccccatctgctcccagccccagccttccaccgaggccactgtcccatcccctacccagtcccccatacgcttccagcctgccccggccaaaacatccaccccactggcccctctccctgtccaaagccaaagtgacaccaaggacagactgggcagcccccttgctgtggatgaggccctcagacggagcgacctggtggaggagttctggatgaagagtgcggagatccgccgcagcctcgggctcacacctgtggaccgcagcaaggggcccgagcccagcttccccacgcctgccttcaggccagtgtccctcaaatcctattccgttgaaaagtccccccaggatgagggactccaccttctcaagcctctgtccatccccaaaaggctgggcctgccaaagccggaaggcgagccgttgtccctgccaaccccccggtccccgtccgacagagagctacgcagcgcccaggaggagcgcagggagctgtccagcagctctggcctgggcctgcacgggagctcctccaacatgaagacactgggcagccagagcttcaacacctcggactccgccatgctcacgcccccctccagcccgcccccaccgccacccccgggcgaggagcccgccaccttgcggaggaagctcagggaggccgagcccaatgcctcggtggtcccgccgcccttgcccgccacctggatgcggcccccccgggagcctgctcagccccccagagaggaggtgcggaagtcgtttgtggagagcgtggaggagattccctttgctgatgatgtggaggacacctatgacgacaagactgaggactcaagcctgcaggagaaattcttcacgcccccgtcctgctggccgcgccccgagaagcctcgccacccgcccctggccaaggagaacgggaggctgcctgctctggaggggacgctgcagccacagaagagggggctgcccttggtgtccgcggaagccaaggagttggccgaggagcgcatgcgagccagggagaagtccgtgaagagccaggcgctgcgggacgccatggccaggcagctgagcaggatgcagcagatggagctggcctcaggcgcccccaggccccgcaaggcgtcctcagcaccctcccagggcaaggagcgccggcctgactcccccacacgccccactctcaggggctccgaggagcccaccctgaagcatgaagccaccagcgaggaggtcctctccccgccgtcggactcagggggcccagatggctctttcacttcatccgagggctccagtgggaagagcaagaagaggtcgtcactcttctccccccgcagaaacaagaaggagaagaagtccaaaggcgagggccggcccccggagaagcccagctccaacctcctagaagaagccgccgccaaacccaagtccctgtggaagtccgtcttctccgggtacaagaaggacaagaagaagaaggccgacgacaagtcctgccccagcaccccctccagcggggccacggtggactctggaaagcacagggtgcttcccgtcgtaagggcagagctgcagctccggcgccagctgagcttctccgaggactcagacctctccagcgacgatgtccttgagaagtcctcacagaagtcccggcgagagccaagaacctacacggaggaggaactgaatgccaagctgacccggcgtgtgcaaaaggcagctcggagacaggccaagcaggaggagcttaagcggctgcatcgagcccagatcatccagcggcagctgcagcaggtggaggagaggcagcggcggctggaggaaaggggcgtggctgtggagaaggcgctccggggcgaagcaggcatgggcaagaaggacgaccccaagctgatgcaggagtggttcaagctagtgcaggagaagaacgccatggtgcgctacgagtcggagctgatgatctttgcccgggagctggagctggaagaccggcagagtcgactgcagcaggagctccgggaacgcatggcagtggaagatcaccttaagactgaggaggagctgtcagaagagaagcagattctcaatgagatgctggaggtggtggagcagagagactcactggtggcgctgctggaggagcagcggctccgggagagagaggaggacaaggacctggaggctgccatgctgtccaagggcttcagccttaactggtcctgagctcccacccaacgctccattttctgttggcatccgcctggccaggcagtggcatccaaaccacccggagccgcgatctgaggaggcctggcacctccttggagtttacgctcagatgcccgtgtgctgcttggaaagtggtcgagtcccgcgtgcagtggggagccccaggtgacagtggttatctgagacggctccacctcctgggaggaggcccacctggacctcccactcagaggagcagcacggcgtgtatggcatgacgcaggggaccaccccgcgcgctccctgaggatgtgctggctgtgccccttttttccactggcacatttggtaagagagggaagctgctccccgtcagaaccacagtgcgccgtgcgaggggcactgtcttcttcatgctccctggagcaccaccaaagaaacgtaaacaataccccacgaaagcagggtcaggggtcagggtgcgatcgagacccaggatgggggcgtccagtcatgcccaccccagcatcacaggagacatggaggtgcgggcaggctcctgaattattatgcaaattaggaggacgcaggaggggtctgccctccagccgaacaccacacactggaccctaagtggccaaatgcctgggccgcttgctggctgtggcctgaggcttgtgggttgctgcattttgcttgtagttcacaaccattttgacactggaaaatgctgactttgggggacaggatgaggccctacattctaagcccccagttggcagacaggcattgtccctgttccacatttatgtcgggacaggagatgaccttttcctccgtgtttttcctgtgtttgcacgttgaaatgaagctgacaacctggcaagacgctcagccgcttcaaaccctttttgtcaattaacttattttttaatacttgaaaagaagtaacttcgtttgtgtatctttactagaggaactgatcacctgcgcccgggtgcgggagccacagcggcatctggtgcgtcctacgcgacctggtccggggctgcccggtgctcctcacgtgcatctatttattagcctttctcttcgtatcactggcctggctggcatcagggagctgcccagaacccctgtgtgggtcctcctcacagctttctgtcccctcctccacccggtgcctgcctcaccctggcgctagaccatctggaccactcatgtgatgagggtgcatttccgttctgttttgggccaggccaacagcagagctgccactctcaccctcccagtgagaattccggctctgcagaactcgcccttgtctcagtttgggggccagggcatcaccttcctccgcacatatgttaaagaaggtttcaggatgggccctcatccacacaggccaagagggtgcaaggtgggaccctggaatcatgtggctggtgagaattccctcctcccagcctaagattcacccagacggaaacgcgagtgctgcagtggatgctgggatgcaggctggtgcctctcaagcagatcagcgactcccgcccttccttccgaaggcgacgggcacctgccttgtgccggatcttcatggggacataaagggcgagccccgaatcactagctcctatagccaaactgttcctttctcacggttccgcaccagcctggctgtgtacagctcatcaagccactgagctaatcggggtggggtgcttgtccatcaaagcagtcagcacatagcccagcgaggagccatccggaccagacccgcctgccaggggcgctccagccgcctgccgcctccgtgggctggggccagctgggagcagaggcctggcccctccaaggcgtcccgcagtggagcaggctgagtggctgtgctgaccttgggctttccatgggaaccacactgtgcttcaacttgaacattcatcccagctgcaaaggagcaaagaacctgtgtcatccttgtctgtccagaagctgccatctctctcccatgcacatccgggagataacgccgctagtggccgccacagcgctgattctccacctgttctcacgtgaggcaaaggtctccttttcttttctctttacttaaaaaaggggagaggagggtttctagattccatcttcaaaccccagtcgtcccataaaattggacgtgggaaaagaccttcactgcctgcgtggcctttcccagacctctcctcgaatgccacaaaaccggtccagccccggcagagccgccttcggcccttgtagctcctgctggccccacaacagggaaacagtttgcaaagtggcttggaaggagtgtggcctagggatctgctgtaagtggccagacgtagcaggagagcccagtgtcaccttctggtcctggtcagccttaacactgtggcatcctccacagcacacacggcagcctgcagtctggaaggtggacccgagcctttgcagagaggcgccgcagagccgcaggcctgcgccccagccttctgctcccgactgtgaggacacccagttctagtagagcactttttttaaagctcccattttgtaaccactagtttgcggttgacttgagtactctggtgacttcctgcgtcaagcgttctcaagctgtgagaatgtgcgcagctccaggcaggttttctctcggagagttaagtcttcccttgaaggcagggaagcaggatggatacacatatatcacacgcataaaacaccaggtgcgggagcagcccagactcaaggctgactaaactggaggctgaataccgtggaggtccacatgcagcttccctggagggcaggccggaggcgctcccgcccctgggcttgaggatgctgcaccccgtgggcttccaggcctgcccagatgatgccttcaggcctctgtccctggcggccatcctcaggccgattttgaccagcaatgatagactcttcttaaccctttcaaaataaatttttcagtgggacagaaaggagagttaaaaaacatttttttaaaggtggtaacatctgacccacaaagggaatgggtctgttttatgcaaaataaaagtttttcaaataaa

SEQ ID NO: 153837 - DNA, 5113 bp, Homo sapiens
  Payload ID: 10244
  Gene Symbol: MICAL3
  Gene Name: microtubule associated monooxygenase, calponin and LIM domain containing 3
  ENST ID: ENST00000495076
  CDS Start-End: 184-1191
gcttctccggctgctacctaccgcgccggacgctcgggctgcggaacagggcggcactggcccgccacagcgacgccggcgccgagggacaccgcagtatgaggcagagattaacgtgacagtgtcaggtggacccacagccatcccacctccccctctggggagtgctgagagtgaggcagcatggaggagaggaagcatgagaccatgaacccagctcatgtcctctttgaccggtttgtccaggccaccacctgcaagggaaccctcaaggctttccaggagctctgtgaccacctggaactaaagccaaaggactaccgctccttctatcacaagctcaagtccaagcttaactactggaaagccaaagccctctgggcaaaattggacaaacggggcagtcacaaagactacaaaaagggaaaagcgtgcactaacaccaagtgtctcatcattggggctggcccctgtggtctccgtacagccatcgacttatccttactgggggccaaggtggttgttattgagaaacgagatgccttctcccgcaacaacgtcttgcatctctggccattcaccatacatgatctacgaggtctgggtgccaagaagttctatggcaagttctgtgctggagccatcgaccatatcagtatccgtcagctccaactaatacttttgaaagtagccttgatcctaggcattgaaatccacgtcaatgtggaattccaaggacttatacagcctcctgaggaccaagagaatgaacggataggctggcgggcactggtgcaccccaagactcatcctgtgtcagagtatgaatttgaagtgatcatcggtggggatggtcggaggaacaccttggaagggtttcgtcggaaagaattccgtggcaaactggccatcgccatcacggcaaattttatcaaccgaaatacaacagcagaagctaaagtggaagagatcagtggtgtggcttttatattcaaccaaaaatttttccaggaactgagggaagccacaggactacgccgacacagagctcctgctttcccgagaaaacgtggaccaggaggctctgctcagctatgccagggaggcggcagacttctctacccagcagcagctgccgtctctggattttgccatcaatcactatgggcagcccgatgtggccatgtttgacttcacttgtatgtatgcctccgagaacgccgccttggtgcgggagcagaacggacaccagttactagtggctctggtcggggacagcctcctagagcctttctggccaatgggaacaggaatagcccggggctttctagctgctatggactctgcctggatggtccgaagttggtctctaggaacgagccctttggaagtgctggcagagagggaaagtatttacaggttgctgcctcagaccacccctgagaatgtgagtaagaacttcagccagtacagtatcgaccctgtcactcggtatcccaatatcaacgtcaacttcctccggccaagccaggtgcgccatttatatgatactggcgaaacaaaagatattcacctggaaatggagagcctggtgaattcccgaaccacccccaaattgactcgcaatgagtctgtagctcgttcaagcaaactgctgggttggtgccagaggcagacagatggctatgcaggggtaaacgtgacagatctcaccatgtcctggaaaagtggcttggccctttgtgcaattatccatagataccgccctgacctgatagattttgattctttggatgagcaaaatgtggagaagaataaccaactggcctttgacattgctgagaaggaattgggcatttctcccatcatgacaggcaaagaaatggcctccgtgggggagcctgataagctgtccatggtgatgtacctgactcagttctacgagatgtttaaggactccctcccctctagcgacaccttggacctaaatgccgaggagaaagcagtcctgatagccagcaccagatcccctatctccttcctaagcaaacttggccagaccatctctcggaagcgttctcccaaggataaaaaggaaaaggacttggatggtgctgggaagaggagaaagaccagtcaatcagaggaggaggaagctcctcggggccacagaggagaaagaccgaccctggtgagcactctgacagacaggaggatggacgttgccgttgggaaccagaacaaagtgaagtacatggcgacccagctgctggccaaatttgaagagaatgcgcccgcacagtccatcggcatacggagacagggctccatgaagaaggagttcccgcagaacctgggaggcagcgacacatgctacttctgccagaagcgggtctacgtgatggagaggctgagtgccgagggcaagttcttccaccggagctgcttcaagtgcgagtactgcgccaccaccctgcgcctctcggcctacgcctacgacatcgaggatggtaaattctactgtaagccacactactgctatcgactctctggctacgcacaaaggaagagaccggcagtggctcccctgtctggaaaggaggccaaaggacccctgcaggatggcgccaccacagatgcaaacggacgggccaacgccgtggccagctccactgagagaaccccaggttcaggcgtgaacggcctggaggagcccagcatcgccaagcgactgaggggcaccccagagcggatcgagctggagaactaccgcctgtccctgaggcaggctgaggcactgcaggaggtaccggaggagactcaggccgagcacaacctgagcagcgtgctggacacgggcgccgaggaggacgtcgccagcaggtcagcacgcagggctgcagggcgcccacccgccacacggccctaagagcctcctcacctctgtgtgtctcggtttcttctcagtgaagggaggcctcctgtctttcctgctgcccgcagtccattctccccagtcccttttaggttcttagcctcatcttctagtcagtgaggactcctccatcagactcaattcagagattcaggaagtatttattccttgaggacctgacatgtccccagctccaagtctgtcattgggaaggaaagtggcaggctctgcccccgggttattcacagattcagcagagggaaggacgggcacacggggagggactctgggtgattcagccaccagtgcaccgggccgtcttgagggaggcctagtccgtcccccaggcatctttttttctcctgtaggtaaagaaagggactgaaaatgtgtgccccaggggccgcatgcagcaccagtggatgcatgcttaggcagttccagagctgtaatcacatccagctgggtgacacctttggggatgtgcatgctataaccctaggactccctatatccactgccctgcaccccagggcttccagtatcagcgaaggcttcaaagtgttcagccgattacagatgatcaagagagccaagaatcaaaagggggtccggtgtcctgtggggcttcaggacagaaacacaggctgcaaacccgaggggcagaggcctcaagtggccttggagagcatttgaatcacacaccttgatttagccatgatgaagggaacatgtggggataaggagagcagagcagtttttttaaggtccaagaacgctttccagaaggtgtttgctgggccgagctgctttcagctgcacccgccacctcagccctcatgtcagacaccctctgcctagattcattcttgggctgcctcacagaccgctcctccgtgcatgccgggggcagcctctgccttggtgtctgcagttccaaagctgtcactgatggtgcatcctcatccagaactctgcttccctatccagagcacccatggaggccccactctccccactgtgcccagatgagggggagcccactctctctctccactgaccctgcagtgagggtgagagatgctgtgtgtcaaaacacatttataaacccttgagcagagctactggcttgaccttgggctgagtgtgggtcagcaccattttctccactgtaatttataaattgtgagaggcagtggggcagcaagttcatgtaatgtagcaaggacattccaggaaggctaacccctggcatttatggcaggtatgacaggagggcagcacagaaaacatgaaatcagtcagcatctatgcaatgcaatacatgcctcatcttactcagattgaagttaaaaaaagattttaaaactagcattcatgctgggcgcagtggctcatgcctgtaatcccagcactttgggaggccaaggtgggcacatcacttaaggtcaggagttcaagaccagcctggccaacataatgaaaccctgtctctactaaaaatacaaaaattagctgggcatggtggtgcacacctgtaatcccagctacttgggagggtaaggcatgagaattgcttgaacctgggaggcggaggttgcagcgagccgagatcatgccactgcaccactgcactccagcctgtgtgacagaatgagactccatctcaaaaaaaattaaaattaaaatcaaaaaataaaataaaggccaggcacggtggctcacacaggagaatcacttgaacctgggaggcggaggttgcagtgatctgagatcacaccagtacactccagcctgggagatggtgagactccgtctcaaaaaaaaaaaaaaaaaaaaaaagataattaaaagtagcattcagtgctatacagaatgaaaaacagtctcttaaaagtgaagagccgggtgcggtggctcacgcctgtaatcccaacgctttgggaggctgaggtgggcggatcacttgaggccaaaagttcgagaccagcctggccaacatggtgaaaccccatctttactaaaaatacaaaaaattagccgggcatggtggcggtcgcctgtaatcccagttactcgggaggctgaggcaggagaatcactggaacccagaaggcagaggttgcagtgagccaagatcgtgccatcaaactccagcctaggcaacaagagcgaaac

SEQ ID NO: 153838 - DNA, 3323 bp, Homo sapiens
  Payload ID: 10244
  Gene Symbol: MICAL3
  Gene Name: microtubule associated monooxygenase, calponin and LIM domain containing 3
  Uniprot ID: Q7RTP6
  ENST ID: ENST00000585038
  CDS Start-End: 63-3284
gtgtcaggtggacccacagccatcccacctccccctctggggagtgctgagagtgaggcagcatggaggagaggaagcatgagaccatgaacccagctcatgtcctctttgaccggtttgtccaggccaccacctgcaagggaaccctcaaggctttccaggagctctgtgaccacctggaactaaagccaaaggactaccgctccttctatcacaagctcaagtccaagcttaactactggaaagccaaagccctctgggcaaaattggacaaacggggcagtcacaaagactacaaaaagggaaaagcgtgcactaacaccaagtgtctcatcattggggctggcccctgtggtctccgtacagccatcgacttatccttactgggggccaaggtggttgttattgagaaacgagatgccttctcccgcaacaacgtcttgcatctctggccattcaccatacatgatctacgaggtctgggtgccaagaagttctatggcaagttctgtgctggagccatcgaccatatcagtatccgtcagctccaactaatacttttgaaagtagccttgatcctaggcattgaaatccacgtcaatgtggaattccaaggacttatacagcctcctgaggaccaagagaatgaacggataggctggcgggcactggtgcaccccaagactcatcctgtgtcagagtatgaatttgaagtgatcatcggtggggatggtcggaggaacaccttggaagggtttcgtcggaaagaattccgtggcaaactggccatcgccatcacggcaaattttatcaaccgaaatacaacagcagaagctaaagtggaagagatcagtggtgtggcttttatattcaaccaaaaatttttccaggaactgagggaagccacaggtattgacttggagaacatcgtttactacaaagatgacacacactatttcgttatgacagccaaaaagcagagtttgctggacaaaggagtgatactacatgactacgccgacacagagctcctgctttcccgagaaaacgtggaccaggaggctctgctcagctatgccagggaggcggcagacttctctacccagcagcagctgccgtctctggattttgccatcaatcactatgggcagcccgatgtggccatgtttgacttcacttgtatgtatgcctccgagaacgccgccttggtgcgggagcagaacggacaccagttactagtggctctggtcggggacagcctcctagagcctttctggccaatgggaacaggaatagcccggggctttctagctgctatggactctgcctggatggtccgaagttggtctctaggaacgagccctttggaagtgctggcagagagggaaagtatttacaggttgctgcctcagaccacccctgagaatgtgagtaagaacttcagccagtacagtatcgaccctgtcactcggtatcccaatatcaacgtcaacttcctccggccaagccaggtgcgccatttatatgatactggcgaaacaaaagatattcacctggaaatggagagcctggtgaattcccgaaccacccccaaattgactcgcaatgagtctgtagctcgttcaagcaaactgctgggttggtgccagaggcagacagatggctatgcaggggtaaacgtgacagatctcaccatgtcctggaaaagtggcttggccctttgtgcaattatccatagataccgccctgacctgatagattttgattctttggatgagcaaaatgtggagaagaataaccaactggcctttgacattgctgagaaggaattgggcatttctcccatcatgacaggcaaagaaatggcctccgtgggggagcctgataagctgtccatggtgatgtacctgactcagttctacgagatgtttaaggactccctcccctctagcgacaccttggacctaaatgccgaggagaaagcagtcctgatagccagcaccagatcccctatctccttcctaagcaaacttggccagaccatctctcggaagcgttctcccaaggataaaaaggaaaaggacttggatggtgctgggaagaggagaaagaccagtcaatcagaggaggaggaagctcctcggggccacagaggagaaagaccgaccctggtgagcactctgacagacaggaggatggacgttgccgttgggaaccagaacaaagtgaagtacatggcgacccagctgctggccaaatttgaagagaatgcgcccgcacagtccatcggcatacggagacagcaacgggaaaaggagtgttctcggacctgccccaaaaaagtgatcaccctgtctcctccccctactccacctccctgtcgggcacatggcggccagcagacatacagggatcttgatgctgacaaccgtggcaagcagagcccccaccatgagaggccagagcctgaacctcctcgtcgattttttgtcgaccagtgggagctttctcttagtctccgctcctctgcccgccccgcctctccctcctccgactccctccgacagaagtatataaagatgtacacgggcggagtgagctcattggctgagcagatagccaatcagcttcaaaggaaagaacaacccaaagcccttctagacaagaaggaactgggctccatgaagaaggagttcccgcagaacctgggaggcagcgacacatgctacttctgccagaagcgggtctacgtgatggagaggctgagtgccgagggcaagttcttccaccggagctgcttcaagtgcgagtactgcgccaccaccctgcgcctctcggcctacgcctacgacatcgaggatggtaaattctactgtaagccacactactgctatcgactctctggctacgcacaaaggaagagaccggcagtggctcccctgtctggaaaggaggccaaaggacccctgcaggatggcgccaccacagatgcaaacggacgggccaacgccgtggccagctccactgagagaaccccaggtagcctcacttccttgtttggctgggtggcgcgtcactccctcggcctctgtgacaaggccaagggcatgagccagcacctccaaagcaacatttcttcattcgggcaacaagtggcccaaaaccctctggactcctttttcatgtgccagctgcttgcgttcggagtcccctttctctatggcctgtcggaggtgctggtgcaaatcagaggggagttccactggcaggctgtggcccagtgatggggccgtccggtgggcggcagagccgtgaagtgctgt

SEQ ID NO: 153839 - DNA, 519 bp, Homo sapiens
  Payload ID: 10244
  Gene Symbol: MICAL3
  Gene Name: microtubule associated monooxygenase, calponin and LIM domain containing 3
  ENST ID: ENST00000579997
  CDS Start-End: 1-519
gggtacaagaaggacaagaagaagaaggccgacgacaagtcctgccccagcaccccctccagcggggccacggtggactctggaaagcacagggtgcttcccgtcgtaagggcagagctgcagctccggcgccagctgagcttctccgaggactcagacctctccagcgacgatgtccttgagaagtcctcacagaagtcccggcgagagccaagaacctacacggaggaggaactgaatgccaagctgacccggcgtgtgcaaaaggcagctcggagacaggccaagcaggaggagcttaagcggctgcatcgagcccagatcatccagcggcagctgcagcaggtggaggagaggcagcggcggctggaggaaaggggcgtggctgtggagaaggcgctccggggcgaagcagttgagcccagtggcgggactccacgacgtagacctctctccttctgcccttgctgtgtccaggaaggcatgggcaagaaggacgaccccaagctgatgcaggag

SEQ ID NO: 153840 - DNA, 5981 bp, Homo sapiens
  Payload ID: 10244
  Gene Symbol: MICAL3
  Gene Name: microtubule associated monooxygenase, calponin and LIM domain containing 3
  ENST ID: ENST00000461307
  CDS Start-End: 1-1490
gccaggtgcgccatttatatgatactggcgaaacaaaagatattcacctggaaatggagagcctggtgaattcccgaaccacccccaaattgactcgcaatgagtctgtagctcgttcaagcaaactgctgggttggtgccagaggcagacagatggctatgcaggggtaaacgtgacagatctcaccatgtcctggaaaagtggcttggccctttgtgcaattatccatagataccgccctgacctgatagattttgattctttggatgagcaaaatgtggagaagaataaccaactggcctttgacattgctgagaaggaattgggcatttctcccatcatgacaggcaaagaaatggcctccgtgggggagcctgataagctgtccatggtgatgtacctgactcagttctacgagatgtttaaggactccctcccctctagcgacaccttggacctaaatgccgaggagaaagcagtcctgatagccagcaccagatcccctatctccttcctaagcaaacttggccagaccatctctcggaagcgttctcccaaggataaaaaggaaaaggacttggatggtgctgggaagaggagaaagaccagtcaatcagaggaggaggaagctcctcggggccacagaggagaaagaccgaccctggtgagcactctgacagacaggaggatggacgttgccgttgggaaccagaacaaagtgaagtacatggcgacccagctgctggccaaatttgaagagaatgcgcccgcacagtccatcggcatacggagacagctgacacaagagcgtggggccagccagccgtcctgctgcctgcctgggcaggttcgccctgcccccaccccccggtggaaacagggctccatgaagaaggagttcccgcagaacctgggaggcagcgacacatgctacttctgccagaagcgggtctacgtgatggagaggctgagtgccgagggcaagttcttccaccggagctgcttcaagtgcgagtactgcgccaccaccctgcgcctctcggcctacgcctacgacatcgaggatggtaaattctactgtaagccacactactgctatcgactctctggctacgcacaaaggaagagaccggcagtggctcccctgtctggaaaggaggccaaaggacccctgcaggatggcgccaccacagatgcaaacggacgggccaacgccgtggccagctccactgagagaaccccaggtagcctcacttccttgtttggctgggtggcgcgtcactccctcggcctctgtgacaaggccaagggcatgagccagcacctccaaagcaacatttcttcattcgggcaacaagtggcccaaaaccctctggactcctttttcatgtgccagctgcttgcgttcggagtcccctttctctatggcctgtcggaggtgctggtgcaaatcagaggggagttccactggcaggctgtggcccagtgatggggccgtccggtgggcggcagagccgtgaagtgctgtccctcagccccgtcccgcaccatcacacctgagggcggcccaggtcctgtgtaggtagacaggagctcgcaggcgctcagacactgctcccatcacccgccctggtgaggccaaggccactcggccttcatgcagtttgcttccaagctcctctgacggcctggagctgtgttgattaagccccgtggtcttgttttgggttcaccttcacttaagattctgcgtcctgttccctgtcactgtgtgtggatgagctgtggctgctctcctgtctgccctgcaccgtgatgggacatgccctgtcctgaccccttggccactgggcttgtcatgaggtccaagccctcacctgtcccactttcatgaccacttccttgtgttgggaggtgaacagtaccatctctacctctacaaacacatttattcttgtcatagcatgacaggactcgcagggtttgtgggtaccaggcctgttgggaagaattatgtagattttccttaaaatggcctctctcagcaacttgtaaaacttgcctgtgagatgcgtccagagctccacaaactgctgggtgttctgaatgtcccacatacagctccaggtggttcacggcccagggtcactgtggcaagagggggccagcagggctgtgtttctgtctgtcacactttcctcttgttcaaaacacatgtatctcaagcagctatatacaaaactcataaaaattaaagatggtcagccagtgccaggaaatgtggaggaggagttggtcatagaatttccatggtgggacaagagaattacccatttggccttcaacgagaggttcccagagttgcatcctttcccttccctaacagctggttcatgtaggccttgtggtgctcattctgggagagggaagatgcgcccagaggctaggcggtgtgccctgggagccatgagaacccagccaagccaggtgaacgcagcttctgctactgcacgtgcccttattatcatctgagcaagttttttaagtaccctgcaggtgggaccaacattttatagccatgtttcaaccattaatgacttttaaaccttctacaatcttgaagatctttataatccatctttctcgtgaagtacccacaggcctttgcagctgacactctcagagcatgggcagaatcactggtagagaaaaataaccaaaggggtctagacagagactttggctttatgctatagaatgtacattcagttggagagagcaccaccttattagtctgggccctatttcatcagagatggattttctgaggaacctgactactcagtagaacaactcaaaagaaactaaactttccatttcggtttggagtacagaacattttttaaaaagaattaaacacagtgaagtttaggttattcctgaatgacgccaggtttgctgactttcccatctggtcgaggttgccattcttgccatctaattgaaagtataatgggtttcaggtttttaggagttctaaagaattacgctttccatagagaataagaggaagaatgttctacatagtggggagagaggatgagggttggcagtgtggttaaagagcaaaaccaccaagaaagagtcagagccctgaggacgtctctgtccgcgtggttcttgattctgagccagaaggtgacttggtatagcacgggagttcaaaatgtggtgtcccaaaggaatcacagtgtggacctttacagttaatgacaggcactgtcccccagcttgggtggcaaaggccagtgagctcagggctgaggggcttaccctccggcagctcagagtccagaacatcttagtccggcagctcagaatcagggcaccttgcctcccggtgagctcactctgctgctagccttggtagaaaaggaacaggattatgggcagtattttatggctggcatgaaatagatacccttttctcctttgatagagatttccttctttaaatatgaaactgaagctttgaggacttaactagacttccttttgaaaagtttcagaaaagctcaggtgtggccaggcacgatggctcatgcctgtaatcccagcactttgggaggccgaggcgggcagatcacgaggtcaggagatcgagaccatcctggctaacacagtgaaaccccgtctctactaaaaatacaaaaaaattagccgggtgtggtgtggtggcggatgcctgtagtcccagctactcgggaggctgaggcaggagaatggcgtgaacccaggaggcagaggttgcagtaagtcgagatcacaccactgcactccagcctgatgacagagcaagactccatctaaaaaaaaaaaagaagaaaagggaaagctcaggtgtttcagggtcccagaatgtatgttgtagagaacagtcattagctcaggcccatggtaaccgcctctactgtgcactcgaccagtagaggcgatgatgacggcacttgattctcttgtgtgtaactcagccatcctccctagacccacgtcccaggaggcagggctggtaaagctatgactgggcagtgtttgacccagctgtgcttttactctgtgcctcctctttatattgtggcatttctctcttctcctttatgttctttttctttttatgccaaaattcttgctgttgccaaaacaaaaacaaaaaaacacacccacacccaattacaacctgcagttcaaagaaccactctaggtcggctttaaagtattgtctttctctggtaaccaaatctgtacctgctgcctaatttagtgtttgggggcattgtttacagtatttctgtttgtaatgtgcttttaatatagaaatcctcttttttgttcttaaatctatgaatgctgtgtttccaagcttatacttactactgcgtgttagtggtcctggcacagattttcttaccctggccttgtactgtccaccatgactttagaaaaagcttgaacaataggcagagaaaggaaatccccaaaagggattattttccccttggacatgagaagtttagttacaggtttcttgaattcgtttttgtccagaggaatcctctttttatctgatacggttgatgaccaaaaatgaagtagggaagccgaaggcatagccggaaaggaacagaagagctttttccccgagtgctcatcaccgggttcattaccggccagagatggacggggagaagcacgttagtttcctgtcatcttatggaaaagatgatctgaagttaaaaaatgaaggtcacaagtggcagttgcctgacccctgtccccagacattccttgcccgataaccatgaggttccatagttcggatcctgaatgggcctttaggaaatgcaggcctttcccacaccagctagaagggtagccaggcagtagaatttcattcaaccctagggttcccacctgacagagggaagttcggaagtcttactgcttcccacgtccccttcccttctaggcatttatggaaagctttttagtggagcaagagaattctacaatccagcttacctcccaccttaccccaagagccatagctgacggtgatgtgtgaatgtttatatataggtacacgtttgtatgtatatagatctaattgcacatatatgggtagatatttatttatatgttgcaccctaaattatagtaattataataattgtgaagctgtttctaaagctgcttgttcctggttctgagaaccacgggagcctcacactggggagccgtactccaggtcagggctttggggatgcacagcagcgtacgggcagcacgcctgtaaggaggtgagtgggtgggtgtctcagaaaatgggcagcacacccccaagaaagggccccaagagcagactaggaacgcagggggctgctgctgccaggacaccacggagagccgggcacccgcctcacatgtctcctgtctggctccactgagttagccgtttgagcccactcctatcttttggtggttagtgcatcttcagctcttttctgcaagacactggaacattcctaggctgtcccaaaaggagttccaccatagcctttaaggtccgagcagggcaccaaggggttcacttttctcccgagccattcagcttggggtgcctgcgggaggggcggacagccagccggcttcccggcggcggtacgagagcccaacaggagaggattagctgtgccaaggaacacgccactgctgcctgtctactgcccgccttctctccacttccatttttgcctttgtttttaacttgtgctcttgtgagttcttggtgtgtttctttgtgagtttttatttaattgtgtaactttgtttttgccgttgactgtgaaaccaagttgtcgtgcttttaattttttttttaacaaatgttacattcttatttaagagaataaattccaaacaa

SEQ ID NO: 153841 - DNA, 436 bp, Homo sapiens
  Payload ID: 10244
  Gene Symbol: MICAL3
  Gene Name: microtubule associated monooxygenase, calponin and LIM domain containing 3
  ENST ID: ENST00000584751
  CDS Start-End: 1-418
gcaggaggagcttaagcggctgcatcgagcccagatcatccagcggcagctgcagcaggtggaggagaggcagcggcggctggaggaaaggggcgtggctgtggagaaggcgctccggggcgaagcagactattggggagagtcttattacagtgacctcatcgacttgcatctgggtggtatgtatggcagcgcctgtgctgacactaaccccgctgacgccctttctccacccacgcttcccagtccctgctcacaaaaacaaggagaaatcaacccaataaccaaatggcaaaagcacagacccttttccagctcaaaacagagcagcgtgctgatctccccgctgcccacatgtgctccagaggaagatctgagcttgcttttgctgcctggggtcgtttttaattttttataataaaactttgcccacccg

SEQ ID NO: 153842 - DNA, 569 bp, Homo sapiens
  Payload ID: 10244
  Gene Symbol: MICAL3
  Gene Name: microtubule associated monooxygenase, calponin and LIM domain containing 3
  ENST ID: ENST00000578984
  CDS Start-End: 1-569
ggaggaggaggaggaagaatatgaagaggaggaggaggaggactatgacgaggaggaggaagagtccagtgaagtgcccgaccttccctccatacgccacgcggcggtgcaggcctggctggagacggtctccggagccccattggatgagaatgacctagaggaagatgtggactcagaaccagccgagatagaaggggaggcagcagaggatggggacccaggggacactggtgctgagctggatgatgatcagcactggtctgacagcccgtcggatgctgacagagagctgcgtttgccgtgcccagctgagggggaagcagagctggagctgagggtgtcggaagatgaggagaagctgcccgcctcaccgaagcaccaagagagaggtccctcccaagccaccagccccatccggtctccccaggaatcagctcttctgttcattccagtccacagcccctcaacagaggggccccaactcccacctgtccctgccgccacccaggagaaatcacctgaggagcgccttttccctgagcctttgctccccaaagagaagccca

SEQ ID NO: 153843 - DNA, 807 bp, Homo sapiens
  Payload ID: 10244
  Gene Symbol: MICAL3
  Gene Name: microtubule associated monooxygenase, calponin and LIM domain containing 3
  ENST ID: ENST00000577821
  CDS Start-End: 1-807
cagctccaacctcctagaagaagccgccgccaaacccaagtccctgtggaagtccgtcttctccgggtacaagaaggacaagaagaagaaggccgacgacaagtcctgccccagcaccccctccagcggggccacggtggactctggaaagcacagggtgcttcccgtcgtaagggcagagctgcagctccggcgccagctgagcttctccgaggactcagacctctccagcgacgatgtccttgagaagtcctcacagaagtcccggcgagagtcaatttatgtaccacacgccttggcattcaggagatcatgtgcatcaaagccaagaacctacacggaggaggaactgaatgccaagctgacccggcgtgtgcaaaaggcagctcggagacaggccaagcaggaggagcttaagcggctgcatcgagcccagatcatccagcggcagctgcagcaggtggaggagaggcagcggcggctggaggaaaggggcgtggctgtggagaaggcgctccggggcgaagcagactattggggagagtcttattacagtgacctcatcgacttgcatctgggtggcatgggcaagaaggacgaccccaagctgatgcaggagtggttcaagctagtgcaggagaagaacgccatggtgcgctacgagtcggagctgatgatctttgcccgggagctggagctggaagaccggcagagtcgactgcagcaggagctccgggaacgcatggcagtggaaggtgagtggggtaaggcacccatggaggccagggtgggtgccacctccaggcc

SEQ ID NO: 153844 - DNA, 593 bp, Homo sapiens
  Payload ID: 10244
  Gene Symbol: MICAL3
  Gene Name: microtubule associated monooxygenase, calponin and LIM domain containing 3
  ENST ID: ENST00000498573
  CDS Start-End: 1-593
atgcccttctgaaagggaaaagtgaagaggagctagaggcctcaaagagctttgggcctgggaatgaagaggaggaggaggaggaggaagaatatgaagaggaggaggaggaggactatgacgaggaggaggaagagtccagtgaagccccattggatgagaatgacctagaggaagatgtggactcagaaccagccgagatagaaggggaggcagcagaggatggggacccaggggacactggtgctgagctggatgatgatcagcactggtctgacagcccgtcggatgctgacagagagctgcgtttgccgtgcccagctgagggggaagcagagctggagctgagggtgtcggaagatgaggagaagctgcccgcctcaccgaagcaccaagagagaggtccctcccaagccaccagccccatccggtctccccaggaatcagctcttctgttcattccagtccacagcccctcaacagaggggccccaactcccacctgtccctgccgccacccaggagaaatcacctgaggagcgccttttccctgagcctttgctccccaaagagaagcccaaagctgatgccccc

SEQ ID NO: 153845 - DNA, 4833 bp, Homo sapiens
  Payload ID: 10245
  Gene Symbol: MAST1
  Gene Name: microtubule associated serine/threonine kinase 1
  Uniprot ID: Q9Y2H9
  ENST ID: ENST00000251472
  CDS Start-End: 40-4752
ctgctgccgcacctgccaccatgtcgccgccgccgggtcatgtctgactctctctggaccgcgctttctaatttctcgatgccctccttccccggcggcagtatgttccgccgcaccaagagctgccgcaccagtaatcggaaaagcctcatcctgaccagcacttcacccacgctaccgagaccccactccccgctgccaggtcacctaggcagcagtcccctggacagcccccgaaacttctcccccaacacccccgcccacttctcgtttgcctcctcccgaagggcggacggacgccggtggtctctggcctcgctcccttcatctggctatggcaccaacacgcccagttccaccgtctcgtcctcctgctcctcccaggagcgccttcaccagctgccctaccagcccacggtggacgagctccacttcctctccaaacacttcgggagcaccgagagcatcacagacgaggatggtggccgtcgctccccagccgtgcggccccgctcacggagcctcagccccgggcgctccccctcctcctacgacaacgagatcgtgatgatgaatcacgtctacaaggagaggttcccgaaggccactgcgcagatggaggagaagctgcgcgactttacccgcgcctacgaacccgacagcgttctgcctctggccgatggcgtgctcagcttcatccaccaccagatcatcgagctggcccgggactgcctgaccaagtcccgtgacggcctcatcaccacggtctacttctatgaattgcaggagaacctggagaagctccttcaagacgcctatgaacgctctgagagcttggaggtggccttcgttactcagctggtgaagaagttgcttattatcatctcacgccctgcgaggctgctggagtgcctggaattcaaccccgaggagttctaccacctgctggaggcggccgaaggacacgccaaggagggccaccttgtgaagacggacatcccccgctacatcatccgccagctgggcctcacccgtgacccctttccagatgtggtgcatctggaggaacaggacagtggtggttccaacacccctgagcaagacgatctctctgagggccgcagcagcaaggccaagaaaccgccgggggagaatgacttcgataccatcaagctcataagcaacggtgcctacggcgctgtctacctggtgcggcaccgcgacacgcggcagcgctttgccatgaaaaagatcaacaagcagaacttgatcctccgcaaccagatccagcaggcctttgtggagcgcgatatcctcaccttcgccgagaacccgtttgtggtcggcatgttctgctcctttgagactcggcgccacctctgcatggtcatggaatatgtggaaggcggcgactgtgccaccctgctgaagaatattggagcgctgcccgtagagatggcccgcatgtactttgctgagacggtgctagccctggagtatttgcacaactatggcatcgtgcaccgcgacctcaagcctgacaacctccttatcacctccatgggtcacatcaagctcacagatttcggcctctccaagatggggctcatgagcctcaccaccaacttatatgaaggccacatcgagaaggacgcccgagagttcctggacaaacaggtgtgtgggaccccagagtacatcgcgcccgaggtcatcctgcgtcaaggctacggcaagccagtggactggtgggctatggggatcatcctctacgagttcctggtgggctgtgtgcccttcttcggagacacaccagaggagctatttggacaggtcatcagtgatgacatcctgtggcccgagggggatgaggccctacctacggaggcccaactcctcatatccagcctcctgcagaccaaccctctggtcaggcttggggcaggcggcgcttttgaggtgaagcagcacagtttctttcgagacctggactggacagggctgctgaggcagaaggccgagttcatcccccacctagagtcggaagatgacactagctactttgacacccgctcagacaggtatcaccacgtgaactcctatgacgaggatgacacgacggaggaggagcccgtggaaatccgccagttctcttcctgctctccgcgcttcagcaaggtgtatagcagcatggagcagctgtcgcagcacgagcccaagaccccagtagcagctgcagggagcagcaagcgggagccgagcaccaagggccccgaggagaaggtggccggcaagcgggaggggctgggcggcctgaccctgcgtgagaagacctggagagggggctctccggagatcaagcgattctccgcgtccgaggccagtttcctggagggagaggccagtccccctttgggcgcccgccgccgtttctcggcgctgctggagcccagccgcttcagcgccccccaagaggacgaggatgaggcccggctgcgcaggcctccccggcccagctccgaccccgcgggatccctggatgcacgggcccccaaagaggagactcaaggggaaggcacctccagcgccggggactccgaggccactgaccgtccacgcccaggtgacctctgcccaccctcgaaggatggggatgcatcaggcccaagggctaccaatgacttggttctgcgccgggcgcggcaccagcagatgtcaggggatgtggcagtagagaagaggccttctcgaactgggggcaaagtcatcaaatcagcctcagccactgccttatctgtcatgattcctgcagtggacccacatggaagttcaccccttgctagtcccatgtctccacgatctctgtcctccaacccatcctcacgggactcctcacccagccgggactactcaccagctgtcagtgggctccgctcccccatcaccatccagcgctcgggcaagaagtatggcttcacactgcgtgccatccgtgtctacatgggtgacacggatgtctatagtgtccaccacattgtctggcatgtggaggaaggaggcccagcccaggaggcaggactctgtgctggggacctcatcacccacgtgaatggggagcctgtgcatggcatggtgcatcctgaggtcgtggagctgatccttaagagtggcaacaaggtagcagtgaccacaacgcccttcgaaaatacctctatccgcattggtcccgcaaggcgcagcagctacaaggctaaaatggctcggaggaacaagcgaccctccgccaaggagggccaggagagcaagaagcgcagctccctcttccggaagatcacgaagcagtcgaacctgctgcatactagccgctcgctgtcgtcgctgaaccgctcgctgtcatccagcgatagtctcccgggctcgcctacgcacgggctgccggcgcgctcgcccacgcacagctaccgctccacgcctgactccgcctacctaggcgcctcatcccagagcagctccccagcctcgagcacgcccaactcgcctgcgtcgtcggcgtcgcaccacattcggcccagcacgctgcacggactgtcgccaaagctccatcgccagtaccgctctgcgcgatgcaagtcggccggcaacatccctctatcgccgctggcacacacgccgtcccccacgcaggcgtcaccgccgccactgccgggccacacggtgggcagctcgcacactactcagagcttcccggccaaactgcactcatcgcctcccgtcgtgcgcccgcgccccaagagtgccgagccccctcgctcgccgctcctcaagcgcgtgcagtcggccgagaagctgggagcctctttgagtgcggacaagaagggcgcgctgcgcaaacacagcctcgaggtgggccacccggatttccgcaaggacttccatggcgagctggcgctgcatagccttgccgagtccgacggtgagacgcccccagtcgagggccttggcgcgccccggcaggtcgccgtccgccgcctgggccgacaggagtcacctttgagcctgggcgcggacccgttgctgcccgagggtgcctccaggccaccagtgtcgagcaaggagaaggaatccccggggggcgccgaggcgtgcaccccaccccgcgcgacgacccccggtggccggaccctggagcgggacgtcggctgcacgcggcatcagagcgtgcagacggaggatggcactggcgggatggccagggctgtggccaaggcggcgctgagcccggtgcaggaacacgagacaggccggcgcagcagctctggcgaggcgggcacacccctggtacccattgtcgtagagcctgcgcggcccggggctaaggctgtggtgcctcagcctctgggcgcggactccaaggggttgcaggaacccgcacccctggcgccttccgtgcccgaggccccccggggccgggagcgctgggtgttggaggtggtggaggagcgcaccacgctgagcggtcctcgctccaagcccgcctccccaaagctctccccggagccccagacaccctccctagccccagcgaagtgcagtgcacccagcagtgcagtgaccccagtcccacccgcatccctcttgggctcaggcaccaagcctcaagtggggctgacctcccggtgccctgctgaagctgtgcccccagcaggcctgaccaaaaaaggagtgtccagtcccgcacccccgggaccatagccaagggggtcatcggccccgcgctgtacagcctccgtatacatatgtacacatataaataaagtgcgtccgtgctgcgtg

SEQ ID NO: 153846 - DNA, 398 bp, Homo sapiens
  Payload ID: 10245
  Gene Symbol: MAST1
  Gene Name: microtubule associated serine/threonine kinase 1
  ENST ID: ENST00000590204
  CDS Start-End: 1-398
cccgcgcccctcctccgtccctcccgcaggccactgcgcagatggaggagaagctgcgcgactttacccgcgcctacgaacccgacagcgttctgcctctggccgatggcgtgctcagcttcatccaccaccagatcatcgagctggcccgggactgcctgaccaagtcccgtgacggcctcatcaccacggtctacttctatgaattgcaggagaacctggagaagctccttcaagacgcctatgaacgctctgagagcttggaggtggccttcgttactcagctggtgaagaagttgcttattatcatctcacgccctgcgaggctgctggagtgcctggaattcaaccccgaggagttctaccacctgctggaggcggccgaaggacacgccaag

SEQ ID NO: 153847 - DNA, 1408 bp, Homo sapiens
  Payload ID: 10245
  Gene Symbol: MAST1
  Gene Name: microtubule associated serine/threonine kinase 1
  ENST ID: ENST00000588379
  CDS Start-End: 1-1300
gagaccccactccccgctgccaggtcacctaggcagcagtcccctggacagcccccgaaacttctcccccaacacccccgcccacttctcgtttgcctcctcccgaagggcggacggacgccggtggtctctggcctcgctcccttcatctggctatggcaccaacacgcccagttccaccgtctcgtcctcctgctcctcccaggagcgccttcaccagctgccctaccagcccacggtggacgagctccacttcctctccaaacacttcgggagcaccgagagcatcacagacgaggatggtggccgtcgctccccagccgtgcggccccgctcacggagcctcagccccgggcgctccccctcctcctacgacaacgagatcgtgatgatgaatcacgtctacaaggagaggttcccgaaggccactgcgcagatggaggagaagctgcgcgactttacccgcgcctacgaacccgacagcgttctgcctctggccgatggcgtgctcagcttcatccaccaccagatcatcgagctggcccgggactgcctgaccaagtcccgtgacggcctcatcaccacggtctacttctatgaattgcaggagaacctggagaagctccttcaagacgcctatgaacgctctgagagcttggaggtggccttcgttactcagctggtgaagaagttgcttattatcatctcacgccctgcgaggctgctggagtgcctggaattcaaccccgaggagttctaccacctgctggaggcggccgaaggacacgccaaggagggccaccttgtgaagacggacatcccccgctacatcatccgccagctgggcctcacccgtgacccctttccagatgtggtgcatctggaggaacaggacagtggtggttccaacacccctgagcaagacgatctctctgagggccgcagcagcaaggccaagaaaccgccgggggagaatgacttcgataccatcaagctcataagcaacggtgcctacggcgctgtctacctggtgcggcaccgcgacacgcggcagcgctttgccatgaaaaagatcaacaagcagaacttgatcctccgcaaccagatccagcaggcctttgtggagcgcgatatcctcaccttcgccgagaacccgtttgtggtcggcatgttctgctcctttgagactcggcgccacctctgcatggtcatggaatatgtggaaggtgtggctgcctgcggggctgcagggaagatggggccgtgctcactggtcagggctgcggggtggcctgcctgagccgcagtctccatattgattagtcggcctgtatgtttatccatctatttatttctccagtcattgatttgtccatccattctacctatatatttattcagtcatcta

SEQ ID NO: 153848 - DNA, 1496 bp, Homo sapiens
  Payload ID: 10245
  Gene Symbol: MAST1
  Gene Name: microtubule associated serine/threonine kinase 1
  ENST ID: ENST00000591495
  CDS Start-End: 18-1445
tcgccgccgctgccgccatggacgattcgggcctcatccgccgccggaggctgcagaaggatttgcccctgccccggaaaagcagcagctgccgcaccagtaatcggaaaagcctcatcctgaccagcacttcacccacgctaccgagaccccactccccgctgccaggtcacctaggcagcagtcccctggacagcccccgaaacttctcccccaacacccccgcccacttctcgtttgcctcctcccgaagggcggacggacgccggtggtctctggcctcgctcccttcatctggctatggcaccaacacgcccagttccaccgtctcgtcctcctgctcctcccaggagcgccttcaccagctgccctaccagcccacggtggacgagctccacttcctctccaaacacttcgggagcaccgagagcatcacagacgaggatggtggccgtcgctccccagccgtgcggccccgctcacggagcctcagccccgggcgctccccctcctcctacgacaacgagatcgtgatgatgaatcacgtctacaaggagaggttcccgaaggccactgcgcagatggaggagaagctgcgcgactttacccgcgcctacgaacccgacagcgttctgcctctggccgatggcgtgctcagcttcatccaccaccagatcatcgagctggcccgggactgcctgaccaagtcccgtgacggcctcatcaccacggtctacttctatgaattgcaggagaacctggagaagctccttcaagacgcctatgaacgctctgagagcttggaggtggccttcgttactcagctggtgaagaagttgcttattatcatctcacgccctgcgaggctgctggagtgcctggaattcaaccccgaggagttctaccacctgctggaggcggccgaaggacacgccaaggagggccaccttgtgaagacggacatcccccgctacatcatccgccagctgggcctcacccgtgacccctttccagatgtggtgcatctggaggaacaggacagtggtggttccaacacccctgagcaagacgatctctctgagggccgcagcagcaaggccaagaaaccgccgggggagaatgacttcgataccatcaagctcataagcaacggtgcctacggcgctgtctacctggtgcggcaccgcgacacgcggcagcgctttgccatgaaaaagatcaacaagcagaacttgatcctccgcaaccagatccagcaggcctttgtggagcgcgatatcctcaccttcgccgagaacccgtttgtggtcggcatgttctgctcctttgagactcggcgccacctctgcatggtcatggaatatgtggaaggtgtggctgcctgcggggctgcagggaagatggggccgtgctcactggtcagggctgcggggtggcctgcctgagccgcagtctccatattgattagtcggcctgtatgtttatccatctattta

SEQ ID NO: 153849 - DNA, 5738 bp, Homo sapiens
  Payload ID: 10246
  Gene Symbol: MAST2
  Gene Name: microtubule associated serine/threonine kinase 2
  Uniprot ID: Q6P0Q8
  ENST ID: ENST00000361297
  CDS Start-End: 284-5680
taggcaggcggctgagccggcggcgggtggcctgcccaacgtgtgctgggtgggagaaggcgaggcgtcagcgatgctgtctcttccgtgaggagcgcagaggaggtcgcggcgccggaggccccagaaggctcgaaggcgccgcgggctggggtcggtggcttagggagcccgtccggccatggtggccgcgggtggtggttggcgcggctgcgctgcggcccggggcagtgcggagccgggacagtcgcggcgctgacgcccgcgggccccagctgcagatatgaagcggagccgctgccgcgaccgaccgcagccgccgccgcccgaccgccgggaggatggagttcagcgggcagcggagctgtctcagtctttgccgccgcgccggcgagcgccgcccgggaggcagcggctggaggagcggacgggccccgcggggcccgagggcaaggagcaggatgtagtaactggagttagtcccctgctcttcaggaaactcagtaatcctgacatattttcatccactggaaaagttaaacttcagcgacaactgagtcaggatgattgtaagttatggagaggaaacctggccagctctctatcgggtaagcagctgctccctttgtccagcagtgtacatagcagtgtgggacaggtgacttggcagtcgtcaggagaagcatcaaacctggttcgaatgagaaaccagtcccttggacagtctgcaccttctcttactgctggcctgaaggagttgagccttccaagaagaggcagcttttgtcggacaagtaaccgcaagagcttgattgtgacctctagcacatcacctacactaccacggccacactcaccactccatggccacacaggtaacagtcctttggacagcccccggaatttctctccaaatgcacctgctcacttttcttttgttcctgcccgtaggactgatgggcggcgctggtctttggcctctttgccctcttcaggatatggaactaacactcctagctccactgtctcatcatcatgctcctcacaggaaaagctgcatcagttgcctttccagcctacagctgatgagctgcactttttgacgaagcatttcagcacagagagcgtaccagatgaggaaggacggcagtccccagccatgcggcctcgctcccggagcctcagtcccggacgatccccagtatcctttgacagtgaaataataatgatgaatcatgtttacaaagaaagattcccaaaggccaccgcacaaatggaagagcgactagcagagtttatttcctccaacactccagacagcgtgctgcccttggcagatggagccctgagctttattcatcatcaggtgattgagatggcccgagactgcctggataaatctcggagtggcctcattacatcacaatacttctacgaacttcaagataatttggagaaacttttacaagatgctcatgagcgctcagagagctcagaagtggcttttgtgatgcagctggtgaaaaagctgatgattatcattgcccgcccagcacgtctcctggaatgcctggagtttgaccctgaagagttctaccaccttttagaagcagctgagggccacgccaaagagggacaagggattaaatgtgacattccccgctacatcgttagccagctgggcctcacccgggatcccctagaagaaatggcccagttgagcagctgtgacagtcctgacactccagagacagatgattctattgagggccatggggcatctctgccatctaaaaagacaccctctgaagaggacttcgagaccattaagctcatcagcaatggcgcctatggggctgtatttctggtgcggcacaagtccacccggcagcgctttgccatgaagaagatcaacaagcagaacctgatcctacggaaccagatccagcaggccttcgtggagcgtgacatactgactttcgctgagaacccctttgtggtcagcatgttctgctcctttgataccaagcgccacttgtgcatggtgatggagtacgttgaagggggagactgtgccactctgctgaagaatattggggccctgcctgtggacatggtgcgtctatactttgcggaaactgtgctggccctggagtacttacacaactatggcatcgtgcaccgtgacctcaagcctgacaacctcctaattacatccatggggcacatcaagctcacggactttggactgtccaaaattggcctcatgagtctgacaacgaacttgtatgagggtcatattgaaaaggatgcccgggaattcctggacaagcaggtatgcgggaccccagaatacattgcgcctgaggtgatcctgcgccagggctatgggaagccagtggactggtgggccatgggcattatcctgtatgagttcctggtgggctgcgtccctttttttggagatactccggaggagctctttgggcaggtgatcagtgatgagattgtgtggcctgagggtgatgaggcactgcccccagacgcccaggacctcacctccaaactgctccaccagaaccctctggagagacttggcacaggcagtgcctatgaggtgaagcagcacccattctttactggtctggactggacaggacttctccgccagaaggctgaatttattcctcagttggagtcagaggatgatactagctattttgacacccgctcagagcgataccaccacatggactcggaggatgaggaagaagtgagtgaggatggctgccttgagatccgccagttctcttcctgctctccaaggttcaacaaggtgtacagcagcatggagcggctctcactgctcgaggagcgccggacaccacccccgaccaagcgcagcctgagtgaggagaaggaggaccattcagatggcctggcagggctcaaaggccgagaccggagctgggtgattggctcccctgagatattacggaagcggctgtcggtgtctgagtcatcccacacagagagtgactcaagccctccaatgacagtgcgacgccgctgctcaggcctcctggatgcgcctcggttcccggagggccctgaggaggccagcagcaccctcaggaggcaaccacaggagggtatatgggtcctgacacccccatctggagagggggtatctgggcctgtcactgaacactcaggggagcagcggccaaagctggatgaggaagctgttggccggagcagtggttccagtccagctatggagacccgaggccgtgggacctcacagctggctgagggagccacagccaaggccatcagtgacctggctgtgcgtagggcccgccaccggctgctctctggggactcaacagagaagcgcactgctcgccctgtcaacaaagtgatcaagtccgcctcagccacagccctctcactcctcattccttcggaacaccacacctgctccccgttggccagccccatgtccccacattctcagtcgtccaacccatcatcccgggactcttctccaagcagggacttcttgccagcccttggcagcatgaggcctcccatcatcatccaccgagctggcaagaagtatggcttcaccctgcgggccattcgcgtctacatgggtgactccgatgtctacaccgtgcaccatatggtgtggcacgtggaggatggaggtccggccagtgaggcagggcttcgtcaaggtgacctcatcacccatgtcaatggggaacctgtgcatggcctggtgcacacggaggtggtagagctgatcctgaagagtggaaacaaggtggccatttcaacaactcccctggagaacacatccattaaagtggggccagctcggaagggcagctacaaggccaagatggcccgaaggagcaagaggagccgcggcaaggatgggcaagaaagcagaaaaaggagctccctgttccgcaagatcaccaagcaagcatccctgctccacaccagccgcagcctttcttcccttaaccgctccttgtcatcaggggagagtgggccaggctctcccacacacagccacagcctttccccccgatctcccactcaaggctaccgggtgacccccgatgctgtgcattcagtgggagggaattcatcacagagcagctcccccagctccagcgtgcccagttccccagccggctctgggcacacacggcccagctccctccacggtctggcacccaagctccaacgccagtaccgctctccacggcgcaagtcagcaggcagcatcccactgtcaccactggcccacaccccttctcccccacccccaacagcttcacctcagcggtccccatcgcccctgtctggccatgtagcccaggcctttcccacaaagcttcacttgtcacctcccctgggcaggcaactctcacggcccaagagtgcggagccaccccgttcaccactactcaagagggtgcagtcggctgagaaactggcagcagcacttgccgcctctgagaagaagctagccacttctcgcaagcacagccttgacctgccccactctgaactaaagaaggaactgccgcccagggaagtgagccctctggaggtagttggagccaggagtgtgctgtctggcaagggggccctgccagggaagggggtgctgcagcctgctccctcacgggccctaggcaccctccggcaggaccgagccgaacgacgggagtcgctgcagaagcaagaagccattcgtgaggtggactcctcagaggacgacaccgaggaagggcctgagaacagccagggtgcacaggagctgagcttggcacctcacccagaagtgagccagagtgtggcccctaaaggagcaggagagagtggggaagaggatcctttcccgtccagagaccctaggagcctgggcccaatggtcccaagcctattgacagggatcacactggggcctcccagaatggaaagtcccagtggtccccacaggaggctcgggagcccacaagccattgaggaggctgccagctcctcctcagcaggccccaacctaggtcagtctggagccacagaccccatccctcctgaaggttgctggaaggcccagcacctccacacccaggcactaacagcactttctcccagcacttcgggactcacccccaccagcagttgctctcctcccagctccacctctgggaagctgagcatgtggtcctggaaatcccttattgagggcccagacagggcatccccaagcagaaaggcaaccatggcaggtgggctagccaacctccaggatttggaaaacacaactccagcccagcctaagaacctgtctcccagggagcaggggaagacacagccacctagtgcccccagactggcccatccatcttatgaggatcccagccagggctggctatgggagtctgagtgtgcacaagcagtgaaagaggatccagccctgagcatcacccaagtgcctgatgcctcaggtgacagaaggcaggacgttccatgccgaggctgccccctcacccagaagtctgagcccagcctcaggaggggccaagaaccagggggccatcaaaagcatcgggatttggcattggttccagatgagcttttaaagcaaacatagcagttgtttgccatttcttgcactcagacctgtgtaatatatgctcctggaaaccatc

SEQ ID NO: 153850 - DNA, 2528 bp, Homo sapiens
  Payload ID: 10246
  Gene Symbol: MAST2
  Gene Name: microtubule associated serine/threonine kinase 2
  ENST ID: ENST00000372008
  CDS Start-End: 168-2528
attcatttgggatctggaacttgtcactgtcccactgctgcctcgtgggctcttaggtcttttgtggggggatgggaggggtgttctgaagatcatgtttttgaagaaaagtactttaatttttgccaatctctaccctttgccgaggagctgaagtaaaccagcacatgttttcacccacatctgctccagccctcttcctcactaaagtcccatttagtgctgattgtgctttggctacttctcctcttgccattttcctgaacccacgagcccacagcagtcctggcactccttgttccagccgcccactgccgtggagttgtcggacaagtaaccgcaagagcttgattgtgacctctagcacatcacctacactaccacggccacactcaccactccatggccacacaggtaacagtcctttggacagcccccggaatttctctccaaatgcacctgctcacttttcttttgttcctgcccgtaggactgatgggcggcgctggtctttggcctctttgccctcttcaggatatggaactaacactcctagctccactgtctcatcatcatgctcctcacaggaaaagctgcatcagttgcctttccagcctacagctgatgagctgcactttttgacgaagcatttcagcacagagagcgtaccagatgaggaaggacggcagtccccagccatgcggcctcgctcccggagcctcagtcccggacgatccccagtatcctttgacagtgaaataataatgatgaatcatgtttacaaagaaagattcccaaaggccaccgcacaaatggaagagcgactagcagagtttatttcctccaacactccagacagcgtgctgcccttggcagatggagccctgagctttattcatcatcaggtgattgagatggcccgagactgcctggataaatctcggagtggcctcattacatcacaatacttctacgaacttcaagataatttggagaaacttttacaagatgctcatgagcgctcagagagctcagaagtggcttttgtgatgcagctggtgaaaaagctgatgattatcattgcccgcccagcacgtctcctggaatgcctggagtttgaccctgaagagttctaccaccttttagaagcagctgagggccacgccaaagagggacaagggattaaatgtgacattccccgctacatcgttagccagctgggcctcacccgggatcccctagaagaaatggcccagttgagcagctgtgacagtcctgacactccagagacagatgattctattgagggccatggggcatctctgccatctaaaaagacaccctctgaagaggacttcgagaccattaagctcatcagcaatggcgcctatggggctgtatttctggtgcggcacaagtccacccggcagcgctttgccatgaagaagatcaacaagcagaacctgatcctacggaaccagatccagcaggccttcgtggagcgtgacatactgactttcgctgagaacccctttgtggtcagcatgttctgctcctttgataccaagcgccacttgtgcatggtgatggagtacgttgaagggggagactgtgccactctgctgaagaatattggggccctgcctgtggacatggtgcgtctatactttgcggaaactgtgctggccctggagtacttacacaactatggcatcgtgcaccgtgacctcaagcctgacaacctcctaattacatccatggggcacatcaagctcacggactttggactgtccaaaattggcctcatgagtctgacaacgaacttgtatgagggtcatattgaaaaggatgcccgggaattcctggacaagcaggtatgcgggaccccagaatacattgcgcctgaggtgatcctgcgccagggctatgggaagccagtggactggtgggccatgggcattatcctgtatgagttcctggtgggctgcgtccctttttttggagatactccggaggagctctttgggcaggtgatcagtgatgagattgtgtggcctgagggtgatgaggcactgcccccagacgcccaggacctcacctccaaactgctccaccagaaccctctggagagacttggcacaggcagtgcctatgaggtgaagcagcacccattctttactggtctggactggacaggacttctccgccagaaggctgaatttattcctcagttggagtcagaggatgatactagctattttgacacccgctcagagcgataccaccacatggactcggaggatgaggaagaagtgagtgaggatggctgccttgagatccgccagttctcttcctgctctccaaggttcaacaaggtgtacagcagcatggagcggctctcactgctcgaggagcgccggacaccacccccgaccaagcgcagcctgagtgaggagaaggaggaccattcagatggcctggcagggctcaaaggccgagaccggagctgggtgattggctcccctgag

SEQ ID NO: 153851 - DNA, 4047 bp, Homo sapiens
  Payload ID: 10246
  Gene Symbol: MAST2
  Gene Name: microtubule associated serine/threonine kinase 2
  ENST ID: ENST00000372009
  CDS Start-End: 38-2413
gagcgtaccagatgaggaaggacggcagtccccagccatgcggcctcgctcccggagcctcagtcccggacgatccccagtatcctttgacagtgaaataataatgatgaatcatgtttacaaagaaagattcccaaaggctcatgagcgctcagagagctcagaagtggcttttgtgatgcagctggtgaaaaagctgatgattatcattgcccgcccagcacgtctcctggaatgcctggagtttgaccctgaagagttctaccaccttttagaagcagctgagggccacgccaaagagggacaagggattaaatgtgacattccccgctacatcgttagccagctgggcctcacccgggatcccctagaagaaatggcccagttgagcagctgtgacagtcctgacactccagagacagatgattctattgagggccatggggcatctctgccatctaaaaagacaccctctgaagaggacttcgagaccattaagctcatcagcaatggcgcctatggggctgtatttctggtgcggcacaagtccacccggcagcgctttgccatgaagaagatcaacaagcagaacctgatcctacggaaccagatccagcaggccttcgtggagcgtgacatactgactttcgctgagaacccctttgtggtcagcatgttctgctcctttgataccaagcgccacttgtgcatggtgatggagtacgttgaagggggagactgtgccactctgctgaagaatattggggccctgcctgtggacatggtgcgtctatactttgcggaaactgtgctggccctggagtacttacacaactatggcatcgtgcaccgtgacctcaagcctgacaacctcctaattacatccatggggcacatcaagctcacggactttggactgtccaaaattggcctcatgagtctgacaacgaacttgtatgagggtcatattgaaaaggatgcccgggaattcctggacaagcaggtatgcgggaccccagaatacattgcgcctgaggtgatcctgcgccagggctatgggaagccagtggactggtgggccatgggcattatcctgtatgagttcctggtgggctgcgtccctttttttggagatactccggaggagctctttgggcaggtgatcagtgatgagattgtgtggcctgagggtgatgaggcactgcccccagacgcccaggacctcacctccaaactgctccaccagaaccctctggagagacttggcacaggcagtgcctatgaggtgaagcagcacccattctttactggtctggactggacaggacttctccgccagaaggctgaatttattcctcagttggagtcagaggatgatactagctattttgacacccgctcagagcgataccaccacatggactcggaggatgaggaagaagtgagtgaggatggctgccttgagatccgccagttctcttcctgctctccaaggttcaacaaggtgtacagcagcatggagcggctctcactgctcgaggagcgccggacaccacccccgaccaagcgcagcctgagtgaggagaaggaggaccattcagatggcctggcagggctcaaaggccgagaccggagctgggtgattggctcccctgagatattacggaagcggctgtcggtgtctgagtcatcccacacagagagtgactcaagccctccaatgacagtgcgacgccgctgctcaggcctcctggatgcgcctcggttcccggagggccctgaggaggccagcagcaccctcaggaggcaaccacaggagggtatatgggtcctgacacccccatctggagagggggtatctgggcctgtcactgaacactcaggggagcagcggccaaagctggatgaggaagctgttggccggagcagtggttccagtccagctatggagacccgaggccgtgggacctcacagctggctgagggagccacagccaaggccatcagtgacctggctgtgcgtagggcccgccaccggctgctctctggggactcaacagagaagcgcactgctcgccctgtcaacaaagtgatcaagtccgcctcagccacagccctctcactcctcattccttcggaacaccacacctgctccccgttggccagccccatgtccccacattctcagtcgtccaacccatcatcccgggactcttctccaagaagtatggcttcaccctgcgggccattcgcgtctacatgggtgactccgatgtctacaccgtgcaccatatggtgtggcacgtggaggatggaggtccggccagtgaggcagggcttcgtcaaggtgacctcatcacccatgtcaatggggaacctgtgcatggcctggtgcacacggaggtggagctgatcctgaagagtggaaacaaggtggccatttcaacaactcccctggagaacacatccattaaagtggggccagctcggaagggcagctacaaggccaagatggcccgaaggagcaagaggagccgcggcaaggatgggcaagaaagcagaaaaaggagctccctgttccgcaagatcaccaagcaagcatccctgctccacaccagccgcagcctttcttcccttaaccgctccttgtcatcaggggagagtgggccaggctctcccacacacagccacagcctttccccccgatctcccactcaaggctaccgggtgacccccgatgctgtgcattcaggcaactctcacggcccaagagtgcggagccaccccgttcaccactactcaagagggtgcagtcggctgagaaactggcagcagcacttgccgcctctgagaagaagctagccacttctcgcaagcacagccttgacctgccccactctgaactaaagaaggaactgccgcccagggaagtgagccctctggaggtagttggagccaggagtgtgctgtctggcaagggggccctgccagggaagggggtgctgcagcctgctccctcacgggccctaggcaccctccggcaggaccgagccgaacgacgggagtcgctgcagaagcaagaagccattcgtgaggtggactcctcagaggacgacaccgaggaagggcctgagaacagccagggtgcacaggagctgagcttggcacctcacccagaagtgagccagagtgtggcccctaaaggagcaggagagagtggggaagaggatcctttcccgtccagagaccctaggagcctgggcccaatggtcccaagcctattgacagggatcacactggggcctcccagaatggaaagtcccagtggtccccacaggaggctcgggagcccacaagccattgaggaggctgccagctcctcctcagcaggccccaacctaggtcagtctggagccacagaccccatccctcctgaaggttgctggaaggcccagcacctccacacccaggcactaacagcactttctcccagcacttcgggactcacccccaccagcagttgctctcctcccagctccacctctgggaagctgagcatgtggtcctggaaatcccttattgagggcccagacagggcatccccaagcagaaaggcaaccatggcaggtgggctagccaacctccaggatttggaaaacacaactccagcccagcctaagaacctgtctcccagggagcaggggaagacacagccacctagtgcccccagactggcccatccatcttatgaggatcccagccagggctggctatgggagtctgagtgtgcacaagcagtgaaagaggatccagccctgagcatcacccaagtgcctgatgcctcaggtgacagaaggcaggacgttccatgccgaggctgccccctcacccagaagtctgagcccagcctcaggaggggccaagaaccagggggccatcaaaagcatcgggatttggcattggttccagatgagcttttaaagcaaacatagcagttgtttgccatttcttgcactcagacctgtgtaatatatgctcctggaaacc

SEQ ID NO: 153852 - DNA, 5896 bp, Homo sapiens
  Payload ID: 10247
  Gene Symbol: MAST3
  Gene Name: microtubule associated serine/threonine kinase 3
  Uniprot ID: O60307
  ENST ID: ENST00000262811
  CDS Start-End: 1-3930
atggacgagtcgagcctcctgcggcgccgcgggctccagaaggagctgagcctgccacgccgaggacgtggctgccgcagcgggaaccgcaagagcttggtggtaggaacgccctccccgaccctctcccggcccctgtcgccattgtcggtcccaacggcaggcagcagccccttggatagtcctcggaatttctcggctgcctctgccctaaatttcccctttgcccggagggcagacggcagaagatggtccctcgcgtctctcccatcttccggctatggaaccaacacacccagctccaccctctcgtcaagctcatcctcccgggaacgtctccaccagcttcccttccagccgacgccggacgagctgcacttcctgtccaagcacttccgcagctcagagaatgtgcttgatgaggaaggcggccggtcaccccgcctccgaccccgctctcgcagtctcagcccgggccgtgcaacggggaccttcgacaatgagattgtcatgatgaatcacgtgtaccgggagaggttccccaaggccacagcacagatggagggccgtctgcaggagttcctgacggcctacgcgcccggcgcccggctggcgctggctgatggcgtcttgggcttcatccaccaccagatcgtcgagctggcccgagactgcttggccaagtctggcgagaacctcgtcacctcccgctacttcctagagatgcaggagaagctggagcggcttctgcaggatgcccatgagcgttcggacagtgaggaggtcagcttcatcgtccagcttgtccggaaactgctgatcatcatctcacggccagctcggctgctggagtgtctggagtttgaccctgaggaattttaccacctgctggaggcggctgagggccatgcgcgggagggccaaggcattaagactgaccttccacagtacatcattgggcagctgggcctggccaaggaccccctggaggagatggtgccactgagtcacctcgaagaagaacagcccccagcacctgagtccccagagagccgcgccctggtcggccagtcacggaggaagccatgcgaaagcgactttgagaccatcaaactcattagcaacggagcctatggggccgtctacctggtgcggcaccgtgacacacggcagcgctttgccatcaagaagatcaacaaacagaacttgatcctgcgtaaccagatccagcaggtctttgtggagcgtgacattctcacctttgccgagaacccctttgtggtcagcatgttctgctcctttgagacccggcgccacctatgtatggtcatggaatacgtggaaggcggcgactgcgccacgctcctgaagaacatgggcccgctgcccgtggacatggcccgcctgtacttcgccgagacggtgttggcgctggagtacctgcataactatggcatcgtgcaccgtgacctcaaaccagacaatctgctcatcacctcgcttggccacatcaagctcacggacttcggcctgtccaagatcggcctcatgagcatggccaccaacctctatgagggccacatcgagaaggacgcccgagagttcatcgacaagcaggtgtgtgggacgccggagtacatagcccccgaggtgatcttccgccagggctatgggaagccagtggactggtgggccatgggcgtcgtcctctatgagtttctggtgggctgcgtgcctttctttggagatacccccgaggaactcttcggtcaggtggtcagcgatgagatcatgtggccagagggagatgaggcccttccagcagacgcccaggacctcatcaccaggttgctccggcagagcccgctggaccgtctgggcactggtggcacccacgaagtgaagcagcacccctttttcctggccctggactgggcagggcttctccgacacaaagccgagttcgtgccccagctcgaagctgaggatgataccagctactttgacacacgttcggaacgttaccgccatctgggctccgaggacgacgagaccaatgatgaagaatcgtccacagagatcccccagttctcctcctgctcccaccggttcagcaaggtctacagcagctctgagttcctggccgtccagcccactcctaccttcgctgaaaggagcttcagtgaagaccgggaggaggggtgggagcgcagcgaagtggactatggccgccggctgagtgctgacatccggctgaggtcctggacatcctctggatcctcctgtcagtcatcttcgtcccagcccgagcggggtcccagcccatctctcctgaataccatcagcctggacacaatgcccaagtttgccttctcatcagaggatgagggggtaggcccaggccctgcaggccccaagaggcccgtcttcattctaggggagcctgaccccccaccagcggccaccccagtgatgcccaagccctcgagcctttctgccgacacagctgctctcagccacgcccgcctacggagcaatagcatcggcgcccgacactccacaccaaggcctctggatgccggccggggccgccgccttgggggcccaagagacccagcccctgagaagtccagagcctcctccagcggtggcagtggtggcggcagtgggggccgcgtgcccaagtcagcctctgtctctgccctgtccctcatcatcacggcagatgatggcagcggcggccccctcatgagccccctttccccgcgctctctgtcctcgaacccgtcgtcccgtgactcttcgccgagccgagacccgtcccccgtgtgtggcagcctgcggccccccatcgttatccacagctctggcaagaagtacggcttcagcctgcgggcgatccgcgtctacatgggtgatagcgacgtctacactgtgcaccacgtcgtctggagtgtggaggacggaagccccgcccaggaggcgggcctgcgggctggggacctcatcacccacatcaacggggagtcagtgctggggctggtgcacatggacgtcgtggagctgctgctgaagagcggcaacaagatatccctgcggaccacagccctggagaacacctccatcaaggtgggccccgcccggaagaatgtggccaagggccgcatggcacgcaggagcaagaggagccgtcggcgggagacccaggatcggcggaagtcacttttcaagaagatctccaagcagacctccgtgctgcacaccagccgcagcttctcctccggactccaccactcactgtcatccagtgagagcctccccggctcgcccacccacagcctctcccccagccccaccactccctgccgaagcccagcccctgatgtcccagcagataccactgcatccccacccagcgcatccccgagctccagcagccccgcctccccagctgctgctggccacacccgccccagctccctgcacggcctggctgccaagcttgggccaccccgccccaagactggccgccgcaagtccaccagcagcatcccgccctccccgctggcctgcccgcccatctccgcgcccccaccccgctcgccctcgcccctgcccgggcacccgcccgcacctgcccgatccccgcggctgcgccggggccagtcagctgacaagctgggcacaggggagcggctggatggggaggcggggcggcgcactcgtgggccagaggccgagctcgtggtcatgcggcggctgcacctgtccgagcgccgagactccttcaagaagcaggaggccgtgcaggaggttagcttcgatgagccgcaggaggaggccactgggctgcccacctcagtgccacagatcgccgtggagggcgaggaagccgtgccagtagctctcgggcccaccggaagagactgatcccctgccaggtctctccctggcatcaaagttacgcgttttcttgtgcaatgttttttccgtaaagtcatgcctggatggggactgagccaccagcctgacacccagaaggcgagaagccatctcggtccttgctggaaggtggagacatcgcttgtgttctggtgtcaatcggggctggatggggcaagaatgggggacaagggtggctttgtaaatagcagcaaatccctgcaactaatttattactttttttttctttttttttttttttttttgagacagagtctcactctgttgcccgggctggagtgcagcggcgtgatctcagctcactgcaacctccgcctcccaagttcaagcgattgtcctgcctcagcttcccaagtggctgggattacaggcgcccaccactatgcccagctaattttttgtatttttagtacagacggggtttcaccatgttggtcaggctggtctcgaactcctgacctcatgatttgcctgcctttgcctcccaaagtgctgggattacaggcgtgagccactgggcccagcctaatttattactttttataagcgatagccgtactgagccgccccctgaaggcggctgccaggtcttgccccaggcacctgggactctgtttgcaggccctgccctctgggctgagaaggatgcactttggacaagtcatctgtgtttgtgttttccagtttttctgtactttttaagtgttttgtgttacctggtctcattcccctccccacacctacccatttgaggggatggagttgaagtcacctggtcacctgtaccggcccagttcggctacaacctggagtgtccgtaaacaattcctctcacccacaaaacaatgtaatcccagcgatggactggattctgaaggccacttcccaccatcatagctgccatgcccaggcagtgcctgctctatatatagagtctgcctccaatcctgctggcttcagcctggagaagggatatgggagctggagctttgatggatgaataggtgttcaccggatctgggcagaggggtcatccgctccccaggtgggcactgataaaggaaggtacaggcctcacctggaactgccaaggcagcctccagaaatgctcggctgtctcggggcacgctccagtatgccagtcctgcgggattacgtccagctacttccagaaacactcagtgtcccctcccctcaggctctgccttggcctggccttgtccagtctaccctggacaagatgccgtgtgtttgaggcccagcagagtaagcccttggccgtgatgtgtctgaaacacctgttaggggttccctccatatgtcagagcctctctgggatgaagttcaagccagaaaacccagtcgaggctcaagtttgaatttcagcttcactgtgtggctctgggaaaatggctttcccactctgtgcctcagtttccttgtgtttacaagactaatcccattgactgtttattaagcacctactgtgtgccaagcgcttttacgtggcttctccctcagccagccttgagaaggctggaggtggtgtcatcacctccattttacagacaaagcagctgagaccccagcgaggggcggagacctgtcccacgatcacccagcaggagtcgtggcagaacggagcatcagccagaccctgttgtgggcgttgtcatcaagggagcttgaatggagggtctggtgtcagatacagccgactccagccccagctcatcccccatgatgctgtgtgacccactgggcactctggtgagggagctttccagacatcaacagcccactctgcttccctttctgagtcccctgtccagcactgcctagtgttggagggtagaccaaggctgtgcatgattcaccccctccttccatcctggagctggcagtgaataaaagcccgtatttacaaagatga

SEQ ID NO: 153853 - DNA, 354 bp, Homo sapiens
  Payload ID: 10247
  Gene Symbol: MAST3
  Gene Name: microtubule associated serine/threonine kinase 3
  ENST ID: ENST00000609494
  CDS Start-End: 1-261
tttgacacacgttcggaacgttaccgccatctgggctccgaggacgacgagaccaatgatgaagaatcgtccacagagatcccccagttctcctcctgctcccaccggttcagcaaggtctacagcagctctgagttcctggccgtccagcccactcctaccttcgctgaaaggagcttcagtgaagaccgggaggaggggtgggagcgcagcgaagtggactatggccgccggctgagtgctgacatccggggagcctgaccccccaccagcggccaccccagtgatgcccaagccctcgagcctttctgccgacacagctgctctcagccacgcccgcctacggagcaatag

SEQ ID NO: 153854 - DNA, 7664 bp, Homo sapiens
  Payload ID: 10248
  Gene Symbol: MAST4
  Gene Name: microtubule associated serine/threonine kinase family member 4
  Uniprot ID: O15021
  ENST ID: ENST00000261569
  CDS Start-End: 375-7664
aaacagatgacaaagtacctccgactgaatcccacagacagcgctttgagcagaacgcacggctcaactcatgtaattactgtttatagctggccgagcctgactaggagagggcagacccgagaggaaatcagtttcccggacctttgagaggaggctgtgtgttaattaaaggctaggacgggacgggtacttctcagacatgctccaagttgttcttgagatcacagttcccatcacattttctctggagggagtgagtagataattgggattttttttttatttttggccttgtctttcttccttttttttacctctccccattttagtcatatggccttgaacccacagtgaattgaagagagaaagaaatggatatgtctgaccccaatttttggactgtgctctcaaactttactttgcctcatttgaggagtgggaacaggcttcggcgaacacaaagttgccgaacaagcaaccggaaaagcttaataggcaatgggcagtcaccagcattgcctcgaccacactcacctctctctgctcatgcaggaaatagccctcaagatagtccaagaaatttctcccccagtgcctcagcccatttttcatttgcacggaggactgatggacgccgctggtcgttggcttctctcccttcctctggctatgggacaaacacacccagctctacggtctcttcatcctgttcctcccaggagaagttgcatcagttaccataccaaccaacaccagacgagttacacttcttatcaaaacatttctgtaccaccgaaagcatcgccactgagaacagatgcaggaacacgccgatgcgcccccgttcccgaagtctgagccctggacgttctcccgcctgctgtgaccatgaaataattatgatgaaccatgtctacaaagaaaggttcccaaaggctacagctcagatggaagaacgtctaaaggaaattatcaccagctactctcctgacaacgttctacccttagcagatggagtgcttagtttcactcaccaccagattattgaactggctcgagattgcttggataaatcccaccagggcctcatcacctcacgatacttccttgaattacagcacaaattagataagttgctacaggaggctcatgatcgttcagaaagtggagaattggcatttattaaacaactagttcgaaagatcctaattgttattgcccgccctgctcggttattagagtgcctggaatttgatccggaagaattttactacctattggaagcagcagaaggccatgccaaagaaggacagggtattaaaaccgacattcccaggtacatcattagccaactgggactcaataaggatcccttggaagaaatggctcatttgggaaactacgatagtgggacagcagaaacaccagaaacagatgaatcagtgagtagctctaatgcctccctgaaacttcgaaggaaacctcgggaaagtgattttgaaacgattaaattgattagcaatggagcctatggggcagtctactttgttcggcataaagaatcccggcagaggtttgccatgaagaagattaataaacagaacctcatccttcgaaaccagatccagcaggcctttgtggagcgggatatcctgacttttgcagaaaacccctttgttgtcagcatgtattgctcctttgaaacaaggcgccacttgtgcatggtcatggaatatgtggaagggggagactgtgctactttaatgaaaaacatgggtcctctccctgttgatatggccagaatgtactttgctgagacggtcttggccttggaatatttacataattatggaattgtacacagggatttgaaaccagacaacttgttggttacctccatggggcacataaagctgacagattttggattatctaaggtgggactaatgagcatgactaccaacctttacgagggtcatattgagaaggatgctagagagttcctggataaacaggtctgtggcacacctgaatacattgcaccagaagtgattctgaggcagggttatggaaagccggtggactggtgggccatggggattatcctctatgaatttctggttggatgcgtgccattctttggggatactccagaggagctatttggacaagtcatcagtgatgagatcaactggcctgagaaggatgaggcacccccacctgatgcccaggatctgattaccttactcctcaggcagaatcccctggagaggctgggaacaggtggtgcatatgaagtcaaacagcatcgattcttccgttctttagactggaacagtttgctgagacagaaggcagaatttattccccaactggaatctgaggatgacacaagttattttgatactcggtctgagaagtatcatcatatggaaacggaggaagaagatgacacaaatgatgaagactttaatgtggaaataaggcagttttcttcatgttcacacaggttttcaaaagttttcagcagtatagatcgaatcactcagaattcagcagaagagaaggaagactctgtggacaaaaccaaaagcaccaccttgccatccacagaaacactgagctggagttcagaatattctgaaatgcaacagctatcaacatccaactcttcagatactgaaagcaacagacataaactcagttctggcctacttcccaaactggctatttcaacagagggagagcaagatgaagctgcctcctgccctggagacccccatgaggagccaggaaagccagcccttcctcctgaagagtgtgcccaggaggagcctgaggtcaccaccccagccagcaccatcagcagctccaccctgtcagttggcagtttttcagagcacttggatcagataaatggacgaagcgagtgtgtggacagtacagataattcctcaaagccatccagtgaacccgcttctcacatggctcggcagcgattagaaagcacagaaaaaaagaaaatctcggggaaagtcacaaagtccctctctgccagtgctctttccctcatgatcccaggagatatgtttgctgtttcccctctgggaagtccaatgtctccccattccctgtcctcggacccttcttcttcacgagattcctctcccagccgagattcctcagcagcttctgccagtccacatcagccgattgtgatccacagttcggggaagaactacggctttaccatccgagccatccgggtgtatgtgggagacagtgacatctatacagtgcaccatatcgtctggaatgtagaagaaggaagtccggcatgccaggcaggactgaaggctggagatcttatcactcacatcaatggagaaccagtgcatggacttgtccacacagaagttatagaactcctactgaagagtgggaataaggtgtcaatcactactaccccatttgaaaacacatcaatcaaaactggaccagccaggagaaacagctataagagccggatggtgaggcggagcaagaaatccaagaagaaagaaagtctcgaaaggaggagatctcttttcaaaaagctagccaagcagccttctcctttactccacaccagccgaagtttctcctgcttgaacagatccctgtcatcgggtgagagcctcccaggttcccccactcatagcttgtctccccggtctccaacaccaagctaccgctccacccctgacttcccatctggtactaattcctcccagagcagctcccctagttctagtgcccccaattccccagcagggtccgggcacatccggcccagcactctccacggtcttgcacccaaactcggcgggcagcggtaccggtccggaaggcgaaagtccgccggcaacatcccactgtccccgctggcccggacgccctctccaaccccgcaacccacctccccgcagcggtcaccatcccctcttctgggacactcactgggcaattccaagatcgcgcaagcctttcccagcaagatgcactccccgcccaccatcgtcagacacatcgtgaggcccaagagtgcggagccccccaggtccccgctgctcaagcgcgtgcagtccgaggagaagctgtcgccctcttacggcagtgacaagaagcacctgtgctcccgcaagcacagcctggaggtgacccaagaggaggtgcagcgggagcagtcccagcgggaggcgccgctgcagagcctggatgagaacgtgtgcgacgtgccgccgctcagccgcgcccggccagtggagcaaggctgcctgaaacgcccagtctcccggaaggtgggccgccaggagtctgtggacgacctggaccgcgacaagctgaaggccaaggtggtggtgaagaaagcagacggcttcccagagaaacaggaatcccaccagaaatcccatggacccgggagtgatttggaaaactttgctctgtttaagctggaagagagagagaagaaagtctatccgaaggctgtggaaaggtcaagtacttttgaaaacaaagcgtctatgcaggaggcgccaccgctgggcagcctgctgaaggatgctcttcacaagcaggccagcgtgcgcgccagcgagggtgcgatgtcggatggccgggtgcctgcggagcaccgccagggtggcggggacttcagacgggcccccgctcctggcaccctccaggatggtctctgccactccctcgacaggggcatctctgggaagggggaaggcacggagaagtcctcccaggccaaggagcttctccgatgtgaaaagttagacagcaagctggccaacatcgattacctccgaaagaaaatgtcacttgaggacaaagaggacaacctctgccctgtgctgaagcccaagatgacagctggctcccacgaatgcctgccagggaacccagtccgacccacgggtgggcagcaggagcccccgccggcttctgagagccgagcttttgtcagcagcacccatgcagctcagatgagtgccgtctcttttgttcccctcaaggccttaacaggccgggtggacagtggaacggagaagcctggcttggttgctcctgagtcccctgttaggaagagcccctccgagtataagctggaaggtaggtctgtctcatgcctgaagccgatcgagggcactctggacattgctctcctgtccggacctcaggcctccaagacagaactgccttccccagagtctgcacagagccccagcccaagtggtgacgtgagggcctctgtgccaccagttctccccagcagcagtgggaaaaagaacgataccaccagtgcaagagagctttctccttccagcttaaagatgaataaatcctacctgctggagccttggttcctgccccccagccgaggtctccagaattcaccagcagtttccctgcctgacccagagttcaagagggacaggaaaggtccccatcctactgccaggagccctggaacagtcatggaaagcaatccccaacagagagagggcagctcccctaaacaccaagaccacaccactgaccccaagcttctgacctgcctggggcagaacctccacagccctgacctggccaggccacgctgcccgctcccacctgaagcttccccctcaagggagaagccaggcctgagggaatcgtctgaaagaggccctcccacagccagaagcgagcgctctgctgcgagggctgacacatgcagagagccctccatggaactgtgctttccagaaactgcgaaaaccagtgacaactccaaaaatctcctctctgtgggaaggacccacccagatttctatacacagacccaggccatggagaaagcatgggcgccgggtgggaaaacgaaccacaaagatggcccaggtgaggcgaggcccccgcccagagacaactcctctctgcactcagctggaattccctgtgagaaggagctgggcaaggtgaggcgtggcgtggaacccaagcccgaagcgcttcttgccaggcggtctctgcagccacctggaattgagagtgagaagagtgaaaagctctccagtttcccatctttgcagaaagatggtgccaaggaacctgaaaggaaggagcagcctctacaaaggcatcccagcagcatccctccgccccctctgacggccaaagacctgtccagcccggctgccaggcagcattgcagttccccaagccacgcttctggcagagagccgggggccaagcccagcactgcagagcccagctcgagcccccaggaccctcccaagcctgttgctgcgcacagtgaaagcagcagccacaagccccggcctggccctgacccgggccctccaaagactaagcaccccgaccggtccctctcctctcagaaaccaagtgtcggggccacaaagggcaaagagcctgccactcagtccctcggtggctctagcagagaggggaagggccacagtaagagtgggccggatgtgtttcctgctaccccaggctcccagaacaaagccagcgatgggattggccagggagaaggtgggccctctgtcccactgcacactgacagggctcctctagacgccaagccacaacccaccagtggtgggcggcccctggaggtgctggagaagcctgtgcatttgccaaggccgggacacccagggcctagtgagccagcggaccagaaactgtccgctgttggtgaaaagcaaaccctgtctccaaagcaccccaaaccatccactgtgaaagattgccccaccctgtgcaaacagacagacaacagacagacagacaaaagcccgagtcagccggccgccaacaccgacagaagggcggaagggaagaaatgcactgaagcactttatgctccagcagagggcgacaagctcgaggccggcctttcctttgtgcatagcgagaaccggttgaaaggcgcggagcggccagccgcgggggtggggaagggcttccctgaggccagagggaaagggcccggtccccagaagccaccgacggaggcagacaagcccaatggcatgaaacggtccccctcagccactgggcagagttctttccgatccacggccctcccggaaaagtctctgagctgctcctccagcttccctgaaaccagggccggagttagagaggcctctgcagccagcagcgacacctcttctgccaaggccgccgggggcatgctggagcttccagcccccagcaacagggaccataggaaggctcagcctgccggggagggccgaacccacatgacaaagagtgactccctgccctccttccgggtctccaccctgcctctggagtcacaccaccccgacccaaacaccatgggcggggccagccaccgggacagggctctctcggtgactgccaccgtaggggaaaccaaagggaaggaccctgccccagcccagcctcccccagctaggaaacagaacgtgggcagagacgtgaccaagccatccccagccccaaacactgaccgccccatctctctttctaatgagaaggactttgtggtacggcagaggcgggggaaagagagtttgcgtagcagccctcacaaaaaggccttgtaa

SEQ ID NO: 153855 - DNA, 7713 bp, Homo sapiens
  Payload ID: 10248
  Gene Symbol: MAST4
  Gene Name: microtubule associated serine/threonine kinase family member 4
  ENST ID: ENST00000405643
  CDS Start-End: 379-7713
ttatttttttgccccagtctgcagggtgaaaaggacttttcatttcactgaggtgaaaagtgggtctgtgagtagagcgactttctttaaaaaaaaaaaaaaaaatcagaaaccaattacttgatatgcagagctgcaagcctcgttcctttaacaaaatcagtgcagtgtgcactgccgttaacctgaggaaagcagctgacatctcttgattacggctagaggtggaaggacccaaacttgcagcctccccctccccctcgagagagtgttagtccagtcctttagagaggttcggtttggctctctgtcatcaccgggacgctggcagggagtgtgtgtcatggttacaatagagtgtgctaacatataacaaccatgaaagcccagcgggaaaggctacagattccggggctgaccttggatctcactcccaggagcctgagtccaaccccatccagcccaggcagtccttgtagtcctctcttggcctttcacttttggagttgccgaacaagcaaccggaaaagcttaataggcaatgggcagtcaccagcattgcctcgaccacactcacctctctctgctcatgcaggaaatagccctcaagatagtccaagaaatttctcccccagtgcctcagcccatttttcatttgcacggagaaatgacaggactgatggacgccgctggtcgttggcttctctcccttcctctggctatgggacaaacacacccagctctacggtctcttcatcctgttcctcccaggagaagttgcatcagttaccataccaaccaacaccagacgagttacacttcttatcaaaacatttctgtaccaccgaaagcatcgccactgagaacagatgcaggaacacgccgatgcgcccccgttcccgaagtctgagccctggacgttctcccgcctgctgtgaccatgaaataattatgatgaaccatgtctacaaagaaaggttcccaaaggctacagctcagatggaagaacgtctaaaggaaattatcaccagctactctcctgacaacgttctacccttagcagatggagtgcttagtttcactcaccaccagattattgaactggctcgagattgcttggataaatcccaccagggcctcatcacctcacgatacttccttgaattacagcacaaattagataagttgctacaggaggctcatgatcgttcagaaagtggagaattggcatttattaaacaactagttcgaaagatcctaattgttattgcccgccctgctcggttattagagtgcctggaatttgatccggaagaattttactacctattggaagcagcagaaggccatgccaaagaaggacagggtattaaaaccgacattcccaggtacatcattagccaactgggactcaataaggatcccttggaagaaatggctcatttgggaaactacgatagtgggacagcagaaacaccagaaacagatgaatcagtgagtagctctaatgcctccctgaaacttcgaaggaaacctcgggaaagtgattttgaaacgattaaattgattagcaatggagcctatggggcagtctactttgttcggcataaagaatcccggcagaggtttgccatgaagaagattaataaacagaacctcatccttcgaaaccagatccagcaggcctttgtggagcgggatatcctgacttttgcagaaaacccctttgttgtcagcatgtattgctcctttgaaacaaggcgccacttgtgcatggtcatggaatatgtggaagggggagactgtgctactttaatgaaaaacatgggtcctctccctgttgatatggccagaatgtactttgctgagacggtcttggccttggaatatttacataattatggaattgtacacagggatttgaaaccagacaacttgttggttacctccatggggcacataaagctgacagattttggattatctaaggtgggactaatgagcatgactaccaacctttacgagggtcatattgagaaggatgctagagagttcctggataaacaggtctgtggcacacctgaatacattgcaccagaagtgattctgaggcagggttatggaaagccggtggactggtgggccatggggattatcctctatgaatttctggttggatgcgtgccattctttggggatactccagaggagctatttggacaagtcatcagtgatgagatcaactggcctgagaaggatgaggcacccccacctgatgcccaggatctgattaccttactcctcaggcagaatcccctggagaggctgggaacaggtggtgcatatgaagtcaaacagcatcgattcttccgttctttagactggaacagtttgctgagacagaaggcagaatttattccccaactggaatctgaggatgacacaagttattttgatactcggtctgagaagtatcatcatatggaaacggaggaagaagatgacacaaatgatgaagactttaatgtggaaataaggcagttttcttcatgttcacacaggttttcaaaagttttcagcagtatagatcgaatcactcagaattcagcagaagagaaggaagactctgtggacaaaaccaaaagcaccaccttgccatccacagaaacactgagctggagttcagaatattctgaaatgcaacagctatcaacatccaactcttcagatactgaaagcaacagacataaactcagttctggcctacttcccaaactggctatttcaacagagggagagcaagatgaagctgcctcctgccctggagacccccatgaggagccaggaaagccagcccttcctcctgaagagtgtgcccaggaggagcctgaggtcaccaccccagccagcaccatcagcagctccaccctgtcagttggcagtttttcagagcacttggatcagataaatggacgaagcgagtgtgtggacagtacagataattcctcaaagccatccagtgaacccgcttctcacatggctcggcagcgattagaaagcacagaaaaaaagaaaatctcggggaaagtcacaaagtccctctctgccagtgctctttccctcatgatcccaggagatatgtttgctgtttcccctctgggaagtccaatgtctccccattccctgtcctcggacccttcttcttcacgagattcctctcccagccgagattcctcagcagcttctgccagtccacatcagccgattgtgatccacagttcggggaagaactacggctttaccatccgagccatccgggtgtatgtgggagacagtgacatctatacagtgcaccatatcgtctggaatgtagaagaaggaagtccggcatgccaggcaggactgaaggctggagatcttatcactcacatcaatggagaaccagtgcatggacttgtccacacagaagttatagaactcctactgaagagtgggaataaggtgtcaatcactactaccccatttgaaaacacatcaatcaaaactggaccagccaggagaaacagctataagagccggatggtgaggcggagcaagaaatccaagaagaaagaaagtctcgaaaggaggagatctcttttcaaaaagctagccaagcagccttctcctttactccacaccagccgaagtttctcctgcttgaacagatccctgtcatcgggtgagagcctcccaggttcccccactcatagcttgtctccccggtctccaacaccaagctaccgctccacccctgacttcccatctggtactaattcctcccagagcagctcccctagttctagtgcccccaattccccagcagggtccgggcacatccggcccagcactctccacggtcttgcacccaaactcggcgggcagcggtaccggtccggaaggcgaaagtccgccggcaacatcccactgtccccgctggcccggacgccctctccaaccccgcaacccacctccccgcagcggtcaccatcccctcttctgggacactcactgggcaattccaagatcgcgcaagcctttcccagcaagatgcactccccgcccaccatcgtcagacacatcgtgaggcccaagagtgcggagccccccaggtccccgctgctcaagcgcgtgcagtccgaggagaagctgtcgccctcttacggcagtgacaagaagcacctgtgctcccgcaagcacagcctggaggtgacccaagaggaggtgcagcgggagcagtcccagcgggaggcgccgctgcagagcctggatgagaacgtgtgcgacgtgccgccgctcagccgcgcccggccagtggagcaaggctgcctgaaacgcccagtctcccggaaggtgggccgccaggagtctgtggacgacctggaccgcgacaagctgaaggccaaggtggtggtgaagaaagcagacggcttcccagagaaacaggaatcccaccagaaatcccatggacccgggagtgatttggaaaactttgctctgtttaagctggaagagagagagaagaaagtctatccgaaggctgtggaaaggtcaagtacttttgaaaacaaagcgtctatgcaggaggcgccaccgctgggcagcctgctgaaggatgctcttcacaagcaggccagcgtgcgcgccagcgagggtgcgatgtcggatggccgggtgcctgcggagcaccgccagggtggcggggacttcagacgggcccccgctcctggcaccctccaggatggtctctgccactccctcgacaggggcatctctgggaagggggaaggcacggagaagtcctcccaggccaaggagcttctccgatgtgaaaagttagacagcaagctggccaacatcgattacctccgaaagaaaatgtcacttgaggacaaagaggacaacctctgccctgtgctgaagcccaagatgacagctggctcccacgaatgcctgccagggaacccagtccgacccacgggtgggcagcaggagcccccgccggcttctgagagccgagcttttgtcagcagcacccatgcagctcagatgagtgccgtctcttttgttcccctcaaggccttaacaggccgggtggacagtggaacggagaagcctggcttggttgctcctgagtcccctgttaggaagagcccctccgagtataagctggaaggtaggtctgtctcatgcctgaagccgatcgagggcactctggacattgctctcctgtccggacctcaggcctccaagacagaactgccttccccagagtctgcacagagccccagcccaagtggtgacgtgagggcctctgtgccaccagttctccccagcagcagtgggaaaaagaacgataccaccagtgcaagagagctttctccttccagcttaaagatgaataaatcctacctgctggagccttggttcctgccccccagccgaggtctccagaattcaccagcagtttccctgcctgacccagagttcaagagggacaggaaaggtccccatcctactgccaggagccctggaacagtcatggaaagcaatccccaacagagagagggcagctcccctaaacaccaagaccacaccactgaccccaagcttctgacctgcctggggcagaacctccacagccctgacctggccaggccacgctgcccgctcccacctgaagcttccccctcaagggagaagccaggcctgagggaatcgtctgaaagaggccctcccacagccagaagcgagcgctctgctgcgagggctgacacatgcagagagccctccatggaactgtgctttccagaaactgcgaaaaccagtgacaactccaaaaatctcctctctgtgggaaggacccacccagatttctatacacagacccaggccatggagaaagcatgggcgccgggtgggaaaacgaaccacaaagatggcccaggtgaggcgaggcccccgcccagagacaactcctctctgcactcagctggaattccctgtgagaaggagctgggcaaggtgaggcgtggcgtggaacccaagcccgaagcgcttcttgccaggcggtctctgcagccacctggaattgagagtgagaagagtgaaaagctctccagtttcccatctttgcagaaagatggtgccaaggaacctgaaaggaaggagcagcctctacaaaggcatcccagcagcatccctccgccccctctgacggccaaagacctgtccagcccggctgccaggcagcattgcagttccccaagccacgcttctggcagagagccgggggccaagcccagcactgcagagcccagctcgagcccccaggaccctcccaagcctgttgctgcgcacagtgaaagcagcagccacaagccccggcctggccctgacccgggccctccaaagactaagcaccccgaccggtccctctcctctcagaaaccaagtgtcggggccacaaagggcaaagagcctgccactcagtccctcggtggctctagcagagaggggaagggccacagtaagagtgggccggatgtgtttcctgctaccccaggctcccagaacaaagccagcgatgggattggccagggagaaggtgggccctctgtcccactgcacactgacagggctcctctagacgccaagccacaacccaccagtggtgggcggcccctggaggtgctggagaagcctgtgcatttgccaaggccgggacacccagggcctagtgagccagcggaccagaaactgtccgctgttggtgaaaagcaaaccctgtctccaaagcaccccaaaccatccactgtgaaagattgccccaccctgtgcaaacagacagacaacagacagacagacaaaagcccgagtcagccggccgccaacaccgacagaagggcggaagggaagaaatgcactgaagcactttatgctccagcagagggcgacaagctcgaggccggcctttcctttgtgcatagcgagaaccggttgaaaggcgcggagcggccagccgcgggggtggggaagggcttccctgaggccagagggaaagggcccggtccccagaagccaccgacggaggcagacaagcccaatggcatgaaacggtccccctcagccactgggcagagttctttccgatccacggccctcccggaaaagtctctgagctgctcctccagcttccctgaaaccagggccggagttagagaggcctctgcagccagcagcgacacctcttctgccaaggccgccgggggcatgctggagcttccagcccccagcaacagggaccataggaaggctcagcctgccggggagggccgaacccacatgacaaagagtgactccctgccctccttccgggtctccaccctgcctctggagtcacaccaccccgacccaaacaccatgggcggggccagccaccgggacagggctctctcggtgactgccaccgtaggggaaaccaaagggaaggaccctgccccagcccagcctcccccagctaggaaacagaacgtgggcagagacgtgaccaagccatccccagccccaaacactgaccgccccatctctctttctaatgagaaggactttgtggtacggcagaggcgggggaaagagagtttgcgtagcagccctcacaaaaaggccttgtaa

SEQ ID NO: 153856 - DNA, 7586 bp, Homo sapiens
  Payload ID: 10248
  Gene Symbol: MAST4
  Gene Name: microtubule associated serine/threonine kinase family member 4
  Uniprot ID: O15021
  ENST ID: ENST00000403666
  CDS Start-End: 69-7373
gtgctgaagtagaggtagtacagcatggctagactgttgtgagaggctcagagaaagcagagggtgagatggatgagtccagcattctaagacgaagagggctccagaaggagctgagtctccccagaagaggaagtttgatagattcccagaagtggaattgcttggtcaaacgttgccgaacaagcaaccggaaaagcttaataggcaatgggcagtcaccagcattgcctcgaccacactcacctctctctgctcatgcaggaaatagccctcaagatagtccaagaaatttctcccccagtgcctcagcccatttttcatttgcacggaggactgatggacgccgctggtcgttggcttctctcccttcctctggctatgggacaaacacacccagctctacggtctcttcatcctgttcctcccaggagaagttgcatcagttaccataccaaccaacaccagacgagttacacttcttatcaaaacatttctgtaccaccgaaagcatcgccactgagaacagatgcaggaacacgccgatgcgcccccgttcccgaagtctgagccctggacgttctcccgcctgctgtgaccatgaaataattatgatgaaccatgtctacaaagaaaggttcccaaaggctacagctcagatggaagaacgtctaaaggaaattatcaccagctactctcctgacaacgttctacccttagcagatggagtgcttagtttcactcaccaccagattattgaactggctcgagattgcttggataaatcccaccagggcctcatcacctcacgatacttccttgaattacagcacaaattagataagttgctacaggaggctcatgatcgttcagaaagtggagaattggcatttattaaacaactagttcgaaagatcctaattgttattgcccgccctgctcggttattagagtgcctggaatttgatccggaagaattttactacctattggaagcagcagaaggccatgccaaagaaggacagggtattaaaaccgacattcccaggtacatcattagccaactgggactcaataaggatcccttggaagaaatggctcatttgggaaactacgatagtgggacagcagaaacaccagaaacagatgaatcagtgagtagctctaatgcctccctgaaacttcgaaggaaacctcgggaaagtgattttgaaacgattaaattgattagcaatggagcctatggggcagtctactttgttcggcataaagaatcccggcagaggtttgccatgaagaagattaataaacagaacctcatccttcgaaaccagatccagcaggcctttgtggagcgggatatcctgacttttgcagaaaacccctttgttgtcagcatgtattgctcctttgaaacaaggcgccacttgtgcatggtcatggaatatgtggaagggggagactgtgctactttaatgaaaaacatgggtcctctccctgttgatatggccagaatgtactttgctgagacggtcttggccttggaatatttacataattatggaattgtacacagggatttgaaaccagacaacttgttggttacctccatggggcacataaagctgacagattttggattatctaaggtgggactaatgagcatgactaccaacctttacgagggtcatattgagaaggatgctagagagttcctggataaacaggtctgtggcacacctgaatacattgcaccagaagtgattctgaggcagggttatggaaagccggtggactggtgggccatggggattatcctctatgaatttctggttggatgcgtgccattctttggggatactccagaggagctatttggacaagtcatcagtgatgagatcaactggcctgagaaggatgaggcacccccacctgatgcccaggatctgattaccttactcctcaggcagaatcccctggagaggctgggaacaggtggtgcatatgaagtcaaacagcatcgattcttccgttctttagactggaacagtttgctgagacagaaggcagaatttattccccaactggaatctgaggatgacacaagttattttgatactcggtctgagaagtatcatcatatggaaacggaggaagaagatgacacaaatgatgaagactttaatgtggaaataaggcagttttcttcatgttcacacaggttttcaaaagttttcagcagtatagatcgaatcactcagaattcagcagaagagaaggaagactctgtggacaaaaccaaaagcaccaccttgccatccacagaaacactgagctggagttcagaatattctgaaatgcaacagctatcaacatccaactcttcagatactgaaagcaacagacataaactcagttctggcctacttcccaaactggctatttcaacagagggagagcaagatgaagctgcctcctgccctggagacccccatgaggagccaggaaagccagcccttcctcctgaagagtgtgcccaggaggagcctgaggtcaccaccccagccagcaccatcagcagctccaccctgtcagttggcagtttttcagagcacttggatcagataaatggacgaagcgagtgtgtggacagtacagataattcctcaaagccatccagtgaacccgcttctcacatggctcggcagcgattagaaagcacagaaaaaaagaaaatctcggggaaagtcacaaagtccctctctgccagtgctctttccctcatgatcccaggagatatgtttgctgtttcccctctgggaagtccaatgtctccccattccctgtcctcggacccttcttcttcacgagattcctctcccagccgagattcctcagcagcttctgccagtccacatcagccgattgtgatccacagttcggggaagaactacggctttaccatccgagccatccgggtgtatgtgggagacagtgacatctatacagtgcaccatatcgtctggaatgtagaagaaggaagtccggcatgccaggcaggactgaaggctggagatcttatcactcacatcaatggagaaccagtgcatggacttgtccacacagaagttatagaactcctactgaagagtgggaataaggtgtcaatcactactaccccatttgaaaacacatcaatcaaaactggaccagccaggagaaacagctataagagccggatggtgaggcggagcaagaaatccaagaagaaagaaagtctcgaaaggaggagatctcttttcaaaaagctagccaagcagccttctcctttactccacaccagccgaagtttctcctgcttgaacagatccctgtcatcgggtgagagcctcccaggttcccccactcatagcttgtctccccggtctccaacaccaagctaccgctccacccctgacttcccatctggtactaattcctcccagagcagctcccctagttctagtgcccccaattccccagcagggtccgggcacatccggcccagcactctccacggtcttgcacccaaactcggcgggcagcggtaccggtccggaaggcgaaagtccgccggcaacatcccactgtccccgctggcccggacgccctctccaaccccgcaacccacctccccgcagcggtcaccatcccctcttctgggacactcactgggcaattccaagatcgcgcaagcctttcccagcaagatgcactccccgcccaccatcgtcagacacatcgtgaggcccaagagtgcggagccccccaggtccccgctgctcaagcgcgtgcagtccgaggagaagctgtcgccctcttacggcagtgacaagaagcacctgtgctcccgcaagcacagcctggaggtgacccaagaggaggtgcagcgggagcagtcccagcgggaggcgccgctgcagagcctggatgagaacgtgtgcgacgtgccgccgctcagccgcgcccggccagtggagcaaggctgcctgaaacgcccagtctcccggaaggtgggccgccaggagtctgtggacgacctggaccgcgacaagctgaaggccaaggtggtggtgaagaaagcagacggcttcccagagaaacaggaatcccaccagaaatcccatggacccgggagtgatttggaaaactttgctctgtttaagctggaagagagagagaagaaagtctatccgaaggctgtggaaaggtcaagtacttttgaaaacaaagcgtctatgcaggaggcgccaccgctgggcagcctgctgaaggatgctcttcacaagcaggccagcgtgcgcgccagcgagggtgcgatgtcggatggccgggtgcctgcggagcaccgccagggtggcggggacttcagacgggcccccgctcctggcaccctccaggatggtctctgccactccctcgacaggggcatctctgggaagggggaaggcacggagaagtcctcccaggccaaggagcttctccgatgtgaaaagttagacagcaagctggccaacatcgattacctccgaaagaaaatgtcacttgaggacaaagaggacaacctctgccctgtgctgaagcccaagatgacagctggctcccacgaatgcctgccagggaacccagtccgacccacgggtgggcagcaggagcccccgccggcttctgagagccgagcttttgtcagcagcacccatgcagctcagatgagtgccgtctcttttgttcccctcaaggccttaacaggccgggtggacagtggaacggagaagcctggcttggttgctcctgagtcccctgttaggaagagcccctccgagtataagctggaaggtaggtctgtctcatgcctgaagccgatcgagggcactctggacattgctctcctgtccggacctcaggcctccaagacagaactgccttccccagagtctgcacagagccccagcccaagtggtgacgtgagggcctctgtgccaccagttctccccagcagcagtgggaaaaagaacgataccaccagtgcaagagagctttctccttccagcttaaagatgaataaatcctacctgctggagccttggttcctgccccccagccgaggtctccagaattcaccagcagtttccctgcctgacccagagttcaagagggacaggaaaggtccccatcctactgccaggagccctggaacagtcatggaaagcaatccccaacagagagagggcagctcccctaaacaccaagaccacaccactgaccccaagcttctgacctgcctggggcagaacctccacagccctgacctggccaggccacgctgcccgctcccacctgaagcttccccctcaagggagaagccaggcctgagggaatcgtctgaaagaggccctcccacagccagaagcgagcgctctgctgcgagggctgacacatgcagagagccctccatggaactgtgctttccagaaactgcgaaaaccagtgacaactccaaaaatctcctctctgtgggaaggacccacccagatttctatacacagacccaggccatggagaaagcatgggcgccgggtgggaaaacgaaccacaaagatggcccaggtgaggcgaggcccccgcccagagacaactcctctctgcactcagctggaattccctgtgagaaggagctgggcaaggtgaggcgtggcgtggaacccaagcccgaagcgcttcttgccaggcggtctctgcagccacctggaattgagagtgagaagagtgaaaagctctccagtttcccatctttgcagaaagatggtgccaaggaacctgaaaggaaggagcagcctctacaaaggcatcccagcagcatccctccgccccctctgacggccaaagacctgtccagcccggctgccaggcagcattgcagttccccaagccacgcttctggcagagagccgggggccaagcccagcactgcagagcccagctcgagcccccaggaccctcccaagcctgttgctgcgcacagtgaaagcagcagccacaagccccggcctggccctgacccgggccctccaaagactaagcaccccgaccggtccctctcctctcagaaaccaagtgtcggggccacaaagggcaaagagcctgccactcagtccctcggtggctctagcagagaggggaagggccacagtaagagtgggccggatgtgtttcctgctaccccaggctcccagaacaaagccagcgatgggattggccagggagaaggtgggccctctgtcccactgcacactgacagggctcctctagacgccaagccacaacccaccagtggtgggcggcccctggaggtgctggagaagcctgtgcatttgccaaggccgggacacccagggcctagtgagccagcggaccagaaactgtccgctgttggtgaaaagcaaaccctgtctccaaagcaccccaaaccatccactgtgaaagattgccccaccctgtgcaaacagacagacaacagacagacagacaaaagcccgagtcagccggccgccaacaccgacagaagggcggaagggaagaaatgcactgaagcactttatgctccagcagagggcgacaagctcgaggccggcctttcctttgtgcatagcgagaaccggttgaaaggcgcggagcggccagccgcgggggtggggaagggcttccctgaggccagagggaaagggcccggtccccagaagccaccgacggaggcagacaagcccaatggcatgaaacggtccccctcagccactgggcagagttctttccgatccacggccctcccggaaaagtctctgagctgctcctccagcttccctgaaaccagggccggagttagagaggcctctgcagccagcagcgacacctcttctgccaaggccgccgggggcatgctggagcttccagcccccagcaacagggaccataggaaggctcagcctgccggggagggccgaacccacatgacaaagagtgactccctgccctccttccgggtctccaccctgcctctggagtcacaccaccccgacccaaacaccatgggcggggccagccaccgggacagggctctctcggtgactgccaccgtaggggaaaccaaagggaaggaccctgccccagcccagcctcccccagctaggaaacagaacgtgggcagagacgtgaccaagccatccccagccccaaacactgaccgccccatctctctttctaatgagaaggactttgtggtacggcagaggcgggggaaagagagtttgcgtagcagccctcacaaaaaggccttgtaacggggagggcccaggggcaggactgtggagacccgtcctgaacgggcgactgtgtcttgactacctttcaaaaccagcactgtgtgggaatgtccgccaggcagagctcggagcctcattgagacaggggagagagaaagacaaagaggggaccttcttccagatgccttcccagttgtaaccggtaaaactgttaccagatagtgtttgtac

SEQ ID NO: 153857 - DNA, 717 bp, Homo sapiens
  Payload ID: 10248
  Gene Symbol: MAST4
  Gene Name: microtubule associated serine/threonine kinase family member 4
  ENST ID: ENST00000406039
  CDS Start-End: 1-717
atgggggagaaagtttcggaggcgccagagccggtgccccgcggctgcagtggccacggcagccggactccagcctctgcgctggtcgccgcgtcctctccgggtgcttcctcggccgagtcctcctcgggctcagaaactctgtcggaggaaggggagcccggcggcttctccagagagcatcagccgccgccgccgccgccgttgggaggcaccctgggcgcccgggcgcccgccgcgtgggctccggcaagcgtgctgctggagcgcggagtccttgcgctgccgccgccgcttcccggaggagctgtgccgcccgcgccccggggcagcagcgcgtcccaggaggagcaggacgaggagcttgaccacatattatcccctccacccatgccgtttcggaaatgcagcaacccagatgtggcttctggccctggaaaatcactgaagtataaaagacagctgagtgaggatggaagacagctaaggcgagggagcctgggaggagccctgactgggaggtaccttcttccaaacccggtggcgggacaggcctggccggcctctgcagagacgtccaacctcgtgcgcatgcgcagccaggccctgggccagtcggcgccctcgctcaccgccagcctgaaggagctgagtctccccagaagaggaagtttccctgtgtgtccaaatgctgggagaacatcaccccttggatga

SEQ ID NO: 153858 - DNA, 1066 bp, Homo sapiens
  Payload ID: 10248
  Gene Symbol: MAST4
  Gene Name: microtubule associated serine/threonine kinase family member 4
  Uniprot ID: O15021
  ENST ID: ENST00000406374
  CDS Start-End: 277-1029
gcagcgcgggagcacagtggagcgcagatcgcggacccgagcgggcatgtccccgcgcgcgggagcctccgtttgcggccgggcccgggcggctgtgaacttagcagcgggctcctgcggccccgtcactgccatgtagtcgctggcggggctccctgcagcccgggagcggcagtgccagtgagcctgagcccaggagcccgcgtcttccccgggaggcgctgagtgcgcgccgcgcccccgccgctcgggaggcactttgggccagacagggaaatgggggagaaagtttcggaggcgccagagccggtgccccgcggctgcagtggccacggcagccggactccagcctctgcgctggtcgccgcgtcctctccgggtgcttcctcggccgagtcctcctcgggctcagaaactctgtcggaggaaggggagcccggcggcttctccagagagcatcagccgccgccgccgccgccgttgggaggcaccctgggcgcccgggcgcccgccgcgtgggctccggcaagcgtgctgctggagcgcggagtccttgcgctgccgccgccgcttcccggaggagctgtgccgcccgcgccccggggcagcagcgcgtcccaggaggagcaggacgaggagcttgaccacatattatcccctccacccatgccgtttcggaaatgcagcaacccagatgtggcttctggccctggaaaatcactgaagtataaaagacagctgagtgaggatggaagacagctaaggcgagggagcctgggaggagccctgactgggaggtaccttcttccaaacccggtggcgggacaggcctggccggcctctgcagagacgtccaacctcgtgcgcatgcgcagccaggccctgggccagtcggcgccctcgctcaccgccagcctgaaggagctgagtctccccagaagaggaagtttgatagattcccagaagtggaattgcttggtcaaacgccctgtgtgtccaaatgctgggagaacatcaccccttggatgaattgccaccacattaaataaaacatatccaaagctca

SEQ ID NO: 153859 - DNA, 559 bp, Homo sapiens
  Payload ID: 10248
  Gene Symbol: MAST4
  Gene Name: microtubule associated serine/threonine kinase family member 4
  ENST ID: ENST00000407621
  CDS Start-End: 352-522
gaaaaggacttttcatttcactgaggtgaaaagtgggtctgtgagtagagcgactttctttaaaaaaaaaaaaaaaaatcagaaaccaattacttgatatgcagagctgcaagcctcgttcctttaacaaaatcagtgcagtgtgcactgccgttaacctgaggaaagcagctgacatctcttgattacggctagaggtggaaggacccaaacttgcagcctccccctccccctcgagagagtgttagtccagtcctttagagaggttcggtttggctctctgtcatcaccgggacgctggcagggagtgtgtgtcatggttacaatagagtgtgctaacatataacaaccatgaaagcccagcgggaaaggctacagattccggggctgaccttggatctcactcccaggagcctgagtccaaccccatccagcccaggcagtccttgtagtcctctcttggcctttcacttttggagccctgtgtgtccaaatgctgggagaacatcaccccttggatgaattgccaccacattaaataaaacatatccaaagctca

SEQ ID NO: 153860 - DNA, 10711 bp, Homo sapiens
  Payload ID: 10248
  Gene Symbol: MAST4
  Gene Name: microtubule associated serine/threonine kinase family member 4
  ENST ID: ENST00000403625
  CDS Start-End: 296-8167
cagtacccgcggctcgggtgcagcgcgggagcacagtggagcgcagatcgcggacccgagcgggcatgtccccgcgcgcgggagcctccgtttgcggccgggcccgggcggctgtgaacttagcagcgggctcctgcggccccgtcactgccatgtagtcgctggcggggctccctgcagcccgggagcggcagtgccagtgagcctgagcccaggagcccgcgtcttccccgggaggcgctgagtgcgcgccgcgcccccgccgctcgggaggcactttgggccagacagggaaatgggggagaaagtttcggaggcgccagagccggtgccccgcggctgcagtggccacggcagccggactccagcctctgcgctggtcgccgcgtcctctccgggtgcttcctcggccgagtcctcctcgggctcagaaactctgtcggaggaaggggagcccggcggcttctccagagagcatcagccgccgccgccgccgccgttgggaggcaccctgggcgcccgggcgcccgccgcgtgggctccggcaagcgtgctgctggagcgcggagtccttgcgctgccgccgccgcttcccggaggagctgtgccgcccgcgccccggggcagcagcgcgtcccaggaggagcaggacgaggagcttgaccacatattatcccctccacccatgccgtttcggaaatgcagcaacccagatgtggcttctggccctggaaaatcactgaagtataaaagacagctgagtgaggatggaagacagctaaggcgagggagcctgggaggagccctgactgggaggtaccttcttccaaacccggtggcgggacaggcctggccggcctctgcagagacgtccaacctcgtgcgcatgcgcagccaggccctgggccagtcggcgccctcgctcaccgccagcctgaaggagctgagtctccccagaagaggaagtttttgccgaacaagcaaccggaaaagcttaataggcaatgggcagtcaccagcattgcctcgaccacactcacctctctctgctcatgcaggaaatagccctcaagatagtccaagaaatttctcccccagtgcctcagcccatttttcatttgcacggaggactgatggacgccgctggtcgttggcttctctcccttcctctggctatgggacaaacacacccagctctacggtctcttcatcctgttcctcccaggagaagttgcatcagttaccataccaaccaacaccagacgagttacacttcttatcaaaacatttctgtaccaccgaaagcatcgccactgagaacagatgcaggaacacgccgatgcgcccccgttcccgaagtctgagccctggacgttctcccgcctgctgtgaccatgaaataattatgatgaaccatgtctacaaagaaaggttcccaaaggctacagctcagatggaagaacgtctaaaggaaattatcaccagctactctcctgacaacgttctacccttagcagatggagtgcttagtttcactcaccaccagattattgaactggctcgagattgcttggataaatcccaccagggcctcatcacctcacgatacttccttgaattacagcacaaattagataagttgctacaggaggctcatgatcgttcagaaagtggagaattggcatttattaaacaactagttcgaaagatcctaattgttattgcccgccctgctcggttattagagtgcctggaatttgatccggaagaattttactacctattggaagcagcagaaggccatgccaaagaaggacagggtattaaaaccgacattcccaggtacatcattagccaactgggactcaataaggatcccttggaagaaatggctcatttgggaaactacgatagtgggacagcagaaacaccagaaacagatgaatcagtgagtagctctaatgcctccctgaaacttcgaaggaaacctcgggaaagtgattttgaaacgattaaattgattagcaatggagcctatggggcagtctactttgttcggcataaagaatcccggcagaggtttgccatgaagaagattaataaacagaacctcatccttcgaaaccagatccagcaggcctttgtggagcgggatatcctgacttttgcagaaaacccctttgttgtcagcatgtattgctcctttgaaacaaggcgccacttgtgcatggtcatggaatatgtggaagggggagactgtgctactttaatgaaaaacatgggtcctctccctgttgatatggccagaatgtactttgctgagacggtcttggccttggaatatttacataattatggaattgtacacagggatttgaaaccagacaacttgttggttacctccatggggcacataaagctgacagattttggattatctaaggtgggactaatgagcatgactaccaacctttacgagggtcatattgagaaggatgctagagagttcctggataaacaggtctgtggcacacctgaatacattgcaccagaagtgattctgaggcagggttatggaaagccggtggactggtgggccatggggattatcctctatgaatttctggttggatgcgtgccattctttggggatactccagaggagctatttggacaagtcatcagtgatgagatcaactggcctgagaaggatgaggcacccccacctgatgcccaggatctgattaccttactcctcaggcagaatcccctggagaggctgggaacaggtggtgcatatgaagtcaaacagcatcgattcttccgttctttagactggaacagtttgctgagacagaaggcagaatttattccccaactggaatctgaggatgacacaagttattttgatactcggtctgagaagtatcatcatatggaaacggaggaagaagatgacacaaatgatgaagactttaatgtggaaataaggcagttttcttcatgttcacacaggttttcaaaagttttcagcagtatagatcgaatcactcagaattcagcagaagagaaggaagactctgtggacaaaaccaaaagcaccaccttgccatccacagaaacactgagctggagttcagaatattctgaaatgcaacagctatcaacatccaactcttcagatactgaaagcaacagacataaactcagttctggcctacttcccaaactggctatttcaacagagggagagcaagatgaagctgcctcctgccctggagacccccatgaggagccaggaaagccagcccttcctcctgaagagtgtgcccaggaggagcctgaggtcaccaccccagccagcaccatcagcagctccaccctgtcagttggcagtttttcagagcacttggatcagataaatggacgaagcgagtgtgtggacagtacagataattcctcaaagccatccagtgaacccgcttctcacatggctcggcagcgattagaaagcacagaaaaaaagaaaatctcggggaaagtcacaaagtccctctctgccagtgctctttccctcatgatcccaggagatatgtttgctgtttcccctctgggaagtccaatgtctccccattccctgtcctcggacccttcttcttcacgagattcctctcccagccgagattcctcagcagcttctgccagtccacatcagccgattgtgatccacagttcggggaagaactacggctttaccatccgagccatccgggtgtatgtgggagacagtgacatctatacagtgcaccatatcgtctggaatgtagaagaaggaagtccggcatgccaggcaggactgaaggctggagatcttatcactcacatcaatggagaaccagtgcatggacttgtccacacagaagttatagaactcctactgaagagtgggaataaggtgtcaatcactactaccccatttgaaaacacatcaatcaaaactggaccagccaggagaaacagctataagagccggatggtgaggcggagcaagaaatccaagaagaaagaaagtctcgaaaggaggagatctcttttcaaaaagctagccaagcagccttctcctttactccacaccagccgaagtttctcctgcttgaacagatccctgtcatcgggtgagagcctcccaggttcccccactcatagcttgtctccccggtctccaacaccaagctaccgctccacccctgacttcccatctggtactaattcctcccagagcagctcccctagttctagtgcccccaattccccagcagggtccgggcacatccggcccagcactctccacggtcttgcacccaaactcggcgggcagcggtaccggtccggaaggcgaaagtccgccggcaacatcccactgtccccgctggcccggacgccctctccaaccccgcaacccacctccccgcagcggtcaccatcccctcttctgggacactcactgggcaattccaagatcgcgcaagcctttcccagcaagatgcactccccgcccaccatcgtcagacacatcgtgaggcccaagagtgcggagccccccaggtccccgctgctcaagcgcgtgcagtccgaggagaagctgtcgccctcttacggcagtgacaagaagcacctgtgctcccgcaagcacagcctggaggtgacccaagaggaggtgcagcgggagcagtcccagcgggaggcgccgctgcagagcctggatgagaacgtgtgcgacgtgccgccgctcagccgcgcccggccagtggagcaaggctgcctgaaacgcccagtctcccggaaggtgggccgccaggagtctgtggacgacctggaccgcgacaagctgaaggccaaggtggtggtgaagaaagcagacggcttcccagagaaacaggaatcccaccagaaatcccatggacccgggagtgatttggaaaactttgctctgtttaagctggaagagagagagaagaaagtctatccgaaggctgtggaaaggtcaagtacttttgaaaacaaagcgtctatgcaggaggcgccaccgctgggcagcctgctgaaggatgctcttcacaagcaggccagcgtgcgcgccagcgagggtgcgatgtcggatggccgggtgcctgcggagcaccgccagggtggcggggacttcagacgggcccccgctcctggcaccctccaggatggtctctgccactccctcgacaggggcatctctgggaagggggaaggcacggagaagtcctcccaggccaaggagcttctccgatgtgaaaagttagacagcaagctggccaacatcgattacctccgaaagaaaatgtcacttgaggacaaagaggacaacctctgccctgtgctgaagcccaagatgacagctggctcccacgaatgcctgccagggaacccagtccgacccacgggtgggcagcaggagcccccgccggcttctgagagccgagcttttgtcagcagcacccatgcagctcagatgagtgccgtctcttttgttcccctcaaggccttaacaggccgggtggacagtggaacggagaagcctggcttggttgctcctgagtcccctgttaggaagagcccctccgagtataagctggaaggtaggtctgtctcatgcctgaagccgatcgagggcactctggacattgctctcctgtccggacctcaggcctccaagacagaactgccttccccagagtctgcacagagccccagcccaagtggtgacgtgagggcctctgtgccaccagttctccccagcagcagtgggaaaaagaacgataccaccagtgcaagagagctttctccttccagcttaaagatgaataaatcctacctgctggagccttggttcctgccccccagccgaggtctccagaattcaccagcagtttccctgcctgacccagagttcaagagggacaggaaaggtccccatcctactgccaggagccctggaacagtcatggaaagcaatccccaacagagagagggcagctcccctaaacaccaagaccacaccactgaccccaagcttctgacctgcctggggcagaacctccacagccctgacctggccaggccacgctgcccgctcccacctgaagcttccccctcaagggagaagccaggcctgagggaatcgtctgaaagaggccctcccacagccagaagcgagcgctctgctgcgagggctgacacatgcagagagccctccatggaactgtgctttccagaaactgcgaaaaccagtgacaactccaaaaatctcctctctgtgggaaggacccacccagatttctatacacagacccaggccatggagaaagcatgggcgccgggtgggaaaacgaaccacaaagatggcccaggtgaggcgaggcccccgcccagagacaactcctctctgcactcagctggaattccctgtgagaaggagctgggcaaggtgaggcgtggcgtggaacccaagcccgaagcgcttcttgccaggcggtctctgcagccacctggaattgagagtgagaagagtgaaaagctctccagtttcccatctttgcagaaagatggtgccaaggaacctgaaaggaaggagcagcctctacaaaggcatcccagcagcatccctccgccccctctgacggccaaagacctgtccagcccggctgccaggcagcattgcagttccccaagccacgcttctggcagagagccgggggccaagcccagcactgcagagcccagctcgagcccccaggaccctcccaagcctgttgctgcgcacagtgaaagcagcagccacaagccccggcctggccctgacccgggccctccaaagactaagcaccccgaccggtccctctcctctcagaaaccaagtgtcggggccacaaagggcaaagagcctgccactcagtccctcggtggctctagcagagaggggaagggccacagtaagagtgggccggatgtgtttcctgctaccccaggctcccagaacaaagccagcgatgggattggccagggagaaggtgggccctctgtcccactgcacactgacagggctcctctagacgccaagccacaacccaccagtggtgggcggcccctggaggtgctggagaagcctgtgcatttgccaaggccgggacacccagggcctagtgagccagcggaccagaaactgtccgctgttggtgaaaagcaaaccctgtctccaaagcaccccaaaccatccactgtgaaagattgccccaccctgtgcaaacagacagacaacagacagacagacaaaagcccgagtcagccggccgccaacaccgacagaagggcggaagggaagaaatgcactgaagcactttatgctccagcagagggcgacaagctcgaggccggcctttcctttgtgcatagcgagaaccggttgaaaggcgcggagcggccagccgcgggggtggggaagggcttccctgaggccagagggaaagggcccggtccccagaagccaccgacggaggcagacaagcccaatggcatgaaacggtccccctcagccactgggcagagttctttccgatccacggccctcccggaaaagtctctgagctgctcctccagcttccctgaaaccagggccggagttagagaggcctctgcagccagcagcgacacctcttctgccaaggccgccgggggcatgctggagcttccagcccccagcaacagggaccataggaaggctcagcctgccggggagggccgaacccacatgacaaagagtgactccctgccctccttccgggtctccaccctgcctctggagtcacaccaccccgacccaaacaccatgggcggggccagccaccgggacagggctctctcggtgactgccaccgtaggggaaaccaaagggaaggaccctgccccagcccagcctcccccagctaggaaacagaacgtgggcagagacgtgaccaagccatccccagccccaaacactgaccgccccatctctctttctaatgagaaggactttgtggtacggcagaggcgggggaaagagagtttgcgtagcagccctcacaaaaaggccttgtaacggggagggcccaggggcaggactgtggagacccgtcctgaacgggcgactgtgtcttgactacctttcaaaaccagcactgtgtgggaatgtccgccaggcagagctcggagcctcattgagacaggggagagagaaagacaaagaggggaccttcttccagatgccttcccagttgtaaccggtaaaactgttaccagatagtgtttgtacaaaaaaaaaaaaaaaaaaaaaaaaaaaaattacctttacagttgagggttgttgaggaaaatgattttctttgtaaatatatagcatcgtgtttggtttgggatgtagagtctatacctggctgctgattgcgtcgtttactacagctttttttaaataagatttttgctttaccatttatcataatgtagtaatgaagcaaaatggtcaaaactgggtgtgtgtgaacagagatacacccatattcgtgtatatacacatccacctacatgttttggtctgtggtttaagagactatttcaaggttccatttttataagctaaaacattctaagttaagatggaagaaagccctaaacacagtagattctgagtttttatgtgtattttaaccagagtttctgatagtactgtatctggctacctatatttccagatctaaagcaagaactactctaagtactgcatttggaatcctcctccattaggaatggccaggacaagtggagctagccattttcattacacggccatcccaatggacactggatccctggtccaactgtctaaaaggccagttgttcctttctgtggatgtggatgtctggccttcacctgaggtagagcggggactataaacacacatcaactttctttctgtttgctttcttttccttcttttcaaactcttaaactcaggcctttatgctgtgagtgactagtccaagaagcacacattttgtagtagtcctgcaccagccctgctcttgaataaaaaggaaaattactggctgcacccaaatcttctagtacttgagtaataagcatcaggcattggaagaggttttaaatttgcttttttgaggaaaagaactgggggtggattttggcatcgtagcatatcgattaaagaataatcaggacatcagatacattttaatacatagctggggccttatgttgtagatgaagcttgctgtttttagcaagttcctgggtttcacattcatttctgctgcatctagtagctccacacatttcataacctgatctctttatttgtatgcaaaaaatactgtcttaatacagagcagcatttttgtaacaaagagactcgctggagctatttggtgcttgaatgtgaccatcctttttacttttgctaagccttatttaaattttgtataccgtggaatatgtagaatttgtcaaatcattttagtgctgaaggtttttgatttcttgtttttgtttctgttgttgcagtttctttggtggcttgttttgtattgtaagatggcacttgctgatataaatactaaggcactaagagaaaatacagataagtatttataagttgcttgggaaccatagcagaattttttgtttggttttgtaagagaaaaaaaattaccaataaataactgatctagcacccaaactctcttgggggatgtcttagtatcttcacgctataaaattgttcatctaagcacagcatcatcttatggccttatggattgtaaatcttctagtgaggctataaactccactctgaaaacaaaggcataacttaaccgactgctcagttgtccttcgttgtaaaatgaattggctttgggaaaaaggaaaaaaacaaacaaaaaaagaaaaagaaaaaagcctcctccttgcccctaatttttttttcccatatggttttagccattccccatcactatattgtgaagctgtaaaaatatatatatatactttacaagagtttactaatggatttcaaaactggtctcaacgtttataatacatatctgtgtttggcagttgtcataacccaatcctacattcagccatcgggacaagtctgtcggggaggtagttcatggtttacaagcctttgctttttaactgtccaatttcctttaaagcacaactagctatttgtttacaaatgatatttttatgtatattttgtatagtgtatcatcatttttgccaaatatgtttttcattataaatgagtaaagagtacttaaggttgcattcatgtattacatgtttgttgttgtaaacctctccaatcagctggtagaaattctcctcattgtgttctatttggtcagtctctgtgtgattgtaggatgtgctccttggtagtactcccagctgtagatttaccagcttaaaagtttgttaggatctgtgcaataaagtgtttgcagtcttattttctctaagaaattccttatggacgtcataattgttgtatattgaacaaaatatttatacttatgcagttgcataacattgaaataaaaatttagcatgaaaaga

SEQ ID NO: 153861 - DNA, 582 bp, Homo sapiens
  Payload ID: 10248
  Gene Symbol: MAST4
  Gene Name: microtubule associated serine/threonine kinase family member 4
  ENST ID: ENST00000436277
  CDS Start-End: 80-582
agacagcgctttgagcagaacgcacggctcaactcattcatatggccttgaacccacagtgaattgaagagagaaagaaatggatatgtctgaccccaatttttggactgtgctctcaaactttactttgcctcatttgaggagtgggaacaggcttcggcgaacacaaagttgccgaacaagcaaccggaaaagcttaataggcaatgggcagtcaccagcattgcctcgaccacactcacctctctctgctcatgcaggaaatagccctcaagatagtccaagaaatttctcccccagtgcctcagcccatttttcatttgcacggaggactgatggacgccgctggtcgttggcttctctcccttcctctggctatgggacaaacacacccagctctacggtctcttcatcctgttcctcccaggagaagttgcatcagttaccataccaaccaacaccagacgagttacacttcttatcaaaacatttctgtaccaccgaaagcatcgccactgagaacagatgcaggaacacgccgatgcgcccccgttcccgaagtctgagccctggacgttctcc

SEQ ID NO: 153862 - DNA, 280 bp, Homo sapiens
  Payload ID: 10248
  Gene Symbol: MAST4
  Gene Name: microtubule associated serine/threonine kinase family member 4
  ENST ID: ENST00000434115
  CDS Start-End: 1-243
aacctcgtgcgcatgcgcagccaggccctgggccagtcggcgccctcgctcaccgccagcctgaaggagctgagtctccccagaagaggaagtttgatagattcccagaagtggaattgcttggtcaaacggagcctgagtccaaccccatccagcccaggcagtccttgtagtcctctcttggcctttcacttttggagccctgtgtgtccaaatgctgggagaacatcaccccttggatgaattgccaccacattaaataaaacatatccaaagctca

SEQ ID NO: 153863 - DNA, 289 bp, Homo sapiens
  Payload ID: 10248
  Gene Symbol: MAST4
  Gene Name: microtubule associated serine/threonine kinase family member 4
  ENST ID: ENST00000411628
  CDS Start-End: 1-200
tcaccgccagcctggaagggcagcctccgaagagccatttcaactcagcccgacatcgccagagactagtggacccagctgcttcaaaaaaggagctgagtctccccagaagaggaagtttgtgcagaagcagtgattgtgactgggtaatagacaagagaagtgagagaaactgctttctaggcaagatgctgttatgagattgtcagccctgtgtgtccaaatgctgggagaacatcaccccttggatgaattgccaccacattaaataaaacatatccaaagctca

SEQ ID NO: 153864 - DNA, 1045 bp, Homo sapiens
  Payload ID: 10248
  Gene Symbol: MAST4
  Gene Name: microtubule associated serine/threonine kinase family member 4
  ENST ID: ENST00000447738
  CDS Start-End: 243-743
agtttcccggacctttgagaggaggctgtgtgttaattaaaggctaggacgggacgggtacttctcagacatgctccaagttgttcttgagatcacagttcccatcacattttctctggagggagtgagtagataattgggattttttttttatttttggccttgtctttcttccttttttttacctctccccattttagtcatatggccttgaacccacagtgaattgaagagagaaagaaatggatatgtctgaccccaatttttggactgtgctctcaaactttactttgcctcatttgaggagtgggaacaggcttcggcgaacacaaagttgccgaacaagcaaccggaaaagcttaataggcaatgggcagtcaccagcattgcctcgaccacactcacctctctctgctcatgcaggaaatagccctcaagatagtccaagaaatttctcccccagtgcctcagcccatttttcatttgcacggaggactgatggacgccgctggtcgttggcttctctcccttcctctggctatgggacaaacacacccagctctacggtctcttcatcctgttcctcccaggagaagttgcatcagttaccataccaaccaacaccagacgagttacacttcttatcaaaacatttctgtaccaccgaaagcatcgccactgagaacagatgcaggaacacgccgatgcgcccccgttcccgaagtctgagtttaaaagggtaatttgctttgcttgcagccctggacgttctcccgcctgctgtgaccatgaaataattatgatgaaccatgtctacaaagaaaggttcccaaaggctacagctcagatggaagaacgtctaaaggaaattatcaccagctactctcctgacaacgttctacccttagcagatggagtgcttagtttcactcaccaccagattattgaactggctcgagattgcttggataaatcccaccagggcctcatcacctcacgatacttccttgaattacagcacaaattagataagttgctacaggag

SEQ ID NO: 153865 - DNA, 5273 bp, Homo sapiens
  Payload ID: 10248
  Gene Symbol: MAST4
  Gene Name: microtubule associated serine/threonine kinase family member 4
  ENST ID: ENST00000443808
  CDS Start-End: 1-5041
gtatcatcatatggaaacggaggaagaagatgacacaaatgatgaagactttaatgtggaaataaggcagttttcttcatgttcacacaggttttcaaaagttttcagcagtatagatcgaatcactcagaattcagcagaagagaaggaagactctgtggacaaaaccaaaagcaccaccttgccatccacagaaacactgagctggagttcagaatattctgaaatgcaacagctatcaacatccaactcttcagatactgaaagcaacagacataaactcagttctggcctacttcccaaactggctatttcaacagagggagagcaagatgaagctgcctcctgccctggagacccccatgaggagccaggaaagccagcccttcctcctgaagagtgtgcccaggaggagcctgaggtcaccaccccagccagcaccatcagcagctccaccctgtcagatatgtttgctgtttcccctctgggaagtccaatgtctccccattccctgtcctcggacccttcttcttcacgagattcctctcccagccgagattcctcagcagcttctgccagtccacatcagccgattgtgatccacagttcggggaagaactacggctttaccatccgagccatccgggtgtatgtgggagacagtgacatctatacagtgcaccatatcgtctggaatgtagaagaaggaagtccggcatgccaggcaggactgaaggctggagatcttatcactcacatcaatggagaaccagtgcatggacttgtccacacagaagttatagaactcctactgaagagtgggaataaggtgtcaatcactactaccccatttgaaaacacatcaatcaaaactggaccagccaggagaaacagctataagagccggatggtgaggcggagcaagaaatccaagaagaaagaaagtctcgaaaggaggagatctcttttcaaaaagctagccaagcagccttctcctttactccacaccagccgaagtttctcctgcttgaacagatccctgtcatcgggtgagagcctcccaggttcccccactcatagcttgtctccccggtctccaacaccaagctaccgctccacccctgacttcccatctggtactaattcctcccagagcagctcccctagttctagtgcccccaattccccagcagggtccgggcacatccggcccagcactctccacggtcttgcacccaaactcggcgggcagcggtaccggtccggaaggcgaaagtccgccggcaacatcccactgtccccgctggcccggacgccctctccaaccccgcaacccacctccccgcagcggtcaccatcccctcttctgggacactcactgggcaattccaagatcgcgcaagcctttcccagcaagatgcactccccgcccaccatcgtcagacacatcgtgaggcccaagagtgcggagccccccaggtccccgctgctcaagcgcgtgcagtccgaggagaagctgtcgccctcttacggcagtgacaagaagcacctgtgctcccgcaagcacagcctggaggtgacccaagaggaggtgcagcgggagcagtcccagcgggaggcgccgctgcagagcctggatgagaacgtgtgcgacgtgccgccgctcagccgcgcccggccagtggagcaaggctgcctgaaacgcccagtctcccggaaggtgggccgccaggagtctgtggacgacctggaccgcgacaagctgaaggccaaggtggtggtgaagaaagcagacggcttcccagagaaacaggaatcccaccagaaatcccatggacccgggagtgatttggaaaactttgctctgtttaagctggaagagagagagaagaaagtctatccgaaggctgtggaaaggtcaagtacttttgaaaacaaagcgtctatgcaggaggcgccaccgctgggcagcctgctgaaggatgctcttcacaagcaggccagcgtgcgcgccagcgagggtgcgatgtcggatggccgggtgcctgcggagcaccgccagggtggcggggacttcagacgggcccccgctcctggcaccctccaggatggtctctgccactccctcgacaggggcatctctgggaagggggaaggcacggagaagtcctcccaggccaaggagcttctccgatgtgaaaagttagacagcaagctggccaacatcgattacctccgaaagaaaatgtcacttgaggacaaagaggacaacctctgccctgtgctgaagcccaagatgacagctggctcccacgaatgcctgccagggaacccagtccgacccacgggtgggcagcaggagcccccgccggcttctgagagccgagcttttgtcagcagcacccatgcagctcagatgagtgccgtctcttttgttcccctcaaggccttaacaggccgggtggacagtggaacggagaagcctggcttggttgctcctgagtcccctgttaggaagagcccctccgagtataagctggaaggtaggtctgtctcatgcctgaagccgatcgagggcactctggacattgctctcctgtccggacctcaggcctccaagacagaactgccttccccagagtctgcacagagccccagcccaagtggtgacgtgagggcctctgtgccaccagttctccccagcagcagtgggaaaaagaacgataccaccagtgcaagagagctttctccttccagcttaaagatgaataaatcctacctgctggagccttggttcctgccccccagccgaggtctccagaattcaccagcagtttccctgcctgacccagagttcaagagggacaggaaaggtccccatcctactgccaggagccctggaacagtcatggaaagcaatccccaacagagagagggcagctcccctaaacaccaagaccacaccactgaccccaagcttctgacctgcctggggcagaacctccacagccctgacctggccaggccacgctgcccgctcccacctgaagcttccccctcaagggagaagccaggcctgagggaatcgtctgaaagaggccctcccacagccagaagcgagcgctctgctgcgagggctgacacatgcagagagccctccatggaactgtgctttccagaaactgcgaaaaccagtgacaactccaaaaatctcctctctgtgggaaggacccacccagatttctatacacagacccaggccatggagaaagcatgggcgccgggtgggaaaacgaaccacaaagatggcccaggtgaggcgaggcccccgcccagagacaactcctctctgcactcagctggaattccctgtgagaaggagctgggcaaggtgaggcgtggcgtggaacccaagcccgaagcgcttcttgccaggcggtctctgcagccacctggaattgagagtgagaagagtgaaaagctctccagtttcccatctttgcagaaagatggtgccaaggaacctgaaaggaaggagcagcctctacaaaggcatcccagcagcatccctccgccccctctgacggccaaagacctgtccagcccggctgccaggcagcattgcagttccccaagccacgcttctggcagagagccgggggccaagcccagcactgcagagcccagctcgagcccccaggaccctcccaagcctgttgctgcgcacagtgaaagcagcagccacaagccccggcctggccctgacccgggccctccaaagactaagcaccccgaccggtccctctcctctcagaaaccaagtgtcggggccacaaagggcaaagagcctgccactcagtccctcggtggctctagcagagaggggaagggccacagtaagagtgggccggatgtgtttcctgctaccccaggctcccagaacaaagccagcgatgggattggccagggagaaggtgggccctctgtcccactgcacactgacagggctcctctagacgccaagccacaacccaccagtggtgggcggcccctggaggtgctggagaagcctgtgcatttgccaaggccgggacacccagggcctagtgagccagcggaccagaaactgtccgctgttggtgaaaagcaaaccctgtctccaaagcaccccaaaccatccactgtgaaagattgccccaccctgtgcaaacagacagacaacagacagacagacaaaagcccgagtcagccggccgccaacaccgacagaagggcggaagggaagaaatgcactgaagcactttatgctccagcagagggcgacaagctcgaggccggcctttcctttgtgcatagcgagaaccggttgaaaggcgcggagcggccagccgcgggggtggggaagggcttccctgaggccagagggaaagggcccggtccccagaagccaccgacggaggcagacaagcccaatggcatgaaacggtccccctcagccactgggcagagttctttccgatccacggccctcccggaaaagtctctgagctgctcctccagcttccctgaaaccagggccggagttagagaggcctctgcagccagcagcgacacctcttctgccaaggccgccgggggcatgctggagcttccagcccccagcaacagggaccataggaaggctcagcctgccggggagggccgaacccacatgacaaagagtgactccctgccctccttccgggtctccaccctgcctctggagtcacaccaccccgacccaaacaccatgggcggggccagccaccgggacagggctctctcggtgactgccaccgtaggggaaaccaaagggaaggaccctgccccagcccagcctcccccagctaggaaacagaacgtgggcagagacgtgaccaagccatccccagccccaaacactgaccgccccatctctctttctaatgagaaggactttgtggtacggcagaggcgggggaaagagagtttgcgtagcagccctcacaaaaaggccttgtaacggggagggcccaggggcaggactgtggagacccgtcctgaacgggcgactgtgtcttgactacctttcaaaaccagcactgtgtgggaatgtccgccaggcagagctcggagcctcattgagacaggggagagagaaagacaaagaggggaccttcttccagatgccttcccagttgtaaccggtaaaactgttaccagatagtgtttgtacaaaaaaaaaaaaaaaaaaa

SEQ ID NO: 153866 - DNA, 272 bp, Homo sapiens
  Payload ID: 10248
  Gene Symbol: MAST4
  Gene Name: microtubule associated serine/threonine kinase family member 4
  ENST ID: ENST00000450827
  CDS Start-End: 1-177
ctaagacgaagagggctccagaaggagctgagtctccccagaagaggaagtttgatagattcccagaagtggaattgcttggtcaaacgtctcactcccaggagcctgagtccaaccccatccagcccaggcagtccttgtagtcctctcttggcctttcacttttggagggaatgatctgcactgaattctccctgtgtgtccaaatgctgggagaacatcaccccttggatgaattgccaccacattaaataaaacatatccaaagctca

SEQ ID NO: 153867 - DNA, 507 bp, Homo sapiens
  Payload ID: 10248
  Gene Symbol: MAST4
  Gene Name: microtubule associated serine/threonine kinase family member 4
  ENST ID: ENST00000452953
  CDS Start-End: 1-299
ctccacccatgccgtttcggaaatgcagcaacccagatgtggcttctggccctggaaaatcactgaagtataaaagacagctgagtgaggatggaagacagctaaggcgagggagcctgggaggagccctgactgggaggtaccttcttccaaacccggtggcgggacaggcctggccggcctctgcagagacgtccaacctcgtgcgcatgcgcagccaggccctgggccagtcggcgccctcgctcaccgccagcctgaaggagctgagtctccccagaagaggaagtttcaactgagcgattctctgacagaacatcgtggattgagaggaaataagaatgggtgtgcctgctttaggattacacagtgctggacctttgaggaaggagaagcagagatggatagaattgttgtggcagaactgagcttgtatacttggtcctgtggagggtatctactcttcttccagctgcgtagggtaaataaaggtttttgtaaagcttc

SEQ ID NO: 153868 - DNA, 458 bp, Homo sapiens
  Payload ID: 10248
  Gene Symbol: MAST4
  Gene Name: microtubule associated serine/threonine kinase family member 4
  ENST ID: ENST00000432817
  CDS Start-End: 1-369
ccacccatgccgtttcggaaatgcagcaacccagatgtggcttctggccctggaaaatcactgaagtataaaagacagctgagtgaggatggaagacagctaaggcgagggagcctgggaggagccctgactgggaggtaccttcttccaaacccggtggcgggacaggcctggccggcctctgcagagacgtccaacctcgtgcgcatgcgcagccaggccctgggccagtcggcgccctcgctcaccgccagcctgaaggagctgagtctccccagaagaggaagtttgtgcagaagcagtgattgtgactgggtaatagacaagagaagtgagagaaactgctttctaggcaagatgctgttatgagattgtcagccctgtgtgtccaaatgctgggagaacatcaccccttggatgaattgccaccacattaaataaaacatatccaaagctca

SEQ ID NO: 153869 - DNA, 438 bp, Homo sapiens
  Payload ID: 10248
  Gene Symbol: MAST4
  Gene Name: microtubule associated serine/threonine kinase family member 4
  ENST ID: ENST00000432426
  CDS Start-End: 261-438
acttgatatgcagagctgcaagcctcgttcctttaacaaaatcagtgcagtgtgcactgccgttaacctgaggaaagcagctgacatctcttgattacggctagaggtggaaggacccaaacttgcagcctccccctccccctcgagagagtgttagtccagtcctttagagaggttcggtttggctctctgtcatcaccgggacgctggcagggagtgtgtgtcatggttacaatagagtgtgctaacatataacaaccatgaaagcccagcgggaaaggctacagattccggggctgaccttggattgccgaacaagcaaccggaaaagcttaataggcaatgggcagtcaccagcattgcctcgaccacactcacctctctctgctcatgcaggaaatagccctcaagatagtccaagaaatttctcccccagtg

SEQ ID NO: 153870 - DNA, 1950 bp, Homo sapiens
  Payload ID: 10248
  Gene Symbol: MAST4
  Gene Name: microtubule associated serine/threonine kinase family member 4
  ENST ID: ENST00000490016
  CDS Start-End: 71-1123
gcgtgctgaagtagaggtagtacagcatggctagactgttgtgagaggctcagagaaagcagagggtgagatggatgagtccagcattctaagacgaagagggctccagaaggagctgagtctccccagaagaggaagtttgatagattcccagaagtggaattgcttggtcaaacgttgccgaacaagcaaccggaaaagcttaataggcaatgggcagtcaccagcattgcctcgaccacactcacctctctctgctcatgcaggaaatagccctcaagatagtccaagaaatttctcccccagtgcctcagcccatttttcatttgcacggaggactgatggacgccgctggtcgttggcttctctcccttcctctggctatgggacaaacacacccagctctacggtctcttcatcctgttcctcccaggagaagttgcatcagttaccataccaaccaacaccagacgagttacacttcttatcaaaacatttctgtaccaccgaaagcatcgccactgagaacagatgcaggaacacgccgatgcgcccccgttcccgaagtctgagccctggacgttctcccgcctgctgtgaccatgaaataattatgatgaaccatgtctacaaagaaaggttcccaaaggctacagctcagatggaagaacgtctaaaggaaattatcaccagctactctcctgacaacgttctacccttagcagatggagtgcttagtttcactcaccaccagattattgaactggctcgagattgcttggataaatcccaccagggcctcatcacctcacgatacttccttgaattacagcacaaattagataagttgctacaggaggctcatgatcgttcagaaagtggagaattggcatttattaaacaactagttcgaaagatcctaattgttattgcccgccctgctcggttattagagtgcctggaatttgatccggaagaattttactacctattggaagcagcagaaggccatgccaaagaaggacagggtattaaaaccgacattcccaggtacatcattagccaactgggactcaataaggatcccttggaaggtgagtccctgggttgttcctacctttgactttgcttatgcactgtcgcctcatagaagaaatctaagtggcaagtctttatttttcctcatgttttggctctatctattgataagtccatatttggggactggttgctatttgaaggaaatagccataaaatgggtcctgagacacgaatgagcatgacccattttgtgtctacctagagcgtgggtcaggccttgacatcctagaagcatgtcagcctgagaatgccagagtgtcccagaagggttgcaatttcagtcttcactgagtagtttttctcttgcagagctcagttgggctcttgagagtacttctaatttttaaaatgttgctaaagaaattatcattaattaaactgacatttaaatttaatttggaagtaatgcaattgatggtagattactttaaattgagtacagtattcataggtatattcttgtttacttaaaatataaaacatagtaatatacaggagagaaaaaagaaattttttttaagcttataaaaggatttatgggctgggcgcagtggctcacgcctgtaatcccagcactttgggaggccgaggtgagtggatcacgaggtcaggagttccagaccagcctggccaatatggtgaaaccctgtctctactaaaaatgcagaaattagctgggcatggtgatgtgcacctgtagtccaagctactcgggaggttgaggcagaagaatcgcttgaacccaggaggtggaggttgcagtgaaccgagatcgcaccactgcactccagcctgggcgacagagtgaaactccgactcaaaaaaaaaaaaaaaaaaaagatttatggt

SEQ ID NO: 153871 - DNA, 2968 bp, Homo sapiens
  Payload ID: 10249
  Gene Symbol: MASTL
  Gene Name: microtubule associated serine/threonine kinase-like
  Uniprot ID: Q96GX5
  ENST ID: ENST00000342386
  CDS Start-End: 58-2580
gggagtggctgctcgcggaggggcagtgtctgcggggccgctgtatgctgtccagcgatggatcccaccgcgggaagcaagaaggagcctggaggaggcgcggcgactgaggagggcgtgaataggatcgcagtgccaaaaccgccctccattgaggaattcagcatagtgaagcccattagccggggcgccttcgggaaagtgtatctggggcagaaaggcggcaaattgtatgcagtaaaggttgttaaaaaagcagacatgatcaacaaaaatatgactcatcaggtccaagctgagagagatgcactggcactaagcaaaagcccattcattgtccatttgtattattcactgcagtctgcaaacaatgtctacttggtaatggaatatcttattgggggagatgtcaagtctctcctacatatatatggttattttgatgaagagatggctgtgaaatatatttctgaagtagcactggctctagactaccttcacagacatggaatcatccacagggacttgaaaccggacaatatgcttatttctaatgagggtcatattaaactgacggattttggcctttcaaaagttactttgaatagagatattaatatgatggatatccttacaacaccatcaatggcaaaacctagacaagattattcaagaaccccaggacaagtgttatcgcttatcagctcgttgggatttaacacaccaattgcagaaaaaaatcaagaccctgcaaacatcctttcagcctgtctgtctgaaacatcacagctttctcaaggactcgtatgccctatgtctgtagatcaaaaggacactacgccttattctagcaaattactaaaatcatgtcttgaaacagttgcctccaacccaggaatgcctgtgaagtgtctaacttctaatttactccagtctaggaaaaggctggccacatccagtgccagtagtcaatcccacaccttcatatccagtgtggaatcagaatgccacagcagtcccaaatgggaaaaagattgccaggaaagtgatgaagcattgggcccaacaatgatgagttggaatgcagttgaaaagttatgcgcaaaatctgcaaatgccattgagacgaaaggtttcaataaaaaggatctggagttagctctttctcccattcataacagcagtgcccttcccaccactggacgctcttgtgtaaaccttgctaaaaaatgcttctctggggaagtttcttgggaagcagtagaactggatgtaaataatataaatatggacactgacacaagtcagttaggtttccatcagtcaaatcagtgggctgtggattctggtgggatatctgaagagcaccttgggaaaagaagtttaaaaagaaattttgagttggttgactccagtccttgtaaaaaaattatacagaataaaaaaacttgtgtagagtataagcataacgaaatgacaaattgttatacaaatcaaaatacaggcttaacagttgaagtgcaggaccttaagctatcagtgcacaaaagtcaacaaaatgactgtgctaataaggagaacattgtcaattcttttactgataaacaacaaacaccagaaaaattacctataccaatgatagcaaaaaaccttatgtgtgaactcgatgaagactgtgaaaagaatagtaagagggactacttaagttctagttttctatgttctgatgatgatagagcttctaaaaatatttctatgaactctgattcatcttttcctggaatttctataatggaaagtccattagaaagtcagcccttagattcagatagaagcatcaaagaatcctcttttgaagaatcaaatattgaagatccacttattgtaacaccagattgccaagaaaagacctcaccaaaaggtgtcgagaaccctgctgtacaagagagtaaccaaaaaatgttaggtcctcctttggaggtgctgaaaacgttagcctctaaaagaaatgctgttgcttttcgaagttttaacagtcatattaatgcatccaataactcagaaccatccagaatgaacatgacttctttagatgcaatggatatttcgtgtgcctacagtggttcatatcccatggctataacccctactcaaaaaagaagatcctgtatgccacatcagaccccaaatcagatcaagtcgggaactccataccgaactccgaagagtgtgagaagaggggtggcccccgttgatgatgggcgaattctaggaaccccagactaccttgcacctgagctgttactaggcagggcccatgatatcccttggccagaaggtgaagaaaagttatctgataatgctcaaagtgcagtagaaatacttttaaccattgatgatacaaagagagctggaatgaaagagctaaaacgtcatcctctcttcagtgatgtggactgggaaaatctgcagcatcagactatgcctttcatcccccagccagatgatgaaacagatacctcctattttgaagccaggaatactgctcagcacctgactgtatctggatttagtctgtagcacaaaaattttccttttagtctagccttgtgttatagaatgaacttgcataattatatactccttaatactagattgatctaagggggaaagatcattatttaacctagttcaatgtgcttttaatgtacgttacagctttcacagagttaaaaggctgaaaggaatatagtcagtaatttatcttaacctcaaaactgtatataaatcttcaaagcttttttcatttatttattttgtttattgcactttatgaaaactgaagcatcaataaaattagaggacactattgagagtgagccactagcttgattttctttctcctctgatttcagttcactgttcagtttagcattaaaataataaaataatcatacagttccatttg

SEQ ID NO: 153872 - DNA, 3080 bp, Homo sapiens
  Payload ID: 10249
  Gene Symbol: MASTL
  Gene Name: microtubule associated serine/threonine kinase-like
  Uniprot ID: Q96GX5
  ENST ID: ENST00000375940
  CDS Start-End: 58-2697
gggagtggctgctcgcggaggggcagtgtctgcggggccgctgtatgctgtccagcgatggatcccaccgcgggaagcaagaaggagcctggaggaggcgcggcgactgaggagggcgtgaataggatcgcagtgccaaaaccgccctccattgaggaattcagcatagtgaagcccattagccggggcgccttcgggaaagtgtatctggggcagaaaggcggcaaattgtatgcagtaaaggttgttaaaaaagcagacatgatcaacaaaaatatgactcatcaggtccaagctgagagagatgcactggcactaagcaaaagcccattcattgtccatttgtattattcactgcagtctgcaaacaatgtctacttggtaatggaatatcttattgggggagatgtcaagtctctcctacatatatatggttattttgatgaagagatggctgtgaaatatatttctgaagtagcactggctctagactaccttcacagacatggaatcatccacagggacttgaaaccggacaatatgcttatttctaatgagggtcatattaaactgacggattttggcctttcaaaagttactttgaatagagatattaatatgatggatatccttacaacaccatcaatggcaaaacctagacaagattattcaagaaccccaggacaagtgttatcgcttatcagctcgttgggatttaacacaccaattgcagaaaaaaatcaagaccctgcaaacatcctttcagcctgtctgtctgaaacatcacagctttctcaaggactcgtatgccctatgtctgtagatcaaaaggacactacgccttattctagcaaattactaaaatcatgtcttgaaacagttgcctccaacccaggaatgcctgtgaagtgtctaacttctaatttactccagtctaggaaaaggctggccacatccagtgccagtagtcaatcccacaccttcatatccagtgtggaatcagaatgccacagcagtcccaaatgggaaaaagattgccaggaaagtgatgaagcattgggcccaacaatgatgagttggaatgcagttgaaaagttatgcgcaaaatctgcaaatgccattgagacgaaaggtttcaataaaaaggatctggagttagctctttctcccattcataacagcagtgcccttcccaccactggacgctcttgtgtaaaccttgctaaaaaatgcttctctggggaagtttcttgggaagcagtagaactggatgtaaataatataaatatggacactgacacaagtcagttaggtttccatcagtcaaatcagtgggctgtggattctggtgggatatctgaagagcaccttgggaaaagaagtttaaaaagaaattttgagttggttgactccagtccttgtaaaaaaattatacagaataaaaaaacttgtgtagagtataagcataacgaaatgacaaattgttatacaaatcaaaatacaggcttaacagttgaagtgcaggaccttaagctatcagtgcacaaaagtcaacaaaatgactgtgctaataaggagaacattgtcaattcttttactgataaacaacaaacaccagaaaaattacctataccaatgatagcaaaaaaccttatgtgtgaactcgatgaagactgtgaaaagaatagtaagagggactacttaagttctagttttctatgttctgatgatgatagagcttctaaaaatatttctatgaactctgattcatcttttcctggaatttctataatggaaagtccattagaaagtcagcccttagattcagatagaagcatcaaagaatcctcttttgaagaatcaaatattgaagatccacttattgtaacaccagattgccaagaaaagacctcaccaaaaggtgtcgagaaccctgctgtacaagagagtaaccaaaaaatgttaggtcctcctttggaggtgctgaaaacgttagcctctaaaagaaatgctgttgcttttcgaagttttaacagtcatattaatgcatccaataactcagaaccatccagaatgaacatgacttctttagatgcaatggatatttcgtgtgcctacagtggttcatatcccatggctataacccctactcaaaaaagaagatcctgtatgccacatcagcagaccccaaatcagatcaagtcgggaactccataccgaactccgaagagtgtgagaagaggggtggcccccgttgatgatgggcgaattctaggaaccccagactaccttgcacctgagctgttactaggcagggcccatggtcctgcggtagactggtgggcacttggagtttgcttgtttgaatttctaacaggaattccccctttcaatgatgaaacaccacaacaagtattccagaatattctgaaaagagatatcccttggccagaaggtgaagaaaagttatctgataatgctcaaagtgcagtagaaatacttttaaccattgatgatacaaagagagctggaatgaaagagctaaaacgtcatcctctcttcagtgatgtggactgggaaaatctgcagcatcagactatgcctttcatcccccagccagatgatgaaacagatacctcctattttgaagccaggaatactgctcagcacctgactgtatctggatttagtctgtagcacaaaaattttccttttagtctagccttgtgttatagaatgaacttgcataattatatactccttaatactagattgatctaagggggaaagatcattatttaacctagttcaatgtgcttttaatgtacgttacagctttcacagagttaaaaggctgaaaggaatatagtcagtaatttatcttaacctcaaaactgtatataaatcttcaaagcttttttcatttatttattttgtttattgcactttatgaaaactgaagcatcaataaaattagaggacactattgagagtgagccactagcttgattttctttctcctctgatttcagttcactgttcagtttagcattaaaataataaaataatcatacagttcc

SEQ ID NO: 153873 - DNA, 3623 bp, Homo sapiens
  Payload ID: 10249
  Gene Symbol: MASTL
  Gene Name: microtubule associated serine/threonine kinase-like
  Uniprot ID: Q96GX5
  ENST ID: ENST00000375946
  CDS Start-End: 604-3240
ttttcctcacactaaatcgaaaactctccctgttggtcctgatctgtttcagtcaggcaaattacatcctgggaaaacgtcagatgacaggggaggccactcgcttcctgctcatccagtttcgacactttctgtgctttcattagcttccagacctcagccctggccctcgctttactgtacagtcagaactggtttctacgcctcgcgagggtgggaggtcgtgtatgggaggaggaccgcttcccaccagcctcgttgggaagccaggagaaatctcttcaaatcctgcgattcagagtcaagtcccagtcgtcctttttctggtcggcccagaactgtttgtgcctcctccctcatgaggaatgatgtcagtggggccgcggtcgccgcccacgaagagtgtaaggctgcgaagtcggggctttcccgacgccccctccgtccgcgtctgcgtaggggaggtgacgagggcggggcgcggcggcggggtgacgtcacggccgcgcgcggcgtgggcggagcctcactttgaacccagttggcgggagtggctgctcgcggaggggcagtgtctgcggggccgctgtatgctgtccagcgatggatcccaccgcgggaagcaagaaggagcctggaggaggcgcggcgactgaggagggcgtgaataggatcgcagtgccaaaaccgccctccattgaggaattcagcatagtgaagcccattagccggggcgccttcgggaaagtgtatctggggcagaaaggcggcaaattgtatgcagtaaaggttgttaaaaaagcagacatgatcaacaaaaatatgactcatcaggtccaagctgagagagatgcactggcactaagcaaaagcccattcattgtccatttgtattattcactgcagtctgcaaacaatgtctacttggtaatggaatatcttattgggggagatgtcaagtctctcctacatatatatggttattttgatgaagagatggctgtgaaatatatttctgaagtagcactggctctagactaccttcacagacatggaatcatccacagggacttgaaaccggacaatatgcttatttctaatgagggtcatattaaactgacggattttggcctttcaaaagttactttgaatagagatattaatatgatggatatccttacaacaccatcaatggcaaaacctagacaagattattcaagaaccccaggacaagtgttatcgcttatcagctcgttgggatttaacacaccaattgcagaaaaaaatcaagaccctgcaaacatcctttcagcctgtctgtctgaaacatcacagctttctcaaggactcgtatgccctatgtctgtagatcaaaaggacactacgccttattctagcaaattactaaaatcatgtcttgaaacagttgcctccaacccaggaatgcctgtgaagtgtctaacttctaatttactccagtctaggaaaaggctggccacatccagtgccagtagtcaatcccacaccttcatatccagtgtggaatcagaatgccacagcagtcccaaatgggaaaaagattgccaggaaagtgatgaagcattgggcccaacaatgatgagttggaatgcagttgaaaagttatgcgcaaaatctgcaaatgccattgagacgaaaggtttcaataaaaaggatctggagttagctctttctcccattcataacagcagtgcccttcccaccactggacgctcttgtgtaaaccttgctaaaaaatgcttctctggggaagtttcttgggaagcagtagaactggatgtaaataatataaatatggacactgacacaagtcagttaggtttccatcagtcaaatcagtgggctgtggattctggtgggatatctgaagagcaccttgggaaaagaagtttaaaaagaaattttgagttggttgactccagtccttgtaaaaaaattatacagaataaaaaaacttgtgtagagtataagcataacgaaatgacaaattgttatacaaatcaaaatacaggcttaacagttgaagtgcaggaccttaagctatcagtgcacaaaagtcaacaaaatgactgtgctaataaggagaacattgtcaattcttttactgataaacaacaaacaccagaaaaattacctataccaatgatagcaaaaaaccttatgtgtgaactcgatgaagactgtgaaaagaatagtaagagggactacttaagttctagttttctatgttctgatgatgatagagcttctaaaaatatttctatgaactctgattcatcttttcctggaatttctataatggaaagtccattagaaagtcagcccttagattcagatagaagcatcaaagaatcctcttttgaagaatcaaatattgaagatccacttattgtaacaccagattgccaagaaaagacctcaccaaaaggtgtcgagaaccctgctgtacaagagagtaaccaaaaaatgttaggtcctcctttggaggtgctgaaaacgttagcctctaaaagaaatgctgttgcttttcgaagttttaacagtcatattaatgcatccaataactcagaaccatccagaatgaacatgacttctttagatgcaatggatatttcgtgtgcctacagtggttcatatcccatggctataacccctactcaaaaaagaagatcctgtatgccacatcagaccccaaatcagatcaagtcgggaactccataccgaactccgaagagtgtgagaagaggggtggcccccgttgatgatgggcgaattctaggaaccccagactaccttgcacctgagctgttactaggcagggcccatggtcctgcggtagactggtgggcacttggagtttgcttgtttgaatttctaacaggaattccccctttcaatgatgaaacaccacaacaagtattccagaatattctgaaaagagatatcccttggccagaaggtgaagaaaagttatctgataatgctcaaagtgcagtagaaatacttttaaccattgatgatacaaagagagctggaatgaaagagctaaaacgtcatcctctcttcagtgatgtggactgggaaaatctgcagcatcagactatgcctttcatcccccagccagatgatgaaacagatacctcctattttgaagccaggaatactgctcagcacctgactgtatctggatttagtctgtagcacaaaaattttccttttagtctagccttgtgttatagaatgaacttgcataattatatactccttaatactagattgatctaagggggaaagatcattatttaacctagttcaatgtgcttttaatgtacgttacagctttcacagagttaaaaggctgaaaggaatatagtcagtaatttatcttaacctcaaaactgtatataaatcttcaaagcttttttcatttatttattttgtttattgcactttatgaaaactgaagcatcaataaaattagaggacactattgagagtgagccactagcttgattttctttctcctctgatttcagttcactgttcagtttagcattaaaataataaaataatcatacagttcc

SEQ ID NO: 153874 - DNA, 1622 bp, Homo sapiens
  Payload ID: 10249
  Gene Symbol: MASTL
  Gene Name: microtubule associated serine/threonine kinase-like
  ENST ID: ENST00000477034
  CDS Start-End: 1-1440
gaaagtgatgaagcattgggcccaacaatgatgagttggaatgcagttgaaaagttatgcgcaaaatctgcaaatgccattgagacgaaaggtttcaataaaaaggatctggagttagctctttctcccattcataacagcagtgcccttcccaccactggacgctcttgtgtaaaccttgctaaaaaatgcttctctggggaagtttcttgggaagcagtagaactggatgtaaataatataaatatggacactgacacaagtcagttaggtttccatcagtcaaatcagtgggctgtggattctggtgggatatctgaagagcaccttgggaaaagaagtttaaaaagaaattttgagttggttgactccagtccttgtaaaaaaattatacagaataaaaaaacttgtgtagagtataagcataacgaaatgacaaattgttatacaaatcaaaatacaggcttaacagttgaagtgcaggaccttaagctatcagtgcacaaaagtcaacaaaatgactgtgctaataaggagaacattgtcaattcttttactgataaacaacaaacaccagaaaaattacctataccaatgatagcaaaaaaccttatgtgtgaactcgatgaagactgtgaaaagaatagtaagagggactacttaagttctagttttctatgttctgatgatgatagagcttctaaaaatatttctatgaactctgattcatcttttcctggaatttctataatggaaagtccattagaaagtcagcccttagattcagatagaagcatcaaagaatcctcttttgaagaatcaaatattgaagatccacttattgtaacaccagattgccaagaaaagacctcaccaaaaggtgtcgagaaccctgctgtacaagagagtaaccaaaaaatgttaggtcctcctttggaggtgctgaaaacgttagcctctaaaagaaatgctgttgcttttcgaagttttaacagtcatattaatgcatccaataactcagaaccatccagaatgaacatgacttctttagatgcaatggatatttcgtgtgcctacagtggttcatatcccatggctataacccctactcaaaaaagaagatcctgtatgccacatcagcagaccccaaatcagatcaagtcgggaactccataccgaactccgaagagtgtgagaagaggggtggcccccgttgatgatgggcgaattctaggaaccccagactaccttgcacctgagctgttactaggcagggcccatgagctaaaacgtcatcctctcttcagtgatgtggactgggaaaatctgcagcatcagactatgcctttcatcccccagccagatgatgaaacagatacctcctattttgaagccaggaatactgctcagcacctgactgtatctggatttagtctgtagcacaaaaattttccttttagtctagccttgtgttatagaatgaacttgcataattatatactccttaatactagattgatctaagggggaaagatcattatttaacctagttcaatgtgcttttaatgtacgttacagctttcacagagttaaaaggctgaaaggaatatagtcagtaattt

SEQ ID NO: 153875 - DNA, 6160 bp, Homo sapiens
  Payload ID: 10250
  Gene Symbol: MTUS1
  Gene Name: microtubule associated tumor suppressor 1
  Uniprot ID: Q9ULD2
  ENST ID: ENST00000262102
  CDS Start-End: 226-4038
gtggcgcctcgctactttctgcagcttgtttgcactttttcacgctctagaaaaatctcatcttaattaagggaacaacaaatcatttaatcttcagagcatcttagactgaaaacctttcaactgtgctgaaaaacctagaagacagaccattttgcccaccctctcatttaaaaggaattgaagaagaaataaaatggcagaggtttaaggttactattcaggatgactgatgataattcagatgataaaatagaagatgaattgcaaaccttctttaccagtgataaagatggaaatacacatgcatacaacccgaaatcaccacctacacaaaactcttcagccagcagtgtgaactggaattctgccaacccagatgacatggtggttgattatgaaactgaccctgctgtagttactggtgaaaatatttctttaagccttcagggtgttgaagtatttggtcatgaaaagtcttctagtgatttcattagtaagcaggtgttagatatgcataaagattctatttgtcagtgtcctgcacttgtaggtactgagaagcccaaatatctgcaacacagttgtcattccctagaagcagttgagggccagagtgttgagccatctttgccttttgtgtggaagcctaatgacaatttgaactgtgcaggctactgtgatgccttggagctaaaccaaacatttgacatgacagtggataaagttaactgcacctttatatcacatcatgccatcggaaagagtcagtccttccatactgctggaagcctgccaccaactggtaggagaagtggaagtacatcttctttatcctattccacttggacatcttcccattctgataagacgcatgcaagagaaactacttatgatagagaaagctttgaaaaccctcaagtcacaccatcagaagcccaagacatgacttacacagcattttctgatgtggtgatgcaaagtgaggtttttgtttcagatattggaaatcagtgtgcatgttcttcaggaaaggtcaccagtgagtacacagatggatcacaacaaagactagttggagaaaaggagacacaagcactaacaccagtttctgatggcatggaagtccccaatgattctgcattacaagagttcttttgtttatcccatgatgaatccaatagcgaaccacattcacagagctcatacaggcacaaggaaatgggccaaaatctgagagagacagtgtcctattgtcttattgatgatgaatgccctttaatggtgccagcttttgataagagcgaagctcaagtgctgaacccagagcataaagtcactgagactgaagacacacaaatggtctccaaaggaaaggatttgggaacccaaaatcatacctcagaattgattctaagtagcccgccaggacaaaaggtgggctcgtcatttggactgacttgggatgcaaatgatatggtcattagcacagacaaaacgatgtgcatgtcaacaccagtcctagaacccacaaaagtaaccttttctgtttcaccgattgaagcgacggagaaatgtaagaaagtggagaagggtaatcgagggcttaaaaacataccagactcgaaggaggcacctgtgaacctgtgtaaacccagtttaggaaaatcaacaatcaaaacgaataccccaataggctgcaaagttagaaaaactgaaattataagttacccaagaccaaacttcaagaatgtcaaagcaaaagttatgtctagagcagtgttgcagcccaaagatgctgctttatcaaaggtcacgcccagacctcagcagaccagtgcctcatcaccctcatcagtgaattcaagacaacaaacagtcttgagcagaacaccgagatctgacttgaatgcagacaaaaaagcagaaattctaattaacaagacacataagcagcagtttaataaactcattactagccaggctgtgcatgttacaactcattctaaaaatgcttcacacagggttccaagaacaacatctgccgtgaaatcgaatcaggaagatgttgacaaagccagttcttctaactcagcatgcgagaccgggtccgtttctgcgttgtttcagaagatcaaaggcatactccctgttaaaatggaaagtgcagaatgtttggaaatgacctatgttcccaacattgataggattagccctgaaaagaagggtgaaaaagaaaatgggacatctatggaaaaacaagagctgaaacaagagattatgaatgagacttttgaatatggttctctgtttttgggctctgcttcaaaaacaacgaccacctcaggtaggaatatatccaagcctgactcctgcggtttgaggcaaatagctgctccaaaagccaaagtggggccccctgtttcctgtttgaggcggaacagtgacaatagaaatcccagtgctgatcgagccgtatctcctcagaggatcaggcgtgtgtccagttctggaaagcctacatccttgaaaactgcacagtcgtcatgggtgaatttgcctagaccacttcctaaatccaaagcatctttgaaaagtcctgcgctgcggaggacaggaagcaccccctcaatagccagcacccacagtgagctgagcacttacagcaacaattctggtaatgccgctgtcatcaaatatgaggagaaacctccaaaaccagcatttcagaatggttcctcaggatccttttatttgaagcctttggtatccagggctcatgttcacttgatgaaaactcctccaaaaggtccttcgagaaaaaatttatttacagctcttaatgcagttgaaaagagcaggcaaaagaatcctcgaagcttatgtatccagccacagacagctcccgatgcgctgccccctgagaaaacacttgaattgacgcaatataaaacaaaatgtgaaaaccaaagtggatttatcctgcagctcaagcagcttcttgcctgtggtaataccaagtttgaggcattgacagttgtgattcagcacctgctgtctgagcgggaggaagcactgaaacaacacaaaaccctatctcaagaacttgttaacctccggggagagctagtcactgcttcaaccacctgtgagaaattagaaaaagccaggaatgagttacaaacagtgtatgaagcattcgtccagcagcaccaggctgaaaaaacagaacgagagaatcggcttaaagagttttacaccagggagtatgaaaagcttcgggacacttacattgaagaagcagagaagtacaaaatgcaattgcaagagcagtttgacaacttaaatgctgcgcatgaaacctctaagttggaaattgaagctagccactcagagaaacttgaattgctaaagaaggcctatgaagcctccctttcagaaattaagaaaggccatgaaatagaaaagaaatcgcttgaagatttactttctgagaagcaggaatcgctagagaagcaaatcaatgatctgaagagtgaaaatgatgctttaaatgaaaaattgaaatcagaagaacaaaaaagaagagcaagagaaaaagcaaatttgaaaaatcctcagatcatgtatctagaacaggagttagaaagcctgaaagctgtgttagagatcaagaatgagaaactgcatcaacaggacatcaagttaatgaaaatggagaaactggtggacaacaacacagcattggttgacaaattgaagcgtttccagcaggagaatgaagaattgaaagctcggatggacaagcacatggcaatctcaaggcagctttccacggagcaggctgttctgcaagagtcgctggagaaggagtcgaaagtcaacaagcgactctctatggaaaacgaggagcttctgtggaaactgcacaatggggacctgtgtagccccaagagatcccccacatcctccgccatccctttgcagtcaccaaggaattcgggctccttccctagccccagcatttcacccagatgacacctccccaaagtccacagactctctgaaagcattttgatgcaggtctgcaggactgaccccaaggaggaacgtgggcacaagaggtatatcagcacacgtgtgatcaccgtagggtaactggagcgtcaccaccggcggaatcgcagcttctgagactggaactctggaggaagacttttgcctccgtccaaaagattcctccaaaaaaagatttaaaaaaagatttcggcatcgacacggacgttgttgcacaaagcacttaaagaacgagagcatcttgttcattgcctttttcacctaagcatagggggaaaaactctcagggccctattaagatttataacctttgtaatgttcttcaccacagacaccttcttgtgagttttcagtctgactgtgggggtggggggtgtgaatgaaatggatgtcacagagtgtcatgtgtctgatgcagcctcctctgctgtgtattaaatgtcaaaatctgaatatatctggatatgtactaatcaaataataatcaatcaatcagcatatacatttcagccaaagccatagaagaaaaagcaatagttgcttgaattatgatcatctaccaccaactctgctcagccctgtaacagggtagggagagggtataacaggaagagctttgacttgtccctgtctatacattctctgtatcttttgggggtaacttcttggcagtttttcagtgttcagccatgtcagttgaaactagatttttctgtagattttttacttacccatgtgagcctaacactatcctgtaattcattttctcaggctatgtgtaaatgtagaaccctaatttttctataaaaaaacaaactaactaactaactgtgtaaagaaagaaaaagggaagtaccaatgggtttttccaccttatttttacctttgatctacccttgcagatttaacctgtcttcttccctcccattattctcattttccttttacctttctccaccatccagagccacaaaagcaaaccttctacctcctacctacttttctctgggacaaggataaaggaatatgattttccagagccccagagccagctcatcttccaggtgctgaaaccactttccaaataaactaaagcctggatttgatattacaaattttgggaaatcttagaataaagaacgagaacaaggaagtcattggctagtataattaagaaaggtaggattcagtgcttaccgatgatgcagtacttgatagaagaaaacagtctgggaggatagcgctcatttttcagttaccctttaaggagtccctttgtctttgggaaagtagcagaatggtccgcttctttcccatgagtggaaaatgtggcttgtccaactctcctccaggttgcatttcagtttctttccaaaacttattacctcccctaatcctgagactttggaaaaggtggaaggaagaactgttgctttatctccccctccctgcatgtgtcaacattgtgatgtcagtatttactaatctacattcagtggctgtacaaataacagctgtagtaagaagagattcaggatgctagaggtgaatatttgggtcatttacatgtacactacatagcaagttgatactcatgttgcatgttcttttaaattagtgattttgtgtcttaagtctttaacttccaatacttcatcatgtatgtaaccttccatgtttgcttctgataaatggaaatgtaggttcactgccacttcatgagatatctctgctcacgcttccaagttgttctcaatgacattagccaaagttgggtttgccattcatcccctaggcatggtaaatcttgtgttgttccctgctgtcctccgtattacgtgaccggcaaataaatctcatagcagttaatataaaacatctttggaggatgggagagaacaggagggaagatgggaaacaaaatagagaattcttaagattttgtttaaaccaaatgtttcatgtagaatgcaaaatgttggcacgtcaaaaatatgaatgtgtagacaactgtagttgtgctcagtttgtagtgatgggaagtgtattttactctgatcaaataaataatgctggaatactc

SEQ ID NO: 153876 - DNA, 3731 bp, Homo sapiens
  Payload ID: 10250
  Gene Symbol: MTUS1
  Gene Name: microtubule associated tumor suppressor 1
  Uniprot ID: Q9ULD2
  ENST ID: ENST00000297488
  CDS Start-End: 294-1604
acagtgtgatgtggttcagaggcagcttctagacctgcaggagggagattgtattcagaggaagagcatcattttggcaacatctgaaagtgaaaacggaagccagaaacacttggccagccctgggggatttttttcttctatgcctctctggtggaatgacatttgctgtgtaggcatctttcctctgactgtatttcttggccttgaagagtactgagtttaaaaagacagtatgtgacagtccatggaaattgcctcttctgtgaaatctcgccacctgctccgaagacatgttgttgtctcccaaattctccttatccaccattcacatacgactgacggccaaaggattgcttcgaaaccttcgacttccttcagggtttaggagaagcactgttgttttccacacagttgaaaagagcaggcaaaagaatcctcgaagcttatgtatccagccacagacagctcccgatgcgctgccccctgagaaaacacttgaattgacgcaatataaaacaaaatgtgaaaaccaaagtggatttatcctgcagctcaagcagcttcttgcctgtggtaataccaagtttgaggcattgacagttgtgattcagcacctgctgtctgagcgggaggaagcactgaaacaacacaaaaccctatctcaagaacttgttaacctccggggagagctagtcactgcttcaaccacctgtgagaaattagaaaaagccaggaatgagttacaaacagtgtatgaagcattcgtccagcagcaccaggctgaaaaaacagaacgagagaatcggcttaaagagttttacaccagggagtatgaaaagcttcgggacacttacattgaagaagcagagaagtacaaaatgcaattgcaagagcagtttgacaacttaaatgctgcgcatgaaacctctaagttggaaattgaagctagccactcagagaaacttgaattgctaaagaaggcctatgaagcctccctttcagaaattaagaaaggccatgaaatagaaaagaaatcgcttgaagatttactttctgagaagcaggaatcgctagagaagcaaatcaatgatctgaagagtgaaaatgatgctttaaatgaaaaattgaaatcagaagaacaaaaaagaagagcaagagaaaaagcaaatttgaaaaatcctcagatcatgtatctagaacaggagttagaaagcctgaaagctgtgttagagatcaagaatgagaaactgcatcaacaggacatcaagttaatgaaaatggagaaactggtggacaacaacacagcattggttgacaaattgaagcgtttccagcaggagaatgaagaattgaaagctcggatggacaagcacatggcaatctcaaggcagctttccacggagcaggctgttctgcaagagtcgctggagaaggagtcgaaagtcaacaagcgactctctatggaaaacgaggagcttctgtggaaactgcacaatggggacctgtgtagccccaagagatcccccacatcctccgccatccctttgcagtcaccaaggaattcgggctccttccctagccccagcatttcacccagatgacacctccccaaagtccacagactctctgaaagcattttgatgcaggtctgcaggactgaccccaaggaggaacgtgggcacaagaggtatatcagcacacgtgtgatcaccgtagggtaactggagcgtcaccaccggcggaatcgcagcttctgagactggaactctggaggaagacttttgcctccgtccaaaagattcctccaaaaaaagatttaaaaaaagatttcggcatcgacacggacgttgttgcacaaagcacttaaagaacgagagcatcttgttcattgcctttttcacctaagcatagggggaaaaactctcagggccctattaagatttataacctttgtaatgttcttcaccacagacaccttcttgtgagttttcagtctgactgtgggggtggggggtgtgaatgaaatggatgtcacagagtgtcatgtgtctgatgcagcctcctctgctgtgtattaaatgtcaaaatctgaatatatctggatatgtactaatcaaataataatcaatcaatcagcatatacatttcagccaaagccatagaagaaaaagcaatagttgcttgaattatgatcatctaccaccaactctgctcagccctgtaacagggtagggagagggtataacaggaagagctttgacttgtccctgtctatacattctctgtatcttttgggggtaacttcttggcagtttttcagtgttcagccatgtcagttgaaactagatttttctgtagattttttacttacccatgtgagcctaacactatcctgtaattcattttctcaggctatgtgtaaatgtagaaccctaatttttctataaaaaaacaaactaactaactaactgtgtaaagaaagaaaaagggaagtaccaatgggtttttccaccttatttttacctttgatctacccttgcagatttaacctgtcttcttccctcccattattctcattttccttttacctttctccaccatccagagccacaaaagcaaaccttctacctcctacctacttttctctgggacaaggataaaggaatatgattttccagagccccagagccagctcatcttccaggtgctgaaaccactttccaaataaactaaagcctggatttgatattacaaattttgggaaatcttagaataaagaacgagaacaaggaagtcattggctagtataattaagaaaggtaggattcagtgcttaccgatgatgcagtacttgatagaagaaaacagtctgggaggatagcgctcatttttcagttaccctttaaggagtccctttgtctttgggaaagtagcagaatggtccgcttctttcccatgagtggaaaatgtggcttgtccaactctcctccaggttgcatttcagtttctttccaaaacttattacctcccctaatcctgagactttggaaaaggtggaaggaagaactgttgctttatctccccctccctgcatgtgtcaacattgtgatgtcagtatttactaatctacattcagtggctgtacaaataacagctgtagtaagaagagattcaggatgctagaggtgaatatttgggtcatttacatgtacactacatagcaagttgatactcatgttgcatgttcttttaaattagtgattttgtgtcttaagtctttaacttccaatacttcatcatgtatgtaaccttccatgtttgcttctgataaatggaaatgtaggttcactgccacttcatgagatatctctgctcacgcttccaagttgttctcaatgacattagccaaagttgggtttgccattcatcccctaggcatggtaaatcttgtgttgttccctgctgtcctccgtattacgtgaccggcaaataaatctcatagcagttaatataaaacatctttggaggatgggagagaacaggagggaagatgggaaacaaaatagagaattcttaagattttgtttaaaccaaatgtttcatgtagaatgcaaaatgttggcacgtcaaaaatatgaatgtgtagacaactgtagttgtgctcagtttgtagtgatgggaagtgtattttactctgatcaaataaataatgctggaatactcaagaa

SEQ ID NO: 153877 - DNA, 3996 bp, Homo sapiens
  Payload ID: 10250
  Gene Symbol: MTUS1
  Gene Name: microtubule associated tumor suppressor 1
  Uniprot ID: Q9ULD2
  ENST ID: ENST00000381861
  CDS Start-End: 321-1874
agtactgtgtctgatgctcctaaggaggctgtaaagtgcttttgtccattcctttttgtcttttaacaaaggggtttaccatacacccacagagcctgtctagtggcgatgtgttcctgttgcggattaagcattcaaatcagtgagtctctttcttagtttgatttgctagctggtttaatctgttttgtgtagtgccttggagcttacgcatttttttttttttccctccattcgaattcactaagagcaagcatgagggatatgagagtgaacatggctgcagtttttcctgcttaagcttgctttgatccttttaaatgactgtaccaggaggatttcgcagttgtacagaaactgatatttcttcaaaaatctttatcaattctacactcaccccaccggctggttcagagaggcactatgatgctaccttattgacactgctggtcgtgggatcgtacagcctttgtataattcctttgttagccacgtttactgggaaaaaaactggtaatgccgctgtcatcaaatatgaggagaaacctccaaaaccagcatttcagaatggttcctcaggatccttttatttgaagcctttggtatccagggctcatgttcacttgatgaaaactcctccaaaaggtccttcgagaaaaaatttatttacagctcttaatgcagttgaaaagagcaggcaaaagaatcctcgaagcttatgtatccagccacagacagctcccgatgcgctgccccctgagaaaacacttgaattgacgcaatataaaacaaaatgtgaaaaccaaagtggatttatcctgcagctcaagcagcttcttgcctgtggtaataccaagtttgaggcattgacagttgtgattcagcacctgctgtctgagcgggaggaagcactgaaacaacacaaaaccctatctcaagaacttgttaacctccggggagagctagtcactgcttcaaccacctgtgagaaattagaaaaagccaggaatgagttacaaacagtgtatgaagcattcgtccagcagcaccaggctgaaaaaacagaacgagagaatcggcttaaagagttttacaccagggagtatgaaaagcttcgggacacttacattgaagaagcagagaagtacaaaatgcaattgcaagagcagtttgacaacttaaatgctgcgcatgaaacctctaagttggaaattgaagctagccactcagagaaacttgaattgctaaagaaggcctatgaagcctccctttcagaaattaagaaaggccatgaaatagaaaagaaatcgcttgaagatttactttctgagaagcaggaatcgctagagaagcaaatcaatgatctgaagagtgaaaatgatgctttaaatgaaaaattgaaatcagaagaacaaaaaagaagagcaagagaaaaagcaaatttgaaaaatcctcagatcatgtatctagaacaggagttagaaagcctgaaagctgtgttagagatcaagaatgagaaactgcatcaacaggacatcaagttaatgaaaatggagaaactggtggacaacaacacagcattggttgacaaattgaagcgtttccagcaggagaatgaagaattgaaagctcggatggacaagcacatggcaatctcaaggcagctttccacggagcaggctgttctgcaagagtcgctggagaaggagtcgaaagtcaacaagcgactctctatggaaaacgaggagcttctgtggaaactgcacaatggggacctgtgtagccccaagagatcccccacatcctccgccatccctttgcagtcaccaaggaattcgggctccttccctagccccagcatttcacccagatgacacctccccaaagtccacagactctctgaaagcattttgatgcaggtctgcaggactgaccccaaggaggaacgtgggcacaagaggtatatcagcacacgtgtgatcaccgtagggtaactggagcgtcaccaccggcggaatcgcagcttctgagactggaactctggaggaagacttttgcctccgtccaaaagattcctccaaaaaaagatttaaaaaaagatttcggcatcgacacggacgttgttgcacaaagcacttaaagaacgagagcatcttgttcattgcctttttcacctaagcatagggggaaaaactctcagggccctattaagatttataacctttgtaatgttcttcaccacagacaccttcttgtgagttttcagtctgactgtgggggtggggggtgtgaatgaaatggatgtcacagagtgtcatgtgtctgatgcagcctcctctgctgtgtattaaatgtcaaaatctgaatatatctggatatgtactaatcaaataataatcaatcaatcagcatatacatttcagccaaagccatagaagaaaaagcaatagttgcttgaattatgatcatctaccaccaactctgctcagccctgtaacagggtagggagagggtataacaggaagagctttgacttgtccctgtctatacattctctgtatcttttgggggtaacttcttggcagtttttcagtgttcagccatgtcagttgaaactagatttttctgtagattttttacttacccatgtgagcctaacactatcctgtaattcattttctcaggctatgtgtaaatgtagaaccctaatttttctataaaaaaacaaactaactaactaactgtgtaaagaaagaaaaagggaagtaccaatgggtttttccaccttatttttacctttgatctacccttgcagatttaacctgtcttcttccctcccattattctcattttccttttacctttctccaccatccagagccacaaaagcaaaccttctacctcctacctacttttctctgggacaaggataaaggaatatgattttccagagccccagagccagctcatcttccaggtgctgaaaccactttccaaataaactaaagcctggatttgatattacaaattttgggaaatcttagaataaagaacgagaacaaggaagtcattggctagtataattaagaaaggtaggattcagtgcttaccgatgatgcagtacttgatagaagaaaacagtctgggaggatagcgctcatttttcagttaccctttaaggagtccctttgtctttgggaaagtagcagaatggtccgcttctttcccatgagtggaaaatgtggcttgtccaactctcctccaggttgcatttcagtttctttccaaaacttattacctcccctaatcctgagactttggaaaaggtggaaggaagaactgttgctttatctccccctccctgcatgtgtcaacattgtgatgtcagtatttactaatctacattcagtggctgtacaaataacagctgtagtaagaagagattcaggatgctagaggtgaatatttgggtcatttacatgtacactacatagcaagttgatactcatgttgcatgttcttttaaattagtgattttgtgtcttaagtctttaacttccaatacttcatcatgtatgtaaccttccatgtttgcttctgataaatggaaatgtaggttcactgccacttcatgagatatctctgctcacgcttccaagttgttctcaatgacattagccaaagttgggtttgccattcatcccctaggcatggtaaatcttgtgttgttccctgctgtcctccgtattacgtgaccggcaaataaatctcatagcagttaatataaaacatctttggaggatgggagagaacaggagggaagatgggaaacaaaatagagaattcttaagattttgtttaaaccaaatgtttcatgtagaatgcaaaatgttggcacgtcaaaaatatgaatgtgtagacaactgtagttgtgctcagtttgtagtgatgggaagtgtattttactctgatcaaataaataatgctggaatactc

SEQ ID NO: 153878 - DNA, 6256 bp, Homo sapiens
  Payload ID: 10250
  Gene Symbol: MTUS1
  Gene Name: microtubule associated tumor suppressor 1
  Uniprot ID: Q9ULD2
  ENST ID: ENST00000381869
  CDS Start-End: 475-4125
aaagggggcggcagcgccggcggagcggaggcgggtctcacgtgggccagcgcagagcctgcggaagggacggatgcggatctcgtcgctgtcaccttgaaagtgaccgaggggcttgactgtggactccttacgccgcccacccgggcccggcggtcccagccttctcgcagggccccttctcagcagaagcaagcggggccgagaaagcgggtggaatagggttgctgcaggtcccaaagacccctcgtggcgcctcgctactttctgcagcttgtttgcactttttcacgctctagaaaaatctcatcttaattaagggaacaacaaatcatttaatcttcagagcatcttagactgaaaacctttcaactgtgctgaaaaacctagaagacagaccattttgcccaccctctcatttaaaaggaattgaagaagaaataaaatggcagaggtttaaggttactattcaggatgactgatgataattcagatgataaaatagaagatgaattgcaaaccttctttaccagtgataaagatggaaatacacatgcatacaacccgaaatcaccacctacacaaaactcttcagccagcagtgtgaactggaattctgccaacccagatgacatggtggttgattatgaaactgaccctgctgtagttactggtgaaaatatttctttaagccttcagggtgttgaagtatttggtcatgaaaagtcttctagtgatttcattagtaagcaggtgttagatatgcataaagattctatttgtcagtgtcctgcacttgtaggtactgagaagcccaaatatctgcaacacagttgtcattccctagaagcagttgagggccagagtgttgagccatctttgccttttgtgtggaagcctaatgacaatttgaactgtgcaggctactgtgatgccttggagctaaaccaaacatttgacatgacagtggataaagttaactgcacctttatatcacatcatgccatcggaaagagtcagtccttccatactgctggaagcctgccaccaactggtaggagaagtggaagtacatcttctttatcctattccacttggacatcttcccattctgataagacgcatgcaagagaaactacttatgatagagaaagctttgaaaaccctcaagtcacaccatcagaagcccaagacatgacttacacagcattttctgatgtggtgatgcaaagtgaggtttttgtttcagatattggaaatcagtgtgcatgttcttcaggaaaggtcaccagtgagtacacagatggatcacaacaaagactagttggagaaaaggagacacaagcactaacaccagtttctgatggcatggaagtccccaatgattctgcattacaagagttcttttgtttatcccatgatgaatccaatagcgaaccacattcacagagctcatacaggcacaaggaaatgggccaaaatctgagagagacagtgtcctattgtcttattgatgatgaatgccctttaatggtgccagcttttgataagagcgaagctcaagtgctgaacccagagcataaagtcactgagactgaagacacacaaatggtctccaaaggaaaggatttgggaacccaaaatcatacctcagaattgattctaagtagcccgccaggacaaaaggtgggctcgtcatttggactgacttgggatgcaaatgatatggtcattagcacagacaaaacgatgtgcatgtcaacaccagtcctagaacccacaaaagtaaccttttctgtttcaccgattgaagcgacggagaaatgtaagaaagtggagaagggtaatcgagggcttaaaaacataccagactcgaaggaggcacctgtgaacctgtgtaaacccagtttaggaaaatcaacaatcaaaacgaataccccaataggctgcaaagttagaaaaactgaaattataagttacccaagaccaaacttcaagaatgtcaaagcaaaagttatgtctagagcagtgttgcagcccaaagatgctgctttatcaaaggtcacgcccagacctcagcagaccagtgcctcatcaccctcatcagtgaattcaagacaacaaacagtcttgagcagaacaccgagatctgacttgaatgcagacaaaaaagcagaaattctaattaacaagacacataagcagcagtttaataaactcattactagccaggctgtgcatgttacaactcattctaaaaatgcttcacacagggttccaagaacaacatctgccgtgaaatcgaatcaggaagatgttgacaaagccagttcttctaactcagcatgcgagaccgggtccgtttctgcgttgtttcagaagatcaaaggcatactccctgttaaaatggaaagtgcagaatgtttggaaatgacctatgttcccaacattgataggattagccctgaaaagaagggtgaaaaagaaaatgggacatctatggaaaaacaagagctgaaacaagagattatgaatgagacttttgaatatggttctctgtttttgggctctgcttcaaaaacaacgaccacctcaggtaggaatatatccaagcctgactcctgcggtttgaggcaaatagctgctccaaaagccaaagtggggccccctgtttcctgtttgaggcggaacagtgacaatagaaatcccagtgctgatcgagccgtatctcctcagaggatcaggcgtgtgtccagttctgctggtaatgccgctgtcatcaaatatgaggagaaacctccaaaaccagcatttcagaatggttcctcaggatccttttatttgaagcctttggtatccagggctcatgttcacttgatgaaaactcctccaaaaggtccttcgagaaaaaatttatttacagctcttaatgcagttgaaaagagcaggcaaaagaatcctcgaagcttatgtatccagccacagacagctcccgatgcgctgccccctgagaaaacacttgaattgacgcaatataaaacaaaatgtgaaaaccaaagtggatttatcctgcagctcaagcagcttcttgcctgtggtaataccaagtttgaggcattgacagttgtgattcagcacctgctgtctgagcgggaggaagcactgaaacaacacaaaaccctatctcaagaacttgttaacctccggggagagctagtcactgcttcaaccacctgtgagaaattagaaaaagccaggaatgagttacaaacagtgtatgaagcattcgtccagcagcaccaggctgaaaaaacagaacgagagaatcggcttaaagagttttacaccagggagtatgaaaagcttcgggacacttacattgaagaagcagagaagtacaaaatgcaattgcaagagcagtttgacaacttaaatgctgcgcatgaaacctctaagttggaaattgaagctagccactcagagaaacttgaattgctaaagaaggcctatgaagcctccctttcagaaattaagaaaggccatgaaatagaaaagaaatcgcttgaagatttactttctgagaagcaggaatcgctagagaagcaaatcaatgatctgaagagtgaaaatgatgctttaaatgaaaaattgaaatcagaagaacaaaaaagaagagcaagagaaaaagcaaatttgaaaaatcctcagatcatgtatctagaacaggagttagaaagcctgaaagctgtgttagagatcaagaatgagaaactgcatcaacaggacatcaagttaatgaaaatggagaaactggtggacaacaacacagcattggttgacaaattgaagcgtttccagcaggagaatgaagaattgaaagctcggatggacaagcacatggcaatctcaaggcagctttccacggagcaggctgttctgcaagagtcgctggagaaggagtcgaaagtcaacaagcgactctctatggaaaacgaggagcttctgtggaaactgcacaatggggacctgtgtagccccaagagatcccccacatcctccgccatccctttgcagtcaccaaggaattcgggctccttccctagccccagcatttcacccagatgacacctccccaaagtccacagactctctgaaagcattttgatgcaggtctgcaggactgaccccaaggaggaacgtgggcacaagaggtatatcagcacacgtgtgatcaccgtagggtaactggagcgtcaccaccggcggaatcgcagcttctgagactggaactctggaggaagacttttgcctccgtccaaaagattcctccaaaaaaagatttaaaaaaagatttcggcatcgacacggacgttgttgcacaaagcacttaaagaacgagagcatcttgttcattgcctttttcacctaagcatagggggaaaaactctcagggccctattaagatttataacctttgtaatgttcttcaccacagacaccttcttgtgagttttcagtctgactgtgggggtggggggtgtgaatgaaatggatgtcacagagtgtcatgtgtctgatgcagcctcctctgctgtgtattaaatgtcaaaatctgaatatatctggatatgtactaatcaaataataatcaatcaatcagcatatacatttcagccaaagccatagaagaaaaagcaatagttgcttgaattatgatcatctaccaccaactctgctcagccctgtaacagggtagggagagggtataacaggaagagctttgacttgtccctgtctatacattctctgtatcttttgggggtaacttcttggcagtttttcagtgttcagccatgtcagttgaaactagatttttctgtagattttttacttacccatgtgagcctaacactatcctgtaattcattttctcaggctatgtgtaaatgtagaaccctaatttttctataaaaaaacaaactaactaactaactgtgtaaagaaagaaaaagggaagtaccaatgggtttttccaccttatttttacctttgatctacccttgcagatttaacctgtcttcttccctcccattattctcattttccttttacctttctccaccatccagagccacaaaagcaaaccttctacctcctacctacttttctctgggacaaggataaaggaatatgattttccagagccccagagccagctcatcttccaggtgctgaaaccactttccaaataaactaaagcctggatttgatattacaaattttgggaaatcttagaataaagaacgagaacaaggaagtcattggctagtataattaagaaaggtaggattcagtgcttaccgatgatgcagtacttgatagaagaaaacagtctgggaggatagcgctcatttttcagttaccctttaaggagtccctttgtctttgggaaagtagcagaatggtccgcttctttcccatgagtggaaaatgtggcttgtccaactctcctccaggttgcatttcagtttctttccaaaacttattacctcccctaatcctgagactttggaaaaggtggaaggaagaactgttgctttatctccccctccctgcatgtgtcaacattgtgatgtcagtatttactaatctacattcagtggctgtacaaataacagctgtagtaagaagagattcaggatgctagaggtgaatatttgggtcatttacatgtacactacatagcaagttgatactcatgttgcatgttcttttaaattagtgattttgtgtcttaagtctttaacttccaatacttcatcatgtatgtaaccttccatgtttgcttctgataaatggaaatgtaggttcactgccacttcatgagatatctctgctcacgcttccaagttgttctcaatgacattagccaaagttgggtttgccattcatcccctaggcatggtaaatcttgtgttgttccctgctgtcctccgtattacgtgaccggcaaataaatctcatagcagttaatataaaacatctttggaggatgggagagaacaggagggaagatgggaaacaaaatagagaattcttaagattttgtttaaaccaaatgtttcatgtagaatgcaaaatgttggcacgtcaaaaatatgaatgtgtagacaactgtagttgtgctcagtttgtagtgatgggaagtgtattttactctgatcaaataaataatgctggaatactcaagaattgc

SEQ ID NO: 153879 - DNA, 4089 bp, Homo sapiens
  Payload ID: 10250
  Gene Symbol: MTUS1
  Gene Name: microtubule associated tumor suppressor 1
  Uniprot ID: Q9ULD2
  ENST ID: ENST00000519263
  CDS Start-End: 175-3825
aaacattttatttcttccagggaacaacaaatcatttaatcttcagagcatcttagactgaaaacctttcaactgtgctgaaaaacctagaagacagaccattttgcccaccctctcatttaaaaggaattgaagaagaaataaaatggcagaggtttaaggttactattcaggatgactgatgataattcagatgataaaatagaagatgaattgcaaaccttctttaccagtgataaagatggaaatacacatgcatacaacccgaaatcaccacctacacaaaactcttcagccagcagtgtgaactggaattctgccaacccagatgacatggtggttgattatgaaactgaccctgctgtagttactggtgaaaatatttctttaagccttcagggtgttgaagtatttggtcatgaaaagtcttctagtgatttcattagtaagcaggtgttagatatgcataaagattctatttgtcagtgtcctgcacttgtaggtactgagaagcccaaatatctgcaacacagttgtcattccctagaagcagttgagggccagagtgttgagccatctttgccttttgtgtggaagcctaatgacaatttgaactgtgcaggctactgtgatgccttggagctaaaccaaacatttgacatgacagtggataaagttaactgcacctttatatcacatcatgccatcggaaagagtcagtccttccatactgctggaagcctgccaccaactggtaggagaagtggaagtacatcttctttatcctattccacttggacatcttcccattctgataagacgcatgcaagagaaactacttatgatagagaaagctttgaaaaccctcaagtcacaccatcagaagcccaagacatgacttacacagcattttctgatgtggtgatgcaaagtgaggtttttgtttcagatattggaaatcagtgtgcatgttcttcaggaaaggtcaccagtgagtacacagatggatcacaacaaagactagttggagaaaaggagacacaagcactaacaccagtttctgatggcatggaagtccccaatgattctgcattacaagagttcttttgtttatcccatgatgaatccaatagcgaaccacattcacagagctcatacaggcacaaggaaatgggccaaaatctgagagagacagtgtcctattgtcttattgatgatgaatgccctttaatggtgccagcttttgataagagcgaagctcaagtgctgaacccagagcataaagtcactgagactgaagacacacaaatggtctccaaaggaaaggatttgggaacccaaaatcatacctcagaattgattctaagtagcccgccaggacaaaaggtgggctcgtcatttggactgacttgggatgcaaatgatatggtcattagcacagacaaaacgatgtgcatgtcaacaccagtcctagaacccacaaaagtaaccttttctgtttcaccgattgaagcgacggagaaatgtaagaaagtggagaagggtaatcgagggcttaaaaacataccagactcgaaggaggcacctgtgaacctgtgtaaacccagtttaggaaaatcaacaatcaaaacgaataccccaataggctgcaaagttagaaaaactgaaattataagttacccaagaccaaacttcaagaatgtcaaagcaaaagttatgtctagagcagtgttgcagcccaaagatgctgctttatcaaaggtcacgcccagacctcagcagaccagtgcctcatcaccctcatcagtgaattcaagacaacaaacagtcttgagcagaacaccgagatctgacttgaatgcagacaaaaaagcagaaattctaattaacaagacacataagcagcagtttaataaactcattactagccaggctgtgcatgttacaactcattctaaaaatgcttcacacagggttccaagaacaacatctgccgtgaaatcgaatcaggaagatgttgacaaagccagttcttctaactcagcatgcgagaccgggtccgtttctgcgttgtttcagaagatcaaaggcatactccctgttaaaatggaaagtgcagaatgtttggaaatgacctatgttcccaacattgataggattagccctgaaaagaagggtgaaaaagaaaatgggacatctatggaaaaacaagagctgaaacaagagattatgaatgagacttttgaatatggttctctgtttttgggctctgcttcaaaaacaacgaccacctcaggtaggaatatatccaagcctgactcctgcggtttgaggcaaatagctgctccaaaagccaaagtggggccccctgtttcctgtttgaggcggaacagtgacaatagaaatcccagtgctgatcgagccgtatctcctcagaggatcaggcgtgtgtccagttctgctggtaatgccgctgtcatcaaatatgaggagaaacctccaaaaccagcatttcagaatggttcctcaggatccttttatttgaagcctttggtatccagggctcatgttcacttgatgaaaactcctccaaaaggtccttcgagaaaaaatttatttacagctcttaatgcagttgaaaagagcaggcaaaagaatcctcgaagcttatgtatccagccacagacagctcccgatgcgctgccccctgagaaaacacttgaattgacgcaatataaaacaaaatgtgaaaaccaaagtggatttatcctgcagctcaagcagcttcttgcctgtggtaataccaagtttgaggcattgacagttgtgattcagcacctgctgtctgagcgggaggaagcactgaaacaacacaaaaccctatctcaagaacttgttaacctccggggagagctagtcactgcttcaaccacctgtgagaaattagaaaaagccaggaatgagttacaaacagtgtatgaagcattcgtccagcagcaccaggctgaaaaaacagaacgagagaatcggcttaaagagttttacaccagggagtatgaaaagcttcgggacacttacattgaagaagcagagaagtacaaaatgcaattgcaagagcagtttgacaacttaaatgctgcgcatgaaacctctaagttggaaattgaagctagccactcagagaaacttgaattgctaaagaaggcctatgaagcctccctttcagaaattaagaaaggccatgaaatagaaaagaaatcgcttgaagatttactttctgagaagcaggaatcgctagagaagcaaatcaatgatctgaagagtgaaaatgatgctttaaatgaaaaattgaaatcagaagaacaaaaaagaagagcaagagaaaaagcaaatttgaaaaatcctcagatcatgtatctagaacaggagttagaaagcctgaaagctgtgttagagatcaagaatgagaaactgcatcaacaggacatcaagttaatgaaaatggagaaactggtggacaacaacacagcattggttgacaaattgaagcgtttccagcaggagaatgaagaattgaaagctcggatggacaagcacatggcaatctcaaggcagctttccacggagcaggctgttctgcaagagtcgctggagaaggagtcgaaagtcaacaagcgactctctatggaaaacgaggagcttctgtggaaactgcacaatggggacctgtgtagccccaagagatcccccacatcctccgccatccctttgcagtcaccaaggaattcgggctccttccctagccccagcatttcacccagatgacacctccccaaagtccacagactctctgaaagcattttgatgcaggtctgcaggactgaccccaaggaggaacgtgggcacaagaggtatatcagcacacgtgtgatcaccgtagggtaactggagcgtcaccaccggcggaatcgcagcttctgagactggaactctggaggaagacttttgcctccgtccaaaagattcctccaaaaaaagatttaaaaaaagatttcggcatcgacacggacgttgttgcacaaagcactt

SEQ ID NO: 153880 - DNA, 5205 bp, Homo sapiens
  Payload ID: 10250
  Gene Symbol: MTUS1
  Gene Name: microtubule associated tumor suppressor 1
  ENST ID: ENST00000520196
  CDS Start-End: 1-1517
gttcttcaggaaaggtcaccagtgagtacacagatggatcacaacaaagactagttggagaaaaggagacacaagcactaacaccagtttctgatggcatggaagtccccaatgattctgcattacaagagttcttttgtttatcccatgatgaatccaatagcgaaccacattcacagagctcatacaggcacaaggaaatgggccaaaatctgagagagacagtgtcctattgtcttattgatgatgaatgccctttaatggtgccagcttttgataagagcgaagctcaagtgctgaacccagagcataaagtcactgagactgaagacacacaaatggtctccaaaggaaaggatttgggaacccaaaatcatacctcagaattgattctaagtagcccgccaggacaaaaggtgggctcgtcatttggactgacttgggatgcaaatgatatggtcattagcacagacaaaacgatgtgcatgtcaacaccagtcctagaacccacaaaagtaaccttttctgtttcaccgattgaagcgacggagaaatgtaagaaagtggagaagggtaatcgagggcttaaaaacataccagactcgaaggaggcacctgtgaacctgtgtaaacccagtttaggaaaatcaacaatcaaaacgaataccccaataggctgcaaagttagaaaaactgaaattataagttacccaagaccaaacttcaagaatgtcaaagcaaaagttatgtctagagcagtgttgcagcccaaagatgctgctttatcaaaggtcacgcccagacctcagcagaccagtgcctcatcaccctcatcagtgaattcaagacaacaaacagtcttgagcagaacaccgagatctgacttgaatgcagacaaaaaagcagaaattctaattaacaagacacataagcagcagtttaataaactcattactagccaggctgtgcatgttacaactcattctaaaaatgcttcacacagggttccaagaacaacatctgccgtgaaatcgaatcaggaagatgttgacaaagccagttcttctaactcagcatgcgagaccgggtccgtttctgcgttgtttcagaagatcaaaggcatactccctgttaaaatggaaagtgcagaatgtttggaaatgacctatgttcccaacattgataggattagccctgaaaagaagggtgaaaaagaaaatgggacatctatggaaaaacaagagctgaaacaagagattatgaatgagacttttgaatatggttctctgtttttgggctctgcttcaaaaacaacgaccacctcaggtaggaatatatccaagcctgactcctgcggtttgaggcaaatagctgctccaaaagccaaagtggggccccctgtttcctgtttgaggcggaacagtgacaatagaaatcccagtgctgatcgagccgtatctcctcagaggatcaggcgtgtgtccagttctgttttgccaaaagctgctttctcatgattattctgattgatcatctccttcagagaacatgtgaaagcctacatccttgaaaactgcacagtcgtcatgggtgaatttgcctagaccacttcctaaatccaaagcatctttgaaaagtcctgcgctgcggaggacaggaagcaccccctcaatagccagcacccacagtgagctgagcacttacagcaacaattctggtaatgccgctgtcatcaaatatgaggagaaacctccaaaaccagcatttcagaatggttcctcaggatccttttatttgaagcctttggtatccagggctcatgttcacttgatgaaaactcctccaaaaggtccttcgagaaaaaatttatttacagctcttaatgcagttgaaaagagcaggcaaaagaatcctcgaagcttatgtatccagccacagacagctcccgatgcgctgccccctgagaaaacacttgaattgacgcaatataaaacaaaatgtgaaaaccaaagtggatttatcctgcagctcaagcagcttcttgcctgtggtaataccaagtttgaggcattgacagttgtgattcagcacctgctgtctgagcgggaggaagcactgaaacaacacaaaaccctatctcaagaacttgttaacctccggggagagctagtcactgcttcaaccacctgtgagaaattagaaaaagccaggaatgagttacaaacagtgtatgaagcattcgtccagcagcaccaggctgaaaaaacagaacgagagaatcggcttaaagagttttacaccagggagtatgaaaagcttcgggacacttacattgaagaagcagagaagtacaaaatgcaattgcaagagcagtttgacaacttaaatgctgcgcatgaaacctctaagttggaaattgaagctagccactcagagaaacttgaattgctaaagaaggcctatgaagcctccctttcagaaattaagaaaggccatgaaatagaaaagaaatcgcttgaagatttactttctgagaagcaggaatcgctagagaagcaaatcaatgatctgaagagtgaaaatgatgctttaaatgaaaaattgaaatcagaagaacaaaaaagaagagcaagagaaaaagcaaatttgaaaaatcctcagatcatgtatctagaacaggagttagaaagcctgaaagctgtgttagagatcaagaatgagaaactgcatcaacaggacatcaagttaatgaaaatggagaaactggtggacaacaacacagcattggttgacaaattgaagcgtttccagcaggagaatgaagaattgaaagctcggatggacaagcacatggcaatctcaaggcagctttccacggagcaggctgttctgcaagagtcgctggagaaggagtcgaaagtcaacaagcgactctctatggaaaacgaggagcttctgtggaaactgcacaatggggacctgtgtagccccaagagatcccccacatcctccgccatccctttgcagtcaccaaggaattcgggctccttccctagccccagcatttcacccagatgacacctccccaaagtccacagactctctgaaagcattttgatgcaggtctgcaggactgaccccaaggaggaacgtgggcacaagaggtatatcagcacacgtgtgatcaccgtagggtaactggagcgtcaccaccggcggaatcgcagcttctgagactggaactctggaggaagacttttgcctccgtccaaaagattcctccaaaaaaagatttaaaaaaagatttcggcatcgacacggacgttgttgcacaaagcacttaaagaacgagagcatcttgttcattgcctttttcacctaagcatagggggaaaaactctcagggccctattaagatttataacctttgtaatgttcttcaccacagacaccttcttgtgagttttcagtctgactgtgggggtggggggtgtgaatgaaatggatgtcacagagtgtcatgtgtctgatgcagcctcctctgctgtgtattaaatgtcaaaatctgaatatatctggatatgtactaatcaaataataatcaatcaatcagcatatacatttcagccaaagccatagaagaaaaagcaatagttgcttgaattatgatcatctaccaccaactctgctcagccctgtaacagggtagggagagggtataacaggaagagctttgacttgtccctgtctatacattctctgtatcttttgggggtaacttcttggcagtttttcagtgttcagccatgtcagttgaaactagatttttctgtagattttttacttacccatgtgagcctaacactatcctgtaattcattttctcaggctatgtgtaaatgtagaaccctaatttttctataaaaaaacaaactaactaactaactgtgtaaagaaagaaaaagggaagtaccaatgggtttttccaccttatttttacctttgatctacccttgcagatttaacctgtcttcttccctcccattattctcattttccttttacctttctccaccatccagagccacaaaagcaaaccttctacctcctacctacttttctctgggacaaggataaaggaatatgattttccagagccccagagccagctcatcttccaggtgctgaaaccactttccaaataaactaaagcctggatttgatattacaaattttgggaaatcttagaataaagaacgagaacaaggaagtcattggctagtataattaagaaaggtaggattcagtgcttaccgatgatgcagtacttgatagaagaaaacagtctgggaggatagcgctcatttttcagttaccctttaaggagtccctttgtctttgggaaagtagcagaatggtccgcttctttcccatgagtggaaaatgtggcttgtccaactctcctccaggttgcatttcagtttctttccaaaacttattacctcccctaatcctgagactttggaaaaggtggaaggaagaactgttgctttatctccccctccctgcatgtgtcaacattgtgatgtcagtatttactaatctacattcagtggctgtacaaataacagctgtagtaagaagagattcaggatgctagaggtgaatatttgggtcatttacatgtacactacatagcaagttgatactcatgttgcatgttcttttaaattagtgattttgtgtcttaagtctttaacttccaatacttcatcatgtatgtaaccttccatgtttgcttctgataaatggaaatgtaggttcactgccacttcatgagatatctctgctcacgcttccaagttgttctcaatgacattagccaaagttgggtttgccattcatcccctaggcatggtaaatcttgtgttgttccctgctgtcctccgtattacgtgaccggcaaataaatctcatagcagttaatataaaacatctttggaggatgggagagaacaggagggaagatgggaaacaaaatagagaattcttaagattttgtttaaaccaaatgtttcatgtagaatgcaaaatgttggcacgtcaaaaatatgaatgtgtagacaactgtagttgtgctcagtttgtagtgatgggaagtgtattttactctgatcaaataaataatgctggaatactcaagaa

SEQ ID NO: 153881 - DNA, 3650 bp, Homo sapiens
  Payload ID: 10250
  Gene Symbol: MTUS1
  Gene Name: microtubule associated tumor suppressor 1
  Uniprot ID: Q9ULD2
  ENST ID: ENST00000544260
  CDS Start-End: 272-1519
tatgagagtaagtagctgcataccctggcacttcaggaatactgggatatgtgacttgcaattaaacaggattgttaccagctttactgttggaattttgaaggtgtggcacaaaatcaggcttgcatgtaagagggaactctgaatttgaaaagctggtaatgccgctgtcatcaaatatgaggagaaacctccaaaaccagcatttcagaatggttcctcaggatccttttatttgaagcctttggtatccagggctcatgttcacttgatgaaaactcctccaaaaggtccttcgagaaaaaatttatttacagctcttaatgcagttgaaaagagcaggcaaaagaatcctcgaagcttatgtatccagccacagacagctcccgatgcgctgccccctgagaaaacacttgaattgacgcaatataaaacaaaatgtgaaaaccaaagtggatttatcctgcagctcaagcagcttcttgcctgtggtaataccaagtttgaggcattgacagttgtgattcagcacctgctgtctgagcgggaggaagcactgaaacaacacaaaaccctatctcaagaacttgttaacctccggggagagctagtcactgcttcaaccacctgtgagaaattagaaaaagccaggaatgagttacaaacagtgtatgaagcattcgtccagcagcaccaggctgaaaaaacagaacgagagaatcggcttaaagagttttacaccagggagtatgaaaagcttcgggacacttacattgaagaagcagagaagtacaaaatgcaattgcaagagcagtttgacaacttaaatgctgcgcatgaaacctctaagttggaaattgaagctagccactcagagaaacttgaattgctaaagaaggcctatgaagcctccctttcagaaattaagaaaggccatgaaatagaaaagaaatcgcttgaagatttactttctgagaagcaggaatcgctagagaagcaaatcaatgatctgaagagtgaaaatgatgctttaaatgaaaaattgaaatcagaagaacaaaaaagaagagcaagagaaaaagcaaatttgaaaaatcctcagatcatgtatctagaacaggagttagaaagcctgaaagctgtgttagagatcaagaatgagaaactgcatcaacaggacatcaagttaatgaaaatggagaaactggtggacaacaacacagcattggttgacaaattgaagcgtttccagcaggagaatgaagaattgaaagctcggatggacaagcacatggcaatctcaaggcagctttccacggagcaggctgttctgcaagagtcgctggagaaggagtcgaaagtcaacaagcgactctctatggaaaacgaggagcttctgtggaaactgcacaatggggacctgtgtagccccaagagatcccccacatcctccgccatccctttgcagtcaccaaggaattcgggctccttccctagccccagcatttcacccagatgacacctccccaaagtccacagactctctgaaagcattttgatgcaggtctgcaggactgaccccaaggaggaacgtgggcacaagaggtatatcagcacacgtgtgatcaccgtagggtaactggagcgtcaccaccggcggaatcgcagcttctgagactggaactctggaggaagacttttgcctccgtccaaaagattcctccaaaaaaagatttaaaaaaagatttcggcatcgacacggacgttgttgcacaaagcacttaaagaacgagagcatcttgttcattgcctttttcacctaagcatagggggaaaaactctcagggccctattaagatttataacctttgtaatgttcttcaccacagacaccttcttgtgagttttcagtctgactgtgggggtggggggtgtgaatgaaatggatgtcacagagtgtcatgtgtctgatgcagcctcctctgctgtgtattaaatgtcaaaatctgaatatatctggatatgtactaatcaaataataatcaatcaatcagcatatacatttcagccaaagccatagaagaaaaagcaatagttgcttgaattatgatcatctaccaccaactctgctcagccctgtaacagggtagggagagggtataacaggaagagctttgacttgtccctgtctatacattctctgtatcttttgggggtaacttcttggcagtttttcagtgttcagccatgtcagttgaaactagatttttctgtagattttttacttacccatgtgagcctaacactatcctgtaattcattttctcaggctatgtgtaaatgtagaaccctaatttttctataaaaaaacaaactaactaactaactgtgtaaagaaagaaaaagggaagtaccaatgggtttttccaccttatttttacctttgatctacccttgcagatttaacctgtcttcttccctcccattattctcattttccttttacctttctccaccatccagagccacaaaagcaaaccttctacctcctacctacttttctctgggacaaggataaaggaatatgattttccagagccccagagccagctcatcttccaggtgctgaaaccactttccaaataaactaaagcctggatttgatattacaaattttgggaaatcttagaataaagaacgagaacaaggaagtcattggctagtataattaagaaaggtaggattcagtgcttaccgatgatgcagtacttgatagaagaaaacagtctgggaggatagcgctcatttttcagttaccctttaaggagtccctttgtctttgggaaagtagcagaatggtccgcttctttcccatgagtggaaaatgtggcttgtccaactctcctccaggttgcatttcagtttctttccaaaacttattacctcccctaatcctgagactttggaaaaggtggaaggaagaactgttgctttatctccccctccctgcatgtgtcaacattgtgatgtcagtatttactaatctacattcagtggctgtacaaataacagctgtagtaagaagagattcaggatgctagaggtgaatatttgggtcatttacatgtacactacatagcaagttgatactcatgttgcatgttcttttaaattagtgattttgtgtcttaagtctttaacttccaatacttcatcatgtatgtaaccttccatgtttgcttctgataaatggaaatgtaggttcactgccacttcatgagatatctctgctcacgcttccaagttgttctcaatgacattagccaaagttgggtttgccattcatcccctaggcatggtaaatcttgtgttgttccctgctgtcctccgtattacgtgaccggcaaataaatctcatagcagttaatataaaacatctttggaggatgggagagaacaggagggaagatgggaaacaaaatagagaattcttaagattttgtttaaaccaaatgtttcatgtagaatgcaaaatgttggcacgtcaaaaatatgaatgtgtagacaactgtagttgtgctcagtttgtagtgatgggaagtgtattttactctgatcaaataaataatgctggaatactcaagaattgc

SEQ ID NO: 153882 - DNA, 567 bp, Homo sapiens
  Payload ID: 10250
  Gene Symbol: MTUS1
  Gene Name: microtubule associated tumor suppressor 1
  ENST ID: ENST00000519066
  CDS Start-End: 166-291
gcacacggtaacctgcaggacatgaagtaagacgcccgagggccaatggcgcgcctcctgctagagctttgaatgtagacagacccgactggtgggtggcgcggccacctgtatgcttcttgcacagtgcgaggggtggggggacttggagacagaagctggaaaatgggctgccccagcagcaaactgtgcctctattctccatgtgcagcaacaaggcgggaggaagcactgaaacaacacaaaaccctatctcaagaacttgttaacctccggggagagctagcttgaccttcagttcacagaattcctggcactgatctgactaagcctagcagaacttctgatgagcaaaatatttctcttgctgaagagagggacagagttatttttgtaattgtgtgaattcctgttaaataatgttgtcatttttttttctgaagcacttttcatatgagaatagtgaaagtttcccctcttgataaacagtaaatccgttgtacttccaagggttggtttgtgagtagtgagtatgaagttgaaaggatgctgtccatgaaggcaact

SEQ ID NO: 153883 - DNA, 1193 bp, Homo sapiens
  Payload ID: 10250
  Gene Symbol: MTUS1
  Gene Name: microtubule associated tumor suppressor 1
  ENST ID: ENST00000634613
  CDS Start-End: 165-1193
cacacggtaacctgcaggacatgaagtaagacgcccgagggccaatggcgcgcctcctgctagagctttgaatgtagacagacccgactggtgggtggcgcggccacctgtatgcttcttgcacagtgcgaggggtggggggacttggagacagaagctggaaaatgggctgccccagcagcaaactgtgcctctattctccatgtgcagcaacaaggcgggaggaagcactgaaacaacacaaaaccctatctcaagaacttgttaacctccggggagagctagtcactgcttcaaccacctgtgagaaattagaaaaagccaggaatgagttacaaacagtgtatgaagcattcgtccagcagcaccaggctgaaaaaacagaacgagagaatcggcttaaagagttttacaccagggagtatgaaaagcttcgggacacttacattgaagaagcagagaagtacaaaatgcaattgcaagagcagtttgacaacttaaatgctgcgcatgaaacctctaagttggaaattgaagctagccactcagagaaacttgaattgctaaagaaggcctatgaagcctccctttcagaaattaagaaaggccatgaaatagaaaagaaatcgcttgaagatttactttctgagaagcaggaatcgctagagaagcaaatcaatgatctgaagagtgaaaatgatgctttaaatgaaaaattgaaatcagaagaacaaaaaagaagagcaagagaaaaagcaaatttgaaaaatcctcagatcatgtatctagaacaggagttagaaagcctgaaagctgtgttagagatcaagaatgagaaactgcatcaacaggacatcaagttaatgaaaatggagaaactggtggacaacaacacagcattggttgacaaattgaagcgtttccagcaggagaatgaagaattgaaagctcggatggacaagcacatggcaatctcaaggcagctttccacggagcaggctgttctgcaagagtcgctggagaaggagtcgaaagtcaacaagcgactctctatggaaaacgaggagcttctgtggaaactgcacaatggggacctgtgtagccccaagagatcccccacatcctccgccatccctttgcagtcaccaaggaattcgggctccttccctagccccagcatttcacccagatga

SEQ ID NO: 153884 - DNA, 1793 bp, Homo sapiens
  Payload ID: 10251
  Gene Symbol: MTUS2
  Gene Name: microtubule associated tumor suppressor candidate 2
  Uniprot ID: Q5JR59
  ENST ID: ENST00000380808
  CDS Start-End: 217-1263
agatctgatcgctgctgccctgctctcctcctcctctcattcctctgcctcctggattcctgaagtttaggagaaataaggtagccaagggaaccacatggaagttgtgacagctcccagcggcgcgcccctttcgtgtgtgccggtacctcggcttaggagttgcccgctgacaccttgaatgaaggaggtccccttgccagccagcctgccgggatgggccattgctgctgcaagccttataactgccttcagtgcctggacaagacgaatgaaagtgcccttgtgaaagaaaaagagctgtcaatcgaacttgcaaacatcagggatgaagttgccttccatacagcaaagtgcgagaaactacaaaaggagaaggaggagctggagaggcggttcgaggacgaggtgaagaggctgggctggcagcagcaggccgagctccaggagctggaggagcggctgcagctgcaattcgaggcggaaatggcgcgcctgcaggaggagcacggtgaccagctgctgagcatccggtgtcaacaccaggagcaggtggaagatctcaccgccagccatgatgctgctctcctagagatggaaaataaccacacagttgccatcacaatcctgcaggatgaccacgaccacaaagtccaagaattgatgtccactcatgagcttgaaaagaaagaattggaagaaaattttgaaaaactgcggctgtcattgcaggaccaggtggacacgctgaccttccagagccagtctctgcgggacagagcccgccgcttcgaagaggccttgaggaagaacacagaggagcagctggagattgcattggctccttatcagcacttggaagaagacatgaagagtctgaagcaggtattagaaatgaagaatcagcaaatacacgagcaagaaaagaagattcttgagctggaaaagctggcagaaaagaacattatcctagaagaaaagatccaggttctccaacagcagaacgaagacctcaaagcaaggattgaccaaaacacagttgtcaccagacagctgtcggaggaaaatgctaacctccaggaatatgttgagaaggaaacccaggagaagaagagattgagccgaaccaatgaagagctgctttggaagctccaaactggggacccgaccagtccgattaaactctcgcccacatctcccgtttaccgcggctcctcctcggggccctcctctccggccagagtcagcacaacacccagatgacgccactacacggcctgcgggagctccggcttctcgtcctccggtctccaccctgagggagcaccgacccggtgccgccggagctggccctgtgcgcatgctcagtagctgcgaatgcatcctaggcgcgtcctcctctgatccccgtgtaagactgccctggtgtcggcacttaggaatgtgtaaatggtaaagtctgatgtgcaaacgttttaccatagttagagccaaaagaaagacacttgcaattgttcttgagcaatgaactttcactgcagaatttcaggttagttacaaaaagctcagttttcaatatacattgaataatcattgtgtactgcaccgatatgtgtgtatatttagatatacgtatatacacatgctgcggttctgaatttcattttttataacatgaagtgctgacatattttagtgaaggtcagcagttttctaacttgtgcctaagaattattgggaaatgaaaatgcatttctatctagcttcccaggaatatttctacccaaaataga

SEQ ID NO: 153885 - DNA, 6938 bp, Homo sapiens
  Payload ID: 10251
  Gene Symbol: MTUS2
  Gene Name: microtubule associated tumor suppressor candidate 2
  ENST ID: ENST00000431530
  CDS Start-End: 59-4198
atttcctcttaatctgattgcagcttgaaggcagcccatttccattaagtaggactgcatggcaagcagccccaccaaagggttgacaatgagcgtcccagtggctcctaagaaatcatgttacactcagttgcgggacaacagaaatgcagcaagaaataataatgaaagcatcttaagtctgggagatacgaatgccaatcaaatcatgttggaggtcagctcctctcatgacgagtccaagacatgtgacctgggagatgaaattggaaatacaaattcaagtgagccagaaaaccgtacccatttccataaggaatttcaccaacttcagggctttgggaaaggctctcaggctggctctgccagcctgaaagattttagactttcttcaaccattcagagggaactcaatgaagagcacacagtggagagaggcacagatagcctgcagaccacgcggagtattcagggaccaagtctgtcgagttggaggaatgtgatgagtgaggccagtctagacgttttggctaaaagggatgctgaaattccccggcatgttcccaaggataaactggcaaagacccttgacaatgaggaactgaggaggcattctttggaaagagcaagcagctctgtagctgcagtcgggagcctgactccgcagcatccacagcctctatccctcgactcccgggaagcacggggtcagatacctgggggtggggaggggccacagaagacattgccagaccacgctgtcccggcagctttccctgcaactgacagtacctcagagggaaagagtgtgcgtcatcctaaaccatctacctcagaaagcaagcagagcactccctcagagacccaaacagtgggggcacatgtactgcaggtgtgcagtgagcacacatcacattccgcccatccagagcctgctctgaatttgactttggcatcgaaggaaatcccaagtaaactggaagcacaattaggtcagggaaagggagaggccaagctggatctgaaatatgttcctcccaggagagttgaacaggagggaaaggcagcccaggaagggtatctgggatgccacaaggaagagaatctgtcagccttggagggaagggatccatgtggggaagcacacccggaagccaccgatgcacttggccatctgctgaacagtgacctccaccaccttggggtgggaagaggcaactgtgaagagaagagaggagtcaacccaggggagcaggattctctccacaccacccccaaacagggctctgcttccttaggaggggctgataatcagcccactggcaaaatttcaccatgtgcaggtgagaagttgggtgaaaggacatccagcagcttttcaccaggtgacagtcatgtggcttttattcctaataatctgactgacagcaagcccttggatgtcattgaggaggaaaggcggttgggcagtgggaataaggacagtgttatggttttggtgttcaatccttctgttggagagaacaagacggaggtgcctgagcccctggaccctcaaagtggccgctcagaagcacgggaaagcaaagaggtcaccacatctgttgctgaaaacaggaaccttctagagaatgcagataagattgaaagcacctcagcaagagcagattcagttctcaatattccagcacccctccacccagagacaactgtgaacatgacctaccagcctacaacacccagtagcagttttcaggatgttagcgtgttcggtatggatgcggggtcccccttggtagttccaccccctactgatagtgcacgcttgttgaacacgtcccccaaagtgcctgacaagaacacttgccccagtgggatccccaagcctgtcttcacacattccaaggacacaccttcctcgcaggagggaatggagaactatcaggttgaaaaaacagaggagaggacagaaactaagcccatcattatgcccaagcccaagcatgtgaggcccaagatcatcacctacatcaggaggaatccccaggccctgggccaggtggacgcctcgctggttccagtggggcttccatatgccccgcccacatgtaccatgcctcttccccacgaagagaaggcagcaggtggtgacctgaagccatctgccaacctctatgagaaattcaagccagacctgcagaagccaagggtcttcagttccggattgatggtgtctggaatcaagcccccgggacatcctttcagtcaaatgagtgaaaagtttttgcaggaggttacagaccaccctggaaaagaagagttttgttctcctccctatgctcattatgaagtccctccaactttctatcggtcagccatgctccttaagccccagctaggattgggtgcaatgtcccgtttaccatctgcaaagagcaggattctgattgcaagtcagaggtcttcagcgagcgccatccacccaccaggacccataacaacagccaccagtctctacagttccgatccttcagcagatttaaagaaagcttccagttcaaatgctgcaaaatccaatctcccgaaatctggtctccgtcctcccggatactcacgtctcccggcagccaaactggcggcatttggctttgtccggagctccagcgtctcctcagtctccagcacccagtccggggacagtgcacagccagagcagggccggccagccacccgttcaacctttgggaatgaagaacagccagttctgaaggcatctctgccttctaaggacacacccaagggggccggccgggtggcccctccagcatcctccagtgtgacagcaccccgcaggagtttacttccagcgccaaaatccacttccacacccgctggaacaaagaaagatgctcagaaagatcaagatacgaataaacctgctgtttcatctcctaagagagtagcagcttcaaccaccaagcttcattcaccaggatacccaaagcagaggactgcggcagctcgaaatgggtttccgcccaagccggacccgcaggcccgtgaggctgagcggcagctggtgctgcggctgaaggagcggtgtgagcagcagaccagacagctgggcgttgcgcaaggggagctgaagagggccatctgcggctttgatgccctcgccgtggccacgcagcatttctttagaaagaatgaaagtgcccttgtgaaagaaaaagagctgtcaatcgaacttgcaaacatcagggatgaagttgccttccatacagcaaagtgcgagaaactacaaaaggagaaggaggagctggagaggcggttcgaggacgaggtgaagaggctgggctggcagcagcaggccgagctccaggagctggaggagcggctgcagctgcaattcgaggcggaaatggcgcgcctgcaggaggagcacggtgaccagctgctgagcatccggtgtcaacaccaggagcaggtggaagatctcaccgccagccatgatgctgctctcctagagatggaaaataaccacacagttgccatcacaatcctgcaggatgaccacgaccacaaagtccaagaattgatgtccactcatgagcttgaaaagaaagaattggaagaaaattttgaaaaactgcggctgtcattgcaggaccaggtggacacgctgaccttccagagccagtctctgcgggacagagcccgccgcttcgaagaggccttgaggaagaacacagaggagcagctggagattgcattggctccttatcagcacttggaagaagacatgaagagtctgaagcaggtattagaaatgaagaatcagcaaatacacgagcaagaaaagaagattcttgagctggaaaagctggcagaaaagaacattatcctagaagaaaagatccaggttctccaacagcagaacgaagacctcaaagcaaggattgaccaaaacacagttgtcaccagacagctgtcggaggaaaatgctaacctccaggaatatgttgagaaggaaacccaggagaagaagagattgagccgaaccaatgaagagctgctttggaagctccaaactggggacccgaccagtccgattaaactctcgcccacatctcccgtttaccgcggctcctcctcggggccctcctctccggccagagtcagcacaacacccagatgacgccactacacggcctgcgggagctccggcttctcgtcctccggtctccaccctgagggagcaccgacccggtgccgccggagctggccctgtgcgcatgctcagtagctgcgaatgcatcctaggcgcgtcctcctctgatccccgtgtaagactgccctggtgtcggcacttaggaatgtgtaaatggtaaagtctgatgtgcaaacgttttaccatagttagagccaaaagaaagacacttgcaattgttcttgagcaatgaactttcactgcagaatttcaggttagttacaaaaagctcagttttcaatatacattgaataatcattgtgtactgcaccgatatgtgtgtatatttagatatacgtatatacacatgctgcggttctgaatttcattttttataacatgaagtgctgacatattttagtgaaggtcagcagttttctaacttgtgcctaagaattattgggaaatgaaaatgcatttctatctagcttcccaggaatatttctacccaaaatagaaaaaggaaaaaaaaaaagatacagagaagaagcgcctttcaactcaccaccaagtggtactctctttaacacgaacaccagctatttgtgaacggtaactgcctttggaacaatcagcttctcagtcaacatgatgtgagatcactattattccattcgcaagttttaattattgatactcctgtcatgagcggataagggagagcagtgggaaaccctaagggggtttagcagttttgcagatgttacccatgacagtgactcatctctgatagtcttgtaaacacaagttttgcttttttcctaaatggcatctcagactcggtcattaagctattgttgcaccctccggaaaacatggcagagcatgacctttgagtaagagtgaggatgaccttgcagatgactgtgcccattcgcgctccatcctcatgaaggaaattgctgccaaggtctgtattttgaccaggcacagagggggaacatcactccagctttccatgtggttcactctgatgcgatgctgtaaatgatcaactctttgaaataggaccctcaggcccccatttcctagcagccccccttcagtttggttctacaactcaaccccttcactgcacattgagatggctcaggggttctagcaggggcttccagaaaaaaaaaacaccatttctgtcccgggggaccagttctgagctgtgctagatcatcacacgaccacccagaaacccacttgcacttcctgctggatgatcaggcaacgctgctgctgaccgtgctcccatcttagacccagaaggttctcccaaacagaggagcccagtgaaacagccagccagggggcaccagctcctggactggcatctgtctctaaaatggtagaattaggatatgaacagtactcatgtagtggtgtggaagattaggagcatgatacacaaaaggaagaagtagttttaacagatatggtgatgatgatgatgcccttgtttcctgtatgtgacaaagaccctgcactttctccctgagacccccccaaaattgtcctgagcacaggcctgtctttgagcgtgcccaaggcgagaagaaccatgagggggtcctgcaggggccggagccatggaacggggaagaaaacagcccgcggacggggtcggcttgtccagggcacgcctgctcggcacacgtgttgccaacgtgaaggcagacatggtccctggccctaggatgagtccacgctgggcttccgggcctcaggtgcatctccagccaacctccaagggtcttgctccttctggggacgtacacagtaaatccacatggaaacaccaccatttctctttgctttagtggctctgcatgatactgtgatattgagttgggcattccattagagtagatcttgccacattgactaaatacacaagtatttattctagtagcaggcacaacctgcaaacacaaattcagttacagcttagctgtccgaattaggaaccgcttacatagccgcacctgctaaatgcagttacacagcaatactgacttccgtgtgatgctagaacgtggtacagtgtattaggctgctgtggtcagagttgtagcatcgttagcactaagtaattcctcattaggtggacttcggtgagagctttgccctaacctgccctgaccttgggtacttgagctaatttccacgtggccctggcttcgtggtttgtttgttttttttcttttgttacggacacccatcatgtatggctcctcatctgagccatcaccgctcccgaaacacatggggcggcagctgctgtgcctccttctcaattcttccacccccccacaccatcagaattcggatttctctccacgtggcgtctgcctctgtccccttccaggctggagcgacgtttccacgttcggatgctgcagcctctgcacctgcctcagacagacccaccagataccacctgtctcttcgtggcatttgggagatgcgtgggcggcctgccccccgaccgccgcccctgcccaccacatgctgggacaaggttctggctggatgtcagaatggatgggggtgggggcagccctggccgtgattagttgaatgaatggggtcacaacatcccttttcctgcccctacagtttgtgttgcatatttgtgtttaaagcctattaaaataaacttgagggactttctgcg

SEQ ID NO: 153886 - DNA, 1165 bp, Homo sapiens
  Payload ID: 10251
  Gene Symbol: MTUS2
  Gene Name: microtubule associated tumor suppressor candidate 2
  Uniprot ID: Q5JR59
  ENST ID: ENST00000542829
  CDS Start-End: 338-1114
agccaagggaaccacatggaagttgtgacagctcccagcggcgcgcccctttcgtgtgtgccggtacctcggcttaggagttgcccgctgacaccttgaatgaaggaggtccccttgccagccagcctgccgggatgggccattgctgctgcaagccttataactgccttcagtgcctggacaagacgccttccatacagcaaagtgcgagaaactacaaaaggagaaggaggagctggagaggcggttcgaggacgaggtgaagaggctgggctggcagcagcaggccgagctccaggagctggaggagcggctgcagctgcaattcgaggcggaaatggcgcgcctgcaggaggagcacggtgaccagctgctgagcatccggtgtcaacaccaggagcaggtggaagatctcaccgccagccatgatgctgctctcctagagatggaaaataaccacacagttgccatcacaatcctgcaggatgaccacgaccacaaagtccaagaattgatgtccactcatgagcttgaaaagaaagaattggaagaaaattttgaaaaactgcggctgtcattgcaggaccaggtggacacgctgaccttccagagccagtctctgcgggacagagcccgccgcttcgaagaggccttgaggaagaacacagaggagcagctggagattgcattggctccttatcagcacttggaagaagacatgaagagtctgaagcaggtattagaaatgaagaatcagcaaatacacgagcaagaaaagaagattcttgagctggaaaagctggcagaaaagaacattatcctagaagaaaagatccaggttctccaacagcagaacgaagacctcaaagcaaggattgaccaaaacacagttgtcaccagacagctgtcggaggaaaatgctaacctccaggaatatgttgagaaggaaacccaggagaagaagagattgagccgaaccaatgaagagctgctttggaagctccaaactggggacccgaccagtccgattaaactctcgcccacatctcccgtttaccgcggctcctcctcggggccctcctctccggccagagtcagcacaacacccagatgacgccactacacggcctgcgggagctccggcttctcgtcctccggtctccac

SEQ ID NO: 153887 - DNA, 7430 bp, Homo sapiens
  Payload ID: 10251
  Gene Symbol: MTUS2
  Gene Name: microtubule associated tumor suppressor candidate 2
  ENST ID: ENST00000612955
  CDS Start-End: 550-4689
agcgagcgccggcggctccaggtgcgggggcgcccctcgcgctccacctgcgccgccgccgccggctctcagggcaagtttatctccccccttctgcggaaacccttgaccgcttagcggagtacagacctgtcggtaaatagaaaactcgagctggagaggaggaggaagcagcgtggcggaacccggcccgagatgagcgtctccgtgagggcagtggtggcctcttggacattacatctttcttggctctttttgacccaggtttccacagctggattgtttactagggccaattgtcaccaatggcagtaaaactcattttctggggaatagggtctcatggactgattggctctcattcagcaggaacctaacagataagtcttcctgctgtatatcaagacaatgcttggttttcaagctgttctgagaatgattaaagcagtgtcgcaaggtgacattgtcaggggagaacaagcagcttgagaatttcctcttaatctgattgcagcttgaaggcagcccatttccattaagtaggactgcatggcaagcagccccaccaaagggttgacaatgagcgtcccagtggctcctaagaaatcatgttacactcagttgcgggacaacagaaatgcagcaagaaataataatgaaagcatcttaagtctgggagatacgaatgccaatcaaatcatgttggaggtcagctcctctcatgacgagtccaagacatgtgacctgggagatgaaattggaaatacaaattcaagtgagccagaaaaccgtacccatttccataaggaatttcaccaacttcagggctttgggaaaggctctcaggctggctctgccagcctgaaagattttagactttcttcaaccattcagagggaactcaatgaagagcacacagtggagagaggcacagatagcctgcagaccacgcggagtattcagggaccaagtctgtcgagttggaggaatgtgatgagtgaggccagtctagacgttttggctaaaagggatgctgaaattccccggcatgttcccaaggataaactggcaaagacccttgacaatgaggaactgaggaggcattctttggaaagagcaagcagctctgtagctgcagtcgggagcctgactccgcagcatccacagcctctatccctcgactcccgggaagcacggggtcagatacctgggggtggggaggggccacagaagacattgccagaccacgctgtcccggcagctttccctgcaactgacagtacctcagagggaaagagtgtgcgtcatcctaaaccatctacctcagaaagcaagcagagcactccctcagagacccaaacagtgggggcacatgtactgcaggtgtgcagtgagcacacatcacattccgcccatccagagcctgctctgaatttgactttggcatcgaaggaaatcccaagtaaactggaagcacaattaggtcagggaaagggagaggccaagctggatctgaaatatgttcctcccaggagagttgaacaggagggaaaggcagcccaggaagggtatctgggatgccacaaggaagagaatctgtcagccttggagggaagggatccatgtggggaagcacacccggaagccaccgatgcacttggccatctgctgaacagtgacctccaccaccttggggtgggaagaggcaactgtgaagagaagagaggagtcaacccaggggagcaggattctctccacaccacccccaaacagggctctgcttccttaggaggggctgataatcagcccactggcaaaatttcaccatgtgcaggtgagaagttgggtgaaaggacatccagcagcttttcaccaggtgacagtcatgtggcttttattcctaataatctgactgacagcaagcccttggatgtcattgaggaggaaaggcggttgggcagtgggaataaggacagtgttatggttttggtgttcaatccttctgttggagagaacaagacggaggtgcctgagcccctggaccctcaaagtggccgctcagaagcacgggaaagcaaagaggtcaccacatctgttgctgaaaacaggaaccttctagagaatgcagataagattgaaagcacctcagcaagagcagattcagttctcaatattccagcacccctccacccagagacaactgtgaacatgacctaccagcctacaacacccagtagcagttttcaggatgttagcgtgttcggtatggatgcggggtcccccttggtagttccaccccctactgatagtgcacgcttgttgaacacgtcccccaaagtgcctgacaagaacacttgccccagtgggatccccaagcctgtcttcacacattccaaggacacaccttcctcgcaggagggaatggagaactatcaggttgaaaaaacagaggagaggacagaaactaagcccatcattatgcccaagcccaagcatgtgaggcccaagatcatcacctacatcaggaggaatccccaggccctgggccaggtggacgcctcgctggttccagtggggcttccatatgccccgcccacatgtaccatgcctcttccccacgaagagaaggcagcaggtggtgacctgaagccatctgccaacctctatgagaaattcaagccagacctgcagaagccaagggtcttcagttccggattgatggtgtctggaatcaagcccccgggacatcctttcagtcaaatgagtgaaaagtttttgcaggaggttacagaccaccctggaaaagaagagttttgttctcctccctatgctcattatgaagtccctccaactttctatcggtcagccatgctccttaagccccagctaggattgggtgcaatgtcccgtttaccatctgcaaagagcaggattctgattgcaagtcagaggtcttcagcgagcgccatccacccaccaggacccataacaacagccaccagtctctacagttccgatccttcagcagatttaaagaaagcttccagttcaaatgctgcaaaatccaatctcccgaaatctggtctccgtcctcccggatactcacgtctcccggcagccaaactggcggcatttggctttgtccggagctccagcgtctcctcagtctccagcacccagtccggggacagtgcacagccagagcagggccggccagccacccgttcaacctttgggaatgaagaacagccagttctgaaggcatctctgccttctaaggacacacccaagggggccggccgggtggcccctccagcatcctccagtgtgacagcaccccgcaggagtttacttccagcgccaaaatccacttccacacccgctggaacaaagaaagatgctcagaaagatcaagatacgaataaacctgctgtttcatctcctaagagagtagcagcttcaaccaccaagcttcattcaccaggatacccaaagcagaggactgcggcagctcgaaatgggtttccgcccaagccggacccgcaggcccgtgaggctgagcggcagctggtgctgcggctgaaggagcggtgtgagcagcagaccagacagctgggcgttgcgcaaggggagctgaagagggccatctgcggctttgatgccctcgccgtggccacgcagcatttctttagaaagaatgaaagtgcccttgtgaaagaaaaagagctgtcaatcgaacttgcaaacatcagggatgaagttgccttccatacagcaaagtgcgagaaactacaaaaggagaaggaggagctggagaggcggttcgaggacgaggtgaagaggctgggctggcagcagcaggccgagctccaggagctggaggagcggctgcagctgcaattcgaggcggaaatggcgcgcctgcaggaggagcacggtgaccagctgctgagcatccggtgtcaacaccaggagcaggtggaagatctcaccgccagccatgatgctgctctcctagagatggaaaataaccacacagttgccatcacaatcctgcaggatgaccacgaccacaaagtccaagaattgatgtccactcatgagcttgaaaagaaagaattggaagaaaattttgaaaaactgcggctgtcattgcaggaccaggtggacacgctgaccttccagagccagtctctgcgggacagagcccgccgcttcgaagaggccttgaggaagaacacagaggagcagctggagattgcattggctccttatcagcacttggaagaagacatgaagagtctgaagcaggtattagaaatgaagaatcagcaaatacacgagcaagaaaagaagattcttgagctggaaaagctggcagaaaagaacattatcctagaagaaaagatccaggttctccaacagcagaacgaagacctcaaagcaaggattgaccaaaacacagttgtcaccagacagctgtcggaggaaaatgctaacctccaggaatatgttgagaaggaaacccaggagaagaagagattgagccgaaccaatgaagagctgctttggaagctccaaactggggacccgaccagtccgattaaactctcgcccacatctcccgtttaccgcggctcctcctcggggccctcctctccggccagagtcagcacaacacccagatgacgccactacacggcctgcgggagctccggcttctcgtcctccggtctccaccctgagggagcaccgacccggtgccgccggagctggccctgtgcgcatgctcagtagctgcgaatgcatcctaggcgcgtcctcctctgatccccgtgtaagactgccctggtgtcggcacttaggaatgtgtaaatggtaaagtctgatgtgcaaacgttttaccatagttagagccaaaagaaagacacttgcaattgttcttgagcaatgaactttcactgcagaatttcaggttagttacaaaaagctcagttttcaatatacattgaataatcattgtgtactgcaccgatatgtgtgtatatttagatatacgtatatacacatgctgcggttctgaatttcattttttataacatgaagtgctgacatattttagtgaaggtcagcagttttctaacttgtgcctaagaattattgggaaatgaaaatgcatttctatctagcttcccaggaatatttctacccaaaatagaaaaaggaaaaaaaaaaagatacagagaagaagcgcctttcaactcaccaccaagtggtactctctttaacacgaacaccagctatttgtgaacggtaactgcctttggaacaatcagcttctcagtcaacatgatgtgagatcactattattccattcgcaagttttaattattgatactcctgtcatgagcggataagggagagcagtgggaaaccctaagggggtttagcagttttgcagatgttacccatgacagtgactcatctctgatagtcttgtaaacacaagttttgcttttttcctaaatggcatctcagactcggtcattaagctattgttgcaccctccggaaaacatggcagagcatgacctttgagtaagagtgaggatgaccttgcagatgactgtgcccattcgcgctccatcctcatgaaggaaattgctgccaaggtctgtattttgaccaggcacagagggggaacatcactccagctttccatgtggttcactctgatgcgatgctgtaaatgatcaactctttgaaataggaccctcaggcccccatttcctagcagccccccttcagtttggttctacaactcaaccccttcactgcacattgagatggctcaggggttctagcaggggcttccagaaaaaaaaaacaccatttctgtcccgggggaccagttctgagctgtgctagatcatcacacgaccacccagaaacccacttgcacttcctgctggatgatcaggcaacgctgctgctgaccgtgctcccatcttagacccagaaggttctcccaaacagaggagcccagtgaaacagccagccagggggcaccagctcctggactggcatctgtctctaaaatggtagaattaggatatgaacagtactcatgtagtggtgtggaagattaggagcatgatacacaaaaggaagaagtagttttaacagatatggtgatgatgatgatgcccttgtttcctgtatgtgacaaagaccctgcactttctccctgagacccccccaaaattgtcctgagcacaggcctgtctttgagcgtgcccaaggcgagaagaaccatgagggggtcctgcaggggccggagccatggaacggggaagaaaacagcccgcggacggggtcggcttgtccagggcacgcctgctcggcacacgtgttgccaacgtgaaggcagacatggtccctggccctaggatgagtccacgctgggcttccgggcctcaggtgcatctccagccaacctccaagggtcttgctccttctggggacgtacacagtaaatccacatggaaacaccaccatttctctttgctttagtggctctgcatgatactgtgatattgagttgggcattccattagagtagatcttgccacattgactaaatacacaagtatttattctagtagcaggcacaacctgcaaacacaaattcagttacagcttagctgtccgaattaggaaccgcttacatagccgcacctgctaaatgcagttacacagcaatactgacttccgtgtgatgctagaacgtggtacagtgtattaggctgctgtggtcagagttgtagcatcgttagcactaagtaattcctcattaggtggacttcggtgagagctttgccctaacctgccctgaccttgggtacttgagctaatttccacgtggccctggcttcgtggtttgtttgttttttttcttttgttacggacacccatcatgtatggctcctcatctgagccatcaccgctcccgaaacacatggggcggcagctgctgtgcctccttctcaattcttccacccccccacaccatcagaattcggatttctctccacgtggcgtctgcctctgtccccttccaggctggagcgacgtttccacgttcggatgctgcagcctctgcacctgcctcagacagacccaccagataccacctgtctcttcgtggcatttgggagatgcgtgggcggcctgccccccgaccgccgcccctgcccaccacatgctgggacaaggttctggctggatgtcagaatggatgggggtgggggcagccctggccgtgattagttgaatgaatggggtcacaacatcccttttcctgcccctacagtttgtgttgcatatttgtgtttaaagcctattaaaataaacttgagggactttctgcga

SEQ ID NO: 153888 - DNA, 5718 bp, Homo sapiens
  Payload ID: 10252
  Gene Symbol: MTCL1
  Gene Name: microtubule crosslinking factor 1
  Uniprot ID: Q9Y4B5
  ENST ID: ENST00000306329
  CDS Start-End: 1-5718
atggagacactgaacggccccgcgggcggaggtgccccggacgcgaagctgcagccgcccggccagcaccaccgccaccaccacctccacccggtggccgaaaggcggcggctgcaccgtgcgccctcgcccgccagacccttcctcaaggacctgcacgcccggcccgccgcgcccggcccggccgtcccctcctcgggccgagccccggctcccgccgccccgcgctcgcccaacctcgcgggcaaagcgccgccctcgccggggtccctggccgcgcccggccgcctctctcggcgcagtggcggcgtcccgggcgcgaaggacaagcccccgccgggcgccggggccagagcggcgggcggtgccaaggctgccctgggaagcaggagggcggcgcgcgtggcgcccgcggagccgctgtcccgggctgggaagcctcccggagccgagccgccgtctgccgctgccaagggccgcaaagccaagcgcggctcccgggcgccacccgcccgcaccgtcggccccccgaccccggccgcccggatccctgccgtgaccctcgcggtgacctcggtggccgggtccccggcccgctgctcgcgcatcagccacacggacagcagctccgacctctctgactgcccctccgaacccctgtccgacgagcagcgcctgctccctgccgccagcagcgacgccgaatccggcacgggctccagcgaccgtgaacccccacgaggagcgccgacgccgagccccgcagcccgaggagcgccgccgggcagccccgagcccccagcgctcctcgccgcgcccctcgccgcgggcgcctgtcccgggggccggagcatcccgagcggggtttcggggggtttcgcggggcccggcgtggcggaggatgtccgggggcgctcgccaccggagcgaccagtccccgggacccccaaggagcccagcctgggcgagcagtctcggctcgtgccagcggcggaggaagaagagctgctgcgggagatggaggagctgcgctcggagaacgactatctcaaggatgagttagatgaactccgtgctgagatggaagagatgagagacagttatttagaggaagatgtttaccagctgcaggaacttcggcgagaactggaccgcgctaataaaaactgccgaatcctgcagtaccgtcttcggaaagccgagcagaaaagcctgaaagtggctgagacgggtcaggtggatggtgagcttattcgaagcctggagcaggacttgaaggtagccaaagatgtatctgtcagattgcaccacgaacttaagacggtggaggaaaagcgcgctaaagctgaggatgaaaacgaaactctccgacagcagatgattgaagtggaaatatccaaacaggccctccagaatgagctggagagactgaaagagagttccctaaaaagaagaagcactcgggaaatgtacaaggagaagaaaacctttaaccaggatgacagtgccgatttgaggtgccagctccagtttgccaaagaggaagccttcctgatgcgcaaaaagatggccaagctaggaagggagaaggacgagctggagcaggagctccagaagtacaagtccctctatggggatgtggacagtcccctgcccacgggggaagcaggcgggccccccagcacccgggaggccgagctgaagctgcggctaaagctggtggaggaggaagccaacatcttgggccggaagatcgtggagctggaggtggagaaccgtggcctcaaggcagagatggaggacatgcggggccagcaggagcgggagggcccgggtcgggaccacgcacccagcattcctacctcacccttcggtgactccctggagtcctccactgagctccgccgccacctgcagtttgtagaagaggaagcggagttgctccggaggtccatctccgagatcgaagaccacaaccggcaactgacccacgagctcagcaagtttaagtttgagcctccccgggagccgggctggctaggagagggtgcaagtcctggtgccgggggtggggcccccctgcaggaggagctgaagtcagccaggctgcagatcagcgagctcagcggcaaggtgctcaaactgcagcacgagaaccacgcgctgctgtccaacatccagcgctgcgacctggcagcccacctggggctgcgtgcccccagtccccgggacagcgatgccgagagtgatgcgggcaagaaggagagtgatggggaggagagccgcctgccccagcccaagcgggaagggcctgttggcggggagagtgactcggaggaaatgtttgagaagacgtcgggcttcgggagcgggaagccatcggaggccagcgagccatgccccacggagctcctgaaggcccgggaggactctgagtacctagtgaccctaaaacacgaggcccagcggctagagcggacggtggagcgcctcatcacggacaccgacagcttcctccatgatgcggggctgcggggtggtgcgcccttaccggggcctggcctccagggcgaagaggagcagggtgagggggaccagcaggagccccagctgctggggaccatcaacgccaagatgaaggctttcaagaaagagctgcaggccttcctggagcaggtgaaccgcattggggatggcctatcccccttgccccacctcacagagtcctctagcttcctctccactgtgacttccgtgtcccgggactcccccatcgggaacctggggaaggagctgggcccagacttgcagtccagactgaaagagcagctggagtggcagctcgggccggcccgaggggacgagcgggagagcctgcgcctccgagccgcgcgggagctgcaccgccgcgcagacggggacaccgggagccacgggctgggaggccagacctgcttcagcctggagatggaggaggagcacctctatgccttgaggtggaaagaactggaaatgcacagcctggctttgcaaaacaccctccatgagcgaacctggagtgatgagaagaatctgatgcagcaggagctccggtccttgaagcagaacattttcctcttctacgtcaaactcaggtggctgctgaaacactggcggcaagggaagcagatggaggaggaaggagaggagttcactgagggtgaacatccagagaccctctccaggctcggggagcttggagtccaggggggtcaccaggcggatggcccagaccacgacagtgaccgaggctgtggctttccagtgggggagcactccccacactcccgggtgcagattggagatcacagcttgcggctgcagaccgcggacaggggacagccccacaaacaggtggtggaaaaccagcagctgttcagcgccttcaaggccttgctggaggacttccgtgcggagctgcgggaggatgagcgtgcccgactacggctgcagcagcaatatgccagcgacaaggcggcctgggacgtggagtgggccgtgctcaagtgccgtctggaacagctggaagagaagactgagaacaagttgggagaactaggctcctccgctgagagcaagggggccttgaagaaggagagagaggtgcaccagaagctcctggcagacagtcacagcctggtcatggacctgcgctggcagatccatcacagcgagaagaactggaaccgggagaaggtggaacttctcgaccgcctggacagagatcggcaggagtgggagcggcagaagaaggaattcttgtggaggatagagcagttgcagaaagagaacagtccccggagaggtggcagtttcctctgtgatcaaaaagacggcaacgttcgcccctttccccaccagggaagcctccgcatgccccgtccagtggccatgtggccttgtgcagatgctgactccatcccgtttgaagaccggccgctgtccaagctgaaggagtcggacaggtgctcggccagtgagaatctctacctggatgccttgtccctggatgacgagccagaagagccaccagcccacaggcccgagagggagttcaggaaccgcctccctgaggaagaagaaaatcacaaaggaaatcttcaaagggcggtgtccgtgtcctccatgtctgagttccagcgtctaatggacatctcccccttcctgcctgagaagggcctgccgtccaccagcagcaaggaggatgtcaccccacccctgtctccagacgacctcaagtacatcgaggagttcaacaagagctgggactacacacccaacaggggccacaatggtggggggccggacctttgggccgacaggaccgaggtggggcgggcagggcacgaggacagcacagagcctttccccgactcctcctggtacctaaccacaagtgtcaccatgaccacggacaccatgaccagcccagagcactgccagaagcagccactgcggagccacgtcctcaccgagcagtcggggttgcgcgtgttacacagcccgcctgccgtgcgcagggtcgacagcatcacggcggcaggtggtgagggtccctttcccacaagcagagccagagggagcccgggagacaccaagggaggccctccagaacccatgctcagcaggtggccttgcacctcccccaggcactcccgggactatgtggagggggcacggcgcccccttgatagtcccctctgtacctccctggggtttgcctccccactgcacagcctggagatgtccaagaacttgagtgatgacatgaaggaggtggccttctctgtcaggaatgccatctgctccggccctggcgagctgcaagtcaaggacatggcctgccagaccaatgggtcccggacgatggggacccagactgttcagaccatcagtgtgggcttgcagactgaagccctgcgtggcagcggtgtcaccagcagcccccacaagtgtctcactccaaaggctgggggcggtgctacacccgtgtcgtctccttcccggagccttaggagcagacaggtggcccctgccatcgagaaggtgcaggccaagtttgaacgcacatgctgctcccccaagtatggttctcccaagctgcagaggaagcccctccccaaagccgaccagccaaataacaggacgtcaccagggatggcccagaaagggtacagtgagtcagcctgggcccgctccaccaccacaagggagagccccgtgcacaccaccattaatgatggcctctccagcctcttcaacatcattgaccacagccccgtggtgcaggaccccttccagaaggggctgcgggccggcagtcggtctcgctcagcagagccccgaccagagctgggcccaggccaggaaacaggcaccaattcccgaggaaggtcgcctagccccattggggtggggtcagagatgtgcagggaggaagggggagagggcacgccagtgaagcaggacttatctgctccccctggctacacgctcactgagaacgtggcccggatcctcaacaagaagctgctggaacatgccttaaaggaggagaggaggcaggctgcccacgggcccccgggtctccacagtgacagccactcgctgggggacacagccgagccagggcccatggagaaccaaactgtcttgctaactgccccctggggactctag

SEQ ID NO: 153889 - DNA, 6093 bp, Homo sapiens
  Payload ID: 10252
  Gene Symbol: MTCL1
  Gene Name: microtubule crosslinking factor 1
  Uniprot ID: Q9Y4B5
  ENST ID: ENST00000359865
  CDS Start-End: 143-4903
gagtgttttcagaagtgggaatagcaggcgaggtcttgaggcctgaagaagcaaagcgtcgcttagtcaatgctgagatgcgtcttgtggaacagaatttttgggacatttgcaggatgagttagatgaactccgtgctgagatggaagagatgagagacagttatttagaggaagatgtttaccagctgcaggaacttcggcgagaactggaccgcgctaataaaaactgccgaatcctgcagtaccgtcttcggaaagccgagcagaaaagcctgaaagtggctgagacgggtcaggtggatggtgagcttattcgaagcctggagcaggacttgaaggtagccaaagatgtatctgtcagattgcaccacgaacttaagacggtggaggaaaagcgcgctaaagctgaggatgaaaacgaaactctccgacagcagatgattgaagtggaaatatccaaacaggccctccagaatgagctggagagactgaaagagagttccctaaaaagaagaagcactcgggaaatgtacaaggagaagaaaacctttaaccaggatgacagtgccgatttgaggtgccagctccagtttgccaaagaggaagccttcctgatgcgcaaaaagatggccaagctaggaagggagaaggacgagctggagcaggagctccagaagtacaagtccctctatggggatgtggacagtcccctgcccacgggggaagcaggcgggccccccagcacccgggaggccgagctgaagctgcggctaaagctggtggaggaggaagccaacatcttgggccggaagatcgtggagctggaggtggagaaccgtggcctcaaggcagagatggaggacatgcggggccagcaggagcgggagggcccgggtcgggaccacgcacccagcattcctacctcacccttcggtgactccctggagtcctccactgagctccgccgccacctgcagtttgtagaagaggaagcggagttgctccggaggtccatctccgagatcgaagaccacaaccggcaactgacccacgagctcagcaagtttaagtttgagcctccccgggagccgggctggctaggagagggtgcaagtcctggtgccgggggtggggcccccctgcaggaggagctgaagtcagccaggctgcagatcagcgagctcagcggcaaggtgctcaaactgcagcacgagaaccacgcgctgctgtccaacatccagcgctgcgacctggcagcccacctggggctgcgtgcccccagtccccgggacagcgatgccgagagtgatgcgggcaagaaggagagtgatggggaggagagccgcctgccccagcccaagcgggaagggcctgttggcggggagagtgactcggaggaaatgtttgagaagacgtcgggcttcgggagcgggaagccatcggaggccagcgagccatgccccacggagctcctgaaggcccgggaggactctgagtacctagtgaccctaaaacacgaggcccagcggctagagcggacggtggagcgcctcatcacggacaccgacagcttcctccatgatgcggggctgcggggtggtgcgcccttaccggggcctggcctccagggcgaagaggagcagggtgagggggaccagcaggagccccagctgctggggaccatcaacgccaagatgaaggctttcaagaaagagctgcaggccttcctggagcaggtgaaccgcattggggatggcctatcccccttgccccacctcacagagtcctctagcttcctctccactgtgacttccgtgtcccgggactcccccatcgggaacctggggaaggagctgggcccagacttgcagtccagactgaaagagcagctggagtggcagctcgggccggcccgaggggacgagcgggagagcctgcgcctccgagccgcgcgggagctgcaccgccgcgcagacggggacaccgggagccacgggctgggaggccagacctgcttcagcctggagctcaggggcccccccgttttacctgagcagagtgtatccatagaggagctacagggtcagctcgtgcaggcggccagactgcatcaagaggagacagagacatttacaaacaagatccataagatggaggaggagcacctctatgccttgaggtggaaagaactggaaatgcacagcctggctttgcaaaacaccctccatgagcgaacctggagtgatgagaagaatctgatgcagcaggagctccggtccttgaagcagaacattttcctcttctacgtcaaactcaggtggctgctgaaacactggcggcaagggaagcagatggaggaggaaggagaggagttcactgagggtgaacatccagagaccctctccaggctcggggagcttggagtccaggggggtcaccaggcggatggcccagaccacgacagtgaccgaggctgtggctttccagtgggggagcactccccacactcccgggtgcagattggagatcacagcttgcggctgcagaccgcggacaggggacagccccacaaacaggtggtggaaaaccagcagctgttcagcgccttcaaggccttgctggaggacttccgtgcggagctgcgggaggatgagcgtgcccgactacggctgcagcagcaatatgccagcgacaaggcggcctgggacgtggagtgggccgtgctcaagtgccgtctggaacagctggaagagaagactgagaacaagttgggagaactaggctcctccgctgagagcaagggggccttgaagaaggagagagaggtgcaccagaagctcctggcagacagtcacagcctggtcatggacctgcgctggcagatccatcacagcgagaagaactggaaccgggagaaggtggaacttctcgaccgcctggacagagatcggcaggagtgggagcggcagaagaaggaattcttgtggaggatagagcagttgcagaaagagaacagtccccggagaggtggcagtttcctctgtgatcaaaaagacggcaacgttcgcccctttccccaccagggaagcctccgcatgccccgtccagtggccatgtggccttgtgcagatgctgactccatcccgtttgaagaccggccgctgtccaagctgaaggagtcggacaggtgctcggccagtgagaatctctacctggatgccttgtccctggatgacgagccagaagagccaccagcccacaggcccgagagggagttcaggaaccgcctccctgaggaagaagaaaatcacaaaggaaatcttcaaagggcggtgtccgtgtcctccatgtctgagttccagcgtctaatggacatctcccccttcctgcctgagaagggcctgccgtccaccagcagcaaggaggatgtcaccccacccctgtctccagacgacctcaagtacatcgaggagttcaacaagagctgggactacacacccaacaggggccacaatggtggggggccggacctttgggccgacaggaccgaggtggggcgggcagggcacgaggacagcacagagcctttccccgactcctcctggtacctaaccacaagtgtcaccatgaccacggacaccatgaccagcccagagcactgccagaagcagccactgcggagccacgtcctcaccgagcagtcggggttgcgcgtgttacacagcccgcctgccgtgcgcagggtcgacagcatcacggcggcaggtggtgagggtccctttcccacaagcagagccagagggagcccgggagacaccaagggaggccctccagaacccatgctcagcaggtggccttgcacctcccccaggcactcccgggactatgtggagggggcacggcgcccccttgatagtcccctctgtacctccctggggtttgcctccccactgcacagcctggagatgtccaagaacttgagtgatgacatgaaggaggtggccttctctgtcaggaatgccatctgctccggccctggcgagctgcaagtcaaggacatggcctgccagaccaatgggtcccggacgatggggacccagactgttcagaccatcagtgtgggcttgcagactgaagccctgcgtggcagcggtgtcaccagcagcccccacaagtgtctcactccaaaggctgggggcggtgctacacccgtgtcgtctccttcccggagccttaggagcagacaggtggcccctgccatcgagaaggtgcaggccaagtttgaacgcacatgctgctcccccaagtatggttctcccaagctgcagaggaagcccctccccaaagccgaccagccaaataacaggacgtcaccagggatggcccagaaagggtacagtgagtcagcctgggcccgctccaccaccacaagggagagccccgtgcacaccaccattaatgatggcctctccagcctcttcaacatcattgaccacagccccgtggtgcaggaccccttccagaaggggctgcgggccggcagtcggtctcgctcagcagagccccgaccagagctgggcccaggccaggaaacaggcaccaattcccgaggaaggtcgcctagccccattggggtggggtcagagatgtgcagggaggaagggggagagggcacgccagtgaagcaggacttatctgctccccctggctacacgctcactgagaacgtggcccggatcctcaacaagaagctgctggaacatgccttaaaggaggagaggaggcaggctgcccacgggcccccgggtctccacagtgacagccactcgctgggggacacagccgagccagggcccatggagaaccaaactgtcttgctaactgccccctggggactctagccctgcccgcctcacgctgaactaccttgttctgcactagctccatccctagagccctgcttctccaggcccgagagaccagcaaaccgtcgccctccgtcccgttgggccccacattcccccactgcctcacagcctcagtcacccggagacccgacgtccttggaggagcatggtggcgaggagccgcccgaggagcagccacaccgagatgcaagcttgcatggattatcacagtataattcactgtaatttgcataaccacaccatcaccatgaacaaaactctgcccaacaggagagatctagttttctcaaggtcaaagaatgttttttaaaaacacaaagctgctgaatgttcaacctgtgaaactgagatgtttctagaatgaaacagtaaatgtgcctgtaataacttaatttttttcatagctcagaaaactatttttgtctccatcttttttacacacagtatattaaacgaaaaggtaaataaggtataaatagatttaaaaaataaaagttttaaaaaatgtacattttaagagattctgaacaccctcgctgtcaatacctgactgcctctgttaaatttgcactgttacattttggttcagtttatttccatgttgaattagagtggattaagttaattttattttgtcagtgttactgttttttacgaattttttaatgcttcagactgtctgattcagtgaactttttgtagtgaaaaagccatgaagccagtagacaagacagatattctgtatgctggaggggatacaggatgattttgaaaaggtacaaagtcctcagtgggcttagaaaattcactgtatgatccttatattatcctacttggcttgcacgtcttcgggtgcatgtatataccgctactgtgtcctcgccatcacctaaatgtgactcagtctgttccactgtaatatgttgtgaatttccttgtactgtacttttattgttggtcttcttgcatcgatgatccaacagcaacaccatttttaaattattgtgaaaagattaactggcaatgtacagagtttactcaaagttttcttaagggaaaacactacaaaaagtcacaaggataccaaatggaaacacatgatgatgcctctgggtctgtatgagaccgtgatgaagtagaaataaagcccttctgagatggca

SEQ ID NO: 153890 - DNA, 6042 bp, Homo sapiens
  Payload ID: 10252
  Gene Symbol: MTCL1
  Gene Name: microtubule crosslinking factor 1
  Uniprot ID: Q9Y4B5
  ENST ID: ENST00000400050
  CDS Start-End: 93-4853
ggatagcgtcgcttagtcaatgctgagatgcgtcttgtggaacagaatttttgggacatttgcaggatgagttagatgaactccgtgctgagatggaagagatgagagacagttatttagaggaagatgtttaccagctgcaggaacttcggcgagaactggaccgcgctaataaaaactgccgaatcctgcagtaccgtcttcggaaagccgagcagaaaagcctgaaagtggctgagacgggtcaggtggatggtgagcttattcgaagcctggagcaggacttgaaggtagccaaagatgtatctgtcagattgcaccacgaacttaagacggtggaggaaaagcgcgctaaagctgaggatgaaaacgaaactctccgacagcagatgattgaagtggaaatatccaaacaggccctccagaatgagctggagagactgaaagagagttccctaaaaagaagaagcactcgggaaatgtacaaggagaagaaaacctttaaccaggatgacagtgccgatttgaggtgccagctccagtttgccaaagaggaagccttcctgatgcgcaaaaagatggccaagctaggaagggagaaggacgagctggagcaggagctccagaagtacaagtccctctatggggatgtggacagtcccctgcccacgggggaagcaggcgggccccccagcacccgggaggccgagctgaagctgcggctaaagctggtggaggaggaagccaacatcttgggccggaagatcgtggagctggaggtggagaaccgtggcctcaaggcagagatggaggacatgcggggccagcaggagcgggagggcccgggtcgggaccacgcacccagcattcctacctcacccttcggtgactccctggagtcctccactgagctccgccgccacctgcagtttgtagaagaggaagcggagttgctccggaggtccatctccgagatcgaagaccacaaccggcaactgacccacgagctcagcaagtttaagtttgagcctccccgggagccgggctggctaggagagggtgcaagtcctggtgccgggggtggggcccccctgcaggaggagctgaagtcagccaggctgcagatcagcgagctcagcggcaaggtgctcaaactgcagcacgagaaccacgcgctgctgtccaacatccagcgctgcgacctggcagcccacctggggctgcgtgcccccagtccccgggacagcgatgccgagagtgatgcgggcaagaaggagagtgatggggaggagagccgcctgccccagcccaagcgggaagggcctgttggcggggagagtgactcggaggaaatgtttgagaagacgtcgggcttcgggagcgggaagccatcggaggccagcgagccatgccccacggagctcctgaaggcccgggaggactctgagtacctagtgaccctaaaacacgaggcccagcggctagagcggacggtggagcgcctcatcacggacaccgacagcttcctccatgatgcggggctgcggggtggtgcgcccttaccggggcctggcctccagggcgaagaggagcagggtgagggggaccagcaggagccccagctgctggggaccatcaacgccaagatgaaggctttcaagaaagagctgcaggccttcctggagcaggtgaaccgcattggggatggcctatcccccttgccccacctcacagagtcctctagcttcctctccactgtgacttccgtgtcccgggactcccccatcgggaacctggggaaggagctgggcccagacttgcagtccagactgaaagagcagctggagtggcagctcgggccggcccgaggggacgagcgggagagcctgcgcctccgagccgcgcgggagctgcaccgccgcgcagacggggacaccgggagccacgggctgggaggccagacctgcttcagcctggagctcaggggcccccccgttttacctgagcagagtgtatccatagaggagctacagggtcagctcgtgcaggcggccagactgcatcaagaggagacagagacatttacaaacaagatccataagatggaggaggagcacctctatgccttgaggtggaaagaactggaaatgcacagcctggctttgcaaaacaccctccatgagcgaacctggagtgatgagaagaatctgatgcagcaggagctccggtccttgaagcagaacattttcctcttctacgtcaaactcaggtggctgctgaaacactggcggcaagggaagcagatggaggaggaaggagaggagttcactgagggtgaacatccagagaccctctccaggctcggggagcttggagtccaggggggtcaccaggcggatggcccagaccacgacagtgaccgaggctgtggctttccagtgggggagcactccccacactcccgggtgcagattggagatcacagcttgcggctgcagaccgcggacaggggacagccccacaaacaggtggtggaaaaccagcagctgttcagcgccttcaaggccttgctggaggacttccgtgcggagctgcgggaggatgagcgtgcccgactacggctgcagcagcaatatgccagcgacaaggcggcctgggacgtggagtgggccgtgctcaagtgccgtctggaacagctggaagagaagactgagaacaagttgggagaactaggctcctccgctgagagcaagggggccttgaagaaggagagagaggtgcaccagaagctcctggcagacagtcacagcctggtcatggacctgcgctggcagatccatcacagcgagaagaactggaaccgggagaaggtggaacttctcgaccgcctggacagagatcggcaggagtgggagcggcagaagaaggaattcttgtggaggatagagcagttgcagaaagagaacagtccccggagaggtggcagtttcctctgtgatcaaaaagacggcaacgttcgcccctttccccaccagggaagcctccgcatgccccgtccagtggccatgtggccttgtgcagatgctgactccatcccgtttgaagaccggccgctgtccaagctgaaggagtcggacaggtgctcggccagtgagaatctctacctggatgccttgtccctggatgacgagccagaagagccaccagcccacaggcccgagagggagttcaggaaccgcctccctgaggaagaagaaaatcacaaaggaaatcttcaaagggcggtgtccgtgtcctccatgtctgagttccagcgtctaatggacatctcccccttcctgcctgagaagggcctgccgtccaccagcagcaaggaggatgtcaccccacccctgtctccagacgacctcaagtacatcgaggagttcaacaagagctgggactacacacccaacaggggccacaatggtggggggccggacctttgggccgacaggaccgaggtggggcgggcagggcacgaggacagcacagagcctttccccgactcctcctggtacctaaccacaagtgtcaccatgaccacggacaccatgaccagcccagagcactgccagaagcagccactgcggagccacgtcctcaccgagcagtcggggttgcgcgtgttacacagcccgcctgccgtgcgcagggtcgacagcatcacggcggcaggtggtgagggtccctttcccacaagcagagccagagggagcccgggagacaccaagggaggccctccagaacccatgctcagcaggtggccttgcacctcccccaggcactcccgggactatgtggagggggcacggcgcccccttgatagtcccctctgtacctccctggggtttgcctccccactgcacagcctggagatgtccaagaacttgagtgatgacatgaaggaggtggccttctctgtcaggaatgccatctgctccggccctggcgagctgcaagtcaaggacatggcctgccagaccaatgggtcccggacgatggggacccagactgttcagaccatcagtgtgggcttgcagactgaagccctgcgtggcagcggtgtcaccagcagcccccacaagtgtctcactccaaaggctgggggcggtgctacacccgtgtcgtctccttcccggagccttaggagcagacaggtggcccctgccatcgagaaggtgcaggccaagtttgaacgcacatgctgctcccccaagtatggttctcccaagctgcagaggaagcccctccccaaagccgaccagccaaataacaggacgtcaccagggatggcccagaaagggtacagtgagtcagcctgggcccgctccaccaccacaagggagagccccgtgcacaccaccattaatgatggcctctccagcctcttcaacatcattgaccacagccccgtggtgcaggaccccttccagaaggggctgcgggccggcagtcggtctcgctcagcagagccccgaccagagctgggcccaggccaggaaacaggcaccaattcccgaggaaggtcgcctagccccattggggtggggtcagagatgtgcagggaggaagggggagagggcacgccagtgaagcaggacttatctgctccccctggctacacgctcactgagaacgtggcccggatcctcaacaagaagctgctggaacatgccttaaaggaggagaggaggcaggctgcccacgggcccccgggtctccacagtgacagccactcgctgggggacacagccgagccagggcccatggagaaccaaactgtcttgctaactgccccctggggactctagccctgcccgcctcacgctgaactaccttgttctgcactagctccatccctagagccctgcttctccaggcccgagagaccagcaaaccgtcgccctccgtcccgttgggccccacattcccccactgcctcacagcctcagtcacccggagacccgacgtccttggaggagcatggtggcgaggagccgcccgaggagcagccacaccgagatgcaagcttgcatggattatcacagtataattcactgtaatttgcataaccacaccatcaccatgaacaaaactctgcccaacaggagagatctagttttctcaaggtcaaagaatgttttttaaaaacacaaagctgctgaatgttcaacctgtgaaactgagatgtttctagaatgaaacagtaaatgtgcctgtaataacttaatttttttcatagctcagaaaactatttttgtctccatcttttttacacacagtatattaaacgaaaaggtaaataaggtataaatagatttaaaaaataaaagttttaaaaaatgtacattttaagagattctgaacaccctcgctgtcaatacctgactgcctctgttaaatttgcactgttacattttggttcagtttatttccatgttgaattagagtggattaagttaattttattttgtcagtgttactgttttttacgaattttttaatgcttcagactgtctgattcagtgaactttttgtagtgaaaaagccatgaagccagtagacaagacagatattctgtatgctggaggggatacaggatgattttgaaaaggtacaaagtcctcagtgggcttagaaaattcactgtatgatccttatattatcctacttggcttgcacgtcttcgggtgcatgtatataccgctactgtgtcctcgccatcacctaaatgtgactcagtctgttccactgtaatatgttgtgaatttccttgtactgtacttttattgttggtcttcttgcatcgatgatccaacagcaacaccatttttaaattattgtgaaaagattaactggcaatgtacagagtttactcaaagttttcttaagggaaaacactacaaaaagtcacaaggataccaaatggaaacacatgatgatgcctctgggtctgtatgagaccgtgatgaagtagaaataaagcccttctgagatggc

SEQ ID NO: 153891 - DNA, 6009 bp, Homo sapiens
  Payload ID: 10252
  Gene Symbol: MTCL1
  Gene Name: microtubule crosslinking factor 1
  Uniprot ID: Q9Y4B5
  ENST ID: ENST00000517570
  CDS Start-End: 183-4820
cggcgcctgctgcactctctgagtattttccggcagggcctgcgggcagtggcgtcttagtcgccttagcactgggtgcttaatccggctccatcttttctccacggagggggcctggtgctgcagacggggttcccggggtcaggacgatccaggatgagttagatgaactccgtgctgagatggaagagatgagagacagttatttagaggaagatgtttaccagctgcaggaacttcggcgagaactggaccgcgctaataaaaactgccgaatcctgcagtaccgtcttcggaaagccgagcagaaaagcctgaaagtggctgagacgggtcaggtggatggtgagcttattcgaagcctggagcaggacttgaaggtagccaaagatgtatctgtcagattgcaccacgaacttaagacggtggaggaaaagcgcgctaaagctgaggatgaaaacgaaactctccgacagcagatgattgaagtggaaatatccaaacaggccctccagaatgagctggagagactgaaagagagttccctaaaaagaagaagcactcgggaaatgtacaaggagaagaaaacctttaaccaggatgacagtgccgatttgaggtgccagctccagtttgccaaagaggaagccttcctgatgcgcaaaaagatggccaagctaggaagggagaaggacgagctggagcaggagctccagaagtacaagtccctctatggggatgtggacagtcccctgcccacgggggaagcaggcgggccccccagcacccgggaggccgagctgaagctgcggctaaagctggtggaggaggaagccaacatcttgggccggaagatcgtggagctggaggtggagaaccgtggcctcaaggcagagatggaggacatgcggggccagcaggagcgggagggcccgggtcgggaccacgcacccagcattcctacctcacccttcggtgactccctggagtcctccactgagctccgccgccacctgcagtttgtagaagaggaagcggagttgctccggaggtccatctccgagatcgaagaccacaaccggcaactgacccacgagctcagcaagtttaagtttgagcctccccgggagccgggctggctaggagagggtgcaagtcctggtgccgggggtggggcccccctgcaggaggagctgaagtcagccaggctgcagatcagcgagctcagcggcaaggtgctcaaactgcagcacgagaaccacgcgctgctgtccaacatccagcgctgcgacctggcagcccacctggggctgcgtgcccccagtccccgggacagcgatgccgagagtgatgcgggcaagaaggagagtgatggggaggagagccgcctgccccagcccaagcgggaagggcctgttggcggggagagtgactcggaggaaatgtttgagaagacgtcgggcttcgggagcgggaagccatcggaggccagcgagccatgccccacggagctcctgaaggcccgggaggactctgagtacctagtgaccctaaaacacgaggcccagcggctagagcggacggtggagcgcctcatcacggacaccgacagcttcctccatgatgcggggctgcggggtggtgcgcccttaccggggcctggcctccagggcgaagaggagcagggtgagggggaccagcaggagccccagctgctggggaccatcaacgccaagatgaaggctttcaagaaagagctgcaggccttcctggagcaggtgaaccgcattggggatggcctatcccccttgccccacctcacagagtcctctagcttcctctccactgtgacttccgtgtcccgggactcccccatcgggaacctggggaaggagctgggcccagacttgcagtccagactgaaagagcagctggagtggcagctcgggccggcccgaggggacgagcgggagagcctgcgcctccgagccgcgcgggagctgcaccgccgcgcagacggggacaccgggagccacgggctgggaggccagacctgcttcagcctggagatggaggaggagcacctctatgccttgaggtggaaagaactggaaatgcacagcctggctttgcaaaacaccctccatgagcgaacctggagtgatgagaagaatctgatgcagcaggagctccggtccttgaagcagaacattttcctcttctacgtcaaactcaggtggctgctgaaacactggcggcaagggaagcagatggaggaggaaggagaggagttcactgagggtgaacatccagagaccctctccaggctcggggagcttggagtccaggggggtcaccaggcggatggcccagaccacgacagtgaccgaggctgtggctttccagtgggggagcactccccacactcccgggtgcagattggagatcacagcttgcggctgcagaccgcggacaggggacagccccacaaacaggtggtggaaaaccagcagctgttcagcgccttcaaggccttgctggaggacttccgtgcggagctgcgggaggatgagcgtgcccgactacggctgcagcagcaatatgccagcgacaaggcggcctgggacgtggagtgggccgtgctcaagtgccgtctggaacagctggaagagaagactgagaacaagttgggagaactaggctcctccgctgagagcaagggggccttgaagaaggagagagaggtgcaccagaagctcctggcagacagtcacagcctggtcatggacctgcgctggcagatccatcacagcgagaagaactggaaccgggagaaggtggaacttctcgaccgcctggacagagatcggcaggagtgggagcggcagaagaaggaattcttgtggaggatagagcagttgcagaaagagaacagtccccggagaggtggcagtttcctctgtgatcaaaaagacggcaacgttcgcccctttccccaccagggaagcctccgcatgccccgtccagtggccatgtggccttgtgcagatgctgactccatcccgtttgaagaccggccgctgtccaagctgaaggagtcggacaggtgctcggccagtgagaatctctacctggatgccttgtccctggatgacgagccagaagagccaccagcccacaggcccgagagggagttcaggaaccgcctccctgaggaagaagaaaatcacaaaggaaatcttcaaagggcggtgtccgtgtcctccatgtctgagttccagcgtctaatggacatctcccccttcctgcctgagaagggcctgccgtccaccagcagcaaggaggatgtcaccccacccctgtctccagacgacctcaagtacatcgaggagttcaacaagagctgggactacacacccaacaggggccacaatggtggggggccggacctttgggccgacaggaccgaggtggggcgggcagggcacgaggacagcacagagcctttccccgactcctcctggtacctaaccacaagtgtcaccatgaccacggacaccatgaccagcccagagcactgccagaagcagccactgcggagccacgtcctcaccgagcagtcggggttgcgcgtgttacacagcccgcctgccgtgcgcagggtcgacagcatcacggcggcaggtggtgagggtccctttcccacaagcagagccagagggagcccgggagacaccaagggaggccctccagaacccatgctcagcaggtggccttgcacctcccccaggcactcccgggactatgtggagggggcacggcgcccccttgatagtcccctctgtacctccctggggtttgcctccccactgcacagcctggagatgtccaagaacttgagtgatgacatgaaggaggtggccttctctgtcaggaatgccatctgctccggccctggcgagctgcaagtcaaggacatggcctgccagaccaatgggtcccggacgatggggacccagactgttcagaccatcagtgtgggcttgcagactgaagccctgcgtggcagcggtgtcaccagcagcccccacaagtgtctcactccaaaggctgggggcggtgctacacccgtgtcgtctccttcccggagccttaggagcagacaggtggcccctgccatcgagaaggtgcaggccaagtttgaacgcacatgctgctcccccaagtatggttctcccaagctgcagaggaagcccctccccaaagccgaccagccaaataacaggacgtcaccagggatggcccagaaagggtacagtgagtcagcctgggcccgctccaccaccacaagggagagccccgtgcacaccaccattaatgatggcctctccagcctcttcaacatcattgaccacagccccgtggtgcaggaccccttccagaaggggctgcgggccggcagtcggtctcgctcagcagagccccgaccagagctgggcccaggccaggaaacaggcaccaattcccgaggaaggtcgcctagccccattggggtggggtcagagatgtgcagggaggaagggggagagggcacgccagtgaagcaggacttatctgctccccctggctacacgctcactgagaacgtggcccggatcctcaacaagaagctgctggaacatgccttaaaggaggagaggaggcaggctgcccacgggcccccgggtctccacagtgacagccactcgctgggggacacagccgagccagggcccatggagaaccaaactgtcttgctaactgccccctggggactctagccctgcccgcctcacgctgaactaccttgttctgcactagctccatccctagagccctgcttctccaggcccgagagaccagcaaaccgtcgccctccgtcccgttgggccccacattcccccactgcctcacagcctcagtcacccggagacccgacgtccttggaggagcatggtggcgaggagccgcccgaggagcagccacaccgagatgcaagcttgcatggattatcacagtataattcactgtaatttgcataaccacaccatcaccatgaacaaaactctgcccaacaggagagatctagttttctcaaggtcaaagaatgttttttaaaaacacaaagctgctgaatgttcaacctgtgaaactgagatgtttctagaatgaaacagtaaatgtgcctgtaataacttaatttttttcatagctcagaaaactatttttgtctccatcttttttacacacagtatattaaacgaaaaggtaaataaggtataaatagatttaaaaaataaaagttttaaaaaatgtacattttaagagattctgaacaccctcgctgtcaatacctgactgcctctgttaaatttgcactgttacattttggttcagtttatttccatgttgaattagagtggattaagttaattttattttgtcagtgttactgttttttacgaattttttaatgcttcagactgtctgattcagtgaactttttgtagtgaaaaagccatgaagccagtagacaagacagatattctgtatgctggaggggatacaggatgattttgaaaaggtacaaagtcctcagtgggcttagaaaattcactgtatgatccttatattatcctacttggcttgcacgtcttcgggtgcatgtatataccgctactgtgtcctcgccatcacctaaatgtgactcagtctgttccactgtaatatgttgtgaatttccttgtactgtacttttattgttggtcttcttgcatcgatgatccaacagcaacaccatttttaaattattgtgaaaagattaactggcaatgtacagagtttactcaaagttttcttaagggaaaacactacaaaaagtcacaaggataccaaatggaaacacatgatgatgcctctgggtctgtatgagaccgtgatgaagtagaaataaagcccttctgagatggc

SEQ ID NO: 153892 - DNA, 3286 bp, Homo sapiens
  Payload ID: 10252
  Gene Symbol: MTCL1
  Gene Name: microtubule crosslinking factor 1
  ENST ID: ENST00000520495
  CDS Start-End: 688-2217
aaatgatgagtgtgcgaccagactgcggcagagaacgagccatgctctctgagtgtaaaagctgcattgtgagcacacgtgacgatccgaaggagttaattctcccccgggggctgacttgttccacagaaggggcgacaggcctggagagcagtttgaagccttttcctccacgagggctgtgggatttgactcccgcagtgctgttgttgacagtttctctgtgtgatgggggaaacctttgctgaagccttttgaaacttttgatggccgatcaaagaggagtgattcgtgaaatcggttatttttcccatctgctgaatgtgaacagtaaaacgtttttgcaaaaccaaaacggggagttcatctggcttcaaaacaaggagaccagccctgcaaagcagcgttgactttccactggacccaaaaagtgccgttttgacctcagccaagcattgcaggctgtgaacagcagagtcagcttttgaggatcctccagaaccctctggaagccctatgaggacacttcttaggttttgatacacttgactctatccaacacttacctccttgccttgggtctctgggtttaatttcctgctgtgttatagcaactaaagggaaaggaacgatgacagtgccgatttgaggtgccagctccagtttgccaaagaggaagccttcctgatgcgcaaaaagatggccaagctaggaagggagaaggacgagctggagcaggagctccagaagtacaagtccctctatggggatgtggacagtcccctgcccacgggggaagcaggcgggccccccagcacccgggaggccgagctgaagctgcggctaaagctggtggaggaggaagccaacatcttgggccggaagatcgtggagctggaggtggagaaccgtggcctcaaggcagagatggaggacatgcggggccagcaggagcgggagggcccgggtcgggaccacgcacccagcattcctacctcacccttcggtgactccctggagtcctccactgagctccgccgccacctgcagtttgtagaagaggaagcggagttgctccggaggtccatctccgagatcgaagaccacaaccggcaactgacccacgagctcagcaagtttaagtttgagcctccccgggagccgggctggctaggagagggtgcaagtcctggtgccgggggtggggcccccctgcaggaggagctgaagtcagccaggctgcagatcagcgagctcagcggcaaggtgctcaaactgcagcacgagaaccacgcgctgctgtccaacatccagcgctgcgacctggcagcccacctggggctgcgtgcccccagtccccgggacagcgatgccgagagtgatgcgggcaagaaggagagtgatggggaggagagccgcctgccccagcccaagcgggaagggcctgttggcggggagagtgactcggaggaaatgtttgagaagacgtcgggcttcgggagcgggaagccatcggaggccagcgagccatgccccacggagctcctgaaggcccgggaggactctgagtacctagtgaccctaaaacacgaggcccagcggctagagcggacggtggagcgcctcatcacggacaccgacagcttcctccatgatgcggggctgcggggtggtgcgcccttaccggggcctggcctccagggcgaagaggagcagggtgagggggaccagcaggagccccagctgctggggaccatcaacgccaagatgaaggctttcaagaaagagctgcaggccttcctggagcaggtgaaccgcattggggatggcctatcccccttgccccacctcacagagtcctctagcttcctctccactgtgacttccgtgtcccgggactcccccatcgggaacctggggaaggagctgggcccagacttgcagatgtgtccacccgcccctttgctcatcctcatcttggtccagactgaaagagcagctggagtggcagctcgggccggcccgaggggacgagcgggagagcctgcgcctccgagccgcgcgggagctgcaccgccgcgcagacggggacaccgggagccacgggctgggaggccagacctgcttcagcctggagatggaggaggagcacctctatgccttgaggtggaaagaactggaaatgcacagcctggctttgcaaaacaccctccatgagcgaacctggagtgatgagaagaatctgatgcagcaggagctccggtccttgaagcagaacattttcctcttctacgtcaaactcaggtggctgctgaaacactggcggcaagggaagcagatggaggaggaaggagaggagttcactgagggtgaacatccagagaccctctccaggctcggggagcttggagtccaggggggtcaccaggcggatggcccagaccacgacagtgaccgaggctgtggctttccagtgggggagcactccccacactcccgggtgcagattggagatcacagcttgcggctgcagaccgcggacaggggacagccccacaaacaggtggtggaaaaccagcagctgttcagcgccttcaaggccttgctggaggacttccgtgcggagctgcgggaggatgagcgtgcccgactacggctgcagcagcaatatgccagcgacaaggcggcctgggacgtggagtgggccgtgctcaagtgccgtctggaacagaattgttgtggatatcccagaattaacattgaggaggagactttaggcttcaccaggctgccagctgggtccacggtaaaaacgttgaagagccttgggttgcagagattggaggtgagaggggtgactctgaagtaaagcagcagcagtggagaaggagtggagggcacacacctgaaaaaaacggagcaagtagagagtggccgggcctggtggccggttcatgagacgccgtggagcaacaggcacctcgcacggctgtcaggtttctagtacgggtgcctgggcgatgggccatcactgagacaggaacgcagagagacaaccagttgggatggaaaggggacaggttggatttgaggtgtgtgtcatcacaggcactgggacttgaaaagggctgggctgaagatgtatatacctgggtgtgaatgaggaggtgggaggcagggccatggaggacgctgcaggactgtgcacagaatgaaaggaactcatagaaggaaccaaaatattcattttgcagaaattagtggaaggagaagagattggaaagga

SEQ ID NO: 153893 - DNA, 3963 bp, Homo sapiens
  Payload ID: 10252
  Gene Symbol: MTCL1
  Gene Name: microtubule crosslinking factor 1
  Uniprot ID: Q9Y4B5
  ENST ID: ENST00000518815
  CDS Start-End: 95-3025
gctttaatagggagatcaagatgaatttgatgtataatcagaatcctagatggaggaggagcacctctatgccttgaggtggaaagaactggaaatgcacagcctggctttgcaaaacaccctccatgagcgaacctggagtgatgagaagaatctgatgcagcaggagctccggtccttgaagcagaacattttcctcttctacgtcaaactcaggtggctgctgaaacactggcggcaagggaagcagatggaggaggaaggagaggagttcactgagggtgaacatccagagaccctctccaggctcggggagcttggagtccaggggggtcaccaggcggatggcccagaccacgacagtgaccgaggctgtggctttccagtgggggagcactccccacactcccgggtgcagattggagatcacagcttgcggctgcagaccgcggacaggggacagccccacaaacaggtggtggaaaaccagcagctgttcagcgccttcaaggccttgctggaggacttccgtgcggagctgcgggaggatgagcgtgcccgactacggctgcagcagcaatatgccagcgacaaggcggcctgggacgtggagtgggccgtgctcaagtgccgtctggaacagaattgttgtggatatcccagaattaacattgaggaggagactttaggcttcaccaggctgccagctgggtccacggtaaaaacgttgaagagccttgggttgcagagattggagctggaagagaagactgagaacaagttgggagaactaggctcctccgctgagagcaagggggccttgaagaaggagagagaggtgcaccagaagctcctggcagacagtcacagcctggtcatggacctgcgctggcagatccatcacagcgagaagaactggaaccgggagaaggtggaacttctcgaccgcctggacagagatcggcaggagtgggagcggcagaagaaggaattcttgtggaggatagagcagggaagcctccgcatgccccgtccagtggccatgtggccttgtgcagatgctgactccatcccgtttgaagaccggccgctgtccaagctgaaggagtcggacaggtgctcggccagtgagaatctctacctggatgccttgtccctggatgacgagccagaagagccaccagcccacaggcccgagagggagttcaggaaccgcctccctgaggaagaagaaaatcacaaaggaaatcttcaaagggcggtgtccgtgtcctccatgtctgagttccagcgtctaatggacatctcccccttcctgcctgagaagggcctgccgtccaccagcagcaaggaggatgtcaccccacccctgtctccagacgacctcaagtacatcgaggagttcaacaagagctgggactacacacccaacaggggccacaatggtggggggccggacctttgggccgacaggaccgaggtggggcgggcagggcacgaggacagcacagagcctttccccgactcctcctggtacctaaccacaagtgtcaccatgaccacggacaccatgaccagcccagagcactgccagaagcagccactgcggagccacgtcctcaccgagcagtcggggttgcgcgtgttacacagcccgcctgccgtgcgcagggtcgacagcatcacggcggcaggtggtgagggtccctttcccacaagcagagccagagggagcccgggagacaccaagggaggccctccagaacccatgctcagcaggtggccttgcacctcccccaggcactcccgggactatgtggagggggcacggcgcccccttgatagtcccctctgtacctccctggggtttgcctccccactgcacagcctggagatgtccaagaacttgagtgatgacatgaaggaggtggccttctctgtcaggaatgccatctgctccggccctggcgagctgcaagtcaaggacatggcctgccagaccaatgggtcccggacgatggggacccagactgttcagaccatcagtgtgggcttgcagactgaagccctgcgtggcagcggtgtcaccagcagcccccacaagtgtctcactccaaaggctgggggcggtgctacacccgtgtcgtctccttcccggagccttaggagcagacaggtggcccctgccatcgagaaggtgcaggccaagtttgaacgcacatgctgctcccccaagtatggttctcccaagctgcagaggaagcccctccccaaagccgaccagccaaataacaggacgtcaccagggatggcccagaaagggtacagtgagtcagcctgggcccgctccaccaccacaagggagagccccgtgcacaccaccattaatgatggcctctccagcctcttcaacatcattgaccacagccccgtggtgcaggaccccttccagaaggggctgcgggccggcagtcggtctcgctcagcagagccccgaccagagctgggcccaggccaggaaacaggcaccaattcccgaggaaggtcgcctagccccattggggtggggtcagagatgtgcagggaggaagggggagagggcacgccagtgaagcaggacttatctgctccccctggctacacgctcactgagaacgtggcccggatcctcaacaagaagctgctggaacatgccttaaaggaggagaggaggcaggctgcccacgggcccccgggtctccacagtgacagccactcgctgggggacacagccgagccagggcccatggaggaactaccttgttctgcactagctccatccctagagccctgcttctccaggcccgagagaccagcaaaccgtcgccctccgtcccgttgggccccacattcccccactgcctcacagcctcagtcacccggagacccgacgtccttggaggagcatggtggcgaggagccgcccgaggagcagccacaccgagatgcaagcttgcatggattatcacagtataattcactgtaatttgcataaccacaccatcaccatgaacaaaactctgcccaacaggagagatctagttttctcaaggtcaaagaatgttttttaaaaacacaaagctgctgaatgttcaacctgtgaaactgagatgtttctagaatgaaacagtaaatgtgcctgtaataacttaatttttttcatagctcagaaaactatttttgtctccatcttttttacacacagtatattaaacgaaaaggtaaataaggtataaatagatttaaaaaataaaagttttaaaaaatgtacattttaagagattctgaacaccctcgctgtcaatacctgactgcctctgttaaatttgcactgttacattttggttcagtttatttccatgttgaattagagtggattaagttaattttattttgtcagtgttactgttttttacgaattttttaatgcttcagactgtctgattcagtgaactttttgtagtgaaaaagccatgaagccagtagacaagacagatattctgtatgctggaggggatacaggatgattttgaaaaggtacaaagtcctcagtgggcttagaaaattcactgtatgatccttatattatcctacttggcttgcacgtcttcgggtgcatgtatataccgctactgtgtcctcgccatcacctaaatgtgactcagtctgttccactgtaatatgttgtgaatttccttgtactgtacttttattgttggtcttcttgcatcgatgatccaacagcaacaccatttttaaattattgtgaaaagattaactggcaatgtacagagtttactcaaagttttcttaagggaaaacactacaaaaagtcacaaggataccaaatggaaacacatgatgatgcctctgggtctgtatgagaccgtgatgaagtagaaataaagcccttctgagatggca

SEQ ID NO: 153894 - DNA, 373 bp, Homo sapiens
  Payload ID: 10252
  Gene Symbol: MTCL1
  Gene Name: microtubule crosslinking factor 1
  ENST ID: ENST00000523122
  CDS Start-End: 232-373
aatgactccttgggttcccctgtattcagggtgcattcctgtggacagcaaagagtggaggtgtgggaaagtcagaataggtgaatgggaaaaaacagacccaatgtgtatttaaaataatggaaaatgtctcatttgtggatagcgtcgcttagtcaatgctgagatgcgtcttgtggaacagaatttttgggacatttgcaggatgagttagatgaactccgtgctgagatggaagagatgagagacagttatttagaggaagatgtttaccagctgcaggaacttcggcgagaactggaccgcgctaataaaaactgccgaatcctgcagtaccgtcttcggaaagccgagcagaaaagcctgaaagtgg

SEQ ID NO: 153895 - DNA, 19141 bp, Homo sapiens
  Payload ID: 10253
  Gene Symbol: MACF1
  Gene Name: microtubule-actin crosslinking factor 1
  Uniprot ID: Q9UPN3
  ENST ID: ENST00000289893
  CDS Start-End: 132-17948
ggctctgattcagttttctttttcttctcttttccttttttttttttttttttttttttttttaggaatgcagagcagttgctggggtgattgacctaggcacagtggagatatttcccatcttcaaagccatgcaaaagggcctccttgaccaagacacaggcctagtgcttctggaatctcaggttatcatgtctggcctcattgcccctgagacgggtgaaaacctctctttggaggagggcatagccagaaacctcattaatccccagatgtaccagcagctccgggagctacaggatgccctggccttaataagcaggcttactgagagcagaggccctctttctgtggtggaagcaattgaaaagagaataatcagtgagacagttggactgaaaatcttagaagctcacctggcaactggaggtttcagtctttcccctagtgagaactgtattaacctggaagaggcttttcatcaaggcctcatttctgcatggcttcattcagtattagagtcttatcttagaacatccaagaatttgatagaccctaacacagctgagaaaattggtttgctggatctgatgcagcgatgtattgtccaccaggaatcaggattcaaattactgcctgtcaaacaattggcaggggggatggtgagcttgaaatcaggccggaaggttagcattttccgtgcagttcaggaagggctaatagataggcaggtcactgtccggttgctggaagctcagctttttgctggtggcatagtagatccaagaacaggacacagacttacagtggaagaggctgtaagacataatctgattgaccaagatatggcctgtgctatcctcataaggcagcttcagacaggaggcatcatagacactgtcacggggcaaaggctaacaatagatgaagcagtgagcaatgatctagtagctgctaagatcgcccttgtgattctggagtccctctggtcattcatggggttgctgtggcctgaatctggagagatcctcccaattacagatgccctagaacaaggtattgtgtctactgaactagcacataaaatccttagtaaccgacagcatattaaggctctgtttctaccagcaaccacagagattttgtcctggaagaaagcaatagaaagtggtatcctggatagagatcttgccaataacttaaaatcgatttgtatacctgatgtgatgccccacatgcaactagcagactctgcagaacaaaatattaatcctggagcagcagttctaccgtgcagcaagagccaccctaaggccacagcaagccagagtgagaatctgttgttccagctgatgactcacagctatattaatgtgcaaaatggacagaggctgcttctgttagataaagagctgatggagacactaacatccagagatgagtatcaaacaagtcctccaaaagtggttgaaattgggcatcaaaggcaaaaaactcctgagggattgcaagaatcagctaatgtgaaaatctcaggaactttcagcagtgggtggactgtgaggctgcctgagttccagttttcttctcagaacaaagaatatcccgatcgggaagattgcactacagaaaaaggcaaaaagaccactgtagaaacagaagattcttctgtagagaaccctgaacaggatctgtttgtagaacaaaaagagagaaatccaaacattgatgctttgaaggtaataaataaagtcaaattagaggtacaaaggcagttgataggtacccaaagggaagaccaaacagcagtgtctgtcagagaaaatgccagcaggggacacctcctgaccatacctcctgctgaggcggaaggtgtgccgttggtggttgacaaagatgttttttctgttgaaacaccaaagaaagaacatcaacctctaagaaacacttcctttacatgtcagaatgaacaagcacacactcttgagactgaatatattcatgatgaaactggaggatctcacataaaaccccaaagcaaaaagttacaagttcaggtaaagaaaactctaggtataaagttagaactaaagtctgaaactgatgggaatgttcatcctctggacaaaaaggaaatgttaaagaaaacatttctggctaaggatgaccataaagaaagtcaagaagcacagaacatcgcaggtggtagtatgatgatgtcagaaaagaccgatgaggaagatagtggcagggaaatttttctgtcatgcagtcatccattagaattgcttgaagaagctaccttaaatgtattatctgcacagttactagatggtggtatctttcatgaacaaacaggtcaaaagctcttactaaatgaagcaatatcccgaggcattgtgccaagtcacactgccgtgaagcttatggagaagctgaacatgtttcaggggttctttgactctcagacttgtgagtctttgacaactgaagaagtcattaatgaaggtctgatggatgagaaattattacataatgtcctcatggcagacaaagctataagtggtgtcttagacccccgtacccagacactgtgctctgtaaaggatgcagttacagttggacttcttgacaaggaaacagccaccagaattttagagaggcaggtggtgactggtggaattattgatctgaaacgaggcaaaaaagtttcagtaactttggcctcaactcttggcttggtggacgttgctgaccagccagaacttataaatctggagaaagcttccaaaggtagagatgctgaaaaaacagttagggagagattaattagtttacaaatggaaacaacaggacttatagaccctgatagtaaagcacctttaacagttgtgcagtccattgacagaggtcttttggagagagaggaggccgttcgtttgttgactaagcaagtggtagatggaggtatcattcaccatatatctgggatgagactttctgttgataatgccttcagacatggcttaattggtgaagatttagccgagaaactcaaaagagttgagaacttaaacatccatcagatttttaatcctgaaacgaaggaaaatatttccctccctaaagccataaaattagatcttattacctcagacctgaaaagagaaatccaggaggttcaggcctttactggaaactttgtggatctcatttctggtcagagattgaccttggcagaagctaaaaaagaaggactgttaactaatgaagcagtattgtctccaggaatgatgcatggcattgtagatcccgagaactgcagaattgtcccctactcagaattagtcaagaaatgtaagattgatattgaatctggacagagatatctagaagtaattcccttctcagacattaaagatggggtgagcgacaaagtgcttacattgtctcaagcaattcagcttggaaaagtagactttgcatctacgctgaaggttctagaagcccaggcaaatactggtggaatcatagatactgctactggaaaaagactgacattggcatcagctttggaagagaaactggtggatgaaaacatggtcagaattattgcatctcatcaggtgttaaatggaggaattgttgacatatttagtgatcagagagtgactttagtagaagctattgagaaaagactgatcagccctgaactggcaaatatgatccaaatagatagttcagagttcagcgatcacagggctcagattgaaaagcaagaagggattgaagtgtgtgcattacaaaatgaatttctaggaaaggatatgttaattgcttgtaatcagactgctgaaatgagttgtaataaagtagaagagagtgagagattatttcaagttgaaaatcagtctgcacaagaaaaggttaaagtgagagtttctgatggggagcaggcaaaaaagagcagggaaatttccttaaaggaatttgggtgcaaggatcaacgtaagccaagaatgtcttcagatgctaaagaatttatcagtatcataaatcctcataatcttaaaggtaaatccttgggccaagtgtcattgacacacccttactctgaatgtgattttaaacttaaagaagtggctagaaataacatgggaaatgatacaaatgaagagcaggaaaaagcagtgacaaaaatagaaattatttctcatatgaagcagtctacctcatgtctagattctgaagaaataagagaaaatcaaggggaagtgattttggaagtacaagaaacatattgtgaaacgtcaggcaaattgccgagtgagcaggttttgcagcaaccaatgaatgctcgggtgaaaagtaagagagagaagagggaggtgattgtagaagaaagtatcagaacatgcaaaccagcatttctttctgaagaaaagttgtatcaggaaactgccattagagatgagcatgactcccatataaagagccaacctagggaaatgacctcaagtgaaaaagggaaagaagctgatacagaaatgggattttctattacttttaaaattgaagagtcctcttcccaagtggtacctcaaggaatttctgtaaaacatttagatgctttaacactcttcagctctaaacaggccaatgaaggaaaagtaaacaatttaagtctctgcttgactttaaaaccagaagaaaacttatctcgagaaattgcctgtggggcccagagtgaaccattcccttgtatgaccccaagacctgaaggattgcactaccaggaatcagatggaaaagcccaagtgacaggcccatcccaaatttccaaaacagacaagtctttccaaggaaccaccagacaggagaccaactatcaagattcctgggttacttcgaaaactaaggaaaccaaacatcaaatttcctcatctaatgaatgtaaagaaaagtcataccaagaagtatcttttgacccagcaagaggtcttaaattggaagaaatcacagtttctagaccagattcaaaagaagtcaggtatctagaattctcagacagaaaagaccttcatcatcagggcagcaaaagtgatgataaactttgtggaactctcaaatctgaaatagcaacacaggaactaactggagagaaatttctagaaatggcaaaccctaatgttgcaggtctagaagcaggatccattgaggacatagtgactcagagaggttccagagtcttgggatcctttcttccagagaaactgttcaaaggagtgtctcaaaaagagaatacagggcaacagaatgccatcattagtcctactgttctagagaccagtgaagaaaagacagtgtccctaacagtatgctctgcagtgaagacagagaagacaccacaggaaaagctcagagaaagccctggcagtgaacaaactcccttcatgactgcacctgaaggaaagggaaatggaggtgtaaacccagagcccttcagagcaactcagaatgtatttacccggcaactctgtttagaacatgatgaaaagctagtatcctatctgtctctgttacggaacattgaaatgaggaccaaacagattcaacctttggagctaaacctggcagaactacaggatctgctgtgtcaggccaaggtattagaaagggagttaaaggatctgaccaccttggtcagtcaggagctggagtgtgtgaatcagattatcatcagccagcctcaagaagttcctgctcaactgttgaaggctctagagaaagatgccaagaatcttcagaagtctctcagctctgtgagtgacacttggaattccaggctactccacttccagaatgctgtggaaatagaaaagactaaagtgttaaatcagcacacacagctagaaggccgacttcaagatctgagagcctgggttggcaataaaaatcttattctgaacagcaagggatctaacagtgaaatagatgttgacagcctgaacctctgcctccaacagtatgaggatttgaaacagcccatggctgaaaggaaagctcagctggatgctcttgcttttgatattcagttctttatctcagaacatgcccaggacttgtcccctcagcagaatcgacagatgctgaggcttctgaatgaactgcagaggtccttccaggacattttggaacagactgccgctcaggtggatgccttgcagggccatcttcaacaaatggagcaggaagccctggtgaagaccctgcagaaacaacaaaatacctgtcaccagcaactggaggatctttgcagttgggtaggacaggcagaaagagcactggcaggccaccaaggcagaaccacccagcaggatctctctgctttgcagaagaaccaaagtgacttgaaggatttacaggatgacattcagaatcgtgccacctcatttgccactgttgtcaaggacattgaggggttcatggaagagaatcagaccaagctgagcccacgtgagttgacagctcttcgggaaaagcttcatcaggctaaggagcaatatgaggcgctccaggaagagacacgtgtggcccagaaggaactggaggaagcagtgacctccgccttacagcaggagactgaaaagagtaaagcagcaaaggaactggcagagaacaagaagaagatcgatgctctcctggattgggtaacttcagtaggatcatctggtggacagctgctgaccaaccttccaggaatggagcagctctcgggagctagcttggagaaaggagccttggacaccactgatggttacatgggggtgaatcaagccccagagaaactggacaagcaatgtgagatgatgaaggcccgtcaccaagaattgctgtcccagcagcaaaatttcattctggccacccagtcagctcaggccttcttggatcagcatggccacaatctcacacctgaggagcaacagatgctgcaacagaagctgggagagctaaaggaacaatactctacttccctggcccaatcagaggcagaactgaagcaggtgcagacacttcaggatgagttgcagaaatttctgcaggatcataaagagtttgaaagctggttggaacgatccgagaaagagctggagaacatgcataagggaggcagcagccccgagacccttccctccctgctaaagcggcaaggaagcttctcagaggatgtcatttcccacaaaggagacttgagatttgtgactatctcaggacagaaagtcttggacatggaaaacagttttaaggaaggcaaagaaccatcagaaattggaaacttagtaaaggacaagttgaaggatgcaacagaaagatacactgctctccactcaaagtgtacacgattaggatctcacctgaatatgctgttaggccagtatcatcaattccaaaacagtgctgacagcctgcaggcctggatgcaggcttgtgaggccaacgtggagaagctcctctcagatactgttgcctctgaccctggagttctccaggagcagcttgcaacaacaaagcagttgcaggaggaattggctgagcaccaagtacctgtggaaaaactccaaaaagtagctcgtgacataatggaaattgaaggggagccagccccagaccacaggcatgttcaagaaactacagattccatactcagccacttccaaagcctctcctatagcctggctgagcgatcttctctgctgcagaaagcaattgcccaatctcagagtgtccaggaaagcctggagagcctgttgcagtctattggggaagttgaacaaaacctggaagggaagcaggtgtcatcactctcatcaggagtcatccaggaagccttagccacaaatatgaaattgaagcaggacattgctcggcaaaagagcagcttggaggccacccgtgagatggtgacccgattcatggagacagcagacagtactacagcagcagtgctgcagggcaaactggcagaggtgagccagcggttcgaacagctctgtctacagcagcaagaaaaggagagctccctaaagaagcttctaccccaggcagagatgtttgaacacctctctggtaagctgcagcagttcatggaaaacaaaagtcggatgctggcctctggaaatcagccagatcaagatattacacatttcttccaacagatccaggagctcaatttggaaatggaagaccaacaggagaacctagatactcttgagcacctggtcactgaactgagctcttgtggctttgcgctggacttgtgccagcatcaggacagggtacagaatctaagaaaagacttcacagagctacagaagacagttaaagagagagagaaagatgcatcatcttgccaggaacagttggatgaattccggaagctggtcaggaccttccagaaatggttgaaagaaactgaagggagtattccacctacggaaacttctatgagtgctaaagagttagaaaagcagattgaacacctgaagagtctactagatgactgggcaagtaagggaactctggtggaagaaatcaattgcaaaggtacttctttagaaaatctcatcatggaaatcacagcacctgattcccaaggcaagacaggttccatactgccctctgtaggaagctctgtaggcagtgtaaacggataccacacctgcaaagatctgacggagatccagtgtgacatgtcagatgtaaacttgaagtatgagaaactagggggagtacttcatgaacgccaggaaagccttcaggctatcctcaacagaatggaggaggttcacaaggaggcaaactctgtgctgcagtggctggaatcaaaagaggaagtcctgaaatccatggatgccatgtcatctccaaccaagacagaaacagtgaaagcccaagctgaatctaacaaggccttcctggctgagttggaacagaattctccaaaaattcaaaaagtaaaggaagccctggctggattactggtgacatatcccaactcacaggaagcagaaaattggaagaaaattcaggaagaactcaattcccgatgggaaagggccactgaggttactgtggctcggcaaaggcagctagaggaatctgcaagtcatctggcctgcttccaggctgcagaatcccagctccggccgtggctgatggagaaagaactgatgatgggagtgctggggcccctgtctattgaccccaacatgttgaatgcacaaaagcaacaggtccagtttatgctaaaggaatttgaagcacgcaggcaacagcatgagcaactgaatgaggcagctcagggcatcctaacaggccctggagatgtctctctgtccaccagccaagtacagaaagaactccagagcatcaatcagaaatgggttgagctgactgacaaactcaactcccgttccagccaaattgaccaagctattgttaagagcacccagtaccaggaactgctccaggacttatcagagaaggtgagggcagttggacaacggctgagtgtccagtcagctatcagcacccaaccagaggctgtaaagcagcaattggaagagaccagtgaaattcgatctgacttggagcagttagaccacgaggttaaggaggctcagacactgtgcgatgaactctcagtgctcattggtgagcagtacctcaaggatgaactgaagaagcgtttggagacagttgccctgcctctccaaggtttagaagaccttgcagccgatcgcattaacagactccaggcagctcttgccagcacccagcagttccagcaaatgtttgatgagttgaggacctggttggatgataaacaaagccagcaagcaaaaaactgcccaatttctgcaaaattggagcggctacagtctcagctacaggagaatgaagagtttcagaaaagtcttaatcaacacagtggctcctatgaggtgattgtggctgaaggggaatctctacttctttctgtacctcctggagaagagaaaaggactctacaaaaccagttggttgagctcaaaaaccattgggaagagcttagtaaaaaaactgcagacagacaatccaggctcaaggattgtatgcagaaagctcagaaatatcagtggcatgtggaagaccttgtgccatggatagaagattgtaaagctaagatgtctgagttgcgagtcactctggatccagtgcagctagagtccagtctcctaagatcaaaggctatgctgaatgaggtggagaagcgccgctccctgctggaaatattgaatagtgctgctgacattctgatcaattcttcagaagcagatgaggatggaatccgggatgagaaggctgggatcaaccagaacatggatgctgttacagaagagctgcaggccaaaacagggtcactcgaagaaatgactcagaggctcagggagttccaggaaagctttaagaatattgaaaagaaggttgaaggagccaaacaccaacttgagatctttgatgctctgggttctcaagcctgtagcaacaagaacctggagaagctaagagctcaacaggaagtgctgcaggccctagagcctcaggtagactatctgaggaactttactcagggtctggtagaagatgccccagatggatctgatgcttctcaacttctccaccaagctgaggtcgcccagcaagagttcctcgaagttaagcaaagagtgaacagtggttgtgtgatgatggaaaacaagctggaggggattggccagtttcactgccgggtccgagagatgttctctcaattggcagacctggatgatgagctagatggcatgggtgctattggcagagacactgatagcctccagtcccaaatcgaggatgtccggctattccttaacaaaattcacgtcctcaaattagacatagaggcctctgaagcagagtgtcgacatatgctagaagaagaggggactctggatttgttaggtctcaaaagggagctagaagccctgaacaaacagtgtggcaaactgacagagagggggaaagctcgtcaggaacagctggaactgacactaggccgtgtagaggacttctacaggaaattgaaaggactcaatgacgcgaccacagcagcagaggaggcagaggccctccagtgggtagtggggaccgaagtggaaatcatcaaccaacaattagcagattttaaaatgtttcagaaagaacaagtggatcctcttcagatgaaattgcagcaggtgaatggacttggccagggattaattcagagtgcaggaaaagactgtgatgtacagggtttagaacatgacatggaagagatcaatgctcgatggaatacattgaataaaaaggtcgcacaaagaattgcacagctacaggaagctttgttgcattgtgggaagtttcaagatgccttggagccattgctcagctggttggcagataccgaggagctcatagccaatcagaaacctccatctgctgagtataaagtggtgaaagcacagatccaagaacagaagttgctccagcggctcctagatgatcgaaaggccacagtagacatgcttcaagcagaaggaggcagaatagcccagtcagcagagctggctgatagagagaaaatcactggacagctggagagtcttgaaagtagatggactgaactactcagtaaggcagcagccaggcaaaaacagctggaagacatcctggttctggccaaacagttccatgagacagctgagcctatttctgacttcttatctgtcacagagaaaaagcttgctaactcagaacctgttggcactcagactgccaaaatacagcagcagatcattcggcacaaggctctggaagaagacatagaaaaccatgcaacagatgtgcaccaggcagtcaaaattgggcagtccctctcctccctgacatctcctgcagaacagggtgtgctgtcagaaaagatagactcattgcaggcccgatacagtgaaattcaagaccgctgttgtcggaaggcagccctacttgaccaagctctgtctaatgctaggctgtttggggaggatgaggtggaggtgctcaactggctggctgaggttgaggacaagctcagttcagtgttcgtaaaggatttcaaacaggatgtcctgcacaggcagcatgctgaccacctggctttaaatgaagaaattgttaatagaaagaagaatgtagatcaagctattaaaaatggtcaggctcttctaaaacaaaccacaggtgaggaggtgttacttatccaggaaaaactagatggtataaagactcgttacgcagacatcacagttactagctccaaggccctcagaactttagagcaagcccggcagctggccaccaagttccagtctacttatgaggaactgaccgggtggctgagggaggtggaggaggagctggcaaccagtggaggacagtctcccacaggggaacagataccccagtttcagcagagacagaaggaattaaagaaggaggtcatggagcacaggctggtgttggacacagtgaatgaggtgagccgtgctctcttagagctggtgccctggagagccagagaagggctggataaacttgtgtccgatgctaacgagcagtacaaactagtcagtgacactattggacaaagggtggatgaaattgatgctgctattcagagatcacaacagtatgagcaagctgccgatgcagaactagcttgggttgctgaaacaaaacggaaactgatggctctgggtccaattcgcctggaacaggaccagaccacagctcagcttcaggtacagaaggctttctccattgacattattcgacacaaagattcaatggatgaactcttcagtcaccgtagtgaaatctttggcacatgtggggaggagcaaaaaactgtattacaggaaaagacagagtctctaatacagcaatatgaagccattagcctactcaattcagagcgttatgcccgcctagagcgggcccaggtcttagtaaaccagttttgggaaacttatgaagagctcagcccctggattgaggaaactcgggcactaatagcacagttaccctctccagccattgatcatgagcagctcaggcagcaacaagaggaaatgaggcaattaagggaatctattgctgaacacaaacctcatattgacaaactactaaagataggcccacaactaaaggaattaaaccctgaggaaggggaaatggtggaagaaaaataccagaaagcagaaaacatgtatgcccaaataaaggaggaggtgcgccagcgagccctggctctggatgaagccgtgtcccagtccacacagattacagagtttcatgataaaattgagcctatgttggagacactggagaatctttcctctcgcctgcgtatgccaccactgatccctgctgaagtagacaagatcagagagtgcatcagtgacaataagagtgccaccgtggagctagaaaaactgcagccatcctttgaggccttgaagcgccgtggagaggagcttattggacgatctcagggagcagacaaggatctggctgcaaaagaaatccaggataaattggatcaaatggtattcttctgggaggacatcaaagctcgggctgaagaacgagaaatcaaatttcttgatgtccttgaattagcagagaagttctggtatgacatggcagctctcctgaccaccatcaaagacacccaggatattgtccatgacttggaaagcccaggcattgatccttccatcatcaaacaacaggttgaagctgctgagactattaaggaagagacagatggtctgcatgaagagctggagtttattcggatccttggagcagatttgatttttgcctgtggagaaactgagaagcctgaagtgaggaagagcattgatgagatgaataatgcttgggagaacttaaacaaaacatggaaagagaggctagaaaaacttgaggatgctatgcaagctgctgtgcagtatcaggacactcttcaggctatgtttgactggctagataacactgtgattaaactctgcaccatgccccctgttggcactgacctcaatactgttaaagatcagttaaatgaaatgaaggagttcaaagtagaagtttaccaacagcaaattgagatggagaagcttaatcaccagggtgaactgatgttaaagaaagctactgatgagacggacagagacattatacgagaaccactgacagaactcaaacacctctgggagaacctgggtgagaaaattgcccaccgacagcacaaactagaaggggctctgttggcccttggtcagttccagcatgccttagaggaactaatgagttggctgactcataccgaagagttgttagatgctcagagaccaataagtggagacccaaaagtcattgaagttgagctcgcaaagcaccatgtcctaaaaaatgatgttttggctcatcaagccacagtggaaacagtcaacaaagctggcaatgagcttcttgaatccagtgctggagatgatgccagcagcttaaggagccgtttggaagccatgaaccaatgctgggagtcagtgttacagaaaacagaggagagggagcagcagcttcagtcaactctgcagcaggcccagggcttccacagtgaaattgaagatttcctcttggaacttactagaatggagagccagctttctgcatctaagcccacaggaggacttcctgaaactgctagggaacagcttgatacacatatggaactctattcccagctgaaagccaaggaagagacttataatcaactacttgacaagggcagactcatgcttctaagccgtgacgactctgggtctggctccaagacagaacagagtgtagcacttttggagcagaagtggcatgtggtcagcagtaagatggaagaaagaaagtcaaagctggaagaggccctcaacttggcaacagaattccagaattccctacaagaatttatcaactggctcactctagcagagcagagtttaaacatcgcttctccaccaagcctgattctaaatactgtcctttcccagatagaagagcacaaggtttttgctaatgaagtaaatgctcatcgagaccagatcattgagctggatcaaactgggaatcaattaaagttccttagccaaaagcaggatgttgttctgatcaagaatttgttggtgagcgtgcagtctcgatgggagaaggttgtccagcgatctattgaaagagggcgatcactagatgatgccaggaagcgggcaaaacaattccatgaagcttggaaaaaactgattgactggctagaagatgcagagagtcacctggactcagaactagagatatccaatgacccagacaaaattaaacttcagctttctaagcataaggagtttcagaagactcttggtggcaagcagcctgtgtatgataccacaattagaactggcagagcactgaaagaaaagactttgcttcccgaagatagtcagaaacttgacaatttcctaggagaagtcagagacaaatgggatactgtttgtggcaagtctgtggagcggcagcacaagttggaggaagccctgctcttttcgggtcagttcatggatgctttgcaggcattggttgactggttatacaaggtggagccacagctggctgaggaccagcccgtgcacggggaccttgacctcgtcatgaacctcatggatgcacacaaggttttccagaaggaactgggaaagcgaacaggaaccgttcaggtcctgaagcggtcaggccgagagctgattgagaatagtcgagatgacaccacttgggtaaaaggacagctccaggaactgagcactcgctgggacactgtctgtaaactctctgtttccaaacaaagccggcttgagcaggccttaaaacaagcggaagtgtttcgagacacagtccacatgctgttggagtggctttctgaagcagagcaaacgcttcgctttcggggagcacttcctgatgacacagaggccctgcagtctctcattgacacccataaggaattcatgaagaaagtagaagaaaagcgagtggacgttaactcagcagtagccatgggagaagtcatcctggctgtctgccaccccgattgcatcacaaccatcaaacactggatcaccatcatccgagctcgcttcgaggaggtcctgacatgggctaagcagcaccagcagcgtcttgaaacggccttgtcagaactggtggctaatgctgagctcctggaagaacttctggcatggatccagtgggctgagaccaccctcattcagcgggatcaggagccaatcccgcagaacattgaccgagttaaagcccttatcgctgagcatcagacatttatggaggagatgactcgcaaacagcctgacgtggaccgggtcaccaagacatacaaaaggaaaaacatagagcctactcacgcgcctttcatagagaaatcccgcagcggaggcaggaaatccctaagtcagccaacccctcctcccatgccaatcctttcacagtctgaagcaaaaaacccacggatcaaccagctttctgcccgctggcagcaggtgtggctgttagcactggagcggcaaaggaaactgaatgatgccttggatcggctggaggagttgaaagaatttgccaactttgactttgatgtctggaggaaaaagtatatgcgttggatgaatcacaaaaagtctcgagtgatggatttcttccggcgcattgataaggaccaggatgggaagataacacgtcaggagtttatcgatggcattttagcatccaagttccccaccaccaagttagagatgactgctgtggctgacattttcgaccgagatggggatggttacattgattattatgaatttgtggctgctcttcatcccaacaaggatgcgtatcgaccaacaaccgatgcagataaaatcgaagatgaggttacaagacaagtggctcagtgcaaatgtgcaaaaaggtttcaggtggagcagatcggagagaataaataccggttcttcctcggcaatcagtttggggattctcagcagttgcggctggtccgtattctgcgcagcaccgtgatggttcgcgttggtggaggatggatggccttggatgaatttttagtgaaaaatgatccctgccgagcacgaggtagaactaacattgaacttagagagaaattcatcctaccagagggagcatcccagggaatgacccccttccgctcacggggtcgaaggtccaaaccatcttcccgggcagcttcccctactcgttccagctccagtgctagtcagagtaaccacagctgtacatccatgccatcttctccagccaccccagccagtggaaccaaggttatcccatcatcaggtagcaagttgaaacgaccaacaccaacttttcattctagtcggacatcccttgctggtgataccagcaatagttcttccccggcctccacaggtgccaaaactaatcgggcagaccctaaaaagtctgccagtcgccctgggagtcgggctgggagtcgagccgggagtcgagccagcagccggcgaggaagtgacgcttctgactttgacctcttagagacgcagtctgcttgttccgacacttcagaaagcagcgctgcagggggccaaggcaactccaggagagggctaaacaaaccttccaaaatcccaaccatgtctaagaagaccaccactgcctcccccaggactccaggtcccaagcgataacactgtctaagcacccccaagccactatccactttgaatcctgctccatacattgggtgtatatttattctgaacgggagaagttatattgttaaaagtgtaaaagaataattgtgttatgaagctgccttattttttttctttttgtaagttactattttcatgtgaatatttatgtagataaaatttgcctcctggtaaccctgtaatggatggggcccagaaatgaaatatttgagaaaaacaagtgaaaaggtcaagatacaaatgtgtattaaaaaaaaaaaagcctattaatagggtttctgcgcggtgcagggttgtaaacctgctttatcttttaggattattcctaaatgcatcttctttataaacttgacttgctatctcagcaagataaattatattaaaaaaataagaatcctgcagtgtttaaggaactctttttttgtaaatcacggacacctcaattagcaagaactgaggggagggctttttccattgtttaatgttttgtgatttttagctaaagagagggaacctcatctaagtaacatttgcacatgatacagcaaaaggagttcattgcaatactgtctttggatattgtttcagtactgggtgtttaaaggacaaatagctgctagaattcaggggtaaatgtaagtgttcagaaaacgtcagaacatttggggttttaaactgatttgttgctccctatccagcctagacaccagtaactcttgtgttcaccaggacccagacccttggcaagggataggctcgttggtgacattgtgaatttcagatttgttttatccactttttttgctatttatttaaatggtcgatcaacttcccacaaactgaggaatgaattccacgagcctgttctgaaaatgtggacgtaagacaaacacgtgctcgtcctttaatggagttcaccagcacacttgttaaccagtcctgtttgctttcgtctttttttgtgcgtaataaagtcaactgaccaagtgaccatgaaaaggggctgtctggggctcctgttttttagctgctgttcttcagctccgaccatgttgctgtgtgattatctcaattggttttaattgaggcagaaactgaagctctaccaatgaactgtttagaaacaagacacacttttgtattaaaattgcttgcagtaacaaata

SEQ ID NO: 153896 - DNA, 2824 bp, Homo sapiens
  Payload ID: 10253
  Gene Symbol: MACF1
  Gene Name: microtubule-actin crosslinking factor 1
  ENST ID: ENST00000360115
  CDS Start-End: 1-1631
ctcgcttcgaggaggtcctgacatgggctaagcagcaccagcagcgtcttgaaacggccttgtcagaactggtggctaatgctgagctcctggaagaacttctggcatggatccagtgggctgagaccaccctcattcagcgggatcaggagccaatcccgcagaacattgaccgagttaaagcccttatcgctgagcatcagacatttatggaggagatgactcgcaaacagcctgacgtggaccgggtcaccaagacatacaaaaggaaaaacatagagcctactcacgcgcctttcatagagaaatcccgcagcggaggcaggaaatccctaagtcagccaacccctcctcccatgccaatcctttcacagtctgaagcaaaaaacccacggatcaaccagctttctgcccgctggcagcaggtgtggctgttagcactggagcggcaaaggaaactgaatgatgccttggatcggctggaggagcagctatgcctggaattgaaagaatttgccaactttgactttgatgtctggaggaaaaagtatatgcgttggatgaatcacaaaaagtctcgagtgatggatttcttccggcgcattgataaggaccaggatgggaagataacacgtcaggagtttatcgatggcattttagcatccaagttccccaccaccaagttagagatgactgctgtggctgacattttcgaccgagatggggatggttacattgattattatgaatttgtggctgctcttcatcccaacaaggatgcgtatcgaccaacaaccgatgcagataaaatcgaagatgaggttacaagacaagtggctcagtgcaaatgtgcaaaaaggtttcaggtggagcagatcggagagaataaataccggttcttcctcggcaatcagtttggggattctcagcagttgcggctggtccgtattctgcgcagcaccgtgatggttcgcgttggtggaggatggatggccttggatgaatttttagtgaaaaatgatccctgccgagcacgaggtagaactaacattgaacttagagagaaattcatcctaccagagggagcatcccagggaatgacccccttccgctcacggggtcgaaggtccaaaccatcttcccgggcagcttcccctactcgttccagctccagtgctagtcagagtaaccacagctgtacatccatgccatcttctccagccaccccagccagtggaaccaaggttatcccatcatcaggtagcaagttgaaacgaccaacaccaacttttcattctagtcggacatcccttgctggtgataccagcaatagttcttccccggcctccacaggtgccaaaactaatcgggcagaccctaaaaagtctgccagtcgccctgggagtcgggctgggagtcgagccgggagtcgagccagcagccggcgaggaagtgacgcttctgactttgacctcttagagacgcagtctgcttgttccgacacttcagaaagcagcgctgcagggggccaaggcaactccaggagagggctaaacaaaccttccaaaatcccaaccatgtctaagaagaccaccactgcctcccccaggactccaggtcccaagcgataacactgtctaagcacccccaagccactatccactttgaatcctgctccatacattgggtgtatatttattctgaacgggagaagttatattgttaaaagtgtaaaagaataattgtgttatgaagctgccttattttttttctttttgtaagttactattttcatgtgaatatttatgtagataaaatttgcctcctggtaaccctgtaatggatggggcccagaaatgaaatatttgagaaaaacaagtgaaaaggtcaagatacaaatgtgtattaaaaaaaaaaaagcctattaatagggtttctgcgcggtgcagggttgtaaacctgctttatcttttaggattattcctaaatgcatcttctttataaacttgacttgctatctcagcaagataaattatattaaaaaaataagaatcctgcagtgtttaaggaactctttttttgtaaatcacggacacctcaattagcaagaactgaggggagggctttttccattgtttaatgttttgtgatttttagctaaagagagggaacctcatctaagtaacatttgcacatgatacagcaaaaggagttcattgcaatactgtctttggatattgtttcagtactgggtgtttaaaggacaaatagctgctagaattcaggggtaaatgtaagtgttcagaaaacgtcagaacatttggggttttaaactgatttgttgctccctatccagcctagacaccagtaactcttgtgttcaccaggacccagacccttggcaagggataggctcgttggtgacattgtgaatttcagatttgttttatccactttttttgctatttatttaaatggtcgatcaacttcccacaaactgaggaatgaattccacgagcctgttctgaaaatgtggacgtaagacaaacacgtgctcgtcctttaatggagttcaccagcacacttgttaaccagtcctgtttgctttcgtctttttttgtgcgtaataaagtcaactgaccaagtgaccatgaaaaggggctgtctggggctcctgttttttagctgctgttcttcagctccgaccatgttgctgtgtgattatctcaattggttttaattgaggcagaaactgaagctctaccaatgaactgtttagaaacaagacacacttttgtattaaaattgcttgcagtaacaaata

SEQ ID NO: 153897 - DNA, 17538 bp, Homo sapiens
  Payload ID: 10253
  Gene Symbol: MACF1
  Gene Name: microtubule-actin crosslinking factor 1
  Uniprot ID: Q9UPN3
  ENST ID: ENST00000361689
  CDS Start-End: 53-16345
atcacttctccctgggctcccaggccctcctgcagcagcccccgcctgggccatgtcttcctcagatgaagagacgctcagtgagcggtcatgtcggagtgagcggtcttgtcggagtgagcgatcttacaggagcgagcggtcggggagcctgtctccctgtcccccaggggacaccttgccctggaacctgccactgcatgagcagaaaaagcggaaaagccaggattcggtgctggaccctgcagagcgtgctgtggtcagagtcgctgatgaacgggaccgggttcagaagaaaacgttcaccaagtgggtcaacaagcacttaatgaaggtccgcaagcacatcaatgatctttatgaagatctgcgggatggccataacctgatctctctgttggaggtcctctcaggcatcaaactgccccgggagaagggcaggatgcgttttcataggctgcagaatgtgcagattgccctggacttcctaaagcagcgacaggtgaaactagtgaatattcgcaatgatgacatcacagatggcaaccccaagttgaccctgggtctgatctggaccattattttgcatttccagatctctgacatctacattagtggagaatcaggggatatgtcagccaaggagaaactactcctgtggacccagaaggtgacagctggttacacaggaatcaaatgcaccaacttttcctcctgctggagtgatgggaagatgttcaatgcactcattcaccgataccgacccgatctagtagacatggagagggtgcaaatccaaagtaaccgagagaatctggaacaggcttttgaagtggcagaaagactgggggtcactcgcctgctggatgcagaagatgtggatgtgccatctccagatgaaaagtctgtaatcacttatgtgtcttcgatttatgatgccttccctaaagttcctgagggtggagaagggatcagtgctacggaagtggactccaggtggcaagaataccaaagccgagtggactccctcattccctggatcaaacagcatacaatactgatgtcagataaaacttttccccaaaaccctgttgaactaaaggcactttataaccaatatatacacttcaaagaaacagaaattctggccaaggagagagaaaaaggaagaattgaggaattatataaattactagaggtgtggattgaatttggccgaattaaactgcctcaaggttatcaccctaatgatgtggaagaagagtggggaaagctcatcatagagatgctggaacgagagaaatcacttcggccggctgtggagaggctggaattgctgctacagattgcaaacaaaatccagaatggtgctttgaactgtgaagaaaaactgacactagctaagaatacactgcaggctgatgctgctcacctggaatcaggacaaccggtacaatgtgagtcagatgtcattatgtacattcaggagtgtgaaggtctcatcaggcagctgcaggtggatctccagatcctgcgggatgagaattactaccagctagaagagctggcttttagggtcatgcgtcttcaggatgagctggtcaccttgcgtctagagtgtacaaacctgtaccggaagggtcatttcacttcacttgaattggttccaccctctactttaaccaccactcatctgaaagcagaacccttaaccaaggcaacccattcttcttctacctcctggttccgaaagcctatgactcgggctgaacttgtggccatcagctcctctgaagatgaaggcaatctccgatttgtgtatgaactactgtcttgggtagaagagatgcagatgaaactggagcgagcagagtggggcaatgacctgcctagtgtggagttgcagctagaaacacagcagcacatccatacgagtgtagaagagctgggctcaagtgtcaaggaggccaggttgtatgagggaaagatgtcccagaatttccataccagctatgctgaaactcttggaaagctggagacacagtattgtaaattgaaggaaacttctagcttccggatgaggcaccttcagagcctgcataaatttgtttccagagctacagctgagttgatctggttgaatgagaaggaggaggaggaactagcatatgactggagtgacaacaattccaatatctcagccaagagaaattacttctctgagttgacaatggaactggaggagaaacaggatgtgtttcgttctctacaagatacagcagaactactttcacttgagaaccacccagccaagcagacagtggaggcttacagtgctgctgtccagtcccagttgcagtggatgaagcagctgtgcctgtgtgttgagcagcatgtgaaagagaatactgcttattttcagttcttcagtgatgcacgagagctggagtcattcttgaggaacctccaagattccattaaacgaaaatattcctgtgaccacaacaccagcttatcccgccttgaagacctgctccaggactccatggatgaaaaggagcagcttatacagtccaagagttccgttgccagtctcgttgggagatcaaaaaccatcgttcagctaaaaccacgcagtccagaccatgtgttaaagaacaccatttctgtcaaggctgtctgtgactacaggcagatcgagattactatttgcaaaaatgatgaatgtgtgctagaagataattctcagcggaccaaatggaaagtgatcagccccacagggaacgaggcaatggtgccgtcagtctgcttcctcatccccccacccaataaggatgccattgagatggccagcagggtcgaacaatcttatcagaaggttatggccctttggcatcagctgcatgttaacaccaaaagccttatctcttggaactatctgcgtaaagaccttgaccttgtacagacctggaacctagaaaagcttcgatcctcagcaccaggggagtgccatcagattatgaagaaccttcaggcccactatgaagactttctgcaggatagtcgtgactctgtgctgttctcagtggctgatcgcttgcgcttggaagaggaggtggaagcttgtaaagcccgcttccagcacctgatgaagtccatggagaatgaggacaaagaggagactgtggccaagatgtacatttcagagttgaagaacatccggctacgcctggaggagtatgaacagagggtggtcaaacgaattcagtctctagccagctctaggactgacagagatgcctggcaggacaatgcattaaggattgcagagcaagagcacacccaggaggatttacagcaattgaggtcagacttggatgcagtttctatgaaatgtgacagctttctccatcagtctccatctagttcaagtgtcccaactctgcgctcagaactgaatctgctggtggagaagatggaccatgtctatggtctctctactgtatatctgaataagttaaagacagttgatgttatagtacgtagcatacaggatgctgaactcttggtcaaaggttatgagattaagctgagtcaagaagaagtagtactggcagatctctcagctctggaggcccattggtcgacattacggcactggcttagtgatgtgaaggacaagaattcagtgttttcagtcctggatgaggaaattgccaaggccaaggtagtggcagagcagatgagtcgtctgacaccagagcgaaatctggatttggagcgctatcaggaaaaaggctcccagctgcaggagcgttggcaccgagtcattgcccagctcgagattcgccaatctgagctagaaagtatccaggaagttctgggagattaccgagcctgccatggaactctcatcaagtggattgaggaaaccactgcccagcaggaaatgatgaagccaggccaggcagaggatagcagagtgctttcggagcagctcagccagcagacggccctatttgcagaaattgagagaaatcagacaaaactggatcaatgtcaaaaattttcccagcagtactctactattgtaaaggactatgaattgcaactgatgacatacaaggcctttgtggaatcgcagcagaaatcccctggcaagcgccgtcgcatgctttcctcttcagatgccatcactcaagagttcatggacttaaggactcgctacacggcattggtgactttaacaactcagcacgtgaaatacatcagtgatgcactccggcgtctggaggaggaggagaaagtggtagaagaggagaaacaagaacatgtggagaaggttaaagaacttttgggctgggtgtctaccctagcgaggaatacacaaggaaaagctacctcatccgagaccaaagaatcaacagacattgaaaaagctattttggaacagcaggttctgtcagaagagctgacaacaaagaaagaacaagtctctgaagctattaaaacatcacagatcttcttggccaagcatggtcataagctctcagaaaaagagaagaaacaaatatctgagcaattgaatgccctaaacaaggcttaccatgacctttgtgatggttctgcaaatcagcttcagcagcttcagagccagttggctcaccagacagaacaaaagaccctgcagaaacaacaaaatacctgtcaccagcaactggaggatctttgcagttgggtaggacaggcagaaagagcactggcaggccaccaaggcagaaccacccagcaggatctctctgctttgcagaagaaccaaagtgacttgaaggatttacaggatgacattcagaatcgtgccacctcatttgccactgttgtcaaggacattgaggggttcatggaagagaatcagaccaagctgagcccacgtgagttgacagctcttcgggaaaagcttcatcaggctaaggagcaatatgaggcgctccaggaagagacacgtgtggcccagaaggaactggaggaagcagtgacctccgccttacagcaggagactgaaaagagtaaagcagcaaaggaactggcagagaacaagaagaagatcgatgctctcctggattgggtaacttcagtaggatcatctggtggacagctgctgaccaaccttccaggaatggagcagctctcgggagctagcttggagaaaggagccttggacaccactgatggttacatgggggtgaatcaagccccagagaaactggacaagcaatgtgagatgatgaaggcccgtcaccaagaattgctgtcccagcagcaaaatttcattctggccacccagtcagctcaggccttcttggatcagcatggccacaatctcacacctgaggagcaacagatgctgcaacagaagctgggagagctaaaggaacaatactctacttccctggcccaatcagaggcagaactgaagcaggtgcagacacttcaggatgagttgcagaaatttctgcaggatcataaagagtttgaaagctggttggaacgatccgagaaagagctggagaacatgcataagggaggcagcagccccgagacccttccctccctgctaaagcggcaaggaagcttctcagaggatgtcatttcccacaaaggagacttgagatttgtgactatctcaggacagaaagtcttggacatggaaaacagttttaaggaaggcaaagaaccatcagaaattggaaacttagtaaaggacaagttgaaggatgcaacagaaagatacactgctctccactcaaagtgtacacgattaggatctcacctgaatatgctgttaggccagtatcatcaattccaaaacagtgctgacagcctgcaggcctggatgcaggcttgtgaggccaacgtggagaagctcctctcagatactgttgcctctgaccctggagttctccaggagcagcttgcaacaacaaagcagttgcaggaggaattggctgagcaccaagtacctgtggaaaaactccaaaaagtagctcgtgacataatggaaattgaaggggagccagccccagaccacaggcatgttcaagaaactacagattccatactcagccacttccaaagcctctcctatagcctggctgagcgatcttctctgctgcagaaagcaattgcccaatctcagagtgtccaggaaagcctggagagcctgttgcagtctattggggaagttgaacaaaacctggaagggaagcaggtgtcatcactctcatcaggagtcatccaggaagccttagccacaaatatgaaattgaagcaggacattgctcggcaaaagagcagcttggaggccacccgtgagatggtgacccgattcatggagacagcagacagtactacagcagcagtgctgcagggcaaactggcagaggtgagccagcggttcgaacagctctgtctacagcagcaagaaaaggagagctccctaaagaagcttctaccccaggcagagatgtttgaacacctctctggtaagctgcagcagttcatggaaaacaaaagtcggatgctggcctctggaaatcagccagatcaagatattacacatttcttccaacagatccaggagctcaatttggaaatggaagaccaacaggagaacctagatactcttgagcacctggtcactgaactgagctcttgtggctttgcgctggacttgtgccagcatcaggacagggtacagaatctaagaaaagacttcacagagctacagaagacagttaaagagagagagaaagatgcatcatcttgccaggaacagttggatgaattccggaagctggtcaggaccttccagaaatggttgaaagaaactgaagggagtattccacctacggaaacttctatgagtgctaaagagttagaaaagcagattgaacacctgaagagtctactagatgactgggcaagtaagggaactctggtggaagaaatcaattgcaaaggtacttctttagaaaatctcatcatggaaatcacagcacctgattcccaaggcaagacaggttccatactgccctctgtaggaagctctgtaggcagtgtaaacggataccacacctgcaaagatctgacggagatccagtgtgacatgtcagatgtaaacttgaagtatgagaaactagggggagtacttcatgaacgccaggaaagccttcaggctatcctcaacagaatggaggaggttcacaaggaggcaaactctgtgctgcagtggctggaatcaaaagaggaagtcctgaaatccatggatgccatgtcatctccaaccaagacagaaacagtgaaagcccaagctgaatctaacaaggccttcctggctgagttggaacagaattctccaaaaattcaaaaagtaaaggaagccctggctggattactggtgacatatcccaactcacaggaagcagaaaattggaagaaaattcaggaagaactcaattcccgatgggaaagggccactgaggttactgtggctcggcaaaggcagctagaggaatctgcaagtcatctggcctgcttccaggctgcagaatcccagctccggccgtggctgatggagaaagaactgatgatgggagtgctggggcccctgtctattgaccccaacatgttgaatgcacaaaagcaacaggtccagtttatgctaaaggaatttgaagcacgcaggcaacagcatgagcaactgaatgaggcagctcagggcatcctaacaggccctggagatgtctctctgtccaccagccaagtacagaaagaactccagagcatcaatcagaaatgggttgagctgactgacaaactcaactcccgttccagccaaattgaccaagctattgttaagagcacccagtaccaggaactgctccaggacttatcagagaaggtgagggcagttggacaacggctgagtgtccagtcagctatcagcacccaaccagaggctgtaaagcagcaattggaagagaccagtgaaattcgatctgacttggagcagttagaccacgaggttaaggaggctcagacactgtgcgatgaactctcagtgctcattggtgagcagtacctcaaggatgaactgaagaagcgtttggagacagttgccctgcctctccaaggtttagaagaccttgcagccgatcgcattaacagactccaggcagctcttgccagcacccagcagttccagcaaatgtttgatgagttgaggacctggttggatgataaacaaagccagcaagcaaaaaactgcccaatttctgcaaaattggagcggctacagtctcagctacaggagaatgaagagtttcagaaaagtcttaatcaacacagtggctcctatgaggtgattgtggctgaaggggaatctctacttctttctgtacctcctggagaagagaaaaggactctacaaaaccagttggttgagctcaaaaaccattgggaagagcttagtaaaaaaactgcagacagacaatccaggctcaaggattgtatgcagaaagctcagaaatatcagtggcatgtggaagaccttgtgccatggatagaagattgtaaagctaagatgtctgagttgcgagtcactctggatccagtgcagctagagtccagtctcctaagatcaaaggctatgctgaatgaggtggagaagcgccgctccctgctggaaatattgaatagtgctgctgacattctgatcaattcttcagaagcagatgaggatggaatccgggatgagaaggctgggatcaaccagaacatggatgctgttacagaagagctgcaggccaaaacagggtcactcgaagaaatgactcagaggctcagggagttccaggaaagctttaagaatattgaaaagaaggttgaaggagccaaacaccaacttgagatctttgatgctctgggttctcaagcctgtagcaacaagaacctggagaagctaagagctcaacaggaagtgctgcaggccctagagcctcaggtagactatctgaggaactttactcagggtctggtagaagatgccccagatggatctgatgcttctcaacttctccaccaagctgaggtcgcccagcaagagttcctcgaagttaagcaaagagtgaacagtggttgtgtgatgatggaaaacaagctggaggggattggccagtttcactgccgggtccgagagatgttctctcaattggcagacctggatgatgagctagatggcatgggtgctattggcagagacactgatagcctccagtcccaaatcgaggatgtccggctattccttaacaaaattcacgtcctcaaattagacatagaggcctctgaagcagagtgtcgacatatgctagaagaagaggggactctggatttgttaggtctcaaaagggagctagaagccctgaacaaacagtgtggcaaactgacagagagggggaaagctcgtcaggaacagctggaactgacactaggccgtgtagaggacttctacaggaaattgaaaggactcaatgacgcgaccacagcagcagaggaggcagaggccctccagtgggtagtggggaccgaagtggaaatcatcaaccaacaattagcagattttaaaatgtttcagaaagaacaagtggatcctcttcagatgaaattgcagcaggtgaatggacttggccagggattaattcagagtgcaggaaaagactgtgatgtacagggtttagaacatgacatggaagagatcaatgctcgatggaatacattgaataaaaaggtcgcacaaagaattgcacagctacaggaagctttgttgcattgtgggaagtttcaagatgccttggagccattgctcagctggttggcagataccgaggagctcatagccaatcagaaacctccatctgctgagtataaagtggtgaaagcacagatccaagaacagaagttgctccagcggctcctagatgatcgaaaggccacagtagacatgcttcaagcagaaggaggcagaatagcccagtcagcagagctggctgatagagagaaaatcactggacagctggagagtcttgaaagtagatggactgaactactcagtaaggcagcagccaggcaaaaacagctggaagacatcctggttctggccaaacagttccatgagacagctgagcctatttctgacttcttatctgtcacagagaaaaagcttgctaactcagaacctgttggcactcagactgccaaaatacagcagcagatcattcggcacaaggctctggaagaagacatagaaaaccatgcaacagatgtgcaccaggcagtcaaaattgggcagtccctctcctccctgacatctcctgcagaacagggtgtgctgtcagaaaagatagactcattgcaggcccgatacagtgaaattcaagaccgctgttgtcggaaggcagccctacttgaccaagctctgtctaatgctaggctgtttggggaggatgaggtggaggtgctcaactggctggctgaggttgaggacaagctcagttcagtgttcgtaaaggatttcaaacaggatgtcctgcacaggcagcatgctgaccacctggctttaaatgaagaaattgttaatagaaagaagaatgtagatcaagctattaaaaatggtcaggctcttctaaaacaaaccacaggtgaggaggtgttacttatccaggaaaaactagatggtataaagactcgttacgcagacatcacagttactagctccaaggccctcagaactttagagcaagcccggcagctggccaccaagttccagtctacttatgaggaactgaccgggtggctgagggaggtggaggaggagctggcaaccagtggaggacagtctcccacaggggaacagataccccagtttcagcagagacagaaggaattaaagaaggaggtcatggagcacaggctggtgttggacacagtgaatgaggtgagccgtgctctcttagagctggtgccctggagagccagagaagggctggataaacttgtgtccgatgctaacgagcagtacaaactagtcagtgacactattggacaaagggtggatgaaattgatgctgctattcagagatcacaacagtatgagcaagctgccgatgcagaactagcttgggttgctgaaacaaaacggaaactgatggctctgggtccaattcgcctggaacaggaccagaccacagctcagcttcaggtacagaaggctttctccattgacattattcgacacaaagattcaatggatgaactcttcagtcaccgtagtgaaatctttggcacatgtggggaggagcaaaaaactgtattacaggaaaagacagagtctctaatacagcaatatgaagccattagcctactcaattcagagcgttatgcccgcctagagcgggcccaggtcttagtaaaccagttttgggaaacttatgaagagctcagcccctggattgaggaaactcgggcactaatagcacagttaccctctccagccattgatcatgagcagctcaggcagcaacaagaggaaatgaggcaattaagggaatctattgctgaacacaaacctcatattgacaaactactaaagataggcccacaactaaaggaattaaaccctgaggaaggggaaatggtggaagaaaaataccagaaagcagaaaacatgtatgcccaaataaaggaggaggtgcgccagcgagccctggctctggatgaagccgtgtcccagtccacacagattacagagtttcatgataaaattgagcctatgttggagacactggagaatctttcctctcgcctgcgtatgccaccactgatccctgctgaagtagacaagatcagagagtgcatcagtgacaataagagtgccaccgtggagctagaaaaactgcagccatcctttgaggccttgaagcgccgtggagaggagcttattggacgatctcagggagcagacaaggatctggctgcaaaagaaatccaggataaattggatcaaatggtattcttctgggaggacatcaaagctcgggctgaagaacgagaaatcaaatttcttgatgtccttgaattagcagagaagttctggtatgacatggcagctctcctgaccaccatcaaagacacccaggatattgtccatgacttggaaagcccaggcattgatccttccatcatcaaacaacaggttgaagctgctgagactattaaggaagagacagatggtctgcatgaagagctggagtttattcggatccttggagcagatttgatttttgcctgtggagaaactgagaagcctgaagtgaggaagagcattgatgagatgaataatgcttgggagaacttaaacaaaacatggaaagagaggctagaaaaacttgaggatgctatgcaagctgctgtgcagtatcaggacactcttcaggctatgtttgactggctagataacactgtgattaaactctgcaccatgccccctgttggcactgacctcaatactgttaaagatcagttaaatgaaatgaaggagttcaaagtagaagtttaccaacagcaaattgagatggagaagcttaatcaccagggtgaactgatgttaaagaaagctactgatgagacggacagagacattatacgagaaccactgacagaactcaaacacctctgggagaacctgggtgagaaaattgcccaccgacagcacaaactagaaggggctctgttggcccttggtcagttccagcatgccttagaggaactaatgagttggctgactcataccgaagagttgttagatgctcagagaccaataagtggagacccaaaagtcattgaagttgagctcgcaaagcaccatgtcctaaaaaatgatgttttggctcatcaagccacagtggaaacagtcaacaaagctggcaatgagcttcttgaatccagtgctggagatgatgccagcagcttaaggagccgtttggaagccatgaaccaatgctgggagtcagtgttacagaaaacagaggagagggagcagcagcttcagtcaactctgcagcaggcccagggcttccacagtgaaattgaagatttcctcttggaacttactagaatggagagccagctttctgcatctaagcccacaggaggacttcctgaaactgctagggaacagcttgatacacatatggaactctattcccagctgaaagccaaggaagagacttataatcaactacttgacaagggcagactcatgcttctaagccgtgacgactctgggtctggctccaagacagaacagagtgtagcacttttggagcagaagtggcatgtggtcagcagtaagatggaagaaagaaagtcaaagctggaagaggccctcaacttggcaacagaattccagaattccctacaagaatttatcaactggctcactctagcagagcagagtttaaacatcgcttctccaccaagcctgattctaaatactgtcctttcccagatagaagagcacaaggtttttgctaatgaagtaaatgctcatcgagaccagatcattgagctggatcaaactgggaatcaattaaagttccttagccaaaagcaggatgttgttctgatcaagaatttgttggtgagcgtgcagtctcgatgggagaaggttgtccagcgatctattgaaagagggcgatcactagatgatgccaggaagcgggcaaaacaattccatgaagcttggaaaaaactgattgactggctagaagatgcagagagtcacctggactcagaactagagatatccaatgacccagacaaaattaaacttcagctttctaagcataaggagtttcagaagactcttggtggcaagcagcctgtgtatgataccacaattagaactggcagagcactgaaagaaaagactttgcttcccgaagatagtcagaaacttgacaatttcctaggagaagtcagagacaaatgggatactgtttgtggcaagtctgtggagcggcagcacaagttggaggaagccctgctcttttcgggtcagttcatggatgctttgcaggcattggttgactggttatacaaggtggagccacagctggctgaggaccagcccgtgcacggggaccttgacctcgtcatgaacctcatggatgcacacaaggttttccagaaggaactgggaaagcgaacaggaaccgttcaggtcctgaagcggtcaggccgagagctgattgagaatagtcgagatgacaccacttgggtaaaaggacagctccaggaactgagcactcgctgggacactgtctgtaaactctctgtttccaaacaaagccggcttgagcaggccttaaaacaagcggaagtgtttcgagacacagtccacatgctgttggagtggctttctgaagcagagcaaacgcttcgctttcggggagcacttcctgatgacacagaggccctgcagtctctcattgacacccataaggaattcatgaagaaagtagaagaaaagcgagtggacgttaactcagcagtagccatgggagaagtcatcctggctgtctgccaccccgattgcatcacaaccatcaaacactggatcaccatcatccgagctcgcttcgaggaggtcctgacatgggctaagcagcaccagcagcgtcttgaaacggccttgtcagaactggtggctaatgctgagctcctggaagaacttctggcatggatccagtgggctgagaccaccctcattcagcgggatcaggagccaatcccgcagaacattgaccgagttaaagcccttatcgctgagcatcagacatttatggaggagatgactcgcaaacagcctgacgtggaccgggtcaccaagacatacaaaaggaaaaacatagagcctactcacgcgcctttcatagagaaatcccgcagcggaggcaggaaatccctaagtcagccaacccctcctcccatgccaatcctttcacagtctgaagcaaaaaacccacggatcaaccagctttctgcccgctggcagcaggtgtggctgttagcactggagcggcaaaggaaactgaatgatgccttggatcggctggaggagttgaaagaatttgccaactttgactttgatgtctggaggaaaaagtatatgcgttggatgaatcacaaaaagtctcgagtgatggatttcttccggcgcattgataaggaccaggatgggaagataacacgtcaggagtttatcgatggcattttagcatccaagttccccaccaccaagttagagatgactgctgtggctgacattttcgaccgagatggggatggttacattgattattatgaatttgtggctgctcttcatcccaacaaggatgcgtatcgaccaacaaccgatgcagataaaatcgaagatgaggttacaagacaagtggctcagtgcaaatgtgcaaaaaggtttcaggtggagcagatcggagagaataaataccggtttggggattctcagcagttgcggctggtccgtattctgcgcagcaccgtgatggttcgcgttggtggaggatggatggccttggatgaatttttagtgaaaaatgatccctgccgagcacgaggtagaactaacattgaacttagagagaaattcatcctaccagagggagcatcccagggaatgacccccttccgctcacggggtcgaaggtccaaaccatcttcccgggcagcttcccctactcgttccagctccagtgctagtcagagtaaccacagctgtacatccatgccatcttctccagccaccccagccagtggaaccaaggttatcccatcatcaggtagcaagttgaaacgaccaacaccaacttttcattctagtcggacatcccttgctggtgataccagcaatagttcttccccggcctccacaggtgccaaaactaatcgggcagaccctaaaaagtctgccagtcgccctgggagtcgggctgggagtcgagccgggagtcgagccagcagccggcgaggaagtgacgcttctgactttgacctcttagagacgcagtctgcttgttccgacacttcagaaagcagcgctgcagggggccaaggcaactccaggagagggctaaacaaaccttccaaaatcccaaccatgtctaagaagaccaccactgcctcccccaggactccaggtcccaagcgataacactgtctaagcacccccaagccactatccactttgaatcctgctccatacattgggtgtatatttattctgaacgggagaagttatattgttaaaagtgtaaaagaataattgtgttatgaagctgccttattttttttctttttgtaagttactattttcatgtgaatatttatgtagataaaatttgcctcctggtaaccctgtaatggatggggcccagaaatgaaatatttgagaaaaacaagtgaaaaggtcaagatacaaatgtgtattaaaaaaaaaaaagcctattaatagggtttctgcgcggtgcagggttgtaaacctgctttatcttttaggattattcctaaatgcatcttctttataaacttgacttgctatctcagcaagataaattatattaaaaaaataagaatcctgcagtgtttaaggaactctttttttgtaaatcacggacacctcaattagcaagaactgaggggagggctttttccattgtttaatgttttgtgatttttagctaaagagagggaacctcatctaagtaacatttgcacatgatacagcaaaaggagttcattgcaatactgtctttggatattgtttcagtactgggtgtttaaaggacaaatagctgctagaattcaggggtaaatgtaagtgttcagaaaacgtcagaacatttggggttttaaactgatttgttgctccctatccagcctagacaccagtaactcttgtgttcaccaggacccagacccttggcaagggataggctcgttggtgacattgtgaatttcagatttgttttatccactttttttgctatttatttaaatggtcgatcaacttcccacaaactgaggaatgaattccacgagcctgttctgaaaatgtggacgtaagacaaacacgtgctcgtcctttaatggagttcaccagcacacttgttaaccagtcctgtttgctttcgtctttttttgtgcgtaataaagtcaactgaccaagtgaccatgaaaaggggctgtctggggctcctgttttttagctgctgttcttcagctccgaccatgttgctgtgtgattatctcaattggttttaattgaggcagaaactgaagctctaccaatgaactgtttagaaacaagacacacttttgtattaaaattgcttgcagtaacaaata

SEQ ID NO: 153898 - DNA, 23440 bp, Homo sapiens
  Payload ID: 10253
  Gene Symbol: MACF1
  Gene Name: microtubule-actin crosslinking factor 1
  Uniprot ID: Q9UPN3
  ENST ID: ENST00000372915
  CDS Start-End: 88-22254
ttttgtctgctcacattcacccctttctccttcagatcacttctccctgggctcccaggccctcctgcagcagcccccgcctgggccatgtcttcctcagatgaagagacgctcagtgagcggtcatgtcggagtgagcggtcttgtcggagtgagcgatcttacaggagcgagcggtcggggagcctgtctccctgtcccccaggggacaccttgccctggaacctgccactgcatgagcagaaaaagcggaaaagccaggattcggtgctggaccctgcagagcgtgctgtggtcagagtcgctgatgaacgggaccgggttcagaagaaaacgttcaccaagtgggtcaacaagcacttaatgaaggtccgcaagcacatcaatgatctttatgaagatctgcgggatggccataacctgatctctctgttggaggtcctctcaggcatcaaactgccccgggagaagggcaggatgcgttttcataggctgcagaatgtgcagattgccctggacttcctaaagcagcgacaggtgaaactagtgaatattcgcaatgatgacatcacagatggcaaccccaagttgaccctgggtctgatctggaccattattttgcatttccagatctctgacatctacattagtggagaatcaggggatatgtcagccaaggagaaactactcctgtggacccagaaggtgacagctggttacacaggaatcaaatgcaccaacttttcctcctgctggagtgatgggaagatgttcaatgcactcattcaccgataccgacccgatctagtagacatggagagggtgcaaatccaaagtaaccgagagaatctggaacaggcttttgaagtggcagaaagactgggggtcactcgcctgctggatgcagaagatgtggatgtgccatctccagatgaaaagtctgtaatcacttatgtgtcttcgatttatgatgccttccctaaagttcctgagggtggagaagggatcagtgctacggaagtggactccaggtggcaagaataccaaagccgagtggactccctcattccctggatcaaacagcatacaatactgatgtcagataaaacttttccccaaaaccctgttgaactaaaggcactttataaccaatatatacacttcaaagaaacagaaattctggccaaggagagagaaaaaggaagaattgaggaattatataaattactagaggtgtggattgaatttggccgaattaaactgcctcaaggttatcaccctaatgatgtggaagaagagtggggaaagctcatcatagagatgctggaacgagagaaatcacttcggccggctgtggagaggctggaattgctgctacagattgcaaacaaaatccagaatggtgctttgaactgtgaagaaaaactgacactagctaagaatacactgcaggctgatgctgctcacctggaatcaggacaaccggtacaatgtgagtcagatgtcattatgtacattcaggagtgtgaaggtctcatcaggcagctgcaggtggatctccagatcctgcgggatgagaattactaccagctagaagagctggcttttagggtcatgcgtcttcaggatgagctggtcaccttgcgtctagagtgtacaaacctgtaccggaagggtcatttcacttcacttgaattggttccaccctctactttaaccaccactcatctgaaagcagaacccttaaccaaggcaacccattcttcttctacctcctggttccgaaagcctatgactcgggctgaacttgtggccatcagctcctctgaagatgaaggcaatctccgatttgtgtatgaactactgtcttgggtagaagagatgcagatgaaactggagcgagcagagtggggcaatgacctgcctagtgtggagttgcagctagaaacacagcagcacatccatacgagtgtagaagagctgggctcaagtgtcaaggaggccaggttgtatgagggaaagatgtcccagaatttccataccagctatgctgaaactcttggaaagctggagacacagtattgtaaattgaaggaaacttctagcttccggatgaggcaccttcagagcctgcataaatttgtttccagagctacagctgagttgatctggttgaatgagaaggaggaggaggaactagcatatgactggagtgacaacaattccaatatctcagccaagagaaattacttctctgagttgacaatggaactggaggagaaacaggatgtgtttcgttctctacaagatacagcagaactactttcacttgagaaccacccagccaagcagacagtggaggcttacagtgctgctgtccagtcccagttgcagtggatgaagcagctgtgcctgtgtgttgagcagcatgtgaaagagaatactgcttattttcagttcttcagtgatgcacgagagctggagtcattcttgaggaacctccaagattccattaaacgaaaatattcctgtgaccacaacaccagcttatcccgccttgaagacctgctccaggactccatggatgaaaaggagcagcttatacagtccaagagttccgttgccagtctcgttgggagatcaaaaaccatcgttcagctaaaaccacgcagtccagaccatgtgttaaagaacaccatttctgtcaaggctgtctgtgactacaggcagatcgagattactatttgcaaaaatgatgaatgtgtgctagaagataattctcagcggaccaaatggaaagtgatcagccccacagggaacgaggcaatggtgccgtcagtctgcttcctcatccccccacccaataaggatgccattgagatggccagcagggtcgaacaatcttatcagaaggttatggccctttggcatcagctgcatgttaacaccaaaagccttatctcttggaactatctgcgtaaagaccttgaccttgtacagacctggaacctagaaaagcttcgatcctcagcaccaggggagtgccatcagattatgaagaaccttcaggcccactatgaagactttctgcaggatagtcgtgactctgtgctgttctcagtggctgatcgcttgcgcttggaagaggaggtggaagcttgtaaagcccgcttccagcacctgatgaagtccatggagaatgaggacaaagaggagactgtggccaagatgtacatttcagagttgaagaacatccggctacgcctggaggagtatgaacagagggtggtcaaacgaattcagtctctagccagctctaggactgacagagatgcctggcaggacaatgcattaaggattgcagagcaagagcacacccaggaggatttacagcaattgaggtcagacttggatgcagtttctatgaaatgtgacagctttctccatcagtctccatctagttcaagtgtcccaactctgcgctcagaactgaatctgctggtggagaagatggaccatgtctatggtctctctactgtatatctgaataagttaaagacagttgatgttatagtacgtagcatacaggatgctgaactcttggtcaaaggttatgagattaagctgagtcaagaagaagtagtactggcagatctctcagctctggaggcccattggtcgacattacggcactggcttagtgatgtgaaggacaagaattcagtgttttcagtcctggatgaggaaattgccaaggccaaggtagtggcagagcagatgagtcgtctgacaccagagcgaaatctggatttggagcgctatcaggaaaaaggctcccagctgcaggagcgttggcaccgagtcattgcccagctcgagattcgccaatctgagctagaaagtatccaggaagttctgggagattaccgagcctgccatggaactctcatcaagtggattgaggaaaccactgcccagcaggaaatgatgaagccaggccaggcagaggatagcagagtgctttcggagcagctcagccagcagacggccctatttgcagaaattgagagaaatcagacaaaactggatcaatgtcaaaaattttcccagcagtactctactattgtaaaggactatgaattgcaactgatgacatacaaggcctttgtggaatcgcagcagaaatcccctggcaagcgccgtcgcatgctttcctcttcagatgccatcactcaagagttcatggacttaaggactcgctacacggcattggtgactttaacaactcagcacgtgaaatacatcagtgatgcactccggcgtctggaggaggaggagaaagtggtagaagaggagaaacaagaacatgtggagaaggttaaagaacttttgggctgggtgtctaccctagcgaggaatacacaaggaaaagctacctcatccgagaccaaagaatcaacagacattgaaaaagctattttggaacagcaggttctgtcagaagagctgacaacaaagaaagaacaagtctctgaagctattaaaacatcacagatcttcttggccaagcatggtcataagctctcagaaaaagagaagaaacaaatatctgagcaattgaatgccctaaacaaggcttaccatgacctttgtgatggttctgcaaatcagcttcagcagcttcagagccagttggctcaccagacagaacaaaaggaatgcagagcagttgctggggtgattgacctaggcacagtggagatatttcccatcttcaaagccatgcaaaagggcctccttgaccaagacacaggcctagtgcttctggaatctcaggttatcatgtctggcctcattgcccctgagacgggtgaaaacctctctttggaggagggcatagccagaaacctcattaatccccagatgtaccagcagctccgggagctacaggatgccctggccttaataagcaggcttactgagagcagaggccctctttctgtggtggaagcaattgaaaagagaataatcagtgagacagttggactgaaaatcttagaagctcacctggcaactggaggtttcagtctttcccctagtgagaactgtattaacctggaagaggcttttcatcaaggcctcatttctgcatggcttcattcagtattagagtcttatcttagaacatccaagaatttgatagaccctaacacagctgagaaaattggtttgctggatctgatgcagcgatgtattgtccaccaggaatcaggattcaaattactgcctgtcaaacaattggcaggggggatggtgagcttgaaatcaggccggaaggttagcattttccgtgcagttcaggaagggctaatagataggcaggtcactgtccggttgctggaagctcagctttttgctggtggcatagtagatccaagaacaggacacagacttacagtggaagaggctgtaagacataatctgattgaccaagatatggcctgtgctatcctcataaggcagcttcagacaggaggcatcatagacactgtcacggggcaaaggctaacaatagatgaagcagtgagcaatgatctagtagctgctaagatcgcccttgtgattctggagtccctctggtcattcatggggttgctgtggcctgaatctggagagatcctcccaattacagatgccctagaacaaggtattgtgtctactgaactagcacataaaatccttagtaaccgacagcatattaaggctctgtttctaccagcaaccacagagattttgtcctggaagaaagcaatagaaagtggtatcctggatagagatcttgccaataacttaaaatcgatttgtatacctgatgtgatgccccacatgcaactagcagactctgcagaacaaaatattaatcctggagcagcagttctaccgtgcagcaagagccaccctaaggccacagcaagccagagtgagaatctgttgttccagctgatgactcacagctatattaatgtgcaaaatggacagaggctgcttctgttagataaagagctgatggagacactaacatccagagatgagtatcaaacaagtcctccaaaagtggttgaaattgggcatcaaaggcaaaaaactcctgagggattgcaagaatcagctaatgtgaaaatctcaggaactttcagcagtgggtggactgtgaggctgcctgagttccagttttcttctcagaacaaagaatatcccgatcgggaagattgcactacagaaaaaggcaaaaagaccactgtagaaacagaagattcttctgtagagaaccctgaacaggatctgtttgtagaacaaaaagagagaaatccaaacattgatgctttgaaggtaataaataaagtcaaattagaggtacaaaggcagttgataggtacccaaagggaagaccaaacagcagtgtctgtcagagaaaatgccagcaggggacacctcctgaccatacctcctgctgaggcggaaggtgtgccgttggtggttgacaaagatgttttttctgttgaaacaccaaagaaagaacatcaacctctaagaaacacttcctttacatgtcagaatgaacaagcacacactcttgagactgaatatattcatgatgaaactggaggatctcacataaaaccccaaagcaaaaagttacaagttcaggtaaagaaaactctaggtataaagttagaactaaagtctgaaactgatgggaatgttcatcctctggacaaaaaggaaatgttaaagaaaacatttctggctaaggatgaccataaagaaagtcaagaagcacagaacatcgcaggtggtagtatgatgatgtcagaaaagaccgatgaggaagatagtggcagggaaatttttctgtcatgcagtcatccattagaattgcttgaagaagctaccttaaatgtattatctgcacagttactagatggtggtatctttcatgaacaaacaggtcaaaagctcttactaaatgaagcaatatcccgaggcattgtgccaagtcacactgccgtgaagcttatggagaagctgaacatgtttcaggggttctttgactctcagacttgtgagtctttgacaactgaagaagtcattaatgaaggtctgatggatgagaaattattacataatgtcctcatggcagacaaagctataagtggtgtcttagacccccgtacccagacactgtgctctgtaaaggatgcagttacagttggacttcttgacaaggaaacagccaccagaattttagagaggcaggtggtgactggtggaattattgatctgaaacgaggcaaaaaagtttcagtaactttggcctcaactcttggcttggtggacgttgctgaccagccagaacttataaatctggagaaagcttccaaaggtagagatgctgaaaaaacagttagggagagattaattagtttacaaatggaaacaacaggacttatagaccctgatagtaaagcacctttaacagttgtgcagtccattgacagaggtcttttggagagagaggaggccgttcgtttgttgactaagcaagtggtagatggaggtatcattcaccatatatctgggatgagactttctgttgataatgccttcagacatggcttaattggtgaagatttagccgagaaactcaaaagagttgagaacttaaacatccatcagatttttaatcctgaaacgaaggaaaatatttccctccctaaagccataaaattagatcttattacctcagacctgaaaagagaaatccaggaggttcaggcctttactggaaactttgtggatctcatttctggtcagagattgaccttggcagaagctaaaaaagaaggactgttaactaatgaagcagtattgtctccaggaatgatgcatggcattgtagatcccgagaactgcagaattgtcccctactcagaattagtcaagaaatgtaagattgatattgaatctggacagagatatctagaagtaattcccttctcagacattaaagatggggtgagcgacaaagtgcttacattgtctcaagcaattcagcttggaaaagtagactttgcatctacgctgaaggttctagaagcccaggcaaatactggtggaatcatagatactgctactggaaaaagactgacattggcatcagctttggaagagaaactggtggatgaaaacatggtcagaattattgcatctcatcaggtgttaaatggaggaattgttgacatatttagtgatcagagagtgactttagtagaagctattgagaaaagactgatcagccctgaactggcaaatatgatccaaatagatagttcagagttcagcgatcacagggctcagattgaaaagcaagaagggattgaagtgtgtgcattacaaaatgaatttctaggaaaggatatgttaattgcttgtaatcagactgctgaaatgagttgtaataaagtagaagagagtgagagattatttcaagttgaaaatcagtctgcacaagaaaaggttaaagtgagagtttctgatggggagcaggcaaaaaagagcagggaaatttccttaaaggaatttgggtgcaaggatcaacgtaagccaagaatgtcttcagatgctaaagaatttatcagtatcataaatcctcataatcttaaaggtaaatccttgggccaagtgtcattgacacacccttactctgaatgtgattttaaacttaaagaagtggctagaaataacatgggaaatgatacaaatgaagagcaggaaaaagcagtgacaaaaatagaaattatttctcatatgaagcagtctacctcatgtctagattctgaagaaataagagaaaatcaaggggaagtgattttggaagtacaagaaacatattgtgaaacgtcaggcaaattgccgagtgagcaggttttgcagcaaccaatgaatgctcgggtgaaaagtaagagagagaagagggaggtgattgtagaagaaagtatcagaacatgcaaaccagcatttctttctgaagaaaagttgtatcaggaaactgccattagagatgagcatgactcccatataaagagccaacctagggaaatgacctcaagtgaaaaagggaaagaagctgatacagaaatgggattttctattacttttaaaattgaagagtcctcttcccaagtggtacctcaaggaatttctgtaaaacatttagatgctttaacactcttcagctctaaacaggccaatgaaggaaaagtaaacaatttaagtctctgcttgactttaaaaccagaagaaaacttatctcgagaaattgcctgtggggcccagagtgaaccattcccttgtatgaccccaagacctgaaggattgcactaccaggaatcagatggaaaagcccaagtgacaggcccatcccaaatttccaaaacagacaagtctttccaaggaaccaccagacaggagaccaactatcaagattcctgggttacttcgaaaactaaggaaaccaaacatcaaatttcctcatctaatgaatgtaaagaaaagtcataccaagaagtatcttttgacccagcaagaggtcttaaattggaagaaatcacagtttctagaccagattcaaaagaagtcaggtatctagaattctcagacagaaaagaccttcatcatcagggcagcaaaagtgatgataaactttgtggaactctcaaatctgaaatagcaacacaggaactaactggagagaaatttctagaaatggcaaaccctaatgttgcaggtctagaagcaggatccattgaggacatagtgactcagagaggttccagagtcttgggatcctttcttccagagaaactgttcaaaggagtgtctcaaaaagagaatacagggcaacagaatgccatcattagtcctactgttctagagaccagtgaagaaaagacagtgtccctaacagtatgctctgcagtgaagacagagaagacaccacaggaaaagctcagagaaagccctggcagtgaacaaactcccttcatgactgcacctgaaggaaagggaaatggaggtgtaaacccagagcccttcagagcaactcagaatgtatttacccggcaactctgtttagaacatgatgaaaagctagtatcctatctgtctctgttacggaacattgaaatgaggaccaaacagattcaacctttggagctaaacctggcagaactacaggatctgctgtgtcaggccaaggtattagaaagggagttaaaggatctgaccaccttggtcagtcaggagctggagtgtgtgaatcagattatcatcagccagcctcaagaagttcctgctcaactgttgaaggctctagagaaagatgccaagaatcttcagaagtctctcagctctgtgagtgacacttggaattccaggctactccacttccagaatgctgtggaaatagaaaagactaaagtgttaaatcagcacacacagctagaaggccgacttcaagatctgagagcctgggttggcaataaaaatcttattctgaacagcaagggatctaacagtgaaatagatgttgacagcctgaacctctgcctccaacagtatgaggatttgaaacagcccatggctgaaaggaaagctcagctggatgctcttgcttttgatattcagttctttatctcagaacatgcccaggacttgtcccctcagcagaatcgacagatgctgaggcttctgaatgaactgcagaggtccttccaggacattttggaacagactgccgctcaggtggatgccttgcagggccatcttcaacaaatggagcaggaagccctggtgaagaccctgcagaaacaacaaaatacctgtcaccagcaactggaggatctttgcagttgggtaggacaggcagaaagagcactggcaggccaccaaggcagaaccacccagcaggatctctctgctttgcagaagaaccaaagtgacttgaaggatttacaggatgacattcagaatcgtgccacctcatttgccactgttgtcaaggacattgaggggttcatggaagagaatcagaccaagctgagcccacgtgagttgacagctcttcgggaaaagcttcatcaggctaaggagcaatatgaggcgctccaggaagagacacgtgtggcccagaaggaactggaggaagcagtgacctccgccttacagcaggagactgaaaagagtaaagcagcaaaggaactggcagagaacaagaagaagatcgatgctctcctggattgggtaacttcagtaggatcatctggtggacagctgctgaccaaccttccaggaatggagcagctctcgggagctagcttggagaaaggagccttggacaccactgatggttacatgggggtgaatcaagccccagagaaactggacaagcaatgtgagatgatgaaggcccgtcaccaagaattgctgtcccagcagcaaaatttcattctggccacccagtcagctcaggccttcttggatcagcatggccacaatctcacacctgaggagcaacagatgctgcaacagaagctgggagagctaaaggaacaatactctacttccctggcccaatcagaggcagaactgaagcaggtgcagacacttcaggatgagttgcagaaatttctgcaggatcataaagagtttgaaagctggttggaacgatccgagaaagagctggagaacatgcataagggaggcagcagccccgagacccttccctccctgctaaagcggcaaggaagcttctcagaggatgtcatttcccacaaaggagacttgagatttgtgactatctcaggacagaaagtcttggacatggaaaacagttttaaggaaggcaaagaaccatcagaaattggaaacttagtaaaggacaagttgaaggatgcaacagaaagatacactgctctccactcaaagtgtacacgattaggatctcacctgaatatgctgttaggccagtatcatcaattccaaaacagtgctgacagcctgcaggcctggatgcaggcttgtgaggccaacgtggagaagctcctctcagatactgttgcctctgaccctggagttctccaggagcagcttgcaacaacaaagcagttgcaggaggaattggctgagcaccaagtacctgtggaaaaactccaaaaagtagctcgtgacataatggaaattgaaggggagccagccccagaccacaggcatgttcaagaaactacagattccatactcagccacttccaaagcctctcctatagcctggctgagcgatcttctctgctgcagaaagcaattgcccaatctcagagtgtccaggaaagcctggagagcctgttgcagtctattggggaagttgaacaaaacctggaagggaagcaggtgtcatcactctcatcaggagtcatccaggaagccttagccacaaatatgaaattgaagcaggacattgctcggcaaaagagcagcttggaggccacccgtgagatggtgacccgattcatggagacagcagacagtactacagcagcagtgctgcagggcaaactggcagaggtgagccagcggttcgaacagctctgtctacagcagcaagaaaaggagagctccctaaagaagcttctaccccaggcagagatgtttgaacacctctctggtaagctgcagcagttcatggaaaacaaaagtcggatgctggcctctggaaatcagccagatcaagatattacacatttcttccaacagatccaggagctcaatttggaaatggaagaccaacaggagaacctagatactcttgagcacctggtcactgaactgagctcttgtggctttgcgctggacttgtgccagcatcaggacagggtacagaatctaagaaaagacttcacagagctacagaagacagttaaagagagagagaaagatgcatcatcttgccaggaacagttggatgaattccggaagctggtcaggaccttccagaaatggttgaaagaaactgaagggagtattccacctacggaaacttctatgagtgctaaagagttagaaaagcagattgaacacctgaagagtctactagatgactgggcaagtaagggaactctggtggaagaaatcaattgcaaaggtacttctttagaaaatctcatcatggaaatcacagcacctgattcccaaggcaagacaggttccatactgccctctgtaggaagctctgtaggcagtgtaaacggataccacacctgcaaagatctgacggagatccagtgtgacatgtcagatgtaaacttgaagtatgagaaactagggggagtacttcatgaacgccaggaaagccttcaggctatcctcaacagaatggaggaggttcacaaggaggcaaactctgtgctgcagtggctggaatcaaaagaggaagtcctgaaatccatggatgccatgtcatctccaaccaagacagaaacagtgaaagcccaagctgaatctaacaaggccttcctggctgagttggaacagaattctccaaaaattcaaaaagtaaaggaagccctggctggattactggtgacatatcccaactcacaggaagcagaaaattggaagaaaattcaggaagaactcaattcccgatgggaaagggccactgaggttactgtggctcggcaaaggcagctagaggaatctgcaagtcatctggcctgcttccaggctgcagaatcccagctccggccgtggctgatggagaaagaactgatgatgggagtgctggggcccctgtctattgaccccaacatgttgaatgcacaaaagcaacaggtccagtttatgctaaaggaatttgaagcacgcaggcaacagcatgagcaactgaatgaggcagctcagggcatcctaacaggccctggagatgtctctctgtccaccagccaagtacagaaagaactccagagcatcaatcagaaatgggttgagctgactgacaaactcaactcccgttccagccaaattgaccaagctattgttaagagcacccagtaccaggaactgctccaggacttatcagagaaggtgagggcagttggacaacggctgagtgtccagtcagctatcagcacccaaccagaggctgtaaagcagcaattggaagagaccagtgaaattcgatctgacttggagcagttagaccacgaggttaaggaggctcagacactgtgcgatgaactctcagtgctcattggtgagcagtacctcaaggatgaactgaagaagcgtttggagacagttgccctgcctctccaaggtttagaagaccttgcagccgatcgcattaacagactccaggcagctcttgccagcacccagcagttccagcaaatgtttgatgagttgaggacctggttggatgataaacaaagccagcaagcaaaaaactgcccaatttctgcaaaattggagcggctacagtctcagctacaggagaatgaagagtttcagaaaagtcttaatcaacacagtggctcctatgaggtgattgtggctgaaggggaatctctacttctttctgtacctcctggagaagagaaaaggactctacaaaaccagttggttgagctcaaaaaccattgggaagagcttagtaaaaaaactgcagacagacaatccaggctcaaggattgtatgcagaaagctcagaaatatcagtggcatgtggaagaccttgtgccatggatagaagattgtaaagctaagatgtctgagttgcgagtcactctggatccagtgcagctagagtccagtctcctaagatcaaaggctatgctgaatgaggtggagaagcgccgctccctgctggaaatattgaatagtgctgctgacattctgatcaattcttcagaagcagatgaggatggaatccgggatgagaaggctgggatcaaccagaacatggatgctgttacagaagagctgcaggccaaaacagggtcactcgaagaaatgactcagaggctcagggagttccaggaaagctttaagaatattgaaaagaaggttgaaggagccaaacaccaacttgagatctttgatgctctgggttctcaagcctgtagcaacaagaacctggagaagctaagagctcaacaggaagtgctgcaggccctagagcctcaggtagactatctgaggaactttactcagggtctggtagaagatgccccagatggatctgatgcttctcaacttctccaccaagctgaggtcgcccagcaagagttcctcgaagttaagcaaagagtgaacagtggttgtgtgatgatggaaaacaagctggaggggattggccagtttcactgccgggtccgagagatgttctctcaattggcagacctggatgatgagctagatggcatgggtgctattggcagagacactgatagcctccagtcccaaatcgaggatgtccggctattccttaacaaaattcacgtcctcaaattagacatagaggcctctgaagcagagtgtcgacatatgctagaagaagaggggactctggatttgttaggtctcaaaagggagctagaagccctgaacaaacagtgtggcaaactgacagagagggggaaagctcgtcaggaacagctggaactgacactaggccgtgtagaggacttctacaggaaattgaaaggactcaatgacgcgaccacagcagcagaggaggcagaggccctccagtgggtagtggggaccgaagtggaaatcatcaaccaacaattagcagattttaaaatgtttcagaaagaacaagtggatcctcttcagatgaaattgcagcaggtgaatggacttggccagggattaattcagagtgcaggaaaagactgtgatgtacagggtttagaacatgacatggaagagatcaatgctcgatggaatacattgaataaaaaggtcgcacaaagaattgcacagctacaggaagctttgttgcattgtgggaagtttcaagatgccttggagccattgctcagctggttggcagataccgaggagctcatagccaatcagaaacctccatctgctgagtataaagtggtgaaagcacagatccaagaacagaagttgctccagcggctcctagatgatcgaaaggccacagtagacatgcttcaagcagaaggaggcagaatagcccagtcagcagagctggctgatagagagaaaatcactggacagctggagagtcttgaaagtagatggactgaactactcagtaaggcagcagccaggcaaaaacagctggaagacatcctggttctggccaaacagttccatgagacagctgagcctatttctgacttcttatctgtcacagagaaaaagcttgctaactcagaacctgttggcactcagactgccaaaatacagcagcagatcattcggcacaaggctttaaatgaagaaattgttaatagaaagaagaatgtagatcaagctattaaaaatggtcaggctcttctaaaacaaaccacaggtgaggaggtgttacttatccaggaaaaactagatggtataaagactcgttacgcagacatcacagttactagctccaaggccctcagaactttagagcaagcccggcagctggccaccaagttccagtctacttatgaggaactgaccgggtggctgagggaggtggaggaggagctggcaaccagtggaggacagtctcccacaggggaacagataccccagtttcagcagagacagaaggaattaaagaaggaggtcatggagcacaggctggtgttggacacagtgaatgaggtgagccgtgctctcttagagctggtgccctggagagccagagaagggctggataaacttgtgtccgatgctaacgagcagtacaaactagtcagtgacactattggacaaagggtggatgaaattgatgctgctattcagagatcacaacagtatgagcaagctgccgatgcagaactagcttgggttgctgaaacaaaacggaaactgatggctctgggtccaattcgcctggaacaggaccagaccacagctcagcttcaggtacagaaggctttctccattgacattattcgacacaaagattcaatggatgaactcttcagtcaccgtagtgaaatctttggcacatgtggggaggagcaaaaaactgtattacaggaaaagacagagtctctaatacagcaatatgaagccattagcctactcaattcagagcgttatgcccgcctagagcgggcccaggtcttagtaaaccagttttgggaaacttatgaagagctcagcccctggattgaggaaactcgggcactaatagcacagttaccctctccagccattgatcatgagcagctcaggcagcaacaagaggaaatgaggcaattaagggaatctattgctgaacacaaacctcatattgacaaactactaaagataggcccacaactaaaggaattaaaccctgaggaaggggaaatggtggaagaaaaataccagaaagcagaaaacatgtatgcccaaataaaggaggaggtgcgccagcgagccctggctctggatgaagccgtgtcccagtccacacagattacagagtttcatgataaaattgagcctatgttggagacactggagaatctttcctctcgcctgcgtatgccaccactgatccctgctgaagtagacaagatcagagagtgcatcagtgacaataagagtgccaccgtggagctagaaaaactgcagccatcctttgaggccttgaagcgccgtggagaggagcttattggacgatctcagggagcagacaaggatctggctgcaaaagaaatccaggataaattggatcaaatggtattcttctgggaggacatcaaagctcgggctgaagaacgagaaatcaaatttcttgatgtccttgaattagcagagaagttctggtatgacatggcagctctcctgaccaccatcaaagacacccaggatattgtccatgacttggaaagcccaggcattgatccttccatcatcaaacaacaggttgaagctgctgagactattaaggaagagacagatggtctgcatgaagagctggagtttattcggatccttggagcagatttgatttttgcctgtggagaaactgagaagcctgaagtgaggaagagcattgatgagatgaataatgcttgggagaacttaaacaaaacatggaaagagaggctagaaaaacttgaggatgctatgcaagctgctgtgcagtatcaggacactcttcaggctatgtttgactggctagataacactgtgattaaactctgcaccatgccccctgttggcactgacctcaatactgttaaagatcagttaaatgaaatgaaggagttcaaagtagaagtttaccaacagcaaattgagatggagaagcttaatcaccagggtgaactgatgttaaagaaagctactgatgagacggacagagacattatacgagaaccactgacagaactcaaacacctctgggagaacctgggtgagaaaattgcccaccgacagcacaaactagaaggggctctgttggcccttggtcagttccagcatgccttagaggaactaatgagttggctgactcataccgaagagttgttagatgctcagagaccaataagtggagacccaaaagtcattgaagttgagctcgcaaagcaccatgtcctaaaaaatgatgttttggctcatcaagccacagtggaaacagtcaacaaagctggcaatgagcttcttgaatccagtgctggagatgatgccagcagcttaaggagccgtttggaagccatgaaccaatgctgggagtcagtgttacagaaaacagaggagagggagcagcagcttcagtcaactctgcagcaggcccagggcttccacagtgaaattgaagatttcctcttggaacttactagaatggagagccagctttctgcatctaagcccacaggaggacttcctgaaactgctagggaacagcttgatacacatatggaactctattcccagctgaaagccaaggaagagacttataatcaactacttgacaagggcagactcatgcttctaagccgtgacgactctgggtctggctccaagacagaacagagtgtagcacttttggagcagaagtggcatgtggtcagcagtaagatggaagaaagaaagtcaaagctggaagaggccctcaacttggcaacagaattccagaattccctacaagaatttatcaactggctcactctagcagagcagagtttaaacatcgcttctccaccaagcctgattctaaatactgtcctttcccagatagaagagcacaaggtttttgctaatgaagtaaatgctcatcgagaccagatcattgagctggatcaaactgggaatcaattaaagttccttagccaaaagcaggatgttgttctgatcaagaatttgttggtgagcgtgcagtctcgatgggagaaggttgtccagcgatctattgaaagagggcgatcactagatgatgccaggaagcgggcaaaacaattccatgaagcttggaaaaaactgattgactggctagaagatgcagagagtcacctggactcagaactagagatatccaatgacccagacaaaattaaacttcagctttctaagcataaggagtttcagaagactcttggtggcaagcagcctgtgtatgataccacaattagaactggcagagcactgaaagaaaagactttgcttcccgaagatagtcagaaacttgacaatttcctaggagaagtcagagacaaatgggatactgtttgtggcaagtctgtggagcggcagcacaagttggaggaagccctgctcttttcgggtcagttcatggatgctttgcaggcattggttgactggttatacaaggtggagccacagctggctgaggaccagcccgtgcacggggaccttgacctcgtcatgaacctcatggatgcacacaaggttttccagaaggaactgggaaagcgaacaggaaccgttcaggtcctgaagcggtcaggccgagagctgattgagaatagtcgagatgacaccacttgggtaaaaggacagctccaggaactgagcactcgctgggacactgtctgtaaactctctgtttccaaacaaagccggcttgagcaggccttaaaacaagcggaagtgtttcgagacacagtccacatgctgttggagtggctttctgaagcagagcaaacgcttcgctttcggggagcacttcctgatgacacagaggccctgcagtctctcattgacacccataaggaattcatgaagaaagtagaagaaaagcgagtggacgttaactcagcagtagccatgggagaagtcatcctggctgtctgccaccccgattgcatcacaaccatcaaacactggatcaccatcatccgagctcgcttcgaggaggtcctgacatgggctaagcagcaccagcagcgtcttgaaacggccttgtcagaactggtggctaatgctgagctcctggaagaacttctggcatggatccagtgggctgagaccaccctcattcagcgggatcaggagccaatcccgcagaacattgaccgagttaaagcccttatcgctgagcatcagacatttatggaggagatgactcgcaaacagcctgacgtggaccgggtcaccaagacatacaaaaggaaaaacatagagcctactcacgcgcctttcatagagaaatcccgcagcggaggcaggaaatccctaagtcagccaacccctcctcccatgccaatcctttcacagtctgaagcaaaaaacccacggatcaaccagctttctgcccgctggcagcaggtgtggctgttagcactggagcggcaaaggaaactgaatgatgccttggatcggctggaggagttgaaagaatttgccaactttgactttgatgtctggaggaaaaagtatatgcgttggatgaatcacaaaaagtctcgagtgatggatttcttccggcgcattgataaggaccaggatgggaagataacacgtcaggagtttatcgatggcattttagcatccaagttccccaccaccaagttagagatgactgctgtggctgacattttcgaccgagatggggatggttacattgattattatgaatttgtggctgctcttcatcccaacaaggatgcgtatcgaccaacaaccgatgcagataaaatcgaagatgaggttacaagacaagtggctcagtgcaaatgtgcaaaaaggtttcaggtggagcagatcggagagaataaataccggtttggggattctcagcagttgcggctggtccgtattctgcgcagcaccgtgatggttcgcgttggtggaggatggatggccttggatgaatttttagtgaaaaatgatccctgccgagcacgaggtagaactaacattgaacttagagagaaattcatcctaccagagggagcatcccagggaatgacccccttccgctcacggggtcgaaggtccaaaccatcttcccgggcagcttcccctactcgttccagctccagtgctagtcagagtaaccacagctgtacatccatgccatcttctccagccaccccagccagtggaaccaaggttatcccatcatcaggtagcaagttgaaacgaccaacaccaacttttcattctagtcggacatcccttgctggtgataccagcaatagttcttccccggcctccacaggtgccaaaactaatcgggcagaccctaaaaagtctgccagtcgccctgggagtcgggctgggagtcgagccgggagtcgagccagcagccggcgaggaagtgacgcttctgactttgacctcttagagacgcagtctgcttgttccgacacttcagaaagcagcgctgcagggggccaaggcaactccaggagagggctaaacaaaccttccaaaatcccaaccatgtctaagaagaccaccactgcctcccccaggactccaggtcccaagcgataacactgtctaagcacccccaagccactatccactttgaatcctgctccatacattgggtgtatatttattctgaacgggagaagttatattgttaaaagtgtaaaagaataattgtgttatgaagctgccttattttttttctttttgtaagttactattttcatgtgaatatttatgtagataaaatttgcctcctggtaaccctgtaatggatggggcccagaaatgaaatatttgagaaaaacaagtgaaaaggtcaagatacaaatgtgtattaaaaaaaaaaaagcctattaatagggtttctgcgcggtgcagggttgtaaacctgctttatcttttaggattattcctaaatgcatcttctttataaacttgacttgctatctcagcaagataaattatattaaaaaaataagaatcctgcagtgtttaaggaactctttttttgtaaatcacggacacctcaattagcaagaactgaggggagggctttttccattgtttaatgttttgtgatttttagctaaagagagggaacctcatctaagtaacatttgcacatgatacagcaaaaggagttcattgcaatactgtctttggatattgtttcagtactgggtgtttaaaggacaaatagctgctagaattcaggggtaaatgtaagtgttcagaaaacgtcagaacatttggggttttaaactgatttgttgctccctatccagcctagacaccagtaactcttgtgttcaccaggacccagacccttggcaagggataggctcgttggtgacattgtgaatttcagatttgttttatccactttttttgctatttatttaaatggtcgatcaacttcccacaaactgaggaatgaattccacgagcctgttctgaaaatgtggacgtaagacaaacacgtgctcgtcctttaatggagttcaccagcacacttgttaaccagtcctgtttgctttcgtctttttttgtgcgtaataaagtcaactgaccaagtgaccatgaaaaggggctgtctggggctcctgttttttagctgctgttcttcagctccgaccatgttgctgtgtgattatctcaattggttttaattgaggcagaaactgaagctctaccaatgaactgtttagaaacaagacacacttttgtattaaaattgcttgcagta

SEQ ID NO: 153899 - DNA, 14496 bp, Homo sapiens
  Payload ID: 10253
  Gene Symbol: MACF1
  Gene Name: microtubule-actin crosslinking factor 1
  ENST ID: ENST00000372925
  CDS Start-End: 1-13303
aaagaacaccatttctgtcaaggctgtctgtgactacaggcagatcgagattactatttgcaaaaatgatgaatgtgtgctagaagataattctcagcggaccaaatggaaagtgatcagccccacagggaacgaggcaatggtgccgtcagtctgcttcctcatccccccacccaataaggatgccattgagatggccagcagggtcgaacaatcttatcagaaggttatggccctttggcatcagctgcatgttaacaccaaaagccttatctcttggaactatctgcgtaaagaccttgaccttgtacagacctggaacctagaaaagcttcgatcctcagcaccaggggagtgccatcagattatgaagaaccttcaggcccactatgaagactttctgcaggatagtcgtgactctgtgctgttctcagtggctgatcgcttgcgcttggaagaggaggtggaagcttgtaaagcccgcttccagcacctgatgaagtccatggagaatgaggacaaagaggagactgtggccaagatgtacatttcagagttgaagaacatccggctacgcctggaggagtatgaacagagggtggtcaaacgaattcagtctctagccagctctaggactgacagagatgcctggcaggacaatgcattaaggattgcagagcaagagcacacccaggaggatttacagcaattgaggtcagacttggatgcagtttctatgaaatgtgacagctttctccatcagtctccatctagttcaagtgtcccaactctgcgctcagaactgaatctgctggtggagaagatggaccatgtctatggtctctctactgtatatctgaataagttaaagacagttgatgttatagtacgtagcatacaggatgctgaactcttggtcaaaggttatgagattaagctgagtcaagaagaagtagtactggcagatctctcagctctggaggcccattggtcgacattacggcactggcttagtgatgtgaaggacaagaattcagtgttttcagtcctggatgaggaaattgccaaggccaaggtagtggcagagcagatgagtcgtctgacaccagagcgaaatctggatttggagcgctatcaggaaaaaggctcccagctgcaggagcgttggcaccgagtcattgcccagctcgagattcgccaatctgagctagaaagtatccaggaagttctgggagattaccgagcctgccatggaactctcatcaagtggattgaggaaaccactgcccagcaggaaatgatgaagccaggccaggcagaggatagcagagtgctttcggagcagctcagccagcagacggccctatttgcagaaattgagagaaatcagacaaaactggatcaatgtcaaaaattttcccagcagtactctactattgtaaaggactatgaattgcaactgatgacatacaaggcctttgtggaatcgcagcagaaatcccctggcaagcgccgtcgcatgctttcctcttcagatgccatcactcaagagttcatggacttaaggactcgctacacggcattggtgactttaacaactcagcacgtgaaatacatcagtgatgcactccggcgtctggaggaggaggagaaagtggtagaagaggagaaacaagaacatgtggagaaggttaaagaacttttgggctgggtgtctaccctagcgaggaatacacaaggaaaagctacctcatccgagaccaaagaatcaacagacattgaaaaagctattttggaacagcaggttctgtcagaagagctgacaacaaagaaagaacaagtctctgaagctattaaaacatcacagatcttcttggccaagcatggtcataagctctcagaaaaagagaagaaacaaatatctgagcaattgaatgccctaaacaaggcttaccatgacctttgtgatggttctgcaaatcagcttcagcagcttcagagccagttggctcaccagacagaacaaaagaccctgcagaaacaacaaaatacctgtcaccagcaactggaggatctttgcagttgggtaggacaggcagaaagagcactggcaggccaccaaggcagaaccacccagcaggatctctctgctttgcagaagaaccaaagtgacttgaaggatttacaggatgacattcagaatcgtgccacctcatttgccactgttgtcaaggacattgaggggttcatggaagagaatcagaccaagctgagcccacgtgagttgacagctcttcgggaaaagcttcatcaggctaaggagcaatatgaggcgctccaggaagagacacgtgtggcccagaaggaactggaggaagcagtgacctccgccttacagcaggagactgaaaagagtaaagcagcaaaggaactggcagagaacaagaagaagatcgatgctctcctggattgggtaacttcagtaggatcatctggtggacagctgctgaccaaccttccaggaatggagcagctctcgggagctagcttggagaaaggagccttggacaccactgatggttacatgggggtgaatcaagccccagagaaactggacaagcaatgtgagatgatgaaggcccgtcaccaagaattgctgtcccagcagcaaaatttcattctggccacccagtcagctcaggccttcttggatcagcatggccacaatctcacacctgaggagcaacagatgctgcaacagaagctgggagagctaaaggaacaatactctacttccctggcccaatcagaggcagaactgaagcaggtgcagacacttcaggatgagttgcagaaatttctgcaggatcataaagagtttgaaagctggttggaacgatccgagaaagagctggagaacatgcataagggaggcagcagccccgagacccttccctccctgctaaagcggcaaggaagcttctcagaggatgtcatttcccacaaaggagacttgagatttgtgactatctcaggacagaaagtcttggacatggaaaacagttttaaggaaggcaaagaaccatcagaaattggaaacttagtaaaggacaagttgaaggatgcaacagaaagatacactgctctccactcaaagtgtacacgattaggatctcacctgaatatgctgttaggccagtatcatcaattccaaaacagtgctgacagcctgcaggcctggatgcaggcttgtgaggccaacgtggagaagctcctctcagatactgttgcctctgaccctggagttctccaggagcagcttgcaacaacaaagcagttgcaggaggaattggctgagcaccaagtacctgtggaaaaactccaaaaagtagctcgtgacataatggaaattgaaggggagccagccccagaccacaggcatgttcaagaaactacagattccatactcagccacttccaaagcctctcctatagcctggctgagcgatcttctctgctgcagaaagcaattgcccaatctcagagtgtccaggaaagcctggagagcctgttgcagtctattggggaagttgaacaaaacctggaagggaagcaggtgtcatcactctcatcaggagtcatccaggaagccttagccacaaatatgaaattgaagcaggacattgctcggcaaaagagcagcttggaggccacccgtgagatggtgacccgattcatggagacagcagacagtactacagcagcagtgctgcagggcaaactggcagaggtgagccagcggttcgaacagctctgtctacagcagcaagaaaaggagagctccctaaagaagcttctaccccaggcagagatgtttgaacacctctctggtaagctgcagcagttcatggaaaacaaaagtcggatgctggcctctggaaatcagccagatcaagatattacacatttcttccaacagatccaggagctcaatttggaaatggaagaccaacaggagaacctagatactcttgagcacctggtcactgaactgagctcttgtggctttgcgctggacttgtgccagcatcaggacagggtacagaatctaagaaaagacttcacagagctacagaagacagttaaagagagagagaaagatgcatcatcttgccaggaacagttggatgaattccggaagctggtcaggaccttccagaaatggttgaaagaaactgaagggagtattccacctacggaaacttctatgagtgctaaagagttagaaaagcagattgaacacctgaagagtctactagatgactgggcaagtaagggaactctggtggaagaaatcaattgcaaaggtacttctttagaaaatctcatcatggaaatcacagcacctgattcccaaggcaagacagatctgacggagatccagtgtgacatgtcagatgtaaacttgaagtatgagaaactagggggagtacttcatgaacgccaggaaagccttcaggctatcctcaacagaatggaggaggttcacaaggaggcaaactctgtgctgcagtggctggaatcaaaagaggaagtcctgaaatccatggatgccatgtcatctccaaccaagacagaaacagtgaaagcccaagctgaatctaacaaggccttcctggctgagttggaacagaattctccaaaaattcaaaaagtaaaggaagccctggctggattactggtgacatatcccaactcacaggaagcagaaaattggaagaaaattcaggaagaactcaattcccgatgggaaagggccactgaggttactgtggctcggcaaaggcagctagaggaatctgcaagtcatctggcctgcttccaggctgcagaatcccagctccggccgtggctgatggagaaagaactgatgatgggagtgctggggcccctgtctattgaccccaacatgttgaatgcacaaaagcaacaggtccagtttatgctaaaggaatttgaagcacgcaggcaacagcatgagcaactgaatgaggcagctcagggcatcctaacaggccctggagatgtctctctgtccaccagccaagtacagaaagaactccagagcatcaatcagaaatgggttgagctgactgacaaactcaactcccgttccagccaaattgaccaagctattgttaagagcacccagtaccaggaactgctccaggacttatcagagaaggtgagggcagttggacaacggctgagtgtccagtcagctatcagcacccaaccagaggctgtaaagcagcaattggaagagaccagtgaaattcgatctgacttggagcagttagaccacgaggttaaggaggctcagacactgtgcgatgaactctcagtgctcattggtgagcagtacctcaaggatgaactgaagaagcgtttggagacagttgccctgcctctccaaggtttagaagaccttgcagccgatcgcattaacagactccaggcagctcttgccagcacccagcagttccagcaaatgtttgatgagttgaggacctggttggatgataaacaaagccagcaagcaaaaaactgcccaatttctgcaaaattggagcggctacagtctcagctacaggagaatgaagagtttcagaaaagtcttaatcaacacagtggctcctatgaggtgattgtggctgaaggggaatctctacttctttctgtacctcctggagaagagaaaaggactctacaaaaccagttggttgagctcaaaaaccattgggaagagcttagtaaaaaaactgcagacagacaatccaggctcaaggattgtatgcagaaagctcagaaatatcagtggcatgtggaagaccttgtgccatggatagaagattgtaaagctaagatgtctgagttgcgagtcactctggatccagtgcagctagagtccagtctcctaagatcaaaggctatgctgaatgaggtggagaagcgccgctccctgctggaaatattgaatagtgctgctgacattctgatcaattcttcagaagcagatgaggatggaatccgggatgagaaggctgggatcaaccagaacatggatgctgttacagaagagctgcaggccaaaacagggtcactcgaagaaatgactcagaggctcagggagttccaggaaagctttaagaatattgaaaagaaggttgaaggagccaaacaccaacttgagatctttgatgctctgggttctcaagcctgtagcaacaagaacctggagaagctaagagctcaacaggaagtgctgcaggccctagagcctcaggtagactatctgaggaactttactcagggtctggtagaagatgccccagatggatctgatgcttctcaacttctccaccaagctgaggtcgcccagcaagagttcctcgaagttaagcaaagagtgaacagtggttgtgtgatgatggaaaacaagctggaggggattggccagtttcactgccgggtccgagagatgttctctcaattggcagacctggatgatgagctagatggcatgggtgctattggcagagacactgatagcctccagtcccaaatcgaggatgtccggctattccttaacaaaattcacgtcctcaaattagacatagaggcctctgaagcagagtgtcgacatatgctagaagaagaggggactctggatttgttaggtctcaaaagggagctagaagccctgaacaaacagtgtggcaaactgacagagagggggaaagctcgtcaggaacagctggaactgacactaggccgtgtagaggacttctacaggaaattgaaaggactcaatgacgcgaccacagcagcagaggaggcagaggccctccagtgggtagtggggaccgaagtggaaatcatcaaccaacaattagcagattttaaaatgtttcagaaagaacaagtggatcctcttcagatgaaattgcagcaggtgaatggacttggccagggattaattcagagtgcaggaaaagactgtgatgtacagggtttagaacatgacatggaagagatcaatgctcgatggaatacattgaataaaaaggtcgcacaaagaattgcacagctacaggaagctttgttgcattgtgggaagtttcaagatgccttggagccattgctcagctggttggcagataccgaggagctcatagccaatcagaaacctccatctgctgagtataaagtggtgaaagcacagatccaagaacagaagttgctccagcggctcctagatgatcgaaaggccacagtagacatgcttcaagcagaaggaggcagaatagcccagtcagcagagctggctgatagagagaaaatcactggacagctggagagtcttgaaagtagatggactgaactactcagtaaggcagcagccaggcaaaaacagctggaagacatcctggttctggccaaacagttccatgagacagctgagcctatttctgacttcttatctgtcacagagaaaaagcttgctaactcagaacctgttggcactcagactgccaaaatacagcagcagatcattcggcacaaggctttaaatgaagaaattgttaatagaaagaagaatgtagatcaagctattaaaaatggtcaggctcttctaaaacaaaccacaggtgaggaggtgttacttatccaggaaaaactagatggtataaagactcgttacgcagacatcacagttactagctccaaggccctcagaactttagagcaagcccggcagctggccaccaagttccagtctacttatgaggaactgaccgggtggctgagggaggtggaggaggagctggcaaccagtggaggacagtctcccacaggggaacagataccccagtttcagcagagacagaaggaattaaagaaggaggtcatggagcacaggctggtgttggacacagtgaatgaggtgagccgtgctctcttagagctggtgccctggagagccagagaagggctggataaacttgtgtccgatgctaacgagcagtacaaactagtcagtgacactattggacaaagggtggatgaaattgatgctgctattcagagatcacaacagtatgagcaagctgccgatgcagaactagcttgggttgctgaaacaaaacggaaactgatggctctgggtccaattcgcctggaacaggaccagaccacagctcagcttcaggtacagaaggctttctccattgacattattcgacacaaagattcaatggatgaactcttcagtcaccgtagtgaaatctttggcacatgtggggaggagcaaaaaactgtattacaggaaaagacagagtctctaatacagcaatatgaagccattagcctactcaattcagagcgttatgcccgcctagagcgggcccaggtcttagtaaaccagttttgggaaacttatgaagagctcagcccctggattgaggaaactcgggcactaatagcacagttaccctctccagccattgatcatgagcagctcaggcagcaacaagaggaaatgaggcaattaagggaatctattgctgaacacaaacctcatattgacaaactactaaagataggcccacaactaaaggaattaaaccctgaggaaggggaaatggtggaagaaaaataccagaaagcagaaaacatgtatgcccaaataaaggaggaggtgcgccagcgagccctggctctggatgaagccgtgtcccagtccacacagattacagagtttcatgataaaattgagcctatgttggagacactggagaatctttcctctcgcctgcgtatgccaccactgatccctgctgaagtagacaagatcagagagtgcatcagtgacaataagagtgccaccgtggagctagaaaaactgcagccatcctttgaggccttgaagcgccgtggagaggagcttattggacgatctcagggagcagacaaggatctggctgcaaaagaaatccaggataaattggatcaaatggtattcttctgggaggacatcaaagctcgggctgaagaacgagaaatcaaatttcttgatgtccttgaattagcagagaagttctggtatgacatggcagctctcctgaccaccatcaaagacacccaggatattgtccatgacttggaaagcccaggcattgatccttccatcatcaaacaacaggttgaagctgctgagactattaaggaagagacagatggtctgcatgaagagctggagtttattcggatccttggagcagatttgatttttgcctgtggagaaactgagaagcctgaagtgaggaagagcattgatgagatgaataatgcttgggagaacttaaacaaaacatggaaagagaggctagaaaaacttgaggatgctatgcaagctgctgtgcagtatcaggacactcttcaggctatgtttgactggctagataacactgtgattaaactctgcaccatgccccctgttggcactgacctcaatactgttaaagatcagttaaatgaaatgaaggagttcaaagtagaagtttaccaacagcaaattgagatggagaagcttaatcaccagggtgaactgatgttaaagaaagctactgatgagacggacagagacattatacgagaaccactgacagaactcaaacacctctgggagaacctgggtgagaaaattgcccaccgacagcacaaactagaaggggctctgttggcccttggtcagttccagcatgccttagaggaactaatgagttggctgactcataccgaagagttgttagatgctcagagaccaataagtggagacccaaaagtcattgaagttgagctcgcaaagcaccatgtcctaaaaaatgatgttttggctcatcaagccacagtggaaacagtcaacaaagctggcaatgagcttcttgaatccagtgctggagatgatgccagcagcttaaggagccgtttggaagccatgaaccaatgctgggagtcagtgttacagaaaacagaggagagggagcagcagcttcagtcaactctgcagcaggcccagggcttccacagtgaaattgaagatttcctcttggaacttactagaatggagagccagctttctgcatctaagcccacaggaggacttcctgaaactgctagggaacagcttgatacacatatggaactctattcccagctgaaagccaaggaagagacttataatcaactacttgacaagggcagactcatgcttctaagccgtgacgactctgggtctggctccaagacagaacagagtgtagcacttttggagcagaagtggcatgtggtcagcagtaagatggaagaaagaaagtcaaagctggaagaggccctcaacttggcaacagaattccagaattccctacaagaatttatcaactggctcactctagcagagcagagtttaaacatcgcttctccaccaagcctgattctaaatactgtcctttcccagatagaagagcacaaggtttttgctaatgaagtaaatgctcatcgagaccagatcattgagctggatcaaactgggaatcaattaaagttccttagccaaaagcaggatgttgttctgatcaagaatttgttggtgagcgtgcagtctcgatgggagaaggttgtccagcgatctattgaaagagggcgatcactagatgatgccaggaagcgggcaaaacaattccatgaagcttggaaaaaactgattgactggctagaagatgcagagagtcacctggactcagaactagagatatccaatgacccagacaaaattaaacttcagctttctaagcataaggagtttcagaagactcttggtggcaagcagcctgtgtatgataccacaattagaactggcagagcactgaaagaaaagactttgcttcccgaagatagtcagaaacttgacaatttcctaggagaagtcagagacaaatgggatactgtttgtggcaagtctgtggagcggcagcacaagttggaggaagccctgctcttttcgggtcagttcatggatgctttgcaggcattggttgactggttatacaaggtggagccacagctggctgaggaccagcccgtgcacggggaccttgacctcgtcatgaacctcatggatgcacacaaggttttccagaaggaactgggaaagcgaacaggaaccgttcaggtcctgaagcggtcaggccgagagctgattgagaatagtcgagatgacaccacttgggtaaaaggacagctccaggaactgagcactcgctgggacactgtctgtaaactctctgtttccaaacaaagccggcttgagcaggccttaaaacaagcggaagtgtttcgagacacagtccacatgctgttggagtggctttctgaagcagagcaaacgcttcgctttcggggagcacttcctgatgacacagaggccctgcagtctctcattgacacccataaggaattcatgaagaaagtagaagaaaagcgagtggacgttaactcagcagtagccatgggagaagtcatcctggctgtctgccaccccgattgcatcacaaccatcaaacactggatcaccatcatccgagctcgcttcgaggaggtcctgacatgggctaagcagcaccagcagcgtcttgaaacggccttgtcagaactggtggctaatgctgagctcctggaagaacttctggcatggatccagtgggctgagaccaccctcattcagcgggatcaggagccaatcccgcagaacattgaccgagttaaagcccttatcgctgagcatcagacatttatggaggagatgactcgcaaacagcctgacgtggaccgggtcaccaagacatacaaaaggaaaaacatagagcctactcacgcgcctttcatagagaaatcccgcagcggaggcaggaaatccctaagtcagccaacccctcctcccatgccaatcctttcacagtctgaagcaaaaaacccacggatcaaccagctttctgcccgctggcagcaggtgtggctgttagcactggagcggcaaaggaaactgaatgatgccttggatcggctggaggagttgaaagaatttgccaactttgactttgatgtctggaggaaaaagtatatgcgttggatgaatcacaaaaagtctcgagtgatggatttcttccggcgcattgataaggaccaggatgggaagataacacgtcaggagtttatcgatggcattttagcatccaagttccccaccaccaagttagagatgactgctgtggctgacattttcgaccgagatggggatggttacattgattattatgaatttgtggctgctcttcatcccaacaaggatgcgtatcgaccaacaaccgatgcagataaaatcgaagatgaggttacaagacaagtggctcagtgcaaatgtgcaaaaaggtttcaggtggagcagatcggagagaataaataccggtttggggattctcagcagttgcggctggtccgtattctgcgcagcaccgtgatggttcgcgttggtggaggatggatggccttggatgaatttttagtgaaaaatgatccctgccgagcacgaggtagaactaacattgaacttagagagaaattcatcctaccagagggagcatcccagggaatgacccccttccgctcacggggtcgaaggtccaaaccatcttcccgggcagcttcccctactcgttccagctccagtgctagtcagagtaaccacagctgtacatccatgccatcttctccagccaccccagccagtggaaccaaggttatcccatcatcaggtagcaagttgaaacgaccaacaccaacttttcattctagtcggacatcccttgctggtgataccagcaatagttcttccccggcctccacaggtgccaaaactaatcgggcagaccctaaaaagtctgccagtcgccctgggagtcgggctgggagtcgagccgggagtcgagccagcagccggcgaggaagtgacgcttctgactttgacctcttagagacgcagtctgcttgttccgacacttcagaaagcagcgctgcagggggccaaggcaactccaggagagggctaaacaaaccttccaaaatcccaaccatgtctaagaagaccaccactgcctcccccaggactccaggtcccaagcgataacactgtctaagcacccccaagccactatccactttgaatcctgctccatacattgggtgtatatttattctgaacgggagaagttatattgttaaaagtgtaaaagaataattgtgttatgaagctgccttattttttttctttttgtaagttactattttcatgtgaatatttatgtagataaaatttgcctcctggtaaccctgtaatggatggggcccagaaatgaaatatttgagaaaaacaagtgaaaaggtcaagatacaaatgtgtattaaaaaaaaaaaagcctattaatagggtttctgcgcggtgcagggttgtaaacctgctttatcttttaggattattcctaaatgcatcttctttataaacttgacttgctatctcagcaagataaattatattaaaaaaataagaatcctgcagtgtttaaggaactctttttttgtaaatcacggacacctcaattagcaagaactgaggggagggctttttccattgtttaatgttttgtgatttttagctaaagagagggaacctcatctaagtaacatttgcacatgatacagcaaaaggagttcattgcaatactgtctttggatattgtttcagtactgggtgtttaaaggacaaatagctgctagaattcaggggtaaatgtaagtgttcagaaaacgtcagaacatttggggttttaaactgatttgttgctccctatccagcctagacaccagtaactcttgtgttcaccaggacccagacccttggcaagggataggctcgttggtgacattgtgaatttcagatttgttttatccactttttttgctatttatttaaatggtcgatcaacttcccacaaactgaggaatgaattccacgagcctgttctgaaaatgtggacgtaagacaaacacgtgctcgtcctttaatggagttcaccagcacacttgttaaccagtcctgtttgctttcgtctttttttgtgcgtaataaagtcaactgaccaagtgaccatgaaaaggggctgtctggggctcctgttttttagctgctgttcttcagctccgaccatgttgctgtgtgattatctcaattggttttaattgaggcagaaactgaagctctaccaatgaactgtttagaaacaagacacacttttgtattaaaattgcttgcagtaacaaata

SEQ ID NO: 153900 - DNA, 2559 bp, Homo sapiens
  Payload ID: 10253
  Gene Symbol: MACF1
  Gene Name: microtubule-actin crosslinking factor 1
  ENST ID: ENST00000446276
  CDS Start-End: 1-1366
aatcctttcacagtctgaagcaaaaaacccacggatcaaccagctttctgcccgctggcagcaggtgtggctgttagcactggagcggcaaaggaaactgaatgatgccttggatcggctggaggagttgaaagaatttgccaactttgactttgatgtctggaggaaaaagtatatgcgttggatgaatcacaaaaagtctcgagtgatggatttcttccggcgcattgataaggaccaggatgggaagataacacgtcaggagtttatcgatggcattttagcatccaagttccccaccaccaagttagagatgactgctgtggctgacattttcgaccgagatggggatggttacattgattattatgaatttgtggctgctcttcatcccaacaaggatgcgtatcgaccaacaaccgatgcagataaaatcgaagatgaggttacaagacaagtggctcagtgcaaatgtgcaaaaaggtttcaggtggagcagatcggagagaataaataccggttcttcctcggcaatcagtttggggattctcagcagttgcggctggtccgtattctgcgcagcaccgtgatggttcgcgttggtggaggatggatggccttggatgaatttttagtgaaaaatgatccctgccgagcacgaggtagaactaacattgaacttagagagaaattcatcctaccagagggagcatcccagggaatgacccccttccgctcacggggtcgaaggtccaaaccatcttcccgggcagcttcccctactcgttccagctccagtgctagtcagagtaaccacagctgtacatccatgccatcttctccagccaccccagccagtggaaccaagacttcacttcagttctctcgctgttatgacaaaccctggttggtaaacagtaaagctggcacccctatcagggacagccattctcctgacctccagctgcccacccccgaggttatcccatcatcaggtagcaagttgaaacgaccaacaccaacttttcattctagtcggacatcccttgctggtgataccagcaatagttcttccccggcctccacaggtgccaaaactaatcgggcagaccctaaaaagtctgccagtcgccctgggagtcgggctgggagtcgagccgggagtcgagccagcagccggcgaggaagtgacgcttctgactttgacctcttagagacgcagtctgcttgttccgacacttcagaaagcagcgctgcagggggccaaggcaactccaggagagggctaaacaaaccttccaaaatcccaaccatgtctaagaagaccaccactgcctcccccaggactccaggtcccaagcgataacactgtctaagcacccccaagccactatccactttgaatcctgctccatacattgggtgtatatttattctgaacgggagaagttatattgttaaaagtgtaaaagaataattgtgttatgaagctgccttattttttttctttttgtaagttactattttcatgtgaatatttatgtagataaaatttgcctcctggtaaccctgtaatggatggggcccagaaatgaaatatttgagaaaaacaagtgaaaaggtcaagatacaaatgtgtattaaaaaaaaaaaagcctattaatagggtttctgcgcggtgcagggttgtaaacctgctttatcttttaggattattcctaaatgcatcttctttataaacttgacttgctatctcagcaagataaattatattaaaaaaataagaatcctgcagtgtttaaggaactctttttttgtaaatcacggacacctcaattagcaagaactgaggggagggctttttccattgtttaatgttttgtgatttttagctaaagagagggaacctcatctaagtaacatttgcacatgatacagcaaaaggagttcattgcaatactgtctttggatattgtttcagtactgggtgtttaaaggacaaatagctgctagaattcaggggtaaatgtaagtgttcagaaaacgtcagaacatttggggttttaaactgatttgttgctccctatccagcctagacaccagtaactcttgtgttcaccaggacccagacccttggcaagggataggctcgttggtgacattgtgaatttcagatttgttttatccactttttttgctatttatttaaatggtcgatcaacttcccacaaactgaggaatgaattccacgagcctgttctgaaaatgtggacgtaagacaaacacgtgctcgtcctttaatggagttcaccagcacacttgttaaccagtcctgtttgctttcgtctttttttgtgcgtaataaagtcaactgaccaagtgaccatgaaaaggggctgtctggggctcctgttttttagctgctgttcttcagctccgaccatgttgctgtgtgattatctcaattggttttaattgaggcagaaactgaagctctaccaatgaactgtttagaaacaagacacacttttgtattaaaattgcttgcagtaacaaata

SEQ ID NO: 153901 - DNA, 2299 bp, Homo sapiens
  Payload ID: 10253
  Gene Symbol: MACF1
  Gene Name: microtubule-actin crosslinking factor 1
  ENST ID: ENST00000442046
  CDS Start-End: 1-1106
atgggaagataacacgtcaggagtttatcgatggcattttagcatccaagttccccaccaccaagttagagatgactgctgtggctgacattttcgaccgagatggggatggttacattgattattatgaatttgtggctgctcttcatcccaacaaggatgcgtatcgaccaacaaccgatgcagataaaatcgaagatgaggttacaagacaagtggctcagtgcaaatgtgcaaaaaggtttcaggtggagcagatcggagagaataaataccggtttggggattctcagcagttgcggctggtccgtattctgcgcagcaccgtgatggttcgcgttggtggaggatggatggccttggatgaatttttagtgaaaaatgatccctgccgagcacgaggtagaactaacattgaacttagagagaaattcatcctaccagagggagcatcccagggaatgacccccttccgctcacggggtcgaaggtccaaaccatcttcccgggcagcttcccctactcgttccagctccagtgctagtcagagtaaccacagctgtacatccatgccatcttctccagccaccccagccagtggaaccaagacttcacttcagttctctcgctgttatgacaaaccctggttggtaaacagtaaagctggcacccctatcagggacagccattctcctgacctccagctgcccacccccgaggttatcccatcatcaggtagcaagttgaaacgaccaacaccaacttttcattctagtcggacatcccttgctggtgataccagcaatagttcttccccggcctccacaggtgccaaaactaatcgggcagaccctaaaaagtctgccagtcgccctgggagtcgggctgggagtcgagccgggagtcgagccagcagccggcgaggaagtgacgcttctgactttgacctcttagagacgcagtctgcttgttccgacacttcagaaagcagcgctgcagggggccaaggcaactccaggagagggctaaacaaaccttccaaaatcccaaccatgtctaagaagaccaccactgcctcccccaggactccaggtcccaagcgataacactgtctaagcacccccaagccactatccactttgaatcctgctccatacattgggtgtatatttattctgaacgggagaagttatattgttaaaagtgtaaaagaataattgtgttatgaagctgccttattttttttctttttgtaagttactattttcatgtgaatatttatgtagataaaatttgcctcctggtaaccctgtaatggatggggcccagaaatgaaatatttgagaaaaacaagtgaaaaggtcaagatacaaatgtgtattaaaaaaaaaaaagcctattaatagggtttctgcgcggtgcagggttgtaaacctgctttatcttttaggattattcctaaatgcatcttctttataaacttgacttgctatctcagcaagataaattatattaaaaaaataagaatcctgcagtgtttaaggaactctttttttgtaaatcacggacacctcaattagcaagaactgaggggagggctttttccattgtttaatgttttgtgatttttagctaaagagagggaacctcatctaagtaacatttgcacatgatacagcaaaaggagttcattgcaatactgtctttggatattgtttcagtactgggtgtttaaaggacaaatagctgctagaattcaggggtaaatgtaagtgttcagaaaacgtcagaacatttggggttttaaactgatttgttgctccctatccagcctagacaccagtaactcttgtgttcaccaggacccagacccttggcaagggataggctcgttggtgacattgtgaatttcagatttgttttatccactttttttgctatttatttaaatggtcgatcaacttcccacaaactgaggaatgaattccacgagcctgttctgaaaatgtggacgtaagacaaacacgtgctcgtcctttaatggagttcaccagcacacttgttaaccagtcctgtttgctttcgtctttttttgtgcgtaataaagtcaactgaccaagtgaccatgaaaaggggctgtctggggctcctgttttttagctgctgttcttcagctccgaccatgttgctgtgtgattatctcaattggttttaattgaggcagaaactgaagctctaccaatgaactgtttagaaacaagacacacttttgtattaaaattgcttgcagtaacaaata

SEQ ID NO: 153902 - DNA, 477 bp, Homo sapiens
  Payload ID: 10253
  Gene Symbol: MACF1
  Gene Name: microtubule-actin crosslinking factor 1
  ENST ID: ENST00000422234
  CDS Start-End: 1-477
gataaaatcgaagatgaggttacaagacaagtggctcagtgcaaatgtgcaaaaaggtttcaggtggagcagatcggagagaataaataccggtttggggattctcagcagttgcggctggtccgtattctgcgcagcaccgtgatggttcgcgttggtggaggatggatggccttggatgaatttttagtgaaaaatgatccctgccgagttcaccatcctgggagtaaaataaagcgctctgattccagctcttcgatttccagtcagtctcccatagcacgaggtagaactaacattgaacttagagagaaattcatcctaccagagggagcatcccagggaatgacccccttccgctcacggggtcgaaggtccaaaccatcttcccgggcagcttcccctactcgttccagctccagtgctagtcagagtaaccacagctgtacatccatgccatcttctccagccacccca

SEQ ID NO: 153903 - DNA, 7410 bp, Homo sapiens
  Payload ID: 10253
  Gene Symbol: MACF1
  Gene Name: microtubule-actin crosslinking factor 1
  ENST ID: ENST00000530275
  CDS Start-End: 1194-5477
gagcacttccagcgagctagcgagctagcgggtcgcgctgcgcgggggaggaggactcgccccccgcccgaccctagcggagccttttgttcccagccagaagtttgcatgccgggaccgtgacagctgcgggcggggaggacggcggggccgcggggccagcggcgtggtggagaatagaggcggctgcttgtcatgcagcccacggcgtggcggctgcgggccggggactggcggcggcgggcgaggcggcgcccacagcactcgggactcagctgccggagggacaaactaacttcctgagcgcgggacctgaggctggcgcggccgggagccacctgcagcctgcggtgaggcgaccctggccctcggggcgcgcggcatggcgcggggaagcgggccgtgctgagcgagcccctccgacagacccgcggccgctgctgctgcccgcccgcccgcctgcctttccgaaggcctggcgcggggctccgctcgccttgttttgcagctacagcgcagggttggcctgggagccacaacaatgccatgatgttttggagacaggaagccccaagctggccccgaatgaaggacttcctgtgtttaaagttgcaggaatatccgccgaccagcccagttcaaatgcaaacaccccagctagggaggacgaatggctaattcagaccagctggactctccagggctggaactgaggataaaatgaaaggaattcttaggagcttgggccatacttgaagactagagaggctgtgccattgttattaaaggatacaatcggcataaatttgctgctcccaactctgcttcggtgagaagtgagtggaactagatatcgaaaaagactcgtcaatatcagatgatttttgttgactgtatttgaaagagcagtgctcttaaaaaaaattaaaccataagccatacaaggaattattttaaattatatcgtctgtcaaccatgaggctgctagcctgtgaggaaaaagctgtttgtcttagagcttctcccagaatggtttcaaaacggaacttccaggcctttctggagggcagatgcaattggtggtttggggtatgaacagctaaaaggatttataacttatgtagaatgcatttggggggaacctgtgaaaaatacttttgaaagattgatggttcatcttgattgaaaaaggatgggtaagccactcagcagaccagactgtttaaggcggaaccccagctgcctggggaaaggagaggaggaggatggctacatagaggactgctatgttccacaacggtctatatatgatacgatgaggataaatgagcaaattgaccaggggtcaaagcttaaccagacttcaaaaagcaccatggaaaagatggaaggaagtactatatccagcaatggtacattaggagcagcatctaatgtttttgaatctagagcaccagaaggtaagaagctggatgagaggataatatttgatgcactaaagctaagcagtgatgtgcagaagtcagcacctgtgccacccagaaggcggccaaatgcagaacgcaaagacaatgttaacaggagatcgtggaagtccttcatgccacccaacttcccagaatttgcagagaggatagaagcttctctcagtgaggtttcagaagctggtgcttcaaatccttccttgcaagagaagaaggagtccagttctgcattaacagaaagttctggtcatttggaccacagggaacctcagtcagagtcagtaactctggaacatgtgtccaaatccataggtattccagaggtgcaagattttaaaaacttaagtggagactgccaggactttagatttcagcagcacagtgcaaaccctcctcatgaattccagcctgtagaatcagaagctgtagcaacaagtggtaacacagatgtaatgcaggaatccagattctcaagtgcaacctggccgagggccacaaaaagtttagctaagggaggcttcagtgagaagcagcacccccttggggacacagcctgcactgtggaaatgccacctctctccccttgcctgagtgaagagctgttagatccagaattgcatgttctcataacccccagcctgagagagaaaacagagtctgagctaaagtttgaggaggatgagcgatggattatgatggaggctgagggagagtgggaggaagagaaactgtcagacagggaaaagacttttctgatggcagatgagaagaacagcctggcagatatttttgaagaaagagaacaagcaaacacagcagtggtggaggatggatccgattgcttagctgctgtcttgaggacttttggccacctatctcttggtcagatttgttgccctgatgacccacagccagccaaggaccagttggctactgttcccaaggatatacccctggattgcgattgtgttcttacaggtgaggatattctcggtgaggtggcaaacagaactgctcaggggttagagggacttgtttcagattcagcatgtactgtgggtactattgatgcagaacagctctctgacacagactcagtgcagatgtttcttgaacttgaaaaggagtgtttatgtgaagaaggagtaactcctctagttgagctacagaatcaaatctcttctgaagggctggctgcatcccaggatgcagaaaatttactcgtaattagtcatttttcaggggctgccttagaaaaggaacagcatttaggccttttacatgtaagggcaaaagattatgatactagattggattgtggatattttaataccctggattcttctcaggtgcctaatgctgtggaacttattgcccacgttgatatcatgagagacacttccactgttagcaaggaggaatgtgaaaaagtgccttttagccccaggactgcagaatttaagtccagacagccagctgatctggattcactggaaaagctggacccaggaggactgctgaactctgatcacagggtttctcatgaagaaaaattatcaggcttcattgcttctgagctggccaaagacaatggcagtttgtcccagggagactgcagtcaaactgaggggaatggtgaggagtgcattgagagggtcaccttcagttttgcttttaatcatgaactaacagatgttacctcaggacctgaagtagaggtgttatatgaatcaaatttactaacagatgaaattcatttggaaagtgggaatgtaactgttaatcaagaaaataacagtctgacatcaatgggaaatgtggtcacttgtgaattgtctgtggagaaagtttgtgatgaggatggtgaggcaaaagagctggattatcaagccacacttttggaggatcaagctccagcacatttccacagaaacttcccagagcaggtcttccaggatctccagaggaagtccccagagtcagagattctgagtctgcacctgctggttgaagaactgagacttaatccagatggagtggaaactgtgaatgatacaaagcctgagctgaatgtggcatcatcagagggaggggagatggaaaggagagattcagattcattcctaaatatttttccagagaaacaagttaccaaggctggtaatactgaaccagttttagaggaatggatacccgtcctccagagaccttcccggactgctgcagtacccactgtcaaagatgccctagatgctgcactgcccagcccagaggagggtacctcaattgctgcagtgcctgccccagagggaactgctgtagttgctgctttagtgccctttccacatgaggacatcctagttgcttcaatagtctccttagaggaggaggatgtcacagctgctgcagtatcagccccagagagggctactgtcccagctgttacagtatctgtccctgaagggactgctgcagttgctgcagtgtcctccccagaggagactgctccagctgttgcagcagccatcacacaggagggtatgtcagctgtcgcagggttctccccagagtgggctgctttagctattacagtacccatcacagaggaggatggtacaccagaagggcctgtcaccccagctaccacagtgcatgctccagaggagcctgatactgcagctgtcagagtgtccaccccagaggagcccgcctccccagctgctgcagtgcccaccccagaggagcccacctccccagctgctgcagtgcccaccccagaggagcccacctccccagctgctgcagtgccccccccagaggagcccacctccccagctgctgcagtgcccaccccagaggagcccacctccccagctgctgcagtgcccaccccagaggagcccacctccccagctgctgcagtgcccaccccagaggagcccacctccccagctgctgcagtgcccaccccagaggagcccacctccccagctgctgcagtgcccaccccagaggagcccacctccccagctgctgcagtgcccaccccagaggagcccgcctccccagctgctgcagtgcccaccccagaggagcccgcctccccagctgctgcagtgcccaccccagaggagcctgccttcccagctcctgcagtgcccaccccagaggaatccgcctccgcagctgttgcagtgcccacccccgaggaatctgcctccccagctgctgcagtgcccaccccagcagaatctgcctcctttgcagctgtggtggccaccctggaggaacccacttccccggcagcttcagtgcccacccctgcagctatggtggccaccctagaggaattcacttccccggcagcttcagtgcccacctctgaggagcctgcctccctagcagctgcagtgtccaacccagaggagcccacctccccagcagcagcagtgcccaccctagaggaacccacctcctcagcagctgcagtgctcaccccagaggaactcagttccccagcagcttcagtgcccacccccgaggagcctgcctccccagcagctgcagtgtccaacctagaggagcccgcctccccagcagcagcagtgcccaccccagaggtggctgccatccctgctgcttcagtgcccaccccagaggtgcctgccatcccagctgctgcagtgcctcctatggaggaagtttcccccattggtgtgcccttcctgggagtttctgcccacactgactcagtgcctatttcagaagaaggaacacctgttctagaggaggcttcctccactggaatgtggatcaaggaggaccttgattccctagtatttggcataaaagaggtgaccagcacagtgctacatgggaaagtgcctctggctgcaaccgctggattaaattcagatgaggtaattgtccattttgattctgggaagggtctaaagagtaaagtgagatttgcagggctgacctggtggtgatgagaaatggcacagatagttcttttgttctttttgggtctcccgggcttatagtttgtagtctttctgttcagtttttggggaaaatatactttaattttgtctggtgaaagactttataatttcatgcttcgttttttattcagataagccaatcccacggaaaacagggatataaacagttgttgatttacatttttaaaaagattattagcaggaaagggtcattctgtttttgaattatacagtgagcatgttcttgcctaaaccaagagacagtttattcattggtggtgtcaacatttaggtagaggccagagtgtgagctttggaatgagacctggggtgcttcctaaccactctgggaaaattagttagctattcttgagtttcctgtttcttcatttgttaaggcataactctgtgaggataaaatgagatacatttaaggtaccaagcgtataagattaccaatcactggccatatcctccccattcttttcaaataggtatgttggttggttgaaagaatttaccaaagtagattggagagaagcaataaagctaaatgattaagaacttttaaatgcaaatatgtgtttctgaaaaccagagctaggcataatgtttatgaaaaatagagatattttagtcatctttgtcaaactgcctttgtgtccttaagcaagtcattttcctttccaggacctcatttcttcattataaaacaagaaaattgggctaaatgtcctcttgggtctctcttggctctaagattctttttattttttttttttagatggagtctggctctgtcagtcaggctggagtgctagagtgcagtggtgcgatctcagctcactgcaagctccacctcccgggttcacgccattctcctgcctcagcctcccgagtagctgggactacaggcgcccgccactacgcccggcaattttttgtatatatatatatataattttttttttttttttttagtagagacgggtttcactgtgttagccaggatggtctcaatctcctgacctcatgatctgcccgcctcggcctcccagagtgctgggattacaggcgtgagccaccgcgcccagccggctctaagattcttaatgttagagaaccgaatgtgttaggaaacagttggaaacgatgttccacatccttgagcactcctagtccaaggaatttgagatcagcagctttccacagttaattacccaggtttgatttggtcagtggtaaagagtgcaggagttagaggtttaatctgaacacaagagatgactgagtgagaagattgttttgattttactgcgcccctaggactcaaaatagtgccttcttcatagcaggcatttgctgttgactgactgactgaatgcatgaatatcaatttcctagactatggatggatgctacaagaaagatgggttttctcattcacctcactgcagagcctttcagggcagccttaagtcagctagagcaccagctaaacatgcaggtcctgacaacaaaatcattttgattgcatgccataaactctttgattaagaggattgattaagataatctggccttgctgagtggtggtggttttaccttgagctttaccagttattttgtcaggtagcattccattaaattaggatgcatcatctttgagactgatggatttttgattcatttttccgagttttattgaatttggaatgacaccgagatcccaatagcctgtacaaagtgaagacagtaggtcaacaacagagccattcttgataatacagaatatttcacaccaggcacagtggctcacacctctaatcccaacatttgggaagccaagggaagaggattgcttgaggccaggagttcgagaacagcctaggcaacatagtaagaccccatctctgag

SEQ ID NO: 153904 - DNA, 1085 bp, Homo sapiens
  Payload ID: 10253
  Gene Symbol: MACF1
  Gene Name: microtubule-actin crosslinking factor 1
  ENST ID: ENST00000482035
  CDS Start-End: 1-1085
ccatccctgctgcttcagtgcccaccccagaggtgcctgccatcccagctgctgcagtgcctcctatggaggaagtttcccccattggtgtgcccttcctgggagtttctgcccacactgactcagtgcctatttcagaagaaggaacacctgttctagaggaggcttcctccactggaatgtggatcaaggaggaccttgattccctagtatttggcataaaagaggtgaccagcacagtgctacatgggaaagtgcctctggctgcaaccgctggattaaattcagatgagatgtttcagaaagaacaagtggatcctcttcagatgaaattgcagcaggtgaatggacttggccagggattaattcagagtgcaggaaaagactgtgatgtacagggtttagaacatgacatggaagagatcaatgctcgatggaatacattgaataaaaaggtcgcacaaagaattgcacagctacaggaagctttgttgcattgtgggaagtttcaagatgccttggagccattgctcagctggttggcagataccgaggagctcatagccaatcagaaacctccatctgctgagtataaagtggtgaaagcacagatccaagaacagaagttgctccagcggctcctagatgatcgaaaggccacagtagacatgcttcaagcagaaggaggcagaatagcccagtcagcagagctggctgatagagagaaaatcactggacagctggagagtcttgaaagtagatggactgaactactcagtaaggcagcagccaggcaaaaacagctggaagacatcctggttctggccaaacagttccatgagacagctgagcctatttctgacttcttatctgtcacagagaaaaagcttgctaactcagaacctgttggcactcagactgccaaaatacagcagcagatcattcggcacaaggctctggaagaagacatagaaaaccatgcaacagatgtgcaccaggcagtcaaaattgggcagtccctctcctccctgacatctcctgcagaacagggtgtgctgtcagaaaagatagactcattgcaggcc

SEQ ID NO: 153905 - DNA, 834 bp, Homo sapiens
  Payload ID: 10253
  Gene Symbol: MACF1
  Gene Name: microtubule-actin crosslinking factor 1
  ENST ID: ENST00000484793
  CDS Start-End: 336-701
cgctgggagtgggggagcgggttgggcggctgcgccggctctgcttcagccgctgccgctagggcgcggggggcggggggctcggcgccgcgagctcggccattgtgggagccgctcccctcggctccgccacgctcccctcgactgcgctccagcctggggcgcgcccggccgccgccgccttcgctgccgccacgggcccgtcttcttcctccttcggctcccaggatgaagaaactgagtctcagagaggtgaagtgacttgcccaagatcacagcaattatcacttctccctgggctcccaggccctcctgcagcagcccccgcctgggccatgtcttcctcagatgaagagacgctcagtgagcggtcatgtcggagtgagcggtcttgtcggagtgagcgatcttacaggagcgagcggtcggggagcctgtctccctgtcccccaggggacaccttgccctggaacctgccactgcatgagcagaaaaagcggaaaagccaggattcggtgctggaccctgcagagcgtgctgtggtcagagtcgctgatgcccttccgagtacatccttctgcttcccccattgcagccttcttagaaatgcagcagcagtctcacccatcaggagcaaaagaaaatcaaagaccaaaaggagaaagcctcagagcttttgcgactgtgtggtctggctataaatttagactgttgcttgaaagaagcgaaaaacctccccttcatagacttccttcttcccatcccccctggcagccgctttgttcctctagccttgtaaaattttctctgtataaaacaggaacatcagccaaa

SEQ ID NO: 153906 - DNA, 4338 bp, Homo sapiens
  Payload ID: 10253
  Gene Symbol: MACF1
  Gene Name: microtubule-actin crosslinking factor 1
  ENST ID: ENST00000524432
  CDS Start-End: 214-4338
ggaccggcggagcgcgagcgggccgggtgcgagcggactgaggagcggagcgcgactgccgggccgggcgaggcgggcggacggcggagagcgagggcgccgtcgccgtctctgagacgcacaaagggtcgaggctggggccgccgccgcctcagcgcgcgggcctggaaccggcagcccccggggctcggcgagaaggcggtgcgggcggccatggccggctacgtgccgggtcagcagccggccaaccgcagccaggagaaggagttcgtgcaggcgtacgaggatgtgctggagcggtacaaagatgaacgggaccgggttcagaagaaaacgttcaccaagtgggtcaacaagcacttaatgaaggtccgcaagcacatcaatgatctttatgaagatctgcgggatggccataacctgatctctctgttggaggtcctctcaggcatcaaactgccccgggagaagggcaggatgcgttttcataggctgcagaatgtgcagattgccctggacttcctaaagcagcgacaggtgaaactagtgaatattcgcaatgatgacatcacagatggcaaccccaagttgaccctgggtctgatctggaccattattttgcatttccagatctctgacatctacattagtggagaatcaggggatatgtcagccaaggagaaactactcctgtggacccagaaggtgacagctggttacacaggaatcaaatgcaccaacttttcctcctgctggagtgatgggaagatgttcaatgcactcattcaccgataccgacccgatctagtagacatggagagggtgcaaatccaaagtaaccgagagaatctggaacaggcttttgaagtggcagaaagactgggggtcactcgcctgctggatgcagaagatgtggatgtgccatctccagatgaaaagtctgtaatcacttatgtgtcttcgatttatgatgccttccctaaagttcctgagggtggagaagggatcagtgctacggaagtggactccaggtggcaagaataccaaagccgagtggactccctcattccctggatcaaacagcatacaatactgatgtcagataaaacttttccccaaaaccctgttgaactaaaggcactttataaccaatatatacacttcaaagaaacagaaattctggccaaggagagagaaaaaggaagaattgaggaattatataaattactagaggtgtggattgaatttggccgaattaaactgcctcaaggttatcaccctaatgatgtggaagaagagtggggaaagctcatcatagagatgctggaacgagagaaatcacttcggccggctgtggagaggctggaattgctgctacagattgcaaacaaaatccagaatggtgctttgaactgtgaagaaaaactgacactagctaagaatacactgcaggctgatgctgctcacctggaatcaggacaaccggtacaatgtgagtcagatgtcattatgtacattcaggagtgtgaaggtctcatcaggcagctgcaggtggatctccagatcctgcgggatgagaattactaccagctagaagagctggcttttagggtcatgcgtcttcaggatgagctggtcaccttgcgtctagagtgtacaaacctgtaccggaagggtcatttcacttcacttgaattggttccaccctctactttaaccaccactcatctgaaagcagaacccttaaccaaggcaacccattcttcttctacctcctggttccgaaagcctatgactcgggctgaacttgtggccatcagctcctctgaagatgaaggcaatctccgatttgtgtatgaactactgtcttgggtagaagagatgcagatgaaactggagcgagcagagtggggcaatgacctgcctagtgtggagttgcagctagaaacacagcagcacatccatacgagtgtagaagagctgggctcaagtgtcaaggaggccaggttgtatgagggaaagatgtcccagaatttccataccagctatgctgaaactcttggaaagctggagacacagtattgtaaattgaaggaaacttctagcttccggatgaggcaccttcagagcctgcataaatttgtttccagagctacagctgagttgatctggttgaatgagaaggaggaggaggaactagcatatgactggagtgacaacaattccaatatctcagccaagagaaattacttctctgagttgacaatggaactggaggagaaacaggatgtgtttcgttctctacaagatacagcagaactactttcacttgagaaccacccagccaagcagacagtggaggcttacagtgctgctgtccagtcccagttgcagtggatgaagcagctgtgcctgtgtgttgagcagcatgtgaaagagaatactgcttattttcagttcttcagtgatgcacgagagctggagtcattcttgaggaacctccaagattccattaaacgaaaatattcctgtgaccacaacaccagcttatcccgccttgaagacctgctccaggactccatggatgaaaaggagcagcttatacagtccaagagttccgttgccagtctcgttgggagatcaaaaaccatcgttcagctaaaaccacgcagtccagaccatgtgttaaagaacaccatttctgtcaaggctgtctgtgactacaggcagatcgagattactatttgcaaaaatgatgaatgtgtgctagaagataattctcagcggaccaaatggaaagtgatcagccccacagggaacgaggcaatggtgccgtcagtctgcttcctcatccccccacccaataaggatgccattgagatggccagcagggtcgaacaatcttatcagaaggttatggccctttggcatcagctgcatgttaacaccaaaagccttatctcttggaactatctgcgtaaagaccttgaccttgtacagacctggaacctagaaaagcttcgatcctcagcaccaggggagtgccatcagattatgaagaaccttcaggcccactatgaagactttctgcaggatagtcgtgactctgtgctgttctcagtggctgatcgcttgcgcttggaagaggaggtggaagcttgtaaagcccgcttccagcacctgatgaagtccatggagaatgaggacaaagaggagactgtggccaagatgtacatttcagagttgaagaacatccggctacgcctggaggagtatgaacagagggtggtcaaacgaattcagtctctagccagctctaggactgacagagatgcctggcaggacaatgcattaaggattgcagagcaagagcacacccaggaggatttacagcaattgaggtcagacttggatgcagtttctatgaaatgtgacagctttctccatcagtctccatctagttcaagtgtcccaactctgcgctcagaactgaatctgctggtggagaagatggaccatgtctatggtctctctactgtatatctgaataagttaaagacagttgatgttatagtacgtagcatacaggatgctgaactcttggtcaaaggttatgagattaagctgagtcaagaagaagtagtactggcagatctctcagctctggaggcccattggtcgacattacggcactggcttagtgatgtgaaggacaagaattcagtgttttcagtcctggatgaggaaattgccaaggccaaggtagtggcagagcagatgagtcgtctgacaccagagcgaaatctggatttggagcgctatcaggaaaaaggctcccagctgcaggagcgttggcaccgagtcattgcccagctcgagattcgccaatctgagctagaaagtatccaggaagttctgggagattaccgagcctgccatggaactctcatcaagtggattgaggaaaccactgcccagcaggaaatgatgaagccaggccaggcagaggatagcagagtgctttcggagcagctcagccagcagacggccctatttgcagaaattgagagaaatcagacaaaactggatcaatgtcaaaaattttcccagcagtactctactattgtaaaggactatgaattgcaactgatgacatacaaggcctttgtggaatcgcagcagaaatcccctggcaagcgccgtcgcatgctttcctcttcagatgccatcactcaagagttcatggacttaaggactcgctacacggcattggtgactttaacaactcagcacgtgaaatacatcagtgatgcactccggcgtctggaggaggaggag

SEQ ID NO: 153907 - DNA, 5065 bp, Homo sapiens
  Payload ID: 10253
  Gene Symbol: MACF1
  Gene Name: microtubule-actin crosslinking factor 1
  ENST ID: ENST00000496804
  CDS Start-End: 234-3422
atgctttgaatttgtcttgttgcagctctgagcctgtaagatggctgtctgaatcggcagcggctggaagagacagagagaggcggggagggagggagaaagaattggagggattgccggcatagtgcatgtttttaaatgtgcatcgaatccgatgaggccaaggttgggatttctgtgggatcccaggactggcttagctgcgtttttgctgagattaggagaggaaggaaatgggaaattcactgggctgttttaaggagccgaaagagtcaatagctattcctgagaaggctcccatatctcctaagaaaagggttcggttcaaaaggaggtggagagggaagaaaatccctactccagaggcatctcaccaggaagaaacctcagaaggaactggagtcattgaagagactgaaaccctaacgaagttaacagagagtctccaaaaggaagacggagtgggaggggtagagcatacccccccagatattttgctgcctggggactcagcccccaactcacgggtagtcgatcgggggatgatagtacaggtaaaggagagattccaaggggaggtccagaccgcccaccttttgttagagaatgagtcatcagttgctggaggggtctgggattccctggaagaggggatgactgtcattgctcacctgcttgataacccagcagaaaggaactgcgagaagtcagtgagccaactggtggaatttcctaggacagcatcctgcagcagcagggctgtgttgctgcctttgcaaggagagactgcagtggagaaaggaaatattcagcgtgggtttcggagctgtgctttgcctaggacagactaccccactgataaaggaaatcaagaacaattttcagagggctggagtgtggaggaaggaaccaagagtgtttcaggtgcccctcagacagcttcctggattatagaatgttctgtttcttcattactactggaccagcctggaggccaaagacgcacggagccttcccatgtgggtcaagtgcccccccaggattccagactgcctacttctcagagtgatttgtccatcagtggtgtgactgtgagcattttgccctcctcctctggctatggcagtgatgggccacacatacatgggatccagcctaaagatacagaacctgaaaagagctctacttccttctcagaagaggatggcactctttctctggaggcaagccacaccccatcatggggtctggaagagatctctgacatctacattagtggagaatcaggggatatgtcagccaaggagaaactactcctgtggacccagaaggtgacagctggttacacaggaatcaaatgcaccaacttttcctcctgctggagtgatgggaagatgttcaatgcactcattcaccgataccgacccgatctagtagacatggagagggtgcaaatccaaagtaaccgagagaatctggaacaggcttttgaagtggcagaaagactgggggtcactcgcctgctggatgcagaagatgtggatgtgccatctccagatgaaaagtctgtaatcacttatgtgtcttcgatttatgatgccttccctaaagttcctgagggtggagaagggatcagtgctacggaagtggactccaggtggcaagaataccaaagccgagtggactccctcattccctggatcaaacagcatacaatactgatgtcagataaaacttttccccaaaaccctgttgaactaaaggcactttataaccaatatatacacttcaaagaaacagaaattctggccaaggagagagaaaaaggaagaattgaggaattatataaattactagaggtgtggattgaatttggccgaattaaactgcctcaaggttatcaccctaatgatgtggaagaagagtggggaaagctcatcatagagatgctggaacgagagaaatcacttcggccggctgtggagaggctggaattgctgctacagattgcaaacaaaatccagaatggtgctttgaactgtgaagaaaaactgacactagctaagaatacactgcaggctgatgctgctcacctggaatcaggacaaccggtacaatgtgagtcagatgtcattatgtacattcaggagtgtgaaggtctcatcaggcagctgcaggtggatctccagatcctgcgggatgagaattactaccagctagaagagctggcttttagggtcatgcgtcttcaggatgagctggtcaccttgcgtctagagtgtacaaacctgtaccggaagggtcatttcacttcacttgaattggttccaccctctactttaaccaccactcatctgaaagcagaacccttaaccaaggcaacccattcttcttctacctcctggttccgaaagcctatgactcgggctgaacttgtggccatcagctcctctgaagatgaaggcaatctccgatttgtgtatgaactactgtcttgggtagaagagatgcagatgaaactggagcgagcagagtggggcaatgacctgcctagtgtggagttgcagctagaaacacagcagcacatccatacgagtgtagaagagctgggctcaagtgtcaaggaggccaggttgtatgagggaaagatgtcccagaatttccataccagctatgctgaaactcttggaaagctggagacacagtattgtaaattgaaggaaacttctagcttccggatgaggcaccttcagagcctgcataaatttgtttccagagctacagctgagttgatctggttgaatgagaaggaggaggaggaactagcatatgactggagtgacaacaattccaatatctcagccaagagaaattacttctctgagttgacaatggaactggaggagaaacaggatgtgtttcgttctctacaagatacagcagaactactttcacttgagaaccacccagccaagcagacagtggaggcttacagtgctgctgtccagtcccagttgcagtggatgaagcagctgtgcctgtgtgttgagcagcatgtgaaagagaatactgcttattttcagttcttcagtgatgcacgagagctggagtcattcttgaggaacctccaagattccattaaacgaaaatattcctgtgaccacaacaccagcttatcccgccttgaagacctgctccaggactccatggcacaggatgaaaaggagcagcttatacagtccaagagttccgttgccagtctcgttgggagatcaaaaaccatcgttcagctaaaaccacgcagtccagaccatgtgttaaagaacaccatttctgtcaaggctgtctgtgactacaggcagatcgagggtcgaacaatcttatcagaaggttatggccctttggcatcagctgcatgttaacaccaaaagccttatctcttggaactatctgcgtaaagaccttgaccttgtacagacctggaacctagaaaagcttcgatcctcagcaccaggggagtgccatcagattatgaagaaccttcaggcccactatgaagactttctgcaggatagtcgtgactctgtgctgttctcagtggctgatcgcttgcgcttggaagaggaggtggaagcttgtaaagcccgcttccagcacctgatgaagtccatggagaatgaggacaaagaggagactgtggccaagatgtacatttcagagttgaagaacatccggctacgcctggaggagtatgaacagagggtggtcaaacgaattcagtctctagccagctctaggactgacagagatgcctggcaggacaatgcattaaggattgcagagcaagagcacacccaggaggatttacagcaattgaggtcagacttggatgcagtttctatgaaatgtgacagctttctccatcagtctccatctagttcaagtgtcccaactctgcgctcagaactgaatctgctggtggagaagatggaccatgtctatggtctctctactgtatatctgaataagttaaagacagttgatgttatagtacgtagcatacaggatgctgaactcttggtcaaaggttatgagattaagctgagtcaagaagaagtagtactggcagatctctcagctctggaggcccattggtcgacattacggcactggcttagtgatgtgaaggacaagaattcagtgttttcagtcctggatgaggaaattgccaaggccaaggtagtggcagagcagatgagtcgtctgacaccagagcgaaatctggatttggagcgctatcaggaaaaaggctcccagctgcaggagcgttggcaccgagtcattgcccagctcgagattcgccaatctgagctagaaagtatccaggaagttctgggagattaccgagcctgccatggaactctcatcaagtggattgaggaaaccactgcccagcaggaaatgatgaagccaggccaggcagaggatagcagagtgctttcggagcagctcagccagcagacggccctatttgcagaaattgagagaaatcagacaaaactggatcaatgtcaaaaattttcccagcagtactctactattgtaaaggactatgaattgcaactgatgacatacaaggcctttgtggaatcgcagcagaaatcccctggcaagcgccgtcgcatgctttcctcttcagatgccatcactcaagagttcatggacttaaggactcgctacacggcattggtgactttaacaactcagcacgtgaaatacatcagtgatgcactccggcgtctggaggaggaggagaaagtggtagaagaggagaaacaagaacatgtggagaaggttaaagaacttttgggctgggtgtctaccctagcgaggaatacacaaggaaaagctacctcatccgagaccaaagaatcaacagacattgaaaaagctattttggaacagcaggttctgtcagaagagctgacaacaaagaaagaacaagtctctgaagctattaaaacatcacagatcttcttggccaagcatggtcataagctctcag

SEQ ID NO: 153908 - DNA, 667 bp, Homo sapiens
  Payload ID: 10253
  Gene Symbol: MACF1
  Gene Name: microtubule-actin crosslinking factor 1
  ENST ID: ENST00000494012
  CDS Start-End: 329-667
agaggtttgagtcagcttgacactggcttaggcgctccttttcactctccttgttccttcttccctttcccctcccccgctggccagttgtttcctgggctttgtctgagatacactgtacagttttagtcccagtctactagcgcctgctgaaaaacagtcagaagtgagatggaggagaagctgccaggaagtttctgacaacactaagctccggcctctgcctctgctgatagtacaggacaacagtaacctcaggagaaaggcatccagaggcctgcgctgagcttgtggctaactcaagggaggagaaaggacgggcctggaaatgcccctcttagattcatcttatttaccaccaaccatctttattttgactcacgttcttggagttgctggtgttctatactggaagaggcatgccagaggtagagcagatgaacgggaccgggttcagaagaaaacgttcaccaagtgggtcaacaagcacttaatgaaggtccgcaagcacatcaatgatctttatgaagatctgcgggatggccataacctgatctctctgttggaggtcctctcaggcatcaaactgccccgggagaagggcaggatgcgttttcataggctgcagaatgtgcagattgccctggacttcctaaagcagcgacag

SEQ ID NO: 153909 - DNA, 6257 bp, Homo sapiens
  Payload ID: 10253
  Gene Symbol: MACF1
  Gene Name: microtubule-actin crosslinking factor 1
  ENST ID: ENST00000530262
  CDS Start-End: 172-6257
gctggaagagacagagagaggcggggagggagggagaaagaattggagggattgccggcatagtgcatgtttttaaatgtgcatcgaatccgatgaggccaaggttgggatttctgtgggatcccaggactggcttagctgcgtttttgctgagattaggagaggaaggaaatgggaaattcactgggctgttttaaggagccgaaagagtcaatagctattcctgagaaggctcccatatctcctaagaaaagggttcggttcaaaaggaggtggagagggaagaaaatccctactccagaggcatctcaccaggaagaaacctcagaaggaactggagtcattgaagagactgaaaccctaacgaagttaacagagagtctccaaaaggaagacggagtgggaggggtagagcatacccccccagatattttgctgcctggggactcagcccccaactcacgggtagtcgatcgggggatgatagtacaggtaaaggagagattccaaggggaggtccagaccgcccaccttttgttagagaatgagtcatcagttgctggaggggtctgggattccctggaagaggggatgactgtcattgctcacctgcttgataacccagcagaaaggaactgcgagaagtcagtgagccaactggtggaatttcctaggacagcatcctgcagcagcagggctgtgttgctgcctttgcaaggagagactgcagtggagaaaggaaatattcagcgtgggtttcggagctgtgctttgcctaggacagactaccccactgataaaggaaatcaagaacaattttcagagggctggagtgtggaggaaggaaccaagagtgtttcaggtgcccctcagacagcttcctggattatagaatgttctgtttcttcattactactggaccagcctggaggccaaagacgcacggagccttcccatgtgggtcaagtgcccccccaggattccagactgcctacttctcagagtgatttgtccatcagtggtgtgactgtgagcattttgccctcctcctctggctatggcagtgatgggccacacatacatgggatccagcctaaagatacagaacctgaaaagagctctacttccttctcagaagaggatggcactctttctctggagatctctgacatctacattagtggagaatcaggggatatgtcagccaaggagaaactactcctgtggacccagaaggtgacagctggttacacaggaatcaaatgcaccaacttttcctcctgctggagtgatgggaagatgttcaatgcactcattcaccgataccgacccgatctagtagacatggagagggtgcaaatccaaagtaaccgagagaatctggaacaggcttttgaagtggcagaaagactgggggtcactcgcctgctggatgcagaagatgtggatgtgccatctccagatgaaaagtctgtaatcacttatgtgtcttcgatttatgatgccttccctaaagttcctgagggtggagaagggatcagtgctacggaagtggactccaggtggcaagaataccaaagccgagtggactccctcattccctggatcaaacagcatacaatactgatgtcagataaaacttttccccaaaaccctgttgaactaaaggcactttataaccaatatatacacttcaaagaaacagaaattctggccaaggagagagaaaaaggaagaattgaggaattatataaattactagaggtgtggattgaatttggccgaattaaactgcctcaaggttatcaccctaatgatgtggaagaagagtggggaaagctcatcatagagatgctggaacgagagaaatcacttcggccggctgtggagaggctggaattgctgctacagattgcaaacaaaatccagaatggtgctttgaactgtgaagaaaaactgacactagctaagaatacactgcaggctgatgctgctcacctggaatcaggacaaccggtacaatgtgagtcagatgtcattatgtacattcaggagtgtgaaggtctcatcaggcagctgcaggtggatctccagatcctgcgggatgagaattactaccagctagaagagctggcttttagggtcatgcgtcttcaggatgagctggtcaccttgcgtctagagtgtacaaacctgtaccggaagggtcatttcacttcacttgaattggttccaccctctactttaaccaccactcatctgaaagcagaacccttaaccaaggcaacccattcttcttctacctcctggttccgaaagcctatgactcgggctgaacttgtggccatcagctcctctgaagatgaaggcaatctccgatttgtgtatgaactactgtcttgggtagaagagatgcagatgaaactggagcgagcagagtggggcaatgacctgcctagtgtggagttgcagctagaaacacagcagcacatccatacgagtgtagaagagctgggctcaagtgtcaaggaggccaggttgtatgagggaaagatgtcccagaatttccataccagctatgctgaaactcttggaaagctggagacacagtattgtaaattgaaggaaacttctagcttccggatgaggcaccttcagagcctgcataaatttgtttccagagctacagctgagttgatctggttgaatgagaaggaggaggaggaactagcatatgactggagtgacaacaattccaatatctcagccaagagaaattacttctctgagttgacaatggaactggaggagaaacaggatgtgtttcgttctctacaagatacagcagaactactttcacttgagaaccacccagccaagcagacagtggaggcttacagtgctgctgtccagtcccagttgcagtggatgaagcagctgtgcctgtgtgttgagcagcatgtgaaagagaatactgcttattttcagttcttcagtgatgcacgagagctggagtcattcttgaggaacctccaagattccattaaacgaaaatattcctgtgaccacaacaccagcttatcccgccttgaagacctgctccaggactccatggatgaaaaggagcagcttatacagtccaagagttccgttgccagtctcgttgggagatcaaaaaccatcgttcagctaaaaccacgcagtccagaccatgtgttaaagaacaccatttctgtcaaggctgtctgtgactacaggcagatcgagattactatttgcaaaaatgatgaatgtgtgctagaagataattctcagcggaccaaatggaaagtgatcagccccacagggaacgaggcaatggtgccgtcagtctgcttcctcatccccccacccaataaggatgccattgagatggccagcagggtcgaacaatcttatcagaaggttatggccctttggcatcagctgcatgttaacaccaaaagccttatctcttggaactatctgcgtaaagaccttgaccttgtacagacctggaacctagaaaagcttcgatcctcagcaccaggggagtgccatcagattatgaagaaccttcaggcccactatgaagactttctgcaggatagtcgtgactctgtgctgttctcagtggctgatcgcttgcgcttggaagaggaggtggaagcttgtaaagcccgcttccagcacctgatgaagtccatggagaatgaggacaaagaggagactgtggccaagatgtacatttcagagttgaagaacatccggctacgcctggaggagtatgaacagagggtggtcaaacgaattcagtctctagccagctctaggactgacagagatgcctggcaggacaatgcattaaggattgcagagcaagagcacacccaggaggatttacagcaattgaggtcagacttggatgcagtttctatgaaatgtgacagctttctccatcagtctccatctagttcaagtgtcccaactctgcgctcagaactgaatctgctggtggagaagatggaccatgtctatggtctctctactgtatatctgaataagttaaagacagttgatgttatagtacgtagcatacaggatgctgaactcttggtcaaaggttatgagattaagctgagtcaagaagaagtagtactggcagatctctcagctctggaggcccattggtcgacattacggcactggcttagtgatgtgaaggacaagaattcagtgttttcagtcctggatgaggaaattgccaaggccaaggtagtggcagagcagatgagtcgtctgacaccagagcgaaatctggatttggagcgctatcaggaaaaaggctcccagctgcaggagcgttggcaccgagtcattgcccagctcgagattcgccaatctgagctagaaagtatccaggaagttctgggagattaccgagcctgccatggaactctcatcaagtggattgaggaaaccactgcccagcaggaaatgatgaagccaggccaggcagaggatagcagagtgctttcggagcagctcagccagcagacggccctatttgcagaaattgagagaaatcagacaaaactggatcaatgtcaaaaattttcccagcagtactctactattgtaaaggactatgaattgcaactgatgacatacaaggcctttgtggaatcgcagcagaaatcccctggcaagcgccgtcgcatgctttcctcttcagatgccatcactcaagagttcatggacttaaggactcgctacacggcattggtgactttaacaactcagcacgtgaaatacatcagtgatgcactccggcgtctggaggaggaggagaaagtggtagaagaggagaaacaagaacatgtggagaaggttaaagaacttttgggctgggtgtctaccctagcgaggaatacacaaggaaaagctacctcatccgagaccaaagaatcaacagacattgaaaaagctattttggaacagcaggttctgtcagaagagctgacaacaaagaaagaacaagtctctgaagctattaaaacatcacagatcttcttggccaagcatggtcataagctctcagaaaaagagaagaaacaaatatctgagcaattgaatgccctaaacaaggcttaccatgacctttgtgatggttctgcaaatcagcttcagcagcttcagagccagttggctcaccagacagaacaaaagaccctgcagaaacaacaaaatacctgtcaccagcaactggaggatctttgcagttgggtaggacaggcagaaagagcactggcaggccaccaaggcagaaccacccagcaggatctctctgctttgcagaagaaccaaagtgacttgaaggatttacaggatgacattcagaatcgtgccacctcatttgccactgttgtcaaggacattgaggggttcatggaagagaatcagaccaagctgagcccacgtgagttgacagctcttcgggaaaagcttcatcaggctaaggagcaatatgaggcgctccaggaagagacacgtgtggcccagaaggaactggaggaagcagtgacctccgccttacagcaggagactgaaaagagtaaagcagcaaaggaactggcagagaacaagaagaagatcgatgctctcctggattgggtaacttcagtaggatcatctggtggacagctgctgaccaaccttccaggaatggagcagctctcgggagctagcttggagaaaggagccttggacaccactgatggttacatgggggtgaatcaagccccagagaaactggacaagcaatgtgagatgatgaaggcccgtcaccaagaattgctgtcccagcagcaaaatttcattctggccacccagtcagctcaggccttcttggatcagcatggccacaatctcacacctgaggagcaacagatgctgcaacagaagctgggagagctaaaggaacaatactctacttccctggcccaatcagaggcagaactgaagcaggtgcagacacttcaggatgagttgcagaaatttctgcaggatcataaagagtttgaaagctggttggaacgatccgagaaagagctggagaacatgcataagggaggcagcagccccgagacccttccctccctgctaaagcggcaaggaagcttctcagaggatgtcatttcccacaaaggagacttgagatttgtgactatctcaggaca

SEQ ID NO: 153910 - DNA, 24828 bp, Homo sapiens
  Payload ID: 10253
  Gene Symbol: MACF1
  Gene Name: microtubule-actin crosslinking factor 1
  ENST ID: ENST00000564288
  CDS Start-End: 778-23445
gggattacagccatgaaccactgcgcccagccagacggatttttttaacccttgagaagtaccccctaaatgagcagtttgctctcctcgctgatcttcatcacacctagatgtcaggtctgcttcatgggagcttgctctgtatgtatcctccctggactgatgttcaggctccttgcttctcctcccgggttgtgggtatggagggtttgccctctgacaactccagggtacttgtggtgctcatacatcctcatgtactttgctttctccccgcaagaggttccctaatgcttctgtgacttttttcttctggctacatcctgaagtctggccttgcaggcaggctgggaatggaaagttaagagtgtgacgtcctctgacaccctcccttcttgtagaagggtctgaggtttgtttatttaagctgagcagaggatgccaaagatagaggtttgagtcagcttgacactggcttaggcgctccttttcactctccttgttccttcttccctttcccctcccccgctggccagttgtttcctgggctttgtctgagatacactgtacagttttagtcccagtctactagcgcctgctgaaaaacagtcagaagtgagatggaggagaagctgccaggaagtttctgacaacactaagctccggcctctgcctctgctgatagtacaggacaacagtaacctcaggagaaaggcatccagaggcctgcgctgagcttgtggctaactcaagggaggagaaaggacgggcctggaaatgcccctcttagattcatcttatttaccaccaaccatctttattttgactcacgttcttggagttgctggtgttctatactggaagaggcatgccagaggtagagcagatgaacgggaccgggttcagaagaaaacgttcaccaagtgggtcaacaagcacttaatgaaggtccgcaagcacatcaatgatctttatgaagatctgcgggatggccataacctgatctctctgttggaggtcctctcaggcatcaaactggagccagcagggctgaagaccctccgtctggtgagcatgccctcctggtgccatacaaacaacgaggagcaggcggaggaagatgatgatgatgtaccccgggagaagggcaggatgcgttttcataggctgcagaatgtgcagattgccctggacttcctaaagcagcgacaggtgaaactagtgaatattcgcaatgatgacatcacagatggcaaccccaagttgaccctgggtctgatctggaccattattttgcatttccagatctctgacatctacattagtggagaatcaggggatatgtcagccaaggagaaactactcctgtggacccagaaggtgacagctggttacacaggaatcaaatgcaccaacttttcctcctgctggagtgatgggaagatgttcaatgcactcattcaccgataccgacccgatctagtagacatggagagggtgcaaatccaaagtaaccgagagaatctggaacaggcttttgaagtggcagaaagactgggggtcactcgcctgctggatgcagaagatgtggatgtgccatctccagatgaaaagtctgtaatcacttatgtgtcttcgatttatgatgccttccctaaagttcctgagggtggagaagggatcagtgctacggaagtggactccaggtggcaagaataccaaagccgagtggactccctcattccctggatcaaacagcatacaatactgatgtcagataaaacttttccccaaaaccctgttgaactaaaggcactttataaccaatatatacacttcaaagaaacagaaattctggccaaggagagagaaaaaggaagaattgaggaattatataaattactagaggtgtggattgaatttggccgaattaaactgcctcaaggttatcaccctaatgatgtggaagaagagtggggaaagctcatcatagagatgctggaacgagagaaatcacttcggccggctgtggagaggctggaattgctgctacagattgcaaacaaaatccagaatggtgctttgaactgtgaagaaaaactgacactagctaagaatacactgcaggctgatgctgctcacctggaatcaggacaaccggtacaatgtgagtcagatgtcattatgtacattcaggagtgtgaaggtctcatcaggcagctgcaggtggatctccagatcctgcgggatgagaattactaccagctagaagagctggcttttagggtcatgcgtcttcaggatgagctggtcaccttgcgtctagagtgtacaaacctgtaccggaagggtcatttcacttcacttgaattggttccaccctctactttaaccaccactcatctgaaagcagaacccttaaccaaggcaacccattcttcttctacctcctggttccgaaagcctatgactcgggctgaacttgtggccatcagctcctctgaagatgaaggcaatctccgatttgtgtatgaactactgtcttgggtagaagagatgcagatgaaactggagcgagcagagtggggcaatgacctgcctagtgtggagttgcagctagaaacacagcagcacatccatacgagtgtagaagagctgggctcaagtgtcaaggaggccaggttgtatgagggaaagatgtcccagaatttccataccagctatgctgaaactcttggaaagctggagacacagtattgtaaattgaaggaaacttctagcttccggatgaggcaccttcagagcctgcataaatttgtttccagagctacagctgagttgatctggttgaatgagaaggaggaggaggaactagcatatgactggagtgacaacaattccaatatctcagccaagagaaattacttctctgagttgacaatggaactggaggagaaacaggatgtgtttcgttctctacaagatacagcagaactactttcacttgagaaccacccagccaagcagacagtggaggcttacagtgctgctgtccagtcccagttgcagtggatgaagcagctgtgcctgtgtgttgagcagcatgtgaaagagaatactgcttattttcagttcttcagtgatgcacgagagctggagtcattcttgaggaacctccaagattccattaaacgaaaatattcctgtgaccacaacaccagcttatcccgccttgaagacctgctccaggactccatggatgaaaaggagcagcttatacagtccaagagttccgttgccagtctcgttgggagatcaaaaaccatcgttcagctaaaaccacgcagtccagaccatgtgttaaagaacaccatttctgtcaaggctgtctgtgactacaggcagatcgagattactatttgcaaaaatgatgaatgtgtgctagaagataattctcagcggaccaaatggaaagtgatcagccccacagggaacgaggcaatggtgccgtcagtctgcttcctcatccccccacccaataaggatgccattgagatggccagcagggtcgaacaatcttatcagaaggttatggccctttggcatcagctgcatgttaacaccaaaagccttatctcttggaactatctgcgtaaagaccttgaccttgtacagacctggaacctagaaaagcttcgatcctcagcaccaggggagtgccatcagattatgaagaaccttcaggcccactatgaagactttctgcaggatagtcgtgactctgtgctgttctcagtggctgatcgcttgcgcttggaagaggaggtggaagcttgtaaagcccgcttccagcacctgatgaagtccatggagaatgaggacaaagaggagactgtggccaagatgtacatttcagagttgaagaacatccggctacgcctggaggagtatgaacagagggtggtcaaacgaattcagtctctagccagctctaggactgacagagatgcctggcaggacaatgcattaaggattgcagagcaagagcacacccaggaggatttacagcaattgaggtcagacttggatgcagtttctatgaaatgtgacagctttctccatcagtctccatctagttcaagtgtcccaactctgcgctcagaactgaatctgctggtggagaagatggaccatgtctatggtctctctactgtatatctgaataagttaaagacagttgatgttatagtacgtagcatacaggatgctgaactcttggtcaaaggttatgagattaagctgagtcaagaagaagtagtactggcagatctctcagctctggaggcccattggtcgacattacggcactggcttagtgatgtgaaggacaagaattcagtgttttcagtcctggatgaggaaattgccaaggccaaggtagtggcagagcagatgagtcgtctgacaccagagcgaaatctggatttggagcgctatcaggaaaaaggctcccagctgcaggagcgttggcaccgagtcattgcccagctcgagattcgccaatctgagctagaaagtatccaggaagttctgggagattaccgagcctgccatggaactctcatcaagtggattgaggaaaccactgcccagcaggaaatgatgaagccaggccaggcagaggatagcagagtgctttcggagcagctcagccagcagacggccctatttgcagaaattgagagaaatcagacaaaactggatcaatgtcaaaaattttcccagcagtactctactattgtaaaggactatgaattgcaactgatgacatacaaggcctttgtggaatcgcagcagaaatcccctggcaagcgccgtcgcatgctttcctcttcagatgccatcactcaagagttcatggacttaaggactcgctacacggcattggtgactttaacaactcagcacgtgaaatacatcagtgatgcactccggcgtctggaggaggaggagaaagtggtagaagaggagaaacaagaacatgtggagaaggttaaagaacttttgggctgggtgtctaccctagcgaggaatacacaaggaaaagctacctcatccgagaccaaagaatcaacagacattgaaaaagctattttggaacagcaggttctgtcagaagagctgacaacaaagaaagaacaagtctctgaagctattaaaacatcacagatcttcttggccaagcatggtcataagctctcagaaaaagagaagaaacaaatatctgagcaattgaatgccctaaacaaggcttaccatgacctttgtgatggttctgcaaatcagcttcagcagcttcagagccagttggctcaccagacagaacaaaaggaatgcagagcagttgctggggtgattgacctaggcacagtggagatatttcccatcttcaaagccatgcaaaagggcctccttgaccaagacacaggcctagtgcttctggaatctcaggttatcatgtctggcctcattgcccctgagacgggtgaaaacctctctttggaggagggcatagccagaaacctcattaatccccagatgtaccagcagctccgggagctacaggatgccctggccttaataagcaggcttactgagagcagaggccctctttctgtggtggaagcaattgaaaagagaataatcagtgagacagttggactgaaaatcttagaagctcacctggcaactggaggtttcagtctttcccctagtgagaactgtattaacctggaagaggcttttcatcaaggcctcatttctgcatggcttcattcagtattagagtcttatcttagaacatccaagaatttgatagaccctaacacagctgagaaaattggtttgctggatctgatgcagcgatgtattgtccaccaggaatcaggattcaaattactgcctgtcaaacaattggcaggggggatggtgagcttgaaatcaggccggaaggttagcattttccgtgcagttcaggaagggctaatagataggcaggtcactgtccggttgctggaagctcagctttttgctggtggcatagtagatccaagaacaggacacagacttacagtggaagaggctgtaagacataatctgattgaccaagatatggcctgtgctatcctcataaggcagcttcagacaggaggcatcatagacactgtcacggggcaaaggctaacaatagatgaagcagtgagcaatgatctagtagctgctaagatcgcccttgtgattctggagtccctctggtcattcatggggttgctgtggcctgaatctggagagatcctcccaattacagatgccctagaacaaggtattgtgtctactgaactagcacataaaatccttagtaaccgacagcatattaaggctctgtttctaccagcaaccacagagattttgtcctggaagaaagcaatagaaagtggtatcctggatagagatcttgccaataacttaaaatcgatttgtatacctgatgtgatgccccacatgcaactagcagactctgcagaacaaaatattaatcctggagcagcagttctaccgtgcagcaagagccaccctaaggccacagcaagccagagtgagaatctgttgttccagctgatgactcacagctatattaatgtgcaaaatggacagaggctgcttctgttagataaagagctgatggagacactaacatccagagatgagtatcaaacaagtcctccaaaagtggttgaaattgggcatcaaaggcaaaaaactcctgagggattgcaagaatcagctaatgtgaaaatctcaggaactttcagcagtgggtggactgtgaggctgcctgagttccagttttcttctcagaacaaagaatatcccgatcgggaagattgcactacagaaaaaggcaaaaagaccactgtagaaacagaagattcttctgtagagaaccctgaacaggatctgtttgtagaacaaaaagagagaaatccaaacattgatgctttgaaggtaataaataaagtcaaattagaggtacaaaggcagttgataggtacccaaagggaagaccaaacagcagtgtctgtcagagaaaatgccagcaggggacacctcctgaccatacctcctgctgaggcggaaggtgtgccgttggtggttgacaaagatgttttttctgttgaaacaccaaagaaagaacatcaacctctaagaaacacttcctttacatgtcagaatgaacaagcacacactcttgagactgaatatattcatgatgaaactggaggatctcacataaaaccccaaagcaaaaagttacaagttcaggtaaagaaaactctaggtataaagttagaactaaagtctgaaactgatgggaatgttcatcctctggacaaaaaggaaatgttaaagaaaacatttctggctaaggatgaccataaagaaagtcaagaagcacagaacatcgcaggtggtagtatgatgatgtcagaaaagaccgatgaggaagatagtggcagggaaatttttctgtcatgcagtcatccattagaattgcttgaagaagctaccttaaatgtattatctgcacagttactagatggtggtatctttcatgaacaaacaggtcaaaagctcttactaaatgaagcaatatcccgaggcattgtgccaagtcacactgccgtgaagcttatggagaagctgaacatgtttcaggggttctttgactctcagacttgtgagtctttgacaactgaagaagtcattaatgaaggtctgatggatgagaaattattacataatgtcctcatggcagacaaagctataagtggtgtcttagacccccgtacccagacactgtgctctgtaaaggatgcagttacagttggacttcttgacaaggaaacagccaccagaattttagagaggcaggtggtgactggtggaattattgatctgaaacgaggcaaaaaagtttcagtaactttggcctcaactcttggcttggtggacgttgctgaccagccagaacttataaatctggagaaagcttccaaaggtagagatgctgaaaaaacagttagggagagattaattagtttacaaatggaaacaacaggacttatagaccctgatagtaaagcacctttaacagttgtgcagtccattgacagaggtcttttggagagagaggaggccgttcgtttgttgactaagcaagtggtagatggaggtatcattcaccatatatctgggatgagactttctgttgataatgccttcagacatggcttaattggtgaagatttagccgagaaactcaaaagagttgagaacttaaacatccatcagatttttaatcctgaaacgaaggaaaatatttccctccctaaagccataaaattagatcttattacctcagacctgaaaagagaaatccaggaggttcaggcctttactggaaactttgtggatctcatttctggtcagagattgaccttggcagaagctaaaaaagaaggactgttaactaatgaagcagtattgtctccaggaatgatgcatggcattgtagatcccgagaactgcagaattgtcccctactcagaattagtcaagaaatgtaagattgatattgaatctggacagagatatctagaagtaattcccttctcagacattaaagatggggtgagcgacaaagtgcttacattgtctcaagcaattcagcttggaaaagtagactttgcatctacgctgaaggttctagaagcccaggcaaatactggtggaatcatagatactgctactggaaaaagactgacattggcatcagctttggaagagaaactggtggatgaaaacatggtcagaattattgcatctcatcaggtgttaaatggaggaattgttgacatatttagtgatcagagagtgactttagtagaagctattgagaaaagactgatcagccctgaactggcaaatatgatccaaatagatagttcagagttcagcgatcacagggctcagattgaaaagcaagaagggattgaagtgtgtgcattacaaaatgaatttctaggaaaggatatgttaattgcttgtaatcagactgctgaaatgagttgtaataaagtagaagagagtgagagattatttcaagttgaaaatcagtctgcacaagaaaaggttaaagtgagagtttctgatggggagcaggcaaaaaagagcagggaaatttccttaaaggaatttgggtgcaaggatcaacgtaagccaagaatgtcttcagatgctaaagaatttatcagtatcataaatcctcataatcttaaaggtaaatccttgggccaagtgtcattgacacacccttactctgaatgtgattttaaacttaaagaagtggctagaaataacatgggaaatgatacaaatgaagagcaggaaaaagcagtgacaaaaatagaaattatttctcatatgaagcagtctacctcatgtctagattctgaagaaataagagaaaatcaaggggaagtgattttggaagtacaagaaacatattgtgaaacgtcaggcaaattgccgagtgagcaggttttgcagcaaccaatgaatgctcgggtgaaaagtaagagagagaagagggaggtgattgtagaagaaagtatcagaacatgcaaaccagcatttctttctgaagaaaagttgtatcaggaaactgccattagagatgagcatgactcccatataaagagccaacctagggaaatgacctcaagtgaaaaagggaaagaagctgatacagaaatgggattttctattacttttaaaattgaagagtcctcttcccaagtggtacctcaaggaatttctgtaaaacatttagatgctttaacactcttcagctctaaacaggccaatgaaggaaaagtaaacaatttaagtctctgcttgactttaaaaccagaagaaaacttatctcgagaaattgcctgtggggcccagagtgaaccattcccttgtatgaccccaagacctgaaggattgcactaccaggaatcagatggaaaagcccaagtgacaggcccatcccaaatttccaaaacagacaagtctttccaaggaaccaccagacaggagaccaactatcaagattcctgggttacttcgaaaactaaggaaaccaaacatcaaatttcctcatctaatgaatgtaaagaaaagtcataccaagaagtatcttttgacccagcaagaggtcttaaattggaagaaatcacagtttctagaccagattcaaaagaagtcaggtatctagaattctcagacagaaaagaccttcatcatcagggcagcaaaagtgatgataaactttgtggaactctcaaatctgaaatagcaacacaggaactaactggagagaaatttctagaaatggcaaaccctaatgttgcaggtctagaagcaggatccattgaggacatagtgactcagagaggttccagagtcttgggatcctttcttccagagaaactgttcaaaggagtgtctcaaaaagagaatacagggcaacagaatgccatcattagtcctactgttctagagaccagtgaagaaaagacagtgtccctaacagtatgctctgcagtgaagacagagaagacaccacaggaaaagctcagagaaagccctggcagtgaacaaactcccttcatgactgcacctgaaggaaagggaaatggaggtgtaaacccagagcccttcagagcaactcagaatgtatttacccggcaactctgtttagaacatgatgaaaagctagtatcctatctgtctctgttacggaacattgaaatgaggaccaaacagattcaacctttggagctaaacctggcagaactacaggatctgctgtgtcaggccaaggtattagaaagggagttaaaggatctgaccaccttggtcagtcaggagctggagtgtgtgaatcagattatcatcagccagcctcaagaagttcctgctcaactgttgaaggctctagagaaagatgccaagaatcttcagaagtctctcagctctgtgagtgacacttggaattccaggctactccacttccagaatgctgtggaaatagaaaagactaaagtgttaaatcagcacacacagctagaaggccgacttcaagatctgagagcctgggttggcaataaaaatcttattctgaacagcaagggatctaacagtgaaatagatgttgacagcctgaacctctgcctccaacagtatgaggatttgaaacagcccatggctgaaaggaaagctcagctggatgctcttgcttttgatattcagttctttatctcagaacatgcccaggacttgtcccctcagcagaatcgacagatgctgaggcttctgaatgaactgcagaggtccttccaggacattttggaacagactgccgctcaggtggatgccttgcagggccatcttcaacaaatggagcaggaagccctggtgaagaccctgcagaaacaacaaaatacctgtcaccagcaactggaggatctttgcagttgggtaggacaggcagaaagagcactggcaggccaccaaggcagaaccacccagcaggatctctctgctttgcagaagaaccaaagtgacttgaaggatttacaggatgacattcagaatcgtgccacctcatttgccactgttgtcaaggacattgaggggttcatggaagagaatcagaccaagctgagcccacgtgagttgacagctcttcgggaaaagcttcatcaggctaaggagcaatatgaggcgctccaggaagagacacgtgtggcccagaaggaactggaggaagcagtgacctccgccttacagcaggagactgaaaagagtaaagcagcaaaggaactggcagagaacaagaagaagatcgatgctctcctggattgggtaacttcagtaggatcatctggtggacagctgctgaccaaccttccaggaatggagcagctctcgggagctagcttggagaaaggagccttggacaccactgatggttacatgggggtgaatcaagccccagagaaactggacaagcaatgtgagatgatgaaggcccgtcaccaagaattgctgtcccagcagcaaaatttcattctggccacccagtcagctcaggccttcttggatcagcatggccacaatctcacacctgaggagcaacagatgctgcaacagaagctgggagagctaaaggaacaatactctacttccctggcccaatcagaggcagaactgaagcaggtgcagacacttcaggatgagttgcagaaatttctgcaggatcataaagagtttgaaagctggttggaacgatccgagaaagagctggagaacatgcataagggaggcagcagccccgagacccttccctccctgctaaagcggcaaggaagcttctcagaggatgtcatttcccacaaaggagacttgagatttgtgactatctcaggacagaaagtcttggacatggaaaacagttttaaggaaggcaaagaaccatcagaaattggaaacttagtaaaggacaagttgaaggatgcaacagaaagatacactgctctccactcaaagtgtacacgattaggatctcacctgaatatgctgttaggccagtatcatcaattccaaaacagtgctgacagcctgcaggcctggatgcaggcttgtgaggccaacgtggagaagctcctctcagatactgttgcctctgaccctggagttctccaggagcagcttgcaacaacaaagcagttgcaggaggaattggctgagcaccaagtacctgtggaaaaactccaaaaagtagctcgtgacataatggaaattgaaggggagccagccccagaccacaggcatgttcaagaaactacagattccatactcagccacttccaaagcctctcctatagcctggctgagcgatcttctctgctgcagaaagcaattgcccaatctcagagtgtccaggaaagcctggagagcctgttgcagtctattggggaagttgaacaaaacctggaagggaagcaggtgtcatcactctcatcaggagtcatccaggaagccttagccacaaatatgaaattgaagcaggacattgctcggcaaaagagcagcttggaggccacccgtgagatggtgacccgattcatggagacagcagacagtactacagcagcagtgctgcagggcaaactggcagaggtgagccagcggttcgaacagctctgtctacagcagcaagaaaaggagagctccctaaagaagcttctaccccaggcagagatgtttgaacacctctctggtaagctgcagcagttcatggaaaacaaaagtcggatgctggcctctggaaatcagccagatcaagatattacacatttcttccaacagatccaggagctcaatttggaaatggaagaccaacaggagaacctagatactcttgagcacctggtcactgaactgagctcttgtggctttgcgctggacttgtgccagcatcaggacagggtacagaatctaagaaaagacttcacagagctacagaagacagttaaagagagagagaaagatgcatcatcttgccaggaacagttggatgaattccggaagctggtcaggaccttccagaaatggttgaaagaaactgaagggagtattccacctacggaaacttctatgagtgctaaagagttagaaaagcagattgaacacctgaagagtctactagatgactgggcaagtaagggaactctggtggaagaaatcaattgcaaaggtacttctttagaaaatctcatcatggaaatcacagcacctgattcccaaggcaagacaggttccatactgccctctgtaggaagctctgtaggcagtgtaaacggataccacacctgcaaagatctgacggagatccagtgtgacatgtcagatgtaaacttgaagtatgagaaactagggggagtacttcatgaacgccaggaaagccttcaggctatcctcaacagaatggaggaggttcacaaggaggcaaactctgtgctgcagtggctggaatcaaaagaggaagtcctgaaatccatggatgccatgtcatctccaaccaagacagaaacagtgaaagcccaagctgaatctaacaaggccttcctggctgagttggaacagaattctccaaaaattcaaaaagtaaaggaagccctggctggattactggtgacatatcccaactcacaggaagcagaaaattggaagaaaattcaggaagaactcaattcccgatgggaaagggccactgaggttactgtggctcggcaaaggcagctagaggaatctgcaagtcatctggcctgcttccaggctgcagaatcccagctccggccgtggctgatggagaaagaactgatgatgggagtgctggggcccctgtctattgaccccaacatgttgaatgcacaaaagcaacaggtccagtttatgctaaaggaatttgaagcacgcaggcaacagcatgagcaactgaatgaggcagctcagggcatcctaacaggccctggagatgtctctctgtccaccagccaagtacagaaagaactccagagcatcaatcagaaatgggttgagctgactgacaaactcaactcccgttccagccaaattgaccaagctattgttaagagcacccagtaccaggaactgctccaggacttatcagagaaggtgagggcagttggacaacggctgagtgtccagtcagctatcagcacccaaccagaggctgtaaagcagcaattggaagagaccagtgaaattcgatctgacttggagcagttagaccacgaggttaaggaggctcagacactgtgcgatgaactctcagtgctcattggtgagcagtacctcaaggatgaactgaagaagcgtttggagacagttgccctgcctctccaaggtttagaagaccttgcagccgatcgcattaacagactccaggcagctcttgccagcacccagcagttccagcaaatgtttgatgagttgaggacctggttggatgataaacaaagccagcaagcaaaaaactgcccaatttctgcaaaattggagcggctacagtctcagctacaggagaatgaagagtttcagaaaagtcttaatcaacacagtggctcctatgaggtgattgtggctgaaggggaatctctacttctttctgtacctcctggagaagagaaaaggactctacaaaaccagttggttgagctcaaaaaccattgggaagagcttagtaaaaaaactgcagacagacaatccaggctcaaggattgtatgcagaaagctcagaaatatcagtggcatgtggaagaccttgtgccatggatagaagattgtaaagctaagatgtctgagttgcgagtcactctggatccagtgcagctagagtccagtctcctaagatcaaaggctatgctgaatgaggtggagaagcgccgctccctgctggaaatattgaatagtgctgctgacattctgatcaattcttcagaagcagatgaggatggaatccgggatgagaaggctgggatcaaccagaacatggatgctgttacagaagagctgcaggccaaaacagggtcactcgaagaaatgactcagaggctcagggagttccaggaaagctttaagaatattgaaaagaaggttgaaggagccaaacaccaacttgagatctttgatgctctgggttctcaagcctgtagcaacaagaacctggagaagctaagagctcaacaggaagtgctgcaggccctagagcctcaggtagactatctgaggaactttactcagggtctggtagaagatgccccagatggatctgatgcttctcaacttctccaccaagctgaggtcgcccagcaagagttcctcgaagttaagcaaagagtgaacagtggttgtgtgatgatggaaaacaagctggaggggattggccagtttcactgccgggtccgagagatgttctctcaattggcagacctggatgatgagctagatggcatgggtgctattggcagagacactgatagcctccagtcccaaatcgaggatgtccggctattccttaacaaaattcacgtcctcaaattagacatagaggcctctgaagcagagtgtcgacatatgctagaagaagaggggactctggatttgttaggtctcaaaagggagctagaagccctgaacaaacagtgtggcaaactgacagagagggggaaagctcgtcaggaacagctggaactgacactaggccgtgtagaggacttctacaggaaattgaaaggactcaatgacgcgaccacagcagcagaggaggcagaggccctccagtgggtagtggggaccgaagtggaaatcatcaaccaacaattagcagattttaaaatgtttcagaaagaacaagtggatcctcttcagatgaaattgcagcaggtgaatggacttggccagggattaattcagagtgcaggaaaagactgtgatgtacagggtttagaacatgacatggaagagatcaatgctcgatggaatacattgaataaaaaggtcgcacaaagaattgcacagctacaggaagctttgttgcattgtgggaagtttcaagatgccttggagccattgctcagctggttggcagataccgaggagctcatagccaatcagaaacctccatctgctgagtataaagtggtgaaagcacagatccaagaacagaagttgctccagcggctcctagatgatcgaaaggccacagtagacatgcttcaagcagaaggaggcagaatagcccagtcagcagagctggctgatagagagaaaatcactggacagctggagagtcttgaaagtagatggactgaactactcagtaaggcagcagccaggcaaaaacagctggaagacatcctggttctggccaaacagttccatgagacagctgagcctatttctgacttcttatctgtcacagagaaaaagcttgctaactcagaacctgttggcactcagactgccaaaatacagcagcagatcattcggcacaaggctctggaagaagacatagaaaaccatgcaacagatgtgcaccaggcagtcaaaattgggcagtccctctcctccctgacatctcctgcagaacagggtgtgctgtcagaaaagatagactcattgcaggcccgatacagtgaaattcaagaccgctgttgtcggaaggcagccctacttgaccaagctctgtctaatgctaggctgtttggggaggatgaggtggaggtgctcaactggctggctgaggttgaggacaagctcagttcagtgttcgtaaaggatttcaaacaggatgtcctgcacaggcagcatgctgaccacctggctttaaatgaagaaattgttaatagaaagaagaatgtagatcaagctattaaaaatggtcaggctcttctaaaacaaaccacaggtgaggaggtgttacttatccaggaaaaactagatggtataaagactcgttacgcagacatcacagttactagctccaaggccctcagaactttagagcaagcccggcagctggccaccaagttccagtctacttatgaggaactgaccgggtggctgagggaggtggaggaggagctggcaaccagtggaggacagtctcccacaggggaacagataccccagtttcagcagagacagaaggaattaaagaaggaggtcatggagcacaggctggtgttggacacagtgaatgaggtgagccgtgctctcttagagctggtgccctggagagccagagaagggctggataaacttgtgtccgatgctaacgagcagtacaaactagtcagtgacactattggacaaagggtggatgaaattgatgctgctattcagagatcacaacagtatgagcaagctgccgatgcagaactagcttgggttgctgaaacaaaacggaaactgatggctctgggtccaattcgcctggaacaggaccagaccacagctcagcttcaggtacagaaggctttctccattgacattattcgacacaaagattcaatggatgaactcttcagtcaccgtagtgaaatctttggcacatgtggggaggagcaaaaaactgtattacaggaaaagacagagtctctaatacagcaatatgaagccattagcctactcaattcagagcgttatgcccgcctagagcgggcccaggtcttagtaaaccagttttgggaaacttatgaagagctcagcccctggattgaggaaactcgggcactaatagcacagttaccctctccagccattgatcatgagcagctcaggcagcaacaagaggaaatgaggcaattaagggaatctattgctgaacacaaacctcatattgacaaactactaaagataggcccacaactaaaggaattaaaccctgaggaaggggaaatggtggaagaaaaataccagaaagcagaaaacatgtatgcccaaataaaggaggaggtgcgccagcgagccctggctctggatgaagccgtgtcccagtccacacagtttcatgataaaattgagcctatgttggagacactggagaatctttcctctcgcctgcgtatgccaccactgatccctgctgaagtagacaagatcagagagtgcatcagtgacaataagagtgccaccgtggagctagaaaaactgcagccatcctttgaggccttgaagcgccgtggagaggagcttattggacgatctcagggagcagacaaggatctggctgcaaaagaaatccaggataaattggatcaaatggtattcttctgggaggacatcaaagctcgggctgaagaacgagaaatcaaatttcttgatgtccttgaattagcagagaagttctggtatgacatggcagctctcctgaccaccatcaaagacacccaggatattgtccatgacttggaaagcccaggcattgatccttccatcatcaaacaacaggttgaagctgctgagactattaaggaagagacagatggtctgcatgaagagctggagtttattcggatccttggagcagatttgatttttgcctgtggagaaactgagaagcctgaagtgaggaagagcattgatgagatgaataatgcttgggagaacttaaacaaaacatggaaagagaggctagaaaaacttgaggatgctatgcaagctgctgtgcagtatcaggacactcttcaggctatgtttgactggctagataacactgtgattaaactctgcaccatgccccctgttggcactgacctcaatactgttaaagatcagttaaatgaaatgaaggagttcaaagtagaagtttaccaacagcaaattgagatggagaagcttaatcaccagggtgaactgatgttaaagaaagctactgatgagacggacagagacattatacgagaaccactgacagaactcaaacacctctgggagaacctgggtgagaaaattgcccaccgacagcacaaactagaaggggctctgttggcccttggtcagttccagcatgccttagaggaactaatgagttggctgactcataccgaagagttgttagatgctcagagaccaataagtggagacccaaaagtcattgaagttgagctcgcaaagcaccatgtcctaaaaaatgatgttttggctcatcaagccacagtggaaacagtcaacaaagctggcaatgagcttcttgaatccagtgctggagatgatgccagcagcttaaggagccgtttggaagccatgaaccaatgctgggagtcagtgttacagaaaacagaggagagggagcagcagcttcagtcaactctgcagcaggcccagggcttccacagtgaaattgaagatttcctcttggaacttactagaatggagagccagctttctgcatctaagcccacaggaggacttcctgaaactgctagggaacagcttgatacacatatggaactctattcccagctgaaagccaaggaagagacttataatcaactacttgacaagggcagactcatgcttctaagccgtgacgactctgggtctggctccaagacagaacagagtgtagcacttttggagcagaagtggcatgtggtcagcagtaagatggaagaaagaaagtcaaagctggaagaggccctcaacttggcaacagaattccagaattccctacaagaatttatcaactggctcactctagcagagcagagtttaaacatcgcttctccaccaagcctgattctaaatactgtcctttcccagatagaagagcacaaggtttttgctaatgaagtaaatgctcatcgagaccagatcattgagctggatcaaactgggaatcaattaaagttccttagccaaaagcaggatgttgttctgatcaagaatttgttggtgagcgtgcagtctcgatgggagaaggttgtccagcgatctattgaaagagggcgatcactagatgatgccaggaagcgggcaaaacaattccatgaagcttggaaaaaactgattgactggctagaagatgcagagagtcacctggactcagaactagagatatccaatgacccagacaaaattaaacttcagctttctaagcataaggagtttcagaagactcttggtggcaagcagcctgtgtatgataccacaattagaactggcagagcactgaaagaaaagactttgcttcccgaagatagtcagaaacttgacaatttcctaggagaagtcagagacaaatgggatactgtttgtggcaagtctgtggagcggcagcacaagttggaggaagccctgctcttttcgggtcagttcatggatgctttgcaggcattggttgactggttatacaaggtggagccacagctggctgaggaccagcccgtgcacggggaccttgacctcgtcatgaacctcatggatgcacacaaggttttccagaaggaactgggaaagcgaacaggaaccgttcaggtcctgaagcggtcaggccgagagctgattgagaatagtcgagatgacaccacttgggtaaaaggacagctccaggaactgagcactcgctgggacactgtctgtaaactctctgtttccaaacaaagccggcttgagcaggccttaaaacaagcggaagtgtttcgagacacagtccacatgctgttggagtggctttctgaagcagagcaaacgcttcgctttcggggagcacttcctgatgacacagaggccctgcagtctctcattgacacccataaggaattcatgaagaaagtagaagaaaagcgagtggacgttaactcagcagtagccatgggagaagtcatcctggctgtctgccaccccgattgcatcacaaccatcaaacactggatcaccatcatccgagctcgcttcgaggaggtcctgacatgggctaagcagcaccagcagcgtcttgaaacggccttgtcagaactggtggctaatgctgagctcctggaagaacttctggcatggatccagtgggctgagaccaccctcattcagcgggatcaggagccaatcccgcagaacattgaccgagttaaagcccttatcgctgagcatcagacatttatggaggagatgactcgcaaacagcctgacgtggaccgggtcaccaagacatacaaaaggaaaaacatagagcctactcacgcgcctttcatagagaaatcccgcagcggaggcaggaaatccctaagtcagccaacccctcctcccatgccaatcctttcacagtctgaagcaaaaaacccacggatcaaccagctttctgcccgctggcagcaggtgtggctgttagcactggagcggcaaaggaaactgaatgatgccttggatcggctggaggagttgaaagaatttgccaactttgactttgatgtctggaggaaaaagtatatgcgttggatgaatcacaaaaagtctcgagtgatggatttcttccggcgcattgataaggaccaggatgggaagataacacgtcaggagtttatcgatggcattttagcatccaagttccccaccaccaagttagagatgactgctgtggctgacattttcgaccgagatggggatggttacattgattattatgaatttgtggctgctcttcatcccaacaaggatgcgtatcgaccaacaaccgatgcagataaaatcgaagatgaggttacaagacaagtggctcagtgcaaatgtgcaaaaaggtttcaggtggagcagatcggagagaataaataccggttcttcctcggcaatcagtttggggattctcagcagttgcggctggtccgtattctgcgcagcaccgtgatggttcgcgttggtggaggatggatggccttggatgaatttttagtgaaaaatgatccctgccgagttcaccatcctgggagtaaaataaagcgctctgattccagctcttcgatttccagtcagtctcccatagcacgaggtagaactaacattgaacttagagagaaattcatcctaccagagggagcatcccagggaatgacccccttccgctcacggggtcgaaggtccaaaccatcttcccgggcagcttcccctactcgttccagctccagtgctagtcagagtaaccacagctgtacatccatgccatcttctccagccaccccagccagtggaaccaagacttcacttcagttctctcgctgttatgacaaaccctggttggtaaacagtaaagctggcacccctatcagggacagccattctcctgacctccagctgcccacccccgaggttatcccatcatcaggtagcaagttgaaacgaccaacaccaacttttcattctagtcggacatcccttgctggtgataccagcaatagttcttccccggcctccacaggtgccaaaactaatcgggcagaccctaaaaagtctgccagtcgccctgggagtcgggctgggagtcgagccgggagtcgagccagcagccggcgaggaagtgacgcttctgactttgacctcttagagacgcagtctgcttgttccgacacttcagaaagcagcgctgcagggggccaaggcaactccaggagagggctaaacaaaccttccaaaatcccaaccatgtctaagaagaccaccactgcctcccccaggactccaggtcccaagcgataacactgtctaagcacccccaagccactatccactttgaatcctgctccatacattgggtgtatatttattctgaacgggagaagttatattgttaaaagtgtaaaagaataattgtgttatgaagctgccttattttttttctttttgtaagttactattttcatgtgaatatttatgtagataaaatttgcctcctggtaaccctgtaatggatggggcccagaaatgaaatatttgagaaaaacaagtgaaaaggtcaagatacaaatgtgtattaaaaaaaaaaaagcctattaatagggtttctgcgcggtgcagggttgtaaacctgctttatcttttaggattattcctaaatgcatcttctttataaacttgacttgctatctcagcaagataaattatattaaaaaaataagaatcctgcagtgtttaaggaactctttttttgtaaatcacggacacctcaattagcaagaactgaggggagggctttttccattgtttaatgttttgtgatttttagctaaagagagggaacctcatctaagtaacatttgcacatgatacagcaaaaggagttcattgcaatactgtctttggatattgtttcagtactgggtgtttaaaggacaaatagctgctagaattcaggggtaaatgtaagtgttcagaaaacgtcagaacatttggggttttaaactgatttgttgctccctatccagcctagacaccagtaactcttgtgttcaccaggacccagacccttggcaagggataggctcgttggtgacattgtgaatttcagatttgttttatccactttttttgctatttatttaaatggtcgatcaacttcccacaaactgaggaatgaattccacgagcctgttctgaaaatgtggacgtaagacaaacacgtgctcgtcctttaatggagttcaccagcacacttgttaaccagtcctgtttgctttcgtctttttttgtgcgtaataaagtcaactgaccaagtgaccatgaaaaggggctgtctggggctcctgttttttagctgctgttcttcagctccgaccatgttgctgtgtgattatctcaattggttttaattgaggcagaaactgaagctctaccaatgaactgtttagaaacaagacacacttttgtattaaaattgcttgcagtaacaaatattttgtatttcctgattttcttttcaactattaccttatctataaatgttaccctggggtataatcatgttgtaggtacttaaatgcattccgcaaatcaaaatatcttgatggataaattatagagcttaatagatcttgttttatttcatccttgttaattttgtttaatatggctgggcatggtggc

SEQ ID NO: 153911 - DNA, 24319 bp, Homo sapiens
  Payload ID: 10253
  Gene Symbol: MACF1
  Gene Name: microtubule-actin crosslinking factor 1
  ENST ID: ENST00000567887
  CDS Start-End: 158-22936
gaaactgaggtacagataggcaggactagaacctctgcttcccaagtcccagtgttccttatgggaccccttttgtctgctcacattcacccctttctccttcagatcacttctccctgggctcccaggccctcctgcagcagcccccgcctgggccatgtcttcctcagatgaagagacgctcagtgagcggtcatgtcggagtgagcggtcttgtcggagtgagcgatcttacaggagcgagcggtcggggagcctgtctccctgtcccccaggggacaccttgccctggaacctgccactgcatgagcagaaaaagcggaaaagccaggattcggtgctggaccctgcagagcgtgctgtggtcagagtcgctgatgaacgggaccgggttcagaagaaaacgttcaccaagtgggtcaacaagcacttaatgaaggtccgcaagcacatcaatgatctttatgaagatctgcgggatggccataacctgatctctctgttggaggtcctctcaggcatcaaactggagccagcagggctgaagaccctccgtctggtgagcatgccctcctggtgccatacaaacaacgaggagcaggcggaggaagatgatgatgatgtaccccgggagaagggcaggatgcgttttcataggctgcagaatgtgcagattgccctggacttcctaaagcagcgacaggtgaaactagtgaatattcgcaatgatgacatcacagatggcaaccccaagttgaccctgggtctgatctggaccattattttgcatttccagatctctgacatctacattagtggagaatcaggggatatgtcagccaaggagaaactactcctgtggacccagaaggtgacagctggttacacaggaatcaaatgcaccaacttttcctcctgctggagtgatgggaagatgttcaatgcactcattcaccgataccgacccgatctagtagacatggagagggtgcaaatccaaagtaaccgagagaatctggaacaggcttttgaagtggcagaaagactgggggtcactcgcctgctggatgcagaagatgtggatgtgccatctccagatgaaaagtctgtaatcacttatgtgtcttcgatttatgatgccttccctaaagttcctgagggtggagaagggatcagtgctacggaagtggactccaggtggcaagaataccaaagccgagtggactccctcattccctggatcaaacagcatacaatactgatgtcagataaaacttttccccaaaaccctgttgaactaaaggcactttataaccaatatatacacttcaaagaaacagaaattctggccaaggagagagaaaaaggaagaattgaggaattatataaattactagaggtgtggattgaatttggccgaattaaactgcctcaaggttatcaccctaatgatgtggaagaagagtggggaaagctcatcatagagatgctggaacgagagaaatcacttcggccggctgtggagaggctggaattgctgctacagattgcaaacaaaatccagaatggtgctttgaactgtgaagaaaaactgacactagctaagaatacactgcaggctgatgctgctcacctggaatcaggacaaccggtacaatgtgagtcagatgtcattatgtacattcaggagtgtgaaggtctcatcaggcagctgcaggtggatctccagatcctgcgggatgagaattactaccagctagaagagctggcttttagggtcatgcgtcttcaggatgagctggtcaccttgcgtctagagtgtacaaacctgtaccggaagggtcatttcacttcacttgaattggttccaccctctactttaaccaccactcatctgaaagcagaacccttaaccaaggcaacccattcttcttctacctcctggttccgaaagcctatgactcgggctgaacttgtggccatcagctcctctgaagatgaaggcaatctccgatttgtgtatgaactactgtcttgggtagaagagatgcagatgaaactggagcgagcagagtggggcaatgacctgcctagtgtggagttgcagctagaaacacagcagcacatccatacgagtgtagaagagctgggctcaagtgtcaaggaggccaggttgtatgagggaaagatgtcccagaatttccataccagctatgctgaaactcttggaaagctggagacacagtattgtaaattgaaggaaacttctagcttccggatgaggcaccttcagagcctgcataaatttgtttccagagctacagctgagttgatctggttgaatgagaaggaggaggaggaactagcatatgactggagtgacaacaattccaatatctcagccaagagaaattacttctctgagttgacaatggaactggaggagaaacaggatgtgtttcgttctctacaagatacagcagaactactttcacttgagaaccacccagccaagcagacagtggaggcttacagtgctgctgtccagtcccagttgcagtggatgaagcagctgtgcctgtgtgttgagcagcatgtgaaagagaatactgcttattttcagttcttcagtgatgcacgagagctggagtcattcttgaggaacctccaagattccattaaacgaaaatattcctgtgaccacaacaccagcttatcccgccttgaagacctgctccaggactccatggatgaaaaggagcagcttatacagtccaagagttccgttgccagtctcgttgggagatcaaaaaccatcgttcagctaaaaccacgcagtccagaccatgtgttaaagaacaccatttctgtcaaggctgtctgtgactacaggcagatcgagattactatttgcaaaaatgatgaatgtgtgctagaagataattctcagcggaccaaatggaaagtgatcagccccacagggaacgaggcaatggtgccgtcagtctgcttcctcatccccccacccaataaggatgccattgagatggccagcagggtcgaacaatcttatcagaaggttatggccctttggcatcagctgcatgttaacaccaaaagccttatctcttggaactatctgcgtaaagaccttgaccttgtacagacctggaacctagaaaagcttcgatcctcagcaccaggggagtgccatcagattatgaagaaccttcaggcccactatgaagactttctgcaggatagtcgtgactctgtgctgttctcagtggctgatcgcttgcgcttggaagaggaggtggaagcttgtaaagcccgcttccagcacctgatgaagtccatggagaatgaggacaaagaggagactgtggccaagatgtacatttcagagttgaagaacatccggctacgcctggaggagtatgaacagagggtggtcaaacgaattcagtctctagccagctctaggactgacagagatgcctggcaggacaatgcattaaggattgcagagcaagagcacacccaggaggatttacagcaattgaggtcagacttggatgcagtttctatgaaatgtgacagctttctccatcagtctccatctagttcaagtgtcccaactctgcgctcagaactgaatctgctggtggagaagatggaccatgtctatggtctctctactgtatatctgaataagttaaagacagttgatgttatagtacgtagcatacaggatgctgaactcttggtcaaaggttatgagattaagctgagtcaagaagaagtagtactggcagatctctcagctctggaggcccattggtcgacattacggcactggcttagtgatgtgaaggacaagaattcagtgttttcagtcctggatgaggaaattgccaaggccaaggtagtggcagagcagatgagtcgtctgacaccagagcgaaatctggatttggagcgctatcaggaaaaaggctcccagctgcaggagcgttggcaccgagtcattgcccagctcgagattcgccaatctgagctagaaagtatccaggaagttctgggagattaccgagcctgccatggaactctcatcaagtggattgaggaaaccactgcccagcaggaaatgatgaagccaggccaggcagaggatagcagagtgctttcggagcagctcagccagcagacggccctatttgcagaaattgagagaaatcagacaaaactggatcaatgtcaaaaattttcccagcagtactctactattgtaaaggactatgaattgcaactgatgacatacaaggcctttgtggaatcgcagcagaaatcccctggcaagcgccgtcgcatgctttcctcttcagatgccatcactcaagagttcatggacttaaggactcgctacacggcattggtgactttaacaactcagcacgtgaaatacatcagtgatgcactccggcgtctggaggaggaggagaaagtggtagaagaggagaaacaagaacatgtggagaaggttaaagaacttttgggctgggtgtctaccctagcgaggaatacacaaggaaaagctacctcatccgagaccaaagaatcaacagacattgaaaaagctattttggaacagcaggttctgtcagaagagctgacaacaaagaaagaacaagtctctgaagctattaaaacatcacagatcttcttggccaagcatggtcataagctctcagaaaaagagaagaaacaaatatctgagcaattgaatgccctaaacaaggcttaccatgacctttgtgatggttctgcaaatcagcttcagcagcttcagagccagttggctcaccagacagaacaaaaggaatgcagagcagttgctggggtgattgacctaggcacagtggagatatttcccatcttcaaagccatgcaaaagggcctccttgaccaagacacaggcctagtgcttctggaatctcaggttatcatgtctggcctcattgcccctgagacgggtgaaaacctctctttggaggagggcatagccagaaacctcattaatccccagatgtaccagcagctccgggagctacaggatgccctggccttaataagcaggcttactgagagcagaggccctctttctgtggtggaagcaattgaaaagagaataatcagtgagacagttggactgaaaatcttagaagctcacctggcaactggaggtttcagtctttcccctagtgagaactgtattaacctggaagaggcttttcatcaaggcctcatttctgcatggcttcattcagtattagagtcttatcttagaacatccaagaatttgatagaccctaacacagctgagaaaattggtttgctggatctgatgcagcgatgtattgtccaccaggaatcaggattcaaattactgcctgtcaaacaattggcaggggggatggtgagcttgaaatcaggccggaaggttagcattttccgtgcagttcaggaagggctaatagataggcaggtcactgtccggttgctggaagctcagctttttgctggtggcatagtagatccaagaacaggacacagacttacagtggaagaggctgtaagacataatctgattgaccaagatatggcctgtgctatcctcataaggcagcttcagacaggaggcatcatagacactgtcacggggcaaaggctaacaatagatgaagcagtgagcaatgatctagtagctgctaagatcgcccttgtgattctggagtccctctggtcattcatggggttgctgtggcctgaatctggagagatcctcccaattacagatgccctagaacaaggtattgtgtctactgaactagcacataaaatccttagtaaccgacagcatattaaggctctgtttctaccagcaaccacagagattttgtcctggaagaaagcaatagaaagtggtatcctggatagagatcttgccaataacttaaaatcgatttgtatacctgatgtgatgccccacatgcaactagcagactctgcagaacaaaatattaatcctggagcagcagttctaccgtgcagcaagagccaccctaaggccacagcaagccagagtgagaatctgttgttccagctgatgactcacagctatattaatgtgcaaaatggacagaggctgcttctgttagataaagagctgatggagacactaacatccagagatgagtatcaaacaagtcctccaaaagtggttgaaattgggcatcaaaggcaaaaaactcctgagggattgcaagaatcagctaatgtgaaaatctcaggaactttcagcagtgggtggactgtgaggctgcctgagttccagttttcttctcagaacaaagaatatcccgatcgggaagattgcactacagaaaaaggcaaaaagaccactgtagaaacagaagattcttctgtagagaaccctgaacaggatctgtttgtagaacaaaaagagagaaatccaaacattgatgctttgaaggtaataaataaagtcaaattagaggtacaaaggcagttgataggtacccaaagggaagaccaaacagcagtgtctgtcagagaaaatgccagcaggggacacctcctgaccatacctcctgctgaggcggaaggtgtgccgttggtggttgacaaagatgttttttctgttgaaacaccaaagaaagaacatcaacctctaagaaacacttcctttacatgtcagaatgaacaagcacacactcttgagactgaatatattcatgatgaaactggaggatctcacataaaaccccaaagcaaaaagttacaagttcaggtaaagaaaactctaggtataaagttagaactaaagtctgaaactgatgggaatgttcatcctctggacaaaaaggaaatgttaaagaaaacatttctggctaaggatgaccataaagaaagtcaagaagcacagaacatcgcaggtggtagtatgatgatgtcagaaaagaccgatgaggaagatagtggcagggaaatttttctgtcatgcagtcatccattagaattgcttgaagaagctaccttaaatgtattatctgcacagttactagatggtggtatctttcatgaacaaacaggtcaaaagctcttactaaatgaagcaatatcccgaggcattgtgccaagtcacactgccgtgaagcttatggagaagctgaacatgtttcaggggttctttgactctcagacttgtgagtctttgacaactgaagaagtcattaatgaaggtctgatggatgagaaattattacataatgtcctcatggcagacaaagctataagtggtgtcttagacccccgtacccagacactgtgctctgtaaaggatgcagttacagttggacttcttgacaaggaaacagccaccagaattttagagaggcaggtggtgactggtggaattattgatctgaaacgaggcaaaaaagtttcagtaactttggcctcaactcttggcttggtggacgttgctgaccagccagaacttataaatctggagaaagcttccaaaggtagagatgctgaaaaaacagttagggagagattaattagtttacaaatggaaacaacaggacttatagaccctgatagtaaagcacctttaacagttgtgcagtccattgacagaggtcttttggagagagaggaggccgttcgtttgttgactaagcaagtggtagatggaggtatcattcaccatatatctgggatgagactttctgttgataatgccttcagacatggcttaattggtgaagatttagccgagaaactcaaaagagttgagaacttaaacatccatcagatttttaatcctgaaacgaaggaaaatatttccctccctaaagccataaaattagatcttattacctcagacctgaaaagagaaatccaggaggttcaggcctttactggaaactttgtggatctcatttctggtcagagattgaccttggcagaagctaaaaaagaaggactgttaactaatgaagcagtattgtctccaggaatgatgcatggcattgtagatcccgagaactgcagaattgtcccctactcagaattagtcaagaaatgtaagattgatattgaatctggacagagatatctagaagtaattcccttctcagacattaaagatggggtgagcgacaaagtgcttacattgtctcaagcaattcagcttggaaaagtagactttgcatctacgctgaaggttctagaagcccaggcaaatactggtggaatcatagatactgctactggaaaaagactgacattggcatcagctttggaagagaaactggtggatgaaaacatggtcagaattattgcatctcatcaggtgttaaatggaggaattgttgacatatttagtgatcagagagtgactttagtagaagctattgagaaaagactgatcagccctgaactggcaaatatgatccaaatagatagttcagagttcagcgatcacagggctcagattgaaaagcaagaagggattgaagtgtgtgcattacaaaatgaatttctaggaaaggatatgttaattgcttgtaatcagactgctgaaatgagttgtaataaagtagaagagagtgagagattatttcaagttgaaaatcagtctgcacaagaaaaggttaaagtgagagtttctgatggggagcaggcaaaaaagagcagggaaatttccttaaaggaatttgggtgcaaggatcaacgtaagccaagaatgtcttcagatgctaaagaatttatcagtatcataaatcctcataatcttaaaggtaaatccttgggccaagtgtcattgacacacccttactctgaatgtgattttaaacttaaagaagtggctagaaataacatgggaaatgatacaaatgaagagcaggaaaaagcagtgacaaaaatagaaattatttctcatatgaagcagtctacctcatgtctagattctgaagaaataagagaaaatcaaggggaagtgattttggaagtacaagaaacatattgtgaaacgtcaggcaaattgccgagtgagcaggttttgcagcaaccaatgaatgctcgggtgaaaagtaagagagagaagagggaggtgattgtagaagaaagtatcagaacatgcaaaccagcatttctttctgaagaaaagttgtatcaggaaactgccattagagatgagcatgactcccatataaagagccaacctagggaaatgacctcaagtgaaaaagggaaagaagctgatacagaaatgggattttctattacttttaaaattgaagagtcctcttcccaagtggtacctcaaggaatttctgtaaaacatttagatgctttaacactcttcagctctaaacaggccaatgaaggaaaagtaaacaatttaagtctctgcttgactttaaaaccagaagaaaacttatctcgagaaattgcctgtggggcccagagtgaaccattcccttgtatgaccccaagacctgaaggattgcactaccaggaatcagatggaaaagcccaagtgacaggcccatcccaaatttccaaaacagacaagtctttccaaggaaccaccagacaggagaccaactatcaagattcctgggttacttcgaaaactaaggaaaccaaacatcaaatttcctcatctaatgaatgtaaagaaaagtcataccaagaagtatcttttgacccagcaagaggtcttaaattggaagaaatcacagtttctagaccagattcaaaagaagtcaggtatctagaattctcagacagaaaagaccttcatcatcagggcagcaaaagtgatgataaactttgtggaactctcaaatctgaaatagcaacacaggaactaactggagagaaatttctagaaatggcaaaccctaatgttgcaggtctagaagcaggatccattgaggacatagtgactcagagaggttccagagtcttgggatcctttcttccagagaaactgttcaaaggagtgtctcaaaaagagaatacagggcaacagaatgccatcattagtcctactgttctagagaccagtgaagaaaagacagtgtccctaacagtatgctctgcagtgaagacagagaagacaccacaggaaaagctcagagaaagccctggcagtgaacaaactcccttcatgactgcacctgaaggaaagggaaatggaggtgtaaacccagagcccttcagagcaactcagaatgtatttacccggcaactctgtttagaacatgatgaaaagctagtatcctatctgtctctgttacggaacattgaaatgaggaccaaacagattcaacctttggagctaaacctggcagaactacaggatctgctgtgtcaggccaaggtattagaaagggagttaaaggatctgaccaccttggtcagtcaggagctggagtgtgtgaatcagattatcatcagccagcctcaagaagttcctgctcaactgttgaaggctctagagaaagatgccaagaatcttcagaagtctctcagctctgtgagtgacacttggaattccaggctactccacttccagaatgctgtggaaatagaaaagactaaagtgttaaatcagcacacacagctagaaggccgacttcaagatctgagagcctgggttggcaataaaaatcttattctgaacagcaagggatctaacagtgaaatagatgttgacagcctgaacctctgcctccaacagtatgaggatttgaaacagcccatggctgaaaggaaagctcagctggatgctcttgcttttgatattcagttctttatctcagaacatgcccaggacttgtcccctcagcagaatcgacagatgctgaggcttctgaatgaactgcagaggtccttccaggacattttggaacagactgccgctcaggtggatgccttgcagggccatcttcaacaaatggagcaggaagccctggtgaagaccctgcagaaacaacaaaatacctgtcaccagcaactggaggatctttgcagttgggtaggacaggcagaaagagcactggcaggccaccaaggcagaaccacccagcaggatctctctgctttgcagaagaaccaaagtgacttgaaggatttacaggatgacattcagaatcgtgccacctcatttgccactgttgtcaaggacattgaggggttcatggaagagaatcagaccaagctgagcccacgtgagttgacagctcttcgggaaaagcttcatcaggctaaggagcaatatgaggcgctccaggaagagacacgtgtggcccagaaggaactggaggaagcagtgacctccgccttacagcaggagactgaaaagagtaaagcagcaaaggaactggcagagaacaagaagaagatcgatgctctcctggattgggtaacttcagtaggatcatctggtggacagctgctgaccaaccttccaggaatggagcagctctcgggagctagcttggagaaaggagccttggacaccactgatggttacatgggggtgaatcaagccccagagaaactggacaagcaatgtgagatgatgaaggcccgtcaccaagaattgctgtcccagcagcaaaatttcattctggccacccagtcagctcaggccttcttggatcagcatggccacaatctcacacctgaggagcaacagatgctgcaacagaagctgggagagctaaaggaacaatactctacttccctggcccaatcagaggcagaactgaagcaggtgcagacacttcaggatgagttgcagaaatttctgcaggatcataaagagtttgaaagctggttggaacgatccgagaaagagctggagaacatgcataagggaggcagcagccccgagacccttccctccctgctaaagcggcaaggaagcttctcagaggatgtcatttcccacaaaggagacttgagatttgtgactatctcaggacagaaagtcttggacatggaaaacagttttaaggaaggcaaagaaccatcagaaattggaaacttagtaaaggacaagttgaaggatgcaacagaaagatacactgctctccactcaaagtgtacacgattaggatctcacctgaatatgctgttaggccagtatcatcaattccaaaacagtgctgacagcctgcaggcctggatgcaggcttgtgaggccaacgtggagaagctcctctcagatactgttgcctctgaccctggagttctccaggagcagcttgcaacaacaaagcagttgcaggaggaattggctgagcaccaagtacctgtggaaaaactccaaaaagtagctcgtgacataatggaaattgaaggggagccagccccagaccacaggcatgttcaagaaactacagattccatactcagccacttccaaagcctctcctatagcctggctgagcgatcttctctgctgcagaaagcaattgcccaatctcagagtgtccaggaaagcctggagagcctgttgcagtctattggggaagttgaacaaaacctggaagggaagcaggtgtcatcactctcatcaggagtcatccaggaagccttagccacaaatatgaaattgaagcaggacattgctcggcaaaagagcagcttggaggccacccgtgagatggtgacccgattcatggagacagcagacagtactacagcagcagtgctgcagggcaaactggcagaggtgagccagcggttcgaacagctctgtctacagcagcaagaaaaggagagctccctaaagaagcttctaccccaggcagagatgtttgaacacctctctggtaagctgcagcagttcatggaaaacaaaagtcggatgctggcctctggaaatcagccagatcaagatattacacatttcttccaacagatccaggagctcaatttggaaatggaagaccaacaggagaacctagatactcttgagcacctggtcactgaactgagctcttgtggctttgcgctggacttgtgccagcatcaggacagggtacagaatctaagaaaagacttcacagagctacagaagacagttaaagagagagagaaagatgcatcatcttgccaggaacagttggatgaattccggaagctggtcaggaccttccagaaatggttgaaagaaactgaagggagtattccacctacggaaacttctatgagtgctaaagagttagaaaagcagattgaacacctgaagagtctactagatgactgggcaagtaagggaactctggtggaagaaatcaattgcaaaggtacttctttagaaaatctcatcatggaaatcacagcacctgattcccaaggcaagacaggttccatactgccctctgtaggaagctctgtaggcagtgtaaacggataccacacctgcaaagatctgacggagatccagtgtgacatgtcagatgtaaacttgaagtatgagaaactagggggagtacttcatgaacgccaggaaagccttcaggctatcctcaacagaatggaggaggttcacaaggaggcaaactctgtgctgcagtggctggaatcaaaagaggaagtcctgaaatccatggatgccatgtcatctccaaccaagacagaaacagtgaaagcccaagctgaatctaacaaggccttcctggctgagttggaacagaattctccaaaaattcaaaaagtaaaggaagccctggctggattactggtgacatatcccaactcacaggaagcagaaaattggaagaaaattcaggaagaactcaattcccgatgggaaagggccactgaggttactgtggctcggcaaaggcagctagaggaatctgcaagtcatctggcctgcttccaggctgcagaatcccagctccggccgtggctgatggagaaagaactgatgatgggagtgctggggcccctgtctattgaccccaacatgttgaatgcacaaaagcaacaggtccagtttatgctaaaggaatttgaagcacgcaggcaacagcatgagcaactgaatgaggcagctcagggcatcctaacaggccctggagatgtctctctgtccaccagccaagtacagaaagaactccagagcatcaatcagaaatgggttgagctgactgacaaactcaactcccgttccagccaaattgaccaagctattgttaagagcacccagtaccaggaactgctccaggacttatcagagaaggtgagggcagttggacaacggctgagtgtccagtcagctatcagcacccaaccagaggctgtaaagcagcaattggaagagaccagtgaaattcgatctgacttggagcagttagaccacgaggttaaggaggctcagacactgtgcgatgaactctcagtgctcattggtgagcagtacctcaaggatgaactgaagaagcgtttggagacagttgccctgcctctccaaggtttagaagaccttgcagccgatcgcattaacagactccaggcagctcttgccagcacccagcagttccagcaaatgtttgatgagttgaggacctggttggatgataaacaaagccagcaagcaaaaaactgcccaatttctgcaaaattggagcggctacagtctcagctacaggagaatgaagagtttcagaaaagtcttaatcaacacagtggctcctatgaggtgattgtggctgaaggggaatctctacttctttctgtacctcctggagaagagaaaaggactctacaaaaccagttggttgagctcaaaaaccattgggaagagcttagtaaaaaaactgcagacagacaatccaggctcaaggattgtatgcagaaagctcagaaatatcagtggcatgtggaagaccttgtgccatggatagaagattgtaaagctaagatgtctgagttgcgagtcactctggatccagtgcagctagagtccagtctcctaagatcaaaggctatgctgaatgaggtggagaagcgccgctccctgctggaaatattgaatagtgctgctgacattctgatcaattcttcagaagcagatgaggatggaatccgggatgagaaggctgggatcaaccagaacatggatgctgttacagaagagctgcaggccaaaacagggtcactcgaagaaatgactcagaggctcagggagttccaggaaagctttaagaatattgaaaagaaggttgaaggagccaaacaccaacttgagatctttgatgctctgggttctcaagcctgtagcaacaagaacctggagaagctaagagctcaacaggaagtgctgcaggccctagagcctcaggtagactatctgaggaactttactcagggtctggtagaagatgccccagatggatctgatgcttctcaacttctccaccaagctgaggtcgcccagcaagagttcctcgaagttaagcaaagagtgaacagtggttgtgtgatgatggaaaacaagctggaggggattggccagtttcactgccgggtccgagagatgttctctcaattggcagacctggatgatgagctagatggcatgggtgctattggcagagacactgatagcctccagtcccaaatcgaggatgtccggctattccttaacaaaattcacgtcctcaaattagacatagaggcctctgaagcagagtgtcgacatatgctagaagaagaggggactctggatttgttaggtctcaaaagggagctagaagccctgaacaaacagtgtggcaaactgacagagagggggaaagctcgtcaggaacagctggaactgacactaggccgtgtagaggacttctacaggaaattgaaaggactcaatgacgcgaccacagcagcagaggaggcagaggccctccagtgggtagtggggaccgaagtggaaatcatcaaccaacaattagcagattttaaaatgtttcagaaagaacaagtggatcctcttcagatgaaattgcagcaggtgaatggacttggccagggattaattcagagtgcaggaaaagactgtgatgtacagggtttagaacatgacatggaagagatcaatgctcgatggaatacattgaataaaaaggtcgcacaaagaattgcacagctacaggaagctttgttgcattgtgggaagtttcaagatgccttggagccattgctcagctggttggcagataccgaggagctcatagccaatcagaaacctccatctgctgagtataaagtggtgaaagcacagatccaagaacagaagttgctccagcggctcctagatgatcgaaaggccacagtagacatgcttcaagcagaaggaggcagaatagcccagtcagcagagctggctgatagagagaaaatcactggacagctggagagtcttgaaagtagatggactgaactactcagtaaggcagcagccaggcaaaaacagctggaagacatcctggttctggccaaacagttccatgagacagctgagcctatttctgacttcttatctgtcacagagaaaaagcttgctaactcagaacctgttggcactcagactgccaaaatacagcagcagatcattcggcacaaggctctggaagaagacatagaaaaccatgcaacagatgtgcaccaggcagtcaaaattgggcagtccctctcctccctgacatctcctgcagaacagggtgtgctgtcagaaaagatagactcattgcaggcccgatacagtgaaattcaagaccgctgttgtcggaaggcagccctacttgaccaagctctgtctaatgctaggctgtttggggaggatgaggtggaggtgctcaactggctggctgaggttgaggacaagctcagttcagtgttcgtaaaggatttcaaacaggatgtcctgcacaggcagcatgctgaccacctggctttaaatgaagaaattgttaatagaaagaagaatgtagatcaagctattaaaaatggtcaggctcttctaaaacaaaccacaggtgaggaggtgttacttatccaggaaaaactagatggtataaagactcgttacgcagacatcacagttactagctccaaggccctcagaactttagagcaagcccggcagctggccaccaagttccagtctacttatgaggaactgaccgggtggctgagggaggtggaggaggagctggcaaccagtggaggacagtctcccacaggggaacagataccccagtttcagcagagacagaaggaattaaagaaggaggtcatggagcacaggctggtgttggacacagtgaatgaggtgagccgtgctctcttagagctggtgccctggagagccagagaagggctggataaacttgtgtccgatgctaacgagcagtacaaactagtcagtgacactattggacaaagggtggatgaaattgatgctgctattcagagatcacaacagtatgagcaagctgccgatgcagaactagcttgggttgctgaaacaaaacggaaactgatggctctgggtccaattcgcctggaacaggaccagaccacagctcagcttcaggtacagaaggctttctccattgacattattcgacacaaagattcaatggatgaactcttcagtcaccgtagtgaaatctttggcacatgtggggaggagcaaaaaactgtattacaggaaaagacagagtctctaatacagcaatatgaagccattagcctactcaattcagagcgttatgcccgcctagagcgggcccaggtcttagtaaaccagttttgggaaacttatgaagagctcagcccctggattgaggaaactcgggcactaatagcacagttaccctctccagccattgatcatgagcagctcaggcagcaacaagaggaaatgaggcaattaagggaatctattgctgaacacaaacctcatattgacaaactactaaagataggcccacaactaaaggaattaaaccctgaggaaggggaaatggtggaagaaaaataccagaaagcagaaaacatgtatgcccaaataaaggaggaggtgcgccagcgagccctggctctggatgaagccgtgtcccagtccacacagtttcatgataaaattgagcctatgttggagacactggagaatctttcctctcgcctgcgtatgccaccactgatccctgctgaagtagacaagatcagagagtgcatcagtgacaataagagtgccaccgtggagctagaaaaactgcagccatcctttgaggccttgaagcgccgtggagaggagcttattggacgatctcagggagcagacaaggatctggctgcaaaagaaatccaggataaattggatcaaatggtattcttctgggaggacatcaaagctcgggctgaagaacgagaaatcaaatttcttgatgtccttgaattagcagagaagttctggtatgacatggcagctctcctgaccaccatcaaagacacccaggatattgtccatgacttggaaagcccaggcattgatccttccatcatcaaacaacaggttgaagctgctgagactattaaggaagagacagatggtctgcatgaagagctggagtttattcggatccttggagcagatttgatttttgcctgtggagaaactgagaagcctgaagtgaggaagagcattgatgagatgaataatgcttgggagaacttaaacaaaacatggaaagagaggctagaaaaacttgaggatgctatgcaagctgctgtgcagtatcaggacactcttcaggctatgtttgactggctagataacactgtgattaaactctgcaccatgccccctgttggcactgacctcaatactgttaaagatcagttaaatgaaatgaaggagttcaaagtagaagtttaccaacagcaaattgagatggagaagcttaatcaccagggtgaactgatgttaaagaaagctactgatgagacggacagagacattatacgagaaccactgacagaactcaaacacctctgggagaacctgggtgagaaaattgcccaccgacagcacaaactagaaggggctctgttggcccttggtcagttccagcatgccttagaggaactaatgagttggctgactcataccgaagagttgttagatgctcagagaccaataagtggagacccaaaagtcattgaagttgagctcgcaaagcaccatgtcctaaaaaatgatgttttggctcatcaagccacagtggaaacagtcaacaaagctggcaatgagcttcttgaatccagtgctggagatgatgccagcagcttaaggagccgtttggaagccatgaaccaatgctgggagtcagtgttacagaaaacagaggagagggagcagcagcttcagtcaactctgcagcaggcccagggcttccacagtgaaattgaagatttcctcttggaacttactagaatggagagccagctttctgcatctaagcccacaggaggacttcctgaaactgctagggaacagcttgatacacatatggaactctattcccagctgaaagccaaggaagagacttataatcaactacttgacaagggcagactcatgcttctaagccgtgacgactctgggtctggctccaagacagaacagagtgtagcacttttggagcagaagtggcatgtggtcagcagtaagatggaagaaagaaagtcaaagctggaagaggccctcaacttggcaacagaattccagaattccctacaagaatttatcaactggctcactctagcagagcagagtttaaacatcgcttctccaccaagcctgattctaaatactgtcctttcccagatagaagagcacaaggtttttgctaatgaagtaaatgctcatcgagaccagatcattgagctggatcaaactgggaatcaattaaagttccttagccaaaagcaggatgttgttctgatcaagaatttgttggtgagcgtgcagtctcgatgggagaaggttgtccagcgatctattgaaagagggcgatcactagatgatgccaggaagcgggcaaaacaattccatgaagcttggaaaaaactgattgactggctagaagatgcagagagtcacctggactcagaactagagatatccaatgacccagacaaaattaaacttcagctttctaagcataaggagtttcagaagactcttggtggcaagcagcctgtgtatgataccacaattagaactggcagagcactgaaagaaaagactttgcttcccgaagatagtcagaaacttgacaatttcctaggagaagtcagagacaaatgggatactgtttgtggcaagtctgtggagcggcagcacaagttggaggaagccctgctcttttcgggtcagttcatggatgctttgcaggcattggttgactggttatacaaggtggagccacagctggctgaggaccagcccgtgcacggggaccttgacctcgtcatgaacctcatggatgcacacaaggttttccagaaggaactgggaaagcgaacaggaaccgttcaggtcctgaagcggtcaggccgagagctgattgagaatagtcgagatgacaccacttgggtaaaaggacagctccaggaactgagcactcgctgggacactgtctgtaaactctctgtttccaaacaaagccggcttgagcaggccttaaaacaagcggaagtgtttcgagacacagtccacatgctgttggagtggctttctgaagcagagcaaacgcttcgctttcggggagcacttcctgatgacacagaggccctgcagtctctcattgacacccataaggaattcatgaagaaagtagaagaaaagcgagtggacgttaactcagcagtagccatgggagaagtcatcctggctgtctgccaccccgattgcatcacaaccatcaaacactggatcaccatcatccgagctcgcttcgaggaggtcctgacatgggctaagcagcaccagcagcgtcttgaaacggccttgtcagaactggtggctaatgctgagctcctggaagaacttctggcatggatccagtgggctgagaccaccctcattcagcgggatcaggagccaatcccgcagaacattgaccgagttaaagcccttatcgctgagcatcagacatttatggaggagatgactcgcaaacagcctgacgtggaccgggtcaccaagacatacaaaaggaaaaacatagagcctactcacgcgcctttcatagagaaatcccgcagcggaggcaggaaatccctaagtcagccaacccctcctcccatgccaatcctttcacagtctgaagcaaaaaacccacggatcaaccagctttctgcccgctggcagcaggtgtggctgttagcactggagcggcaaaggaaactgaatgatgccttggatcggctggaggagttgaaagaatttgccaactttgactttgatgtctggaggaaaaagtatatgcgttggatgaatcacaaaaagtctcgagtgatggatttcttccggcgcattgataaggaccaggatgggaagataacacgtcaggagtttatcgatggcattttagcatccaagttccccaccaccaagttagagatgactgctgtggctgacattttcgaccgagatggggatggttacattgattattatgaatttgtggctgctcttcatcccaacaaggatgcgtatcgaccaacaaccgatgcagataaaatcgaagatgaggttacaagacaagtggctcagtgcaaatgtgcaaaaaggtttcaggtggagcagatcggagagaataaataccggttcttcctcggcaatcagtttggggattctcagcagttgcggctggtccgtattctgcgcagcaccgtgatggttcgcgttggtggaggatggatggccttggatgaatttttagtgaaaaatgatccctgccgagttcaccatcctgggagtaaaataaagcgctctgattccagctcttcgatttccagtcagtctcccatagcacgaggtagaactaacattgaacttagagagaaattcatcctaccagagggagcatcccagggaatgacccccttccgctcacggggtcgaaggtccaaaccatcttcccgggcagcttcccctactcgttccagctccagtgctagtcagagtaaccacagctgtacatccatgccatcttctccagccaccccagccagtggaaccaagacttcacttcagttctctcgctgttatgacaaaccctggttggtaaacagtaaagctggcacccctatcagggacagccattctcctgacctccagctgcccacccccgaggttatcccatcatcaggtagcaagttgaaacgaccaacaccaacttttcattctagtcggacatcccttgctggtgataccagcaatagttcttccccggcctccacaggtgccaaaactaatcgggcagaccctaaaaagtctgccagtcgccctgggagtcgggctgggagtcgagccgggagtcgagccagcagccggcgaggaagtgacgcttctgactttgacctcttagagacgcagtctgcttgttccgacacttcagaaagcagcgctgcagggggccaaggcaactccaggagagggctaaacaaaccttccaaaatcccaaccatgtctaagaagaccaccactgcctcccccaggactccaggtcccaagcgataacactgtctaagcacccccaagccactatccactttgaatcctgctccatacattgggtgtatatttattctgaacgggagaagttatattgttaaaagtgtaaaagaataattgtgttatgaagctgccttattttttttctttttgtaagttactattttcatgtgaatatttatgtagataaaatttgcctcctggtaaccctgtaatggatggggcccagaaatgaaatatttgagaaaaacaagtgaaaaggtcaagatacaaatgtgtattaaaaaaaaaaaagcctattaatagggtttctgcgcggtgcagggttgtaaacctgctttatcttttaggattattcctaaatgcatcttctttataaacttgacttgctatctcagcaagataaattatattaaaaaaataagaatcctgcagtgtttaaggaactctttttttgtaaatcacggacacctcaattagcaagaactgaggggagggctttttccattgtttaatgttttgtgatttttagctaaagagagggaacctcatctaagtaacatttgcacatgatacagcaaaaggagttcattgcaatactgtctttggatattgtttcagtactgggtgtttaaaggacaaatagctgctagaattcaggggtaaatgtaagtgttcagaaaacgtcagaacatttggggttttaaactgatttgttgctccctatccagcctagacaccagtaactcttgtgttcaccaggacccagacccttggcaagggataggctcgttggtgacattgtgaatttcagatttgttttatccactttttttgctatttatttaaatggtcgatcaacttcccacaaactgaggaatgaattccacgagcctgttctgaaaatgtggacgtaagacaaacacgtgctcgtcctttaatggagttcaccagcacacttgttaaccagtcctgtttgctttcgtctttttttgtgcgtaataaagtcaactgaccaagtgaccatgaaaaggggctgtctggggctcctgttttttagctgctgttcttcagctccgaccatgttgctgtgtgattatctcaattggttttaattgaggcagaaactgaagctctaccaatgaactgtttagaaacaagacacacttttgtattaaaattgcttgcagtaacaaatattttgtatttcctgattttcttttcaactattaccttatctataaatgttaccctggggtataatcatgttgtaggtacttaaatgcattccgcaaatcaaaatatcttgatggataaattatagagcttaatagatcttgttttatttcatccttgttaattttgtttaatatggctgggcatggtggc

SEQ ID NO: 153912 - DNA, 1423 bp, Homo sapiens
  Payload ID: 10253
  Gene Symbol: MACF1
  Gene Name: microtubule-actin crosslinking factor 1
  ENST ID: ENST00000602421
  CDS Start-End: 180-545
attgtgggagccgctcccctcggctccgccacgctcccctcgactgcgctccagcctggggcgcgcccggccgccgccgccttcgctgccgccacgggcccgtcttcttcctccttcggctcccaggatcacttctccctgggctcccaggccctcctgcagcagcccccgcctgggccatgtcttcctcagatgaagagacgctcagtgagcggtcatgtcggagtgagcggtcttgtcggagtgagcgatcttacaggagcgagcggtcggggagcctgtctccctgtcccccaggggacaccttgccctggaacctgccactgcatgagcagaaaaagcggaaaagccaggattcggtgctggaccctgcagagcgtgctgtggtcagagtcgctgatgcccttccgagtacatccttctgcttcccccattgcagccttcttagaaatgcagcagcagtctcacccatcaggagcaaaagaaaatcaaagaccaaaaggagaaagcctcagagcttttgcgactgtgtggtctggctataaatttagactgttgcttgaaagaagcgaaaaacctccccttcatagacttccttcttcccatcccccctggcagccgctttgttcctctagccttgtaaaattttctctgtataaaacaggaacatcagccaaacatgtggacttccccactttccattcattagaagaatgcattatttcaaaatctcctgggagcatttaaatgcaaattttgtcaagaaagcaatttgagtcttagagaagctctctagccacaacctaaagcagaagtttcttctttgatttgtgtgtttcttaaaaggaatctcaaccccttgccttctccctgcaacgcccccaggtcttctctgattctcacagcggactcttcccctttttgcccctgttctttcttcacctttggcaagcatcagtcacacatcttgaggaacctgctcacaaagtggcgcgtgtagcagccccaggtgggaatggagggacttttctatgtagtgtaatggacataaggaggcagatgtctgtgtgggggtgagatgtctgtgtggaggtgtttgtatgcgtgatttctgtctgggccttcttaggcctgctggtataaaataatatgggaaatgcagatgactcagcactgacacagtcaagatccccagagttagcatttctatattctctgctgtttacgaaaaatgtgcttgtgccatcaatcagcaactcatcctgcattttccgctaaaagccttttactgaaaaatgcatatacttcaaacttattccccttctttttgtaaactgagctcattagcagctgacaccaaactgagaactagttttgtttgtttgtttgttttagcacggaggattaaactggaaggaaatga

SEQ ID NO: 153913 - DNA, 1574 bp, Homo sapiens
  Payload ID: 10254
  Gene Symbol: MAP1LC3A
  Gene Name: microtubule-associated protein 1 light chain 3 alpha
  Uniprot ID: Q9H492
  ENST ID: ENST00000360668
  CDS Start-End: 762-1127
attccccatcacctgtctctctggtgagctgcttccgatcagcctccaggtccacgatttctcttctgttgtccttttctgccttctcacctcatcctctgagacctgaatttcgatggctctacttttcaattatattattctttttcaaacctgggcgttcatttctagcatcctgttctatcctgtgtctgactgtgcctcccgcaccttctcccttctctcgccctaagccccgtgaaggcgccgggcctttggctccggctgtttcccacggcgcccagaaccgcgtcagtcctgacacagactcggtgagggcgggaagtggtgccgtggggctgcagcctggcccgcccgctccatcggcctagggcggccccaccgccctccgggccttaccttgagttcgggctgcgggagaagctcccgcgctgcccatgacgtcacgggactgtgacgcgcccagaagccccgcccctcgcgtcccggtccgcggacccaggctctctgcgccgtgacgtcacgggtccgggcgggcgggttgtgcgtcggcccaatgggagcggcgcactggcctcccctttaaggaatgttgtgacctgacgtcaccgggcgagttacctcccgcagccgcagccgccgtgctcagcgcgagccccggagcccttgagcgcgaggcgcggagcccccggagcccccaaaccgcagacacatccccgcgccccagagccccggcctgcgcgcccagccgggcccgcgcgatgccctcagaccggcctttcaagcagcggcggagcttcgccgaccgctgtaaggaggtacagcagatccgcgaccagcaccccagcaaaatcccggtgatcatcgagcgctacaagggtgagaagcagctgcccgtcctggacaagaccaagtttttggtcccggaccatgtcaacatgagcgagttggtcaagatcatccggcgccgcctgcagctgaaccccacgcaggccttcttcctgctggtgaaccagcacagcatggtgagtgtgtccacgcccatcgcggacatctacgagcaggagaaagacgaggacggcttcctctatatggtctacgcctcccaggaaaccttcggcttctgagccagcagtaggggggctcggcctgggagtcgggcggccccggtcaggccctgcccagagagctcctggttcctgaactgagctgcctctaccgtggtgggctgggcaggcatgtgcccccctagtcagagggcaccaacccacctactctgcccctgggtggatcctgggccggtcgtgttagggttgtccctctgggtgctggctggtgggatgggggagggtggggagcagctcccagcacccctgctgtgtggttcatcttttttttaggcccctgcctgtctgcccatctgcccctcacccacccgaggctctgcccaccgcctggacctgcccacccctgaaagactggcccctggctccccgcccctcggtctccacgtggtgtatggatctgtggtcattgtccctctgcagaataaagattgctcaggcctgcctggc

SEQ ID NO: 153914 - DNA, 961 bp, Homo sapiens
  Payload ID: 10254
  Gene Symbol: MAP1LC3A
  Gene Name: microtubule-associated protein 1 light chain 3 alpha
  Uniprot ID: Q9H492
  ENST ID: ENST00000374837
  CDS Start-End: 137-514
cagccacctgccactcctgactgcatggaagccaggtgcaaggagaaaggattttgaggaggggactccatggcttccgagttgctgactgaccctccacctcagaggtagttctgacactgtctcagttttgcagatgaagatgagattcttcagttctccatgtggaaaagcagctgtggacccagccgaccgctgtaaggaggtacagcagatccgcgaccagcaccccagcaaaatcccggtgatcatcgagcgctacaagggtgagaagcagctgcccgtcctggacaagaccaagtttttggtcccggaccatgtcaacatgagcgagttggtcaagatcatccggcgccgcctgcagctgaaccccacgcaggccttcttcctgctggtgaaccagcacagcatggtgagtgtgtccacgcccatcgcggacatctacgagcaggagaaagacgaggacggcttcctctatatggtctacgcctcccaggaaaccttcggcttctgagccagcagtaggggggctcggcctgggagtcgggcggccccggtcaggccctgcccagagagctcctggttcctgaactgagctgcctctaccgtggtgggctgggcaggcatgtgcccccctagtcagagggcaccaacccacctactctgcccctgggtggatcctgggccggtcgtgttagggttgtccctctgggtgctggctggtgggatgggggagggtggggagcagctcccagcacccctgctgtgtggttcatcttttttttaggcccctgcctgtctgcccatctgcccctcacccacccgaggctctgcccaccgcctggacctgcccacccctgaaagactggcccctggctccccgcccctcggtctccacgtggtgtatggatctgtggtcattgtccctctgcagaataaagattgctcaggcctgcctggc

SEQ ID NO: 153915 - DNA, 698 bp, Homo sapiens
  Payload ID: 10254
  Gene Symbol: MAP1LC3A
  Gene Name: microtubule-associated protein 1 light chain 3 alpha
  Uniprot ID: Q9H492
  ENST ID: ENST00000397709
  CDS Start-End: 152-517
gggcgagttacctcccgcagccgcagccgccgtgctcagcgcgagccccggagcccttgagcgcgaggcgcggagcccccggagcccccaaaccgcagacacatccccgcgccccagagccccggcctgcgcgcccagccgggcccgcgcgatgccctcagaccggcctttcaagcagcggcggagcttcgccgaccgctgtaaggaggtacagcagatccgcgaccagcaccccagcaaaatcccggtgatcatcgagcgctacaagggtgagaagcagctgcccgtcctggacaagaccaagtttttggtcccggaccatgtcaacatgagcgagttggtcaagatcatccggcgccgcctgcagctgaaccccacgcaggccttcttcctgctggtgaaccagcacagcatggtgagtgtgtccacgcccatcgcggacatctacgagcaggagaaagacgaggacggcttcctctatatggtctacgcctcccaggaaaccttcggcttctgagccagcagcccctgcctgtctgcccatctgcccctcacccacccgaggctctgcccaccgcctggacctgcccacccctgaaagactggcccctggctccccgcccctcggtctccacgtggtgtatggatctgtggtcattgtccctctgcagaataaagattgctcaggcctgcctggc

SEQ ID NO: 153916 - DNA, 2688 bp, Homo sapiens
  Payload ID: 10255
  Gene Symbol: MAP1LC3B
  Gene Name: microtubule-associated protein 1 light chain 3 beta
  Uniprot ID: Q9GZQ8
  ENST ID: ENST00000268607
  CDS Start-End: 629-1006
acgggcgagcggcgaccctgcctcccggagacggcgcggcctgccctgcgcgcctcagccccgggtgccggcgtctcgggcagcaccaccaagtctctctggaggggaaaggatggtcggatttgccccatgtcccttcctctgacccctccctcaagagtgccccgggacaccccgcctgtggctcagcctcccccgccccgcgctgccatctcctcagggccgggcagcaggctcccgagcgcccacagacccggggtgcggcccagcccacaaccgtcacctcaggggcctcaggcgcccagcggtgctgggcggggctggggcacgaccgggagcatgcgcagagcgcgcgtttcgcccatcgcgcacgcgcacacacctgctccgcccccacgctgcgtgccgctgctgggttccgccacgcccgtcatggcggcggccccggccggctctggccccgcccctcggtgacgcgtcgcgagtcacctgaccaggctgcgggctgaggagatacaagggaagtggctatcgccagagtcggattcgccgccgcagcagccgccgcccccgggagccgccgggaccctcgcgtcgtcgccgccgccgccgcccagatccctgcaccatgccgtcggagaagaccttcaagcagcgccgcaccttcgaacaaagagtagaagatgtccgacttattcgagagcagcatccaaccaaaatcccggtgataatagaacgatacaagggtgagaagcagcttcctgttctggataaaacaaagttccttgtacctgaccatgtcaacatgagtgagctcatcaagataattagaaggcgcttacagctcaatgctaatcaggccttcttcctgttggtgaacggacacagcatggtcagcgtctccacaccaatctcagaggtgtatgagagtgagaaagatgaagatggattcctgtacatggtctatgcctcccaggagacgttcgggatgaaattgtcagtgtaaaaccagaaaaaatgcagctcttctagaattgtttaaacccttaccaaggaaaaaaaagggatgttaccaactgagatcgatcagttcatccaatcacagatcatgaaacagtagtgttcccacctaggagtgttaggaagttgtgtttgtgtttcaagcagaaaaactgagctccaagtgagcacattcagctttggaaactatattatttaatgtaggctagcttgttttcaaattttaaaagtttaaaaataaaatactttgcattctaagttgccaataaaatagaccttcaagttattttaatgctcttttctcactaataggaacttgtaattccagcagtaatttaaaggctttcagagagaccctgagtcttctcttcaggttcacaaaacccgccgcctttttgggtagaagttttctactcagctagagagatctccctaagaggatctttaggcctgagttgtgaagcgcaacccccgcaaaacgcatttgccatcacagttggcacaaacgcagggtaaacgggctgtgtgagaaaacggccctgactgtaaactgctgaaggtccctgactcctaagagaaccacacccaaagtcctcactcttgcaggggtagacatttctggtttggtttgttctctagatagttacacacataaagacaccactcaaaaggaaacttgaataatttataattttgatcgagtttcttaaaagaccctggagaaagagtggcatttcttctgtttcaggttttgtctgagttcaaactagtgcctgtgttgttacggaaagcagcagtgtaccagtgtcactctggagtacagcgggagaaacacaaaatagtataactgaaaacattaacattcagacacactcccttctgccttccggcttaaagctgtggatgatccacgtttttgtttttttaatgttaaatgtgtaactcagtattactgaaaaggtacccacattttgaatagtagttatcactcttaggtcagacagccatcagaattctcccacaccaagtgcatgtcagttgtggagaaaacatagcaaaaagagccgtacgctctttacagatactaatgtcaagagttaaacctcctcaggttcaacctgtgataaaagactagtgcttcccagtacttgcatggggttcactatttatagttttcttgggagtatcacaggaaaatcacaattacaccactttagaccctatgtgtagcaggtcacaacttacccttgtgtgtttagatgtgtatgaaatacctgtatacgttagtgaaagctgtttactgtaacggggaaaaccagattctttgcatctgggccctctactgattgttaaaggagttcctgtcacctgctccccccacccccgcatgcgtctgtccacttggctaacttttaatatgtgtatttttacattatgtatattcttaactggactgtctcgtttagactgtatacatcatatctgacattattgtaactaccgtgtgatcagtaagattcctgtaagaaatactgctttttaagaaaaaaaataacatgctgaggggtgacctatatcccatgtgagtggtcactttatttataggatctttaaaacatttttaatgaactaagttgaataaaggcacaattaaaaactgtcatcaaa

SEQ ID NO: 153917 - DNA, 3085 bp, Homo sapiens
  Payload ID: 10255
  Gene Symbol: MAP1LC3B
  Gene Name: microtubule-associated protein 1 light chain 3 beta
  ENST ID: ENST00000564844
  CDS Start-End: 85-291
attcgccgccgcagcagccgccgcccccgggagccgccgggaccctcgcgtcgtcgccgccgccgccgcccagatccctgcaccatgccgtcggagaagaccttcaagcagcgccgcaccttcggtgagtgtcgccgcgagggcggcgggtgcggcggggccggggtccgagctgtggagggcggcagggcctgggacgccgtgaggggtcggggccgagccgggaggccgagcggggccggtggctgccggccggcggggccgagggatgcggggcccggggccccgtgagggacccaggccgggaccgagccgggagggccaggggctggtctgggccggggcggcctgcggacctctcggaggcctgggaggaggcagccggcggagggcgggcgggggccggtgcgctcggggccccgggcctgctgaatcaccccgcgccctccgcggcggggtgcctgccgtaccccggccaccgccgcccccgcaagcgcgctgcgggcgagggtcgcgcttctggggcccaacagcccccggggccgcgctgggccgttcggctctgaagcggggctgcgccgggacccagcgcgtcaccttcagggctggttttcccgtcgagggagcccgcccgggtgcgagtgcctcttacagacctcagtgcctcggtcgagaggaggggaatgtgctgggccccggcctcgccgcgcccgggacggcccacagcggtgttgccagttcctgtctgtagcccaggagctggggtgggagacttctcttgggtttgcgattacgttctcaccttggcaccaggaataccgaatacatcccttttctgccggttcagactggaaacccagcttaggtgtgctggcatttggttaaacgtgcaggtgtcaccatcacaatatttactccacgcagatgatgcgaagtgattatttcccgcttgagcaagagaacgccgcagatccagaacaaagagtagaagatgtccgacttattcgagagcagcatccaaccaaaatcccgggtggaagaattactgtatatagaaaagatgtccgcagcgttcagtaaacacagacactaatgagactcagaggctcatctgtggtcaggtgataatagaacgatacaagggtgagaagcagcttcctgttctggataaaacaaagttccttgtacctgaccatgtcaacatgagtgagctcatcaagataattagaaggcgcttacagctcaatgctaatcaggccttcttcctgttggtgaacggacacagcatggtcagcgtctccacaccaatctcagaggtgtatgagagtgagaaagatgaagatggattcctgtacatggtctatgcctcccaggagacgttcgggatgaaattgtcagtgtaaaaccagaaaaaatgcagctcttctagaattgtttaaacccttaccaaggaaaaaaaagggatgttaccaactgagatcgatcagttcatccaatcacagatcatgaaacagtagtgttcccacctaggagtgttaggaagttgtgtttgtgtttcaagcagaaaaactgagctccaagtgagcacattcagctttggaaactatattatttaatgtaggctagcttgttttcaaattttaaaagtttaaaaataaaatactttgcattctaagttgccaataaaatagaccttcaagttattttaatgctcttttctcactaataggaacttgtaattccagcagtaatttaaaggctttcagagagaccctgagtcttctcttcaggttcacaaaacccgccgcctttttgggtagaagttttctactcagctagagagatctccctaagaggatctttaggcctgagttgtgaagcgcaacccccgcaaaacgcatttgccatcacagttggcacaaacgcagggtaaacgggctgtgtgagaaaacggccctgactgtaaactgctgaaggtccctgactcctaagagaaccacacccaaagtcctcactcttgcaggggtagacatttctggtttggtttgttctctagatagttacacacataaagacaccactcaaaaggaaacttgaataatttataattttgatcgagtttcttaaaagaccctggagaaagagtggcatttcttctgtttcaggttttgtctgagttcaaactagtgcctgtgttgttacggaaagcagcagtgtaccagtgtcactctggagtacagcgggagaaacacaaaatagtataactgaaaacattaacattcagacacactcccttctgccttccggcttaaagctgtggatgatccacgtttttgtttttttaatgttaaatgtgtaactcagtattactgaaaaggtacccacattttgaatagtagttatcactcttaggtcagacagccatcagaattctcccacaccaagtgcatgtcagttgtggagaaaacatagcaaaaagagccgtacgctctttacagatactaatgtcaagagttaaacctcctcaggttcaacctgtgataaaagactagtgcttcccagtacttgcatggggttcactatttatagttttcttgggagtatcacaggaaaatcacaattacaccactttagaccctatgtgtagcaggtcacaacttacccttgtgtgtttagatgtgtatgaaatacctgtatacgttagtgaaagctgtttactgtaacggggaaaaccagattctttgcatctgggccctctactgattgttaaaggagttcctgtcacctgctccccccacccccgcatgcgtctgtccacttggctaacttttaatatgtgtatttttacattatgtatattcttaactggactgtctcgtttagactgtatacatcatatctgacattattgtaactaccgtgtgatcagtaagattcctgtaagaaatactgctttttaagaaaaaaaataacatgctgaggggtgacctatatcccatgtgagtggtcactttatttataggatctttaaaacatttttaatgaactaagttgaataaaggcacaattaaaaactgtcatcaaa

SEQ ID NO: 153918 - DNA, 1259 bp, Homo sapiens
  Payload ID: 10255
  Gene Symbol: MAP1LC3B
  Gene Name: microtubule-associated protein 1 light chain 3 beta
  ENST ID: ENST00000570189
  CDS Start-End: 112-255
aagggaagtggctatcgccagagtcggattcgccgccgcagcagccgccgcccccgggagccgccgggaccctcgcgtcgtcgccgccgccgccgcccagatccctgcaccatgccgtcggagaagaccttcaagcagcgccgcaccttcgaacaaagagtagaagatgtccgacttattcgagagcagcatccaaccaaaatcccgggtggaagaattactgtatatagaaaagatgtccgcagcgttcagtaaacacagacactaatgagactcagaggctcatctgtggtcaggtgataatagaacgatacaagggtgagaagcagcttcctgttctggataaaacaaagttccttgtacctgaccatgtcaacatgagtgagctcatcaagataattagaaggcgcttacagctcaatgctaatcaggccttcttcctgttggtgaacggacacagcatggtcagcgtctccacaccaatctcagaggtgtatgagagtgagaaagatgaagatggattcctgtacatggtctatgcctcccaggagacgttcgggatgaaattgtcagtgtaaaaccagaaaaaatgcagctcttctagaattgtttaaacccttaccaaggaaaaaaaagggatgttaccaactgagatcgatcagttcatccaatcacagatcatgaaacagtagtgttcccacctaggagtgttaggaagttgtgtttgtgtttcaagcagaaaaactgagctccaagtgagcacattcagctttggaaactatattatttaatgtaggctagcttgttttcaaattttaaaagtttaaaaataaaatactttgcattctaagttgccaataaaatagaccttcaagttattttaatgctcttttctcactaataggaacttgtaattccagcagtaatttaaaggctttcagagagaccctgagtcttctcttcaggttcacaaaacccgccgcctttttgggtagaagttttctactcagctagagagatctccctaagaggatctttaggcctgagttgtgaagcgcaacccccgcaaaacgcatttgccatcacagttggcacaaacgcagggtaaacgggctgtgtgagaaaacggccctgactgtaaactgctgaaggtccctgactcctaagagaaccacacccaaagtcctcactcttgcaggggtagacatttctggtttggtttgttctctagatagttacacacataaagacaccactca

SEQ ID NO: 153919 - DNA, 625 bp, Homo sapiens
  Payload ID: 10255
  Gene Symbol: MAP1LC3B
  Gene Name: microtubule-associated protein 1 light chain 3 beta
  ENST ID: ENST00000565788
  CDS Start-End: 95-322
ccagagtcggattcgccgccgcagcagccgccgcccccgggagccgccgggaccctcgcgtcgtcgccgccgccgccgcccagatccctgcaccatgccgtcggagaagaccttcaagcagcgccgcaccttcgaacaaagagtagaagatgtccgacttattcgagagcagcatccaaccaaaatcccggtgataatagaacgatacaagggtgagaagcagcttcctgttctggataaaacaaagttccttgtacctgaccatgtcaacatgagtgagctcatcaagataattaggtattcagtcacctttgtttcataatatatttcctttgagtaacttcttattctttatgaaacttacagttaaatctttagttctggttaaaatctttaaaaaatatttttcagctgaattcagttctgattcagttatgattaaaacaatttcaacttaaactataaaatgtttctttttttgaggttttatattacttgctagactgcagagcccgtttctttcatcataacatcgtttagatgtttcctgtttaaaatcagtgttacaagttattaaggtattgtacagcaaagctagttaaagagaatgtagactctgtgagtg

SEQ ID NO: 153920 - DNA, 660 bp, Homo sapiens
  Payload ID: 10256
  Gene Symbol: MAP1LC3B2
  Gene Name: microtubule-associated protein 1 light chain 3 beta 2
  Uniprot ID: A6NCE7
  ENST ID: ENST00000556529
  CDS Start-End: 155-532
gcaaggctcgcagccacctctcgggagtgcagggccagatcctgtgccagcggccttacacggccacagtcggattcgctgccgcagcagccgccacccccaggagccgccgggaccctcgcgtcgtcgccgccgcggcccagatccccacaccatgccgtcggagaagaccttcaagcagcggcgcaccttcgaacaaagagtagaagatgtccgacttattcgagagcagcatccaaccaaaatcccggtgataatagaacgatacaagggtgagaagcagcttcctgttctggataaaacaaagttccttgtacctgaccatgtcaacatgagtgagctcatcaagataattagaaggcgcttacagctcaatgctaatcaggccttcttcctgttggtgaacggacacagcatggtcagcgtctccacaccaatctcagaggtgtatgagagtgagaaagatgaagatggattcctgtacatggtctgtgcctcccaggagacgttcgggatgaaattgtcagtgtaaaaccagaaaaaatgcatctcttctagaattttttaaacccttaccaaggaaaaaaaaagggatgttaccaactgagatcgatcagttcatctaatcacagatcatcaaacagtagtgttcccacctag

SEQ ID NO: 153921 - DNA, 1182 bp, Homo sapiens
  Payload ID: 10257
  Gene Symbol: MAP1LC3C
  Gene Name: microtubule-associated protein 1 light chain 3 gamma
  Uniprot ID: Q9BXW4
  ENST ID: ENST00000357246
  CDS Start-End: 66-509
gttaggttcccggttgcgggacagtttttttttcttttttaaaacagacacagctactgagtgcaatgccgcctccacagaaaatcccaagcgtcagacccttcaagcagaggaaaagcttggcaatcagacaagaggaagttgctggaatccgggcaaagttccccaacaaaatcccggtggtagtggagcgctaccccagggagacgttcctgcccccgctggacaaaaccaagttcctggtcccgcaggagctgaccatgacccagttcctcagcatcatccggagccgcatggtcctgagagccacggaagccttttacttgctggtgaacaacaagagcctggtcagcatgagcgcaaccatggcagagatctacagagactacaaggatgaggatggcttcgtgtacatgacctacgcctcccaggagacatttggctgcctggagtcagcagcccccagggatgggagcagccttgaggacagaccctgcaatcctctctagcccatgtcgggaaggatgtgtgctctgacagacgtgtcagatgctggcagaagggattggttttctcctgtgtatacagtggaggagtctgagaagcagggatgcctggggtgatcagctccaaccagtggcagcagagtggtggctcttcctagtttagtttttgtgctccgtgttcttgtgtccttctaagaaaaatgtgggctgctcttgaaagttatataattatcatttttttttttttgaaacagggtcttgctctattgcctaggctggagcacagtggcatgatcttggctcactgcaacctccgcctcctgggttcaagtgattcttctgcctccaccccccgagtggctggtattacaagcacatgccaccacaccaggctaatttttgtatttttagtagagacggggtttcaccatgttggccaggctggtctcgaactcctgacctcaggtgatccacccacctcggcctcccaaagtgctgggattacaggcgtgagccactgcatccagccatataaccgtattctaaataagaaatggttggcttgtgtgatggttttgtgtaatgagctagagataatattttaagtgtcttctgtggtatatgtgggagggccattaaggagtgggtttcactccctgcatgtgggcaggtgtcc

SEQ ID NO: 153922 - DNA, 3516 bp, Homo sapiens
  Payload ID: 10258
  Gene Symbol: MAP10
  Gene Name: microtubule-associated protein 10
  Uniprot ID: Q9P2G4
  ENST ID: ENST00000418460
  CDS Start-End: 133-3276
tttttgccagtgtattcacactccgtgtgtgtgtggtgtgtctgtctcagtactactgtaattgatgaggcaggggctccctggccatcccagcagtgtcaccatcttttgggtagaacagcagacacagagatggcccactgtggacagttaactaactggctctgtttagcatgggaaaggaaggagagtcctgattttctttcaatattcctcaggtatattgatctgacccccaagttacataagatctgcagtgataaaaccattacccaaaaaactcactgtcttttaccacttatatcctcagcattatcatcaattgtcttaatacaaggttggtggcaaaaaacggctcacaagtatgcatacaaaggggccaaacacattgagcagcaaaacccccaaagcagacaccgcccgagacccgctggagcgcttccgcaaatctcgcgagatagcaggcagcgatgccttttgctccggtttctcgtgagaccccggggcttcagcttctcgtttgcggagcccgcggcggcgtttcctggggcaacagcaatggcggcctcgctgtccgagcggctcttctcgctggagctgctggtggactgggtgcgtttggaagcccggctgctgccgtcccccgctgccgcagtggagcaggaggaggaagaggaggaaaaggagcagggggaggcctcgtcgccgcgcggtctgtgccccgccgtggccttccgcctgctggacttccccacgctgttggtttaccctcctgacggccccggcgctcccgccgccgaaccgtggcccggtgtcatccgcttcggtcgcggcaagtcctgcctcttccgcctgcagcctgctaccctgcactgccggctcctgcggaccccgcttgccaccttgctgctgcagctgccccctgggcgcccgacgcccaccccacagctcctgggggcctgcgacatttcgctggccaccgcagcgcacagggtcgtggggccggccgcctccggatgctcccaccgtcaccggggacgtttccccctgcataatcgagtgggcgagcggactggggacattgcactggcctaccgcctgactgacctgggaagccgcctgctgagccaacttgagcggcccctcaccttcacccgcacaggaggaggagcggaggtcagtccccaaacccagcaggaaagacagcagctgcagcagccagcctcacagccaagcccaaaagaggctgataagccgctgggggagttagaaatcccagaggcacagaaggatttgaaggaaatggttaaaagtaaggccgaatgtgataatgtgggttctgtggagaatggcaaaaccaattctgttgttacatgttcaggtgctggcaatgggagaaatgttagctccctaaatgaggaagtcacagaattggacatggagaccaatatattttgccctcctcctttgtattacactaacttgacccaagaaaaaccgccccctgcacaggctaaaatcaccattgagcctcaaatgaatgcacctgaggaaatggatgatgcttctcctgaaaaaaagcgtgtaaatcccccagcacacaggagttgtctaaagcatccaagttctgcagcacacgaacatcctccaatgcttgtaaatcctccacatattcagaatataggagcaactaatcaaacatgtcaaactgaacaaaatcgaattaatacaataaggcagttgcctttgttaaatgctttgttagttgagttgtccttgttatatgaccaacctgtgacaagtcctgctcatatacatcctcacctagcctggttatataggactgaggataagaagtcacccgaatcttctgccaaatccacatgccggtctgaagccaagaaggataagcgttctgtggggggatgtgaaaagtcagtgagtcttcagtataaaaagaaccaaattgaaaactataaggaagataaatattctgaaaagagcagtggtgccctccataaaagagttccaaaagggaggctactttatggcttaacaaatacactaagactacgtttaaagctgacaaatcctgatatgttggtggtacatgaaaaaagagaactatatagaaaaagacaatcacaaatgttgggtacaaaattcagaattccgtcatccaaagttaaactattaagctctgcagaacaaagtcagaagccacaactgcctgaagataagtatttagattcagatgcatctttcactgaaaatagtgatacctcaagacaaatcagtggagtttttgatgagcccagcacaagtaaagaaactaaactgaaatatgcaactgaaaaaaagacagttgattgtagtaaaaatagaatcaataatgtttcattggaagaagttgtgagtcctgcaaattccattattccagaaaggcttacccctacaaatattctgggaggaaatgtggaaatgaaaatccaaagtccatgtgttttccaacaggatgctgttgttgacagaattgtagataaggaaatagatattagacaggtcaaaaccacagataatgacattcttatggctgatataagtgacaagagaacaggtaaaaatagttgctatgaaaacatctcagaactgaagtattcagatgatttgtctagcccttgctattctgaagatttctgtaccagtgaggacaccagcagaagtttcaaagctcatgatagcagttcaaggacagaaaatccaaaacatagtcaatatacaagcaagtctagtgacacaggagtgtccaaaaagaaaaatagtagtgacaggagttctatccttagcccacctttttcagccgggtcacctgtacactcatacagaaaatttcatatttcaaagactcaggataaaagtttggaggaagcatctagtatctctgctagtgatttatcttcaacacattggactgaacaaaaagaaaaccagatagatcaaaatagtatgcacaattctgaaattacaaagagagctcaagacatctctgttaaaacaagaagtagttggaaatctttagaaaaaagccagtcaccacaaacatcccaggtgagttcttacctgccttcaaatgtgtccgaacttaatgtcctggatagcagtacatcagatcactttgaagaaggcaatgatgatgttggttcactaaatatttccaagcaatgcaaagatatttgtgaattagtaataaataaacttccaggatacacaatgtaaaaatacatgcttttaaaaaactttcaaggacctatgtgtactgttagtgaaaaaaattttaaagctgttttagttcatgaattatgtgaataattttttaaagaaatatgaattaacgttattcctttgatgtttaaatggtattttaccattaaatctgataatattgattattaaatcatataaacagatttctttttaaattgtttaatcataagaataaaagtgtgtctttctaaa

SEQ ID NO: 153923 - DNA, 10258 bp, Homo sapiens
  Payload ID: 10259
  Gene Symbol: MAP1A
  Gene Name: microtubule-associated protein 1A
  Uniprot ID: P78559
  ENST ID: ENST00000300231
  CDS Start-End: 451-8862
tgcagactcttccctgaagctgccggctgaggccggagctgccgcctccatgagaggcttcctcctacaccccagggccagaggaccctttgccaccagagtgagatcctagagaccatcatcctggtaaatcccagtgcagacagcatcagctctgaggttcatcatcttcttagcagctcatcagcttataaactactaatcttgagtgggcaaagtttagagcctgggggagacctcatcctacagagtggcacctactcatatgaaaactttgcccaggtccttcacaaccccgagatttcccaattgctcagcaatagagaccctgggatacaggccttccttaccgtgtcctgcttaggggaaggtgattggagccacctgggattatccagttcccaagagaccctgcacctccggctaaaccctgagcccactctgcccaccatggacggcgtggctgagttctccgagtatgtctctgagactgtggacgtgccatccccatttgacctactagagccccccacctcagggggcttcctcaagctctccaagccttgttgctacatcttcccaggtggtcgtggggactctgccctctttgctgtcaatggtttcaacatcctggtggatggtggctctgatcgcaagtcctgtttttggaagctggtacggcacttggaccgcattgactcggtgctactcacacacattggggcagacaacctgccaggcatcaatggactactgcagcgcaaagtggcagagctagaggaggagcagtcccagggctctagcagttacagcgactgggtgaagaaccttatctctcctgagcttggagttgtctttttcaacgtgcctgagaagctgcggcttcctgatgcctcccggaaagccaagcgtagcattgaggaggcctgcctcactctgcagcacttaaaccgcctgggcatccaggctgagcctctatatcgtgtggtcagcaataccattgagccactgaccctcttccacaaaatgggtgtgggccggctggacatgtatgtcctcaaccctgtcaaggacagcaaggagatgcagttcctcatgcaaaagtgggcaggcaatagtaaagccaagacaggcatcgtgctgcccaatgggaaggaggctgagatctccgtgccctaccttacctctatcactgctctggtggtctggctaccagccaatcccactgagaagattgtgcgtgtgctttttccaggaaatgctccccaaaacaagatcttggagggcctagaaaagcttcggcatctggacttcctgcgttaccctgtggccacgcagaaggacctggcttctggggctgtgcctaccaacctcaagcccagcaaaatcaaacagcgggctgatagcaaggagagcctcaaagccactaccaagacggccgtgagcaagttggccaaacgggaggaggtggtagaagagggagccaaggaggcacgttcagagctggccaaggagttagccaagacagagaagaaggcaaaagagtcatctgagaagcccccagagaagcctgccaagcctgagagggtgaagacagagtcaagtgaggcactgaaggcagagaagcgaaagctgatcaaagacaaggtagggaaaaagcaccttaaagaaaagatatcaaagctggaagaaaaaaaagacaaggagaaaaaagagatcaaaaaggagaggaaagagctcaagaaggatgaaggaaggaaggaggagaagaaggatgccaagaaggaggagaagaggaaagataccaaacctgagctcaagaagatttccaagccagacctaaagccctttactcctgaggtacgtaagaccctctataaagccaaggtccctggaagagtcaaaatagacaggagccgtgctatccgtggggagaaggagctgtcttctgagccccagacacccccagcccagaagggaactgtaccactcccaaccatcagtgggcacagggagctggtcctatcctcaccagaggacctcacacaggactttgaggagatgaagcgtgaggagagggctttgctggctgaacaaagggacacaggactaggagataagccattccctctagacactgcagaggagggacccccaagtacagctatccagggaacaccaccctctgttccagggctgggacaagaagaacatgtgatgaaggagaaagagcttgtcccagaggtccctgaggaacaaggcagcaaggacagaggcctagactctggggctgaaacagaggaagagaaagatacctgggaggaaaagaagcagagggaagcagagaggctcccagacagaacagaagccagagaggaaagtgaacctgaagtaaaggaggatgtgatagaaaaggctgagttagaagaaatggaggaggtacacccttcagatgaggaggaagaggacgcgacaaaagctgagggtttttaccaaaaacatatgcaggaacccttgaaggtaactccaaggagccgggaggcttttgggggtcgggaattgggactccagggcaaggcccctgagaaggagacctcgttattcctaagcagcctgaccacacctgcaggagccactgagcatgtctcttacatccaggatgagacaatccctggctactcagagactgagcagaccatctcagatgaggagatccatgatgagccggaggagcgcccagctccacccagatttcatacaagtacatatgacctgcccgggcctgaaggtgctggcccattcgaagccagccaacctgccgatagtgctgttcctgctacctctggcaaagtctatggaacgccagagactgaactcacctaccccactaacatagtggctgcccctttggctgaagaggaacatgtgtcctcggccacttcaatcactgagtgtgacaaactttcttcctttgccacatcagtggctgaggaccaatctgtggcctcacttacagctccccagacagaggagacaggcaagagctccctgctgcttgacacagtcacaagcatcccttcctcccgtactgaagctacgcagggcttggactatgtgccatcagctggtaccatctcacccacctcctcactggaagaagacaagggcttcaaatcaccaccctgtgaggacttctctgtgactggggagtcagagaagagaggagagatcatagggaaaggcttgtctggagagagagctgtggaagaggaagaggaggagacagcaaacgtagagatgtctgagaaactttgcagtcaatatggaactccagtgtttagtgcccctgggcatgccctacatccaggagaaccagcccttggagaagcagaggagcggtgccttagcccagatgacagcacagtgaagatggcttctcctccaccatctggcccacccagtgccacccacacaccctttcatcagtccccagtggaagaaaagtctgagccccaagactttcaggaggcagactcctggggagacactaagcgcacaccaggtgtgggcaaagaagatgctgctgaggagacagtcaagccagggcctgaagagggcacactagagaaggaagagaaagttcctcctcccaggagcccccaggcccaggaagcacctgtcaacattgatgaggggcttacaggctgtaccattcaactgttgccagcacaggataaagcaatagtctttgagattatggaggcaggagagcccacaggcccaattctgggagcagaagcccttcccggaggtttgaggactttaccccaagaacctggcaaacctcagaaagatgaggtgctcagatatcctgaccgaagcctctctcctgaagatgcagaatccctctctgtcctcagcgtgccctccccagacactgccaaccaagagcctacccccaagtctccctgtggcctgacagaacagtacctacacaaagaccgttggccagaggtatctccagaagacacccagtcactttctctgtcagaagagagtcccagcaaggagacctccctggatgtctcttctaagcagctctctccagaaagccttggcaccctccagtttggggaactaaaccttgggaaggaagaaatggggcatctgatgcaggccgaggatacctctcaccacacagctcccatgtctgttccagagccccatgcagccacagcgtcacctcccacagatgggacaactcgatactctgcacagacagacatcacagatgacagccttgacaggaagtcacctgccagctcattctctcactctacaccttcaggaaatgggaagtacttacctggggcgatcacaagccctgatgaacacattctgacacctgatagctccttctccaagagtcctgagtctttgccaggccctgccttggaggacattgccataaagtgggaagataaagttccagggttgaaagacagaacctcagaacagaagaaggaacctgagccaaaggatgaagttttacagcagaaagacaaaactctggagcacaaggaggtggtagagccgaaggatacagccatctatcagaaagatgaggctctgcatgtaaagaatgaggctgtgaaacagcaggataaggctttagaacaaaagggcagagacttagagcaaaaagacacagccctagaacagaaggacaaggccctggaaccaaaagacaaagacttagaagaaaaagacaaggccctggaacagaaggataagattccagaagagaaagacaaagccttagaacaaaaggatacagccctggaacagaaggacaaggccctggaaccaaaagataaagacttggaacaaaaggacagggtcctagaacagaaggagaagatcccagaagagaaagacaaagccttagatcaaaaagtcagaagtgttgaacataaggctccggaggacacggtcgctgaaatgaaggacagagacctagaacagacagacaaagcccctgaacagaaacaccaggcccaggaacaaaaggataaagtctcagaaaagaaggatcaggccttagaacaaaaatactgggctttgggacagaaggatgaagccctggaacaaaacattcaggctctggaagagaaccaccaaactcaggagcaggagagcctagtgcaggaggataaaaccaggaaaccaaagatgctagaggaaaaatccccagaaaaggtcaaggccatggaagagaagttagaagctcttctggagaagaccaaagctctgggcctggaagagagcctagtgcaggagggcagggccagagagcaggaagaaaagtactggagggggcaggatgtggtccaggagtggcaagaaacatctcctaccagagaggagccggctggagaacagaaagagcttgccccggcatgggaggacacatctcctgagcaggacaataggtattggaggggcagagaggatgtggccttggaacaggacacatactggagggagctaagctgtgagcggaaggtctggttccctcacgagctggatggccagggggcccgcccacactacactgaggaacgggaaagcactttcctagatgagggcccagatgatgagcaagaagtacccctgcgggaacacgcaacccggagcccctgggcctcagacttcaaggatttccaggaatcctcaccacagaaggggctagaggtggagcgctggcttgctgaatcaccagttgggttgccaccagaggaagaggacaaactgacccgctctccctttgagatcatctcccctccagcttccccacctgagatggttggacaaagggttccttcagccccaggacaagagagtcctatcccagaccctaagctcatgccacacatgaagaatgaacccactactccctcatggctggctgacatcccaccctgggtgcccaaggacagacccctcccccctgcacccctctccccagctcctggtccccccacacctgccccggaatcccatactcctgcacccttctcttggggcacagccgagtatgacagtgtggtggctgcagtgcaggagggggcagctgagttggaaggtgggccatactcccccctggggaaggactaccgcaaggctgaaggggaaagggaagaagaaggtagggctgaggctcctgacaaaagctcacacagctcaaaggtaccagaggccagcaaaagccatgccaccacggagcctgagcagactgagccggagcagagagagcccacaccctatcctgatgagagaagctttcagtatgcagacatctatgagcagatgatgcttactgggcttggccctgcatgccccactagagagcctccacttggagcagctggggattggcccccatgcctctcaaccaaggaggcagctgccggccgaaacacatctgcagagaaggagctttcatctcctatctcacccaagagcctccagtctgacactccaaccttcagctatgcagccctggcaggacccactgtacccccaaggccagagccagggccaagtatggagcccagcctcaccccacctgcagttcccccccgtgctcctatcctgagcaaaggcccaagcccccctcttaatggtaacatcctgagctgcagcccagataggaggtccccatcccccaaggaatcaggccggagtcactgggatgacagcactagtgactcagaactggagaagggggctcgggaacagccagaaaaagaggcccaatccccaagtcctcctcaccccattcctatggggtcccccacattatggccagaaactgaggcacatgttagccctcccttggactcacacctggggcctgcccgacccagtctggacttccctgcttcagcctttggcttctcctcattgcagccagctcccccacagctgccctctccagctgaaccccgctcggcaccctgtggctcccttgccttctctggggatcgagctctggctctggctccaggaccccccaccagaacccggcatgatgaatacctggaagtgaccaaggcccccagcctggattcctcactgccccagctcccatcacccagttctcctggggcccctctcctctccaatctgccacgacctgcctcaccagccctgtctgagggctcctcctctgaggctaccacgcctgtgatttcaagtgtggcggagcgcttctctccaagccttgaggctgcagaacaggagtctggagagctggacccaggaatggaaccagctgcccacagcctctgggacctcactcctctgagcccagcacccccagcttcactggacttggccctagctccagctccaagcctgcctggagacatgggtgatggcatcctgccgtgccacctggagtgctcagaggcagccacggagaagccaagccccttccaggttccctctgaggattgtgcagccaatggcccaactgaaaccagccctaaccccccaggccctgccccagccaaggctgaaaatgaagaggctgcggcttgccctgcctgggaacgtggggcctggcctgaaggagctgagaggagctcccggcctgacacattgctctcccctgagcagccagtgtgtcctgcagggggctccgggggcccacccagcagtgcctctcctgaggtcgaagctgggccccagggatgtgccactgagcctcggccccatcgtggggagctctccccatccttcctgaacccacctctgcccccatccatagatgatagggacctctcaactgaggaagttcggctagtaggaagaggggggcggcgccgggtaggggggccagggaccactgggggcccatgccctgtgactgatgagacaccccctacatcagccagtgactcaggctcctcacagtcagattctgatgtcccgccagaaactgaggagtgtccgtccatcacagctgaggcagccctcgactcagatgaagatggagacttcctacctgtggacaaagctgggggtgtcagtggtactcaccaccccaggcctggccatgacccacctcctctcccacagccagacccccgcccatcccctccccgccctgatgtgtgcatggctgaccccgaggggctcagctcagagtctgggagagtagagaggctacgggagaaggaaaaggttcaggggcgagtagggcgcagggccccaggcaaggccaagccagcgtcccctgcacggcgtctggatcttcggggaaaacgctcacccacccctggtaaagggcctgcagatcgagcatcccgggccccacctcgaccacgcagcaccacaagccaggtcaccccagcagaggaaaaggatggacacagccccatgtccaaaggcctagtcaatggactcaaggcaggaccaatggccttgagttccaagggcagctctggtgcccctgtatatgtggatctcgcctacatcccgaatcattgcagtggcaagactgctgaccttgacttcttccgtcgagtgcgtgcatcctactatgtggtcagtgggaatgaccctgccaatggcgagccaagccgggctgtgctggatgccctgctggagggcaaggcccagtggggggagaatcttcaggtgactctgatccctactcatgacacggaggtgactcgtgagtggtaccaacaaactcatgagcagcagcaacaactgaatgtcctggtcctggctagcagcagcaccgtggtgatgcaggatgagtccttccctgcctgcaagattgagttctgaaagagccgccctcccttccccaaggatccactcccccagctcctttagagaatggctactgctgagtcctttggggttgagggagatgggagctagggggaggggagggagatgtcttgttgtggggacttgggctgggctaaatgggaggggttgtccctccccatcatccattcctgtgaggtgtctcaaaccaaagttaacagggagaggatgggggaggggacaaattagaataggatagcatctgatgcctgagaaccctctcctagcactgtcaaatgctggtattgaatggggactgaggatgggtctcagagagcaacctcctccctcgtagagggagattatatccccaactccagggacctctttatctcaatctatttatttggcatcctgggagggatttccaatagtaatttatgtgacctggggcaggataccgtcagtgaggtgcccagagctgcaccctttcctccatttcccatcccccatctcctcaaccaccagggtctgagttctagcagggtcctgggggtatcccactgctatactgttctactgcttccctcagtatctgaatgtctcaatttaaaacttgaagctctttagaccaatagactggtgagaggagaaaggagcttatcccccagaccctgctttataccattcacatcccagggctgtgtccagacagcacaaaacggcaaggagagcccaagccccaatgccagaattcttccaaactccctgactctttgaagtttttactcaccccatttcaattatcctgatcccttctcatcccctgcttggcttctctgcatgtggtcatctgctgtggcttggtgtttaatgggttaaaaataagccactgcctgacatcccaacatttgacaccccagcaatgtgtgactcccccaacattccactatgccatcctgcagctgaaatgggaacactggctgcctctccaaacccgctcttggacagaggatctgggaggtggaagccaggccagaggacttggggaaaatgagatggaggaaggaaaaagggagaagctgagccacagcttaactcctacagagtgaaatgaaaacgggctgaaaataccaccccaggagaggacctcgccccaagcaagccagtgagcagccctgccagactactgccagactgagaaacccagaagctggtagtcatgtgggcttgccttctctgccaaacgactgggaaaccaaaatgagcccaccttgtgttcttcctagctccaccctccccgtgctgctgtgttctgctcctccccacgcttccctgctatagttcccagctgctgtaacggagccacctccaactctaacaataaaccaagttcattgcagatagtgta

SEQ ID NO: 153924 - DNA, 10553 bp, Homo sapiens
  Payload ID: 10259
  Gene Symbol: MAP1A
  Gene Name: microtubule-associated protein 1A
  ENST ID: ENST00000382031
  CDS Start-End: 32-9157
gctgccggactaacactccgcgggtgtttccatggagaccgaggccgagcctgcgcggcctcacggcgttgccatggagacaactccggggctggggctccgaagtcccggcgcaccgctggctcagaaccccgcggagctgctgtgcgaggccggagccgcggtggcggctgcacgctgggacctgcagaagcactctttgctaattgtgatcggcgatatcggtacagagagtcagctgagggccgtgcgggcccaccttgaacaagggattctctcctggaacattgacctgtcatcctttgacttgaaccaacagttgagactcttcattacccggcacctagctcacttctcctcagaggtcaaaggccagaggaccctttgccaccagagtgagatcctagagaccatcatcctggtaaatcccagtgcagacagcatcagctctgaggttcatcatcttcttagcagctcatcagcttataaactactaatcttgagtgggcaaagtttagagcctgggggagacctcatcctacagagtggcacctactcatatgaaaactttgcccaggtccttcacaaccccgagatttcccaattgctcagcaatagagaccctgggatacaggccttccttaccgtgtcctgcttaggggaaggtgattggagccacctgggattatccagttcccaagagaccctgcacctccggctaaaccctgagcccactctgcccaccatggacggcgtggctgagttctccgagtatgtctctgagactgtggacgtgccatccccatttgacctactagagccccccacctcagggggcttcctcaagctctccaagccttgttgctacatcttcccaggtggtcgtggggactctgccctctttgctgtcaatggtttcaacatcctggtggatggtggctctgatcgcaagtcctgtttttggaagctggtacggcacttggaccgcattgactcggtgctactcacacacattggggcagacaacctgccaggcatcaatggactactgcagcgcaaagtggcagagctagaggaggagcagtcccagggctctagcagttacagcgactgggtgaagaaccttatctctcctgagcttggagttgtctttttcaacgtgcctgagaagctgcggcttcctgatgcctcccggaaagccaagcgtagcattgaggaggcctgcctcactctgcagcacttaaaccgcctgggcatccaggctgagcctctatatcgtgtggtcagcaataccattgagccactgaccctcttccacaaaatgggtgtgggccggctggacatgtatgtcctcaaccctgtcaaggacagcaaggagatgcagttcctcatgcaaaagtgggcaggcaatagtaaagccaagacaggcatcgtgctgcccaatgggaaggaggctgagatctccgtgccctaccttacctctatcactgctctggtggtctggctaccagccaatcccactgagaagattgtgcgtgtgctttttccaggaaatgctccccaaaacaagatcttggagggcctagaaaagcttcggcatctggacttcctgcgttaccctgtggccacgcagaaggacctggcttctggggctgtgcctaccaacctcaagcccagcaaaatcaaacagcgggctgatagcaaggagagcctcaaagccactaccaagacggccgtgagcaagttggccaaacgggaggaggtggtagaagagggagccaaggaggcacgttcagagctggccaaggagttagccaagacagagaagaaggcaaaagagtcatctgagaagcccccagagaagcctgccaagcctgagagggtgaagacagagtcaagtgaggcactgaaggcagagaagcgaaagctgatcaaagacaaggtagggaaaaagcaccttaaagaaaagatatcaaagctggaagaaaaaaaagacaaggagaaaaaagagatcaaaaaggagaggaaagagctcaagaaggatgaaggaaggaaggaggagaagaaggatgccaagaaggaggagaagaggaaagataccaaacctgagctcaagaagatttccaagccagacctaaagccctttactcctgaggtacgtaagaccctctataaagccaaggtccctggaagagtcaaaatagacaggagccgtgctatccgtggggagaaggagctgtcttctgagccccagacacccccagcccagaagggaactgtaccactcccaaccatcagtgggcacagggagctggtcctatcctcaccagaggacctcacacaggactttgaggagatgaagcgtgaggagagggctttgctggctgaacaaagggacacaggactaggagataagccattccctctagacactgcagaggagggacccccaagtacagctatccagggaacaccaccctctgttccagggctgggacaagaagaacatgtgatgaaggagaaagagcttgtcccagaggtccctgaggaacaaggcagcaaggacagaggcctagactctggggctgaaacagaggaagagaaagatacctgggaggaaaagaagcagagggaagcagagaggctcccagacagaacagaagccagagaggaaagtgaacctgaagtaaaggaggatgtgatagaaaaggctgagttagaagaaatggaggaggtacacccttcagatgaggaggaagaggacgcgacaaaagctgagggtttttaccaaaaacatatgcaggaacccttgaaggtaactccaaggagccgggaggcttttgggggtcgggaattgggactccagggcaaggcccctgagaaggagacctcgttattcctaagcagcctgaccacacctgcaggagccactgagcatgtctcttacatccaggatgagacaatccctggctactcagagactgagcagaccatctcagatgaggagatccatgatgagccggaggagcgcccagctccacccagatttcatacaagtacatatgacctgcccgggcctgaaggtgctggcccattcgaagccagccaacctgccgatagtgctgttcctgctacctctggcaaagtctatggaacgccagagactgaactcacctaccccactaacatagtggctgcccctttggctgaagaggaacatgtgtcctcggccacttcaatcactgagtgtgacaaactttcttcctttgccacatcagtggctgaggaccaatctgtggcctcacttacagctccccagacagaggagacaggcaagagctccctgctgcttgacacagtcacaagcatcccttcctcccgtactgaagctacgcagggcttggactatgtgccatcagctggtaccatctcacccacctcctcactggaagaagacaagggcttcaaatcaccaccctgtgaggacttctctgtgactggggagtcagagaagagaggagagatcatagggaaaggcttgtctggagagagagctgtggaagaggaagaggaggagacagcaaacgtagagatgtctgagaaactttgcagtcaatatggaactccagtgtttagtgcccctgggcatgccctacatccaggagaaccagcccttggagaagcagaggagcggtgccttagcccagatgacagcacagtgaagatggcttctcctccaccatctggcccacccagtgccacccacacaccctttcatcagtccccagtggaagaaaagtctgagccccaagactttcaggaggcagactcctggggagacactaagcgcacaccaggtgtgggcaaagaagatgctgctgaggagacagtcaagccagggcctgaagagggcacactagagaaggaagagaaagttcctcctcccaggagcccccaggcccaggaagcacctgtcaacattgatgaggggcttacaggctgtaccattcaactgttgccagcacaggataaagcaatagtctttgagattatggaggcaggagagcccacaggcccaattctgggagcagaagcccttcccggaggtttgaggactttaccccaagaacctggcaaacctcagaaagatgaggtgctcagatatcctgaccgaagcctctctcctgaagatgcagaatccctctctgtcctcagcgtgccctccccagacactgccaaccaagagcctacccccaagtctccctgtggcctgacagaacagtacctacacaaagaccgttggccagaggtatctccagaagacacccagtcactttctctgtcagaagagagtcccagcaaggagacctccctggatgtctcttctaagcagctctctccagaaagccttggcaccctccagtttggggaactaaaccttgggaaggaagaaatggggcatctgatgcaggccgaggatacctctcaccacacagctcccatgtctgttccagagccccatgcagccacagcgtcacctcccacagatgggacaactcgatactctgcacagacagacatcacagatgacagccttgacaggaagtcacctgccagctcattctctcactctacaccttcaggaaatgggaagtacttacctggggcgatcacaagccctgatgaacacattctgacacctgatagctccttctccaagagtcctgagtctttgccaggccctgccttggaggacattgccataaagtgggaagataaagttccagggttgaaagacagaacctcagaacagaagaaggaacctgagccaaaggatgaagttttacagcagaaagacaaaactctggagcacaaggaggtggtagagccgaaggatacagccatctatcagaaagatgaggctctgcatgtaaagaatgaggctgtgaaacagcaggataaggctttagaacaaaagggcagagacttagagcaaaaagacacagccctagaacagaaggacaaggccctggaaccaaaagacaaagacttagaagaaaaagacaaggccctggaacagaaggataagattccagaagagaaagacaaagccttagaacaaaaggatacagccctggaacagaaggacaaggccctggaaccaaaagataaagacttggaacaaaaggacagggtcctagaacagaaggagaagatcccagaagagaaagacaaagccttagatcaaaaagtcagaagtgttgaacataaggctccggaggacacggtcgctgaaatgaaggacagagacctagaacagacagacaaagcccctgaacagaaacaccaggcccaggaacaaaaggataaagtctcagaaaagaaggatcaggccttagaacaaaaatactgggctttgggacagaaggatgaagccctggaacaaaacattcaggctctggaagagaaccaccaaactcaggagcaggagagcctagtgcaggaggataaaaccaggaaaccaaagatgctagaggaaaaatccccagaaaaggtcaaggccatggaagagaagttagaagctcttctggagaagaccaaagctctgggcctggaagagagcctagtgcaggagggcagggccagagagcaggaagaaaagtactggagggggcaggatgtggtccaggagtggcaagaaacatctcctaccagagaggagccggctggagaacagaaagagcttgccccggcatgggaggacacatctcctgagcaggacaataggtattggaggggcagagaggatgtggccttggaacaggacacatactggagggagctaagctgtgagcggaaggtctggttccctcacgagctggatggccagggggcccgcccacactacactgaggaacgggaaagcactttcctagatgagggcccagatgatgagcaagaagtacccctgcgggaacacgcaacccggagcccctgggcctcagacttcaaggatttccaggaatcctcaccacagaaggggctagaggtggagcgctggcttgctgaatcaccagttgggttgccaccagaggaagaggacaaactgacccgctctccctttgagatcatctcccctccagcttccccacctgagatggttggacaaagggttccttcagccccaggacaagagagtcctatcccagaccctaagctcatgccacacatgaagaatgaacccactactccctcatggctggctgacatcccaccctgggtgcccaaggacagacccctcccccctgcacccctctccccagctcctggtccccccacacctgccccggaatcccatactcctgcacccttctcttggggcacagccgagtatgacagtgtggtggctgcagtgcaggagggggcagctgagttggaaggtgggccatactcccccctggggaaggactaccgcaaggctgaaggggaaagggaagaagaaggtagggctgaggctcctgacaaaagctcacacagctcaaaggtaccagaggccagcaaaagccatgccaccacggagcctgagcagactgagccggagcagagagagcccacaccctatcctgatgagagaagctttcagtatgcagacatctatgagcagatgatgcttactgggcttggccctgcatgccccactagagagcctccacttggagcagctggggattggcccccatgcctctcaaccaaggaggcagctgccggccgaaacacatctgcagagaaggagctttcatctcctatctcacccaagagcctccagtctgacactccaaccttcagctatgcagccctggcaggacccactgtacccccaaggccagagccagggccaagtatggagcccagcctcaccccacctgcagttcccccccgtgctcctatcctgagcaaaggcccaagcccccctcttaatggtaacatcctgagctgcagcccagataggaggtccccatcccccaaggaatcaggccggagtcactgggatgacagcactagtgactcagaactggagaagggggctcgggaacagccagaaaaagaggcccaatccccaagtcctcctcaccccattcctatggggtcccccacattatggccagaaactgaggcacatgttagccctcccttggactcacacctggggcctgcccgacccagtctggacttccctgcttcagcctttggcttctcctcattgcagccagctcccccacagctgccctctccagctgaaccccgctcggcaccctgtggctcccttgccttctctggggatcgagctctggctctggctccaggaccccccaccagaacccggcatgatgaatacctggaagtgaccaaggcccccagcctggattcctcactgccccagctcccatcacccagttctcctggggcccctctcctctccaatctgccacgacctgcctcaccagccctgtctgagggctcctcctctgaggctaccacgcctgtgatttcaagtgtggcggagcgcttctctccaagccttgaggctgcagaacaggagtctggagagctggacccaggaatggaaccagctgcccacagcctctgggacctcactcctctgagcccagcacccccagcttcactggacttggccctagctccagctccaagcctgcctggagacatgggtgatggcatcctgccgtgccacctggagtgctcagaggcagccacggagaagccaagccccttccaggttccctctgaggattgtgcagccaatggcccaactgaaaccagccctaaccccccaggccctgccccagccaaggctgaaaatgaagaggctgcggcttgccctgcctgggaacgtggggcctggcctgaaggagctgagaggagctcccggcctgacacattgctctcccctgagcagccagtgtgtcctgcagggggctccgggggcccacccagcagtgcctctcctgaggtcgaagctgggccccagggatgtgccactgagcctcggccccatcgtggggagctctccccatccttcctgaacccacctctgcccccatccatagatgatagggacctctcaactgaggaagttcggctagtaggaagaggggggcggcgccgggtaggggggccagggaccactgggggcccatgccctgtgactgatgagacaccccctacatcagccagtgactcaggctcctcacagtcagattctgatgtcccgccagaaactgaggagtgtccgtccatcacagctgaggcagccctcgactcagatgaagatggagacttcctacctgtggacaaagctgggggtgtcagtggtactcaccaccccaggcctggccatgacccacctcctctcccacagccagacccccgcccatcccctccccgccctgatgtgtgcatggctgaccccgaggggctcagctcagagtctgggagagtagagaggctacgggagaaggaaaaggttcaggggcgagtagggcgcagggccccaggcaaggccaagccagcgtcccctgcacggcgtctggatcttcggggaaaacgctcacccacccctggtaaagggcctgcagatcgagcatcccgggccccacctcgaccacgcagcaccacaagccaggtcaccccagcagaggaaaaggatggacacagccccatgtccaaaggcctagtcaatggactcaaggcaggaccaatggccttgagttccaagggcagctctggtgcccctgtatatgtggatctcgcctacatcccgaatcattgcagtggcaagactgctgaccttgacttcttccgtcgagtgcgtgcatcctactatgtggtcagtgggaatgaccctgccaatggcgagccaagccgggctgtgctggatgccctgctggagggcaaggcccagtggggggagaatcttcaggtgactctgatccctactcatgacacggaggtgactcgtgagtggtaccaacaaactcatgagcagcagcaacaactgaatgtcctggtcctggctagcagcagcaccgtggtgatgcaggatgagtccttccctgcctgcaagattgagttctgaaagagccgccctcccttccccaaggatccactcccccagctcctttagagaatggctactgctgagtcctttggggttgagggagatgggagctagggggaggggagggagatgtcttgttgtggggacttgggctgggctaaatgggaggggttgtccctccccatcatccattcctgtgaggtgtctcaaaccaaagttaacagggagaggatgggggaggggacaaattagaataggatagcatctgatgcctgagaaccctctcctagcactgtcaaatgctggtattgaatggggactgaggatgggtctcagagagcaacctcctccctcgtagagggagattatatccccaactccagggacctctttatctcaatctatttatttggcatcctgggagggatttccaatagtaatttatgtgacctggggcaggataccgtcagtgaggtgcccagagctgcaccctttcctccatttcccatcccccatctcctcaaccaccagggtctgagttctagcagggtcctgggggtatcccactgctatactgttctactgcttccctcagtatctgaatgtctcaatttaaaacttgaagctctttagaccaatagactggtgagaggagaaaggagcttatcccccagaccctgctttataccattcacatcccagggctgtgtccagacagcacaaaacggcaaggagagcccaagccccaatgccagaattcttccaaactccctgactctttgaagtttttactcaccccatttcaattatcctgatcccttctcatcccctgcttggcttctctgcatgtggtcatctgctgtggcttggtgtttaatgggttaaaaataagccactgcctgacatcccaacatttgacaccccagcaatgtgtgactcccccaacattccactatgccatcctgcagctgaaatgggaacactggctgcctctccaaacccgctcttggacagaggatctgggaggtggaagccaggccagaggacttggggaaaatgagatggaggaaggaaaaagggagaagctgagccacagcttaactcctacagagtgaaatgaaaacgggctgaaaataccaccccaggagaggacctcgccccaagcaagccagtgagcagccctgccagactactgccagactgagaaacccagaagctggtagtcatgtgggcttgccttctctgccaaacgactgggaaaccaaaatgagcccaccttgtgttcttcctagctccaccctccccgtgctgctgtgttctgctcctccccacgcttccctgctatagttcccagctgctgtaacggagccacctccaactctaacaataaaccaagttcattgcagatagtgta

SEQ ID NO: 153925 - DNA, 12036 bp, Homo sapiens
  Payload ID: 10260
  Gene Symbol: MAP1B
  Gene Name: microtubule-associated protein 1B
  Uniprot ID: P46821
  ENST ID: ENST00000296755
  CDS Start-End: 299-7705
gtgaggatgtgccgggtggtcctttcctcctcctcttcctcctcctcccggctccctgcctagtctccatataaaagcggcgccgcctccccgccctctctcactccccgctcctctccgccgcgcactctccgcggcgctgggagagggcggagggggaggcggcgcgcggcgccagaggaggggggacgcagggggcggagcggagacagtaccttcggagataatcctttctcctgccgcagtggagaggagcggccggagcgagacacttcgccgaggcacagcagccggcaggatggcgaccgtggtggtggaagccaccgagccggagccgtccggcagcatcgccaacccggcggcgtccacctcgcctagcctgtcgcaccgcttccttgacagcaagttctacttgctggtggtcgtcggcgagatcgtgaccgaggagcacctgcggcgtgccatcggcaacatcgagctcggaatccgatcatgggacacaaacctgattgaatgcaacttggaccaagaactcaaactttttgtatctcgacactctgcaagattctctcctgaagtcccaggacaaaagatccttcatcaccgaagtgacgttttagaaacagtggtcctgatcaacccttctgatgaagcagtcagcaccgaggtgcgcttaatgatcactgatgctgcccgacacaagctgctcgtgctgaccgggcagtgctttgaaaataccggagagctcattctccagtccggctctttctccttccagaacttcatagagattttcaccgatcaagagatcggggagttactaagcaccacccatcctgccaacaaagccagcttaaccctgttctgtcctgaagaaggggactggaagaactccaatcttgacagacacaatctccaagacttcatcaatattaaactcaattcagcttctatcttgccagaaatggaaggactttctgagtttaccgagtatctctcagaatcagtggaagtcccatctccctttgacatcttggaacctcccacatcgggtggatttctgaagctctccaagccctgctgttatatttttccaggagggaggggcgattctgccttgtttgcagtgaatggtttcaatatgctcatcaatggcggatcagagagaaaatcctgcttctggaagctcatccgacacttagaccgagtggactccatcctgctcacccacattggggatgacaatttgcctggaataaacagcatgttacagcggaaaattgcagagctcgaggaagaacagtcccagggctccaccacaaatagtgactggatgaaaaacctcatctcccctgacttaggagttgtatttctcaatgtacctgaaaatctcaaaaatccagagccaaacatcaagatgaagagaagcatagaagaagcctgcttcactctccagtacctaaacaaattgtccatgaaaccagaacctctgtttagaagtgtaggcaatactattgatcctgtcattcttttccaaaaaatgggagtaggtaaacttgagatgtatgtgcttaatccagtcaagagcagcaaggaaatgcagtattttatgcagcagtggactggtaccaacaaagacaaggctgaattcattctgcctaatggtcaagaagtagatctcccgatttcctacttaacttcagtctcatctttgattgtgtggcatccagcaaaccctgcggagaaaatcatccgagtcctgtttcctgggaacagcacccagtacaacatcctggaagggttggaaaagctcaaacatctagactttctgaagcagccactggccacccaaaaggatctcactggccaggtgcccactcctgtggtgaaacaaacaaaactgaaacagagggctgatagccgagaaagtctgaagccagccgcaaaaccacttcctagcaaatccgtgcgcaaggagtcaaaagaagaaacccctgaggtcacaaaagtgaatcacgtggaaaagccacccaaagttgaaagcaaagaaaaggtaatggtgaaaaaagacaagccaataaaaacagagaccaaaccttcagtgactgaaaaggaggttcccagcaaagaagagccatctccagtgaaagccgaggtggctgagaagcaagccacagatgtcaaacccaaagctgccaaggagaagacggtgaaaaaggaaacaaaggtaaagcctgaagacaagaaagaggagaaagaaaagccaaagaaagaagtggctaaaaaggaggacaaaacacctatcaagaaggaggaaaaaccaaaaaaggaagaggtgaaaaaagaagtcaaaaaagagatcaagaaagaagagaaaaaagaacccaagaaagaggttaagaaagaaacaccgccaaaggaagtcaagaaggaagttaagaaggaagagaagaaggaagtgaaaaaggaagaaaaggaacccaaaaaagaaattaagaagctccctaaagacgcaaagaaatcatctactcctctgtctgaagcaaaaaaaccagctgctttaaaaccaaaagtacccaagaaggaagagtctgtcaagaaagattctgttgctgccggaaagccaaaggagaaggggaaaataaaagtcattaagaaggaaggcaaggccgcagaggctgtcgctgcagctgtcggcactggagccaccacagcagctgtcatggcggcagctggaatagcagccattggccctgccaaagaactcgaagctgagaggtcccttatgtcatctcctgaggatctaaccaaggactttgaagagttaaaggctgaagaggtcgatgtaacaaaggacatcaagcctcagctggagctaatcgaagacgaagagaaactgaaggaaactgagccagtcgaagcctacgtcatccagaaggagagagaagtcaccaaaggtcctgccgagtcccctgatgagggaatcactaccactgaaggggagggcgaatgtgaacagacacctgaggagctggagcccgtcgagaagcagggagtagacgacattgaaaaatttgaagatgaaggagccggttttgaagaatcttcagagactggagactatgaagagaaggcagaaactgaggaggctgaggagccagaagaggatggggaggaacacgtatgtgtgagcgcctccaagcacagccccactgaggatgaggaaagtgccaaggcggaggctgatgcatacatcagggagaagagggagtctgtggccagtggggatgaccgagccgaagaagacatggatgaggccattgagaaaggagaggctgaacaatctgaagaggaggctgatgaggaggacaaagctgaagatgccagagaggaggaatatgagccggaaaaaatggaagctgaagactatgtgatggctgtggtcgacaaggctgcagaggctggtggtgccgaggagcagtatggattcctcaccacaccaaccaagcaactaggagcccagtctcctggccgagaacctgcatcttcaattcatgatgagactttacctggaggctcagagagcgaggccaccgcttctgatgaggagaatcgagaagaccagcctgaggaattcactgccacctctggctacactcagtctactattgagatatccagtgagcccacccccatggatgagatgtctacccctcgagacgtgatgagtgatgagaccaacaatgaagagacggagtccccttctcaggaattcgtaaatatcaccaaatatgaatcttcattgtattctcaggaatactctaaacctgctgatgttacaccgctcaacggattttctgaaggatcaaaaacagatgccactgatggcaaggattacaatgcttcagcctctaccatatcaccaccctcttccatggaggaagacaaattcagcagatctgctttacgtgatgcttactgctctgaagtgaaagccagcaccactttggacatcaaagatagcatctcagctgtttcaagtgaaaaggtcagcccatcgaagagcccgtccctgagtccatctccaccatcacccttagaaaagacccccctgggtgaacgtagtgtgaacttctctctgacgcccaatgagattaaagtctctgcagaggcagaagtagccccggtgtctcctgaggtgacccaagaagtagttgaagaacattgtgctagtcctgaggacaagactctggaagtggtgtcaccatctcagtccgtgactggcagtgctggtcacacaccttactatcaatctcctactgacgagaaatccagtcatctccctacagaagtcattgaaaaaccaccagcagttccagtgagttttgaattcagtgatgccaaagatgagaatgaaagggcttcagtaagccccatggatgagcccgtgcctgactcagagtctcctattgaaaaagttttgtctcctttacgcagcccgcccctcattggatccgagtctgcttatgaaagttttctaagtgctgatgacaaggcttctggcagaggtgccgaaagtccttttgaagaaaagagtggaaaacaaggctctccagaccaagtaagtccagtttctgaaatgacttctactagtctttaccaagacaaacaggaagggaaaagcacagactttgcaccaataaaagaagactttggccaagaaaagaaaactgatgatgttgaagccatgagttctcaaccagcactggctctggatgaaaggaaattaggagatgtttctcccacacaaatagatgtcagtcagtttggatcttttaaagaagacactaagatgtccatttctgaaggtactgtctcagacaagtcagctactcctgttgatgagggcgtagcagaagacacgtactctcatatggagggtgtggcctcagtgtccacagcctcagtggctacgagctcatttccagagccaacaacagatgatgtgtctccatctctgcatgctgaggttggctccccacattccacagaagtagatgactccctttcagtgtctgttgtgcaaacacctaccacattccaggaaacagaaatgtctccatctaaagaagaatgcccaagaccgatgtcaatttctccaccagatttctcccctaaaactgcaaagtccaggacacccgttcaagatcacagatctgaacagtcctcaatgtctattgaatttggccaagaatctcctgagcaatcccttgctatggacttcagtcgacagtctccagatcaccctacagtgggtgcaggcgtgcttcacatcactgaaaatgggccaactgaagtggactacagtccttctgacatgcaggactccagtttatcacataagataccacctatggaggagccgtcctacacccaagataatgatctttctgagctcatctcagtatctcaggtagaggcctccccgtccacctcttctgctcataccccttctcagatcgcttctcctctccaagaagatactctatccgatgttgctcctcccagagatatgtccttatatgcctcactcacctctgaaaaagtgcaaagtctggaaggagagaagctctctccaaaatctgatatctctccactcaccccacgagagtcctctcctttatattcacctactttttcagattctacctctgcagtcaaagagaaaacagcaacttgccacagttcctcttctccaccaatagatgcagcatccgcagagccctatggcttccgtgcctcagtgttattcgatacaatgcaacaccatctagccttgaatagagatttgtccacacctggcctggagaaggacagtggagggaagacacctggtgactttagctatgcctatcaaaagcctgaggaaacaaccaggtccccagatgaagaagattatgactatgagtcttatgagaagaccacccggacctcagatgtgggtggctattactatgagaagatagagagaaccacaaaatctccaagtgacagtggctactcctatgagaccattgggaaaactaccaagacccctgaagatggtgactattcctatgaaattattgagaagaccacacggacccctgaagagggtgggtactcatatgacataagtgaaaagaccaccagcccccccgaagtgagtggttacagctatgaaaagactgagaggtctagaaggcttctggatgacatcagcaatggctatgatgactctgaggatggtggccacacacttggggaccccagctactcttatgaaaccactgagaaaattaccagtttccctgagtctgaaggttattcctatgagacatctacaaagacaacacgaacccctgatacttccacatactgttacgagactgcagagaaaatcactagaacccctcaggcatccacatattcctacgagacttcagacctatgctacactgcagaaaagaagtccccctcagaagcccgtcaggatgtcgatttatgcctcgtgtcctcttgtgaatacaagcaccccaagacagagctttcaccctctttcattaatcccaatcctcttgagtggtttgccagtgaagaacccactgaagaatctgaaaagcccctcactcaatcagggggagccccaccgcctccaggaggaaagcaacagggccgacagtgtgatgaaacccctcccacctcagtcagcgagtcagccccatcccagaccgactctgatgttcccccggagactgaagagtgcccctccatcacggccgatgccaatatcgactctgaagacgagtcggaaaccatccccacagacaaaactgtcacgtacaaacacatggacccacctccagctcccgtgcaagaccgcagcccttcgccacgccaccctgatgtgtccatggtggacccagaggccttggccattgagcagaacctgggcaaagctctaaagaaagatctgaaagagaagaccaaaaccaaaaagccaggtacaaagaccaagtcatcttcacctgtcaaaaagagtgatgggaagtctaagcccttggcagcttcaccaaaaccagcgggcttgaaagaatcctcggataaagtgtccagggtggcttctcctaagaagaaagaatctgtggaaaaggcagcaaaacccaccaccactcctgaggtcaaagctgcacgtggggaagagaaagacaaggagaccaagaatgctgccaatgcctctgcatccaagtcggccaagaccgccactgcaggaccaggaactaccaagacgaccaagtcatctgctgtgcccccaggcctccctgtgtatttggacctgtgctacattcctaaccacagcaatagtaagaatgttgatgtggaatttttcaagagagtgcggtcttcctactacgtggtgagtgggaatgaccctgctgctgaggagcccagccgggctgtcctggacgctttgttggaaggaaaggctcagtggggcagcaacatgcaggtgacactgatcccaactcatgactcagaagtgatgagggaatggtaccaggagacccatgagaaacagcaagatctcaacatcatggttttagcaagcagcagcacagtggttatgcaagatgaatccttccctgcatgcaagattgaactgtaaaaaccaaggccagccacaccacaggatctgaactttgtttccagaaattcttcaatttgaaatcaccttttctaaaaagtcaattcatctagttaagtcgctgaacaattacctgccaaatgctatactgtgtcatggtgatgcaagtcactaaatttctcagtttttgctgattgctaagggaaataacagtatttccacaatagggttcaaattcctgcaaaattacctaccccagttcatctctgctgaacatttggaaaccatgcactagccaacccaactgacttctgctaggtagaggcatttgtcttagagagagagagagcgcgggagagagtgagagagagtgagagcacaaagataacgcaggagagagagagagaaagaatgagaaagaaaaggaatgcaagagaaggagatgtaatgacagagagttctggtgagatacccagagagaaaaagagagagcagggtggggtaaggaggagaaaataaaccaacaattaggtctgcattttctcaggcagtaggcattctttagtctacataggcaaagttttccatttttgtcagtctgagtcatcaaaaagagtcttaattttctaaaacaagttggctagaagaaagtaaaaagaacaacacttgttatgagggcatgtgatattttcacatcttaattaagctccttcagtttgaaggctgcacactgacataatgtagtgagtgtagactggccatgcaagtggtttgggccccattcagaactctcagactctaaacacacaagtagattgatctaaggcatgctcccagcatttgtccacccacttagtccactctgagtcgattaacctgcatgcagcaacacccaagtccaccccaattaactgaagcaaataccaaagcagttgggagtacatatggtagacaatttgccttaggaagtgacttgaatgtacaaagatacttgatgcacttattttttaatgtgagacagcaagtttataaaacatccatataggattatagatacttaaaggaacacgtgggtgagcgtgtgtgggggtactagaagctgatctgattggtccaacagtttgatgctgagtcatgcgtgttgaatcccacttcagtgcacctgtggcctctcagtcaaacaagttgtgcctttcacagcttctttactactgcaagttcaagactgaaatggcttctatgatcagaactgggaaaacagtgaatcttatggtggaagaggttctcagcaagtgtacagtatttaccttcctttgtcttacattggctttttaaattttccattaatttcaacataattatgggaacaagtgtacagaagaattttttttttaagatatgtgagaacttttcatagatgaactttttaacaaatgttttcatttacaggaaattgcaaagaaaattctcaagtgatagtctttttttttaagtgtttcgtaagacaaaaattgaataatgttttttgaagttctggcaagattgaagtctgatattgcagtaatgatatttattaaaaacccataactaccaggaataatgatacctcccaccccttgattcccataacataaaagtgctacttgagagtgggggagaatggcatggtaggctacttttcagggccttgacaagtacatcacccagtggtatcctacatacttctttcaagatcttcaaccatgaggtaaaagagccaagttcaaagaaccctagcacaaatttgctttgggattttcttttctggaaaaaaaaaataaaagaaatagtacattgaaaacaaatgaattctcaactcctacggttcatgtagagtttagagaaaatttccatcattgtcatcattgaactgtgaacctgggaagccagatcatgattaacactgacatcaagtttcaagttgcagatcaatgcacccagtgttcagatgaggcaaacttctccgtgacaactgtgctgtgctctgtcacattacatttcctgcagactctaagatctacggagtagagaacaatgacctcattttattttctatgttagttatttatttcaaaattaacattttagttgatttttgtctgataagtctatgttttgcactgctaactatgatgagggtttaaaaaaatgcttcttcagggtcctttcactgaggacctatgcagtctacttaatgctgtgaattacatttttcaaatgtttaattttttaaagaaaattaatattctatttttgttaggcttctctagaaatgcagcttttatttattaccccatttctttcaagtccttggaaaataacatattaagggtacaagaaattaacacatgatggaaaagtcattgtgacgccaatgaatttcattgagtataaactcatctacttcaaatttattttataacacaacctaagatactcaagataattatttaatggttagctcttaagttgaattggtctacataatgcgtgggaagaaaaccagatttttagccttcttgccaaatccagacctctggttgatttttctttgacagaagatgcaagttattttccaatttcacaattaaatgtatttaacctgaacattattttgctttaaaaactataaacattgtaggagaattatagccagtcttcagttataaccactccaccctcctcactttctctctctctctctctttttttttttttttttttttgctatgggatttaatgggaaaaatatgtaaaaactgtcactagtcagctggctctttttcctatgaaatctatcagtacctttctccatccgttgttctcaatatgaccacagagcctgagtataccaagaaaaccaatattcgcattacaggttgctcctgtccttccagacacctttcctgcctgtgtgactaacctaattttgctagttccataaatacacgattagtttagtaacagccatcacaatgtaccatgtacattcatggtgagagctaaagatcgacacagacttctaggagctttgttcatactgattacttaatccaattgtatagattgaatatttgagtggaaggaatttacactctgtttaaatgatgggattctatcgagatagcactcatgatcatgacctttttggtagtattcttaaacaaaattctacagagactaaatgttagcgatgatcctccattttcaattttaaccaattctgtcccctttctcaaaaccctgagccctgtgcatgctttctcagtcttgtggtgggactggatacaatgactaacttcccctcctcccctctttaaacaccattttccatggagttcaaaaaaattttttttcttaacgttacatatcatagtgaatggtttccccagtgtatatgaatgttttaagtgtctccaatagcttatgcagtctaggagctttccaatactcatttaattaagatttaatcatttgctaatggaaatcttaccacctttcattttccctctgttaccaaatttcagctcttaggagctgctctacaattctgaatttgcttttcttgcctctctttagtcacctgtcacaggaggttcctgctcagtaatgatattgtgagttaggataataactttttttttttgtgcttcagatttagaagaaaagatcctgtttccatttgaaaggaactgtaagcttttatcttttaaccaactgaacaatacaccaaaagcagcctagggatgagcatttctttgaaagcaattaggttattcacctggtattaaaactatttactgttaaaaaatctgtgacttcatgaagttgatttttaaaggcagcatcaaaaactgaaaaggaagggaaaaaataggcagcttctctgcacttgtttggagctccccaaaacaggagccatggagaagtggcatcaagaccgggctgccctttcgagaacaccctgtggcagttcagagacacgcttttcctacactgcatgcagcccctctttccagcactggaaagaagtggtcttgagcccagctgagaagcacttcacactcctctctcttgttctgaatggtgtttgtgtcagtctgcagctgtgtatggtattatgtcttataatcctgcatcacttctatcctatccagtcatatctaatgtagaaaattagtttccagtgaaagtaatatgtagtgcttttatgatatttgtgtgcaatatcccctcttccattgaggatatttgatgtaaaggaaaaaaaaaaactcagttccacaataaaatacaaaagtggcaaaagttca

SEQ ID NO: 153926 - DNA, 2079 bp, Homo sapiens
  Payload ID: 10260
  Gene Symbol: MAP1B
  Gene Name: microtubule-associated protein 1B
  ENST ID: ENST00000504492
  CDS Start-End: 373-2079
agatgctggggcggcccagccccaggttacgtcgtccccagaaagaatctggccaacagtctggccgtgacaagagctggaagcttctctctctccctttaaatcccctccttcattcaaatccgatcctataaaaaggcttttgttgaaggagcagccatggcatcttggtgcacgtctgtgccattcctctcaatatttccaaagatggacaaaagagaacatcgttagttgaattcctgggcaaactggtctgaagattgacttggaaggagtggaggacaaaagatccttcatcaccgaagtgacgttttagaaacagtggtcctgatcaacccttctgatgaagcagtcagcaccgaggtgcgcttaatgatcactgatgctgcccgacacaagctgctcgtgctgaccgggcagtgctttgaaaataccggagagctcattctccagtccggctctttctccttccagaacttcatagagattttcaccgatcaagagatcggggagttactaagcaccacccatcctgccaacaaagccagcttaaccctgttctgtcctgaagaaggggactggaagaactccaatcttgacagacacaatctccaagacttcatcaatattaaactcaattcagcttctatcttgccagaaatggaaggactttctgagtttaccgagtatctctcagaatcagtggaagtcccatctccctttgacatcttggaacctcccacatcgggtggatttctgaagctctccaagccctgctgttatatttttccaggagggaggggcgattctgccttgtttgcagtgaatggtttcaatatgctcatcaatggcggatcagagagaaaatcctgcttctggaagctcatccgacacttagaccgagtggactccatcctgctcacccacattggggatgacaatttgcctggaataaacagcatgttacagcggaaaattgcagagctcgaggaagaacagtcccagggctccaccacaaatagtgactggatgaaaaacctcatctcccctgacttaggagttgtatttctcaatgtacctgaaaatctcaaaaatccagagccaaacatcaagatgaagagaagcatagaagaagcctgcttcactctccagtacctaaacaaattgtccatgaaaccagaacctctgtttagaagtgtaggcaatactattgatcctgtcattcttttccaaaaaatgggagtaggtaaacttgagatgtatgtgcttaatccagtcaagagcagcaaggaaatgcagtattttatgcagcagtggactggtaccaacaaagacaaggctgaattcattctgcctaatggtcaagaagtagatctcccgatttcctacttaacttcagtctcatctttgattgtgtggcatccagcaaaccctgcggagaaaatcatccgagtcctgtttcctgggaacagcacccagtacaacatcctggaagggttggaaaagctcaaacatctagactttctgaagcagccactggccacccaaaaggatctcactggccaggtgcccactcctgtggtgaaacaaacaaaactgaaacagagggctgatagccgagaaagtctgaagccagccgcaaaaccacttcctagcaaatccgtgcgcaaggagtcaaaagaagaaacccctgaggtcacaaaagtgaatcacgtggaaaagccacccaaagttgaaagcaaagaaaaggtaatggtgaaaaaagacaagccaataaaaacagagaccaaaccttcagtgactgaaaaggaggttcccagcaaagaagagccatctccagtgaaagccgaggtggctgagaagcaagccacagatgtcaaacccaaagctgccaaggagaagacggtgaaaaaggaaacaaaggtaaagcctgaagacaagaaagaggagaaagaaaagccaaagaaagaagtggctaaaaaggaggacaaaacacctatcaagaaggaggaaaaaccaaaaaaggaagaggtgaaaaaagaagtcaaaaaagagatcaagaaagaagagaaaaaagaa

SEQ ID NO: 153927 - DNA, 2056 bp, Homo sapiens
  Payload ID: 10260
  Gene Symbol: MAP1B
  Gene Name: microtubule-associated protein 1B
  ENST ID: ENST00000511641
  CDS Start-End: 47-2056
gagcggccggagcgagacacttcgccgaggcacagcagccggcaggatggcgaccgtggtggtggaagccaccgagccggagccgtccggcagcatcgccaacccggcggcgtccacctcgcctagcctgtcgcaccgcttccttgacagcaagttctacttgctggtggtcgtcggcgagatcgtgaccgaggagcacctgcggcgtgccatcggcaacatcgagctcggaatccgatcatgggacacaaacctgattgaatgcaacttggaccaagaactcaaactttttgtatctcgacactctgcaagattctctcctgaagtcccaggacaaaagatccttcatcaccgaagtgacgttttagaaacagtggtcctgatcaacccttctgatgaagcagtcagcaccgaggtgcgcttaatgatcactgatgctgcccgacacaagctgctcgtgctgaccgggcagtgctttgaaaataccggagagctcattctccagtccggctctttctccttccagaacttcatagagattttcaccgatcaagagatcctgaaaggaggccacaacaagtgccctgttaatctgaatttctttaagatcggggagttactaagcaccacccatcctgccaacaaagccagcttaaccctgttctgtcctgaagaaggggactggaagaactccaatcttgacagacacaatctccaagacttcatcaatattaaactcaattcagcttctatcttgccagaaatggaaggactttctgagtttaccgagtatctctcagaatcagtggaagtcccatctccctttgacatcttggaacctcccacatcgggtggatttctgaagctctccaagccctgctgttatatttttccaggagggaggggcgattctgccttgtttgcagtgaatggtttcaatatgctcatcaatggcggatcagagagaaaatcctgcttctggaagctcatccgacacttagaccgagtggactccatcctgctcacccacattggggatgacaatttgcctggaataaacagcatgttacagcggaaaattgcagagctcgaggaagaacagtcccagggctccaccacaaatagtgactggatgaaaaacctcatctcccctgacttaggagttgtatttctcaatgtacctgaaaatctcaaaaatccagagccaaacatcaagatgaagagaagcatagaagaagcctgcttcactctccagtacctaaacaaattgtccatgaaaccagaacctctgtttagaagtgtaggcaatactattgatcctgtcattcttttccaaaaaatgggagtaggtaaacttgagatgtatgtgcttaatccagtcaagagcagcaaggaaatgcagtattttatgcagcagtggactggtaccaacaaagacaaggctgaattcattctgcctaatggtcaagaagtagatctcccgatttcctacttaacttcagtctcatctttgattgtgtggcatccagcaaaccctgcggagaaaatcatccgagtcctgtttcctgggaacagcacccagtacaacatcctggaagggttggaaaagctcaaacatctagactttctgaagcagccactggccacccaaaaggatctcactggccaggtgcccactcctgtggtgaaacaaacaaaactgaaacagagggctgatagccgagaaagtctgaagccagccgcaaaaccacttcctagcaaatccgtgcgcaaggagtcaaaagaagaaacccctgaggtcacaaaagtgaatcacgtggaaaagccacccaaagttgaaagcaaagaaaaggtaatggtgaaaaaagacaagccaataaaaacagagaccaaaccttcagtgactgaaaaggaggttcccagcaaagaagagccatctccagtgaaagccgaggtggctgagaagcaagccacagatgtcaaacccaaagctgccaaggagaagacggtgaaaaaggaaacaaaggtaaagcctgaagacaagaaagaggagaaa

SEQ ID NO: 153928 - DNA, 580 bp, Homo sapiens
  Payload ID: 10260
  Gene Symbol: MAP1B
  Gene Name: microtubule-associated protein 1B
  ENST ID: ENST00000512974
  CDS Start-End: 214-580
gtgaggatgtgccgggtggtcctttcctcctcctcttcctcctcctcccggctccctgcctagtctccatataaaagcggcgcgcggcgccagaggaggggggacgcagggggcggagcggagacagtaccttcggagataatcctttctcctgccgcagtggagaggagcggccggagcgagacacttcgccgaggcacagcagccggcaggatggcgaccgtggtggtggaagccaccgagccggagccgtccggcagcatcgccaacccggcggcgtccacctcgcctagcctgtcgcaccgcttccttgacagcaagttctacttgctggtggtcgtcggcgagatcgtgaccgaggagcacctgcggcgtgccatcggcaacatcgagctcggaatccgatcatgggacacaaacctgattgaatgcaacttggaccaagaactcaaactttttgtatctcgacactctgcaagattctctcctgaagtcccaggacaaaagatccttcatcaccgaagtgacgttttagaaacagtggtcctgatcaacccttctgatgaagcagtcagcaccg

SEQ ID NO: 153929 - DNA, 2154 bp, Homo sapiens
  Payload ID: 10260
  Gene Symbol: MAP1B
  Gene Name: microtubule-associated protein 1B
  ENST ID: ENST00000513526
  CDS Start-End: 56-367
agtggagaggagcggccggagcgagacacttcgccgaggcacagcagccggcaggatggcgaccgtggtggtggaagccaccgagccggagccgtccggcagcatcgccaacccggcggcgtccacctcgcctagcctgtcgcaccgcttccttgacagcaagttctacttgctggtggtcgtcggcgagatcgtgaccgaggagcacctgcggcgtgccatcggcaacatcgagctcggaatccgatcatgggacacaaacctgattgaatgcaacttggaccaagaactcaaactttttgtatctcgacactctgcaagattctctcctgaagtcccagagatgaaaaagaatatcaaagaataattaaaggacaaaagatccttcatcaccgaagtgacgttttagaaacagtggtcctgatcaacccttctgatgaagcagtcagcaccgaggtgcgcttaatgatcactgatgctgcccgacacaagctgctcgtgctgaccgggcagtgctttgaaaataccggagagctcattctccagtccggctctttctccttccagaacttcatagagattttcaccgatcaagagatcggggagttactaagcaccacccatcctgccaacaaagccagcttaaccctgttctgtcctgaagaaggggactggaagaactccaatcttgacagacacaatctccaagacttcatcaatattaaactcaattcagcttctatcttgccagaaatggaaggactttctgagtttaccgagtatctctcagaatcagtggaagtcccatctccctttgacatcttggaacctcccacatcgggtggatttctgaagctctccaagccctgctgttatatttttccaggagggaggggcgattctgccttgtttgcagtgaatggtttcaatatgctcatcaatggcggatcagagagaaaatcctgcttctggaagctcatccgacacttagaccgagtggactccatcctgctcacccacattggggatgacaatttgcctggaataaacagcatgttacagcggaaaattgcagagctcgaggaagaacagtcccagggctccaccacaaatagtgactggatgaaaaacctcatctcccctgacttaggagttgtatttctcaatgtacctgaaaatctcaaaaatccagagccaaacatcaagatgaagagaagcatagaagaagcctgcttcactctccagtacctaaacaaattgtccatgaaaccagaacctctgtttagaagtgtaggcaatactattgatcctgtcattcttttccaaaaaatgggagtaggtaaacttgagatgtatgtgcttaatccagtcaagagcagcaaggaaatgcagtattttatgcagcagtggactggtaccaacaaagacaaggctgaattcattctgcctaatggtcaagaagtagatctcccgatttcctacttaacttcagtctcatctttgattgtgtggcatccagcaaaccctgcggagaaaatcatccgagtcctgtttcctgggaacagcacccagtacaacatcctggaagggttggaaaagctcaaacatctagactttctgaagcagccactggccacccaaaaggatctcactggccaggtgcccactcctgtggtgaaacaaacaaaactgaaacagagggctgatagccgagaaagtctgaagccagccgcaaaaccacttcctagcaaatccgtgcgcaaggagtcaaaagaagaaacccctgaggtcacaaaagtgaatcacgtggaaaagccacccaaagttgaaagcaaagaaaaggtaatggtgaaaaaagacaagccaataaaaacagagaccaaaccttcagtgactgaaaaggaggttcccagcaaagaagagccatctccagtgaaagccgaggtggctgagaagcaagccacagatgtcaaacccaaagctgccaaggagaagacggtgaaaaaggaaacaaaggtaaagcctgaagacaagaaagaggagaaagaaaagccaaagaaagaagtggctaaaaaggaggacaaaacacctatcaagaaggaggaaaaaccaaaaaaggaagaggtgaaaaaagaagtcaaaaaagagatcaag

SEQ ID NO: 153930 - DNA, 3419 bp, Homo sapiens
  Payload ID: 10261
  Gene Symbol: MAP1S
  Gene Name: microtubule-associated protein 1S
  Uniprot ID: Q66K74
  ENST ID: ENST00000324096
  CDS Start-End: 152-3331
gctctccacgacctcaaagggcctgtaagtggtcgacaaaaaggggcggggatgcggtggttccgggcggggtcttcagcccttccggtgcggcccctttaagaggcggggcctgcggggcgggcgccgagaacgccggggcggcccgaagatggcggcggtggctggatctggggctgccgcggctccgagctcactgctcctcgtggtgggcagcgagttcgggagcccggggctcctcacctacgtcctggaggagctcgaaagaggcatccggtcttgggatgtcgatcctggcgtctgcaaccttgatgaacagctcaaggtctttgtgtcccgacactctgccaccttctccagcattgtgaaaggccagcggagcctgcaccaccgtggagacaacctggagaccctggtcctcctgaacccatcagacaagtccctgtatgatgagctccggaaccttctgttggaccctgcctctcacaagctactggtgttggctgggccctgcctggaggagacgggggagctgctgctacagacagggggcttctcgcctcaccacttcctccaggtcctgaaggacagagagatccgggacatcctggccaccacgcccccacctgtgcagccgcccatactcaccatcacctgccccaccttcggtgactgggctcagctggcacccgctgtgcctggccttcagggggcgctccggctccagctgcggctgaaccccccggcgcagctgcccaactctgagggcctgtgcgaattcctggagtacgtggctgagtctctggagccaccgtcccccttcgagctgctggagcccccgacctccgggggcttcctcaggctgggccggccctgctgctacatcttccctggaggcctcggggatgccgccttcttcgccgtcaatggcttcactgtgctggtcaacggtggctcaaaccccaagtccagtttctggaagctggtgcggcacctggaccgcgtggatgccgtgctggtgacccaccctggcgccgacagcctccccggcctcaacagcctgctgcggcgcaaactggcggagcgctccgaggtggctgctggtgggggctcctgggacgacaggctgcgcaggctcatctcccccaacctgggggtcgtgttcttcaacgcctgcgaggccgcgtcgcggctggcgcgcggcgaggatgaggcggagctggcgctgagcctcctggcgcagctgggcatcacgcctctgccactcagccgcggccccgtgccagccaaacccaccgtgctcttcgagaagatgggcgtgggccggctggacatgtatgtgctgcacccgccctccgccggcgccgagcgcacgctggcctctgtgtgcgccctgctggtgtggcaccccgccggccccggcgagaaggtggtgcgcgtgctgttccccggttgcaccccgcccgcctgcctcctggacggcctggtccgcctgcagcacttgaggttcctgcgagagcccgtggtgacgccccaggacctggaggggccggggcgagccgagagcaaagagagcgtgggctcccgggacagctcgaagagagagggcctcctggccacccaccctagacctggccaggagcgccctggggtggcccgcaaggagccagcacgggctgaggccccacgcaagactgagaaagaagccaagaccccccgggagttgaagaaagaccccaaaccgagtgtctcccggacccagccgcgggaggtgcgccgggcagcctcttctgtgcccaacctcaagaagacgaatgcccaggcggcacccaagccccgcaaagcgcccagcacgtcccactctggcttcccgccggtggcaaatggaccccgcagcccgcccagcctccgatgtggagaagccagcccccccagtgcagcctgcggctctccggcctcccagctggtggccacgcccagcctggagctggggccgatcccagccggggaggagaaggcactggagctgcctttggccgccagctcaatcccaaggccacgcacaccctcccctgagtcccaccggagccccgcagagggcagcgagcggctgtcgctgagcccactgcggggcggggaggccgggccagacgcctcacccacagtgaccacacccacggtgaccacgccctcactacccgcagaggtgggctccccgcactcgaccgaggtggacgagtccctgtcggtgtcctttgagcaggtgctgccgccatccgcccccaccagtgaggctgggctgagcctcccgctgcgtggcccccgggcgcggcgctcggcttccccacacgatgtggacctgtgcctggtgtcaccctgtgaatttgagcatcgcaaggcggtgccaatggcaccggcacctgcgtcccccggcagctcgaatgacagcagtgcccggtcacaggaacgggcaggtgggctgggggccgaggagacgccacccacatcggtcagcgagtccctgcccaccctgtctgactcggatcccgtgcccctggcccccggtgcggcagactcagacgaagacacagagggctttggagtccctcgccacgaccctttgcctgaccccctcaaggtccccccaccactgcctgacccatccagcatctgcatggtggaccccgagatgctgccccccaagacagcacggcaaacggagaacgtcagccgcacccggaagcccctggcccgccccaactcacgcgctgccgcccccaaagccactccagtggctgctgccaaaaccaaggggcttgctggtggggaccgtgccagccgaccactcagtgcccggagtgagcccagtgagaagggaggccgggcacccctgtccagaaagtcctcaacccccaagactgccactcgaggcccgtcggggtcagccagcagccggcccggggtgtcagccaccccacccaagtccccggtctacctggacctggcctacctgcccagcgggagcagcgcccacctggtggatgaggagttcttccagcgcgtgcgcgcgctctgctacgtcatcagtggccaggaccagcgcaaggaggaaggcatgcgggccgtcctggacgcgctactggccagcaagcagcattgggaccgtgacctgcaggtgaccctgatccccactttcgactcggtggccatgcatacgtggtacgcagagacgcacgcccggcaccaggcgctgggcatcacggtgttgggcagcaacagcatggtgtccatgcaggatgacgccttcccggcctgcaaggtggagttctagccccatcgccgacacgccccccactcagcccagcccgcctgtccctagattcagccacatcagaaataaactgtgactacacttggct

SEQ ID NO: 153931 - DNA, 3399 bp, Homo sapiens
  Payload ID: 10261
  Gene Symbol: MAP1S
  Gene Name: microtubule-associated protein 1S
  Uniprot ID: Q66K74
  ENST ID: ENST00000544059
  CDS Start-End: 236-3337
gagtcataggcgcacctgccaggttcacctgcagccacttggctcagtgggactggcgggcgtgatgcgcccgtgggtggagatgggtgttcatcccccatccctcggagcatctggacctggcgtttcattgcatgtaaaatgggacaggaacacgcacctcggttcatgtgcttgaggagtgtttagtgagcacctgctatgcgccaggcctttgggcagtggacacagggatatggccgggatgatagacaggttcagccctgccaacacaggcatccggtcttgggatgtcgatcctggcgtctgcaaccttgatgaacagctcaaggtctttgtgtcccgacactctgccaccttctccagcattgtgaaaggccagcggagcctgcaccaccgtggagacaacctggagaccctggtcctcctgaacccatcagacaagtccctgtatgatgagctccggaaccttctgttggaccctgcctctcacaagctactggtgttggctgggccctgcctggaggagacgggggagctgctgctacagacagggggcttctcgcctcaccacttcctccaggtcctgaaggacagagagatccgggacatcctggccaccacgcccccacctgtgcagccgcccatactcaccatcacctgccccaccttcggtgactgggctcagctggcacccgctgtgcctggccttcagggggcgctccggctccagctgcggctgaaccccccggcgcagctgcccaactctgagggcctgtgcgaattcctggagtacgtggctgagtctctggagccaccgtcccccttcgagctgctggagcccccgacctccgggggcttcctcaggctgggccggccctgctgctacatcttccctggaggcctcggggatgccgccttcttcgccgtcaatggcttcactgtgctggtcaacggtggctcaaaccccaagtccagtttctggaagctggtgcggcacctggaccgcgtggatgccgtgctggtgacccaccctggcgccgacagcctccccggcctcaacagcctgctgcggcgcaaactggcggagcgctccgaggtggctgctggtgggggctcctgggacgacaggctgcgcaggctcatctcccccaacctgggggtcgtgttcttcaacgcctgcgaggccgcgtcgcggctggcgcgcggcgaggatgaggcggagctggcgctgagcctcctggcgcagctgggcatcacgcctctgccactcagccgcggccccgtgccagccaaacccaccgtgctcttcgagaagatgggcgtgggccggctggacatgtatgtgctgcacccgccctccgccggcgccgagcgcacgctggcctctgtgtgcgccctgctggtgtggcaccccgccggccccggcgagaaggtggtgcgcgtgctgttccccggttgcaccccgcccgcctgcctcctggacggcctggtccgcctgcagcacttgaggttcctgcgagagcccgtggtgacgccccaggacctggaggggccggggcgagccgagagcaaagagagcgtgggctcccgggacagctcgaagagagagggcctcctggccacccaccctagacctggccaggagcgccctggggtggcccgcaaggagccagcacgggctgaggccccacgcaagactgagaaagaagccaagaccccccgggagttgaagaaagaccccaaaccgagtgtctcccggacccagccgcgggaggtgcgccgggcagcctcttctgtgcccaacctcaagaagacgaatgcccaggcggcacccaagccccgcaaagcgcccagcacgtcccactctggcttcccgccggtggcaaatggaccccgcagcccgcccagcctccgatgtggagaagccagcccccccagtgcagcctgcggctctccggcctcccagctggtggccacgcccagcctggagctggggccgatcccagccggggaggagaaggcactggagctgcctttggccgccagctcaatcccaaggccacgcacaccctcccctgagtcccaccggagccccgcagagggcagcgagcggctgtcgctgagcccactgcggggcggggaggccgggccagacgcctcacccacagtgaccacacccacggtgaccacgccctcactacccgcagaggtgggctccccgcactcgaccgaggtggacgagtccctgtcggtgtcctttgagcaggtgctgccgccatccgcccccaccagtgaggctgggctgagcctcccgctgcgtggcccccgggcgcggcgctcggcttccccacacgatgtggacctgtgcctggtgtcaccctgtgaatttgagcatcgcaaggcggtgccaatggcaccggcacctgcgtcccccggcagctcgaatgacagcagtgcccggtcacaggaacgggcaggtgggctgggggccgaggagacgccacccacatcggtcagcgagtccctgcccaccctgtctgactcggatcccgtgcccctggcccccggtgcggcagactcagacgaagacacagagggctttggagtccctcgccacgaccctttgcctgaccccctcaaggtccccccaccactgcctgacccatccagcatctgcatggtggaccccgagatgctgccccccaagacagcacggcaaacggagaacgtcagccgcacccggaagcccctggcccgccccaactcacgcgctgccgcccccaaagccactccagtggctgctgccaaaaccaaggggcttgctggtggggaccgtgccagccgaccactcagtgcccggagtgagcccagtgagaagggaggccgggcacccctgtccagaaagtcctcaacccccaagactgccactcgaggcccgtcggggtcagccagcagccggcccggggtgtcagccaccccacccaagtccccggtctacctggacctggcctacctgcccagcgggagcagcgcccacctggtggatgaggagttcttccagcgcgtgcgcgcgctctgctacgtcatcagtggccaggaccagcgcaaggaggaaggcatgcgggccgtcctggacgcgctactggccagcaagcagcattgggaccgtgacctgcaggtgaccctgatccccactttcgactcggtggccatgcatacgtggtacgcagagacgcacgcccggcaccaggcgctgggcatcacggtgttgggcagcaacagcatggtgtccatgcaggatgacgccttcccggcctgcaaggtggagttctagccccatcgccgacacgccccccactcagcccagcccgcctgtccctagattcagccacatca

SEQ ID NO: 153932 - DNA, 566 bp, Homo sapiens
  Payload ID: 10261
  Gene Symbol: MAP1S
  Gene Name: microtubule-associated protein 1S
  ENST ID: ENST00000593593
  CDS Start-End: 194-439
ggcgcacctgccaggttcacctgcagccacttggctcagtgggactggcgggcgtgatgcgcccgtgggtggagatgggtgttcatcccccatccctcggagcatctggacctggcgtttcattgcatgtaaaatgggacaggaacacgcacctcggttcatgtgcttgaggagtgtttagtgagcacctgctatgcgccaggcctttgggcagtggacacagggatatggccgggatgatagacaggttcagccctgccaacacaggtctggtttggggatggacccaaagcgagtgaggagatggaacaagcttccagctcacatggtgtcaggaaggatgagaaggctgcaagggactgagaggacagtcagtcttagcacccgaagctcaaggtctttgtgtcccgacactctgccaccttctccagcattgtgaaaggccagcggagcctgcaccaccgtggagacaacctggagaccctggtcctcctgaacccatcagacaagtccctgtatgatgagctccggaaccttctgttggaccctgcctctcacaagctact

SEQ ID NO: 153933 - DNA, 1132 bp, Homo sapiens
  Payload ID: 10261
  Gene Symbol: MAP1S
  Gene Name: microtubule-associated protein 1S
  ENST ID: ENST00000594212
  CDS Start-End: 24-272
gagaacgccggggcggcccgaagatggcggcggtggctggatctggggctgccgcggctccgagctcactgctcctcgtggtgggcagcgagttcgggagcccggggctcctcacctacgtcctggaggagctcgaaagagctcaaggtctttgtgtcccgacactctgccaccttctccagcattgtgaaaggccagcggagcctgcaccaccgtggagacaacctggagaccctggtcctcctgaacccatcagacaagtccctgtatgatgagctccggaaccttctgttggaccctgcctctcacaagctactggtgttggctgggccctgcctggaggagacgggggagctgctgctacagacagggggcttctcgcctcaccacttcctccaggtcctgaaggacagagagatccgggacatcctggccaccacgcccccacctgtgcagccgcccatactcaccatcacctgccccaccttcggtgactgggctcagctggcacccgctgtgcctggccttcagggggcgctccggctccagctgcggctgaaccccccggcgcagctgcccaactctgagggcctgtgcgaattcctggagtacgtggctgagtctctggagccaccgtcccccttcgagctgctggagcccccgacctccgggggcttcctcaggctgggccggccctgctgctacatcttccctggaggcctcggggatgccgccttcttcgccgtcaatggcttcactgtgctggtcaacggtggctcaaaccccaagtccagtttctggaagctggtgcggcacctggaccgcgtggatgccgtgctggtgacccaccctggcgccgacagcctccccggcctcaacagcctgctgcggcgcaaactggcggagcgctccgaggtggctgctggtgggggctcctgggacgacaggctgcgcaggctcatctcccccaacctgggggtcgtgttcttcaacgcctgcgaggccgcgtcgcggctggcgcgcggcgaggatgaggcggagctggcgctgagcctcctggcgcagctgggcatcacgcctctgccactcagccgcggccccgtgccagccaaacccaccgtgctcttcgaga

SEQ ID NO: 153934 - DNA, 891 bp, Homo sapiens
  Payload ID: 10261
  Gene Symbol: MAP1S
  Gene Name: microtubule-associated protein 1S
  ENST ID: ENST00000594365
  CDS Start-End: 197-436
ataggcgcacctgccaggttcacctgcagccacttggctcagtgggactggcgggcgtgatgcgcccgtgggtggagatgggtgttcatcccccatccctcggagcatctggacctggcgtttcattgcatgtaaaatgggacaggaacacgcacctcggttcatgtgcttgaggagtgtttagtgagcacctgctatgcgccaggcctttgggcagtggacacagggatatggccgggatgatagacaggttcagccctgccaacacaggtctggtttggggatggacccaaagcgagtgaggagatggaacaagcttccagctcacatggtgtcaggaaggatgagaaggctgcaagggactgagaggacagtcagtcttagcacccgaaggcatccggtcttgggatgtcgatcctggcgtctgcaaccttgatgaacagctcaaggtctttgtgtcccgacactctgccaccttctccagcattgtgaaaggccagcggagcctgcaccaccgtggagacaacctggagaccctggtcctcctgaacccatcagacaagtccctgtatgatgagctccggaaccttctgttggaccctgcctctcacaagctactggtgttggctgggccctgcctggaggagacgggggagctgctgctacagacagggggcttctcgcctcaccacttcctccaggtcctgaaggacagagagatccgggacatcctggccaccacgcccccacctgtgcagccgcccatactcaccatcacctgccccaccttcggtgactgggctcagctggcacccgctgtgcctggccttcagggggcgctccggctccagctgcggctgaaccccccggcgcagctgcccaactctgagg

SEQ ID NO: 153935 - DNA, 580 bp, Homo sapiens
  Payload ID: 10261
  Gene Symbol: MAP1S
  Gene Name: microtubule-associated protein 1S
  ENST ID: ENST00000597735
  CDS Start-End: 24-580
gagaacgccggggcggcccgaagatggcggcggtggctggatctggggctgccgcggctccgagctcactgctcctcgtggtgggcagcgagttcgggagcccggggctcctcacctacgtcctggaggagctcgaaagaggcatccggtcttgggatgtcgatcctggcgtctgcaaccttgatgaacagctcaaggtctttgtgtcccgacactctgccaccttctccagcattgtgaaaggccagcggagcctgcaccaccgtggagacaacctggagaccctggtcctcctgaacccatcagacaagtccctgtatgatgagctccggaaccttctgttggaccctgcctctcacaagctactggtgttggccgggcacccctgtccagaaagtcctcaacccccaagactgccactcgaggcccgtcggggtcagccagcagccggcccggggtgtcagccaccccacccaagtccccggtctacctggacctggcctacctgcccagcgggagcagcgcccacctggtggatgaggagttcttccagcgcgtgcgcgcgctctgctacgtcatc

SEQ ID NO: 153936 - DNA, 585 bp, Homo sapiens
  Payload ID: 10261
  Gene Symbol: MAP1S
  Gene Name: microtubule-associated protein 1S
  ENST ID: ENST00000594625
  CDS Start-End: 17-585
aatcaaagcttgttcaatgaaaaaaaaaatgaatgaatggtcacttgggagaggcggctcccaagcggacacccaggagtcggccaacccctttaacgcccgcatcccctgctctccacgacctcaaagggcctgcatccggtcttgggatgtcgatcctggcgtctgcaaccttgatgaacagctcaaggtctttgtgtcccgacactctgccaccttctccagcattgtgaaaggccagcggagcctgcaccaccgtggagacaacctggagaccctggtcctcctgaacccatcagacaagtccctgtatgatgagctccggaaccttctgttggaccctgcctctcacaagctactggtgttggctgggccctgcctggaggagacgggggagctgctgctacagacagggggcttctcgcctcaccacttcctccaggtcctgaaggacagagagatccgggacatcctggccaccacgcccccacctgtgcagccgcccatactcaccatcacctgccccaccttcggtgactgggctcagctggcacccgctgtgcctggccttcagggggcgctccg

SEQ ID NO: 153937 - DNA, 573 bp, Homo sapiens
  Payload ID: 10261
  Gene Symbol: MAP1S
  Gene Name: microtubule-associated protein 1S
  ENST ID: ENST00000596637
  CDS Start-End: 167-370
cacttggctcagtgggactggcgggcgtgatgcgcccgtgggtggagatgggtgttcatcccccatccctcggagcatctggacctggcgtttcattgcatgtaaaatgggacaggaacacgcacctcggttcatgtgcttgaggagtgtttagtgagcacctgctatgcgccaggcctttgggcagtggacacagggatatggccgggatgatagacaggttcagccctgccaacacaggtctggtttggggatggacccaaagcgagtgaggagatggaacaagcttccagctcacatggtgtcaggaaggatgagaaggctgcaagggactgagaggacagtcagtcttagcacccgaaggtgctgagggggaagggccccctggccagtaggaacaggcatccggtcttgggatgtcgatcctggcgtctgcaaccttgatgaacagctcaaggtctttgtgtcccgacactctgccaccttctccagcattgtgaaaggccagcggagcctgcaccaccgtggagacaacctggagaccctggtcctcctgaacccatcagacaagtc

SEQ ID NO: 153938 - DNA, 539 bp, Homo sapiens
  Payload ID: 10261
  Gene Symbol: MAP1S
  Gene Name: microtubule-associated protein 1S
  ENST ID: ENST00000600608
  CDS Start-End: 24-305
gagaacgccggggcggcccgaagatggcggcggtggctggatctggggctgccgcggctccgagctcactgctcctcgtggtgggcagcgagttcgggagcccggggctcctcacctacgtcctggaggagctcgaaagaggcatccggtcttgggatgtcgatcctggcgtctgcaaccttgatgaacagctcaaggtctttgtgtcccgacactctgccaccttctccagcattgtgaaagatgaggaaattggcattgaagggggaagaggcagggagatctctgaggagggggttttttgatgagaaactgctatgactggtgtgtccagtggaagggaagggccccagtcaagacccagcagtggacagaacatctagaatgaaccgggcgcggtggcttacgcctctgatctcagcactttgggaggccgcagcgggcggatcacttgaggccagcggagcctgcaccaccgtggagacaacctggagaccctggtcctcctgaacccatcagacaagtccctgtatgatgag

SEQ ID NO: 153939 - DNA, 587 bp, Homo sapiens
  Payload ID: 10261
  Gene Symbol: MAP1S
  Gene Name: microtubule-associated protein 1S
  ENST ID: ENST00000600186
  CDS Start-End: 24-587
gagaacgccggggcggcccgaagatggcggcggtggctggatctggggctgccgcggctccgagctcactgctcctcgtggtgggcagcgagttcgggagcccggggctcctcacctacgtcctggaggagctcgaaagaggccagcggagcctgcaccaccgtggagacaacctggagaccctggtcctcctgaacccatcagacaagtccctgtatgatgagctccggaaccttctgttggaccctgcctctcacaagctactggtgttggctgggccctgcctggaggagacgggggagctgctgctacagacagggggcttctcgcctcaccacttcctccaggtcctgaaggacagagagatccgggacatcctggccaccacgcccccacctgtgcagccgcccatactcaccatcacctgccccaccttcggtgactgggctcagctggcacccgctgtgcctggccttcagggggcgctccggctccagctgcggctgaaccccccggcgcagctgcccaactctgagggcctgtgcgaattcctggagtacgtggctgagtctctggagccaccgtcc

SEQ ID NO: 153940 - DNA, 448 bp, Homo sapiens
  Payload ID: 10261
  Gene Symbol: MAP1S
  Gene Name: microtubule-associated protein 1S
  ENST ID: ENST00000597000
  CDS Start-End: 1-363
aggtgggctccccgcactcgaccgaggtggacgagtccctgtcggtgtcctttgagcagcgcccacctggtggatgaggagttcttccagcgcgtgcgcgcgctctgctacgtcatcagtggccaggaccagcgcaaggaggaaggcatgcgggccgtcctggacgcgctactggccagcaagcagcattgggaccgtgacctgcaggtgaccctgatccccactttcgactcggtggccatgcatacgtggtacgcagagacgcacgcccggcaccaggcgctgggcatcacggtgttgggcagcaacagcatggtgtccatgcaggatgacgccttcccggcctgcaaggtggagttctagccccatcgccgacacgccccccactcagcccagcccgcctgtccctagattcagccacatcagaaataaactgtgactacacttg

SEQ ID NO: 153941 - DNA, 2241 bp, Homo sapiens
  Payload ID: 10262
  Gene Symbol: MAP2
  Gene Name: microtubule-associated protein 2
  Uniprot ID: P11137
  ENST ID: ENST00000199940
  CDS Start-End: 441-2120
ggcgctcgggctgcgcgggctctgggcagcagcagcagcagcagcagcatcctctcttcctttacttcccttccgcttctttctcttccttctccttctttttcccccccctccccttcttcccctaacccttctacccctctcctttttctccggagggcgctaagtccgtgagcggtggcagtcgcgaccgcgggtgcatccagtttctgcgcccagattttattgatctaatccaaagtatcttataacttctggctggaattaagattcttcagcttgtctctaaccgaggaagcattgattgggagctactcattcagaaaattaaaagaaagaagccagaaaatattatcaaccctttgagaacacgacacaacgaactttatattttaccacttccttgaatagttgcaggagaaataacaaggcattgaagaatggcagatgaacggaaagatgaagcaaaggcacctcactggacctcagcaccgctaacagaggcatctgcacactcacatccacctgagattaaggatcaaggcggagcaggggaaggacttgtccgaagcgccaatggattcccatacagggaggatgaagagggtgcctttggagagcatgggtcacagggcacctattcaaataccaaagagaatgggatcaacggagagctgacctcagctgacagagaaacagcagaggaggtgtctgcaaggatagttcaagtagtcactgctgaggctgtagcagtcctgaaaggtgaacaagagaaagaagctcaacataaagaccagactgcagctctgcctttagcagctgaagaaacagctaatctgcctccttctccacccccatcacctgcctcagaacagactgtcacagtggaggaagcagcaggtggggaatcagctctggctcccagtgtatttaaacaggcaaaggacaaagtctctaattctaccttgtcaaagattcctgctttacagggtagcacaaagtccccaagatacagctcagcctgccctagcacgactaaaagggctacattttctgacagtttattaatacagcccacctcagcaggctccacagaccgtttgccatactcaaaatcagggaacaaggacggagtaaccaagagcccagaaaagcgctcttctctcccaagaccttcctccattctccctcctcggcgaggtgtgtcaggagacagagatgagaattccttctctctcaacagttctatctcttcttcagcacggcggaccaccaggtcagagccaattcgcagagcagggaagagtggtacctcaacacccactacccctgggtctactgccatcactcctggcaccccaccaagttattcttcacgcacaccaggcactcctggaacccctagctatcccaggacccctcacacaccaggaacccccaagtctgccatcttggtgccgagtgagaagaaggtcgccatcatacgtactcctccaaaatctcctgcgactcccaagcagcttcggcttattaaccaaccactgccagacctgaagaatgtcaaatccaaaatcggatcaacagacaacatcaaataccagcctaaaggggggcaggttaggattttaaacaagaagatcgattttagcaaagttcagtccagatgtggttccaaggataacatcaaacattcggctgggggcggaaatgtacaaattgttaccaagaaaatagacctaagccatgtgacatccaaatgtggctctctgaagaacatccgccacaggccaggtggcggacgtgtgaaaattgagagtgtaaaactagatttcaaagaaaaggcccaagctaaagttggttctcttgataatgctcatcatgtacctggaggtggtaatgtcaagattgacagccaaaagttgaacttcagagagcatgctaaagcccgtgtggaccatggggctgagatcattacacagtccccaggcagatccagcgtggcatcaccccgacgactcagcaatgtctcctcgtctggaagcatcaacctgctcgaatctcctcagcttgccactttggctgaggatgtcactgctgcactcgctaagcagggcttgtgaatatttctcatttagcattgaaataataatatttaggcatgagctcttggcaggagtgggctctgagcagttgttatattcattctttataaaccataaaataaataatctcatccccaaa

SEQ ID NO: 153942 - DNA, 9711 bp, Homo sapiens
  Payload ID: 10262
  Gene Symbol: MAP2
  Gene Name: microtubule-associated protein 2
  Uniprot ID: P11137
  ENST ID: ENST00000360351
  CDS Start-End: 507-5990
atggcaaaccgctaaatcgtaagtgagggctgcatcctattgtcagtgaatgatggcggagctgagtggcttgtcatcattctcgaaaattctgagactagtgagctctctccctctctcccactcgccttattttcctgttcgccactgcggggacttctaatttgcagcttccctttccccggcacacacagacacgagctggtggcttgcagactgcgtctgtctggagctagagagccagagagccagcctgtggggataatgctcccggagaaggattctgcagcagttctcaaaggctagacttgagtggtattgctgcatatgcgctgattcttcagcttgtctctaaccgaggaagcattgattgggagctactcattcagaaaattaaaagaaagaagccagaaaatattatcaaccctttgagaacacgacacaacgaactttatattttaccacttccttgaatagttgcaggagaaataacaaggcattgaagaatggcagatgaacggaaagatgaagcaaaggcacctcactggacctcagcaccgctaacagaggcatctgcacactcacatccacctgagattaaggatcaaggcggagcaggggaaggacttgtccgaagcgccaatggattcccatacagggaggatgaagagggtgcctttggagagcatgggtcacagggcacctattcaaataccaaagagaatgggatcaacggagagctgacctcagctgacagagaaacagcagaggaggtgtctgcaaggatagttcaagtagtcactgctgaggctgtagcagtcctgaaaggtgaacaagagaaagaagctcaacataaagaccagactgcagctctgcctttagcagctgaagaaacagctaatctgcctccttctccacccccatcacctgcctcagaacagactgtcacagtggaggaagatttacttacagcctcgaagatggagttccacgatcaacaggaattgactccctctacagctgagccttcagaccagaaggaaaaggagtcagagaagcaaagtaagcctggtgaagaccttaaacatgctgccttagtttctcagccagagacaactaaaacttaccctgataaaaaggacatgcaaggcacggaagaagaaaaagcacccctagctttgtttgggcacactcttgttgccagcctggaagacatgaaacagaagacagaaccaagccttgtagtacctggcattgacctccctaaagagcctccaactccaaaagaacaaaaggactggttcatcgaaatgccaacggaagcaaaaaaggatgagtggggtttagttgcccccatatctcctggccctctgactcccatgagggaaaaagatgtatttgatgatatcccaaaatgggaagggaaacagtttgattctcccatgccaagtccctttcaagggggaagcttcactcttcctttagatgtcatgaagaatgaaatagttacagaaacatcgccctttgcccctgcctttttacagccagatgacaaaaaatctctgcaacaaaccagtggcccagctactgccaaagatagttttaaaattgaagagccccatgaggctaaacctgacaaaatggcagaagcaccaccctcagaggcaatgaccttacccaaagatgctcacattccagttgtagaagaacatgttatggggaaagttttagaggaagaaaaggaggccataaatcaagagactgtgcagcaaagggatactttcacccccagtggacaggaacctatacttactgaaaaggaaactgagctgaagcttgaagaaaaaaccaccatttctgacaaagaagctgtgccaaaagagagtaaacccccaaaacctgcagatgaagaaataggcataattcagacctccacagagcacactttctcagaacagaaagaccaagagcctaccacagatatgttgaaacaggactcgttccctgtaagtttggagcaagcagttacagattcagccatgacctctaaaacactggagaaagccatgaccgaaccatctgcattaattgaaaagagctcaattcaggaactttttgaaatgagagttgatgacaaagataagattgaaggagttggagctgcaacatcagctgagcttgatatgccattttatgaagataaatcaggaatgtccaagtactttgaaacatctgccttgaaagaagaagcaacaaaaagcattgagccaggcagtgattactatgaactgagtgacactagagaaagtgtccatgagtctattgataccatgtctcccatgcataaaaatggtgacaaggagtttcaaacaggaaaagaatcccagcccagtcctccagcacaagaagcagggtacagcactctcgcacagagttatccatcagatttacctgaagaacccagttctcctcaagaaagaatgttcactattgatccaaaagtgtatggagagaaaagggacctccacagtaagaataaggatgatttgacccttagcaggagtttaggacttggtggtaggtctgcaatagaacaaagaagcatgtcaatcaatttgccgatgtcttgcctagattccatagcccttggatttaactttggtcggggacatgatctttctcctctggcttccgatattctaaccaacactagtggaagtatggatgaaggggatgattaccttccagccaccacacctgcactggagaaagccccttgcttccctgtagaaagcaaagaggaagaacagatagagaaagtaaaagctactggagaagaaagtactcaagcggagatatcatgtgagtctcctttcctagccaaagatttttacaaaaatggtactgtcatggcacctgaccttcctgaaatgctagatctggcaggcacaaggtcaagattggcttctgtgagtgcagatgctgaggttgccaggaggaaatcagtcccatcagagactgtggttgaggatagtcgtactggcttgcccccggtaactgatgaaaaccatgtcattgtaaaaacggacagtcagctcgaagacctgggctactgtgtgttcaataagtacacagtcccattgccatcacctgttcaagacagtgagaatttatcaggggagagtggtaccttttacgaaggcactgatgataaagttcgaagagatttggccacagacctttcactgattgaagtgaaactggcagcagccggaagagtcaaagatgagttcagtgttgacaaagaagcatccgcgcatatctctggtgacaaatcaggactgagtaaggagtttgaccaagagaagaaagctaatgataggttggatactgtactagaaaagagtgaagaacatgctgattcaaaagaacatgccaagaaaactgaagaggctggtgatgaaatagaaacattcggattaggagtaacctatgagcaagctttggccaaagatttgtcaataccaacagatgcatcctctgagaaagcagagaagggtcttagttcagtgccagagatagctgaggtagaaccatccaaaaaggtggaacaaggtctggattttgctgtccagggtcaactagatgttaaaattagtgactttggacagatggcttcagggctaaacatagatgatagaagggcaacagagctaaaacttgaggctacacaggacatgaccccctcatccaaagcaccgcaggaggcagatgcatttatgggtgttgagtctggccacatgaaagaaggcactaaagttagtgagacagaagtcaaagagaaggtggccaagcctgacttggtgcaccaggaggctgtagacaaggaggagtcctatgaatctagtggtgagcatgaaagtctcaccatggagtccttgaaagctgatgagggcaagaaggaaacatctccagaatcatctctaattcaagatgagattgccgtcaaattgtcagtggaaataccttgcccacctgctgtttcagaggctgatttagccacagatgagagagctgatgtccagatggaatttattcaggggccaaaagaagaaagcaaagagaccccagatatatccatcacgccttctgatgttgcagagccattgcatgaaacgatcgtatctgaaccagcagagattcagagtgaggaagaagagatagaagcccagggagaatatgataaactgctcttccgctcagacacccttcagataactgacctgggtgtctcaggtgccagggaggaatttgtggagacctgcccaagtgaacacaaaggagtgattgagtctgttgtgaccatcgaggatgatttcatcactgtagtgcaaaccacaactgatgaaggggagtcagggtcccacagcgtgcgttttgcagccctagagcagcctgaggtggaaaggagaccatctcctcatgatgaagaagagtttgaagtagaagaggcagctgaagcccaggcagaacccaaagatggttccccagaggctccagcttcccctgagagagaagaggttgcactttctgaatataagacagaaacctatgacgattacaaagatgagaccaccattgacgactccatcatggacgctgacagcctctgggtggacactcaagatgatgataggagcatcatgacagaacagttagaaactattcctaaagaggagaaagctgaaaaggaagctcggagatcatctcttgagaaacatagaaaagaaaagccttttaaaaccgggagaggcagaatttccactcctgaaagaaaagtagctaaaaaggaacctagcacagtctccagagatgaagtgagaaggaaaaaagcagtttataagaaggctgaacttgctaaaaaaacagaagttcaggcccactctccctccaggaaattcattttaaaacctgctatcaaatatactagaccaactcatctctcctgtgttaagcggaaaaccacagcagcaggtggggaatcagctctggctcccagtgtatttaaacaggcaaaggacaaagtctctgacggagtaaccaagagcccagaaaagcgctcttctctcccaagaccttcctccattctccctcctcggcgaggtgtgtcaggagacagagatgagaattccttctctctcaacagttctatctcttcttcagcacggcggaccaccaggtcagagccaattcgcagagcagggaagagtggtacctcaacacccactacccctgggtctactgccatcactcctggcaccccaccaagttattcttcacgcacaccaggcactcctggaacccctagctatcccaggacccctcacacaccaggaacccccaagtctgccatcttggtgccgagtgagaagaaggtcgccatcatacgtactcctccaaaatctcctgcgactcccaagcagcttcggcttattaaccaaccactgccagacctgaagaatgtcaaatccaaaatcggatcaacagacaacatcaaataccagcctaaaggggggcaggtacaaattgttaccaagaaaatagacctaagccatgtgacatccaaatgtggctctctgaagaacatccgccacaggccaggtggcggacgtgtgaaaattgagagtgtaaaactagatttcaaagaaaaggcccaagctaaagttggttctcttgataatgctcatcatgtacctggaggtggtaatgtcaagattgacagccaaaagttgaacttcagagagcatgctaaagcccgtgtggaccatggggctgagatcattacacagtccccaggcagatccagcgtggcatcaccccgacgactcagcaatgtctcctcgtctggaagcatcaacctgctcgaatctcctcagcttgccactttggctgaggatgtcactgctgcactcgctaagcagggcttgtgaatatttctcatttagcattgaaataataatatttaggcatgagctcttggcaggagtgggctctgagcagttgttatattcattctttataaaccataaaataaataatctcatccccaaactgtagtaattgttacaattttctatttaaaaaatgaatagtacatgcagaaattgacctgatttccatttgcaacaggaagacactggctttacatgggttcaattggacaattatttttgctctgctctgttttgcatggagtattattattttaaaaattgcatttttacctttcatgtgcctgaaggctatccactacattctgaaggccttgttaaaatccaagctgctcatttcactattctgtttctgagtgagaagataaaaactgcccattgtaacttatttcaggttaaattaaaccaaggagtctgattgcaggaagggaagagcatgtaagaaataagtttttttaaagtgttattttgtataaatgggaagaaagattcaattaagttattaacatttgggacctggataattatatcagagtatgtcagtccaataaattatttaactaattaaaaaatagttgcaaagcatttgagctgtggttgaggaagtggtgtaaaagtgcatccattaggaatgatgcactttcattaggatggactcgtgtctgattagaatgtcagttgatcagctagatttgtgtccacactaccagtttcacaccccctttccatctgtttgatacagtattatagatataaatatatatatatttctctgtggccatttgtgatacttcctcatatacttgaatattatacttctttattcacagtatctgtgtctcctgcaccctttggtgttgcaattttagatatgtgaaagtagatgttagcagggttctctccctatttaaaaaaaatacattaaaaaagacaaaaaattttagcatgaagttgctttctgtaacaactcaaagccgtaaccctgttttagtgccagatacaagtctctcccgtgatgctagacaaaaaattatttttctttgctttcaccaacatggagtttgtgggggtgggtccagttatacatgaaagggtttacagattgttggtttaagattatggatttatctcatttttaatcacaggatagtttggggtttattcctattattattcatgaaaccgacttaagattttttctttatttttctttttttttccatttgctaaagttgaaagttgaaactaactataatagtttgaaacatgttttctcatttttccaaatagtatctgtttattaaattctctaatagaagatgtttgtctttcttacccaaagtaaagatcccctgatcagaaagaaaaaatacaatactttgggaagctatagctataaaacacttgagacacagatatctaaatcagtttttttccaagactccaacattgcactctgtaaagtaacacactgtgatctagtattatttatcagtagataatactgttctgactgtatatacagtctagaactcacaaatcaattagttcctctcacaaatcattcatcttagacttacaaataaggaatgaaatagtcaatggcctgattaaggcaaagagctaccaggctagatggacactttttaaaaattttatctgttctttttcttgctcagggctggtaggttggatctgaaccattaaaatcaaatggtccactaggcgtatgatctctttgagccaaatcagttcctgaatataaaggaggaaatgatgaggatgtactgaggcaacggggaagtatagaaacatccaagacaaaagccaagggatgcaaaggcagagacacaggtgctttttggtgacccagtggatatggcaaccagtgtaactgccatacaagaaaccctaggagcaaacccacaccactcattctcagctaagagattttacacaggcaaacgtgtcttaaaccatctataaatcagttattttatatgacagtcaaaaccttagaaaccttaggatcattatatctattttctgcctattaattgctgtgaggtttgatttgaccaatctgggcaatttattcatcagcttcccttgaagtgcaccagaaaatagaagaaaggtgtgtggagacttagggtattttattacatgttttcatagtcttaaatagtgattaaatttctctagaaagaagttaacagctcattagaaaagttttaacctgtgaaataagtatttttctcaacattctttaaagtttttatataagttaacactaggtaaacattctgcatactagaagtcagtttattacaaatacatgtcaaaaataaagattatacaaggcaccaaactactagatttggcattaaaacaaatgtttatttctaatcacaacaaaattataatgaataaatgttcttgctttgtatggaaatacaattctttattaaagttaacagaaaggaactgatcgtttgtaccagtaaaagagagaaacacacaggttaaatatcttcttgtggggttaaggggtagaacctatcttgccttcactctcaagataacgactcaaattaagctttttgagcaccactcttgtggggacacacatacgctgatctaggaatgaaatcttcgtggtctcaattctagatctactatgccagtttctctctggctttagcctttgagaacctgtataagaatacgtaagtaatccagagctgtgaagagtttaaaggccaacttctccagtgaactcaacctctgggtcacttgcaaccagaaattggatacctcataatgatgcaggaaagacccgagttcatgatgagtttcaaaggccacgttcatttaggaaccaactctctctggatttacctgctgagttccagcagcgtgatgggctgacatcccacctacaagtatgacacctgtgtaacaccagctaggtacggctggagaaggctgaagagagaatgccattaaatggaagaatgtactgattgtagtgaccttctccacacacacacacacacacacacacacacacacctacagtaatacagcaagcgtggaataatcagccaatatataacattccatcagtattttattaaggaaataacctgaatgtggttgattttgacatagctgcaattacagttttcttctatttttcaagccacaataaggaaaataaactactcatggtctaaatactagagataaagtagattcatggcttggtaaggaaattttaagcattccttcaaagattgacgtgctaaaataagcattgatgttttgagtttttttacacctaggatttttagcttgggtgtgtaggtgaaggccaagactctctgcaggaaaaagcttattttcaaactcagaaaataaaatgtcaatcataaaaatctacttcaactttagcaaaaagaaaaaaaaatcaacaaaaagtatactctgtatgctgggattccgaggttccaacacactgttacaaatctgtggggggtttctttcttctgataattctagagcctgttaccatagaaaggcatttcttcaatggctggttgtagttagttcatgtttttcaatcaaatttgcaaatgtatttgttgctgtatagtgattgttttgcaaaataaaattgcttgtcacctaactgcta

SEQ ID NO: 153943 - DNA, 2038 bp, Homo sapiens
  Payload ID: 10262
  Gene Symbol: MAP2
  Gene Name: microtubule-associated protein 2
  Uniprot ID: P11137
  ENST ID: ENST00000361559
  CDS Start-End: 497-1912
gctaaatcgtaagtgagggctgcatcctattgtcagtgaatgatggcggagctgagtggcttgtcatcattctcgaaaattctgagactagtgagctctctccctctctcccactcgccttattttcctgttcgccactgcggggacttctaatttgcagcttccctttccccggcacacacagacacgagctggtggcttgcagactgcgtctgtctggagctagagagccagagagccagcctgtggggataatgctcccggagaaggattctgcagcagttctcaaaggctagacttgagtggtattgctgcatatgcgctgattcttcagcttgtctctaaccgaggaagcattgattgggagctactcattcagaaaattaaaagaaagaagccagaaaatattatcaaccctttgagaacacgacacaacgaactttatattttaccacttccttgaatagttgcaggagaaataacaaggcattgaagaatggcagatgaacggaaagatgaagcaaaggcacctcactggacctcagcaccgctaacagaggcatctgcacactcacatccacctgagattaaggatcaaggcggagcaggggaaggacttgtccgaagcgccaatggattcccatacagggaggatgaagagggtgcctttggagagcatgggtcacagggcacctattcaaataccaaagagaatgggatcaacggagagctgacctcagctgacagagaaacagcagaggaggtgtctgcaaggatagttcaagtagtcactgctgaggctgtagcagtcctgaaaggtgaacaagagaaagaagctcaacataaagaccagactgcagctctgcctttagcagctgaagaaacagctaatctgcctccttctccacccccatcacctgcctcagaacagactgtcacagtggaggaagcagcaggtggggaatcagctctggctcccagtgtatttaaacaggcaaaggacaaagtctctgacggagtaaccaagagcccagaaaagcgctcttctctcccaagaccttcctccattctccctcctcggcgaggtgtgtcaggagacagagatgagaattccttctctctcaacagttctatctcttcttcagcacggcggaccaccaggtcagagccaattcgcagagcagggaagagtggtacctcaacacccactacccctgggtctactgccatcactcctggcaccccaccaagttattcttcacgcacaccaggcactcctggaacccctagctatcccaggacccctcacacaccaggaacccccaagtctgccatcttggtgccgagtgagaagaaggtcgccatcatacgtactcctccaaaatctcctgcgactcccaagcagcttcggcttattaaccaaccactgccagacctgaagaatgtcaaatccaaaatcggatcaacagacaacatcaaataccagcctaaaggggggcaggtacaaattgttaccaagaaaatagacctaagccatgtgacatccaaatgtggctctctgaagaacatccgccacaggccaggtggcggacgtgtgaaaattgagagtgtaaaactagatttcaaagaaaaggcccaagctaaagttggttctcttgataatgctcatcatgtacctggaggtggtaatgtcaagattgacagccaaaagttgaacttcagagagcatgctaaagcccgtgtggaccatggggctgagatcattacacagtccccaggcagatccagcgtggcatcaccccgacgactcagcaatgtctcctcgtctggaagcatcaacctgctcgaatctcctcagcttgccactttggctgaggatgtcactgctgcactcgctaagcagggcttgtgaatatttctcatttagcattgaaataataatatttaggcatgagctcttggcaggagtgggctctgagcagttgttatattcattctttataaaccataaaataaataatctcatccccaaactgta

SEQ ID NO: 153944 - DNA, 614 bp, Homo sapiens
  Payload ID: 10262
  Gene Symbol: MAP2
  Gene Name: microtubule-associated protein 2
  ENST ID: ENST00000392193
  CDS Start-End: 296-614
ggagaccagatgatgacattcataggctgatagactcgactcctggggacacacttggatggaggcaattaaaatgcctgtcaggcatttggtaccagaagcccctatggcaaaccgctaaatcattcttcagcttgtctctaaccgaggaagcattgattgggagctactcattcagaaaattaaaagaaagaagccagaaaatattatcaaccctttgagaacacgacacaacgaactttatattttaccacttccttgaatagttgcaggagaaataacaaggcattgaagaatggcagatgaacggaaagatgaagcaaaggcacctcactggacctcagcaccgctaacagaggcatctgcacactcacatccacctgagattaaggatcaaggcggagcaggggaaggacttgtccgaagcgccaatggattcccatacagggaggatgaagagggtgcctttggagagcatgggtcacagggcacctattcaaataccaaagagaatgggatcaacggagagctgacctcagctgacagagaaacagcagaggaggtgtctgcaaggatagttcaagtagtcactgctgaggctgtagcagtcctga

SEQ ID NO: 153945 - DNA, 5303 bp, Homo sapiens
  Payload ID: 10262
  Gene Symbol: MAP2
  Gene Name: microtubule-associated protein 2
  Uniprot ID: P11137
  ENST ID: ENST00000392194
  CDS Start-End: 167-1582
tcagcttgtctctaaccgaggaagcattgattgggagctactcattcagaaaattaaaagaaagaagccagaaaatattatcaaccctttgagaacacgacacaacgaactttatattttaccacttccttgaatagttgcaggagaaataacaaggcattgaagaatggcagatgaacggaaagatgaagcaaaggcacctcactggacctcagcaccgctaacagaggcatctgcacactcacatccacctgagattaaggatcaaggcggagcaggggaaggacttgtccgaagcgccaatggattcccatacagggaggatgaagagggtgcctttggagagcatgggtcacagggcacctattcaaataccaaagagaatgggatcaacggagagctgacctcagctgacagagaaacagcagaggaggtgtctgcaaggatagttcaagtagtcactgctgaggctgtagcagtcctgaaaggtgaacaagagaaagaagctcaacataaagaccagactgcagctctgcctttagcagctgaagaaacagctaatctgcctccttctccacccccatcacctgcctcagaacagactgtcacagtggaggaagcagcaggtggggaatcagctctggctcccagtgtatttaaacaggcaaaggacaaagtctctgacggagtaaccaagagcccagaaaagcgctcttctctcccaagaccttcctccattctccctcctcggcgaggtgtgtcaggagacagagatgagaattccttctctctcaacagttctatctcttcttcagcacggcggaccaccaggtcagagccaattcgcagagcagggaagagtggtacctcaacacccactacccctgggtctactgccatcactcctggcaccccaccaagttattcttcacgcacaccaggcactcctggaacccctagctatcccaggacccctcacacaccaggaacccccaagtctgccatcttggtgccgagtgagaagaaggtcgccatcatacgtactcctccaaaatctcctgcgactcccaagcagcttcggcttattaaccaaccactgccagacctgaagaatgtcaaatccaaaatcggatcaacagacaacatcaaataccagcctaaaggggggcaggtacaaattgttaccaagaaaatagacctaagccatgtgacatccaaatgtggctctctgaagaacatccgccacaggccaggtggcggacgtgtgaaaattgagagtgtaaaactagatttcaaagaaaaggcccaagctaaagttggttctcttgataatgctcatcatgtacctggaggtggtaatgtcaagattgacagccaaaagttgaacttcagagagcatgctaaagcccgtgtggaccatggggctgagatcattacacagtccccaggcagatccagcgtggcatcaccccgacgactcagcaatgtctcctcgtctggaagcatcaacctgctcgaatctcctcagcttgccactttggctgaggatgtcactgctgcactcgctaagcagggcttgtgaatatttctcatttagcattgaaataataatatttaggcatgagctcttggcaggagtgggctctgagcagttgttatattcattctttataaaccataaaataaataatctcatccccaaactgtagtaattgttacaattttctatttaaaaaatgaatagtacatgcagaaattgacctgatttccatttgcaacaggaagacactggctttacatgggttcaattggacaattatttttgctctgctctgttttgcatggagtattattattttaaaaattgcatttttacctttcatgtgcctgaaggctatccactacattctgaaggccttgttaaaatccaagctgctcatttcactattctgtttctgagtgagaagataaaaactgcccattgtaacttatttcaggttaaattaaaccaaggagtctgattgcaggaagggaagagcatgtaagaaataagtttttttaaagtgttattttgtataaatgggaagaaagattcaattaagttattaacatttgggacctggataattatatcagagtatgtcagtccaataaattatttaactaattaaaaaatagttgcaaagcatttgagctgtggttgaggaagtggtgtaaaagtgcatccattaggaatgatgcactttcattaggatggactcgtgtctgattagaatgtcagttgatcagctagatttgtgtccacactaccagtttcacaccccctttccatctgtttgatacagtattatagatataaatatatatatatttctctgtggccatttgtgatacttcctcatatacttgaatattatacttctttattcacagtatctgtgtctcctgcaccctttggtgttgcaattttagatatgtgaaagtagatgttagcagggttctctccctatttaaaaaaaatacattaaaaaagacaaaaaattttagcatgaagttgctttctgtaacaactcaaagccgtaaccctgttttagtgccagatacaagtctctcccgtgatgctagacaaaaaattatttttctttgctttcaccaacatggagtttgtgggggtgggtccagttatacatgaaagggtttacagattgttggtttaagattatggatttatctcatttttaatcacaggatagtttggggtttattcctattattattcatgaaaccgacttaagattttttctttatttttctttttttttccatttgctaaagttgaaagttgaaactaactataatagtttgaaacatgttttctcatttttccaaatagtatctgtttattaaattctctaatagaagatgtttgtctttcttacccaaagtaaagatcccctgatcagaaagaaaaaatacaatactttgggaagctatagctataaaacacttgagacacagatatctaaatcagtttttttccaagactccaacattgcactctgtaaagtaacacactgtgatctagtattatttatcagtagataatactgttctgactgtatatacagtctagaactcacaaatcaattagttcctctcacaaatcattcatcttagacttacaaataaggaatgaaatagtcaatggcctgattaaggcaaagagctaccaggctagatggacactttttaaaaattttatctgttctttttcttgctcagggctggtaggttggatctgaaccattaaaatcaaatggtccactaggcgtatgatctctttgagccaaatcagttcctgaatataaaggaggaaatgatgaggatgtactgaggcaacggggaagtatagaaacatccaagacaaaagccaagggatgcaaaggcagagacacaggtgctttttggtgacccagtggatatggcaaccagtgtaactgccatacaagaaaccctaggagcaaacccacaccactcattctcagctaagagattttacacaggcaaacgtgtcttaaaccatctataaatcagttattttatatgacagtcaaaaccttagaaaccttaggatcattatatctattttctgcctattaattgctgtgaggtttgatttgaccaatctgggcaatttattcatcagcttcccttgaagtgcaccagaaaatagaagaaaggtgtgtggagacttagggtattttattacatgttttcatagtcttaaatagtgattaaatttctctagaaagaagttaacagctcattagaaaagttttaacctgtgaaataagtatttttctcaacattctttaaagtttttatataagttaacactaggtaaacattctgcatactagaagtcagtttattacaaatacatgtcaaaaataaagattatacaaggcaccaaactactagatttggcattaaaacaaatgtttatttctaatcacaacaaaattataatgaataaatgttcttgctttgtatggaaatacaattctttattaaagttaacagaaaggaactgatcgtttgtaccagtaaaagagagaaacacacaggttaaatatcttcttgtggggttaaggggtagaacctatcttgccttcactctcaagataacgactcaaattaagctttttgagcaccactcttgtggggacacacatacgctgatctaggaatgaaatcttcgtggtctcaattctagatctactatgccagtttctctctggctttagcctttgagaacctgtataagaatacgtaagtaatccagagctgtgaagagtttaaaggccaacttctccagtgaactcaacctctgggtcacttgcaaccagaaattggatacctcataatgatgcaggaaagacccgagttcatgatgagtttcaaaggccacgttcatttaggaaccaactctctctggatttacctgctgagttccagcagcgtgatgggctgacatcccacctacaagtatgacacctgtgtaacaccagctaggtacggctggagaaggctgaagagagaatgccattaaatggaagaatgtactgattgtagtgaccttctccacacacacacacacacacacacacacacacacctacagtaatacagcaagcgtggaataatcagccaatatataacattccatcagtattttattaaggaaataacctgaatgtggttgattttgacatagctgcaattacagttttcttctatttttcaagccacaataaggaaaataaactactcatggtctaaatactagagataaagtagattcatggcttggtaaggaaattttaagcattccttcaaagattgacgtgctaaaataagcattgatgttttgagtttttttacacctaggatttttagcttgggtgtgtaggtgaaggccaagactctctgcaggaaaaagcttattttcaaactcagaaaataaaatgtcaatcataaaaatctacttcaactttagcaaaaagaaaaaaaaatcaacaaaaagtatactctgtatgctgggattccgaggttccaacacactgttacaaatctgtggggggtttctttcttctgataattctagagcctgttaccatagaaaggcatttcttcaatggctggttgtagttagttcatgtttttcaatcaaatttgcaaatgtatttgttgctgtatagtgattgttttgcaaaataaaattgcttgtcacctaactgcta

SEQ ID NO: 153946 - DNA, 624 bp, Homo sapiens
  Payload ID: 10262
  Gene Symbol: MAP2
  Gene Name: microtubule-associated protein 2
  ENST ID: ENST00000452717
  CDS Start-End: 1-624
atcaacggagagctgacctcagctgacagagaaacagcagaggaggtgtctgcaaggatagttcaagtagtcactgctgaggctgtagcagtcctgaaaggtgaacaagagaaagaagctcaacataaagaccagactgcagctctgcctttagcagctgaagaaacagctaatctgcctccttctccacccccatcacctgcctcagaacagactgtcacagtggaggaagcagcaggtggggaatcagctctggctcccagtgtatttaaacaggcaaaggacaaagtctctggtgtccatgtgcaggcttgttacaagggtatattacgtgatgctgagaattctaccttgtcaaagattcctgctttacagggtagcacaaagtccccaagatacagctcagcctgccctagcacgactaaaagggctacattttctgacagtttattaatacagcccacctcagcaggctccacagaccgtttgccatactcaaaatcagggaacaaggacggagtaaccaagagcccagaaaagcgctcttctctcccaagaccttcctccattctccctcctcggcgaggtgtgtcaggagacagagatgagaattccttctctctc

SEQ ID NO: 153947 - DNA, 5472 bp, Homo sapiens
  Payload ID: 10262
  Gene Symbol: MAP2
  Gene Name: microtubule-associated protein 2
  Uniprot ID: P11137
  ENST ID: ENST00000447185
  CDS Start-End: 1-5472
atggcagatgaacggaaagatgaagcaaaggcacctcactggacctcagcaccgctaacagaggcatctgcacactcacatccacctgagattaaggatcaaggcggagcaggggaaggacttgtccgaagcgccaatggattcccatacagggaggatgaagagggtgcctttggagagcatgggtcacagggcacctattcaaataccaaagagaatgggatcaacggagagctgacctcagctgacagagaaacagcagaggaggtgtctgcaaggatagttcaagtagtcactgctgaggctgtagcagtcctgaaaggtgaacaagagaaagaagctcaacataaagaccagactgcagctctgcctttagcagctgaagaaacagctaatctgcctccttctccacccccatcacctgcctcagaacagactgtcacagtggaggaagcctcgaagatggagttccacgatcaacaggaattgactccctctacagctgagccttcagaccagaaggaaaaggagtcagagaagcaaagtaagcctggtgaagaccttaaacatgctgccttagtttctcagccagagacaactaaaacttaccctgataaaaaggacatgcaaggcacggaagaagaaaaagcacccctagctttgtttgggcacactcttgttgccagcctggaagacatgaaacagaagacagaaccaagccttgtagtacctggcattgacctccctaaagagcctccaactccaaaagaacaaaaggactggttcatcgaaatgccaacggaagcaaaaaaggatgagtggggtttagttgcccccatatctcctggccctctgactcccatgagggaaaaagatgtatttgatgatatcccaaaatgggaagggaaacagtttgattctcccatgccaagtccctttcaagggggaagcttcactcttcctttagatgtcatgaagaatgaaatagttacagaaacatcgccctttgcccctgcctttttacagccagatgacaaaaaatctctgcaacaaaccagtggcccagctactgccaaagatagttttaaaattgaagagccccatgaggctaaacctgacaaaatggcagaagcaccaccctcagaggcaatgaccttacccaaagatgctcacattccagttgtagaagaacatgttatggggaaagttttagaggaagaaaaggaggccataaatcaagagactgtgcagcaaagggatactttcacccccagtggacaggaacctatacttactgaaaaggaaactgagctgaagcttgaagaaaaaaccaccatttctgacaaagaagctgtgccaaaagagagtaaacccccaaaacctgcagatgaagaaataggcataattcagacctccacagagcacactttctcagaacagaaagaccaagagcctaccacagatatgttgaaacaggactcgttccctgtaagtttggagcaagcagttacagattcagccatgacctctaaaacactggagaaagccatgaccgaaccatctgcattaattgaaaagagctcaattcaggaactttttgaaatgagagttgatgacaaagataagattgaaggagttggagctgcaacatcagctgagcttgatatgccattttatgaagataaatcaggaatgtccaagtactttgaaacatctgccttgaaagaagaagcaacaaaaagcattgagccaggcagtgattactatgaactgagtgacactagagaaagtgtccatgagtctattgataccatgtctcccatgcataaaaatggtgacaaggagtttcaaacaggaaaagaatcccagcccagtcctccagcacaagaagcagggtacagcactctcgcacagagttatccatcagatttacctgaagaacccagttctcctcaagaaagaatgttcactattgatccaaaagtgtatggagagaaaagggacctccacagtaagaataaggatgatttgacccttagcaggagtttaggacttggtggtaggtctgcaatagaacaaagaagcatgtcaatcaatttgccgatgtcttgcctagattccatagcccttggatttaactttggtcggggacatgatctttctcctctggcttccgatattctaaccaacactagtggaagtatggatgaaggggatgattaccttccagccaccacacctgcactggagaaagccccttgcttccctgtagaaagcaaagaggaagaacagatagagaaagtaaaagctactggagaagaaagtactcaagcggagatatcatgtgagtctcctttcctagccaaagatttttacaaaaatggtactgtcatggcacctgaccttcctgaaatgctagatctggcaggcacaaggtcaagattggcttctgtgagtgcagatgctgaggttgccaggaggaaatcagtcccatcagagactgtggttgaggatagtcgtactggcttgcccccggtaactgatgaaaaccatgtcattgtaaaaacggacagtcagctcgaagacctgggctactgtgtgttcaataagtacacagtcccattgccatcacctgttcaagacagtgagaatttatcaggggagagtggtaccttttacgaaggcactgatgataaagttcgaagagatttggccacagacctttcactgattgaagtgaaactggcagcagccggaagagtcaaagatgagttcagtgttgacaaagaagcatccgcgcatatctctggtgacaaatcaggactgagtaaggagtttgaccaagagaagaaagctaatgataggttggatactgtactagaaaagagtgaagaacatgctgattcaaaagaacatgccaagaaaactgaagaggctggtgatgaaatagaaacattcggattaggagtaacctatgagcaagctttggccaaagatttgtcaataccaacagatgcatcctctgagaaagcagagaagggtcttagttcagtgccagagatagctgaggtagaaccatccaaaaaggtggaacaaggtctggattttgctgtccagggtcaactagatgttaaaattagtgactttggacagatggcttcagggctaaacatagatgatagaagggcaacagagctaaaacttgaggctacacaggacatgaccccctcatccaaagcaccgcaggaggcagatgcatttatgggtgttgagtctggccacatgaaagaaggcactaaagttagtgagacagaagtcaaagagaaggtggccaagcctgacttggtgcaccaggaggctgtagacaaggaggagtcctatgaatctagtggtgagcatgaaagtctcaccatggagtccttgaaagctgatgagggcaagaaggaaacatctccagaatcatctctaattcaagatgagattgccgtcaaattgtcagtggaaataccttgcccacctgctgtttcagaggctgatttagccacagatgagagagctgatgtccagatggaatttattcaggggccaaaagaagaaagcaaagagaccccagatatatccatcacgccttctgatgttgcagagccattgcatgaaacgatcgtatctgaaccagcagagattcagagtgaggaagaagagatagaagcccagggagaatatgataaactgctcttccgctcagacacccttcagataactgacctgggtgtctcaggtgccagggaggaatttgtggagacctgcccaagtgaacacaaaggagtgattgagtctgttgtgaccatcgaggatgatttcatcactgtagtgcaaaccacaactgatgaaggggagtcagggtcccacagcgtgcgttttgcagccctagagcagcctgaggtggaaaggagaccatctcctcatgatgaagaagagtttgaagtagaagaggcagctgaagcccaggcagaacccaaagatggttccccagaggctccagcttcccctgagagagaagaggttgcactttctgaatataagacagaaacctatgacgattacaaagatgagaccaccattgacgactccatcatggacgctgacagcctctgggtggacactcaagatgatgataggagcatcatgacagaacagttagaaactattcctaaagaggagaaagctgaaaaggaagctcggagatcatctcttgagaaacatagaaaagaaaagccttttaaaaccgggagaggcagaatttccactcctgaaagaaaagtagctaaaaaggaacctagcacagtctccagagatgaagtgagaaggaaaaaagcagtttataagaaggctgaacttgctaaaaaaacagaagttcaggcccactctccctccaggaaattcattttaaaacctgctatcaaatatactagaccaactcatctctcctgtgttaagcggaaaaccacagcagcaggtggggaatcagctctggctcccagtgtatttaaacaggcaaaggacaaagtctctgacggagtaaccaagagcccagaaaagcgctcttctctcccaagaccttcctccattctccctcctcggcgaggtgtgtcaggagacagagatgagaattccttctctctcaacagttctatctcttcttcagcacggcggaccaccaggtcagagccaattcgcagagcagggaagagtggtacctcaacacccactacccctgggtctactgccatcactcctggcaccccaccaagttattcttcacgcacaccaggcactcctggaacccctagctatcccaggacccctcacacaccaggaacccccaagtctgccatcttggtgccgagtgagaagaaggtcgccatcatacgtactcctccaaaatctcctgcgactcccaagcagcttcggcttattaaccaaccactgccagacctgaagaatgtcaaatccaaaatcggatcaacagacaacatcaaataccagcctaaaggggggcaggtacaaattgttaccaagaaaatagacctaagccatgtgacatccaaatgtggctctctgaagaacatccgccacaggccaggtggcggacgtgtgaaaattgagagtgtaaaactagatttcaaagaaaaggcccaagctaaagttggttctcttgataatgctcatcatgtacctggaggtggtaatgtcaagattgacagccaaaagttgaacttcagagagcatgctaaagcccgtgtggaccatggggctgagatcattacacagtccccaggcagatccagcgtggcatcaccccgacgactcagcaatgtctcctcgtctggaagcatcaacctgctcgaatctcctcagcttgccactttggctgaggatgtcactgctgcactcgctaagcagggcttgtga

SEQ ID NO: 153948 - DNA, 2019 bp, Homo sapiens
  Payload ID: 10262
  Gene Symbol: MAP2
  Gene Name: microtubule-associated protein 2
  ENST ID: ENST00000445941
  CDS Start-End: 319-2019
acacagacacgagctggtggcttgcagactgcgtctgtctggagctagagagccagagagccagcctgtggggataatgctcccggagaaggattctgcagcagttctcaaaggctagacttgagtggtattgctgcatatgcgctgattcttcagcttgtctctaaccgaggaagcattgattgggagctactcattcagaaaattaaaagaaagaagccagaaaatattatcaaccctttgagaacacgacacaacgaactttatattttaccacttccttgaatagttgcaggagaaataacaaggcattgaagaatggcagatgaacggaaagatgaagcaaaggcacctcactggacctcagcaccgctaacagaggcatctgcacactcacatccacctgagattaaggatcaaggcggagcaggggaaggacttgtccgaagcgccaatggattcccatacagggaggatgaagagggtgcctttggagagcatgggtcacagggcacctattcaaataccaaagagaatgggatcaacggagagctgacctcagctgacagagaaacagcagaggaggtgtctgcaaggatagttcaagtagtcactgctgaggctgtagcagtcctgaaaggtgaacaagagaaagaagctcaacataaagaccagactgcagctctgcctttagcagctgaagaaacagctaatctgcctccttctccacccccatcacctgcctcagaacagactgtcacagtggaggaagaagaagaaacgctagagagtcggatggctgaggaagagaaacctgctgctcttcctgagaaagagtgtggggctgctaagtcctcagaccaacccaagggcctcagtaagggccaaatggagtctagtgcggaggcccaaatagttcccgaagagagtgccccagcaggggccccacatgagaaaagtgtaaaagaggtcaaggaggtgtctccagaagtaaaaaccccttcctctgctggggaagatttacttacagcctcgaagatggagttccacgatcaacaggaattgactccctctacagctgagccttcagaccagaaggaaaaggagtcagagaagcaaagtaagcctggtgaagaccttaaacatgctgccttagtttctcagccagagacaactaaaacttaccctgataaaaaggacatgcaaggcacggaagaagaaaaagcacccctagctttgtttgggcacactcttgttgccagcctggaagacatgaaacagaagacagaaccaagccttgtagtacctggcattgacctccctaaagagcctccaactccaaaagaacaaaaggactggttcatcgaaatgccaacggaagcaaaaaaggatgagtggggtttagttgcccccatatctcctggccctctgactcccatgagggaaaaagatgtatttgatgatatcccaaaatgggaagggaaacagtttgattctcccatgccaagtccctttcaagggggaagcttcactcttcctttagatgtcatgaagaatgaaatagttacagaaacatcgccctttgcccctgcctttttacagccagatgacaaaaaatctctgcaacaaaccagtggcccagctactgccaaagatagttttaaaattgaagagccccatgaggctaaacctgacaaaatggcagaagcaccaccctcagaggcaatgaccttacccaaagatgctcacattccagttgtagaagaacatgttatggggaaagttttagaggaagaaaaggaggccataaatcaagagactgtgcagcaaagggatactttcacccccagtggacaggaacctatacttactgaaaaggaaactgagctgaagcttgaagaaaaaaccaccatttctgacaaagaagctgtgccaaaagagagtaaacccccaaaacctgcagatgaagaaataggcataattcagacctccacagagcacactttctcagaacagaaa

SEQ ID NO: 153949 - DNA, 1564 bp, Homo sapiens
  Payload ID: 10263
  Gene Symbol: MAP4
  Gene Name: microtubule-associated protein 4
  ENST ID: ENST00000335271
  CDS Start-End: 1-1392
atctgtgaggaaccagtggccaagaagagagaagaattggctcacttcagcaacagcagcagcaactctgggaagaaggaactcggcactgctggattatatctccatagtaagctggagcagattcctgaaggaagcagcaaggaaaaagggcaggaagattttagtgaaactagaattgattcatgctcgcaggtttgccagcgaggagagaaacagccaggacagacggctctggcagggaagaaagaaattgaggtcactgcaacccagagcactccatcgttcctgtttgaaaagcccccacgtgatggaatagccaggccagaagaaggaaggcctgtggtgagtgggacaggaaatgacatcaccaccccaccgaacaaggagctcccaccaagcccagagaagaaaacaaagcccattgcagatgcaaaggctcctgagaagcgggcctcaccatccaagccagcttctgccccagcctccagatctgggtccaagagcactcagactgttgcaaaaaccacaacagctgctgctgttgcctcaactggcccaagcagtaggagcccctccacgctcctgcccaagaagcccactgccattaagactgagggaaaacctgcagaagtcaagaagatgactgcaaagtctgtaccagctgacttgagtcgcccaaagagcacctccaccagttccatgaagaaaaccaccactctcagtgggacagcccccgctgcaggggtggttcccagccgagtcaaggccacacccatgccctcccggccctccacaactcctttcatagacaagaagcccacctcggccaaacccagctccaccaccccccggctcagccgcctggccaccaatacttctgctcctgatctgaagaatgtccgctccaaggttggctccacggaaaacatcaagcatcagcctggaggaggccgggtccagatagtctccaaaaaagtgagctacagccatattcagtccaagtgtggttccaaggacaatattaagcatgtccctggaggtggtaatgttcagattcagaacaagaaagtggacatctctaaggtctcctccaagtgtgggtctaaggctaacatcaagcacaagcctggtggaggagatgtcaagattgaaagtcagaagttgaacttcaaggagaaggcccaggccaaggtgggatccctcgataatgtgggccacctacctgcaggaggtgctgtgaagattgagacctacaggctgacgttccgggcaaatgccagggcccgcaccgaccacggggccgacattgtctcccgccccccacacttccctggcggccccaactcgggctcccgggtccttggccccctttcccgggctgtccactagaccagtgagcgcttgggcgccgtgctgggcagcccgctaggctcgccttccctcctgctttgcgtgcccggggcagcagcagccctgccccacacctcctctcactccccagcctgggcccatctccctgctttggtcttgccccatcactgcgccactgctccgtggagga

SEQ ID NO: 153950 - DNA, 5142 bp, Homo sapiens
  Payload ID: 10263
  Gene Symbol: MAP4
  Gene Name: microtubule-associated protein 4
  Uniprot ID: P27816
  ENST ID: ENST00000360240
  CDS Start-End: 520-3978
acccgctggtggcccggtccgcgtgtgcgccgactctcgcactctcctcgctccgggcgcccagactctgagagagagcgacggccatcatagaacagcgaaggcagtcgatcggcctgcggtccgcttcggcattcgcaggccgcaggcgggaggctagagcccccaggcgcacctcgccccaaccgcccgcggctcgggcagctctgcagagacgtcgtggcggcagggccagcacccattggtccgccacagccctccgccctccccctcgccacgcttattggccggagcggcggcgctcgccgggtaggcggtggcggcgtccctcccttgcgccggccctcaagaggcgacgaggaagcggccgcctccctgcgccccgcccctccggctagctcgctggctcccggctcctcccgacgtctcctacctcctcacggctcttcccggcgctctcctggctcccttctgccccagctccgtctcggcggcggcgggcagttgcagtggtgcagaatggctgacctcagtcttgcagatgcattaacagaaccatctccagacattgagggagagataaagcgggacttcattgccacactagaggcagaggcctttgatgatgttgtgggagaaactgttggaaaaacagactatattcctctcctggatgttgatgagaaaaccgggaactcagagtcaaagaagaaaccgtgctcagaaactagccagattgaagatactccatcttctaaaccaacactcctagccaatggtggtcatggagtagaagggagcgatactacagggtctccaactgaattccttgaagagaaaatggcctaccaggaatacccaaatagccagaactggccagaagataccaacttttgtttccaacctgagcaagtggtcgatcctatccagactgatccctttaagatgtaccatgatgatgacctggcagatttggtctttccctccagtgcgacagctgatacttcaatatttgcaggacaaaatgatcccttgaaagacagttacggtatgtctccctgcaacacagctgttgtacctcaggggtggtctgtggaagccttaaactctccacactcagagtcctttgtttccccagaggctgttgcagaacctcctcagccaacggcagttcccttagagctagccaaggagatagaaatggcatcagaagagaggccaccagcacaagcattggaaataatgatgggactgaagactactgacatggcaccatctaaagaaacagagatggccctcgccaaggacatggcactagctacaaaaaccgaggtggcattggctaaagatatggaatcacccaccaaattagatgtgacactggccaaggacatgcagccatccatggaatcagatatggccctagtcaaggacatggaactacccacagaaaaagaagtggccctggttaaggatgtcagatggcccacagaaacagatgtatcttcagccaagaatgtggtactgcccacagaaacagaggtagccccagccaaggatgtgacactgttgaaagaaacagagagggcatctcctataaaaatggacttagccccttccaaggacatgggaccacccaaagaaaacaagaaagaaacagagagggcatctcctataaaaatggacttggctccttccaaggacatgggaccacccaaagaaaacaagatagtcccagccaaggatttggtattactctcagaaatagaggtggcacaggctaatgacattatatcatccacagaaatatcctctgctgagaaggtggctttgtcctcagaaacagaggtagccctggccagggacatgacactgcccccggaaaccaacgtgatcttgaccaaggataaagcactacctttagaagcagaggtggccccagtcaaggacatggctcaactcccagaaacagaaatagccccggccaaggatgtggctccgtccacagtaaaagaagtgggcttgttgaaggacatgtctccactatcagaaacagaaatggctctgggcaaggatgtgactccacctccagaaacagaagtagttctcatcaagaacgtatgtctgcctccagaaatggaggtggccctgactgaggatcaggtcccagccctcaaaacagaagcacccctggctaaggatggggttctgaccctggccaacaatgtgactccagccaaagatgttccaccactctcagaaacagaggcaacaccagttccaattaaagacatggaaattgcacaaacacaaaaaggaataagtgaggattcccatttagaatctctgcaggatgtggggcagtcagctgcacctactttcatgatttcaccagaaaccgtcacaggaacggggaaaaagtgcagcttgccggccgaggaggattctgtgttagaaaaactaggggaaaggaaaccatgcaacagtcaaccttctgagctttcttcagagacctcaggaatagccaggccagaagaaggaaggcctgtggtgagtgggacaggaaatgacatcaccaccccaccgaacaaggagctcccaccaagcccagagaagaaaacaaagcctttggccaccactcaacctgcaaagacttcaacatcgaaagccaaaacacagcccacttctctccctaagcagccagctcccaccaccattggtgggttgaataaaaaacccatgagccttgcttcaggcttagtgccagctgccccacccaaacgccctgccgtcgcctctgccaggccttccatcttaccttcaaaagacgtgaagccaaagcccattgcagatgcaaaggctcctgagaagcgggcctcaccatccaagccagcttctgccccagcctccagatctgggtccaagagcactcagactgttgcaaaaaccacaacagctgctgctgttgcctcaactggcccaagcagtaggagcccctccacgctcctgcccaagaagcccactgccattaagactgagggaaaacctgcagaagtcaagaagatgactgcaaagtctgtaccagctgacttgagtcgcccaaagagcacctccaccagttccatgaagaaaaccaccactctcagtgggacagcccccgctgcaggggtggttcccagccgagtcaaggccacacccatgccctcccggccctccacaactcctttcatagacaagaagcccacctcggccaaacccagctccaccaccccccggctcagccgcctggccaccaatacttctgctcctgatctgaagaatgtccgctccaaggttggctccacggaaaacatcaagcatcagcctggaggaggccgggccaaagtagagaaaaaaacagaggcagctgctacaacccgaaagcctgaatctaatgcagtcactaaaacagccggcccaattgcaagtgcacagaaacaacctgcggggaaagtccagatagtctccaaaaaagtgagctacagccatattcagtccaagtgtggttccaaggacaatattaagcatgtccctggaggtggtaatgttcagattcagaacaagaaagtggacatctctaaggtctcctccaagtgtgggtctaaggctaacatcaagcacaagcctggtggaggagatgtcaagattgaaagtcagaagttgaacttcaaggagaaggcccaggccaaggtgggatccctcgataatgtgggccacctacctgcaggaggtgctgtgaagactgagggcggtggcagcgaggctcctctgtgtccgggtccccctgctggggaggagccggccatctctgaggcagcgcctgaagctggcgcccccacttcagccagtggcctcaatggccaccccaccctgtcagggggtggtgaccaaagggaggcccagaccttggacagccagatccaggagacaagcatctaatgatgacattctggtctcgtcttccgtctcccccgtgttcccctcttgtctcccctgttcccctctcccttccctcctcccatgtcactgcagattgagacctacaggctgacgttccgggcaaatgccagggcccgcaccgaccacggggccgacattgtctcccgccccccacacttccctggcggccccaactcgggctcccgggtccttggccccctttcccgggctgtccactagaccagtgagcgcttgggcgccgtgctgggcagcccgctaggctcgccttccctcctgctttgcgtgcccggggcagcagcagccctgccccacacctcctctcactccccagcctgggcccatctccctgctttggtcttgccccatcactgcgccactgctccgtggaggaggttgggagggggttggggtggttgaggctaagttgggatctaggagaggagaaccagattctatcctcatctttttttggttctttggtccaaacccaaaagaaactgacatgccctcccttctccctggatctacctggagggaagagtggaggtggattccgagtggtgacaggacgctgaccgtggagcttaagccactgcctctccctctggtcccacaaatgggcgcccccccctccccatgcaggtggtgtcgggcccttcttgctgccctgccccaagttgggggtcagtgctgcctgtccccatgcttaacatacccgcctagctgctgtcacatttttcttgttttgtccttttatttttttctaataacctaaaaactggcaaaatagttctgcaggttgaagccatgtctacatgaaagtcctcagtaagtgttagagggaacagggcggagatatccttatgccacccccgctggaggatgtgggcagcttagggccctggaggcggtgcggcagggaagaggggtgcagaggctgtggctggtgagccggtcaggcacacaaggggcccttggagcgtggactggttggttttgccattttgttgtgtgtatgctgcttttcttttctaaccaagaggctggttttggcatctctgtcccattccctgggatctggtggtcagccctaggataaaaagccagggctggagaacaagaaagggccaggagatggaattc

SEQ ID NO: 153951 - DNA, 2282 bp, Homo sapiens
  Payload ID: 10263
  Gene Symbol: MAP4
  Gene Name: microtubule-associated protein 4
  ENST ID: ENST00000383736
  CDS Start-End: 1-2282
aagacagatgcagccaatagatacactgcagtggctgacaaaccaagtaaaaggagtaatgatggaaaaagtaaaaaggttaaaaatagttctcctgagaagcacattctggagaataagatagatgcaacaaaaatacatgttcccatggaaaccacaggggaccagggaattgaaggaatggcctatatggacgaaaatagaaatattacatttacctgtcccagaacaccatcagagctgataaataaatcatctcctctagaggttctggaatcagcagcctgtgaaaaactgcccactcctactcctcaagtagtaaaggaaggtgattcctttccagataccttggcaaaaaatgggcaagagatagccccagcccagatttccaaatcattaatggtagataactacaccaaagatggagtcccaggtcaagaaagacccaagggtccctctgctgttgtgccctctacaagcacaggaggagttgctctacctattacaacagccatagaaacagttaacattcatggagatcactctcttaagaataaagctgagcttgctgattccatgaaaaatgaagcagggatcgatgaagggcatgtgataggagaatctgagtcagtgcacagtggtgcgtctaagcattcagtagagaaagtcacagagctagcaaaaggtcacctccttcctggagtgccagtagaagaccagagcctaccaggagaggccagagccctagaaggatatgcagatagaggtaatttcccagcacatccagtgaatgaagagaaagagactaaagaagggtctgttgcagttcagattcctgacttactggaagacaaagcacaaaagctcagtttttgtgaggaccaaaatgctcaagatagaaattccaaaggttcagatagtttgaataagaaggtagatctgactcttttgtctccaaaaagtgaaaatgataaattgaaagaaattagtctggcttgtaaaatcacggaattggaaagcgtttccttgccaacaccagaaatccagtcagatttcttacatagcaaagtcgaagctcctccttcagaggtggcggatacgttagtaataatgactgcttccaagggtgttcgactcccagaacccaaagataagattttggagacacctcagaaaatgacagaaaaatctgaatcaaagacaccaggagaagggaaaaaggaagataaaagcagaatggcagaaccaatgaaaggctacatgagacccaccaagtcccgaggacttactccacttttgccaaagtctacaatccaggaacaagagagacataagcaactgaagtccgctggaatagccaggccagaagaaggaaggcctgtggtgagtgggacaggaaatgacatcaccaccccaccgaacaaggagctcccaccaagcccagagaagaaaacaaagcctttggccaccactcaacctgcaaagacttcaacatcgaaagccaaaacacagcccacttctctccctaagcagccagctcccaccaccattggtgggttgaataaaaaacccatgagccttgcttcaggcttagtgccagctgccccacccaaacgccctgccgtcgcctctgccaggccttccatcttaccttcaaaagacgtgaagccaaagcccattgcagatgcaaaggctcctgagaagcgggcctcaccatccaagccagcttctgccccagcctccagatctgggtccaagagcactcagactgttgcaaaaaccacaacagctgctgctgttgcctcaactggcccaagcagtaggagcccctccacgctcctgcccaagaagcccactgccattaagactgagggaaaacctgcagaagtcaagaagatgactgcaaagtctgtaccagctgacttgagtcgcccaaagagcacctccaccagttccatgaagaaaaccaccactctcagtgggacagcccccgctgcaggggtggttcccagccgagtcaaggccacacccatgccctcccggccctccacaactcctttcatagacaagaagcccacctcggccaaacccagctccaccaccccccggctcagccgcctggccaccaatacttctgctcctgatctgaagaatgtccgctccaaggccaaagtagagaaaaaaacagaggcagctgctacaacccgaaagcctgaatctaatgcagtcactaaaacagccggcccaattgcaagtgcacagaaacaacctgcggggaaagt

SEQ ID NO: 153952 - DNA, 5590 bp, Homo sapiens
  Payload ID: 10263
  Gene Symbol: MAP4
  Gene Name: microtubule-associated protein 4
  Uniprot ID: P27816
  ENST ID: ENST00000395734
  CDS Start-End: 87-3494
ctcctcacggctcttcccggcgctctcctggctcccttctgccccagctccgtctcggcggcggcgggcagttgcagtggtgcagaatggctgacctcagtcttgcagatgcattaacagaaccatctccagacattgagggagagataaagcgggacttcattgccacactagaggcagaggcctttgatgatgttgtgggagaaactgttggaaaaacagactatattcctctcctggatgttgatgagaaaaccgggaactcagagtcaaagaagaaaccgtgctcagaaactagccagattgaagatactccatcttctaaaccaacactcctagccaatggtggtcatggagtagaagggagcgatactacagggtctccaactgaattccttgaagagaaaatggcctaccaggaatacccaaatagccagaactggccagaagataccaacttttgtttccaacctgagcaagtggtcgatcctatccagactgatccctttaagatgtaccatgatgatgacctggcagatttggtctttccctccagtgcgacagctgatacttcaatatttgcaggacaaaatgatcccttgaaagacagttacggtatgtctccctgcaacacagctgttgtacctcaggggtggtctgtggaagccttaaactctccacactcagagtcctttgtttccccagaggctgttgcagaacctcctcagccaacggcagttcccttagagctagccaaggagatagaaatggcatcagaagagaggccaccagcacaagcattggaaataatgatgggactgaagactactgacatggcaccatctaaagaaacagagatggccctcgccaaggacatggcactagctacaaaaaccgaggtggcattggctaaagatatggaatcacccaccaaattagatgtgacactggccaaggacatgcagccatccatggaatcagatatggccctagtcaaggacatggaactacccacagaaaaagaagtggccctggttaaggatgtcagatggcccacagaaacagatgtatcttcagccaagaatgtggtactgcccacagaaacagaggtagccccagccaaggatgtgacactgttgaaagaaacagagagggcatctcctataaaaatggacttagccccttccaaggacatgggaccacccaaagaaaacaagaaagaaacagagagggcatctcctataaaaatggacttggctccttccaaggacatgggaccacccaaagaaaacaagatagtcccagccaaggatttggtattactctcagaaatagaggtggcacaggctaatgacattatatcatccacagaaatatcctctgctgagaaggtggctttgtcctcagaaacagaggtagccctggccagggacatgacactgcccccggaaaccaacgtgatcttgaccaaggataaagcactacctttagaagcagaggtggccccagtcaaggacatggctcaactcccagaaacagaaatagccccggccaaggatgtggctccgtccacagtaaaagaagtgggcttgttgaaggacatgtctccactatcagaaacagaaatggctctgggcaaggatgtgactccacctccagaaacagaagtagttctcatcaagaacgtatgtctgcctccagaaatggaggtggccctgactgaggatcaggtcccagccctcaaaacagaagcacccctggctaaggatggggttctgaccctggccaacaatgtgactccagccaaagatgttccaccactctcagaaacagaggcaacaccagttccaattaaagacatggaaattgcacaaacacaaaaaggaataagtgaggattcccatttagaatctctgcaggatgtggggcagtcagctgcacctactttcatgatttcaccagaaaccgtcacaggaacggggaaaaagtgcagcttgccggccgaggaggattctgtgttagaaaaactaggggaaaggaaaccatgcaacagtcaaccttctgagctttcttcagagacctcaggaatagccaggccagaagaaggaaggcctgtggtgagtgggacaggaaatgacatcaccaccccaccgaacaaggagctcccaccaagcccagagaagaaaacaaagcctttggccaccactcaacctgcaaagacttcaacatcgaaagccaaaacacagcccacttctctccctaagcagccagctcccaccaccattggtgggttgaataaaaaacccatgagccttgcttcaggcttagtgccagctgccccacccaaacgccctgccgtcgcctctgccaggccttccatcttaccttcaaaagacgtgaagccaaagcccattgcagatgcaaaggctcctgagaagcgggcctcaccatccaagccagcttctgccccagcctccagatctgggtccaagagcactcagactgttgcaaaaaccacaacagctgctgctgttgcctcaactggcccaagcagtaggagcccctccacgctcctgcccaagaagcccactgccattaagactgagggaaaacctgcagaagtcaagaagatgactgcaaagtctgtaccagctgacttgagtcgcccaaagagcacctccaccagttccatgaagaaaaccaccactctcagtgggacagcccccgctgcaggggtggttcccagccgagtcaaggccacacccatgccctcccggccctccacaactcctttcatagacaagaagcccacctcggccaaacccagctccaccaccccccggctcagccgcctggccaccaatacttctgctcctgatctgaagaatgtccgctccaaggttggctccacggaaaacatcaagcatcagcctggaggaggccgggccaaagtagagaaaaaaacagaggcagctgctacaacccgaaagcctgaatctaatgcagtcactaaaacagccggcccaattgcaagtgcacagaaacaacctgcggggaaagtccagatagtctccaaaaaagtgagctacagccatattcagtccaagtgtggttccaaggacaatattaagcatgtccctggaggtggtaatgttcagattcagaacaagaaagtggacatctctaaggtctcctccaagtgtgggtctaaggctaacatcaagcacaagcctggtggaggagatgtcaagattgaaagtcagaagttgaacttcaaggagaaggcccaggccaaggtgggatccctcgataatgtgggccacctacctgcaggaggtgctgtgaagattgagacctacaggctgacgttccgggcaaatgccagggcccgcaccgaccacggggccgacattgtctcccgccccccacacttccctggcggccccaactcgggctcccgggtccttggccccctttcccgggctgtccactagaccagtgagcgcttgggcgccgtgctgggcagcccgctaggctcgccttccctcctgctttgcgtgcccggggcagcagcagccctgccccacacctcctctcactccccagcctgggcccatctccctgctttggtcttgccccatcactgcgccactgctccgtggaggaggttgggagggggttggggtggttgaggctaagttgggatctaggagaggagaaccagattctatcctcatctttttttggttctttggtccaaacccaaaagaaactgacatgccctcccttctccctggatctacctggagggaagagtggaggtggattccgagtggtgacaggacgctgaccgtggagcttaagccactgcctctccctctggtcccacaaatgggcgcccccccctccccatgcaggtggtgtcgggcccttcttgctgccctgccccaagttgggggtcagtgctgcctgtccccatgcttaacatacccgcctagctgctgtcacatttttcttgttttgtccttttatttttttctaataacctaaaaactggcaaaatagttctgcaggttgaagccatgtctacatgaaagtcctcagtaagtgttagagggaacagggcggagatatccttatgccacccccgctggaggatgtgggcagcttagggccctggaggcggtgcggcagggaagaggggtgcagaggctgtggctggtgagccggtcaggcacacaaggggcccttggagcgtggactggttggttttgccattttgttgtgtgtatgctgcttttcttttctaaccaagaggctggttttggcatctctgtcccattccctgggatctggtggtcagccctaggataaaaagccagggctggagaacaagaaagggccaggagatggaattccttcaggccggcacccacaccctaggacatgtaagccctcatgtccaagggagcctcatgcagatagtaggaaatcaggtctggaaatttaaaaataaaaggcatgagactaaggctatctgcttcccttatgccctgactggagaggggagggaggagaggcaaggcccacagagggcatcccagctaggccttgggatggctgcagtgaggagaaatcccgggaactgtattgacacaaagattcttattgcacttgtattttttgtattaaagtttgcatggtttctaataaaggattcaaacataagtttgtagtgaaatggcctgggagattccaagggcttctctggagggggattggctgcagtgtagatttgcctctgaggaggctgccccagacttggcctcctcatgccccctcctgacctctgcccttctctggtcctggcatccctggagaaggtaggggtcttgacctaagtttagatttgatctccatgtgcagggaggctgtcctgggcctgacaggtcctccccctttctgaggtagcagtgccttgtggaggtttgacaccatgtccctagctccccaagcacacaccaggaaactgcaggggctcacggaggaagtgctgcctgggccagggggaccagctttcctccgtagagaccatgtgcagaacacttctgctgtgccaagaacatgagggagccagtgttttgtcagcaggaagaaagggcctgctgggatgaaagtgggaaggaaacagggttgcgtagtcaggagacacctcaggggcaacagcacaggcccagagtacctgctgcctccactgcgtctgtcctggggtcatgaggatgctgaggttgacgacaggttccaggtcctttcactcctttggccaaaggttgggggtaggtggcccaagtggcgtgctctctaggtagacaacaggagtggtcagagttccctcaaaggatcctccactccagagcacctgagaaggccgggaccagaggccctgtgtgatgtgtactccgcagctgtttggggtgggacatttctgtacttctcgatttgcttatggctcagccattacctgtgtcagtccatgattctgttgtaacagttttaagagtaaataaataaagctgcctgatgtcccatc

SEQ ID NO: 153953 - DNA, 2743 bp, Homo sapiens
  Payload ID: 10263
  Gene Symbol: MAP4
  Gene Name: microtubule-associated protein 4
  Uniprot ID: P27816
  ENST ID: ENST00000439356
  CDS Start-End: 72-371
cccggcgctctcctggctcccttctgccccagctccgtctcggcggcggcgggcagttgcagtggtgcagaatggctgacctcagtcttgcagatgcattaacagaaccatctccagacattgagggagagataaagcgggacttcattgccacactagaggcagaggcctttgatgatgttgtgggagaaactgttggaaaaacagactatattcctctcctggatgttgatgagaaaaccgggaactcagagtcaaagaagaaaccgtgctcagaaactagccagattgaagatactccatcttctaaaccaacactcctagccaatggtggtcatggagtagaagggagcgatactacagaagcctagcgtgtctctcaacactggggctgctgcaacaccagaccagtgatctttcctaagcatcgttatacttctaaaaccttcagcattttgcagagctttgcttttcattcctggacatgatgtagaagaaactgagggtagttcttcggggcctatttctgctgatgcctgagcaaacaacctgcttcctcttgtgctctgcagggtttgatggagcctcatttccctttgtgaacacaaagtgcaaaatgaattctttttaattttagtaatttttacaaaggttatctaatgtcttttatttcttgttttctttatgattttatcatttgattcattctcacatttttttcctttaaatatttttagttgacctttttcctttggttttcaaatgttcaacatgaatcagaatagtgtaacaccaaatgagaacatgtgttttcataaaggggttgaggccaccagtactgcagcgaatttccttttcttctccctcctccttccttctctgagcttgcttttagggaaggttaatcttacaggctacctatgtttctctccaccttactaaaatctaaataatgatagatattttaagtttttaaattgagtagttctgagtaatcctagaatatttttccaaattaaataatcctttattatttgcaagttgggccaaatttttttttttttggagacggactcttaacaatctaagattgtttcaacaggactttcttattcccattcctaattttttcaaactaattgcttaaatctagaaccagttgagattagtactgtacaatggtatgctttgattgtatttatagaaatataacataaaacatggaccatgttttgaaatcttagaggaattctggtttaaaatctgaaatactttaaagttttctatccttttactgattatgcagcttcttataacccccaaggtacagattatttcagcttaaaagaaataattggcaccatgttctgagaaagattttgagatatacattgttttttgtttttgagacagggtctcactcttgcctaggctggagtgcggtggcgcgatcttggcttactgcaccctctgcctcccaggttcaagtggttctcctgcctcagcctcccaagtagctgggattataggtgtgcgccaccacaccagctaatttttgtatttttagtagagacggggttttactttgttggccaggctggtctcgaactcctgatctcaagtgatccacccgccttggccacccaaagtgctgggattacaggtgtgagacactgtgcctggccagatatacattgttttagatcccctgatacagaactacttttgagatggtaagattagaatatcatgaaagtttaaactgaatccttgcagcgacttccggaatttaggaagcattccctcttctacaggggtctggtcacaagggctggattctctgacaaaaatttcttctatggattctggacagaagacacttgagggtgatatgttttaaaggaaagaggttatgcttatcttcttagcagttgataaaatattaaaactctcttgccatagagaatacaccatcaaagaaaacacaaccctttccctttggtgtacagttatttattaagttgattttggggtttctttcgccagggatcttttcaaaactggtagtagttatttttaaaaatcatgtttgacatctttctattgctcgtaaccagtccctgtagctgtctaagttatgggtggagaagcctgggtatgactttccgttgtgtacactcacacttcatgattgacatttatttattcttttatttccatttggttatgcttatttttgtttgaaatttgtttttttcaaatatgtttcctttttgaacttacagaattgttgaaattttctactaacagccagctaaaatttggtatatgttagctctatctgtttcacttggacgtttcattttgaaagaaagaaattttatgtttcacatatagttttatacaaagtagccagtcccataatgaaatgctgtattgccatagtggtcacacccaagtggtccagtatctcaatggtgaggcagccagactggtcagggctgctttgttgaaatgtgatgattttcatatgccttctttctctttctctctctctttttttttccttttttggcccaatgttgaagatgtagaactttgtttttaaataatgtttttataatttcattcgtatacctaagtttgtattttttgtgactttggacttcaacagtttgtatattgggacttctaatgtgattactgtactaaataaattccactaataaacatcttacattaa

SEQ ID NO: 153954 - DNA, 2772 bp, Homo sapiens
  Payload ID: 10263
  Gene Symbol: MAP4
  Gene Name: microtubule-associated protein 4
  Uniprot ID: P27816
  ENST ID: ENST00000434267
  CDS Start-End: 99-398
ggacagaaatgttgaaggcaggtgcctgatccaaaatgcatttagtcaggactgaacacaagctgcctggatagttcctgcagttgcagtggtgcagaatggctgacctcagtcttgcagatgcattaacagaaccatctccagacattgagggagagataaagcgggacttcattgccacactagaggcagaggcctttgatgatgttgtgggagaaactgttggaaaaacagactatattcctctcctggatgttgatgagaaaaccgggaactcagagtcaaagaagaaaccgtgctcagaaactagccagattgaagatactccatcttctaaaccaacactcctagccaatggtggtcatggagtagaagggagcgatactacagaagcctagcgtgtctctcaacactggggctgctgcaacaccagaccagtgatctttcctaagcatcgttatacttctaaaaccttcagcattttgcagagctttgcttttcattcctggacatgatgtagaagaaactgagggtagttcttcggggcctatttctgctgatgcctgagcaaacaacctgcttcctcttgtgctctgcagggtttgatggagcctcatttccctttgtgaacacaaagtgcaaaatgaattctttttaattttagtaatttttacaaaggttatctaatgtcttttatttcttgttttctttatgattttatcatttgattcattctcacatttttttcctttaaatatttttagttgacctttttcctttggttttcaaatgttcaacatgaatcagaatagtgtaacaccaaatgagaacatgtgttttcataaaggggttgaggccaccagtactgcagcgaatttccttttcttctccctcctccttccttctctgagcttgcttttagggaaggttaatcttacaggctacctatgtttctctccaccttactaaaatctaaataatgatagatattttaagtttttaaattgagtagttctgagtaatcctagaatatttttccaaattaaataatcctttattatttgcaagttgggccaaatttttttttttttggagacggactcttaacaatctaagattgtttcaacaggactttcttattcccattcctaattttttcaaactaattgcttaaatctagaaccagttgagattagtactgtacaatggtatgctttgattgtatttatagaaatataacataaaacatggaccatgttttgaaatcttagaggaattctggtttaaaatctgaaatactttaaagttttctatccttttactgattatgcagcttcttataacccccaaggtacagattatttcagcttaaaagaaataattggcaccatgttctgagaaagattttgagatatacattgttttttgtttttgagacagggtctcactcttgcctaggctggagtgcggtggcgcgatcttggcttactgcaccctctgcctcccaggttcaagtggttctcctgcctcagcctcccaagtagctgggattataggtgtgcgccaccacaccagctaatttttgtatttttagtagagacggggttttactttgttggccaggctggtctcgaactcctgatctcaagtgatccacccgccttggccacccaaagtgctgggattacaggtgtgagacactgtgcctggccagatatacattgttttagatcccctgatacagaactacttttgagatggtaagattagaatatcatgaaagtttaaactgaatccttgcagcgacttccggaatttaggaagcattccctcttctacaggggtctggtcacaagggctggattctctgacaaaaatttcttctatggattctggacagaagacacttgagggtgatatgttttaaaggaaagaggttatgcttatcttcttagcagttgataaaatattaaaactctcttgccatagagaatacaccatcaaagaaaacacaaccctttccctttggtgtacagttatttattaagttgattttggggtttctttcgccagggatcttttcaaaactggtagtagttatttttaaaaatcatgtttgacatctttctattgctcgtaaccagtccctgtagctgtctaagttatgggtggagaagcctgggtatgactttccgttgtgtacactcacacttcatgattgacatttatttattcttttatttccatttggttatgcttatttttgtttgaaatttgtttttttcaaatatgtttcctttttgaacttacagaattgttgaaattttctactaacagccagctaaaatttggtatatgttagctctatctgtttcacttggacgtttcattttgaaagaaagaaattttatgtttcacatatagttttatacaaagtagccagtcccataatgaaatgctgtattgccatagtggtcacacccaagtggtccagtatctcaatggtgaggcagccagactggtcagggctgctttgttgaaatgtgatgattttcatatgccttctttctctttctctctctctttttttttccttttttggcccaatgttgaagatgtagaactttgtttttaaataatgtttttataatttcattcgtatacctaagtttgtattttttgtgactttggacttcaacagtttgtatattgggacttctaatgtgattactgtactaaataaattccactaataaacatcttacattaaca

SEQ ID NO: 153955 - DNA, 8920 bp, Homo sapiens
  Payload ID: 10263
  Gene Symbol: MAP4
  Gene Name: microtubule-associated protein 4
  ENST ID: ENST00000426837
  CDS Start-End: 89-6982
acctcctcacggctcttcccggcgctctcctggctcccttctgccccagctccgtctcggcggcggcgggcagttgcagtggtgcagaatggctgacctcagtcttgcagatgcattaacagaaccatctccagacattgagggagagataaagcgggacttcattgccacactagaggcagaggcctttgatgatgttgtgggagaaactgttggaaaaacagactatattcctctcctggatgttgatgagaaaaccgggaactcagagtcaaagaagaaaccgtgctcagaaactagccagattgaagacctcccactacccccacaccctgccagcctttcttttcatcttcctcttgatactccatcttctaaaccaacactcctagccaatggtggtcatggagtagaagggagcgatactacagggtctccaactgaattccttgaagagaaaatggcctaccaggaatacccaaatagccagaactggccagaagataccaacttttgtttccaacctgagcaagtggtcgatcctatccagactgatccctttaagatgtaccatgatgatgacctggcagatttggtctttccctccagtgcgacagctgatacttcaatatttgcaggacaaaatgatcccttgaaagacagttacggtatgtctccctgcaacacagctgttgtacctcaggggtggtctgtggaagccttaaactctccacactcagagtcctttgtttccccagaggctgttgcagaacctcctcagccaacggcagttcccttagagctagccaaggagatagaaatggcatcagaagagaggccaccagcacaagcattggaaataatgatgggactgaagactactgacatggcaccatctaaagaaacagagatggccctcgccaaggacatggcactagctacaaaaaccgaggtggcattggctaaagatatggaatcacccaccaaattagatgtgacactggccaaggacatgcagccatccatggaatcagatatggccctagtcaaggacatggaactacccacagaaaaagaagtggccctggttaaggatgtcagatggcccacagaaacagatgtatcttcagccaagaatgtggtactgcccacagaaacagaggtagccccagccaaggatgtgacactgttgaaagaaacagagagggcatctcctataaaaatggacttagccccttccaaggacatgggaccacccaaagaaaacaagaaagaaacagagagggcatctcctataaaaatggacttggctccttccaaggacatgggaccacccaaagaaaacaagatagtcccagccaaggatttggtattactctcagaaatagaggtggcacaggctaatgacattatatcatccacagaaatatcctctgctgagaaggtggctttgtcctcagaaacagaggtagccctggccagggacatgacactgcccccggaaaccaacgtgatcttgaccaaggataaagcactacctttagaagcagaggtggccccagtcaaggacatggctcaactcccagaaacagaaatagccccggccaaggatgtggctccgtccacagtaaaagaagtgggcttgttgaaggacatgtctccactatcagaaacagaaatggctctgggcaaggatgtgactccacctccagaaacagaagtagttctcatcaagaacgtatgtctgcctccagaaatggaggtggccctgactgaggatcaggtcccagccctcaaaacagaagcacccctggctaaggatggggttctgaccctggccaacaatgtgactccagccaaagatgttccaccactctcagaaacagaggcaacaccagttccaattaaagacatggaaattgcacaaacacaaaaaggaataagtgaggattcccatttagaatctctgcaggatgtggggcagtcagctgcacctactttcatgatttcaccagaaaccgtcacaggaacggggaaaaagtgcagcttgccggccgaggaggattctgtgttagaaaaactaggggaaaggaaaccatgcaacagtcaaccttctgagctttcttcagagacctcagccaacttcatgtattgcggtacccctcccacacaagccaaacaagtttgcagacccagtgaccgcaggtcaacccggcccaagcctgccagggtccctcctgagctgctgggaggctctcctccatggaagactcttgatcacaggctgggccactgctctttgtctgagtcaggttgggtctctggttcatcctcctgtggtgggcctgggaaccaaagaaaaagtattcatgttgactcacttgaaccccagagggatcttggcagggaggcctgggatatagaaagcacaccaataatgatgaagaaaaagaagaagaaaccaaagcaaaagagatattctcaaccacgggctggaggaccttcggatgatgacaatgcagataagcctaaaggtcatccatttgcagctgacacacaaaaatcaggtgttctccccagccagcctaccactatgggtacagaatatggacttgtatctggagaaaacttgaaaagggaatgtttagttaactccagtgcagccagactggtagctgagaactttgtctcagagagtctcagaattcctttatatccttctgaagaagcccccaaaactgcaataagttctcagtctaagctgagagtagaggaagagagcaaaagtaacaagtcagtactacaaaaccaagacaagaaattgctgaagcaacatgaatacaaaccacagcctgcaccccacctgaagactcctgtagataaaagccagtcagtaggccctctcaatctgaaaggacccctagcagaagtttctgcatacaatgtagaaacccctttggatatcagacttaaagagggttgctctcctttcttggaccaagaggttatgggtgtagtttcaaaacccacagcagcaaaagaaataccaaatttggtacccactttgatagcaagtaatccattagaatgtaatctaaaagaagggaataatgaaagtaaaatgactaaactgcagaatgtcaaactgaaggagtttcctgaaggagctgaagaggataaagaactaaaaaaggaagcttttcccaacgaaagacaagagatcagcatctttacttctgagcagctgcagggccaagtgttggtacaggtccctggggtagagaatgaaccatttaagagaatggcaggtgatggcaaaagcaggaagggaaggggaagttctgggaaaatgagaacagattctgggaaggtaaaagcaaaatctgagctgccatttcttctggacagccagaaggacggaagggctgttctcataccgagtgagccagtctctaaaactgaaggaatgactactcaggataagagtgaggagctggggctgaattcttcaaagcaaccaggcactaaggctgatctcacggaggcagtggtgatgggggagcctaaagagatgactcagcctaaggtggcaggcaccatgcaggcattgattcctttggaaagtggatcaggcatgactcagacttctggtgttagcacagaaacaggagatgtagtcaaagatatgggtgtcaataaccagagcaaggaaggaaggtgtccatggaaggatcatgaggcagctccctggatttctgaaaagcctaaaaagagaggcaatgaaggcaaaagcaaaaagtttaaaaataattattccacacagcctgctagaatggagaggaaggaagaaatccttaacccaccttttgaagggaaggatggagatactggtagtattccccataaaagcaaggaaataggatttactttccccaaaatgcatgattcttcgttctcacatacaccagatacacccacagtggaagcagttgacaggaagggtggaaattttcaggttaattttgttgagcttgggactcttggggaaaacaagataagcacagtcaaggcttctactgttactgaaccacctgccaaggtgacagatgtgagctgccaagagcaaatccagggggcaggatttgttccttcagtagtatctgaggagaataagacagatgcagccaatagatacactgcagtggctgacaaaccaagtaaaaggagtaatgatggaaaaagtaaaaaggttaaaaatagttctcctgagaagcacattctggagaataagatagatgcaacaaaaatacatgttcccatggaaaccacaggggaccagggaattgaaggaatggcctatatggacgaaaatagaaatattacatttacctgtcccagaacaccatcagagctgataaataaatcatctcctctagaggttctggaatcagcagcctgtgaaaaactgcccactcctactcctcaagtagtaaaggaaggtgattcctttccagataccttggcaaaaaatgggcaagagatagccccagcccagatttccaaatcattaatggtagataactacaccaaagatggagtcccaggtcaagaaagacccaagggtccctctgctgttgtgccctctacaagcacaggaggagttgctctacctattacaacagccatagaaacagttaacattcatggagatcactctcttaagaataaagctgagcttgctgattccatgaaaaatgaagcagggatcgatgaagggcatgtgataggagaatctgagtcagtgcacagtggtgcgtctaagcattcagtagagaaagtcacagagctagcaaaaggtcacctccttcctggagtgccagtagaagaccagagcctaccaggagaggccagagccctagaaggatatgcagatagaggtaatttcccagcacatccagtgaatgaagagaaagagactaaagaagggtctgttgcagttcagattcctgacttactggaagacaaagcacaaaagctcagtttttgtgaggaccaaaatgctcaagatagaaattccaaaggttcagatagtttgaataagaaggtagatctgactcttttgtctccaaaaagtgaaaatgataaattgaaagaaattagtctggcttgtaaaatcacggaattggaaagcgtttccttgccaacaccagaaatccagtcagatttcttacatagcaaagtcgaagctcctccttcagaggtggcggatacgttagtaataatgactgcttccaagggtgttcgactcccagaacccaaagataagattttggagacacctcagaaaatgacagaaaaatctgaatcaaagacaccaggagaagggaaaaaggaagataaaagcagaatggcagaaccaatgaaaggctacatgagacccaccaagtcccgaggacttactccacttttgccaaagtctacaatccaggaacaagagagacataagcaactgaagtccgctggaatagccaggccagaagaaggaaggcctgtggtgagtgggacaggaaatgacatcaccaccccaccgaacaaggagctcccaccaagcccagagaagaaaacaaagcctttggccaccactcaacctgcaaagacttcaacatcgaaagccaaaacacagcccacttctctccctaagcagccagctcccaccaccattggtgggttgaataaaaaacccatgagccttgcttcaggcttagtgccagctgccccacccaaacgccctgccgtcgcctctgccaggccttccatcttaccttcaaaagacgtgaagccaaagcccattgcagatgcaaaggctcctgagaagcgggcctcaccatccaagccagcttctgccccagcctccagatctgggtccaagagcactcagactgttgcaaaaaccacaacagctgctgctgttgcctcaactggcccaagcagtaggagcccctccacgctcctgcccaagaagcccactgccattaagactgagggaaaacctgcagaagtcaagaagatgactgcaaagtctgtaccagctgacttgagtcgcccaaagagcacctccaccagttccatgaagaaaaccaccactctcagtgggacagcccccgctgcaggggtggttcccagccgagtcaaggccacacccatgccctcccggccctccacaactcctttcatagacaagaagcccacctcggccaaacccagctccaccaccccccggctcagccgcctggccaccaatacttctgctcctgatctgaagaatgtccgctccaaggttggctccacggaaaacatcaagcatcagcctggaggaggccgggccaaagtagagaaaaaaacagaggcagctgctacaacccgaaagcctgaatctaatgcagtcactaaaacagccggcccaattgcaagtgcacagaaacaacctgcggggaaagtccagatagtctccaaaaaagtgagctacagccatattcagtccaagtgtggttccaaggacaatattaagcatgtccctggaggtggtaatgttcagattcagaacaagaaagtggacatctctaaggtctcctccaagtgtgggtctaaggctaacatcaagcacaagcctggtggaggagatgtcaagattgaaagtcagaagttgaacttcaaggagaaggcccaggccaaggtgggatccctcgataatgtgggccacctacctgcaggaggtgctgtgaagactgagggcggtggcagcgaggctcctctgtgtccgggtccccctgctggggaggagccggccatctctgaggcagcgcctgaagctggcgcccccacttcagccagtggcctcaatggccaccccaccctgtcagggggtggtgaccaaagggaggcccagaccttggacagccagatccaggagacaagcatctaatgatgacattctggtctcgtcttccgtctcccccgtgttcccctcttgtctcccctgttcccctctcccttccctcctcccatgtcactgcagattgagacctacaggctgacgttccgggcaaatgccagggcccgcaccgaccacggggccgacattgtctcccgccccccacacttccctggcggccccaactcgggctcccgggtccttggccccctttcccgggctgtccactagaccagtgagcgcttgggcgccgtgctgggcagcccgctaggctcgccttccctcctgctttgcgtgcccggggcagcagcagccctgccccacacctcctctcactccccagcctgggcccatctccctgctttggtcttgccccatcactgcgccactgctccgtggaggaggttgggagggggttggggtggttgaggctaagttgggatctaggagaggagaaccagattctatcctcatctttttttggttctttggtccaaacccaaaagaaactgacatgccctcccttctccctggatctacctggagggaagagtggaggtggattccgagtggtgacaggacgctgaccgtggagcttaagccactgcctctccctctggtcccacaaatgggcgcccccccctccccatgcaggtggtgtcgggcccttcttgctgccctgccccaagttgggggtcagtgctgcctgtccccatgcttaacatacccgcctagctgctgtcacatttttcttgttttgtccttttatttttttctaataacctaaaaactggcaaaatagttctgcaggttgaagccatgtctacatgaaagtcctcagtaagtgttagagggaacagggcggagatatccttatgccacccccgctggaggatgtgggcagcttagggccctggaggcggtgcggcagggaagaggggtgcagaggctgtggctggtgagccggtcaggcacacaaggggcccttggagcgtggactggttggttttgccattttgttgtgtgtatgctgcttttcttttctaaccaagaggctggttttggcatctctgtcccattccctgggatctggtggtcagccctaggataaaaagccagggctggagaacaagaaagggccaggagatggaattccttcaggccggcacccacaccctaggacatgtaagccctcatgtccaagggagcctcatgcagatagtaggaaatcaggtctggaaatttaaaaataaaaggcatgagactaaggctatctgcttcccttatgccctgactggagaggggagggaggagaggcaaggcccacagagggcatcccagctaggccttgggatggctgcagtgaggagaaatcccgggaactgtattgacacaaagattcttattgcacttgtattttttgtattaaagtttgcatggtttctaataaaggattcaaacataagtttgtagtgaaatggcctgggagattccaagggcttctctggagggggattggctgcagtgtagatttgcctctgaggaggctgccccagacttggcctcctcatgccccctcctgacctctgcccttctctggtcctggcatccctggagaaggtaggggtcttgacctaagtttagatttgatctccatgtgcagggaggctgtcctgggcctgacaggtcctccccctttctgaggtagcagtgccttgtggaggtttgacaccatgtccctagctccccaagcacacaccaggaaactgcaggggctcacggaggaagtgctgcctgggccagggggaccagctttcctccgtagagaccatgtgcagaacacttctgctgtgccaagaacatgagggagccagtgttttgtcagcaggaagaaagggcctgctgggatgaaagtgggaaggaaacagg

SEQ ID NO: 153956 - DNA, 3478 bp, Homo sapiens
  Payload ID: 10263
  Gene Symbol: MAP4
  Gene Name: microtubule-associated protein 4
  ENST ID: ENST00000420772
  CDS Start-End: 345-2831
cttagtgcttggattggcaccatactgtgttttaaattgcagatctaaacagagtgctagttcacgggaaattacattctcagattaaagtagcattttgttgtgcagaaagcagcaggttccttcctttctttcgctttcattcattcttcctttctttctttctttcacatttgtaagtgcatttaatactcaactgcttgaggagagaggggcattgagggagagatgaattttgtcatgaatactggggaattggtgtgatgtcactgcaagctctgtgtgatcgtaggtggtattagagctccaggagcgaaagcagggagagcagtggaggagagacgatgtcgctctcagacaagcagacagcctctctcactgccgcgtacggtcagctcagtaagggcaagcctgcagagtgccgaatggactccccaaaagaaatcagtcaagccggattcgaatggcagaggacagagggcaaactgaatgaaattgggctgaatgtcagcatggacgggcaaccaaaagatgggcttgtgaagaatgccagcttcctggagcagaacaagctctgcttttttgaggggaagctagacaaagagctgagcattgaaatgcaggacaaggactgtcaagaagcctcaggtcaccttgagagcaggtatgtgatttcagagacctgccatcccttggaggggaactcggtacaccagaagacctccgagttccatctgggactcatagaggggccagacaaaaacaaaaccattccagttcaggggaaggtggcagggaagaatggactagagaccaagagccagtcagatctggatttccctggggctgctgacatccctaccagatatgttaaggagcaggaaaccagtgtttggaaccccagctttcatccagtggctcaaggctctctgggctcaagggaagcaactccgggagagatggagaatagcatcacccctggctgcccagtgattggggtggtaaatgataactctgagcagctgaagtgtgagtccccactcctggtgtctctagcccacccagcccccattattgagcattcacccaccaccattccgccaatcactatggtgttcacccaggaacatttgaatgcaagctgtcacatcagagaccatgataaggagttggagaaattgagttctaccgaggaggctgtgctcaaccaagccccccagcagaaaaaggcagtgcgcagggccctgtctgaatgttctcacctctcagttcccccagctgtcaaccttgcagataagtaccctgaactccctgcccgagaagagccttcttctggcctgctgcctccccctagtagcccaatgcctagtcctacacctgggaaactgggagctcctgctatgaagcgctccatgactgtgggtgaggaacagacagctagctacaaattgagccctgggaaactgcccatcttgtctactaaagagatacctcctttcatctgtgaggaaccagtggccaagaagagagaagaattggctcacttcagcaacagcagcagcaactctgggaagaaggaactcggcactgctggattatatctccatagtaagctggagcagattcctgaaggaagcagcaaggaaaaagggcaggaagattttagtgaaactagaattgattcatgctcgcaggtttgccagcgaggagagaaacagccaggacagacggctctggcagggaagaaagaaattgaggtcactgcaacccagagcactccatcgttcctgtttgaaaagcccccacgtgatggaatagccaggccagaagaaggaaggcctgtggtgagtgggacaggaaatgacatcaccaccccaccgaacaaggagctcccaccaagcccagagaagaaaacaaagcccattgcagatgcaaaggctcctgagaagcgggcctcaccatccaagccagcttctgccccagcctccagatctgggtccaagagcactcagactgttgcaaaaaccacaacagctgctgctgttgcctcaactggcccaagcagtaggagcccctccacgctcctgcccaagaagcccactgctgacttgagtcgcccaaagagcacctccaccagttccatgaagaaaaccaccactctcagtgggacagcccccgctgcaggggtggttcccagccgagtcaaggccacacccatgccctcccggccctccacaactcctttcatagacaagaagcccacctcggccaaacccagctccaccaccccccggctcagccgcctggccaccaatacttctgctcctgatctgaagaatgtccgctccaaggttggctccacggaaaacatcaagcatcagcctggaggaggccgggtccagatagtctccaaaaaagtgagctacagccatattcagtccaagtgtggttccaaggacaatattaagcatgtccctggaggtggtaatgttcagattcagaacaagaaagtggacatctctaaggtctcctccaagtgtgggtctaaggctaacatcaagcacaagcctggtggaggagatgtcaagattgaaagtcagaagttgaacttcaaggagaaggcccaggccaaggtgggatccctcgataatgtgggccacctacctgcaggaggtgctgtgaagattgagacctacaggctgacgttccgggcaaatgccagggcccgcaccgaccacggggccgacattgtctcccgccccccacacttccctggcggccccaactcgggctcccgggtccttggccccctttcccgggctgtccactagaccagtgagcgcttgggcgccgtgctgggcagcccgctaggctcgccttccctcctgctttgcgtgcccggggcagcagcagccctgccccacacctcctctcactccccagcctgggcccatctccctgctttggtcttgccccatcactgcgccactgctccgtggaggaggttgggagggggttggggtggttgaggctaagttgggatctaggagaggagaaccagattctatcctcatctttttttggttctttggtccaaacccaaaagaaactgacatgccctcccttctccctggatctacctggagggaagagtggaggtggattccgagtggtgacaggacgctgaccgtggagcttaagccactgcctctccctctggtcccacaaatgggcgcccccccctccccatgcaggtggtgtcgggcccttcttgctgccctgccccaagttgggggtcagtgctgcctgtccccatgcttaacatacccgcctagctgctgtcacatttttcttgttttgtccttttatttttttctaataacctaaaaactggcaaaatagttctgcaggttgaagccatgtctacatgaaagtcctcagtaagtgttagagggaacagggcggagatatccttatg

SEQ ID NO: 153957 - DNA, 899 bp, Homo sapiens
  Payload ID: 10263
  Gene Symbol: MAP4
  Gene Name: microtubule-associated protein 4
  ENST ID: ENST00000423088
  CDS Start-End: 49-899
ctgccccagctccgtctcggcggcggcgggcagttgcagtggtgcagaatggctgacctcagtcttgcagatgcattaacagaaccatctccagacattgagggagagataaagcgggacttcattgccacactagaggcagaggcctttgatgatgttgtgggagaaactgttggaaaaacagactatattcctctcctggatgttgatgagaaaaccgggaactcagagtcaaagaagaaaccgtgctcagaaactagccagattgaagatactccatcttctaaaccaacactcctagccaatggtggtcatggagtagaagggagcgatactacagggtctccaactgaattccttgaagagaaaatggcctaccaggaatacccaaatagccagaactggccagaagataccaacttttgtttccaacctgagcaagtggtcgatcctatccagactggtatgtctccctgcaacacagctgttgtacctcaggggtggtctgtggaagccttaaactctccacactcagagtcctttgtttccccagaggctgttgcagaacctcctcagccaacggcagttcccttagagctagccaaggagatagaaatggcatcagaagagaggccaccagcacaagcattggaaataatgatgggactgaagactactgacatggcaccatctaaagaaacagagatggccctcgccaaggacatggcactagctacaaaaaccgaggtggcattggctaaagatatggaatcacccaccaaattagatgtgacactggccaaggacatgcagccatccatggaatcagatatggccctagtcaaggacatggaactacccacagaaaaagaagtggccctggttaaggatgtcagatg

SEQ ID NO: 153958 - DNA, 3724 bp, Homo sapiens
  Payload ID: 10263
  Gene Symbol: MAP4
  Gene Name: microtubule-associated protein 4
  ENST ID: ENST00000429422
  CDS Start-End: 1-1480
caagggtgttcgactcccagaacccaaagataagattttggagacacctcagaaaatgacagaaaaatctgaatcaaagacaccaggagaagggaaaaaggaagataaaagcagaatggcagaaccaatgaaaggctacatgagacccaccaagtcccgaggacttactccacttttgccaaagtctacaatccaggaacaagagagacataagcaactgaagtccgctggaatagccaggccagaagaaggaaggcctgtggtgagtgggacaggaaatgacatcaccaccccaccgaacaaggagctcccaccaagcccagagaagaaaacaaagcctttggccaccactcaacctgcaaagacttcaacatcgaaagccaaaacacagcccacttctctccctaagcagccagctcccaccaccattggtgggttgaataaaaaacccatgagccttgcttcaggcttagtgccagctgccccacccaaacgccctgccgtcgcctctgccaggccttccatcttaccttcaaaagacgtgaagccaaagcccattgcagatgcaaaggctcctgagaagcgggcctcaccatccaagccagcttctgccccagcctccagatctgggtccaagagcactcagactgttgcaaaaaccacaacagctgctgctgttgcctcaactggcccaagcagtaggagcccctccacgctcctgcccaagaagcccactgccattaagactgagggaaaacctgcagaagtcaagaagatgactgcaaagtctgtaccagctgacttgagtcgcccaaagagcacctccaccagttccatgaagaaaaccaccactctcagtgggacagcccccgctgcaggggtggttcccagccgagtcaaggccacacccatgccctcccggccctccacaactcctttcatagacaagaagcccacctcggccaaacccagctccaccaccccccggctcagccgcctggccaccaatacttctgctcctgatctgaagaatgtccgctccaaggttggctccacggaaaacatcaagcatcagcctggaggaggccgggttcagattcagaacaagaaagtggacatctctaaggtctcctccaagtgtgggtctaaggctaacatcaagcacaagcctggtggaggagatgtcaagattgaaagtcagaagttgaacttcaaggagaaggcccaggccaaggtgggatccctcgataatgtgggccacctacctgcaggaggtgctgtgaagactgagggcggtggcagcgaggctcctctgtgtccgggtccccctgctggggaggagccggccatctctgaggcagcgcctgaagctggcgcccccacttcagccagtggcctcaatggccaccccaccctgtcagggggtggtgaccaaagggaggcccagaccttggacagccagatccaggagacaaattgagacctacaggctgacgttccgggcaaatgccagggcccgcaccgaccacggggccgacattgtctcccgccccccacacttccctggcggccccaactcgggctcccgggtccttggccccctttcccgggctgtccactagaccagtgagcgcttgggcgccgtgctgggcagcccgctaggctcgccttccctcctgctttgcgtgcccggggcagcagcagccctgccccacacctcctctcactccccagcctgggcccatctccctgctttggtcttgccccatcactgcgccactgctccgtggaggaggttgggagggggttggggtggttgaggctaagttgggatctaggagaggagaaccagattctatcctcatctttttttggttctttggtccaaacccaaaagaaactgacatgccctcccttctccctggatctacctggagggaagagtggaggtggattccgagtggtgacaggacgctgaccgtggagcttaagccactgcctctccctctggtcccacaaatgggcgcccccccctccccatgcaggtggtgtcgggcccttcttgctgccctgccccaagttgggggtcagtgctgcctgtccccatgcttaacatacccgcctagctgctgtcacatttttcttgttttgtccttttatttttttctaataacctaaaaactggcaaaatagttctgcaggttgaagccatgtctacatgaaagtcctcagtaagtgttagagggaacagggcggagatatccttatgccacccccgctggaggatgtgggcagcttagggccctggaggcggtgcggcagggaagaggggtgcagaggctgtggctggtgagccggtcaggcacacaaggggcccttggagcgtggactggttggttttgccattttgttgtgtgtatgctgcttttcttttctaaccaagaggctggttttggcatctctgtcccattccctgggatctggtggtcagccctaggataaaaagccagggctggagaacaagaaagggccaggagatggaattccttcaggccggcacccacaccctaggacatgtaagccctcatgtccaagggagcctcatgcagatagtaggaaatcaggtctggaaatttaaaaataaaaggcatgagactaaggctatctgcttcccttatgccctgactggagaggggagggaggagaggcaaggcccacagagggcatcccagctaggccttgggatggctgcagtgaggagaaatcccgggaactgtattgacacaaagattcttattgcacttgtattttttgtattaaagtttgcatggtttctaataaaggattcaaacataagtttgtagtgaaatggcctgggagattccaagggcttctctggagggggattggctgcagtgtagatttgcctctgaggaggctgccccagacttggcctcctcatgccccctcctgacctctgcccttctctggtcctggcatccctggagaaggtaggggtcttgacctaagtttagatttgatctccatgtgcagggaggctgtcctgggcctgacaggtcctccccctttctgaggtagcagtgccttgtggaggtttgacaccatgtccctagctccccaagcacacaccaggaaactgcaggggctcacggaggaagtgctgcctgggccagggggaccagctttcctccgtagagaccatgtgcagaacacttctgctgtgccaagaacatgagggagccagtgttttgtcagcaggaagaaagggcctgctgggatgaaagtgggaaggaaacagggttgcgtagtcaggagacacctcaggggcaacagcacaggcccagagtacctgctgcctccactgcgtctgtcctggggtcatgaggatgctgaggttgacgacaggttccaggtcctttcactcctttggccaaaggttgggggtaggtggcccaagtggcgtgctctctaggtagacaacaggagtggtcagagttccctcaaaggatcctccactccagagcacctgagaaggccgggaccagaggccctgtgtgatgtgtactccgcagctgtttggggtgggacatttctgtacttctcgatttgcttatggctcagccattacctgtgtcagtccatgattctgttgtaacagttttaagagtaaataaataaagctgcctgatgtcccatcacgcag

SEQ ID NO: 153959 - DNA, 487 bp, Homo sapiens
  Payload ID: 10263
  Gene Symbol: MAP4
  Gene Name: microtubule-associated protein 4
  ENST ID: ENST00000468075
  CDS Start-End: 260-487
gagagagagcgacggccatcatagaacagcgaaggcagtcgatcggcctgcggtccgcttcggcattcgcaggccgcaggcgggaggctagagcccccaggcgcacctcgccccaaccgcccgcggctcgggcagctctgcagagacgtcgtggcggcagggccagcacccattggtccgccacagccctccgccctccccctcgccacgcttattggccggagcggcggcgctcgccgggcagttgcagtggtgcagaatggctgacctcagtcttgcagatgcattaacagaaccatctccagacattgagggagagataaagcgggacttcattgccacactagaggcagaggcctttgatgatgttgtgggagaaactgttggaaaaacagactatattcctctcctggatgttgatgagaaaaccgggaactcagagtcaaagaagaaaccgtgctcagaaactagccagattgaagatact

SEQ ID NO: 153960 - DNA, 570 bp, Homo sapiens
  Payload ID: 10263
  Gene Symbol: MAP4
  Gene Name: microtubule-associated protein 4
  ENST ID: ENST00000633710
  CDS Start-End: 150-570
attcatttggacagaaatgttgaaggcaggtgcctgatccaaaatgcatttagtcaggactgaacacaagctgcctggatagttcctattagagaactcagccctgaaaggtgactcattcaaggccacagcagttgcagtggtgcagaatggctgacctcagtcttgcagatgcattaacagaaccatctccagacattgagggagagataaagcgggacttcattgccacactagaggcagaggcctttgatgatgttgtgggagaaactgttggaaaaacagactatattcctctcctggatgttgatgagaaaaccgggaactcagagtcaaagaagaaaccgtgctcagaaactagccagattgaagacctcccactacccccacaccctgccagcctttcttttcatcttcctcttgatactccatcttctaaaccaacactcctagccaatggtggtcatggagtagaagggagcgatactacagggtctccaactgaattccttgaagagaaaatggcctaccaggaatacccaaatagccagaactggccagaagatacca

SEQ ID NO: 153961 - DNA, 3334 bp, Homo sapiens
  Payload ID: 10264
  Gene Symbol: MAP6
  Gene Name: microtubule-associated protein 6
  Uniprot ID: Q96JE9
  ENST ID: ENST00000304771
  CDS Start-End: 752-3193
agcactctttcagtcagcatcgttcctggatttttttctcactgctgagcagcataaaagggtggggccgcttccctgcagcagaggcagaggcggcggcggcagcggctgcagcatcattcgcgggcagcggcggagaccgagagctgcagaaaagggtggggtcgcttcccaggagaagaggcggtggcggcggcggctgcggcatcctcgcgggcagcggcggaggcagcaatgctcggtctccgctggaggtgatggcctcccagccctgctaggtggccggctgcactaggacgccggcaggaaggagactcgagcccggtccgcggaccctgcggccacaccgcccggcccctcctctgcgccatggcttaagcctgtagccacctctcctcacgtcgcctcgctcgaccgaggtctgtgcgccgccgcagccgcagggaggggcgcgtcccagacaccctcgccggggactcgggaacgccgtgcgtctcacccttcggcgctcgcagcagactgcgctcccaaaggcgtttgcgaccggtaatcgagggactctacagactctcctaggacagctctccccgggtgctcgctgagggaggagggcgaactagctccggctgatcgggggtagaaaacggtgggaaccacattggccggtcaggatcggaggctgaaggaagattatagagacttgctttagaaccacaagaagaaagaggaggccggcttttcagctagcatcatggcgtggccgtgcatcacgagggcctgctgcatcgcccgcttctggaaccagttggacaaagcggacatcgctgtgccgctggttttcaccaagtactcggaggccaccgagcacccgggcgccccgccgcagccaccgccgccgcagcagcaggcgcagccggcgctcgcgcccccctcggcgcgcgcggttgccatagagacgcagccagcccagggcgagttggatgcagttgcccgggcaacggggccagcgcctgggcctaccggcgagcgcgagccggcggcgggccccggccggagcgggccgggcccgggcctgggctccggctccacctccggccccgcggactcggtgatgcggcaggattaccgagcctggaaggtgcagcggcccgagcccagctgccggccgcgcagcgaataccagccctccgacgctcccttcgagcgcgagacccagtaccagaaggacttccgcgcctggccgctgccgcgccgcggggaccacccgtggatccccaagcccgtgcagatctctgcggcctcccaggcgtcggcgcccattctcggggcgcccaagcgccggccgcagagccaggagcgctggccagtgcaggccgccgctgaggcccgggagcaggaggcggcccccggcggagcgggtggcctggcggccggaaaggcgtccggggcggacgagcgcgacacgcgcaggaaggccgggcctgcctggattgtgcgccgcgccgagggcctggggcacgagcagacgccgctgcccgcggcccaggcccaggtccaggccaccggccccgaggctggcagggggcgcgccgcggcggacgccctcaaccggcaaatccgcgaggaggtggcgagtgcagtgagcagctcctacaggaatgaattcagggcatggacggacatcaagcctgtgaaaccaataaaggccaagccccagtacaagcccccagatgataagatggttcatgagaccagctacagtgctcagttcaaaggagaggccagcaagccaacaacagctgacaataaggtcattgatcgcagaagaatacgcagcctctacagcgaacccttcaaggaacccccaaaggtggaaaaacctagtgttcagagttccaaaccaaaaaagacctcagcgagccataagcccacgaggaaggccaaagacaagcaggcggtgtcaggccaggctgccaagaaaaagagcgcggagggcccgagtaccaccaagccagacgacaaggagcaaagcaaagagatgaacaataaactggctgaggcgaaagagagcctggctcaacccgtcagtgattcaagtaagactcaaggtcctgtagccacagagccagacaaggatcaaggttctgtggtcccaggccttctgaaaggtcaaggtcctatggtgcaagagcctctgaagaagcaaggttctgtggtcccagggcctccaaaggatctaggtcccatgatcccattaccagtcaaggatcaagatcacacggtccctgagcctttaaagaatgaaagccctgttatctcagcaccagtcaaggaccaaggtccctcggtcccagttcctccaaagaatcaaagtcctatggttccagcaaaagttaaggatcaaggctctgtggtaccagagtctctaaaggatcaaggtcctaggattcctgagcctgtgaagaatcaagctcctatggtcccagcacctgtcaaggatgaaggtcccatggtctcagcatctgtcaaggatcaaggtcccatggtctcagcacctgtcaaggatcaaggtcccatagtcccagcacctgtcaagggtgaaggtcccatagtcccagcacctgtcaaggatgaaggtcccatggtctcagcacctatcaaggatcaagatcccatggtcccagagcatccgaaggatgaaagtgccatggccacagcacccataaagaatcaaggttccatggtctctgagcctgtaaagaatcaaggtttagtggtctcagggccagtcaaggatcaagatgttgtagtcccagagcatgcaaaggttcacgattctgcagttgtggcacctgtaaagaatcaaggtcctgtggtccccgagtccgtgaagaatcaagaccccattctcccagtactagttaaggatcaaggccccacagtcctacagcctccaaagaatcaaggtcgtatagtccctgaacctctgaagaatcaagttcctatagtcccagtgcctctgaaggatcaagatcctctggtgccagtaccagcaaaggaccaaggtcctgcagtccctgaacctctgaagactcaaggtcccagggaccctcagctacctactgtctcacctctaccccgagtcatgatcccaactgccccccatacggaatacattgagagctccccttgacactcaccccttgacacaccaatgaaggagctgacagtgagagtgctcccctcccaggggcagtgaagacacatatttaatctgcatgaaacatgtacagtagtcttgctggaatctaataaaaatggtccctctggctca

SEQ ID NO: 153962 - DNA, 4329 bp, Homo sapiens
  Payload ID: 10264
  Gene Symbol: MAP6
  Gene Name: microtubule-associated protein 6
  Uniprot ID: Q96JE9
  ENST ID: ENST00000434603
  CDS Start-End: 66-1385
aagattatagagacttgctttagaaccacaagaagaaagaggaggccggcttttcagctagcatcatggcgtggccgtgcatcacgagggcctgctgcatcgcccgcttctggaaccagttggacaaagcggacatcgctgtgccgctggttttcaccaagtactcggaggccaccgagcacccgggcgccccgccgcagccaccgccgccgcagcagcaggcgcagccggcgctcgcgcccccctcggcgcgcgcggttgccatagagacgcagccagcccagggcgagttggatgcagttgcccgggcaacggggccagcgcctgggcctaccggcgagcgcgagccggcggcgggccccggccggagcgggccgggcccgggcctgggctccggctccacctccggccccgcggactcggtgatgcggcaggattaccgagcctggaaggtgcagcggcccgagcccagctgccggccgcgcagcgaataccagccctccgacgctcccttcgagcgcgagacccagtaccagaaggacttccgcgcctggccgctgccgcgccgcggggaccacccgtggatccccaagcccgtgcagatctctgcggcctcccaggcgtcggcgcccattctcggggcgcccaagcgccggccgcagagccaggagcgctggccagtgcaggccgccgctgaggcccgggagcaggaggcggcccccggcggagcgggtggcctggcggccggaaaggcgtccggggcggacgagcgcgacacgcgcaggaaggccgggcctgcctggattgtgcgccgcgccgagggcctggggcacgagcagacgccgctgcccgcggcccaggcccaggtccaggccaccggccccgaggctggcagggggcgcgccgcggcggacgccctcaaccggcaaatccgcgaggaggtggcgagtgcagtgagcagctcctacaggaatgaattcagggcatggacggacatcaagcctgtgaaaccaataaaggccaagccccagtacaagcccccagatgataagatggttcatgagaccagctacagtgctcagttcaaaggagaggccagcaagccaacaacagctgacaataaggtcattgatcgcagaagaatacgcagcctctacagcgaacccttcaaggaacccccaaaggtggaaaaacctagtgttcagagttccaaaccaaaaaagacctcagcgagccataagcccacgaggaaggccaaagacaagcaggcggtgtcaggccaggctgccaagaaaaagagcgcggagggcccgagtaccaccaagccagacgacaaggagcaaagcaaagagatgaacaataaactggctgaggcgaaagagtaaatttccctgcactttccttttactcttctctctctctccctccccccaactttttttttttaaaccaacaaaccaaaaaaggccacaaaattaattagaggcttctcatctgccttggtcctgagtgttccaggagctctttggtttggcttcttttgatggaagaatcctgcttcacagactgagtggcaggcctcctcctgagggcagcccctggagcaccaggaagcgttgccgctggctgtgccctcccctggcactctgactgcatgctgatgagcaaggcaggcaggtctgagaggcgaaacgaatctcccggcagtgcttggaagtgtctgtggggtctcctcctcccagatccccaagatctgtgtcactggtcgattttgaactttaggtacatgtgttcttttcaaaaattcagagaatcgtcatgtgccacagaagctcagcctgggcttcagcaattgacaaaatttgaagaaatattaaacaaaaataacaaaaaaagaaacaaccttggccttaatgtcaataaaagggagttgtgtctgttaagtggtcttttcatagaatcgtccattagaaatgtgtgcctgtgtttagcttcctatcagtgggctttaaattgtataccgagtcatagatacgccactgataactaaaactagatcagggctggtgaagaaggttaggtgttttaggtacattccagctgtcataggaagatcacagaaatgaggaggctgttttcctctgattctcctcggccgaccacctgtccaatgctgctggtttcgcagagcgaccggttggagatgtctgaggaagaaagttcaaggtgtagggatagtgtgtttggaatttgactttccatttctgagacccaagggggcgtagatgtagtggcaagtgtggcgatgtttactctcccttcctgaaccgctctggtctgctcctcagagagggcagcggtgccaggcctcaggtcagggagaatgtctgtgacttagctgcagactaggagactgccctgctaactaattagcaagcagctttgacctcattaatatataaaagcagctctcagtatattccgtgtcgtgtgtgtgtgtggccaaagcccccaagggtggcaagtgccaccttcgctgtgctagagttgtgttgtaggaattagtcagggagttgttgtgaaaaaaaaaaccccagtgcttgtgagggaactcaaaatagttaccagaaaaataatatttgccaatatgacgtgtatattgctcagcacactctgtatctcctgtccttaaaatcctcttgtccccggcattctgacacactgggctgccgtccggtgtcaagccccggcgcaggcttgctcttcttttacaatgaaaggggtgaagagtgagggtctcacagttccttacctcaaagtccctttaggtccttctggtttggaggaagtggagcctccacgaactctctcttactccgaccattcaggcagcaaagtctctgcttacatcattttggttgtcaccttggggctgagtgagaagtcttttgtaaattaattcggcgtgtgctacatgagccataattattaacagaacaggaatatcagaaacgaagttgttgatcaggcccactgcgaccttcctttctatctcagggtttaaaactgtgaggaaggagaagtatgaaggaaggtagaaaatgctggtgggtctccgtgtttatgagtcacagattttgaaagctatcaggaaatgactagagtggatcctggcactgattccaactctttgccagctaatcttaacatttagcagaaagctctagcaacatgatcttaattgtatccagaggatttgccaatgtatgttcagtctctcaagatttggcattagtcagacatgttgatgctagccacaatttggatttctccatagaataatcatttatttttgcagatcaaataaatcagagtttacaatgcacaggggatcatttatttagcattcccttgctagaagcccgtgtgccaggcactgtgctaggcgtggtgggcagtataaagaaatctgtctccacagccacacaaccagagggtgcacatgacttgatccctatgaccaagtcaagttggtgttgcccaaatcgcagtttgacataagggtcccacaggcttccccaccccccgcccccactcactgccccagggaccaacttcctaccctcacccaaggctttagaggacctgtagcatgtctttttcaacctgtcagtatccccttctgcttaacacacccactgagaaaaccctgtttgtagttcactttgactcttgaatgtgtcactttactggcaagagacttcctttgatttctactgtttacaaataaaactcagccagtctcattctatatcccaaacgtactgaatgaaactgattttggttccacaagcagtgtttgggtgttgccttcctgaaggtgaccaagcttccaaagctcgtcccactggcctctgtacatttccctgtggttctccgtccttccctggcgagggagctgggactgaagctttcccgctgtttccctgcctgcaaaagcagccccaagagctgcgcattggcttccctcagcaatctgtcctgtctgtgctcccattcggtccacatagctttctttgcctctctgaggcagacaggaagtgtctaattacgattttgtggcctgggttttgttgcataccacagattgtctatgtaacatgtagcgcacacctctcttggtgctatttcattcctgctgtaagagaatgacaaaaatattcatgtatagccaattgattgtgacgtgcttgtggtctgtgcttgctcagaaaaacaaacaaacaaacagtttttccaattataaataaatgctaaagacgaacacca

SEQ ID NO: 153963 - DNA, 1755 bp, Homo sapiens
  Payload ID: 10264
  Gene Symbol: MAP6
  Gene Name: microtubule-associated protein 6
  Uniprot ID: Q96JE9
  ENST ID: ENST00000526740
  CDS Start-End: 161-1615
agcagactgcgctcccaaaggcgtttgcgaccggtaatcgagggactctacagactctcctaggacagctctccccgggaatgaattcagggcatggacggacatcaagcctgtgaaaccaataaaggccaagccccagtacaagcccccagatgataagatggttcatgagaccagctacagtgctcagttcaaaggagaggccagcaagccaacaacagctgacaataaggtcattgatcgcagaagaatacgcagcctctacagcgaacccttcaaggaacccccaaaggtggaaaaacctagtgttcagagttccaaaccaaaaaagacctcagcgagccataagcccacgaggaaggccaaagacaagcaggcggtgtcaggccaggctgccaagaaaaagagcgcggagggcccgagtaccaccaagccagacgacaaggagcaaagcaaagagatgaacaataaactggctgaggcgaaagagagcctggctcaacccgtcagtgattcaagtaagactcaaggtcctgtagccacagagccagacaaggatcaaggttctgtggtcccaggccttctgaaaggtcaaggtcctatggtgcaagagcctctgaagaagcaaggttctgtggtcccagggcctccaaaggatctaggtcccatgatcccattaccagtcaaggatcaagatcacacggtccctgagcctttaaagaatgaaagccctgttatctcagcaccagtcaaggaccaaggtccctcggtcccagttcctccaaagaatcaaagtcctatggttccagcaaaagttaaggatcaaggctctgtggtaccagagtctctaaaggatcaaggtcctaggattcctgagcctgtgaagaatcaagctcctatggtcccagcacctgtcaaggatgaaggtcccatggtctcagcatctgtcaaggatcaaggtcccatggtctcagcacctgtcaaggatcaaggtcccatagtcccagcacctgtcaagggtgaaggtcccatagtcccagcacctgtcaaggatgaaggtcccatggtctcagcacctatcaaggatcaagatcccatggtcccagagcatccgaaggatgaaagtgccatggccacagcacccataaagaatcaaggttccatggtctctgagcctgtaaagaatcaaggtttagtggtctcagggccagtcaaggatcaagatgttgtagtcccagagcatgcaaaggttcacgattctgcagttgtggcacctgtaaagaatcaaggtcctgtggtccccgagtccgtgaagaatcaagaccccattctcccagtactagttaaggatcaaggccccacagtcctacagcctccaaagaatcaaggtcgtatagtccctgaacctctgaagaatcaagttcctatagtcccagtgcctctgaaggatcaagatcctctggtgccagtaccagcaaaggaccaaggtcctgcagtccctgaacctctgaagactcaaggtcccagggaccctcagctacctactgtctcacctctaccccgagtcatgatcccaactgccccccatacggaatacattgagagctccccttgacactcaccccttgacacaccaatgaaggagctgacagtgagagtgctcccctcccaggggcagtgaagacacatatttaatctgcatgaaacatgtacagtagtcttgctggaatctaataaaaatggtccctctggctc

SEQ ID NO: 153964 - DNA, 4152 bp, Homo sapiens
  Payload ID: 10265
  Gene Symbol: MAP7
  Gene Name: microtubule-associated protein 7
  Uniprot ID: Q14244
  ENST ID: ENST00000354570
  CDS Start-End: 412-2661
gggaaatagcgtctccgtaccctcgccccacctgggctgctcctcggaccgccgctcgtcccagactccaggaggcgccaccaggcctcgctgaccccgctccatatctccgggagccctcagctggtcggccgcggcgaccggaagctccggactgaggtactggttccgcccgccgctcttccagccgagactcggcagcggcggtcggagcggctgccacgccgcacctgcccgcgagggggcgcgccaggcccaggccgcagccgactgccgcgctctctgtccccgccctccgccatccccggactgcgctcacctgtctgggccgctggcctgggaggcgggggccggcgggagccaagccgaggaaagggcggagcggctctccgggcgcgtcatcggagcaccatggcggagctaggagctggcggcgacggccacaggggcggcgacggcgcagtgcgaagcgaaacagcacccgacagctacaaagtgcaagataagaaaaatgcctccagccgccctgcctctgcaatttcaggacaaaataacaaccactcaggaaataaaccagaccctccgcctgtgttacgtgttgatgaccggcagcggctggcccgggagcgacgtgaggaacgggagaaacagctagctgcaagagaaatagtgtggttagaaagagaagagcgagccaggcagcactacgagaagcacctggaagagcggaagaagaggttggaggagcagaggcagaaggaggagcggaggagggctgctgtggaggagaagcggaggcagagacttgaggaggacaaagaacgccacgaagctgttgtacggcgcacaatggaaaggagccagaagccaaaacagaagcataaccgttggtcgtggggaggctctctccatgggagccctagcatccacagtgcagatccagacaggcggtcagtttccaccatgaatctttcgaaatatgttgatcccgtcattagcaagcggctctcctcttcatctgcaactttactaaattctccagatagagctcgccgcctgcagctcagcccatgggagagcagcgttgttaacagactcctgacgcccacacattcgttcctggccagaagtaaaagcacagctgccttgtctggagaagcagcatcttgcagccccatcatcatgccctacaaagctgcacactctagaaattcgatggatcgaccaaaactctttgtaacaccacctgagggctcttctcgcaggaggatcattcatggcacagcgagctataaaaaagaaagagagagagaaaatgtactcttcctcacatctggcacccgaagggctgtatctccatctaatcccaaagcaagacaaccagctcgctcccgactttggcttccgtccaagtctcttcctcatttgcctggcacacccagaccgacatcctccttgccacccggctcagtcaaagctgctcctgctcaggtccggcccccatcccccggcaacatccgccctgtcaagagggaagtcaaagtggagcctgagaagaaagatcctgagaaggaacctcagaaagttgccaatgagccctcactaaagggcagagcacctttagtgaaggtagaagaagccacagttgaagagcggacacctgctgaaccagaagttggccctgctgctccagccatggccccagctccagcctcggccccagctccagcctcggccccagctccagccccggtccccaccccagccatggtctcagccccgtcatccactgtgaatgccagtgcttctgttaagacttctgcaggcaccaccgacccagaggaggccacaaggcttctagctgagaagaggcggctggcccgagagcagagagaaaaggaagaaagggagaggagggagcaggaagagcttgaaagacaaaagagagaggaattggctcaacgtgtggctgaagagaggacgactcgccgtgaggaggagtcgcgcaggctggaagccgagcaggcccgggagaaggaggagcagctgcagcggcaggcggaggagcgggcgctgcgcgagcgggaggaggcagagcgcgcccagaggcagaaagaagaagaagctcgcgttcgtgaagaagcagagagggtccggcaggaacgagagaagcatttccagagagaagagcaagagcgcctggagagaaagaagcgacttgaggagattatgaaaagaaccaggagaacagaagctacagataagaaaaccagtgatcagagaaacggtgatatagccaagggagctctcactggaggaacagaggtgtctgcacttccatgtacaacaaacgctccgggaaatggaaagccagttggcagcccacatgtggttacctcacaccagtcaaaagtgacagtggagagcactcccgatttggaaaaacaaccaaatgaaaatggtgtatctgttcagaatgaaaattttgaagaaattataaacttacccattggatctaaaccatccagattagatgtcaccaacagtgagagcccagaaattcctttgaatccaattttggcctttgatgatgaagggacacttgggcccctgcctcaggtagatggtgttcagacacagcagactgcagaagttatatgagtgtttcttctgaagaaccaaagctgaaatttaatgagaatttctacaattaatggaattcctttcctgctataaaggagcatcccctccacccgttttctagagttcttgaccatcattttgaaaagatttattaaaactagctaaagacaacagactggatagcttttctaataattttcatcaataggaaaaaagaaatacgtctcattcttcaatactttaaaatggctttttccagtgtgctccttcttagcaatcaatatttttctgcattctttaaaagacaagagaatttggttataaaagaaatgggctgactaggcatgatttttttggtcttaaaagcttaacatgtaaaattggcaaaaaaaattttttaccttttataatacttgaaaaataagtacctctttgttctacaagtagaatgaataggagaagagtttaagcctgtttttttaaaatattattgcaaagagctctatttgtagaagcaaattataggcagattaccaggttcttataaatacagcttgtacatggacattctgcaaacccagctgtcacatttttcttgcaactccttttgcaaaagcagactaaaatgttttaaaatgtgaaaaaacattattttttcaaagcaagaaaataatttactgccctcttacataatgtatttataaagtttttccagataaactaatcaaataaattagaataatgtgacaacattacaaatttaatttgttagctgcattccttctgatgttaccacgatagaatgttactgatgattcagggctatttctgaagtctgtatgttgctgctgtccccagtgatggtggacttatctttgccttacctgatcacaaattatgttggggaaaataaagatttaatatttctttaaatagaaaaagaatttggttttgctcgtttaagagcaatgagaaaatgatggaatgttgactgtgtttggcacacaggacacggaccttcatggaagtccttgctctgcgtggcatctgtcagcttttcacctttcattcttattcttcacttttgctgctgagcctagctgtacaaacttgcactttcatttgctaatataaattcagttttattttaccattttagagactactaatgattaaatgtagaaggagagggtgcacatgtttttatgtggagtgtttaaaagataaatttataccactgtaatgtgcagcttttattaaaagagaaattggttgaactgctaggttgaatgagagacttcatctattggactattttttttaatccaggcatatggtctttagtaatggcttgtaatttgtgaaaacattaatttgggggttttccctgttttcagttgtccatgtacacatagtcattatattagaaaagaaatctgttcaacaaacttgtttaatttgtttaaatcaacatagcatgaaacaccaaataaaatgtttgacatagtt

SEQ ID NO: 153965 - DNA, 2633 bp, Homo sapiens
  Payload ID: 10265
  Gene Symbol: MAP7
  Gene Name: microtubule-associated protein 7
  Uniprot ID: Q14244
  ENST ID: ENST00000438100
  CDS Start-End: 20-2224
aaaaacaagtagcagcggtatgcctggatcagctacagctctccgacatgagagactgaagaagaccaatgcaaggccaattcctcttggtttattcaccattaatgaggaagacgaacagcaaaagaatggaaattccagaagaccaaaagcacccgacagctacaaagtgcaagataagaaaaatgcctccagccgccctgcctctgcaatttcaggacaaaataacaaccactcaggaaataaaccagaccctccgcctgtgttacgtgttgatgaccggcagcggctggcccgggagcgacgtgaggaacgggagaaacagctagctgcaagagaaatagtgtggttagaaagagaagagcgagccaggcagcactacgagaagcacctggaagagcggaagaagaggttggaggagcagaggcagaaggaggagcggaggagggctgctgtggaggagaagcggaggcagagacttgaggaggacaaagaacgccacgaagctgttgtacggcgcacaatggaaaggagccagaagccaaaacagaagcataaccgttggtcgtggggaggctctctccatgggagccctagcatccacagtgcagctcgccgcctgcagctcagcccatgggagagcagcgttgttaacagactcctgacgcccacacattcgttcctggccagaagtaaaagcacagctgccttgtctggagaagcagcatcttgcagccccatcatcatgccctacaaagctgcacactctagaaattcgatggatcgaccaaaactctttgtaacaccacctgagggctcttctcgcaggaggatcattcatggcacagcgagctataaaaaagaaagagagagagaaaatgtactcttcctcacatctggcacccgaagggctgtatctccatctaatcccaaagcaagacaaccagctcgctcccgactttggcttccgtccaagtctcttcctcatttgcctggcacacccagaccgacatcctccttgccacccggctcagtcaaagctgctcctgctcaggtccggcccccatcccccggcaacatccgccctgtcaagagggaagtcaaagtggagcctgagaagaaagatcctgagaaggaacctcagaaagttgccaatgagccctcactaaagggcagagcacctttagtgaaggtagaagaagccacagttgaagagcggacacctgctgaaccagaagttggccctgctgctccagccatggccccagctccagcctcggccccagctccagcctcggccccagctccagccccggtccccaccccagccatggtctcagccccgtcatccactgtgaatgccagtgcttctgttaagacttctgcaggcaccaccgacccagaggaggccacaaggcttctagctgagaagaggcggctggcccgagagcagagagaaaaggaagaaagggagaggagggagcaggaagagcttgaaagacaaaagagagaggaattggctcaacgtgtggctgaagagaggacgactcgccgtgaggaggagtcgcgcaggctggaagccgagcaggcccgggagaaggaggagcagctgcagcggcaggcggaggagcgggcgctgcgcgagcgggaggaggcagagcgcgcccagaggcagaaagaagaagaagctcgcgttcgtgaagaagcagagagggtccggcaggaacgagagaagcatttccagagagaagagcaagagcgcctggagagaaagaagcgacttgaggagattatgaaaagaaccaggagaacagaagctacagataagaaaaccagtgatcagagaaacggtgatatagccaagggagctctcactggaggaacagaggtgtctgcacttccatgtacaacaaacgctccgggaaatggaaagccagttggcagcccacatgtggttacctcacaccagtcaaaagtgacagtggagagcactcccgatttggaaaaacaaccaaatgaaaatggtgtatctgttcagaatgaaaattttgaagaaattataaacttacccattggatctaaaccatccagattagatgtcaccaacagtgagagcccagaaattcctttgaatccaattttggcctttgatgatgaagggacacttgggcccctgcctcaggtagatggtgttcagacacagcagactgcagaagttatatgagtgtttcttctgaagaaccaaagctgaaatttaatgagaatttctacaattaatggaattcctttcctgctataaaggagcatcccctccacccgttttctagagttcttgaccatcattttgaaaagatttattaaaactagctaaagacaacagactggatagcttttctaataattttcatcaataggaaaaaagaaatacgtctcattcttcaatactttaaaatggctttttccagtgtgctccttcttagcaatcaatatttttctgcattctttaaaagacaagagaatttggttataaaagaaatgggctgactaggcatgatttttttggtcttaaaagcttaacatgtaaaattggcaaaaaaaattttttaccttttataatacttgaaaaataagta

SEQ ID NO: 153966 - DNA, 3119 bp, Homo sapiens
  Payload ID: 10265
  Gene Symbol: MAP7
  Gene Name: microtubule-associated protein 7
  Uniprot ID: Q14244
  ENST ID: ENST00000454590
  CDS Start-End: 119-2434
atatcatattttcccctctctgctgtgggctgaatattttactgtgtggtagcaggaagaagattggaaaaaggtgctgcagcaggaagaagctgggatctgattgaacagcagcggtatgcctggatcagctacagctctccgacatgagagactgaagaagaccaatgcaaggccaattcctcttggtttattcaccattaatgaggaagacgaacagcaaaagaatggaaattccagaagaccaaaagcacccgacagctacaaagtgcaagataagaaaaatgcctccagccgccctgcctctgcaatttcaggacaaaataacaaccactcaggaaataaaccagaccctccgcctgtgttacgtgttgatgaccggcagcggctggcccgggagcgacgtgaggaacgggagaaacagctagctgcaagagaaatagtgtggttagaaagagaagagcgagccaggcagcactacgagaagcacctggaagagcggaagaagaggttggaggagcagaggcagaaggaggagcggaggagggctgctgtggaggagaagcggaggcagagacttgaggaggacaaagaacgccacgaagctgttgtacggcgcacaatggaaaggagccagaagccaaaacagaagcataaccgttggtcgtggggaggctctctccatgggagccctagcatccacagtgcagatccagacaggcggtcagtttccaccatgaatctttcgaaatatgttgatcccgtcattagcaagcggctctcctcttcatctgcaactttactaaattctccagatagagctcgccgcctgcagctcagcccatgggagagcagcgttgttaacagactcctgacgcccacacattcgttcctggccagaagtaaaagcacagctgccttgtctggagaagcagcatcttgcagccccatcatcatgccctacaaagctgcacactctagaaattcgatggatcgaccaaaactctttgtaacaccacctgagggctcttctcgcaggaggatcattcatggcacagcgagctataaaaaagaaagagagagagaaaatgtactcttcctcacatctggcacccgaagggctgtatctccatctaatcccaaagcaagacaaccagctcgctcccgactttggcttccgtccaagtctcttcctcatttgcctggcacacccagaccgacatcctccttgccacccggctcagtcaaagctgctcctgctcaggtccggcccccatcccccggcaacatccgccctgtcaagagggaagtcaaagtggagcctgagaagaaagatcctgagaaggaacctcagaaagttgccaatgagccctcactaaagggcagagcacctttagtgaaggtagaagaagccacagttgaagagcggacacctgctgaaccagaagttggccctgctgctccagccatggccccagctccagcctcggccccagctccagcctcggccccagctccagccccggtccccaccccagccatggtctcagccccgtcatccactgtgaatgccagtgcttctgttaagacttctgcaggcaccaccgacccagaggaggccacaaggcttctagctgagaagaggcggctggcccgagagcagagagaaaaggaagaaagggagaggagggagcaggaagagcttgaaagacaaaagagagaggaattggctcaacgtgtggctgaagagaggacgactcgccgtgaggaggagtcgcgcaggctggaagccgagcaggcccgggagaaggaggagcagctgcagcggcaggcggaggagcgggcgctgcgcgagcgggaggaggcagagcgcgcccagaggcagaaagaagaagaagctcgcgttcgtgaagaagcagagagggtccggcaggaacgagagaagcatttccagagagaagagcaagagcgcctggagagaaagaagcgacttgaggagattatgaaaagaaccaggagaacagaagctacagataagaaaaccagtgatcagagaaacggtgatatagccaagggagctctcactggaggaacagaggtgtctgcacttccatgtacaacaaacgctccgggaaatggaaagccagttggcagcccacatgtggttacctcacaccagtcaaaagtgacagtggagagcactcccgatttggaaaaacaaccaaatgaaaatggtgtatctgttcagaatgaaaattttgaagaaattataaacttacccattggatctaaaccatccagattagatgtcaccaacagtgagagcccagaaattcctttgaatccaattttggcctttgatgatgaagggacacttgggcccctgcctcaggtagatggtgttcagacacagcagactgcagaagttatatgagtgtttcttctgaagaaccaaagctgaaatttaatgagaatttctacaattaatggaattcctttcctgctataaaggagcatcccctccacccgttttctagagttcttgaccatcattttgaaaagatttattaaaactagctaaagacaacagactggatagcttttctaataattttcatcaataggaaaaaagaaatacgtctcattcttcaatactttaaaatggctttttccagtgtgctccttcttagcaatcaatatttttctgcattctttaaaagacaagagaatttggttataaaagaaatgggctgactaggcatgatttttttggtcttaaaagcttaacatgtaaaattggcaaaaaaaattttttaccttttataatacttgaaaaataagtacctctttgttctacaagtagaatgaataggagaagagtttaagcctgtttttttaaaatattattgcaaagagctctatttgtagaagcaaattataggcagattaccaggttcttataaatacagcttgtacatggacattctgcaaacccagctgtcacatttttcttgcaactccttttgcaaaagcagactaaaatgttttaaaatgtgaaaaaacattattttttcaaagcaagaaaataatttactgccctcttacataatgtatttata

SEQ ID NO: 153967 - DNA, 4375 bp, Homo sapiens
  Payload ID: 10265
  Gene Symbol: MAP7
  Gene Name: microtubule-associated protein 7
  Uniprot ID: Q14244
  ENST ID: ENST00000432797
  CDS Start-End: 617-2428
gtaaccctctgctggtgagttcccagaacccagcatcctgcaagctgccgcttctcagctggggagatggagccgctctgggcccttcttgattaggatatgttagggttgtcagggcaactgttaacggcagcatatcatattttcccctctctgctgtgggctgaatattttactgtgtggtagcaggaagaagattggaaaaaggtgctgcagcaggaagaagctgggatctgattgaacagcacccgacagctacaaagtgcaagataagaaaaatgcctccagccgccctgcctctgcaatttcaggacaaaataacaaccactcaggaaataaaccagaccctccgcctgtgttacgtgttgatgaccggcagcggctggcccgggagcgacgtgaggaacgggagaaacagctagctgcaagagaaatagtgtggttagaaagagaagagcgagccaggcagcactacgagaagcacctggaagagcggaagaagaggttggaggagcagaggcagaaggaggagcggaggagggctgctgtggaggagaagcggaggcagagacttgaggaggacaaagaacgccacgaagctgttgtacggcgcacaatggaaaggagccagaagccaaaacagaagcataaccgttggtcgtggggaggctctctccatgggagccctagcatccacagtgcagatccagacaggcggtcagtttccaccatgaatctttcgaaatatgttgatcccgtcattagcaagcggctctcctcttcatctgcaactttactaaattctccagatagagctcgccgcctgcagctcagcccatgggagagcagcgttgttaacagactcctgacgcccacacattcgttcctggccagaagtaaaagcacagctgccttgtctggagaagcagcatcttgcagccccatcatcatgccctacaaagctgcacactctagaaattcgatggatcgaccaaaactctttgtaacaccacctgagggctcttctcgcaggaggatcattcatggcacagcgagctataaaaaagaaagagagagagaaaatgtactcttcctcacatctggcacccgaagggctgtatctccatctaatcccaaagcaagacaaccagctcgctcccgactttggcttccgtccaagtctcttcctcatttgcctggcacacccagaccgacatcctccttgccacccggctcagtcaaagctgctcctgctcaggtccggcccccatcccccggcaacatccgccctgtcaagagggaagtcaaagtggagcctgagaagaaagatcctgagaaggaacctcagaaagttgccaatgagccctcactaaagggcagagcacctttagtgaaggtagaagaagccacagttgaagagcggacacctgctgaaccagaagttggccctgctgctccagccatggccccagctccagcctcggccccagctccagcctcggccccagctccagccccggtccccaccccagccatggtctcagccccgtcatccactgtgaatgccagtgcttctgttaagacttctgcaggcaccaccgacccagaggaggccacaaggcttctagctgagaagaggcggctggcccgagagcagagagaaaaggaagaaagggagaggagggagcaggaagagcttgaaagacaaaagagagaggaattggctcaacgtgtggctgaagagaggacgactcgccgtgaggaggagtcgcgcaggctggaagccgagcaggcccgggagaaggaggagcagctgcagcggcaggcggaggagcgggcgctgcgcgagcgggaggaggcagagcgcgcccagaggcagaaagaagaagaagctcgcgttcgtgaagaagcagagagggtccggcaggaacgagagaagcatttccagagagaagagcaagagcgcctggagagaaagaagcgacttgaggagattatgaaaagaaccaggagaacagaagctacagataagaaaaccagtgatcagagaaacggtgatatagccaagggagctctcactggaggaacagaggtgtctgcacttccatgtacaacaaacgctccgggaaatggaaagccagttggcagcccacatgtggttacctcacaccagtcaaaagtgacagtggagagcactcccgatttggaaaaacaaccaaatgaaaatggtgtatctgttcagaatgaaaattttgaagaaattataaacttacccattggatctaaaccatccagattagatgtcaccaacagtgagagcccagaaattcctttgaatccaattttggcctttgatgatgaagggacacttgggcccctgcctcaggtagatggtgttcagacacagcagactgcagaagttatatgagtgtttcttctgaagaaccaaagctgaaatttaatgagaatttctacaattaatggaattcctttcctgctataaaggagcatcccctccacccgttttctagagttcttgaccatcattttgaaaagatttattaaaactagctaaagacaacagactggatagcttttctaataattttcatcaataggaaaaaagaaatacgtctcattcttcaatactttaaaatggctttttccagtgtgctccttcttagcaatcaatatttttctgcattctttaaaagacaagagaatttggttataaaagaaatgggctgactaggcatgatttttttggtcttaaaagcttaacatgtaaaattggcaaaaaaaattttttaccttttataatacttgaaaaataagtacctctttgttctacaagtagaatgaataggagaagagtttaagcctgtttttttaaaatattattgcaaagagctctatttgtagaagcaaattataggcagattaccaggttcttataaatacagcttgtacatggacattctgcaaacccagctgtcacatttttcttgcaactccttttgcaaaagcagactaaaatgttttaaaatgtgaaaaaacattattttttcaaagcaagaaaataatttactgccctcttacataatgtatttataaagtttttccagataaactaatcaaataaattagaataatgtgacaacattacaaatttaatttgttagctgcattccttctgatgttaccacgatagaatgttactgatgattcagggctatttctgaagtctgtatgttgctgctgtccccagtgatggtggacttatctttgccttacctgatcacaaattatgttggggaaaataaagatttaatatttctttaaatagaaaaagaatttggttttgctcgtttaagagcaatgagaaaatgatggaatgttgactgtgtttggcacacaggacacggaccttcatggaagtccttgctctgcgtggcatctgtcagcttttcacctttcattcttattcttcacttttgctgctgagcctagctgtacaaacttgcactttcatttgctaatataaattcagttttattttaccattttagagactactaatgattaaatgtagaaggagagggtgcacatgtttttatgtggagtgtttaaaagataaatttataccactgtaatgtgcagcttttattaaaagagaaattggttgaactgctaggttgaatgagagacttcatctattggactattttttttaatccaggcatatggtctttagtaatggcttgtaatttgtgaaaacattaatttgggggttttccctgttttcagttgtccatgtacacatagtcattatattagaaaagaaatctgttcaacaaacttgtttaatttgtttaaatcaacatagcatgaaacaccaaataaaatgtttgacatagttttacttttagctttctcatatgttataacttcactcagattgattcttgagtcttcagattgtccttcatttaactcagtgacattttcctagcctcctgttgattaagcatataggatagccttatttaaaatttagagcagtaggtgtattttggctgtttttctttttcatgtgtgtttttaaactttagtcatcattagcaaacggaaagccttctaagtaatcaagttttaattagaagtggtgcaaaattcttaattatattgtgttaaagagcagcgctgccagagaatgaccctgacctttacaatggctggcttgctttttggccagcactggaaaaatctatatttacttgcagaccttaaggaggtcttcagtattcaccctacattaaggggagcgctcaggaatcaaatatggccctcagtatgaaatgagagtgaatgggct

SEQ ID NO: 153968 - DNA, 2744 bp, Homo sapiens
  Payload ID: 10265
  Gene Symbol: MAP7
  Gene Name: microtubule-associated protein 7
  Uniprot ID: Q14244
  ENST ID: ENST00000544465
  CDS Start-End: 94-2298
gatatttggtctttgcctggctgagggacacaaagcaagaagagggagacatgcagatatgttgcaggatattcaagaaagaaggattttagcatggaagacactaaactgtactcacccgacagctacaaagtgcaagataagaaaaatgcctccagccgccctgcctctgcaatttcaggacaaaataacaaccactcaggaaataaaccagaccctccgcctgtgttacgtgttgatgaccggcagcggctggcccgggagcgacgtgaggaacgggagaaacagctagctgcaagagaaatagtgtggttagaaagagaagagcgagccaggcagcactacgagaagcacctggaagagcggaagaagaggttggaggagcagaggcagaaggaggagcggaggagggctgctgtggaggagaagcggaggcagagacttgaggaggacaaagaacgccacgaagctgttgtacggcgcacaatggaaaggagccagaagccaaaacagaagcataaccgttggtcgtggggaggctctctccatgggagccctagcatccacagtgcagatccagacaggcggtcagtttccaccatgaatctttcgaaatatgttgatcccgtcattagcaagcggctctcctcttcatctgcaactttactaaattctccagatagagctcgccgcctgcagctcagcccatgggagagcagcgttgttaacagactcctgacgcccacacattcgttcctggccagaagtaaaagcacagctgccttgtctggagaagcagcatcttgcagccccatcatcatgccctacaaagctgcacactctagaaattcgatggatcgaccaaaactctttgtaacaccacctgagggctcttctcgcaggaggatcattcatggcacagcgagctataaaaaagaaagagagagagaaaatgtactcttcctcacatctggcacccgaagggctgtatctccatctaatcccaaagcaagacaaccagctcgctcccgactttggcttccgtccaagtctcttcctcatttgcctggcacacccagaccgacatcctccttgccacccggctcagtcaaagctgctcctgctcaggtccggcccccatcccccggcaacatccgccctgtcaagagggaagtcaaagtggagcctgagaagaaagatcctgagaaggaacctcagaaagttgccaatgagccctcactaaagggcagagcacctttagtgaaggtagaagaagccacagttgaagagcggacacctgctgaaccagaagttggccctgctgctccagccatggccccagctccagcctcggccccagctccagcctcggccccagctccagccccggtccccaccccagccatggtctcagccccgtcatccactgtgaatgccagtgcttctgttaagacttctgcaggcaccaccgacccagaggaggccacaaggcttctagctgagaagaggcggctggcccgagagcagagagaaaaggaagaaagggagaggagggagcaggaagagcttgaaagacaaaagagagaggaattggctcaacgtgtggctgaagagaggacgactcgccgtgaggaggagtcgcgcaggctggaagccgagcaggcccgggagaaggaggagcagctgcagcggcaggcggaggagcgggcgctgcgcgagcgggaggaggcagagcgcgcccagaggcagaaagaagaagaagctcgcgttcgtgaagaagcagagagggtccggcaggaacgagagaagcatttccagagagaagagcaagagcgcctggagagaaagaagcgacttgaggagattatgaaaagaaccaggagaacagaagctacagataagaaaaccagtgatcagagaaacggtgatatagccaagggagctctcactggaggaacagaggtgtctgcacttccatgtacaacaaacgctccgggaaatggaaagccagttggcagcccacatgtggttacctcacaccagtcaaaagtgacagtggagagcactcccgatttggaaaaacaaccaaatgaaaatggtgtatctgttcagaatgaaaattttgaagaaattataaacttacccattggatctaaaccatccagattagatgtcaccaacagtgagagcccagaaattcctttgaatccaattttggcctttgatgatgaagggacacttgggcccctgcctcaggtagatggtgttcagacacagcagactgcagaagttatatgagtgtttcttctgaagaaccaaagctgaaatttaatgagaatttctacaattaatggaattcctttcctgctataaaggagcatcccctccacccgttttctagagttcttgaccatcattttgaaaagatttattaaaactagctaaagacaacagactggatagcttttctaataattttcatcaataggaaaaaagaaatacgtctcattcttcaatactttaaaatggctttttccagtgtgctccttcttagcaatcaatatttttctgcattctttaaaagacaagagaatttggttataaaagaaatgggctgactaggcatgatttttttggtcttaaaagcttaacatgtaaaattggcaaaaaaaattttttaccttttataatacttgaaaaataagtacctctttgttctacaagtagaatgaataggagaagag

SEQ ID NO: 153969 - DNA, 4536 bp, Homo sapiens
  Payload ID: 10265
  Gene Symbol: MAP7
  Gene Name: microtubule-associated protein 7
  ENST ID: ENST00000617204
  CDS Start-End: 250-2589
agtgggagggggctggtaggggaggtggggaagctgctgctaggtgaggggaactgcagggcctcagttgccaagtggctggtactatctgtcagctgtttgcaaactgtttacccataggggatctattacaagtgctcaaatgaacaggcagcttaggaactagcagcttcctgggagctgcaattacataagcatatatttttaatataatcacaattaaaaaaaaaaaaaacaagtagcagcggtatgcctggatcagctacagctctccgacatgagagactgaagaagaccaatgcaaggccaattcctcttggtttattcaccattaatgaggaagacgaacagcaaaagaatggaaattccagaagaccaaaagcacccgacagctacaaagtgcaagataagaaaaatgcctccagccgccctgcctctgcaatttcaggacaaaataacaaccactcaggaaataaaccagaccctccgcctgtgttacgtgttgatgaccggcagcggctggcccgggagcgacgtgaggaacgggagaaacagctagctgcaagagaaatagtgtggttagaaagagaagagcgagccaggcagcactacgagaagcacctggaagagcggaagaagaggttggaggagcagaggcagaaggaggagcggaggagggctgctgtggaggagaagcggaggcagagacttgaggaggacaaagaacgccacgaagctgttgtacggcgcacaatggaaaggagccagaagccaaaacagaagcataaccgttggtcgtggggaggctctctccatgggagccctagcatccacagtgcagatccagacaggcggtcagtttccaccatgaatctttcgaaatatgttgatcccgtcattagcaagcggctctcctcttcatctgcaactttactaaattctccagatagagctcgccgcctgcagctcagcccatgggagagcagcgttgttaacagactcctgacgcccacacattcgttcctggccagaagtaaaagcacagctgccttgtctggagaagcagttatccccatttgtcctcgttcagcatcttgcagccccatcatcatgccctacaaagctgcacactctagaaattcgatggatcgaccaaaactctttgtaacaccacctgagggctcttctcgcaggaggatcattcatggcacagcgagctataaaaaagaaagagagagagaaaatgtactcttcctcacatctggcacccgaagggctgtatctccatctaatcccaaagcaagacaaccagctcgctcccgactttggcttccgtccaagtctcttcctcatttgcctggcacacccagaccgacatcctccttgccacccggctcagtcaaagctgctcctgctcaggtccggcccccatcccccggcaacatccgccctgtcaagagggaagtcaaagtggagcctgagaagaaagatcctgagaaggaacctcagaaagttgccaatgagccctcactaaagggcagagcacctttagtgaaggtagaagaagccacagttgaagagcggacacctgctgaaccagaagttggccctgctgctccagccatggccccagctccagcctcggccccagctccagcctcggccccagctccagccccggtccccaccccagccatggtctcagccccgtcatccactgtgaatgccagtgcttctgttaagacttctgcaggcaccaccgacccagaggaggccacaaggcttctagctgagaagaggcggctggcccgagagcagagagaaaaggaagaaagggagaggagggagcaggaagagcttgaaagacaaaagagagaggaattggctcaacgtgtggctgaagagaggacgactcgccgtgaggaggagtcgcgcaggctggaagccgagcaggcccgggagaaggaggagcagctgcagcggcaggcggaggagcgggcgctgcgcgagcgggaggaggcagagcgcgcccagaggcagaaagaagaagaagctcgcgttcgtgaagaagcagagagggtccggcaggaacgagagaagcatttccagagagaagagcaagagcgcctggagagaaagaagcgacttgaggagattatgaaaagaaccaggagaacagaagctacagataagaaaaccagtgatcagagaaacggtgatatagccaagggagctctcactggaggaacagaggtgtctgcacttccatgtacaacaaacgctccgggaaatggaaagccagttggcagcccacatgtggttacctcacaccagtcaaaagtgacagtggagagcactcccgatttggaaaaacaaccaaatgaaaatggtgtatctgttcagaatgaaaattttgaagaaattataaacttacccattggatctaaaccatccagattagatgtcaccaacagtgagagcccagaaattcctttgaatccaattttggcctttgatgatgaagggacacttgggcccctgcctcaggtagatggtgttcagacacagcagactgcagaagttatatgagtgtttcttctgaagaaccaaagctgaaatttaatgagaatttctacaattaatggaattcctttcctgctataaaggagcatcccctccacccgttttctagagttcttgaccatcattttgaaaagatttattaaaactagctaaagacaacagactggatagcttttctaataattttcatcaataggaaaaaagaaatacgtctcattcttcaatactttaaaatggctttttccagtgtgctccttcttagcaatcaatatttttctgcattctttaaaagacaagagaatttggttataaaagaaatgggctgactaggcatgatttttttggtcttaaaagcttaacatgtaaaattggcaaaaaaaattttttaccttttataatacttgaaaaataagtacctctttgttctacaagtagaatgaataggagaagagtttaagcctgtttttttaaaatattattgcaaagagctctatttgtagaagcaaattataggcagattaccaggttcttataaatacagcttgtacatggacattctgcaaacccagctgtcacatttttcttgcaactccttttgcaaaagcagactaaaatgttttaaaatgtgaaaaaacattattttttcaaagcaagaaaataatttactgccctcttacataatgtatttataaagtttttccagataaactaatcaaataaattagaataatgtgacaacattacaaatttaatttgttagctgcattccttctgatgttaccacgatagaatgttactgatgattcagggctatttctgaagtctgtatgttgctgctgtccccagtgatggtggacttatctttgccttacctgatcacaaattatgttggggaaaataaagatttaatatttctttaaatagaaaaagaatttggttttgctcgtttaagagcaatgagaaaatgatggaatgttgactgtgtttggcacacaggacacggaccttcatggaagtccttgctctgcgtggcatctgtcagcttttcacctttcattcttattcttcacttttgctgctgagcctagctgtacaaacttgcactttcatttgctaatataaattcagttttattttaccattttagagactactaatgattaaatgtagaaggagagggtgcacatgtttttatgtggagtgtttaaaagataaatttataccactgtaatgtgcagcttttattaaaagagaaattggttgaactgctaggttgaatgagagacttcatctattggactattttttttaatccaggcatatggtctttagtaatggcttgtaatttgtgaaaacattaatttgggggttttccctgttttcagttgtccatgtacacatagtcattatattagaaaagaaatctgttcaacaaacttgtttaatttgtttaaatcaacatagcatgaaacaccaaataaaatgtttgacatagttttacttttagctttctcatatgttataacttcactcagattgattcttgagtcttcagattgtccttcatttaactcagtgacattttcctagcctcctgttgattaagcatataggatagccttatttaaaatttagagcagtaggtgtattttggctgtttttctttttcatgtgtgtttttaaactttagtcatcattagcaaacggaaagccttctaagtaatcaagttttaattagaagtggtgcaaaattcttaattatattgtgttaaagagcagcgctgccagagaatgaccctgacctttacaatggctggcttgctttttggccagcactggaaaaatctatatttacttgcagaccttaaggaggtcttcagtattcaccctacattaaggggagcgctcaggaatcaaatatggccctcagtatgaaatgagagtgaatgggct

SEQ ID NO: 153970 - DNA, 4497 bp, Homo sapiens
  Payload ID: 10265
  Gene Symbol: MAP7
  Gene Name: microtubule-associated protein 7
  Uniprot ID: Q14244
  ENST ID: ENST00000618822
  CDS Start-End: 412-2550
gggaaatagcgtctccgtaccctcgccccacctgggctgctcctcggaccgccgctcgtcccagactccaggaggcgccaccaggcctcgctgaccccgctccatatctccgggagccctcagctggtcggccgcggcgaccggaagctccggactgaggtactggttccgcccgccgctcttccagccgagactcggcagcggcggtcggagcggctgccacgccgcacctgcccgcgagggggcgcgccaggcccaggccgcagccgactgccgcgctctctgtccccgccctccgccatccccggactgcgctcacctgtctgggccgctggcctgggaggcgggggccggcgggagccaagccgaggaaagggcggagcggctctccgggcgcgtcatcggagcaccatggcggagctaggagctggcggcgacggccacaggggcggcgacggcgcagtgcgaagcgaaacagcacccgacagctacaaagtgcaagataagaaaaatgcctccagccgccctgcctctgcaatttcaggacaaaataacaaccactcaggaaataaaccagaccctccgcctgtgttacgtgttgatgaccggcagcggctggcccgggagcgacgtgaggaacgggagaaacagctagctgcaagagaaatagtgtggttagaaagagaagagcgagccaggcagcactacgagaagcacctggaagagcggaagaagaggttggaggagcagaggcagaaggaggagcggaggagggctgctgtggaggagaagcggaggcagagacttgaggaggacaaagaacgccacgaagctgttgtacggcgcacaatggaaaggagccagaagccaaaacagaagcataaccgttggtcgtggggaggctctctccatgggagccctagcatccacagtgcagctcgccgcctgcagctcagcccatgggagagcagcgttgttaacagactcctgacgcccacacattcgttcctggccagaagtaaaagcacagctgccttgtctggagaagcagcatcttgcagccccatcatcatgccctacaaagctgcacactctagaaattcgatggatcgaccaaaactctttgtaacaccacctgagggctcttctcgcaggaggatcattcatggcacagcgagctataaaaaagaaagagagagagaaaatgtactcttcctcacatctggcacccgaagggctgtatctccatctaatcccaaagcaagacaaccagctcgctcccgactttggcttccgtccaagtctcttcctcatttgcctggcacacccagaccgacatcctccttgccacccggctcagtcaaagctgctcctgctcaggtccggcccccatcccccggcaacatccgccctgtcaagagggaagtcaaagtggagcctgagaagaaagatcctgagaaggaacctcagaaagttgccaatgagccctcactaaagggcagagcacctttagtgaaggtagaagaagccacagttgaagagcggacacctgctgaaccagaagttggccctgctgctccagccatggccccagctccagcctcggccccagctccagcctcggccccagctccagccccggtccccaccccagccatggtctcagccccgtcatccactgtgaatgccagtgcttctgttaagacttctgcaggcaccaccgacccagaggaggccacaaggcttctagctgagaagaggcggctggcccgagagcagagagaaaaggaagaaagggagaggagggagcaggaagagcttgaaagacaaaagagagaggaattggctcaacgtgtggctgaagagaggacgactcgccgtgaggaggagtcgcgcaggctggaagccgagcaggcccgggagaaggaggagcagctgcagcggcaggcggaggagcgggcgctgcgcgagcgggaggaggcagagcgcgcccagaggcagaaagaagaagaagctcgcgttcgtgaagaagcagagagggtccggcaggaacgagagaagcatttccagagagaagagcaagagcgcctggagagaaagaagcgacttgaggagattatgaaaagaaccaggagaacagaagctacagataagaaaaccagtgatcagagaaacggtgatatagccaagggagctctcactggaggaacagaggtgtctgcacttccatgtacaacaaacgctccgggaaatggaaagccagttggcagcccacatgtggttacctcacaccagtcaaaagtgacagtggagagcactcccgatttggaaaaacaaccaaatgaaaatggtgtatctgttcagaatgaaaattttgaagaaattataaacttacccattggatctaaaccatccagattagatgtcaccaacagtgagagcccagaaattcctttgaatccaattttggcctttgatgatgaagggacacttgggcccctgcctcaggtagatggtgttcagacacagcagactgcagaagttatatgagtgtttcttctgaagaaccaaagctgaaatttaatgagaatttctacaattaatggaattcctttcctgctataaaggagcatcccctccacccgttttctagagttcttgaccatcattttgaaaagatttattaaaactagctaaagacaacagactggatagcttttctaataattttcatcaataggaaaaaagaaatacgtctcattcttcaatactttaaaatggctttttccagtgtgctccttcttagcaatcaatatttttctgcattctttaaaagacaagagaatttggttataaaagaaatgggctgactaggcatgatttttttggtcttaaaagcttaacatgtaaaattggcaaaaaaaattttttaccttttataatacttgaaaaataagtacctctttgttctacaagtagaatgaataggagaagagtttaagcctgtttttttaaaatattattgcaaagagctctatttgtagaagcaaattataggcagattaccaggttcttataaatacagcttgtacatggacattctgcaaacccagctgtcacatttttcttgcaactccttttgcaaaagcagactaaaatgttttaaaatgtgaaaaaacattattttttcaaagcaagaaaataatttactgccctcttacataatgtatttataaagtttttccagataaactaatcaaataaattagaataatgtgacaacattacaaatttaatttgttagctgcattccttctgatgttaccacgatagaatgttactgatgattcagggctatttctgaagtctgtatgttgctgctgtccccagtgatggtggacttatctttgccttacctgatcacaaattatgttggggaaaataaagatttaatatttctttaaatagaaaaagaatttggttttgctcgtttaagagcaatgagaaaatgatggaatgttgactgtgtttggcacacaggacacggaccttcatggaagtccttgctctgcgtggcatctgtcagcttttcacctttcattcttattcttcacttttgctgctgagcctagctgtacaaacttgcactttcatttgctaatataaattcagttttattttaccattttagagactactaatgattaaatgtagaaggagagggtgcacatgtttttatgtggagtgtttaaaagataaatttataccactgtaatgtgcagcttttattaaaagagaaattggttgaactgctaggttgaatgagagacttcatctattggactattttttttaatccaggcatatggtctttagtaatggcttgtaatttgtgaaaacattaatttgggggttttccctgttttcagttgtccatgtacacatagtcattatattagaaaagaaatctgttcaacaaacttgtttaatttgtttaaatcaacatagcatgaaacaccaaataaaatgtttgacatagttttacttttagctttctcatatgttataacttcactcagattgattcttgagtcttcagattgtccttcatttaactcagtgacattttcctagcctcctgttgattaagcatataggatagccttatttaaaatttagagcagtaggtgtattttggctgtttttctttttcatgtgtgtttttaaactttagtcatcattagcaaacggaaagccttctaagtaatcaagttttaattagaagtggtgcaaaattcttaattatattgtgttaaagagcagcgctgccagagaatgaccctgacctttacaatggctggcttgctttttggccagcactggaaaaatctatatttacttgcagaccttaaggaggtcttcagtattcaccctacattaaggggagcgctcaggaatcaaatatggccctcagtatgaaatgagagtgaatgggct

SEQ ID NO: 153971 - DNA, 2317 bp, Homo sapiens
  Payload ID: 10265
  Gene Symbol: MAP7
  Gene Name: microtubule-associated protein 7
  Uniprot ID: Q14244
  ENST ID: ENST00000611373
  CDS Start-End: 118-1929
atcctgctgcgctgccgctgagaggaagagggagctgcccagcggcctcacgctgtaaccctctgctgctcttctattccatctaaggaacgccacgaagctgttgtacggcgcacaatggaaaggagccagaagccaaaacagaagcataaccgttggtcgtggggaggctctctccatgggagccctagcatccacagtgcagatccagacaggcggtcagtttccaccatgaatctttcgaaatatgttgatcccgtcattagcaagcggctctcctcttcatctgcaactttactaaattctccagatagagctcgccgcctgcagctcagcccatgggagagcagcgttgttaacagactcctgacgcccacacattcgttcctggccagaagtaaaagcacagctgccttgtctggagaagcagcatcttgcagccccatcatcatgccctacaaagctgcacactctagaaattcgatggatcgaccaaaactctttgtaacaccacctgagggctcttctcgcaggaggatcattcatggcacagcgagctataaaaaagaaagagagagagaaaatgtactcttcctcacatctggcacccgaagggctgtatctccatctaatcccaaagcaagacaaccagctcgctcccgactttggcttccgtccaagtctcttcctcatttgcctggcacacccagaccgacatcctccttgccacccggctcagtcaaagctgctcctgctcaggtccggcccccatcccccggcaacatccgccctgtcaagagggaagtcaaagtggagcctgagaagaaagatcctgagaaggaacctcagaaagttgccaatgagccctcactaaagggcagagcacctttagtgaaggtagaagaagccacagttgaagagcggacacctgctgaaccagaagttggccctgctgctccagccatggccccagctccagcctcggccccagctccagcctcggccccagctccagccccggtccccaccccagccatggtctcagccccgtcatccactgtgaatgccagtgcttctgttaagacttctgcaggcaccaccgacccagaggaggccacaaggcttctagctgagaagaggcggctggcccgagagcagagagaaaaggaagaaagggagaggagggagcaggaagagcttgaaagacaaaagagagaggaattggctcaacgtgtggctgaagagaggacgactcgccgtgaggaggagtcgcgcaggctggaagccgagcaggcccgggagaaggaggagcagctgcagcggcaggcggaggagcgggcgctgcgcgagcgggaggaggcagagcgcgcccagaggcagaaagaagaagaagctcgcgttcgtgaagaagcagagagggtccggcaggaacgagagaagcatttccagagagaagagcaagagcgcctggagagaaagaagcgacttgaggagattatgaaaagaaccaggagaacagaagctacagataagaaaaccagtgatcagagaaacggtgatatagccaagggagctctcactggaggaacagaggtgtctgcacttccatgtacaacaaacgctccgggaaatggaaagccagttggcagcccacatgtggttacctcacaccagtcaaaagtgacagtggagagcactcccgatttggaaaaacaaccaaatgaaaatggtgtatctgttcagaatgaaaattttgaagaaattataaacttacccattggatctaaaccatccagattagatgtcaccaacagtgagagcccagaaattcctttgaatccaattttggcctttgatgatgaagggacacttgggcccctgcctcaggtagatggtgttcagacacagcagactgcagaagttatatgagtgtttcttctgaagaaccaaagctgaaatttaatgagaatttctacaattaatggaattcctttcctgctataaaggagcatcccctccacccgttttctagagttcttgaccatcattttgaaaagatttattaaaactagctaaagacaacagactggatagcttttctaataattttcatcaataggaaaaaagaaatacgtctcattcttcaatactttaaaatggctttttccagtgtgctccttcttagcaatcaatatttttctgcattctttaaaagacaagagaatttggttataaaagaaatgggctgactaggcatgatttttttggtcttaaaagcttaacatgtaaaattggcaaaaaaaattttttacctttt

SEQ ID NO: 153972 - DNA, 4326 bp, Homo sapiens
  Payload ID: 10265
  Gene Symbol: MAP7
  Gene Name: microtubule-associated protein 7
  Uniprot ID: Q14244
  ENST ID: ENST00000616617
  CDS Start-End: 412-2379
gggaaatagcgtctccgtaccctcgccccacctgggctgctcctcggaccgccgctcgtcccagactccaggaggcgccaccaggcctcgctgaccccgctccatatctccgggagccctcagctggtcggccgcggcgaccggaagctccggactgaggtactggttccgcccgccgctcttccagccgagactcggcagcggcggtcggagcggctgccacgccgcacctgcccgcgagggggcgcgccaggcccaggccgcagccgactgccgcgctctctgtccccgccctccgccatccccggactgcgctcacctgtctgggccgctggcctgggaggcgggggccggcgggagccaagccgaggaaagggcggagcggctctccgggcgcgtcatcggagcaccatggcggagctaggagctggcggcgacggccacaggggcggcgacggcgcagtgcgaagcgaaacagcacccgacagctacaaagtgcaagataagaaaaatgcctccagccgccctgcctctgcaatttcaggacaaaataacaaccactcaggaaataaaccagaccctccgcctgtgttacgtgttgatgaccggcagcggctggcccgggagcgacgtgaggaacgggagaaacagctagatccagacaggcggtcagtttccaccatgaatctttcgaaatatgttgatcccgtcattagcaagcggctctcctcttcatctgcaactttactaaattctccagatagagctcgccgcctgcagctcagcccatgggagagcagcgttgttaacagactcctgacgcccacacattcgttcctggccagaagtaaaagcacagctgccttgtctggagaagcagcatcttgcagccccatcatcatgccctacaaagctgcacactctagaaattcgatggatcgaccaaaactctttgtaacaccacctgagggctcttctcgcaggaggatcattcatggcacagcgagctataaaaaagaaagagagagagaaaatgtactcttcctcacatctggcacccgaagggctgtatctccatctaatcccaaagcaagacaaccagctcgctcccgactttggcttccgtccaagtctcttcctcatttgcctggcacacccagaccgacatcctccttgccacccggctcagtcaaagctgctcctgctcaggtccggcccccatcccccggcaacatccgccctgtcaagagggaagtcaaagtggagcctgagaagaaagatcctgagaaggaacctcagaaagttgccaatgagccctcactaaagggcagagcacctttagtgaaggtagaagaagccacagttgaagagcggacacctgctgaaccagaagttggccctgctgctccagccatggccccagctccagcctcggccccagctccagcctcggccccagctccagccccggtccccaccccagccatggtctcagccccgtcatccactgtgaatgccagtgcttctgttaagacttctgcaggcaccaccgacccagaggaggccacaaggcttctagctgagaagaggcggctggcccgagagcagagagaaaaggaagaaagggagaggagggagcaggaagagcttgaaagacaaaagagagaggaattggctcaacgtgtggctgaagagaggacgactcgccgtgaggaggagtcgcgcaggctggaagccgagcaggcccgggagaaggaggagcagctgcagcggcaggcggaggagcgggcgctgcgcgagcgggaggaggcagagcgcgcccagaggcagaaagaagaagaagctcgcgttcgtgaagaagcagagagggtccggcaggaacgagagaagcatttccagagagaagagcaagagcgcctggagagaaagaagcgacttgaggagattatgaaaagaaccaggagaacagaagctacagataagaaaaccagtgatcagagaaacggtgatatagccaagggagctctcactggaggaacagaggtgtctgcacttccatgtacaacaaacgctccgggaaatggaaagccagttggcagcccacatgtggttacctcacaccagtcaaaagtgacagtggagagcactcccgatttggaaaaacaaccaaatgaaaatggtgtatctgttcagaatgaaaattttgaagaaattataaacttacccattggatctaaaccatccagattagatgtcaccaacagtgagagcccagaaattcctttgaatccaattttggcctttgatgatgaagggacacttgggcccctgcctcaggtagatggtgttcagacacagcagactgcagaagttatatgagtgtttcttctgaagaaccaaagctgaaatttaatgagaatttctacaattaatggaattcctttcctgctataaaggagcatcccctccacccgttttctagagttcttgaccatcattttgaaaagatttattaaaactagctaaagacaacagactggatagcttttctaataattttcatcaataggaaaaaagaaatacgtctcattcttcaatactttaaaatggctttttccagtgtgctccttcttagcaatcaatatttttctgcattctttaaaagacaagagaatttggttataaaagaaatgggctgactaggcatgatttttttggtcttaaaagcttaacatgtaaaattggcaaaaaaaattttttaccttttataatacttgaaaaataagtacctctttgttctacaagtagaatgaataggagaagagtttaagcctgtttttttaaaatattattgcaaagagctctatttgtagaagcaaattataggcagattaccaggttcttataaatacagcttgtacatggacattctgcaaacccagctgtcacatttttcttgcaactccttttgcaaaagcagactaaaatgttttaaaatgtgaaaaaacattattttttcaaagcaagaaaataatttactgccctcttacataatgtatttataaagtttttccagataaactaatcaaataaattagaataatgtgacaacattacaaatttaatttgttagctgcattccttctgatgttaccacgatagaatgttactgatgattcagggctatttctgaagtctgtatgttgctgctgtccccagtgatggtggacttatctttgccttacctgatcacaaattatgttggggaaaataaagatttaatatttctttaaatagaaaaagaatttggttttgctcgtttaagagcaatgagaaaatgatggaatgttgactgtgtttggcacacaggacacggaccttcatggaagtccttgctctgcgtggcatctgtcagcttttcacctttcattcttattcttcacttttgctgctgagcctagctgtacaaacttgcactttcatttgctaatataaattcagttttattttaccattttagagactactaatgattaaatgtagaaggagagggtgcacatgtttttatgtggagtgtttaaaagataaatttataccactgtaatgtgcagcttttattaaaagagaaattggttgaactgctaggttgaatgagagacttcatctattggactattttttttaatccaggcatatggtctttagtaatggcttgtaatttgtgaaaacattaatttgggggttttccctgttttcagttgtccatgtacacatagtcattatattagaaaagaaatctgttcaacaaacttgtttaatttgtttaaatcaacatagcatgaaacaccaaataaaatgtttgacatagttttacttttagctttctcatatgttataacttcactcagattgattcttgagtcttcagattgtccttcatttaactcagtgacattttcctagcctcctgttgattaagcatataggatagccttatttaaaatttagagcagtaggtgtattttggctgtttttctttttcatgtgtgtttttaaactttagtcatcattagcaaacggaaagccttctaagtaatcaagttttaattagaagtggtgcaaaattcttaattatattgtgttaaagagcagcgctgccagagaatgaccctgacctttacaatggctggcttgctttttggccagcactggaaaaatctatatttacttgcagaccttaaggaggtcttcagtattcaccctacattaaggggagcgctcaggaatcaaatatggccctcagtatgaaatgagagtgaatgggct

SEQ ID NO: 153973 - DNA, 7333 bp, Homo sapiens
  Payload ID: 10266
  Gene Symbol: MAP9
  Gene Name: microtubule-associated protein 9
  Uniprot ID: Q49MG5
  ENST ID: ENST00000311277
  CDS Start-End: 265-2208
acttccttcgtctgggtggttgccccagcgacacgttgggccgaagagcggtgttgggtacccgagagacccggcggtggggaagtcacttcctcccgaagacgctgtttcctagcaaccgccctccgcctctgttattagcccctcctcctcgctcggtccaggaccggctctgcgggcgccgccaggcccagaccaagctactatcagaagttgaattctaataattagctattttataaaggtaacgagaaaaaatacactatgtctgatgaagtttttagcaccactttggcatatacaaagagtccaaaagttaccaaaagaactactttccaggatgagctaataagagcaattacagctcgctcagccagacaaaggagttctgaatactcagatgactttgacagtgatgagattgtttctttaggtgatttttctgacacttcagcagatgaaaattcagttaataaaaaaatgaatgactttcatatatcagatgatgaagaaaagaatccttcaaaactattgtttttgaaaaccaataaatcaaacggtaacataaccaaagatgagccagtgtgtgccatcaaaaatgaagaggaaatggcacctgatgggtgtgaagacattgttgtaaaatctttctctgaatctcaaaataaggatgaggaatttgaaaaagacaaaataaaaatgaaacctaaacccagaattctttcaattaaaagcacatcttcagcagaaaacaacagccttgacacagatgatcactttaaaccatcacctcggccaaggagtatgttgaaaaagaaaagtcacatggaggagaaggatggactagaagataaagaaactgccctcagtgaagaattggagttacattctgcaccttcttcccttccaacgccgaatggcatacaattagaagctgagaaaaaagcattctctgaaaaccttgatcctgaggattcatgcttaacaagtctagcatcatcatcacttaaacaaattcttggagattctttttcaccaggatctgagggaaacgcatctggaaaagatccaaatgaagaaatcactgaaaaccataattccttgaaatcagatgaaaataaagagaattcattttcagcagaccatgtgactactgcagttgagaaatccaaggaaagtcaagtgactgctgatgaccttgaagaagaaaaggcaaaagcggaactgattatggatgatgacagaacagttgatccactactatctaaatctcagagtatcttaatatctaccagtgcaacagcatcttcaaagaaaacaattgaagatagaaatataaagaataaaaagtcaacaaataatagagcatccagtgcatctgccagattaatgacctctgagtttttgaagaaatctagttctaaaaggagaactccatcgacaactacctcttctcactatttagggactttaaaagtcttggaccaaaaaccttcacagaaacagagcatagaacctgatagagcagataacataagggcagctgtttatcaggagtggttagaaaagaaaaatgtgtatttacatgaaatgcacagaataaaaagaattgaaagtgaaaacttaaggatccaaaatgaacagaaaaaagctgctaaaagagaagaagcattagcatcatttgaggcctggaaggctatgaaagaaaaggaagcaaagaaaatagctgccaaaaagaggcttgaagaaaaaaacaagaagaaaactgaagaagaaaatgctgcaagaaaaggagaagcactacaagcttttgaaaaatggaaagagaaaaagatggaatatcttaaagagaaaaatagaaaggagagagaatatgaaagagcaaagaaacagaaagaggaggaaactgttgccgagaaaaagaaagataatttaactgctgttgagaaatggaatgaaaaaaaggaagcttttttcaagcaaaaggaaaaagaaaaaataaatgagaaaagaaaggaagaactgaaaagagctgagaaaaaagataaagataaacaagctattaatgaatatgaaaaatggctggaaaataaggaaaaacaagaaagaattgaacgaaaacagaagaaacgtcattcctttcttgaaagtgaggcacttcctccgtggagccctccaagcagaactgtgttcgcaaaagtgttttgataattctagttcttacattatttggttatttatcggtttgccaatattagccatagatttaaaaccattcaattatttatagttagaggaatatattttaattaaatgccagacactcctgctgacaatgaaagaaatactttggaatgtaatcagtgaaagcatttttttgaactgtagataaactgcctcaaacaaagacctaataatcagattgtttttaccattaagatacataagattttatcatgtcctgataattcttatggtggagtgattcatgatctttttcattaagctctgtatgttatttaagtatatttaattccagtaataaaaaggaaatcatctaggtaccataatgatagaaattattccttttgtggatgattgtgaatctagattcaggtttttaaatgaagggtcgctgggaagtgcgcatatattattccttctgaaactgatgtttagctcaaagcagttgcatttgtactgtgctagttagaattttcatcagttgaggcagtagctcagtagaactctaatcatcaaggctttttatttaagaattttgccttatgttttaatatgagtgtactttatctgttccaggcttatgtgataatcataggtactttataatgagtccacctctgaaatttttctttctgaattctatctcactttattatttcagtgataccaaaagacatcaatgtcacagtagtgatatacttatgtattagttatggaaattccacaggagttcaaggtcattatcactataattattttcctgactaaagccataaaggtgatttaggcaattattgtcatcttagctagtcctgttttatagcttatattcagcagacagctgtatgggaaggtaaatatgttgacaatgtccacaaagcctttatttatttatttatttgatctctgcatgtcctcgtagtaactggtctcatacttgacctggtcatctggtttaagacagaccaagtgtatgctcacggagctgaaatgcattagtcagttgtgcaatgaggagatgatggatgagaatatatagttcctatttattgagcatctaatatataatctctactggacctttacaaatgtatttaacatctttacaacaacttttcagggtaggtgttaccggcttcatcttacatataaaaatactggcgctcagataaaccaagtaacttaccgtccatctggagtgtgcctgagttgagatcaaacgggattcagtacgtctgactgaatctgcctccttctgaaatctctatgctctttttcacacttctctgtagcctcagagactgccaagttctgtcaagacctctgcataatatcaacgttacaaacacgttttaacttttagagcctaaaatcatgtattgttatccaaagatgatctttctctacagaaatagctgcttgttcttagagatggtggaggtcattaaatctataaagtgagataaaaatccataagatttcatgagttactcaggcatcttataactactatcagaatatcagaaaactcagcaagttatgtgacaaaggctttgagatgatcactccagacgttccacatactgagcatcagccttcttgctgcagtgcatgtgcaagataagatgtcataggcagctttgtaagattgtatcagtgctatagacaattaagagaaatttcatagataaaactagaaccctttctatatggccagaactgtaatactttatgaaattgatctgattatcagcaatatgtagtatcagcatggaatttaggacctctcttactcattcctgtgtcccccatagtaccaaaaacagtgcctgccaaaatagattaaaagtgtttattgtattagctgtttagagctgaaaagatatttacaaattccagggaagtaaaaggaaaaaaactgaaaaaggtacagctacttttggggatgtgagatcatggatgtgtatcttatagatttcacattatttatttactttccattattttcttctacattatcatatttagtggctaaccattattacttcttaggttgttgtgagaaccgagttaattaatgtaaactatttgacacataataaggacttaaatgttcattgttgtcattattgatttattaccatgagccctacatttccccattcatgagtgtgcgaacattaacatagatagggttgataatggttatttgacattacacatttttaggaagaagaaatttctgtcttgctggccagtccaggctgtaacactcaaaaaaacaaaacaaaacaaaacaaaacaaaaaaacagaaagatgccttgtattagggccttcctaaaaagaaagctaagtaagtattaatttcttaggattgcttctgaggtaggatgaggtgtttgcatagacccaacaagtcattcacttcaaattttttttgtcttactatgataaataacatattatttcctgtttacagcaacctgcactgaaattaactagttgaataaaatcacctcttctagcacaaataaagctgagttcggggaggtgggtgaaaatacagtactgttgtttacttcctaagatccaagggagagaatcaagcttggtaatattctcttgaatatacatttacctatttaaaaggtatgattttcccatatttccttaggaagtatgtcatgtcaatatagatatttactcattaggtttacattaatttgtattataagggaatgtttaattcaaattaaggacattaaaagtatatagactttcatataaaagttccggttttataaattgcgttgatcacttaaagaatgcagagatctcaaagtaaagaaaacaaattttatgaatattttaaaacattacttaaaacaagtttccttagaaagcacatttgtggataaatttaaatattaatactaaataataaagtagtatacagaatttaaatttcataataatgaagaaagtggtaatgctatttaacttaaaagatgcaatatggcattttagatcaagaggttaaagttttcttaatgaaagaaagtaacgatttatgggataaaaatattccagtggtttgtatttgcttcatacttcaaaagtgttagtccatttattgtttaaagttatattgaaactgatattttcactgctgccaaagcagtacctgacagtagataggtatccacagtcttatgttccttagagttatagaactatgcctctgaaaggggttttaatactttaataaacctggcctaaactgttttatttctaagttgaagaaactgattgtcaagtactttgacttgtccaatctcatacaactaactatggtacatctagagttagatctcagtatcaggggtcccagttgtattctgctcaccattccacaatttcgatattgataaaactttcacactaacttttgaactgtggttattattaatttagttgattcatgtcctcttatttatctccttactcctccactgctgccttcataactgtccaccagatcaaagctatttgggtacctacactttaaagtgaggggaaataatgaagtttcttaaatcctgtgtcatggactaagatacaataaagaaaaggaatttcacaaagtaggggaaattacgtgttagttataatcattcccaagaataaactagtaaaagaaacttagatttccctaatttaatcttgactccgattttgatagtgctatataaaaaggtatttaaacccatatgcttccttttacataaaagaaagatatcaactttcctagtttgcatttacactggctaataggataataaaatgctgtgtaaatgttaaactggaagtttctctgagttatttttactttaaaatttcatgtgattatgccattttgaatatgtatattacatgtaattgtataatgttaactcgggtaggcaaaattcttggtattaaatttaggatgttttaaaaattattaagaagatattaatgtctgctttttgatagcatatattttcatgtaatgtttagtgtattaaaatcaaccattcaagatttattttattgggtgacactattgactgtgttccaaaatgcccatagtgttaggaaatgtggtgtgagttttatttgtgggctaaggataaaataatcatatgctaatataccttttattataaatgactaaaaatttggatataaaactgatgttttactacacaaattacagagagagataatataattatataattattaaataattagaaaatgcaaataagcaaaagtcacccatgttcccagttctcatctcctgaagatagttataactaacatattattttgtactcttcctgttaattagtttctagtgtactttctcctgtagctgaaattaagctgagaaaaaaggaagagatagttcctccctcctctttctctctcccactctgtctctctcctgtgctatctgtgtgtatatacaaatatgtatgcatatatatataatgatgtacataatatatataaaatacaaatactaatgtgcatattttcaaacatacacatattttttattatttgaaataagaatgagtcagactacatatttggtagccagatttttttcactcagtgatatatcatgaacatatttccatgctaatataattttctaataattttagatgctgtaactacaatttcattgttaatgggcaatttgttgctttacaaatggtaaattatatgataaataatatgatcattattcttgtagccaatatcattattagaaatgatggaccgcattaaagctataaaattaaataagaatttataaatgtaaggagttattcagacatcttgtatctagtattacaatatcagaaaactcagcaggttatatgacatatacactttgagatagtcactcagaggttttcacatacaggattaaccttgctgcagtgcgtgtgcaagattaaaaaagatgtcacgggtcactttgtaatgtcatatcgttgctgttgataaataaaggaaatgttataaataaaa

SEQ ID NO: 153974 - DNA, 1165 bp, Homo sapiens
  Payload ID: 10266
  Gene Symbol: MAP9
  Gene Name: microtubule-associated protein 9
  ENST ID: ENST00000379248
  CDS Start-End: 257-829
tcacttcctcccgaagacgctgtttcctagcaaccgccctccgcctctgttattagcccctcctcctcgctcggtccaggaccggctctgcgggcgccgccaggcccagaccaaggatgagctaataagagcaattacagctcgctcagccagacaaaggagttctgaatactcagatgactttgacagtgatgagattgtttctttaggtgatttttctgacacttcagcagatgaaaattcagttaataaaaaaatgaatgactttcatatatcagatgatgaagaaaagaatccttcaaaactattgtttttgaaaaccaataaatcaaacggtaacataaccaaagatgagccagtgtgtgccatcaaaaatgaagaggaaatggcacctgatgggtgtgaagacattgttgtaaaatctttctctgaatctcaaaataaggatgaggaatttgaaaaagacaaaataaaaatgaaacctaaacccagaattctttcaattaaaagcacatcttcagaaaacaacagccttgacacagatgatcactttaaaccatcacctcggccaaggagtatgttgaaaaagaaaagtcacatggaggagaaggatggactagaagataaagaaactgccctcagtgaagaattggagttacattctgcaccttcttcccttccaacgccgaatggcatacaattagaagctgagaaaaaagcattctctgaaaaccttgatcctgaggttagcactaccactaaactgttgaattgtgttcttgaatttatgcttttttatctgattatgaaaaagagaaggagagaatgaatttgtgtgcgtgtgtgtgtgttttacatactttcttctgcaactgataaggaaataatttttaaaaatacactgtattccaccgagtctaaaactgcatcaattgtaagacgtagcattattttacataccactaaggaagaaggaaatgcatccaattaaactataacacaccagtgattgtagagtttatccagttttagagaaagtaaaatgtcaaaaagtgttgcttttctgaatctatataatagtgtttatctttaataattttttaaatttatgtatctttgaattatgtaatttatggctaagaacaatatagtcagtgtcatttta

SEQ ID NO: 153975 - DNA, 1644 bp, Homo sapiens
  Payload ID: 10266
  Gene Symbol: MAP9
  Gene Name: microtubule-associated protein 9
  ENST ID: ENST00000433024
  CDS Start-End: 180-1644
tcacttcctcccgaagacgctgtttcctagcaaccgccctccgcctctgttattagcccctcctcctcgctcggtccaggaccggctctgcgggcgccgccaggcccagaccaagctactatcagaagttgaattctaataattagctattttataaaggtaacgagaaaaaatacactatgtctgatgaagtttttagcaccactttggcatatacaaagagtccaaaagttaccaaaagaactactttccaggatgagctaataagagcaattacagctcgctcagccagacaaaggagttctgaatactcagatgactttgacagtgatgagattgtttctttaggtgatttttctgacacttcagcagatgaaaattcagttaataaaaaaatgaatgactttcatatatcagatgatgaagaaaagaatccttcaaaactattgtttttgaaaaccaataaatcaaacggtaacataaccaaagatgagccagtgtgtgccatcaaaaatgaagaggaaatggcacctgatgggtgtgaagacattgttgtaaaatctttctctgaatctcaaaataaggatgaggaatttgaaaaagacaaaataaaaatgaaacctaaacccagaattctttcaattaaaagcacatcttcagaaaacaacagccttgacacagatgatcactttaaaccatcacctcggccaaggagtatgttgaaaaagaaaagtcacatggaggagaaggatggactagaagataaagaaactgccctcagtgaagaattggagttacattctgcaccttcttcccttccaacgccgaatggcatacaattagaagctgagaaaaaagcattctctgaaaaccttgatcctgaggattcatgcttaacaagtctagcatcatcatcacttaaacaaattcttggagattctttttcaccaggatctgagggaaacgcatctggaaaagatccaaatgaagaaatcactgaaaaccataattccttgaaatcagatgaaaataaagagaattcattttcagcagaccatgtgactactgcagttgagaaatccaaggaaagtcaagtgactgctgatgaccttgaagaagaaaaggcaaaagcggaactgattatggatgatgacagaacagttgatccactactatctaaatctcagagtatcttaatatctaccagtgcaacagcatcttcaaagaaaacaattgaagatagaaatataaagaataaaaagtcaacaaataatagagcatccagtgcatctgccagattaatgacctctgagtttttgaagaaatctagttctaaaaggagaactccatcgacaactacctcttctcactatttagggactttaaaagtcttggaccaaaaaccttcacagaaacagagcatagaacctgatagagcagataacataagggcagctgtttatcaggagtggttagaaaagaaaaatgtgtatttacatgaaatgcacagaataaaaagaattgaaagtgaaaacttaaggatccaaaatgaacagaaaaaagctgctaaaagagaagaagcattagcatcatttgaggcctggaaggctatgaaagaaaaggaagcaaagaaaatagctgcca

SEQ ID NO: 153976 - DNA, 560 bp, Homo sapiens
  Payload ID: 10266
  Gene Symbol: MAP9
  Gene Name: microtubule-associated protein 9
  ENST ID: ENST00000450097
  CDS Start-End: 468-560
agaccaaggtgagcagctcctacccgatgcttggctcttgattctcagggtcgcggagaactggccgcgggcgtccggggccgggaacagaaagcgggacctgggggccatgggggatccggacagagaccgcgcttggacgtgcacgggcctggcgttcgctggtgctcagcatacggcgcggtgaggagcggcgagcacccggacgtcacctggcctggtagggaacggaacccggggcgcacaacgctatgggcggccctgccaggcctctgctccgagtacgggaaaccgcgattttaatgcggctcatcgcgaaagcttcgtcgttttgtctggctctctttaacacttttgtgagaggaaaaattggcttgcaatacatctcgctggctgtttgcggctactatcagaagttgaattctaataattagctattttataaaggtaacgagaaaaaatacactatgtctgatgaagtttttagcaccactttggcatatacaaagagtccaaaagttaccaaaagaactactttccaggatgagctaataagagca

SEQ ID NO: 153977 - DNA, 1828 bp, Homo sapiens
  Payload ID: 10266
  Gene Symbol: MAP9
  Gene Name: microtubule-associated protein 9
  ENST ID: ENST00000424373
  CDS Start-End: 265-1395
acttccttcgtctgggtggttgccccagcgacacgttgggccgaagagcggtgttgggtacccgagagacccggcggtggggaagtcacttcctcccgaagacgctgtttcctagcaaccgccctccgcctctgttattagcccctcctcctcgctcggtccaggaccggctctgcgggcgccgccaggcccagaccaagctactatcagaagttgaattctaataattagctattttataaaggtaacgagaaaaaatacactatgtctgatgaagtttttagcaccactttggcatatacaaagagtccaaaagttaccaaaagaactactttccaggatgagctaataagagcaattacagctcgctcagccagacaaaggagttctgaatactcagatgactttgacagtgatgagattgtttctttaggtgatttttctgacacttcagcagatgaaaattcagttaataaaaaaatgaatgactttcatatatcagatgatgaagaaaagaatccttcaaaactattgtttttgaaaaccaataaatcaaacggtaacataaccaaagatgagccagtgtgtgccatcaaaaatgaagaggaaatggcacctgatgggtgtgaagacattgttgtaaaatctttctctgaatctcaaaataaggatgaggaatttgaaaaagacaaaataaaaatgaaacctaaacccagaattctttcaattaaaagcacatcttcagcagaaaacaacagccttgacacagatgatcactttaaaccatcacctcggccaaggagtatgttgaaaaagaaaagtcacatggaggagaaggatggactagaagataaagaaactgccctcagtgaagaattggagttacattctgcaccttcttcccttccaacgccgaatggcatacaattagaagctgagaaaaaagcattctctgaaaaccttgatcctgaggattcatgcttaacaagtctagcatcatcatcacttaaacaaattcttggagattctttttcaccaggatctgagggaaacgcatctggaaaagatccaaatgaagaaatcactgaaaaccataattccttgaaatcagatgaaaataaagagaattcattttcagcagaccatgtgactactgcagttgagaaatccaaggaaagtcaagtgactgctgatgaccttgaagaagaaaaggcaaaagcggaactgattatggatgatgacagaacagttgatccactactatctaaatctcagagtatcttaatatctaccagtgcaacagcatcttcaaagaaaacaattgaagatagaaatataaagaataaaaagtcaacaaataatagagcatccagtgcatctgccaggagtggttagaaaagaaaaatgtgtatttacatgaaatgcacagaataaaaagaattgaaagtgaaaacttaaggatccaaaatgaacagaaaaaagctgctaaaagagaagaagcattagcatcatttgaggcctggaaggctatgaaagaaaaggaagcaaagaaaatagctgccaaaaagaggcttgaagaaaaaaacaagaagaaaactgaagaagaaaatgctgcaagaaaaggagaagcactacaagcttttgaaaaatggaaagagaaaaagatggaatatcttaaagagaaaaatagaaaggagagagaatatgaaagagcaaagaaacagaaagaggaggaaactgttgccgagaaaaagaaagataatttaactgctgttgagaaatggaatgaaaaaaaggaagcttttttcaagcaaaaggaaaaagaaaa

SEQ ID NO: 153978 - DNA, 660 bp, Homo sapiens
  Payload ID: 10266
  Gene Symbol: MAP9
  Gene Name: microtubule-associated protein 9
  ENST ID: ENST00000503466
  CDS Start-End: 1-100
aaaaataaatgagaaaagaaaggaagaactgaaaagagctgagaaaaaagataaagataaacaagctattaatgaatatgaaaaatggctgatagaatagaaaaattgcccctgtataggagtctaatgacttcagttttcatggaaaacaacatctcaagctttttatatacaaactagtttgaacagtaagcatttggtgggtaattgctttaggggaaagttaatagccaaagatcaggtaagactaaaatatttttcttgccaattaccagattaattcatcattacctttagtaagaaaataagcaaaaagctcagttttccacaaataaatgtctgaaggactttttaacaaggttcttttaattactatcaaggtgactattgattcttttgaactgatattacagttaatataattgtctatttgctaccctggctttacagctccctgctagtaagatgaagcatatttcaagttactgccccctcatgttaagtgaaattacaaaaagagatttattcagtcaatttctgtggacacagtctggtcactgcttttcttccgcctagctagatggtctgtctctaaaatattaaaatgattgaagatgatctaattacagctttgcttttctcaattaaaattctgaaagg

SEQ ID NO: 153979 - DNA, 2044 bp, Homo sapiens
  Payload ID: 10266
  Gene Symbol: MAP9
  Gene Name: microtubule-associated protein 9
  ENST ID: ENST00000515654
  CDS Start-End: 131-2002
ttattagcccctcctcctcgctcggtccaggaccggctctgcgggcgccgccaggcccagaccaagctactatcagaagttgaattctaataattagctattttataaaggtaacgagaaaaaatacactatgtctgatgaagtttttagcaccactttggcatatacaaagagtccaaaagttaccaaaagaactactttccaggatgagctaataagagcaattacagctcgctcagccagacaaaggagttctgaatactcagatgactttgacagtgatgagattgtttctttaggtgatttttctgacacttcagcagatgaaaattcagttaataaaaaaatgaatgactttcatatatcagatgatgaagaaaagaatccttcaaaactattgtttttgaaaaccaataaatcaaacggtaacataaccaaagatgagccagtgtgtgccatcaaaaatgaagaggaaatggcacctgatgggtgtgaagacattgttgtaaaatctttctctgaatctcaaaataaggatgaggaatttgaaaaagacaaaataaaaatgaaacctaaacccagaattctttcaattaaaagcacatcttcagcagaaaacaacagccttgacacagatgatcactttaaaccatcacctcggccaaggagtatgttgaaaaagaaaagtcacatggaggagaaggatggactagaagataaagaaactgccctcagtgaagaattggagttacattctgcaccttcttcccttccaacgccgaatggcatacaattagaagctgagaaaaaagcattctctgaaaaccttgatcctgaggattcatgcttaacaagtctagcatcatcatcacttaaacaaattcttggagattctttttcaccaggatctgagggaaacgcatctggaaaagcagaccatgtgactactgcagttgagaaatccaaggaaagtcaagtgactgctgatgaccttgaagaagaaaaggcaaaagcggaactgattatggatgatgacagaacagttgatccactactatctaaatctcagagtatcttaatatctaccagtgcaacagcatcttcaaagaaaacaattgaagatagaaatataaagaataaaaagtcaacaaataatagagcatccagtgcatctgccagattaatgacctctgagtttttgaagaaatctagttctaaaaggagaactccatcgacaactacctcttctcactatttagggactttaaaagtcttggaccaaaaaccttcacagaaacagagcatagaacctgatagagcagataacataagggcagctgtttatcaggagtggttagaaaagaaaaatgtgtatttacatgaaatgcacagaataaaaagaattgaaagtgaaaacttaaggatccaaaatgaacagaaaaaagctgctaaaagagaagaagcattagcatcatttgaggcctggaaggctatgaaagaaaaggaagcaaagaaaatagctgccaaaaagaggcttgaagaaaaaaacaagaagaaaactgaagaagaaaatgctgcaagaaaaggagaagcactacaagcttttgaaaaatggaaagagaaaaagatggaatatcttaaagagaaaaatagaaaggagagagaatatgaaagagcaaagaaacagaaagaggaggaaactgttgccgagaaaaagaaagataatttaactgctgttgagaaatggaatgaaaaaaaggaagcttttttcaagcaaaaggaaaaagaaaaaataaatgagaaaagaaaggaagaactgaaaagagctgagaaaaaagataaagataaacaagctattaatgaatatgaaaaatggctggaaaataaggaaaaacaagaaagaattgaacgaaaacagaagaaacgtcattcctttcttgaaagtgaggcacttcctccgtggagccctccaagcagaactgtgttcgcaaaagtgttttgataattctagttcttacattatttggttatttatcggtttgcc

SEQ ID NO: 153980 - DNA, 6762 bp, Homo sapiens
  Payload ID: 10267
  Gene Symbol: MAPT
  Gene Name: microtubule-associated protein tau
  Uniprot ID: P10636
  ENST ID: ENST00000262410
  CDS Start-End: 323-2599
ggacggccgagcggcagggcgctcgcgcgcgcccactagtggccggaggagaaggctcccgcggaggccgcgctgcccgccccctcccctggggaggctcgcgttcccgctgctcgcgcctgcgccgcccgccggcctcaggaacgcgccctcttcgccggcgcgcgccctcgcagtcaccgccacccaccagctccggcaccaacagcagcgccgctgccaccgcccaccttctgccgccgccaccacagccaccttctcctcctccgctgtcctctcccgtcctcgcctctgtcgactatcaggtgaactttgaaccaggatggctgagccccgccaggagttcgaagtgatggaagatcacgctgggacgtacgggttgggggacaggaaagatcaggggggctacaccatgcaccaagaccaagagggtgacacggacgctggcctgaaagaatctcccctgcagacccccactgaggacggatctgaggaaccgggctctgaaacctctgatgctaagagcactccaacagcggaagatgtgacagcacccttagtggatgagggagctcccggcaagcaggctgccgcgcagccccacacggagatcccagaaggaaccacagctgaagaagcaggcattggagacacccccagcctggaagacgaagctgctggtcacgtgacccaagagcctgaaagtggtaaggtggtccaggaaggcttcctccgagagccaggccccccaggtctgagccaccagctcatgtccggcatgcctggggctcccctcctgcctgagggccccagagaggccacacgccaaccttcggggacaggacctgaggacacagagggcggccgccacgcccctgagctgctcaagcaccagcttctaggagacctgcaccaggaggggccgccgctgaagggggcagggggcaaagagaggccggggagcaaggaggaggtggatgaagaccgcgacgtcgatgagtcctccccccaagactcccctccctccaaggcctccccagcccaagatgggcggcctccccagacagccgccagagaagccaccagcatcccaggcttcccagcggagggtgccatccccctccctgtggatttcctctccaaagtttccacagagatcccagcctcagagcccgacgggcccagtgtagggcgggccaaagggcaggatgcccccctggagttcacgtttcacgtggaaatcacacccaacgtgcagaaggagcaggcgcactcggaggagcatttgggaagggctgcatttccaggggcccctggagaggggccagaggcccggggcccctctttgggagaggacacaaaagaggctgaccttccagagccctctgaaaagcagcctgctgctgctccgcgggggaagcccgtcagccgggtccctcaactcaaagctcgcatggtcagtaaaagcaaagacgggactggaagcgatgacaaaaaagccaagacatccacacgttcctctgctaaaaccttgaaaaataggccttgccttagccccaaacaccccactcctggtagctcagaccctctgatccaaccctccagccctgctgtgtgcccagagccaccttcctctcctaaatacgtctcttctgtcacttcccgaactggcagttctggagcaaaggagatgaaactcaagggggctgatggtaaaacgaagatcgccacaccgcggggagcagcccctccaggccagaagggccaggccaacgccaccaggattccagcaaaaaccccgcccgctccaaagacaccacccagctctggtgaacctccaaaatcaggggatcgcagcggctacagcagccccggctccccaggcactcccggcagccgctcccgcaccccgtcccttccaaccccacccacccgggagcccaagaaggtggcagtggtccgtactccacccaagtcgccgtcttccgccaagagccgcctgcagacagcccccgtgcccatgccagacctgaagaatgtcaagtccaagatcggctccactgagaacctgaagcaccagccgggaggcgggaaggtgcagataattaataagaagctggatcttagcaacgtccagtccaagtgtggctcaaaggataatatcaaacacgtcccgggaggcggcagtgtgcaaatagtctacaaaccagttgacctgagcaaggtgacctccaagtgtggctcattaggcaacatccatcataaaccaggaggtggccaggtggaagtaaaatctgagaagcttgacttcaaggacagagtccagtcgaagattgggtccctggacaatatcacccacgtccctggcggaggaaataaaaagattgaaacccacaagctgaccttccgcgagaacgccaaagccaagacagaccacggggcggagatcgtgtacaagtcgccagtggtgtctggggacacgtctccacggcatctcagcaatgtctcctccaccggcagcatcgacatggtagactcgccccagctcgccacgctagctgacgaggtgtctgcctccctggccaagcagggtttgtgatcaggcccctggggcggtcaataattgtggagaggagagaatgagagagtgtggaaaaaaaaagaataatgacccggcccccgccctctgcccccagctgctcctcgcagttcggttaattggttaatcacttaacctgcttttgtcactcggctttggctcgggacttcaaaatcagtgatgggagtaagagcaaatttcatctttccaaattgatgggtgggctagtaataaaatatttaaaaaaaaacattcaaaaacatggccacatccaacatttcctcaggcaattccttttgattcttttttcttccccctccatgtagaagagggagaaggagaggctctgaaagctgcttctgggggatttcaagggactgggggtgccaaccacctctggccctgttgtgggggtgtcacagaggcagtggcagcaacaaaggatttgaaacttggtgtgttcgtggagccacaggcagacgatgtcaaccttgtgtgagtgtgacgggggttggggtggggcgggaggccacgggggaggccgaggcaggggctgggcagaggggagaggaagcacaagaagtgggagtgggagaggaagccacgtgctggagagtagacatccccctccttgccgctgggagagccaaggcctatgccacctgcagcgtctgagcggccgcctgtccttggtggccgggggtgggggcctgctgtgggtcagtgtgccaccctctgcagggcagcctgtgggagaagggacagcgggtaaaaagagaaggcaagctggcaggagggtggcacttcgtggatgacctccttagaaaagactgaccttgatgtcttgagagcgctggcctcttcctccctccctgcagggtagggggcctgagttgaggggcttccctctgctccacagaaaccctgttttattgagttctgaaggttggaactgctgccatgattttggccactttgcagacctgggactttagggctaaccagttctctttgtaaggacttgtgcctcttgggagacgtccacccgtttccaagcctgggccactggcatctctggagtgtgtgggggtctgggaggcaggtcccgagccccctgtccttcccacggccactgcagtcaccccgtctgcgccgctgtgctgttgtctgccgtgagagcccaatcactgcctatacccctcatcacacgtcacaatgtcccgaattcccagcctcaccaccccttctcagtaatgaccctggttggttgcaggaggtacctactccatactgagggtgaaattaagggaaggcaaagtccaggcacaagagtgggaccccagcctctcactctcagttccactcatccaactgggaccctcaccacgaatctcatgatctgattcggttccctgtctcctcctcccgtcacagatgtgagccagggcactgctcagctgtgaccctaggtgtttctgccttgttgacatggagagagccctttcccctgagaaggcctggccccttcctgtgctgagcccacagcagcaggctgggtgtcttggttgtcagtggtggcaccaggatggaagggcaaggcacccagggcaggcccacagtcccgctgtcccccacttgcaccctagcttgtagctgccaacctcccagacagcccagcccgctgctcagctccacatgcatagtatcagccctccacacccgacaaaggggaacacacccccttggaaatggttcttttcccccagtcccagctggaagccatgctgtctgttctgctggagcagctgaacatatacatagatgttgccctgccctccccatctgcaccctgttgagttgtagttggatttgtctgtttatgcttggattcaccagagtgactatgatagtgaaaagaaaaaaaaaaaaaaaaaaggacgcatgtatcttgaaatgcttgtaaagaggtttctaacccaccctcacgaggtgtctctcacccccacactgggactcgtgtggcctgtgtggtgccaccctgctggggcctcccaagttttgaaaggctttcctcagcacctgggacccaacagagaccagcttctagcagctaaggaggccgttcagctgtgacgaaggcctgaagcacaggattaggactgaagcgatgatgtccccttccctacttccccttggggctccctgtgtcagggcacagactaggtcttgtggctggtctggcttgcggcgcgaggatggttctctctggtcatagcccgaagtctcatggcagtcccaaaggaggcttacaactcctgcatcacaagaaaaaggaagccactgccagctggggggatctgcagctcccagaagctccgtgagcctcagccacccctcagactgggttcctctccaagctcgccctctggaggggcagcgcagcctcccaccaagggccctgcgaccacagcagggattgggatgaattgcctgtcctggatctgctctagaggcccaagctgcctgcctgaggaaggatgacttgacaagtcaggagacactgttcccaaagccttgaccagagcacctcagcccgctgaccttgcacaaactccatctgctgccatgagaaaagggaagccgcctttgcaaaacattgctgcctaaagaaactcagcagcctcaggcccaattctgccacttctggtttgggtacagttaaaggcaaccctgagggacttggcagtagaaatccagggcctcccctggggctggcagcttcgtgtgcagctagagctttacctgaaaggaagtctctgggcccagaactctccaccaagagcctccctgccgttcgctgagtcccagcaattctcctaagttgaagggatctgagaaggagaaggaaatgtggggtagatttggtggtggttagagatatgcccccctcattactgccaacagtttcggctgcatttcttcacgcacctcggttcctcttcctgaagttcttgtgccctgctcttcagcaccatgggccttcttatacggaaggctctgggatctcccccttgtggggcaggctcttggggccagcctaagatcatggtttagggtgatcagtgctggcagataaattgaaaaggcacgctggcttgtgatcttaaatgaggacaatccccccagggctgggcactcctcccctcccctcacttctcccacctgcagagccagtgtccttgggtgggctagataggatatactgtatgccggctccttcaagctgctgactcactttatcaatagttccatttaaattgacttcagtggtgagactgtatcctgtttgctattgcttgttgtgctatggggggaggggggaggaatgtgtaagatagttaacatgggcaaagggagatcttggggtgcagcacttaaactgcctcgtaacccttttcatgatttcaaccacatttgctagagggagggagcagccacggagttagaggcccttggggtttctcttttccactgacaggctttcccaggcagctggctagttcattccctccccagccaggtgcaggcgtaggaatatggacatctggttgctttggcctgctgccctctttcaggggtcctaagcccacaatcatgcctccctaagaccttggcatccttccctctaagccgttggcacctctgtgccacctctcacactggctccagacacacagcctgtgcttttggagctgagatcactcgcttcaccctcctcatctttgttctccaagtaaagccacgaggtcggggcgagggcagaggtgatcacctgcgtgtcccatctacagacctgcagcttcataaaacttctgatttctcttcagctttgaaaagggttaccctgggcactggcctagagcctcacctcctaatagacttagccccatgagtttgccatgttgagcaggactatttctggcacttgcaagtcccatgatttcttcggtaattctgagggtggggggagggacatgaaatcatcttagcttagctttctgtctgtgaatgtctatatagtgtattgtgtgttttaacaaatgatttacactgactgttgctgtaaaagtgaatttggaaataaagttattactctgattaaa

SEQ ID NO: 153981 - DNA, 5811 bp, Homo sapiens
  Payload ID: 10267
  Gene Symbol: MAPT
  Gene Name: microtubule-associated protein tau
  Uniprot ID: P10636
  ENST ID: ENST00000351559
  CDS Start-End: 323-1648
ggacggccgagcggcagggcgctcgcgcgcgcccactagtggccggaggagaaggctcccgcggaggccgcgctgcccgccccctcccctggggaggctcgcgttcccgctgctcgcgcctgcgccgcccgccggcctcaggaacgcgccctcttcgccggcgcgcgccctcgcagtcaccgccacccaccagctccggcaccaacagcagcgccgctgccaccgcccaccttctgccgccgccaccacagccaccttctcctcctccgctgtcctctcccgtcctcgcctctgtcgactatcaggtgaactttgaaccaggatggctgagccccgccaggagttcgaagtgatggaagatcacgctgggacgtacgggttgggggacaggaaagatcaggggggctacaccatgcaccaagaccaagagggtgacacggacgctggcctgaaagaatctcccctgcagacccccactgaggacggatctgaggaaccgggctctgaaacctctgatgctaagagcactccaacagcggaagatgtgacagcacccttagtggatgagggagctcccggcaagcaggctgccgcgcagccccacacggagatcccagaaggaaccacagctgaagaagcaggcattggagacacccccagcctggaagacgaagctgctggtcacgtgacccaagctcgcatggtcagtaaaagcaaagacgggactggaagcgatgacaaaaaagccaagggggctgatggtaaaacgaagatcgccacaccgcggggagcagcccctccaggccagaagggccaggccaacgccaccaggattccagcaaaaaccccgcccgctccaaagacaccacccagctctggtgaacctccaaaatcaggggatcgcagcggctacagcagccccggctccccaggcactcccggcagccgctcccgcaccccgtcccttccaaccccacccacccgggagcccaagaaggtggcagtggtccgtactccacccaagtcgccgtcttccgccaagagccgcctgcagacagcccccgtgcccatgccagacctgaagaatgtcaagtccaagatcggctccactgagaacctgaagcaccagccgggaggcgggaaggtgcagataattaataagaagctggatcttagcaacgtccagtccaagtgtggctcaaaggataatatcaaacacgtcccgggaggcggcagtgtgcaaatagtctacaaaccagttgacctgagcaaggtgacctccaagtgtggctcattaggcaacatccatcataaaccaggaggtggccaggtggaagtaaaatctgagaagcttgacttcaaggacagagtccagtcgaagattgggtccctggacaatatcacccacgtccctggcggaggaaataaaaagattgaaacccacaagctgaccttccgcgagaacgccaaagccaagacagaccacggggcggagatcgtgtacaagtcgccagtggtgtctggggacacgtctccacggcatctcagcaatgtctcctccaccggcagcatcgacatggtagactcgccccagctcgccacgctagctgacgaggtgtctgcctccctggccaagcagggtttgtgatcaggcccctggggcggtcaataattgtggagaggagagaatgagagagtgtggaaaaaaaaagaataatgacccggcccccgccctctgcccccagctgctcctcgcagttcggttaattggttaatcacttaacctgcttttgtcactcggctttggctcgggacttcaaaatcagtgatgggagtaagagcaaatttcatctttccaaattgatgggtgggctagtaataaaatatttaaaaaaaaacattcaaaaacatggccacatccaacatttcctcaggcaattccttttgattcttttttcttccccctccatgtagaagagggagaaggagaggctctgaaagctgcttctgggggatttcaagggactgggggtgccaaccacctctggccctgttgtgggggtgtcacagaggcagtggcagcaacaaaggatttgaaacttggtgtgttcgtggagccacaggcagacgatgtcaaccttgtgtgagtgtgacgggggttggggtggggcgggaggccacgggggaggccgaggcaggggctgggcagaggggagaggaagcacaagaagtgggagtgggagaggaagccacgtgctggagagtagacatccccctccttgccgctgggagagccaaggcctatgccacctgcagcgtctgagcggccgcctgtccttggtggccgggggtgggggcctgctgtgggtcagtgtgccaccctctgcagggcagcctgtgggagaagggacagcgggtaaaaagagaaggcaagctggcaggagggtggcacttcgtggatgacctccttagaaaagactgaccttgatgtcttgagagcgctggcctcttcctccctccctgcagggtagggggcctgagttgaggggcttccctctgctccacagaaaccctgttttattgagttctgaaggttggaactgctgccatgattttggccactttgcagacctgggactttagggctaaccagttctctttgtaaggacttgtgcctcttgggagacgtccacccgtttccaagcctgggccactggcatctctggagtgtgtgggggtctgggaggcaggtcccgagccccctgtccttcccacggccactgcagtcaccccgtctgcgccgctgtgctgttgtctgccgtgagagcccaatcactgcctatacccctcatcacacgtcacaatgtcccgaattcccagcctcaccaccccttctcagtaatgaccctggttggttgcaggaggtacctactccatactgagggtgaaattaagggaaggcaaagtccaggcacaagagtgggaccccagcctctcactctcagttccactcatccaactgggaccctcaccacgaatctcatgatctgattcggttccctgtctcctcctcccgtcacagatgtgagccagggcactgctcagctgtgaccctaggtgtttctgccttgttgacatggagagagccctttcccctgagaaggcctggccccttcctgtgctgagcccacagcagcaggctgggtgtcttggttgtcagtggtggcaccaggatggaagggcaaggcacccagggcaggcccacagtcccgctgtcccccacttgcaccctagcttgtagctgccaacctcccagacagcccagcccgctgctcagctccacatgcatagtatcagccctccacacccgacaaaggggaacacacccccttggaaatggttcttttcccccagtcccagctggaagccatgctgtctgttctgctggagcagctgaacatatacatagatgttgccctgccctccccatctgcaccctgttgagttgtagttggatttgtctgtttatgcttggattcaccagagtgactatgatagtgaaaagaaaaaaaaaaaaaaaaaaggacgcatgtatcttgaaatgcttgtaaagaggtttctaacccaccctcacgaggtgtctctcacccccacactgggactcgtgtggcctgtgtggtgccaccctgctggggcctcccaagttttgaaaggctttcctcagcacctgggacccaacagagaccagcttctagcagctaaggaggccgttcagctgtgacgaaggcctgaagcacaggattaggactgaagcgatgatgtccccttccctacttccccttggggctccctgtgtcagggcacagactaggtcttgtggctggtctggcttgcggcgcgaggatggttctctctggtcatagcccgaagtctcatggcagtcccaaaggaggcttacaactcctgcatcacaagaaaaaggaagccactgccagctggggggatctgcagctcccagaagctccgtgagcctcagccacccctcagactgggttcctctccaagctcgccctctggaggggcagcgcagcctcccaccaagggccctgcgaccacagcagggattgggatgaattgcctgtcctggatctgctctagaggcccaagctgcctgcctgaggaaggatgacttgacaagtcaggagacactgttcccaaagccttgaccagagcacctcagcccgctgaccttgcacaaactccatctgctgccatgagaaaagggaagccgcctttgcaaaacattgctgcctaaagaaactcagcagcctcaggcccaattctgccacttctggtttgggtacagttaaaggcaaccctgagggacttggcagtagaaatccagggcctcccctggggctggcagcttcgtgtgcagctagagctttacctgaaaggaagtctctgggcccagaactctccaccaagagcctccctgccgttcgctgagtcccagcaattctcctaagttgaagggatctgagaaggagaaggaaatgtggggtagatttggtggtggttagagatatgcccccctcattactgccaacagtttcggctgcatttcttcacgcacctcggttcctcttcctgaagttcttgtgccctgctcttcagcaccatgggccttcttatacggaaggctctgggatctcccccttgtggggcaggctcttggggccagcctaagatcatggtttagggtgatcagtgctggcagataaattgaaaaggcacgctggcttgtgatcttaaatgaggacaatccccccagggctgggcactcctcccctcccctcacttctcccacctgcagagccagtgtccttgggtgggctagataggatatactgtatgccggctccttcaagctgctgactcactttatcaatagttccatttaaattgacttcagtggtgagactgtatcctgtttgctattgcttgttgtgctatggggggaggggggaggaatgtgtaagatagttaacatgggcaaagggagatcttggggtgcagcacttaaactgcctcgtaacccttttcatgatttcaaccacatttgctagagggagggagcagccacggagttagaggcccttggggtttctcttttccactgacaggctttcccaggcagctggctagttcattccctccccagccaggtgcaggcgtaggaatatggacatctggttgctttggcctgctgccctctttcaggggtcctaagcccacaatcatgcctccctaagaccttggcatccttccctctaagccgttggcacctctgtgccacctctcacactggctccagacacacagcctgtgcttttggagctgagatcactcgcttcaccctcctcatctttgttctccaagtaaagccacgaggtcggggcgagggcagaggtgatcacctgcgtgtcccatctacagacctgcagcttcataaaacttctgatttctcttcagctttgaaaagggttaccctgggcactggcctagagcctcacctcctaatagacttagccccatgagtttgccatgttgagcaggactatttctggcacttgcaagtcccatgatttcttcggtaattctgagggtggggggagggacatgaaatcatcttagcttagctttctgtctgtgaatgtctatatagtgtattgtgtgttttaacaaatgatttacactgactgttgctgtaaaagtgaatttggaaataaagttattactctgattaaa

SEQ ID NO: 153982 - DNA, 1107 bp, Homo sapiens
  Payload ID: 10267
  Gene Symbol: MAPT
  Gene Name: microtubule-associated protein tau
  Uniprot ID: P10636
  ENST ID: ENST00000334239
  CDS Start-End: 37-1095
cgcctctgtcgactatcaggtgaactttgaaccaggatggctgagccccgccaggagttcgaagtgatggaagatcacgctgggacgtacgggttgggggacaggaaagatcaggggggctacaccatgcaccaagaccaagagggtgacacggacgctggcctgaaagctgaagaagcaggcattggagacacccccagcctggaagacgaagctgctggtcacgtgacccaagctcgcatggtcagtaaaagcaaagacgggactggaagcgatgacaaaaaagccaagggggctgatggtaaaacgaagatcgccacaccgcggggagcagcccctccaggccagaagggccaggccaacgccaccaggattccagcaaaaaccccgcccgctccaaagacaccacccagctctggtgaacctccaaaatcaggggatcgcagcggctacagcagccccggctccccaggcactcccggcagccgctcccgcaccccgtcccttccaaccccacccacccgggagcccaagaaggtggcagtggtccgtactccacccaagtcgccgtcttccgccaagagccgcctgcagacagcccccgtgcccatgccagacctgaagaatgtcaagtccaagatcggctccactgagaacctgaagcaccagccgggaggcgggaaggtgcaaatagtctacaaaccagttgacctgagcaaggtgacctccaagtgtggctcattaggcaacatccatcataaaccaggaggtggccaggtggaagtaaaatctgagaagcttgacttcaaggacagagtccagtcgaagattgggtccctggacaatatcacccacgtccctggcggaggaaataaaaagattgaaacccacaagctgaccttccgcgagaacgccaaagccaagacagaccacggggcggagatcgtgtacaagtcgccagtggtgtctggggacacgtctccacggcatctcagcaatgtctcctccaccggcagcatcgacatggtagactcgccccagctcgccacgctagctgacgaggtgtctgcctccctggccaagcagggtttgtgatcaggcccctgg

SEQ ID NO: 153983 - DNA, 5724 bp, Homo sapiens
  Payload ID: 10267
  Gene Symbol: MAPT
  Gene Name: microtubule-associated protein tau
  Uniprot ID: P10636
  ENST ID: ENST00000340799
  CDS Start-End: 323-1561
ggacggccgagcggcagggcgctcgcgcgcgcccactagtggccggaggagaaggctcccgcggaggccgcgctgcccgccccctcccctggggaggctcgcgttcccgctgctcgcgcctgcgccgcccgccggcctcaggaacgcgccctcttcgccggcgcgcgccctcgcagtcaccgccacccaccagctccggcaccaacagcagcgccgctgccaccgcccaccttctgccgccgccaccacagccaccttctcctcctccgctgtcctctcccgtcctcgcctctgtcgactatcaggtgaactttgaaccaggatggctgagccccgccaggagttcgaagtgatggaagatcacgctgggacgtacgggttgggggacaggaaagatcaggggggctacaccatgcaccaagaccaagagggtgacacggacgctggcctgaaagaatctcccctgcagacccccactgaggacggatctgaggaaccgggctctgaaacctctgatgctaagagcactccaacagcggaagctgaagaagcaggcattggagacacccccagcctggaagacgaagctgctggtcacgtgacccaagctcgcatggtcagtaaaagcaaagacgggactggaagcgatgacaaaaaagccaagggggctgatggtaaaacgaagatcgccacaccgcggggagcagcccctccaggccagaagggccaggccaacgccaccaggattccagcaaaaaccccgcccgctccaaagacaccacccagctctggtgaacctccaaaatcaggggatcgcagcggctacagcagccccggctccccaggcactcccggcagccgctcccgcaccccgtcccttccaaccccacccacccgggagcccaagaaggtggcagtggtccgtactccacccaagtcgccgtcttccgccaagagccgcctgcagacagcccccgtgcccatgccagacctgaagaatgtcaagtccaagatcggctccactgagaacctgaagcaccagccgggaggcgggaaggtgcagataattaataagaagctggatcttagcaacgtccagtccaagtgtggctcaaaggataatatcaaacacgtcccgggaggcggcagtgtgcaaatagtctacaaaccagttgacctgagcaaggtgacctccaagtgtggctcattaggcaacatccatcataaaccaggaggtggccaggtggaagtaaaatctgagaagcttgacttcaaggacagagtccagtcgaagattgggtccctggacaatatcacccacgtccctggcggaggaaataaaaagattgaaacccacaagctgaccttccgcgagaacgccaaagccaagacagaccacggggcggagatcgtgtacaagtcgccagtggtgtctggggacacgtctccacggcatctcagcaatgtctcctccaccggcagcatcgacatggtagactcgccccagctcgccacgctagctgacgaggtgtctgcctccctggccaagcagggtttgtgatcaggcccctggggcggtcaataattgtggagaggagagaatgagagagtgtggaaaaaaaaagaataatgacccggcccccgccctctgcccccagctgctcctcgcagttcggttaattggttaatcacttaacctgcttttgtcactcggctttggctcgggacttcaaaatcagtgatgggagtaagagcaaatttcatctttccaaattgatgggtgggctagtaataaaatatttaaaaaaaaacattcaaaaacatggccacatccaacatttcctcaggcaattccttttgattcttttttcttccccctccatgtagaagagggagaaggagaggctctgaaagctgcttctgggggatttcaagggactgggggtgccaaccacctctggccctgttgtgggggtgtcacagaggcagtggcagcaacaaaggatttgaaacttggtgtgttcgtggagccacaggcagacgatgtcaaccttgtgtgagtgtgacgggggttggggtggggcgggaggccacgggggaggccgaggcaggggctgggcagaggggagaggaagcacaagaagtgggagtgggagaggaagccacgtgctggagagtagacatccccctccttgccgctgggagagccaaggcctatgccacctgcagcgtctgagcggccgcctgtccttggtggccgggggtgggggcctgctgtgggtcagtgtgccaccctctgcagggcagcctgtgggagaagggacagcgggtaaaaagagaaggcaagctggcaggagggtggcacttcgtggatgacctccttagaaaagactgaccttgatgtcttgagagcgctggcctcttcctccctccctgcagggtagggggcctgagttgaggggcttccctctgctccacagaaaccctgttttattgagttctgaaggttggaactgctgccatgattttggccactttgcagacctgggactttagggctaaccagttctctttgtaaggacttgtgcctcttgggagacgtccacccgtttccaagcctgggccactggcatctctggagtgtgtgggggtctgggaggcaggtcccgagccccctgtccttcccacggccactgcagtcaccccgtctgcgccgctgtgctgttgtctgccgtgagagcccaatcactgcctatacccctcatcacacgtcacaatgtcccgaattcccagcctcaccaccccttctcagtaatgaccctggttggttgcaggaggtacctactccatactgagggtgaaattaagggaaggcaaagtccaggcacaagagtgggaccccagcctctcactctcagttccactcatccaactgggaccctcaccacgaatctcatgatctgattcggttccctgtctcctcctcccgtcacagatgtgagccagggcactgctcagctgtgaccctaggtgtttctgccttgttgacatggagagagccctttcccctgagaaggcctggccccttcctgtgctgagcccacagcagcaggctgggtgtcttggttgtcagtggtggcaccaggatggaagggcaaggcacccagggcaggcccacagtcccgctgtcccccacttgcaccctagcttgtagctgccaacctcccagacagcccagcccgctgctcagctccacatgcatagtatcagccctccacacccgacaaaggggaacacacccccttggaaatggttcttttcccccagtcccagctggaagccatgctgtctgttctgctggagcagctgaacatatacatagatgttgccctgccctccccatctgcaccctgttgagttgtagttggatttgtctgtttatgcttggattcaccagagtgactatgatagtgaaaagaaaaaaaaaaaaaaaaaaggacgcatgtatcttgaaatgcttgtaaagaggtttctaacccaccctcacgaggtgtctctcacccccacactgggactcgtgtggcctgtgtggtgccaccctgctggggcctcccaagttttgaaaggctttcctcagcacctgggacccaacagagaccagcttctagcagctaaggaggccgttcagctgtgacgaaggcctgaagcacaggattaggactgaagcgatgatgtccccttccctacttccccttggggctccctgtgtcagggcacagactaggtcttgtggctggtctggcttgcggcgcgaggatggttctctctggtcatagcccgaagtctcatggcagtcccaaaggaggcttacaactcctgcatcacaagaaaaaggaagccactgccagctggggggatctgcagctcccagaagctccgtgagcctcagccacccctcagactgggttcctctccaagctcgccctctggaggggcagcgcagcctcccaccaagggccctgcgaccacagcagggattgggatgaattgcctgtcctggatctgctctagaggcccaagctgcctgcctgaggaaggatgacttgacaagtcaggagacactgttcccaaagccttgaccagagcacctcagcccgctgaccttgcacaaactccatctgctgccatgagaaaagggaagccgcctttgcaaaacattgctgcctaaagaaactcagcagcctcaggcccaattctgccacttctggtttgggtacagttaaaggcaaccctgagggacttggcagtagaaatccagggcctcccctggggctggcagcttcgtgtgcagctagagctttacctgaaaggaagtctctgggcccagaactctccaccaagagcctccctgccgttcgctgagtcccagcaattctcctaagttgaagggatctgagaaggagaaggaaatgtggggtagatttggtggtggttagagatatgcccccctcattactgccaacagtttcggctgcatttcttcacgcacctcggttcctcttcctgaagttcttgtgccctgctcttcagcaccatgggccttcttatacggaaggctctgggatctcccccttgtggggcaggctcttggggccagcctaagatcatggtttagggtgatcagtgctggcagataaattgaaaaggcacgctggcttgtgatcttaaatgaggacaatccccccagggctgggcactcctcccctcccctcacttctcccacctgcagagccagtgtccttgggtgggctagataggatatactgtatgccggctccttcaagctgctgactcactttatcaatagttccatttaaattgacttcagtggtgagactgtatcctgtttgctattgcttgttgtgctatggggggaggggggaggaatgtgtaagatagttaacatgggcaaagggagatcttggggtgcagcacttaaactgcctcgtaacccttttcatgatttcaaccacatttgctagagggagggagcagccacggagttagaggcccttggggtttctcttttccactgacaggctttcccaggcagctggctagttcattccctccccagccaggtgcaggcgtaggaatatggacatctggttgctttggcctgctgccctctttcaggggtcctaagcccacaatcatgcctccctaagaccttggcatccttccctctaagccgttggcacctctgtgccacctctcacactggctccagacacacagcctgtgcttttggagctgagatcactcgcttcaccctcctcatctttgttctccaagtaaagccacgaggtcggggcgagggcagaggtgatcacctgcgtgtcccatctacagacctgcagcttcataaaacttctgatttctcttcagctttgaaaagggttaccctgggcactggcctagagcctcacctcctaatagacttagccccatgagtttgccatgttgagcaggactatttctggcacttgcaagtcccatgatttcttcggtaattctgagggtggggggagggacatgaaatcatcttagcttagctttctgtctgtgaatgtctatatagtgtattgtgtgttttaacaaatgatttacactgactgttgctgtaaaagtgaatttggaaataaagttattactctgattaaa

SEQ ID NO: 153984 - DNA, 6816 bp, Homo sapiens
  Payload ID: 10267
  Gene Symbol: MAPT
  Gene Name: microtubule-associated protein tau
  Uniprot ID: P10636
  ENST ID: ENST00000344290
  CDS Start-End: 323-2653
ggacggccgagcggcagggcgctcgcgcgcgcccactagtggccggaggagaaggctcccgcggaggccgcgctgcccgccccctcccctggggaggctcgcgttcccgctgctcgcgcctgcgccgcccgccggcctcaggaacgcgccctcttcgccggcgcgcgccctcgcagtcaccgccacccaccagctccggcaccaacagcagcgccgctgccaccgcccaccttctgccgccgccaccacagccaccttctcctcctccgctgtcctctcccgtcctcgcctctgtcgactatcaggtgaactttgaaccaggatggctgagccccgccaggagttcgaagtgatggaagatcacgctgggacgtacgggttgggggacaggaaagatcaggggggctacaccatgcaccaagaccaagagggtgacacggacgctggcctgaaagaatctcccctgcagacccccactgaggacggatctgaggaaccgggctctgaaacctctgatgctaagagcactccaacagcggaagatgtgacagcacccttagtggatgagggagctcccggcaagcaggctgccgcgcagccccacacggagatcccagaaggaaccacagctgaagaagcaggcattggagacacccccagcctggaagacgaagctgctggtcacgtgacccaagagcctgaaagtggtaaggtggtccaggaaggcttcctccgagagccaggccccccaggtctgagccaccagctcatgtccggcatgcctggggctcccctcctgcctgagggccccagagaggccacacgccaaccttcggggacaggacctgaggacacagagggcggccgccacgcccctgagctgctcaagcaccagcttctaggagacctgcaccaggaggggccgccgctgaagggggcagggggcaaagagaggccggggagcaaggaggaggtggatgaagaccgcgacgtcgatgagtcctccccccaagactcccctccctccaaggcctccccagcccaagatgggcggcctccccagacagccgccagagaagccaccagcatcccaggcttcccagcggagggtgccatccccctccctgtggatttcctctccaaagtttccacagagatcccagcctcagagcccgacgggcccagtgtagggcgggccaaagggcaggatgcccccctggagttcacgtttcacgtggaaatcacacccaacgtgcagaaggagcaggcgcactcggaggagcatttgggaagggctgcatttccaggggcccctggagaggggccagaggcccggggcccctctttgggagaggacacaaaagaggctgaccttccagagccctctgaaaagcagcctgctgctgctccgcgggggaagcccgtcagccgggtccctcaactcaaagctcgcatggtcagtaaaagcaaagacgggactggaagcgatgacaaaaaagccaagacatccacacgttcctctgctaaaaccttgaaaaataggccttgccttagccccaaacaccccactcctggtagctcagaccctctgatccaaccctccagccctgctgtgtgcccagagccaccttcctctcctaaatacgtctcttctgtcacttcccgaactggcagttctggagcaaaggagatgaaactcaagggggctgatggtaaaacgaagatcgccacaccgcggggagcagcccctccaggccagaagggccaggccaacgccaccaggattccagcaaaaaccccgcccgctccaaagacaccacccagctctgcgactaagcaagtccagagaagaccaccccctgcagggcccagatctgagagaggtgaacctccaaaatcaggggatcgcagcggctacagcagccccggctccccaggcactcccggcagccgctcccgcaccccgtcccttccaaccccacccacccgggagcccaagaaggtggcagtggtccgtactccacccaagtcgccgtcttccgccaagagccgcctgcagacagcccccgtgcccatgccagacctgaagaatgtcaagtccaagatcggctccactgagaacctgaagcaccagccgggaggcgggaaggtgcagataattaataagaagctggatcttagcaacgtccagtccaagtgtggctcaaaggataatatcaaacacgtcccgggaggcggcagtgtgcaaatagtctacaaaccagttgacctgagcaaggtgacctccaagtgtggctcattaggcaacatccatcataaaccaggaggtggccaggtggaagtaaaatctgagaagcttgacttcaaggacagagtccagtcgaagattgggtccctggacaatatcacccacgtccctggcggaggaaataaaaagattgaaacccacaagctgaccttccgcgagaacgccaaagccaagacagaccacggggcggagatcgtgtacaagtcgccagtggtgtctggggacacgtctccacggcatctcagcaatgtctcctccaccggcagcatcgacatggtagactcgccccagctcgccacgctagctgacgaggtgtctgcctccctggccaagcagggtttgtgatcaggcccctggggcggtcaataattgtggagaggagagaatgagagagtgtggaaaaaaaaagaataatgacccggcccccgccctctgcccccagctgctcctcgcagttcggttaattggttaatcacttaacctgcttttgtcactcggctttggctcgggacttcaaaatcagtgatgggagtaagagcaaatttcatctttccaaattgatgggtgggctagtaataaaatatttaaaaaaaaacattcaaaaacatggccacatccaacatttcctcaggcaattccttttgattcttttttcttccccctccatgtagaagagggagaaggagaggctctgaaagctgcttctgggggatttcaagggactgggggtgccaaccacctctggccctgttgtgggggtgtcacagaggcagtggcagcaacaaaggatttgaaacttggtgtgttcgtggagccacaggcagacgatgtcaaccttgtgtgagtgtgacgggggttggggtggggcgggaggccacgggggaggccgaggcaggggctgggcagaggggagaggaagcacaagaagtgggagtgggagaggaagccacgtgctggagagtagacatccccctccttgccgctgggagagccaaggcctatgccacctgcagcgtctgagcggccgcctgtccttggtggccgggggtgggggcctgctgtgggtcagtgtgccaccctctgcagggcagcctgtgggagaagggacagcgggtaaaaagagaaggcaagctggcaggagggtggcacttcgtggatgacctccttagaaaagactgaccttgatgtcttgagagcgctggcctcttcctccctccctgcagggtagggggcctgagttgaggggcttccctctgctccacagaaaccctgttttattgagttctgaaggttggaactgctgccatgattttggccactttgcagacctgggactttagggctaaccagttctctttgtaaggacttgtgcctcttgggagacgtccacccgtttccaagcctgggccactggcatctctggagtgtgtgggggtctgggaggcaggtcccgagccccctgtccttcccacggccactgcagtcaccccgtctgcgccgctgtgctgttgtctgccgtgagagcccaatcactgcctatacccctcatcacacgtcacaatgtcccgaattcccagcctcaccaccccttctcagtaatgaccctggttggttgcaggaggtacctactccatactgagggtgaaattaagggaaggcaaagtccaggcacaagagtgggaccccagcctctcactctcagttccactcatccaactgggaccctcaccacgaatctcatgatctgattcggttccctgtctcctcctcccgtcacagatgtgagccagggcactgctcagctgtgaccctaggtgtttctgccttgttgacatggagagagccctttcccctgagaaggcctggccccttcctgtgctgagcccacagcagcaggctgggtgtcttggttgtcagtggtggcaccaggatggaagggcaaggcacccagggcaggcccacagtcccgctgtcccccacttgcaccctagcttgtagctgccaacctcccagacagcccagcccgctgctcagctccacatgcatagtatcagccctccacacccgacaaaggggaacacacccccttggaaatggttcttttcccccagtcccagctggaagccatgctgtctgttctgctggagcagctgaacatatacatagatgttgccctgccctccccatctgcaccctgttgagttgtagttggatttgtctgtttatgcttggattcaccagagtgactatgatagtgaaaagaaaaaaaaaaaaaaaaaaggacgcatgtatcttgaaatgcttgtaaagaggtttctaacccaccctcacgaggtgtctctcacccccacactgggactcgtgtggcctgtgtggtgccaccctgctggggcctcccaagttttgaaaggctttcctcagcacctgggacccaacagagaccagcttctagcagctaaggaggccgttcagctgtgacgaaggcctgaagcacaggattaggactgaagcgatgatgtccccttccctacttccccttggggctccctgtgtcagggcacagactaggtcttgtggctggtctggcttgcggcgcgaggatggttctctctggtcatagcccgaagtctcatggcagtcccaaaggaggcttacaactcctgcatcacaagaaaaaggaagccactgccagctggggggatctgcagctcccagaagctccgtgagcctcagccacccctcagactgggttcctctccaagctcgccctctggaggggcagcgcagcctcccaccaagggccctgcgaccacagcagggattgggatgaattgcctgtcctggatctgctctagaggcccaagctgcctgcctgaggaaggatgacttgacaagtcaggagacactgttcccaaagccttgaccagagcacctcagcccgctgaccttgcacaaactccatctgctgccatgagaaaagggaagccgcctttgcaaaacattgctgcctaaagaaactcagcagcctcaggcccaattctgccacttctggtttgggtacagttaaaggcaaccctgagggacttggcagtagaaatccagggcctcccctggggctggcagcttcgtgtgcagctagagctttacctgaaaggaagtctctgggcccagaactctccaccaagagcctccctgccgttcgctgagtcccagcaattctcctaagttgaagggatctgagaaggagaaggaaatgtggggtagatttggtggtggttagagatatgcccccctcattactgccaacagtttcggctgcatttcttcacgcacctcggttcctcttcctgaagttcttgtgccctgctcttcagcaccatgggccttcttatacggaaggctctgggatctcccccttgtggggcaggctcttggggccagcctaagatcatggtttagggtgatcagtgctggcagataaattgaaaaggcacgctggcttgtgatcttaaatgaggacaatccccccagggctgggcactcctcccctcccctcacttctcccacctgcagagccagtgtccttgggtgggctagataggatatactgtatgccggctccttcaagctgctgactcactttatcaatagttccatttaaattgacttcagtggtgagactgtatcctgtttgctattgcttgttgtgctatggggggaggggggaggaatgtgtaagatagttaacatgggcaaagggagatcttggggtgcagcacttaaactgcctcgtaacccttttcatgatttcaaccacatttgctagagggagggagcagccacggagttagaggcccttggggtttctcttttccactgacaggctttcccaggcagctggctagttcattccctccccagccaggtgcaggcgtaggaatatggacatctggttgctttggcctgctgccctctttcaggggtcctaagcccacaatcatgcctccctaagaccttggcatccttccctctaagccgttggcacctctgtgccacctctcacactggctccagacacacagcctgtgcttttggagctgagatcactcgcttcaccctcctcatctttgttctccaagtaaagccacgaggtcggggcgagggcagaggtgatcacctgcgtgtcccatctacagacctgcagcttcataaaacttctgatttctcttcagctttgaaaagggttaccctgggcactggcctagagcctcacctcctaatagacttagccccatgagtttgccatgttgagcaggactatttctggcacttgcaagtcccatgatttcttcggtaattctgagggtggggggagggacatgaaatcatcttagcttagctttctgtctgtgaatgtctatatagtgtattgtgtgttttaacaaatgatttacactgactgttgctgtaaaagtgaatttggaaataaagttattactctgattaaa

SEQ ID NO: 153985 - DNA, 1233 bp, Homo sapiens
  Payload ID: 10267
  Gene Symbol: MAPT
  Gene Name: microtubule-associated protein tau
  Uniprot ID: P10636
  ENST ID: ENST00000431008
  CDS Start-End: 1-1233
atggctgagccccgccaggagttcgaagtgatggaagatcacgctgggacgtacgggttgggggacaggaaagatcaggggggctacaccatgcaccaagaccaagagggtgacacggacgctggcctgaaagaatctcccctgcagacccccactgaggacggatctgaggaaccgggctctgaaacctctgatgctaagagcactccaacagcggaagatgtgacagcacccttagtggatgagggagctcccggcaagcaggctgccgcgcagccccacacggagatcccagaaggaaccacagctgaagaagcaggcattggagacacccccagcctggaagacgaagctgctggtcacgtgacccaagctcgcatggtcagtaaaagcaaagacgggactggaagcgatgacaaaaaagccaagggggctgatggtaaaacgaagatcgccacaccgcggggagcagcccctccaggccagaagggccaggccaacgccaccaggattccagcaaaaaccccgcccgctccaaagacaccacccagctctggtgaacctccaaaatcaggggatcgcagcggctacagcagccccggctccccaggcactcccggcagccgctcccgcaccccgtcccttccaaccccacccacccgggagcccaagaaggtggcagtggtccgtactccacccaagtcgccgtcttccgccaagagccgcctgcagacagcccccgtgcccatgccagacctgaagaatgtcaagtccaagatcggctccactgagaacctgaagcaccagccgggaggcgggaaggtgcaaatagtctacaaaccagttgacctgagcaaggtgacctccaagtgtggctcattaggcaacatccatcataaaccaggaggtggccaggtggaagtaaaatctgagaagcttgacttcaaggacagagtccagtcgaagattgggtccctggacaatatcacccacgtccctggcggaggaaataaaaagattgaaacccacaagctgaccttccgcgagaacgccaaagccaagacagaccacggggcggagatcgtgtacaagtcgccagtggtgtctggggacacgtctccacggcatctcagcaatgtctcctccaccggcagcatcgacatggtagactcgccccagctcgccacgctagctgacgaggtgtctgcctccctggccaagcagggtttgtga

SEQ ID NO: 153986 - DNA, 5345 bp, Homo sapiens
  Payload ID: 10267
  Gene Symbol: MAPT
  Gene Name: microtubule-associated protein tau
  Uniprot ID: P10636
  ENST ID: ENST00000446361
  CDS Start-End: 31-1182
tgtcgactatcaggtgaactttgaaccaggatggctgagccccgccaggagttcgaagtgatggaagatcacgctgggacgtacgggttgggggacaggaaagatcaggggggctacaccatgcaccaagaccaagagggtgacacggacgctggcctgaaagctgaagaagcaggcattggagacacccccagcctggaagacgaagctgctggtcacgtgacccaagctcgcatggtcagtaaaagcaaagacgggactggaagcgatgacaaaaaagccaagggggctgatggtaaaacgaagatcgccacaccgcggggagcagcccctccaggccagaagggccaggccaacgccaccaggattccagcaaaaaccccgcccgctccaaagacaccacccagctctggtgaacctccaaaatcaggggatcgcagcggctacagcagccccggctccccaggcactcccggcagccgctcccgcaccccgtcccttccaaccccacccacccgggagcccaagaaggtggcagtggtccgtactccacccaagtcgccgtcttccgccaagagccgcctgcagacagcccccgtgcccatgccagacctgaagaatgtcaagtccaagatcggctccactgagaacctgaagcaccagccgggaggcgggaaggtgcagataattaataagaagctggatcttagcaacgtccagtccaagtgtggctcaaaggataatatcaaacacgtcccgggaggcggcagtgtgcaaatagtctacaaaccagttgacctgagcaaggtgacctccaagtgtggctcattaggcaacatccatcataaaccaggaggtggccaggtggaagtaaaatctgagaagcttgacttcaaggacagagtccagtcgaagattgggtccctggacaatatcacccacgtccctggcggaggaaataaaaagattgaaacccacaagctgaccttccgcgagaacgccaaagccaagacagaccacggggcggagatcgtgtacaagtcgccagtggtgtctggggacacgtctccacggcatctcagcaatgtctcctccaccggcagcatcgacatggtagactcgccccagctcgccacgctagctgacgaggtgtctgcctccctggccaagcagggtttgtgatcaggcccctggggcggtcaataattgtggagaggagagaatgagagagtgtggaaaaaaaaagaataatgacccggcccccgccctctgcccccagctgctcctcgcagttcggttaattggttaatcacttaacctgcttttgtcactcggctttggctcgggacttcaaaatcagtgatgggagtaagagcaaatttcatctttccaaattgatgggtgggctagtaataaaatatttaaaaaaaaacattcaaaaacatggccacatccaacatttcctcaggcaattccttttgattcttttttcttccccctccatgtagaagagggagaaggagaggctctgaaagctgcttctgggggatttcaagggactgggggtgccaaccacctctggccctgttgtgggggtgtcacagaggcagtggcagcaacaaaggatttgaaacttggtgtgttcgtggagccacaggcagacgatgtcaaccttgtgtgagtgtgacgggggttggggtggggcgggaggccacgggggaggccgaggcaggggctgggcagaggggagaggaagcacaagaagtgggagtgggagaggaagccacgtgctggagagtagacatccccctccttgccgctgggagagccaaggcctatgccacctgcagcgtctgagcggccgcctgtccttggtggccgggggtgggggcctgctgtgggtcagtgtgccaccctctgcagggcagcctgtgggagaagggacagcgggtaaaaagagaaggcaagctggcaggagggtggcacttcgtggatgacctccttagaaaagactgaccttgatgtcttgagagcgctggcctcttcctccctccctgcagggtagggggcctgagttgaggggcttccctctgctccacagaaaccctgttttattgagttctgaaggttggaactgctgccatgattttggccactttgcagacctgggactttagggctaaccagttctctttgtaaggacttgtgcctcttgggagacgtccacccgtttccaagcctgggccactggcatctctggagtgtgtgggggtctgggaggcaggtcccgagccccctgtccttcccacggccactgcagtcaccccgtctgcgccgctgtgctgttgtctgccgtgagagcccaatcactgcctatacccctcatcacacgtcacaatgtcccgaattcccagcctcaccaccccttctcagtaatgaccctggttggttgcaggaggtacctactccatactgagggtgaaattaagggaaggcaaagtccaggcacaagagtgggaccccagcctctcactctcagttccactcatccaactgggaccctcaccacgaatctcatgatctgattcggttccctgtctcctcctcccgtcacagatgtgagccagggcactgctcagctgtgaccctaggtgtttctgccttgttgacatggagagagccctttcccctgagaaggcctggccccttcctgtgctgagcccacagcagcaggctgggtgtcttggttgtcagtggtggcaccaggatggaagggcaaggcacccagggcaggcccacagtcccgctgtcccccacttgcaccctagcttgtagctgccaacctcccagacagcccagcccgctgctcagctccacatgcatagtatcagccctccacacccgacaaaggggaacacacccccttggaaatggttcttttcccccagtcccagctggaagccatgctgtctgttctgctggagcagctgaacatatacatagatgttgccctgccctccccatctgcaccctgttgagttgtagttggatttgtctgtttatgcttggattcaccagagtgactatgatagtgaaaagaaaaaaaaaaaaaaaaaaggacgcatgtatcttgaaatgcttgtaaagaggtttctaacccaccctcacgaggtgtctctcacccccacactgggactcgtgtggcctgtgtggtgccaccctgctggggcctcccaagttttgaaaggctttcctcagcacctgggacccaacagagaccagcttctagcagctaaggaggccgttcagctgtgacgaaggcctgaagcacaggattaggactgaagcgatgatgtccccttccctacttccccttggggctccctgtgtcagggcacagactaggtcttgtggctggtctggcttgcggcgcgaggatggttctctctggtcatagcccgaagtctcatggcagtcccaaaggaggcttacaactcctgcatcacaagaaaaaggaagccactgccagctggggggatctgcagctcccagaagctccgtgagcctcagccacccctcagactgggttcctctccaagctcgccctctggaggggcagcgcagcctcccaccaagggccctgcgaccacagcagggattgggatgaattgcctgtcctggatctgctctagaggcccaagctgcctgcctgaggaaggatgacttgacaagtcaggagacactgttcccaaagccttgaccagagcacctcagcccgctgaccttgcacaaactccatctgctgccatgagaaaagggaagccgcctttgcaaaacattgctgcctaaagaaactcagcagcctcaggcccaattctgccacttctggtttgggtacagttaaaggcaaccctgagggacttggcagtagaaatccagggcctcccctggggctggcagcttcgtgtgcagctagagctttacctgaaaggaagtctctgggcccagaactctccaccaagagcctccctgccgttcgctgagtcccagcaattctcctaagttgaagggatctgagaaggagaaggaaatgtggggtagatttggtggtggttagagatatgcccccctcattactgccaacagtttcggctgcatttcttcacgcacctcggttcctcttcctgaagttcttgtgccctgctcttcagcaccatgggccttcttatacggaaggctctgggatctcccccttgtggggcaggctcttggggccagcctaagatcatggtttagggtgatcagtgctggcagataaattgaaaaggcacgctggcttgtgatcttaaatgaggacaatccccccagggctgggcactcctcccctcccctcacttctcccacctgcagagccagtgtccttgggtgggctagataggatatactgtatgccggctccttcaagctgctgactcactttatcaatagttccatttaaattgacttcagtggtgagactgtatcctgtttgctattgcttgttgtgctatggggggaggggggaggaatgtgtaagatagttaacatgggcaaagggagatcttggggtgcagcacttaaactgcctcgtaacccttttcatgatttcaaccacatttgctagagggagggagcagccacggagttagaggcccttggggtttctcttttccactgacaggctttcccaggcagctggctagttcattccctccccagccaggtgcaggcgtaggaatatggacatctggttgctttggcctgctgccctctttcaggggtcctaagcccacaatcatgcctccctaagaccttggcatccttccctctaagccgttggcacctctgtgccacctctcacactggctccagacacacagcctgtgcttttggagctgagatcactcgcttcaccctcctcatctttgttctccaagtaaagccacgaggtcggggcgagggcagaggtgatcacctgcgtgtcccatctacagacctgcagcttcataaaacttctgatttctcttcagctttgaaaagggttaccctgggcactggcctagagcctcacctcctaatagacttagccccatgagtttgccatgttgagcaggactatttctggcacttgcaagtcccatgatttcttcggtaattctgagggtggggggagggacatgaaatcatcttagcttagctttctgtctgtgaatgtctatatagtgtattgtgtgttttaacaaatgatttacactgactgttgctgtaaaagtgaatttggaaataaagttattactctgattaaa

SEQ ID NO: 153987 - DNA, 2331 bp, Homo sapiens
  Payload ID: 10267
  Gene Symbol: MAPT
  Gene Name: microtubule-associated protein tau
  Uniprot ID: P10636
  ENST ID: ENST00000415613
  CDS Start-End: 1-2331
atggctgagccccgccaggagttcgaagtgatggaagatcacgctgggacgtacgggttgggggacaggaaagatcaggggggctacaccatgcaccaagaccaagagggtgacacggacgctggcctgaaagaatctcccctgcagacccccactgaggacggatctgaggaaccgggctctgaaacctctgatgctaagagcactccaacagcggaagatgtgacagcacccttagtggatgagggagctcccggcaagcaggctgccgcgcagccccacacggagatcccagaaggaaccacagctgaagaagcaggcattggagacacccccagcctggaagacgaagctgctggtcacgtgacccaagagcctgaaagtggtaaggtggtccaggaaggcttcctccgagagccaggccccccaggtctgagccaccagctcatgtccggcatgcctggggctcccctcctgcctgagggccccagagaggccacacgccaaccttcggggacaggacctgaggacacagagggcggccgccacgcccctgagctgctcaagcaccagcttctaggagacctgcaccaggaggggccgccgctgaagggggcagggggcaaagagaggccggggagcaaggaggaggtggatgaagaccgcgacgtcgatgagtcctccccccaagactcccctccctccaaggcctccccagcccaagatgggcggcctccccagacagccgccagagaagccaccagcatcccaggcttcccagcggagggtgccatccccctccctgtggatttcctctccaaagtttccacagagatcccagcctcagagcccgacgggcccagtgtagggcgggccaaagggcaggatgcccccctggagttcacgtttcacgtggaaatcacacccaacgtgcagaaggagcaggcgcactcggaggagcatttgggaagggctgcatttccaggggcccctggagaggggccagaggcccggggcccctctttgggagaggacacaaaagaggctgaccttccagagccctctgaaaagcagcctgctgctgctccgcgggggaagcccgtcagccgggtccctcaactcaaagctcgcatggtcagtaaaagcaaagacgggactggaagcgatgacaaaaaagccaagacatccacacgttcctctgctaaaaccttgaaaaataggccttgccttagccccaaacaccccactcctggtagctcagaccctctgatccaaccctccagccctgctgtgtgcccagagccaccttcctctcctaaatacgtctcttctgtcacttcccgaactggcagttctggagcaaaggagatgaaactcaagggggctgatggtaaaacgaagatcgccacaccgcggggagcagcccctccaggccagaagggccaggccaacgccaccaggattccagcaaaaaccccgcccgctccaaagacaccacccagctctgcgactaagcaagtccagagaagaccaccccctgcagggcccagatctgagagaggtgaacctccaaaatcaggggatcgcagcggctacagcagccccggctccccaggcactcccggcagccgctcccgcaccccgtcccttccaaccccacccacccgggagcccaagaaggtggcagtggtccgtactccacccaagtcgccgtcttccgccaagagccgcctgcagacagcccccgtgcccatgccagacctgaagaatgtcaagtccaagatcggctccactgagaacctgaagcaccagccgggaggcgggaaggtgcagataattaataagaagctggatcttagcaacgtccagtccaagtgtggctcaaaggataatatcaaacacgtcccgggaggcggcagtgtgcaaatagtctacaaaccagttgacctgagcaaggtgacctccaagtgtggctcattaggcaacatccatcataaaccaggaggtggccaggtggaagtaaaatctgagaagcttgacttcaaggacagagtccagtcgaagattgggtccctggacaatatcacccacgtccctggcggaggaaataaaaagattgaaacccacaagctgaccttccgcgagaacgccaaagccaagacagaccacggggcggagatcgtgtacaagtcgccagtggtgtctggggacacgtctccacggcatctcagcaatgtctcctccaccggcagcatcgacatggtagactcgccccagctcgccacgctagctgacgaggtgtctgcctccctggccaagcagggtttgtga

SEQ ID NO: 153988 - DNA, 1239 bp, Homo sapiens
  Payload ID: 10267
  Gene Symbol: MAPT
  Gene Name: microtubule-associated protein tau
  Uniprot ID: P10636
  ENST ID: ENST00000420682
  CDS Start-End: 1-1239
atggctgagccccgccaggagttcgaagtgatggaagatcacgctgggacgtacgggttgggggacaggaaagatcaggggggctacaccatgcaccaagaccaagagggtgacacggacgctggcctgaaagaatctcccctgcagacccccactgaggacggatctgaggaaccgggctctgaaacctctgatgctaagagcactccaacagcggaagctgaagaagcaggcattggagacacccccagcctggaagacgaagctgctggtcacgtgacccaagctcgcatggtcagtaaaagcaaagacgggactggaagcgatgacaaaaaagccaagggggctgatggtaaaacgaagatcgccacaccgcggggagcagcccctccaggccagaagggccaggccaacgccaccaggattccagcaaaaaccccgcccgctccaaagacaccacccagctctggtgaacctccaaaatcaggggatcgcagcggctacagcagccccggctccccaggcactcccggcagccgctcccgcaccccgtcccttccaaccccacccacccgggagcccaagaaggtggcagtggtccgtactccacccaagtcgccgtcttccgccaagagccgcctgcagacagcccccgtgcccatgccagacctgaagaatgtcaagtccaagatcggctccactgagaacctgaagcaccagccgggaggcgggaaggtgcagataattaataagaagctggatcttagcaacgtccagtccaagtgtggctcaaaggataatatcaaacacgtcccgggaggcggcagtgtgcaaatagtctacaaaccagttgacctgagcaaggtgacctccaagtgtggctcattaggcaacatccatcataaaccaggaggtggccaggtggaagtaaaatctgagaagcttgacttcaaggacagagtccagtcgaagattgggtccctggacaatatcacccacgtccctggcggaggaaataaaaagattgaaacccacaagctgaccttccgcgagaacgccaaagccaagacagaccacggggcggagatcgtgtacaagtcgccagtggtgtctggggacacgtctccacggcatctcagcaatgtctcctccaccggcagcatcgacatggtagactcgccccagctcgccacgctagctgacgaggtgtctgcctccctggccaagcagggtttgtga

SEQ ID NO: 153989 - DNA, 5718 bp, Homo sapiens
  Payload ID: 10267
  Gene Symbol: MAPT
  Gene Name: microtubule-associated protein tau
  Uniprot ID: P10636
  ENST ID: ENST00000535772
  CDS Start-End: 323-1555
ggacggccgagcggcagggcgctcgcgcgcgcccactagtggccggaggagaaggctcccgcggaggccgcgctgcccgccccctcccctggggaggctcgcgttcccgctgctcgcgcctgcgccgcccgccggcctcaggaacgcgccctcttcgccggcgcgcgccctcgcagtcaccgccacccaccagctccggcaccaacagcagcgccgctgccaccgcccaccttctgccgccgccaccacagccaccttctcctcctccgctgtcctctcccgtcctcgcctctgtcgactatcaggtgaactttgaaccaggatggctgagccccgccaggagttcgaagtgatggaagatcacgctgggacgtacgggttgggggacaggaaagatcaggggggctacaccatgcaccaagaccaagagggtgacacggacgctggcctgaaagaatctcccctgcagacccccactgaggacggatctgaggaaccgggctctgaaacctctgatgctaagagcactccaacagcggaagatgtgacagcacccttagtggatgagggagctcccggcaagcaggctgccgcgcagccccacacggagatcccagaaggaaccacagctgaagaagcaggcattggagacacccccagcctggaagacgaagctgctggtcacgtgacccaagctcgcatggtcagtaaaagcaaagacgggactggaagcgatgacaaaaaagccaagggggctgatggtaaaacgaagatcgccacaccgcggggagcagcccctccaggccagaagggccaggccaacgccaccaggattccagcaaaaaccccgcccgctccaaagacaccacccagctctggtgaacctccaaaatcaggggatcgcagcggctacagcagccccggctccccaggcactcccggcagccgctcccgcaccccgtcccttccaaccccacccacccgggagcccaagaaggtggcagtggtccgtactccacccaagtcgccgtcttccgccaagagccgcctgcagacagcccccgtgcccatgccagacctgaagaatgtcaagtccaagatcggctccactgagaacctgaagcaccagccgggaggcgggaaggtgcaaatagtctacaaaccagttgacctgagcaaggtgacctccaagtgtggctcattaggcaacatccatcataaaccaggaggtggccaggtggaagtaaaatctgagaagcttgacttcaaggacagagtccagtcgaagattgggtccctggacaatatcacccacgtccctggcggaggaaataaaaagattgaaacccacaagctgaccttccgcgagaacgccaaagccaagacagaccacggggcggagatcgtgtacaagtcgccagtggtgtctggggacacgtctccacggcatctcagcaatgtctcctccaccggcagcatcgacatggtagactcgccccagctcgccacgctagctgacgaggtgtctgcctccctggccaagcagggtttgtgatcaggcccctggggcggtcaataattgtggagaggagagaatgagagagtgtggaaaaaaaaagaataatgacccggcccccgccctctgcccccagctgctcctcgcagttcggttaattggttaatcacttaacctgcttttgtcactcggctttggctcgggacttcaaaatcagtgatgggagtaagagcaaatttcatctttccaaattgatgggtgggctagtaataaaatatttaaaaaaaaacattcaaaaacatggccacatccaacatttcctcaggcaattccttttgattcttttttcttccccctccatgtagaagagggagaaggagaggctctgaaagctgcttctgggggatttcaagggactgggggtgccaaccacctctggccctgttgtgggggtgtcacagaggcagtggcagcaacaaaggatttgaaacttggtgtgttcgtggagccacaggcagacgatgtcaaccttgtgtgagtgtgacgggggttggggtggggcgggaggccacgggggaggccgaggcaggggctgggcagaggggagaggaagcacaagaagtgggagtgggagaggaagccacgtgctggagagtagacatccccctccttgccgctgggagagccaaggcctatgccacctgcagcgtctgagcggccgcctgtccttggtggccgggggtgggggcctgctgtgggtcagtgtgccaccctctgcagggcagcctgtgggagaagggacagcgggtaaaaagagaaggcaagctggcaggagggtggcacttcgtggatgacctccttagaaaagactgaccttgatgtcttgagagcgctggcctcttcctccctccctgcagggtagggggcctgagttgaggggcttccctctgctccacagaaaccctgttttattgagttctgaaggttggaactgctgccatgattttggccactttgcagacctgggactttagggctaaccagttctctttgtaaggacttgtgcctcttgggagacgtccacccgtttccaagcctgggccactggcatctctggagtgtgtgggggtctgggaggcaggtcccgagccccctgtccttcccacggccactgcagtcaccccgtctgcgccgctgtgctgttgtctgccgtgagagcccaatcactgcctatacccctcatcacacgtcacaatgtcccgaattcccagcctcaccaccccttctcagtaatgaccctggttggttgcaggaggtacctactccatactgagggtgaaattaagggaaggcaaagtccaggcacaagagtgggaccccagcctctcactctcagttccactcatccaactgggaccctcaccacgaatctcatgatctgattcggttccctgtctcctcctcccgtcacagatgtgagccagggcactgctcagctgtgaccctaggtgtttctgccttgttgacatggagagagccctttcccctgagaaggcctggccccttcctgtgctgagcccacagcagcaggctgggtgtcttggttgtcagtggtggcaccaggatggaagggcaaggcacccagggcaggcccacagtcccgctgtcccccacttgcaccctagcttgtagctgccaacctcccagacagcccagcccgctgctcagctccacatgcatagtatcagccctccacacccgacaaaggggaacacacccccttggaaatggttcttttcccccagtcccagctggaagccatgctgtctgttctgctggagcagctgaacatatacatagatgttgccctgccctccccatctgcaccctgttgagttgtagttggatttgtctgtttatgcttggattcaccagagtgactatgatagtgaaaagaaaaaaaaaaaaaaaaaaggacgcatgtatcttgaaatgcttgtaaagaggtttctaacccaccctcacgaggtgtctctcacccccacactgggactcgtgtggcctgtgtggtgccaccctgctggggcctcccaagttttgaaaggctttcctcagcacctgggacccaacagagaccagcttctagcagctaaggaggccgttcagctgtgacgaaggcctgaagcacaggattaggactgaagcgatgatgtccccttccctacttccccttggggctccctgtgtcagggcacagactaggtcttgtggctggtctggcttgcggcgcgaggatggttctctctggtcatagcccgaagtctcatggcagtcccaaaggaggcttacaactcctgcatcacaagaaaaaggaagccactgccagctggggggatctgcagctcccagaagctccgtgagcctcagccacccctcagactgggttcctctccaagctcgccctctggaggggcagcgcagcctcccaccaagggccctgcgaccacagcagggattgggatgaattgcctgtcctggatctgctctagaggcccaagctgcctgcctgaggaaggatgacttgacaagtcaggagacactgttcccaaagccttgaccagagcacctcagcccgctgaccttgcacaaactccatctgctgccatgagaaaagggaagccgcctttgcaaaacattgctgcctaaagaaactcagcagcctcaggcccaattctgccacttctggtttgggtacagttaaaggcaaccctgagggacttggcagtagaaatccagggcctcccctggggctggcagcttcgtgtgcagctagagctttacctgaaaggaagtctctgggcccagaactctccaccaagagcctccctgccgttcgctgagtcccagcaattctcctaagttgaagggatctgagaaggagaaggaaatgtggggtagatttggtggtggttagagatatgcccccctcattactgccaacagtttcggctgcatttcttcacgcacctcggttcctcttcctgaagttcttgtgccctgctcttcagcaccatgggccttcttatacggaaggctctgggatctcccccttgtggggcaggctcttggggccagcctaagatcatggtttagggtgatcagtgctggcagataaattgaaaaggcacgctggcttgtgatcttaaatgaggacaatccccccagggctgggcactcctcccctcccctcacttctcccacctgcagagccagtgtccttgggtgggctagataggatatactgtatgccggctccttcaagctgctgactcactttatcaatagttccatttaaattgacttcagtggtgagactgtatcctgtttgctattgcttgttgtgctatggggggaggggggaggaatgtgtaagatagttaacatgggcaaagggagatcttggggtgcagcacttaaactgcctcgtaacccttttcatgatttcaaccacatttgctagagggagggagcagccacggagttagaggcccttggggtttctcttttccactgacaggctttcccaggcagctggctagttcattccctccccagccaggtgcaggcgtaggaatatggacatctggttgctttggcctgctgccctctttcaggggtcctaagcccacaatcatgcctccctaagaccttggcatccttccctctaagccgttggcacctctgtgccacctctcacactggctccagacacacagcctgtgcttttggagctgagatcactcgcttcaccctcctcatctttgttctccaagtaaagccacgaggtcggggcgagggcagaggtgatcacctgcgtgtcccatctacagacctgcagcttcataaaacttctgatttctcttcagctttgaaaagggttaccctgggcactggcctagagcctcacctcctaatagacttagccccatgagtttgccatgttgagcaggactatttctggcacttgcaagtcccatgatttcttcggtaattctgagggtggggggagggacatgaaatcatcttagcttagctttctgtctgtgaatgtctatatagtgtattgtgtgttttaacaaatgatttacactgactgttgctgtaaaagtgaatttggaaataaagttattactctgattaaa

SEQ ID NO: 153990 - DNA, 2277 bp, Homo sapiens
  Payload ID: 10267
  Gene Symbol: MAPT
  Gene Name: microtubule-associated protein tau
  Uniprot ID: P10636
  ENST ID: ENST00000571987
  CDS Start-End: 1-2277
atggctgagccccgccaggagttcgaagtgatggaagatcacgctgggacgtacgggttgggggacaggaaagatcaggggggctacaccatgcaccaagaccaagagggtgacacggacgctggcctgaaagaatctcccctgcagacccccactgaggacggatctgaggaaccgggctctgaaacctctgatgctaagagcactccaacagcggaagatgtgacagcacccttagtggatgagggagctcccggcaagcaggctgccgcgcagccccacacggagatcccagaaggaaccacagctgaagaagcaggcattggagacacccccagcctggaagacgaagctgctggtcacgtgacccaagagcctgaaagtggtaaggtggtccaggaaggcttcctccgagagccaggccccccaggtctgagccaccagctcatgtccggcatgcctggggctcccctcctgcctgagggccccagagaggccacacgccaaccttcggggacaggacctgaggacacagagggcggccgccacgcccctgagctgctcaagcaccagcttctaggagacctgcaccaggaggggccgccgctgaagggggcagggggcaaagagaggccggggagcaaggaggaggtggatgaagaccgcgacgtcgatgagtcctccccccaagactcccctccctccaaggcctccccagcccaagatgggcggcctccccagacagccgccagagaagccaccagcatcccaggcttcccagcggagggtgccatccccctccctgtggatttcctctccaaagtttccacagagatcccagcctcagagcccgacgggcccagtgtagggcgggccaaagggcaggatgcccccctggagttcacgtttcacgtggaaatcacacccaacgtgcagaaggagcaggcgcactcggaggagcatttgggaagggctgcatttccaggggcccctggagaggggccagaggcccggggcccctctttgggagaggacacaaaagaggctgaccttccagagccctctgaaaagcagcctgctgctgctccgcgggggaagcccgtcagccgggtccctcaactcaaagctcgcatggtcagtaaaagcaaagacgggactggaagcgatgacaaaaaagccaagacatccacacgttcctctgctaaaaccttgaaaaataggccttgccttagccccaaacaccccactcctggtagctcagaccctctgatccaaccctccagccctgctgtgtgcccagagccaccttcctctcctaaatacgtctcttctgtcacttcccgaactggcagttctggagcaaaggagatgaaactcaagggggctgatggtaaaacgaagatcgccacaccgcggggagcagcccctccaggccagaagggccaggccaacgccaccaggattccagcaaaaaccccgcccgctccaaagacaccacccagctctggtgaacctccaaaatcaggggatcgcagcggctacagcagccccggctccccaggcactcccggcagccgctcccgcaccccgtcccttccaaccccacccacccgggagcccaagaaggtggcagtggtccgtactccacccaagtcgccgtcttccgccaagagccgcctgcagacagcccccgtgcccatgccagacctgaagaatgtcaagtccaagatcggctccactgagaacctgaagcaccagccgggaggcgggaaggtgcagataattaataagaagctggatcttagcaacgtccagtccaagtgtggctcaaaggataatatcaaacacgtcccgggaggcggcagtgtgcaaatagtctacaaaccagttgacctgagcaaggtgacctccaagtgtggctcattaggcaacatccatcataaaccaggaggtggccaggtggaagtaaaatctgagaagcttgacttcaaggacagagtccagtcgaagattgggtccctggacaatatcacccacgtccctggcggaggaaataaaaagattgaaacccacaagctgaccttccgcgagaacgccaaagccaagacagaccacggggcggagatcgtgtacaagtcgccagtggtgtctggggacacgtctccacggcatctcagcaatgtctcctccaccggcagcatcgacatggtagactcgccccagctcgccacgctagctgacgaggtgtctgcctccctggccaagcagggtttgtga

SEQ ID NO: 153991 - DNA, 544 bp, Homo sapiens
  Payload ID: 10267
  Gene Symbol: MAPT
  Gene Name: microtubule-associated protein tau
  ENST ID: ENST00000571311
  CDS Start-End: 139-318
acccaccagctccggcaccaacagcagcgccgctgccaccgcccaccttctgccgccgccaccacagccaccttctcctcctccgctgtcctctcccgtcctcgcctctgtcgactatcaggtgaactttgaaccaggatggctgagccccgccaggagttcgaagtgatggaagatcacgctgggacgtacgggttgggggacaggaaagatcaggggggctacaccatgcaccaagaccaagagggtgacacggacgctggcctgaaagaggggagtgaattcactgagctgagagctgaggaaccattgatctgatggctgagacaccactgggaagactggagaggcttttctgggcatgcagtgccaggcacaggaggagctgagggaagatgactaagagaatctcccctgcagacccccactgaggacggatctgaggaaccgggctctgaaacctctgatgctaagagcactccaacagcggaagctgaagaagcaggcattggagacacccccagcctggaagacgaagctgctg

SEQ ID NO: 153992 - DNA, 1326 bp, Homo sapiens
  Payload ID: 10267
  Gene Symbol: MAPT
  Gene Name: microtubule-associated protein tau
  Uniprot ID: P10636
  ENST ID: ENST00000574436
  CDS Start-End: 1-1326
atggctgagccccgccaggagttcgaagtgatggaagatcacgctgggacgtacgggttgggggacaggaaagatcaggggggctacaccatgcaccaagaccaagagggtgacacggacgctggcctgaaagaatctcccctgcagacccccactgaggacggatctgaggaaccgggctctgaaacctctgatgctaagagcactccaacagcggaagatgtgacagcacccttagtggatgagggagctcccggcaagcaggctgccgcgcagccccacacggagatcccagaaggaaccacagctgaagaagcaggcattggagacacccccagcctggaagacgaagctgctggtcacgtgacccaagctcgcatggtcagtaaaagcaaagacgggactggaagcgatgacaaaaaagccaagggggctgatggtaaaacgaagatcgccacaccgcggggagcagcccctccaggccagaagggccaggccaacgccaccaggattccagcaaaaaccccgcccgctccaaagacaccacccagctctggtgaacctccaaaatcaggggatcgcagcggctacagcagccccggctccccaggcactcccggcagccgctcccgcaccccgtcccttccaaccccacccacccgggagcccaagaaggtggcagtggtccgtactccacccaagtcgccgtcttccgccaagagccgcctgcagacagcccccgtgcccatgccagacctgaagaatgtcaagtccaagatcggctccactgagaacctgaagcaccagccgggaggcgggaaggtgcagataattaataagaagctggatcttagcaacgtccagtccaagtgtggctcaaaggataatatcaaacacgtcccgggaggcggcagtgtgcaaatagtctacaaaccagttgacctgagcaaggtgacctccaagtgtggctcattaggcaacatccatcataaaccaggaggtggccaggtggaagtaaaatctgagaagcttgacttcaaggacagagtccagtcgaagattgggtccctggacaatatcacccacgtccctggcggaggaaataaaaagattgaaacccacaagctgaccttccgcgagaacgccaaagccaagacagaccacggggcggagatcgtgtacaagtcgccagtggtgtctggggacacgtctccacggcatctcagcaatgtctcctccaccggcagcatcgacatggtagactcgccccagctcgccacgctagctgacgaggtgtctgcctccctggccaagcagggtttgtga

SEQ ID NO: 153993 - DNA, 1326 bp, Homo sapiens
  Payload ID: 10267
  Gene Symbol: MAPT
  Gene Name: microtubule-associated protein tau
  Uniprot ID: P10636
  ENST ID: ENST00000621329
  CDS Start-End: 1-1326
atggctgagccccgccaggagttcgaagtgatggaagatcacgctgggacgtacgggttgggggacaggaaagatcaggggggctacaccatgcaccaagaccaagagggtgacacggacgctggcctgaaagaatctcccctgcagacccccactgaggacggatctgaggaaccgggctctgaaacctctgatgctaagagcactccaacagcggaagatgtgacagcacccttagtggatgagggagctcccggcaagcaggctgccgcgcagccccacacggagatcccagaaggaaccacagctgaagaagcaggcattggagacacccccagcctggaagacgaagctgctggtcacgtgacccaagctcgcatggtcagtaaaagcaaagacgggactggaagcgatgacaaaaaagccaagggggctgatggtaaaacgaagatcgccacaccgcggggagcagcccctccaggccagaagggccaggccaacgccaccaggattccagcaaaaaccccacccgctccaaagacaccacccagctctggtgaacctccaaaatcaggggatcgcagcggctacagcagccccggctccccaggcactcccggcagccgctcccgcaccccgtcccttccaaccccacccacccgggagcccaagaaggtggcggtggtccgtactccacccaagtcgccgtcttccgccaagagccgcctgcagacagcccccgtgcccatgccagacctgaagaacgtcaagtccaagatcggctccactgagaacctgaagcaccagccgggaggcgggaaggtgcagataattaataagaagctggatcttagcaacgtccagtccaagtgtggctcaaaggataatatcaaacacgtcccgggaggcggcagtgtgcaaatagtctacaaaccagttgacctgagcaaggtgacctccaagtgtggctcattaggcaacatccatcataaaccaggaggtggccaggtggaagtaaaatctgagaagcttgacttcaaggacagagtccagtcgaagattgggtccctggacaatatcacccacgtccctggcggaggaaataaaaagattgaaacccacaagctgaccttccgcgagaacgccaaagccaagacagaccacggggcggagatcgtgtacaagtcgccagtggtgtctggggacacgtctccacggcatctcagcaatgtctcctccaccggcagcatcgacatggtagactcgccccagctcgccacgctagctgacgaggtgtctgcctccctggccaagcagggtttgtga

SEQ ID NO: 153994 - DNA, 5724 bp, Homo sapiens; identical to SEQ ID NO: 153983
  Payload ID: 10267
  Gene Symbol: MAPT
  Gene Name: microtubule-associated protein tau
  Uniprot ID: P10636
  ENST ID: ENST00000612872
  CDS Start-End: 323-1561

SEQ ID NO: 153995 - DNA, 2351 bp, Homo sapiens
  Payload ID: 10267
  Gene Symbol: MAPT
  Gene Name: microtubule-associated protein tau
  Uniprot ID: P10636
  ENST ID: ENST00000622728
  CDS Start-End: 21-1172
caggtgagctttgaaccaggatggctgagccccgccaggagttcgaagtgatggaagatcacgctgggacgtacgggttgggggacaggaaagatcaggggggctacaccatgcaccaagaccaagagggtgacacggacgctggcctgaaagctgaagaagcaggcattggagacacccccagcctggaagacgaagctgctggtcacgtgacccaagctcgcatggtcagtaaaagcaaagacgggactggaagcgatgacaaaaaagccaagggggctgatggtaaaacgaagatcgccacaccgcggggagcagcccctccaggccagaagggccaggccaacgccaccaggattccagcaaaaaccccacccgctccaaagacaccacccagctctggtgaacctccaaaatcaggggatcgcagcggctacagcagccccggctccccaggcactcccggcagccgctcccgcaccccgtcccttccaaccccacccacccgggagcccaagaaggtggcggtggtccgtactccacccaagtcgccgtcttccgccaagagccgcctgcagacagcccccgtgcccatgccagacctgaagaacgtcaagtccaagatcggctccactgagaacctgaagcaccagccgggaggcgggaaggtgcagataattaataagaagctggatcttagcaacgtccagtccaagtgtggctcaaaggataatatcaaacacgtcccgggaggcggcagtgtgcaaatagtctacaaaccagttgacctgagcaaggtgacctccaagtgtggctcattaggcaacatccatcataaaccaggaggtggccaggtggaagtaaaatctgagaagcttgacttcaaggacagagtccagtcgaagattgggtccctggacaatatcacccacgtccctggcggaggaaataaaaagattgaaacccacaagctgaccttccgcgagaacgccaaagccaagacagaccacggggcggagatcgtgtacaagtcgccagtggtgtctggggacacgtctccacggcatctcagcaatgtctcctccaccggcagcatcgacatggtagactcgccccagctcgccacgctagctgacgaggtgtctgcctccctggccaagcagggtttgtgatcaggcccctggggcggtcaataatcgtggagaggagagaatgagagagtgtggaaaaaaaaagaataatgacccggcccccgccctctgcccccagctgctcctcgcagttcggttaattggttaatcacttaacctgcttttgtcactcggctttggctcgggacttcaaaatcagtgatgggagtaagagcaaatttcatctttccaaattgatgggtgggctagtaataaaatattttaaaaaaaaacattcaaaaacatggccacatccaacatttcctcaggcaattccttttgattcttttttcttcccccctccatgtagaagagggggaaggagaggctctgaaagctgcttctgggggatttcaagggactgggggtgccaaccacctctggccctgttgtgggggtgtcacagaggcagtggcagcaacaaaggatttgaaacttggtgtgttcgtggagccacaggcagacgatgtcaaccttgtgtgagtgtgacgggggttggggtggggcgggaggccacgggggaggccgaggcaggggctgggcagaggggagaggaagcacaagaagtgggagtgggagaggaagccacgtgctggagagtagacatccccctccttgccgctgggagagccaaggcctatgccacctgcagcgtctgagcggccgcctgtccttggtggccgggggtgggggcctgctgtgggtcagtgtgccaccctctgcagggcagcctgtgggagaagggacagcgggtaaaaagagaaggcaagctggcaggagggtggcacttcgtggatgacctccttagaaaagactgaccttgatgtcttgagagcgctggcctcttcctccctccctgcagggtagggggcctgagttgaggggcttccctctctgctccacagaaaccctgttttattgagttctgaaggttggaactgctgccatgattttggccactttgcagacctgggactttagggctaaccagttctctttgtaaggacttgtgcctcttgggagacgtccacccgtttccaagcctgggccaccggcatctctggagtgtgtgggggtctgggaggcgggtcccgagccccctgtccttcccacggccactgcagtcacccctgtctgccccgctgtgctgttgtctgccgt

SEQ ID NO: 153996 - DNA, 6816 bp, Homo sapiens
  Payload ID: 10267
  Gene Symbol: MAPT
  Gene Name: microtubule-associated protein tau
  ENST ID: ENST00000618029
  CDS Start-End: 323-2653
ggacggccgagcggcagggcgctcgcgcgcgcccactagtggccggaggagaaggctcccgcggaggccgcgctgcccgccccctcccctggggaggctcgcgttcccgctgctcgcgcctgcgccgcccgccggcctcaggaacgcgccctcttcgccggcgcgcgccctcgcagtcaccgccacccaccagctccggcaccaacagcagcgccgctgccaccgcccaccttctgccgccgccaccacagccaccttctcctcctccgctgtcctctcccgtcctcgcctctgtcgactatcaggtgaactttgaaccaggatggctgagccccgccaggagttcgaagtgatggaagatcacgctgggacgtacgggttgggggacaggaaagatcaggggggctacaccatgcaccaagaccaagagggtgacacggacgctggcctgaaagaatctcccctgcagacccccactgaggacggatctgaggaaccgggctctgaaacctctgatgctaagagcactccaacagcggaagatgtgacagcacccttagtggatgagggagctcccggcaagcaggctgccgcgcagccccacacggagatcccagaaggaaccacagctgaagaagcaggcattggagacacccccagcctggaagacgaagctgctggtcacgtgacccaagagcctgaaagtggtaaggtggtccaggaaggcttcctccgagagccaggccccccaggtctgagccaccagctcatgtccggcatgcctggggctcccctcctgcctgagggccccagagaggccacacgccaaccttcggggacaggacctgaggacacagagggcggccgccacgcccctgagctgctcaagcaccagcttctaggagacctgcaccaggaggggccgccgctgaagggggcagggggcaaagagaggccggggagcaaggaggaggtggatgaagaccgcgacgtcgatgagtcctccccccaagactcccctccctccaaggcctccccagcccaagatgggcggcctccccagacagccgccagagaagccaccagcatcccaggcttcccagcggagggtgccatccccctccctgtggatttcctctccaaagtttccacagagatcccagcctcagagcccgatgggcccagtgtagggcgggccaaagggcaggatgcccccctggagttcacgtttcacgtggaaatcacacccaacgtgcagaaggagcaggcgcactcggaggagcatttgggaagggctgcatttccaggggcccctggagaggggccagaggcccggggcccctctttgggagaggacacaaaagaggctgaccttccagagccctctgaaaagcagcctgctgctgctccgcgggggaagcccgtcagccgggtccctcaactcaaagctcgcatggtcagtaaaagcaaagacgggactggaagcgatgacaaaaaagccaagacatccacacgttcctctgctaaaaccttgaaaaataggccttgccttagccccaaacaccccactcctggtagctcagaccctctgatccaaccctccagccctgctgtgtgcccagagccaccttcctctcctaaacacgtctcttctgtcacttcccgaactggcagttctggagcaaaggagatgaaactcaagggggctgatggtaaaacgaagatcgccacaccgcggggagcagcccctccaggccagaagggccaggccaacgccaccaggattccagcaaaaaccccgcccgctccaaagacaccacccagctctgcgactaagcaagtccagagaagaccaccccctgcagggcccagatctgagagaggtgaacctccaaaatcaggggatcgcagcggctacagcagccccggctccccaggcactcccggcagccgctcccgcaccccgtcccttccaaccccacccacccgggagcccaagaaggtggcagtggtccgtactccacccaagtcgccgtcttccgccaagagccgcctgcagacagcccccgtgcccatgccagacctgaagaatgtcaagtccaagatcggctccactgagaacctgaagcaccagccgggaggcgggaaggtgcagataattaataagaagctggatcttagcaacgtccagtccaagtgtggctcaaaggataatatcaaacacgtcccgggaggcggcagtgtgcaaatagtctacaaaccagttgacctgagcaaggtgacctccaagtgtggctcattaggcaacatccatcataaaccaggaggtggccaggtggaagtaaaatctgagaagcttgacttcaaggacagagtccagtcgaagattgggtccctggacaatatcacccacgtccctggcggaggaaataaaaagattgaaacccacaagctgaccttccgcgagaacgccaaagccaagacagaccacggggcggagatcgtgtacaagtcgccagtggtgtctggggacacgtctccacggcatctcagcaatgtctcctccaccggcagcatcgacatggtagactcgccccagctcgccacgctagctgacgaggtgtctgcctccctggccaagcagggtttgtgatcaggcccctggggcggtcaataattgtggagaggagagaatgagagagtgtggaaaaaaaaagaataatgacccggcccccgccctctgcccccagctgctcctcgcagttcggttaattggttaatcacttaacctgcttttgtcactcggctttggctcgggacttcaaaatcagtgatgggagtaagagcaaatttcatctttccaaattgatgggtgggctagtaataaaatatttaaaaaaaaacattcaaaaacatggccacatccaacatttcctcaggcaattccttttgattcttttttcttccccctccatgtagaagagggagaaggagaggctctgaaagctgcttctgggggatttcaagggactgggggtgccaaccacctctggccctgttgtgggggtgtcacagaggcagtggcagcaacaaaggatttgaaacttggtgtgttcgtggagccacaggcagacgatgtcaaccttgtgtgagtgtgacgggggttggggtggggcgggaggccacgggggaggccgaggcaggggctgggcagaggggagaggaagcacaagaagtgggagtgggagaggaagccacgtgctggagagtagacatccccctccttgccgctgggagagccaaggcctatgccacctgcagcgtctgagcggccgcctgtccttggtggccgggggtgggggcctgctgtgggtcagtgtgccaccctctgcagggcagcctgtgggagaagggacagcgggtaaaaagagaaggcaagctggcaggagggtggcacttcgtggatgacctccttagaaaagactgaccttgatgtcttgagagcgctggcctcttcctccctccctgcagggtagggggcctgagttgaggggcttccctctgctccacagaaaccctgttttattgagttctgaaggttggaactgctgccatgattttggccactttgcagacctgggactttagggctaaccagttctctttgtaaggacttgtgcctcttgggagacgtccacccgtttccaagcctgggccactggcatctctggagtgtgtgggggtctgggaggcaggtcccgagccccctgtccttcccacggccactgcagtcaccccgtctgcgccgctgtgctgttgtctgccgtgagagcccaatcactgcctatacccctcatcacacgtcacaatgtcccgaattcccagcctcaccaccccttctcagtaatgaccctggttggttgcaggaggtacctactccatactgagggtgaaattaagggaaggcaaagtccaggcacaagagtgggaccccagcctctcactctcagttccactcatccaactgggaccctcaccacgaatctcatgatctgattcggttccctgtctcctcctcccgtcacagatgtgagccagggcactgctcagctgtgaccctaggtgtttctgccttgttgacatggagagagccctttcccctgagaaggcctggccccttcctgtgctgagcccacagcagcaggctgggtgtcttggttgtcagtggtggcaccaggatggaagggcaaggcacccagggcaggcccacagtcccgctgtcccccacttgcaccctagcttgtagctgccaacctcccagacagcccagcccgctgctcagctccacatgcatagtatcagccctccacacccgacaaaggggaacacacccccttggaaatggttcttttcccccagtcccagctggaagccatgctgtctgttctgctggagcagctgaacatatacatagatgttgccctgccctccccatctgcaccctgttgagttgtagttggatttgtctgtttatgcttggattcaccagagtgactatgatagtgaaaagaaaaaaaaaaaaaaaaaaggacgcatgtatcttgaaatgcttgtaaagaggtttctaacccaccctcacgaggtgtctctcacccccacactgggactcgtgtggcctgtgtggtgccaccctgctggggcctcccaagttttgaaaggctttcctcagcacctgggacccaacagagaccagcttctagcagctaaggaggccgttcagctgtgacgaaggcctgaagcacaggattaggactgaagcgatgatgtccccttccctacttccccttggggctccctgtgtcagggcacagactaggtcttgtggctggtctggcttgcggcgcgaggatggttctctctggtcatagcccgaagtctcatggcagtcccaaaggaggcttacaactcctgcatcacaagaaaaaggaagccactgccagctggggggatctgcagctcccagaagctccgtgagcctcagccacccctcagactgggttcctctccaagctcgccctctggaggggcagcgcagcctcccaccaagggccctgcgaccacagcagggattgggatgaattgcctgtcctggatctgctctagaggcccaagctgcctgcctgaggaaggatgacttgacaagtcaggagacactgttcccaaagccttgaccagagcacctcagcccgctgaccttgcacaaactccatctgctgccatgagaaaagggaagccgcctttgcaaaacattgctgcctaaagaaactcagcagcctcaggcccaattctgccacttctggtttgggtacagttaaaggcaaccctgagggacttggcagtagaaatccagggcctcccctggggctggcagcttcgtgtgcagctagagctttacctgaaaggaagtctctgggcccagaactctccaccaagagcctccctgccgttcgctgagtcccagcaattctcctaagttgaagggatctgagaaggagaaggaaatgtggggtagatttggtggtggttagagatatgcccccctcattactgccaacagtttcggctgcatttcttcacgcacctcggttcctcttcctgaagttcttgtgccctgctcttcagcaccatgggccttcttatacggaaggctctgggatctcccccttgtggggcaggctcttggggccagcctaagatcatggtttagggtgatcagtgctggcagataaattgaaaaggcacgctggcttgtgatcttaaatgaggacaatccccccagggctgggcactcctcccctcccctcacttctcccacctgcagagccagtgtccttgggtgggctagataggatatactgtatgccggctccttcaagctgctgactcactttatcaatagttccatttaaattgacttcagtggtgagactgtatcctgtttgctattgcttgttgtgctatggggggaggggggaggaatgtgtaagatagttaacatgggcaaagggagatcttggggtgcagcacttaaactgcctcgtaacccttttcatgatttcaaccacatttgctagagggagggagcagccacggagttagaggcccttggggtttctcttttccactgacaggctttcccaggcagctggctagttcattccctccccagccaggtgcaggcgtaggaatatggacatctggttgctttggcctgctgccctctttcaggggtcctaagcccacaatcatgcctccctaagaccttggcatccttccctctaagccgttggcacctctgtgccacctctcacactggctccagacacacagcctgtgcttttggagctgagatcactcgcttcaccctcctcatctttgttctccaagtaaagccacgaggtcggggcgagggcagaggtgatcacctgcgtgtcccatctacagacctgcagcttcataaaacttctgatttctcttcagctttgaaaagggttaccctgggcactggcctagagcctcacctcctaatagacttagccccatgagtttgccatgttgagcaggactatttctggcacttgcaagtcccatgatttcttcggtaattctgagggtggggggagggacatgaaatcatcttagcttagctttctgtctgtgaatgtctatatagtgtattgtgtgttttaacaaatgatttacactgactgttgctgtaaaagtgaatttggaaataaagttattactctgattaaa

SEQ ID NO: 153997 - DNA, 1233 bp, Homo sapiens
  Payload ID: 10267
  Gene Symbol: MAPT
  Gene Name: microtubule-associated protein tau
  Uniprot ID: P10636
  ENST ID: ENST00000620981
  CDS Start-End: 1-1233
atggctgagccccgccaggagttcgaagtgatggaagatcacgctgggacgtacgggttgggggacaggaaagatcaggggggctacaccatgcaccaagaccaagagggtgacacggacgctggcctgaaagaatctcccctgcagacccccactgaggacggatctgaggaaccgggctctgaaacctctgatgctaagagcactccaacagcggaagatgtgacagcacccttagtggatgagggagctcccggcaagcaggctgccgcgcagccccacacggagatcccagaaggaaccacagctgaagaagcaggcattggagacacccccagcctggaagacgaagctgctggtcacgtgacccaagctcgcatggtcagtaaaagcaaagacgggactggaagcgatgacaaaaaagccaagggggctgatggtaaaacgaagatcgccacaccgcggggagcagcccctccaggccagaagggccaggccaacgccaccaggattccagcaaaaaccccacccgctccaaagacaccacccagctctggtgaacctccaaaatcaggggatcgcagcggctacagcagccccggctccccaggcactcccggcagccgctcccgcaccccgtcccttccaaccccacccacccgggagcccaagaaggtggcggtggtccgtactccacccaagtcgccgtcttccgccaagagccgcctgcagacagcccccgtgcccatgccagacctgaagaacgtcaagtccaagatcggctccactgagaacctgaagcaccagccgggaggcgggaaggtgcaaatagtctacaaaccagttgacctgagcaaggtgacctccaagtgtggctcattaggcaacatccatcataaaccaggaggtggccaggtggaagtaaaatctgagaagcttgacttcaaggacagagtccagtcgaagattgggtccctggacaatatcacccacgtccctggcggaggaaataaaaagattgaaacccacaagctgaccttccgcgagaacgccaaagccaagacagaccacggggcggagatcgtgtacaagtcgccagtggtgtctggggacacgtctccacggcatctcagcaatgtctcctccaccggcagcatcgacatggtagactcgccccagctcgccacgctagctgacgaggtgtctgcctccctggccaagcagggtttgtga

SEQ ID NO: 153998 - DNA, 5345 bp, Homo sapiens; identical to SEQ ID NO: 153986
  Payload ID: 10267
  Gene Symbol: MAPT
  Gene Name: microtubule-associated protein tau
  Uniprot ID: P10636
  ENST ID: ENST00000622106
  CDS Start-End: 31-1182

SEQ ID NO: 153999 - DNA, 6762 bp, Homo sapiens
  Payload ID: 10267
  Gene Symbol: MAPT
  Gene Name: microtubule-associated protein tau
  ENST ID: ENST00000618825
  CDS Start-End: 323-2599
ggacggccgagcggcagggcgctcgcgcgcgcccactagtggccggaggagaaggctcccgcggaggccgcgctgcccgccccctcccctggggaggctcgcgttcccgctgctcgcgcctgcgccgcccgccggcctcaggaacgcgccctcttcgccggcgcgcgccctcgcagtcaccgccacccaccagctccggcaccaacagcagcgccgctgccaccgcccaccttctgccgccgccaccacagccaccttctcctcctccgctgtcctctcccgtcctcgcctctgtcgactatcaggtgaactttgaaccaggatggctgagccccgccaggagttcgaagtgatggaagatcacgctgggacgtacgggttgggggacaggaaagatcaggggggctacaccatgcaccaagaccaagagggtgacacggacgctggcctgaaagaatctcccctgcagacccccactgaggacggatctgaggaaccgggctctgaaacctctgatgctaagagcactccaacagcggaagatgtgacagcacccttagtggatgagggagctcccggcaagcaggctgccgcgcagccccacacggagatcccagaaggaaccacagctgaagaagcaggcattggagacacccccagcctggaagacgaagctgctggtcacgtgacccaagagcctgaaagtggtaaggtggtccaggaaggcttcctccgagagccaggccccccaggtctgagccaccagctcatgtccggcatgcctggggctcccctcctgcctgagggccccagagaggccacacgccaaccttcggggacaggacctgaggacacagagggcggccgccacgcccctgagctgctcaagcaccagcttctaggagacctgcaccaggaggggccgccgctgaagggggcagggggcaaagagaggccggggagcaaggaggaggtggatgaagaccgcgacgtcgatgagtcctccccccaagactcccctccctccaaggcctccccagcccaagatgggcggcctccccagacagccgccagagaagccaccagcatcccaggcttcccagcggagggtgccatccccctccctgtggatttcctctccaaagtttccacagagatcccagcctcagagcccgatgggcccagtgtagggcgggccaaagggcaggatgcccccctggagttcacgtttcacgtggaaatcacacccaacgtgcagaaggagcaggcgcactcggaggagcatttgggaagggctgcatttccaggggcccctggagaggggccagaggcccggggcccctctttgggagaggacacaaaagaggctgaccttccagagccctctgaaaagcagcctgctgctgctccgcgggggaagcccgtcagccgggtccctcaactcaaagctcgcatggtcagtaaaagcaaagacgggactggaagcgatgacaaaaaagccaagacatccacacgttcctctgctaaaaccttgaaaaataggccttgccttagccccaaacaccccactcctggtagctcagaccctctgatccaaccctccagccctgctgtgtgcccagagccaccttcctctcctaaacacgtctcttctgtcacttcccgaactggcagttctggagcaaaggagatgaaactcaagggggctgatggtaaaacgaagatcgccacaccgcggggagcagcccctccaggccagaagggccaggccaacgccaccaggattccagcaaaaaccccgcccgctccaaagacaccacccagctctggtgaacctccaaaatcaggggatcgcagcggctacagcagccccggctccccaggcactcccggcagccgctcccgcaccccgtcccttccaaccccacccacccgggagcccaagaaggtggcagtggtccgtactccacccaagtcgccgtcttccgccaagagccgcctgcagacagcccccgtgcccatgccagacctgaagaatgtcaagtccaagatcggctccactgagaacctgaagcaccagccgggaggcgggaaggtgcagataattaataagaagctggatcttagcaacgtccagtccaagtgtggctcaaaggataatatcaaacacgtcccgggaggcggcagtgtgcaaatagtctacaaaccagttgacctgagcaaggtgacctccaagtgtggctcattaggcaacatccatcataaaccaggaggtggccaggtggaagtaaaatctgagaagcttgacttcaaggacagagtccagtcgaagattgggtccctggacaatatcacccacgtccctggcggaggaaataaaaagattgaaacccacaagctgaccttccgcgagaacgccaaagccaagacagaccacggggcggagatcgtgtacaagtcgccagtggtgtctggggacacgtctccacggcatctcagcaatgtctcctccaccggcagcatcgacatggtagactcgccccagctcgccacgctagctgacgaggtgtctgcctccctggccaagcagggtttgtgatcaggcccctggggcggtcaataattgtggagaggagagaatgagagagtgtggaaaaaaaaagaataatgacccggcccccgccctctgcccccagctgctcctcgcagttcggttaattggttaatcacttaacctgcttttgtcactcggctttggctcgggacttcaaaatcagtgatgggagtaagagcaaatttcatctttccaaattgatgggtgggctagtaataaaatatttaaaaaaaaacattcaaaaacatggccacatccaacatttcctcaggcaattccttttgattcttttttcttccccctccatgtagaagagggagaaggagaggctctgaaagctgcttctgggggatttcaagggactgggggtgccaaccacctctggccctgttgtgggggtgtcacagaggcagtggcagcaacaaaggatttgaaacttggtgtgttcgtggagccacaggcagacgatgtcaaccttgtgtgagtgtgacgggggttggggtggggcgggaggccacgggggaggccgaggcaggggctgggcagaggggagaggaagcacaagaagtgggagtgggagaggaagccacgtgctggagagtagacatccccctccttgccgctgggagagccaaggcctatgccacctgcagcgtctgagcggccgcctgtccttggtggccgggggtgggggcctgctgtgggtcagtgtgccaccctctgcagggcagcctgtgggagaagggacagcgggtaaaaagagaaggcaagctggcaggagggtggcacttcgtggatgacctccttagaaaagactgaccttgatgtcttgagagcgctggcctcttcctccctccctgcagggtagggggcctgagttgaggggcttccctctgctccacagaaaccctgttttattgagttctgaaggttggaactgctgccatgattttggccactttgcagacctgggactttagggctaaccagttctctttgtaaggacttgtgcctcttgggagacgtccacccgtttccaagcctgggccactggcatctctggagtgtgtgggggtctgggaggcaggtcccgagccccctgtccttcccacggccactgcagtcaccccgtctgcgccgctgtgctgttgtctgccgtgagagcccaatcactgcctatacccctcatcacacgtcacaatgtcccgaattcccagcctcaccaccccttctcagtaatgaccctggttggttgcaggaggtacctactccatactgagggtgaaattaagggaaggcaaagtccaggcacaagagtgggaccccagcctctcactctcagttccactcatccaactgggaccctcaccacgaatctcatgatctgattcggttccctgtctcctcctcccgtcacagatgtgagccagggcactgctcagctgtgaccctaggtgtttctgccttgttgacatggagagagccctttcccctgagaaggcctggccccttcctgtgctgagcccacagcagcaggctgggtgtcttggttgtcagtggtggcaccaggatggaagggcaaggcacccagggcaggcccacagtcccgctgtcccccacttgcaccctagcttgtagctgccaacctcccagacagcccagcccgctgctcagctccacatgcatagtatcagccctccacacccgacaaaggggaacacacccccttggaaatggttcttttcccccagtcccagctggaagccatgctgtctgttctgctggagcagctgaacatatacatagatgttgccctgccctccccatctgcaccctgttgagttgtagttggatttgtctgtttatgcttggattcaccagagtgactatgatagtgaaaagaaaaaaaaaaaaaaaaaaggacgcatgtatcttgaaatgcttgtaaagaggtttctaacccaccctcacgaggtgtctctcacccccacactgggactcgtgtggcctgtgtggtgccaccctgctggggcctcccaagttttgaaaggctttcctcagcacctgggacccaacagagaccagcttctagcagctaaggaggccgttcagctgtgacgaaggcctgaagcacaggattaggactgaagcgatgatgtccccttccctacttccccttggggctccctgtgtcagggcacagactaggtcttgtggctggtctggcttgcggcgcgaggatggttctctctggtcatagcccgaagtctcatggcagtcccaaaggaggcttacaactcctgcatcacaagaaaaaggaagccactgccagctggggggatctgcagctcccagaagctccgtgagcctcagccacccctcagactgggttcctctccaagctcgccctctggaggggcagcgcagcctcccaccaagggccctgcgaccacagcagggattgggatgaattgcctgtcctggatctgctctagaggcccaagctgcctgcctgaggaaggatgacttgacaagtcaggagacactgttcccaaagccttgaccagagcacctcagcccgctgaccttgcacaaactccatctgctgccatgagaaaagggaagccgcctttgcaaaacattgctgcctaaagaaactcagcagcctcaggcccaattctgccacttctggtttgggtacagttaaaggcaaccctgagggacttggcagtagaaatccagggcctcccctggggctggcagcttcgtgtgcagctagagctttacctgaaaggaagtctctgggcccagaactctccaccaagagcctccctgccgttcgctgagtcccagcaattctcctaagttgaagggatctgagaaggagaaggaaatgtggggtagatttggtggtggttagagatatgcccccctcattactgccaacagtttcggctgcatttcttcacgcacctcggttcctcttcctgaagttcttgtgccctgctcttcagcaccatgggccttcttatacggaaggctctgggatctcccccttgtggggcaggctcttggggccagcctaagatcatggtttagggtgatcagtgctggcagataaattgaaaaggcacgctggcttgtgatcttaaatgaggacaatccccccagggctgggcactcctcccctcccctcacttctcccacctgcagagccagtgtccttgggtgggctagataggatatactgtatgccggctccttcaagctgctgactcactttatcaatagttccatttaaattgacttcagtggtgagactgtatcctgtttgctattgcttgttgtgctatggggggaggggggaggaatgtgtaagatagttaacatgggcaaagggagatcttggggtgcagcacttaaactgcctcgtaacccttttcatgatttcaaccacatttgctagagggagggagcagccacggagttagaggcccttggggtttctcttttccactgacaggctttcccaggcagctggctagttcattccctccccagccaggtgcaggcgtaggaatatggacatctggttgctttggcctgctgccctctttcaggggtcctaagcccacaatcatgcctccctaagaccttggcatccttccctctaagccgttggcacctctgtgccacctctcacactggctccagacacacagcctgtgcttttggagctgagatcactcgcttcaccctcctcatctttgttctccaagtaaagccacgaggtcggggcgagggcagaggtgatcacctgcgtgtcccatctacagacctgcagcttcataaaacttctgatttctcttcagctttgaaaagggttaccctgggcactggcctagagcctcacctcctaatagacttagccccatgagtttgccatgttgagcaggactatttctggcacttgcaagtcccatgatttcttcggtaattctgagggtggggggagggacatgaaatcatcttagcttagctttctgtctgtgaatgtctatatagtgtattgtgtgttttaacaaatgatttacactgactgttgctgtaaaagtgaatttggaaataaagttattactctgattaaa

SEQ ID NO: 154000 - DNA, 1239 bp, Homo sapiens
  Payload ID: 10267
  Gene Symbol: MAPT
  Gene Name: microtubule-associated protein tau
  Uniprot ID: P10636
  ENST ID: ENST00000613360
  CDS Start-End: 1-1239
atggctgagccccgccaggagttcgaagtgatggaagatcacgctgggacgtacgggttgggggacaggaaagatcaggggggctacaccatgcaccaagaccaagagggtgacacggacgctggcctgaaagaatctcccctgcagacccccactgaggacggatctgaggaaccgggctctgaaacctctgatgctaagagcactccaacagcggaagctgaagaagcaggcattggagacacccccagcctggaagacgaagctgctggtcacgtgacccaagctcgcatggtcagtaaaagcaaagacgggactggaagcgatgacaaaaaagccaagggggctgatggtaaaacgaagatcgccacaccgcggggagcagcccctccaggccagaagggccaggccaacgccaccaggattccagcaaaaaccccacccgctccaaagacaccacccagctctggtgaacctccaaaatcaggggatcgcagcggctacagcagccccggctccccaggcactcccggcagccgctcccgcaccccgtcccttccaaccccacccacccgggagcccaagaaggtggcggtggtccgtactccacccaagtcgccgtcttccgccaagagccgcctgcagacagcccccgtgcccatgccagacctgaagaacgtcaagtccaagatcggctccactgagaacctgaagcaccagccgggaggcgggaaggtgcagataattaataagaagctggatcttagcaacgtccagtccaagtgtggctcaaaggataatatcaaacacgtcccgggaggcggcagtgtgcaaatagtctacaaaccagttgacctgagcaaggtgacctccaagtgtggctcattaggcaacatccatcataaaccaggaggtggccaggtggaagtaaaatctgagaagcttgacttcaaggacagagtccagtcgaagattgggtccctggacaatatcacccacgtccctggcggaggaaataaaaagattgaaacccacaagctgaccttccgcgagaacgccaaagccaagacagaccacggggcggagatcgtgtacaagtcgccagtggtgtctggggacacgtctccacggcatctcagcaatgtctcctccaccggcagcatcgacatggtagactcgccccagctcgccacgctagctgacgaggtgtctgcctccctggccaagcagggtttgtga

SEQ ID NO: 154001 - DNA, 5718 bp, Homo sapiens; identical to SEQ ID NO: 153989
  Payload ID: 10267
  Gene Symbol: MAPT
  Gene Name: microtubule-associated protein tau
  Uniprot ID: P10636
  ENST ID: ENST00000620818
  CDS Start-End: 323-1555

SEQ ID NO: 154002 - DNA, 5811 bp, Homo sapiens; identical to SEQ ID NO: 153981
  Payload ID: 10267
  Gene Symbol: MAPT
  Gene Name: microtubule-associated protein tau
  Uniprot ID: P10636
  ENST ID: ENST00000620070
  CDS Start-End: 323-1648

SEQ ID NO: 154003 - DNA, 543 bp, Homo sapiens
  Payload ID: 10267
  Gene Symbol: MAPT
  Gene Name: microtubule-associated protein tau
  ENST ID: ENST00000625688
  CDS Start-End: 138-317
acccaacagctccggcaccaacagcagcgccgctgccaccgcccaccttctgccgccgccaccacagccaccttctcctcctccgctgtcctctccgtcctcgcctctgtcgactatcaggtgagctttgaaccaggatggctgagccccgccaggagttcgaagtgatggaagatcacgctgggacgtacgggttgggggacaggaaagatcaggggggctacaccatgcaccaagaccaagagggtgacacggacgctggcctgaaagaggggagtgaattcactgagctgagagctgaggaaccattgatctgatggctgagacaccactgggaagactggagaggcttttctgggcatgcagtgccaggcacaggaggagctgagggaagatgactaagagaatctcccctgcagacccccactgaggacggatctgaggaaccgggctctgaaacctctgatgctaagagcactccaacagcggaagctgaagaagcaggcattggagacacccccagcctggaagacgaagctgctg

SEQ ID NO: 154004 - DNA, 2277 bp, Homo sapiens
  Payload ID: 10267
  Gene Symbol: MAPT
  Gene Name: microtubule-associated protein tau
  ENST ID: ENST00000627711
  CDS Start-End: 1-2277
atggctgagccccgccaggagttcgaagtgatggaagatcacgctgggacgtacgggttgggggacaggaaagatcaggggggctacaccatgcaccaagaccaagagggtgacacggacgctggcctgaaagaatctcccctgcagacccccactgaggacggatctgaggaaccgggctctgaaacctctgatgctaagagcactccaacagcggaagatgtgacagcacccttagtggatgagggagctcccggcaagcaggctgccgcgcagccccacacggagatcccagaaggaaccacagctgaagaagcaggcattggagacacccccagcctggaagacgaagctgctggtcacgtgacccaagagcctgaaagtggtaaggtggtccaggaaggcttcctccgagagccaggccccccaggtctgagccaccagctcatgtccggcatgcctggggctcccctcctgcctgagggccccagagaggccacacgccaaccttcggggacaggacctgaggacacagagggcggccgccacgcccctgagctgctcaagcaccagcttctaggagacctgcaccaggaggggccgctgctgaagggggcagggggcaaagagaggccggggagcaaggaggaggtggatgaagaccgcgacgtcgatgagtcctccccccaagactcccctccctccaaggcctccccagcccaagatgggcggcctccccagacagccgccagagaagccaccagcatcccaggcttcccagcggagggtgccatccccctccctgtggatttcctctccaaagtttccacagagatcccagcctcagagcccaacgggcccagtgcagggcgggccaaagggcaggatgcccccctggagttcacgtttcacgtggaaatcacacccaacgtgcagaaggagcaggcgcactcggaggagcatttgggaagggctgcatttccaggggcccctggagaggggccagaggcccggggcccctctttgggagaggacacaaaagaggctgaccttccagagccctctgaaaagcagcctgctgctgctccgcgggggaagcccgtcagctgggtccctcaactcaaagctcgcatggtcagtaaaagcaaagacgggactggaagcgatgacaaaaaagccaagacatccacacgttcctctgctaaaaccttgaaaaataggccttgccttagccccaaacaccccactcctggtagctcagaccctctgatccaaccctccagccctgctgtgtgcccagagccaccttcctctcctaaatacgtctcttctgtcactccccgaactggcagttctggagcaaaggagatgaaactcaagggggctgatggtaaaacgaagatcgccacaccgcggggagcagcccctccaggccagaagggccaggccaacgccaccaggattccagcaaaaaccccacccgctccaaagacaccacccagctctggtgaacctccaaaatcaggggatcgcagcggctacagcagccccggctccccaggcactcccggcagccgctcccgcaccccgtcccttccaaccccacccacccgggagcccaagaaggtggcggtggtccgtactccacccaagtcgccgtcttccgccaagagccgcctgcagacagcccccgtgcccatgccagacctgaagaacgtcaagtccaagatcggctccactgagaacctgaagcaccagccgggaggcgggaaggtgcagataattaataagaagctggatcttagcaacgtccagtccaagtgtggctcaaaggataatatcaaacacgtcccgggaggcggcagtgtgcaaatagtctacaaaccagttgacctgagcaaggtgacctccaagtgtggctcattaggcaacatccatcataaaccaggaggtggccaggtggaagtaaaatctgagaagcttgacttcaaggacagagtccagtcgaagattgggtccctggacaatatcacccacgtccctggcggaggaaataaaaagattgaaacccacaagctgaccttccgcgagaacgccaaagccaagacagaccacggggcggagatcgtgtacaagtcgccagtggtgtctggggacacgtctccacggcatctcagcaatgtctcctccaccggcagcatcgacatggtagactcgccccagctcgccacgctagctgacgaggtgtctgcctccctggccaagcagggtttgtga

SEQ ID NO: 154005 - DNA, 5343 bp, Homo sapiens
  Payload ID: 10267
  Gene Symbol: MAPT
  Gene Name: microtubule-associated protein tau
  Uniprot ID: P10636
  ENST ID: ENST00000626571
  CDS Start-End: 31-1182
tgtcgactatcaggtgagctttgaaccaggatggctgagccccgccaggagttcgaagtgatggaagatcacgctgggacgtacgggttgggggacaggaaagatcaggggggctacaccatgcaccaagaccaagagggtgacacggacgctggcctgaaagctgaagaagcaggcattggagacacccccagcctggaagacgaagctgctggtcacgtgacccaagctcgcatggtcagtaaaagcaaagacgggactggaagcgatgacaaaaaagccaagggggctgatggtaaaacgaagatcgccacaccgcggggagcagcccctccaggccagaagggccaggccaacgccaccaggattccagcaaaaaccccacccgctccaaagacaccacccagctctggtgaacctccaaaatcaggggatcgcagcggctacagcagccccggctccccaggcactcccggcagccgctcccgcaccccgtcccttccaaccccacccacccgggagcccaagaaggtggcggtggtccgtactccacccaagtcgccgtcttccgccaagagccgcctgcagacagcccccgtgcccatgccagacctgaagaacgtcaagtccaagatcggctccactgagaacctgaagcaccagccgggaggcgggaaggtgcagataattaataagaagctggatcttagcaacgtccagtccaagtgtggctcaaaggataatatcaaacacgtcccgggaggcggcagtgtgcaaatagtctacaaaccagttgacctgagcaaggtgacctccaagtgtggctcattaggcaacatccatcataaaccaggaggtggccaggtggaagtaaaatctgagaagcttgacttcaaggacagagtccagtcgaagattgggtccctggacaatatcacccacgtccctggcggaggaaataaaaagattgaaacccacaagctgaccttccgcgagaacgccaaagccaagacagaccacggggcggagatcgtgtacaagtcgccagtggtgtctggggacacgtctccacggcatctcagcaatgtctcctccaccggcagcatcgacatggtagactcgccccagctcgccacgctagctgacgaggtgtctgcctccctggccaagcagggtttgtgatcaggcccctggggcggtcaataatcgtggagaggagagaatgagagagtgtggaaaaaaaaagaataatgacccggcccccgccctctgcccccagctgctcctcgcagttcggttaattggttaatcacttaacctgcttttgtcactcggctttggctcgggacttcaaaatcagtgatgggagtaagagcaaatttcatctttccaaattgatgggtgggctagtaataaaatattttaaaaaaaaacattcaaaaacatggccacatccaacatttcctcaggcaattccttttgattcttttttcttcccccctccatgtagaagagggggaaggagaggctctgaaagctgcttctgggggatttcaagggactgggggtgccaaccacctctggccctgttgtgggggtgtcacagaggcagtggcagcaacaaaggatttgaaacttggtgtgttcgtggagccacaggcagacgatgtcaaccttgtgtgagtgtgacgggggttggggtggggcgggaggccacgggggaggccgaggcaggggctgggcagaggggagaggaagcacaagaagtgggagtgggagaggaagccacgtgctggagagtagacatccccctccttgccgctgggagagccaaggcctatgccacctgcagcgtctgagcggccgcctgtccttggtggccgggggtgggggcctgctgtgggtcagtgtgccaccctctgcagggcagcctgtgggagaagggacagcgggtaaaaagagaaggcaagctggcaggagggtggcacttcgtggatgacctccttagaaaagactgaccttgatgtcttgagagcgctggcctcttcctccctccctgcagggtagggggcctgagttgaggggcttccctctctgctccacagaaaccctgttttattgagttctgaaggttggaactgctgccatgattttggccactttgcagacctgggactttagggctaaccagttctctttgtaaggacttgtgcctcttgggagacgtccacccgtttccaagcctgggccaccggcatctctggagtgtgtgggggtctgggaggcgggtcccgagccccctgtccttcccacggccactgcagtcacccctgtctgccccgctgtgctgttgtctgccgtgagagcccaatcactgcctatacccctcatcacgtcacaatgtcccgaattcccagcctcaccaccccttctcagtaatgaccctggttggttgcaggaggtacctactccatactgagggtgaaattaagggaaggcaaagtccaggcaccagagtgggaccccagcctctcactctcagttccactcatccaactgggaccctcaccacgaatctcacgatctgattcggttccctgtctcctcctcccgtcacagatgtgagccagggcactgctcagctgtgaccctaggtgtttctgccttgttgacatggagagagccctttcccctgagaaggcctggccccttcctgtgctgagcccacagcagcaggctgggtgtcttggttgtcagtggtggcaccaggatggaagggcaaggcacccagggcaggcccacagtcccgctgtcccccacttgcaccctagcttgtagctgccaacctcccagacagcccagcccgctgctcagctccacatgcatagtatcagccctccacacccgacaaaggggaacacacccccttggaaatggttctttccccccagtcccagctggaagccatgctgtctgttctgctggagcagctgaacatatacatagatgttgccctgccctccccatctgcaccctgttgagttgtagttggatttgtctgtttatgcttggattcaccagagtgactatgatagtgaaaagaaaaaaaaaaaaaaaaaaaggacgcatgtatcttgaaatgcttgtaaagaggtttctaacccaccctcacgaggtgtctctcacccccacactgggactcgtgtggcctgtgtggtgccaccctgctggggcctcccaagttttgaaaggctttcctcagcatctgggacccaacagagaccagcttctagcagctaaggaggccgttcagctgtgacgaaggcctgaagcacaggattaggactgaagcgatgatgtccccttccctacttccccttggggctccctgtgtcagggcacagactaggtcttgtggctggtctggcttgcggcgcgaggatggttctctctggtcatagcccgaagtctcacagcagtcccaaaggaggcttacaactcctgcatcacaagaaaaaggaagccactgccagctggggggatctgcagctcccagaagctccgtgagcctcagcctacccctcagactgggttcctctccaagctcgccctctggaggggcagcgcagcctcccaccaagggccctgcgaccacagcagggattgggatgaattgcctgtcctggatctgctctagaggcccaagctgcctgcctgaggaaggatgacttgacaagtcaggagacactgttcccaaagccttgaccagagcacctcagcccgctgaccttgcacaaactccatctgctgccatgagaaaagggaagccgcctttgcaaaacattgctgcctaaagaaactcagcagcctcaggcccaattctgccacttctggtttgggtacagttaaaggcaaccctgagggacttgcagtagaaatccagggcctcccctggggctggcagcttcgtgtgcagctagagctttacctgcaaggaagtctctgggcccagaactctccaccaagagcctccctgccgttcgctgagtcccagcaattctaagttgaagggatctgagaaggagaaggaaatgtggggtagatttggtggtggttagagatatgcccccctcattactgccaacagtttcggccgcatttcttcacgcacctcggttcctcttcctgaagttcttgtgccctgctcttcagcaccatgggccttatacggaaggctctgggatctcccccttgtggggcaggctcttggggccagcctaagatcatggtttagggtgatcagtgctggcagataaattgaaaaggcacgctggcttgtgatcttaaatgaggacaatccccccagggctgggcactcctcccctcccctcacttctcccacctgcagagccagtgtccttgggtgggctagataggatatactgtatgccggctccttcaagctgctgactcactttatcaatagttccatttaaattgacttcagtggtgagactgtatcctgtttgctattgcttgttgtgctatggggggaggggggaggaatgtgtaagatagttaacatgggcaaagggagatcttggggtgcagcacttaaactgcctcgtaacccttttcatgatttcaaccacatttgctagagggagggagcagccacggagttagaggcccttggggtttctcttttccactgacaggctttcccaggcagctggctagttcattccctccccagccaggtgcaggcgtaggaatatggacatctggttgctttggcctgctgccctctttcaggggtcctaagcccacaatcatgcctccctaagaccttggcatccttccctctaagccgttggcacctctgtgccacctctcacactggctccagacacacagcctgtgcttttggagctgagatcactcgcttcaccctcctcatctttgttctccaagtaaagccacgaggtcggggcgagggcagaggtgatcacctgcgtgtcccatctacagacctgcggcttcataaaacttctgatttctcttcagctttgaaaagggttaccctgggcactggcctagagcctcacctcctaatagacttagccccatgagtttgccatgttgagcaggactatttctggcacttgcaagtcccatgatttcttcggtaattctgagggtggggggagggacatgaaatcatcttagcttagctttctgtctgtgaatgtctatatagtgtattgtgtgttttaacaaatgatttacactgactgttgctgtaaaagtgaatttggaaataaagttattactctgattaaa

SEQ ID NO: 154006 - DNA, 2331 bp, Homo sapiens
  Payload ID: 10267
  Gene Symbol: MAPT
  Gene Name: microtubule-associated protein tau
  ENST ID: ENST00000629368
  CDS Start-End: 1-2331
atggctgagccccgccaggagttcgaagtgatggaagatcacgctgggacgtacgggttgggggacaggaaagatcaggggggctacaccatgcaccaagaccaagagggtgacacggacgctggcctgaaagaatctcccctgcagacccccactgaggacggatctgaggaaccgggctctgaaacctctgatgctaagagcactccaacagcggaagatgtgacagcacccttagtggatgagggagctcccggcaagcaggctgccgcgcagccccacacggagatcccagaaggaaccacagctgaagaagcaggcattggagacacccccagcctggaagacgaagctgctggtcacgtgacccaagagcctgaaagtggtaaggtggtccaggaaggcttcctccgagagccaggccccccaggtctgagccaccagctcatgtccggcatgcctggggctcccctcctgcctgagggccccagagaggccacacgccaaccttcggggacaggacctgaggacacagagggcggccgccacgcccctgagctgctcaagcaccagcttctaggagacctgcaccaggaggggccgctgctgaagggggcagggggcaaagagaggccggggagcaaggaggaggtggatgaagaccgcgacgtcgatgagtcctccccccaagactcccctccctccaaggcctccccagcccaagatgggcggcctccccagacagccgccagagaagccaccagcatcccaggcttcccagcggagggtgccatccccctccctgtggatttcctctccaaagtttccacagagatcccagcctcagagcccaacgggcccagtgcagggcgggccaaagggcaggatgcccccctggagttcacgtttcacgtggaaatcacacccaacgtgcagaaggagcaggcgcactcggaggagcatttgggaagggctgcatttccaggggcccctggagaggggccagaggcccggggcccctctttgggagaggacacaaaagaggctgaccttccagagccctctgaaaagcagcctgctgctgctccgcgggggaagcccgtcagctgggtccctcaactcaaagctcgcatggtcagtaaaagcaaagacgggactggaagcgatgacaaaaaagccaagacatccacacgttcctctgctaaaaccttgaaaaataggccttgccttagccccaaacaccccactcctggtagctcagaccctctgatccaaccctccagccctgctgtgtgcccagagccaccttcctctcctaaatacgtctcttctgtcactccccgaactggcagttctggagcaaaggagatgaaactcaagggggctgatggtaaaacgaagatcgccacaccgcggggagcagcccctccaggccagaagggccaggccaacgccaccaggattccagcaaaaaccccacccgctccaaagacaccacccagctctgcgaccaagcaagtccagagaagaccaccccctgcagggcccagatctgagagaggtgaacctccaaaatcaggggatcgcagcggctacagcagccccggctccccaggcactcccggcagccgctcccgcaccccgtcccttccaaccccacccacccgggagcccaagaaggtggcggtggtccgtactccacccaagtcgccgtcttccgccaagagccgcctgcagacagcccccgtgcccatgccagacctgaagaacgtcaagtccaagatcggctccactgagaacctgaagcaccagccgggaggcgggaaggtgcagataattaataagaagctggatcttagcaacgtccagtccaagtgtggctcaaaggataatatcaaacacgtcccgggaggcggcagtgtgcaaatagtctacaaaccagttgacctgagcaaggtgacctccaagtgtggctcattaggcaacatccatcataaaccaggaggtggccaggtggaagtaaaatctgagaagcttgacttcaaggacagagtccagtcgaagattgggtccctggacaatatcacccacgtccctggcggaggaaataaaaagattgaaacccacaagctgaccttccgcgagaacgccaaagccaagacagaccacggggcggagatcgtgtacaagtcgccagtggtgtctggggacacgtctccacggcatctcagcaatgtctcctccaccggcagcatcgacatggtagactcgccccagctcgccacgctagctgacgaggtgtctgcctccctggccaagcagggtttgtga

SEQ ID NO: 154007 - DNA, 1107 bp, Homo sapiens
  Payload ID: 10267
  Gene Symbol: MAPT
  Gene Name: microtubule-associated protein tau
  Uniprot ID: P10636
  ENST ID: ENST00000628393
  CDS Start-End: 37-1095
cgcctctgtcgactatcaggtgagctttgaaccaggatggctgagccccgccaggagttcgaagtgatggaagatcacgctgggacgtacgggttgggggacaggaaagatcaggggggctacaccatgcaccaagaccaagagggtgacacggacgctggcctgaaagctgaagaagcaggcattggagacacccccagcctggaagacgaagctgctggtcacgtgacccaagctcgcatggtcagtaaaagcaaagacgggactggaagcgatgacaaaaaagccaagggggctgatggtaaaacgaagatcgccacaccgcggggagcagcccctccaggccagaagggccaggccaacgccaccaggattccagcaaaaaccccacccgctccaaagacaccacccagctctggtgaacctccaaaatcaggggatcgcagcggctacagcagccccggctccccaggcactcccggcagccgctcccgcaccccgtcccttccaaccccacccacccgggagcccaagaaggtggcggtggtccgtactccacccaagtcgccgtcttccgccaagagccgcctgcagacagcccccgtgcccatgccagacctgaagaacgtcaagtccaagatcggctccactgagaacctgaagcaccagccgggaggcgggaaggtgcaaatagtctacaaaccagttgacctgagcaaggtgacctccaagtgtggctcattaggcaacatccatcataaaccaggaggtggccaggtggaagtaaaatctgagaagcttgacttcaaggacagagtccagtcgaagattgggtccctggacaatatcacccacgtccctggcggaggaaataaaaagattgaaacccacaagctgaccttccgcgagaacgccaaagccaagacagaccacggggcggagatcgtgtacaagtcgccagtggtgtctggggacacgtctccacggcatctcagcaatgtctcctccaccggcagcatcgacatggtagactcgccccagctcgccacgctagctgacgaggtgtctgcctccctggccaagcagggtttgtgatcaggcccctgg

SEQ ID NO: 154008 - DNA, 544 bp, Homo sapiens; identical to SEQ ID NO: 153991
  Payload ID: 10267
  Gene Symbol: MAPT
  Gene Name: microtubule-associated protein tau
  ENST ID: ENST00000633415
  CDS Start-End: 139-318

SEQ ID NO: 154009 - DNA, 1326 bp, Homo sapiens; identical to SEQ ID NO: 153992
  Payload ID: 10267
  Gene Symbol: MAPT
  Gene Name: microtubule-associated protein tau
  Uniprot ID: P10636
  ENST ID: ENST00000634049
  CDS Start-End: 1-1326

SEQ ID NO: 154010 - DNA, 1239 bp, Homo sapiens; identical to SEQ ID NO: 153988
  Payload ID: 10267
  Gene Symbol: MAPT
  Gene Name: microtubule-associated protein tau
  Uniprot ID: P10636
  ENST ID: ENST00000632500
  CDS Start-End: 1-1239

SEQ ID NO: 154011 - DNA, 2331 bp, Homo sapiens
  Payload ID: 10267
  Gene Symbol: MAPT
  Gene Name: microtubule-associated protein tau
  ENST ID: ENST00000633801
  CDS Start-End: 1-2331
atggctgagccccgccaggagttcgaagtgatggaagatcacgctgggacgtacgggttgggggacaggaaagatcaggggggctacaccatgcaccaagaccaagagggtgacacggacgctggcctgaaagaatctcccctgcagacccccactgaggacggatctgaggaaccgggctctgaaacctctgatgctaagagcactccaacagcggaagatgtgacagcacccttagtggatgagggagctcccggcaagcaggctgccgcgcagccccacacggagatcccagaaggaaccacagctgaagaagcaggcattggagacacccccagcctggaagacgaagctgctggtcacgtgacccaagagcctgaaagtggtaaggtggtccaggaaggcttcctccgagagccaggccccccaggtctgagccaccagctcatgtccggcatgcctggggctcccctcctgcctgagggccccagagaggccacacgccaaccttcggggacaggacctgaggacacagagggcggccgccacgcccctgagctgctcaagcaccagcttctaggagacctgcaccaggaggggccgccgctgaagggggcagggggcaaagagaggccggggagcaaggaggaggtggatgaagaccgcgacgtcgatgagtcctccccccaagactcccctccctccaaggcctccccagcccaagatgggcggcctccccagacagccgccagagaagccaccagcatcccaggcttcccagcggagggtgccatccccctccctgtggatttcctctccaaagtttccacagagatcccagcctcagagcccgatgggcccagtgtagggcgggccaaagggcaggatgcccccctggagttcacgtttcacgtggaaatcacacccaacgtgcagaaggagcaggcgcactcggaggagcatttgggaagggctgcatttccaggggcccctggagaggggccagaggcccggggcccctctttgggagaggacacaaaagaggctgaccttccagagccctctgaaaagcagcctgctgctgctccgcgggggaagcccgtcagccgggtccctcaactcaaagctcgcatggtcagtaaaagcaaagacgggactggaagcgatgacaaaaaagccaagacatccacacgttcctctgctaaaaccttgaaaaataggccttgccttagccccaaacaccccactcctggtagctcagaccctctgatccaaccctccagccctgctgtgtgcccagagccaccttcctctcctaaacacgtctcttctgtcacttcccgaactggcagttctggagcaaaggagatgaaactcaagggggctgatggtaaaacgaagatcgccacaccgcggggagcagcccctccaggccagaagggccaggccaacgccaccaggattccagcaaaaaccccgcccgctccaaagacaccacccagctctgcgactaagcaagtccagagaagaccaccccctgcagggcccagatctgagagaggtgaacctccaaaatcaggggatcgcagcggctacagcagccccggctccccaggcactcccggcagccgctcccgcaccccgtcccttccaaccccacccacccgggagcccaagaaggtggcagtggtccgtactccacccaagtcgccgtcttccgccaagagccgcctgcagacagcccccgtgcccatgccagacctgaagaatgtcaagtccaagatcggctccactgagaacctgaagcaccagccgggaggcgggaaggtgcagataattaataagaagctggatcttagcaacgtccagtccaagtgtggctcaaaggataatatcaaacacgtcccgggaggcggcagtgtgcaaatagtctacaaaccagttgacctgagcaaggtgacctccaagtgtggctcattaggcaacatccatcataaaccaggaggtggccaggtggaagtaaaatctgagaagcttgacttcaaggacagagtccagtcgaagattgggtccctggacaatatcacccacgtccctggcggaggaaataaaaagattgaaacccacaagctgaccttccgcgagaacgccaaagccaagacagaccacggggcggagatcgtgtacaagtcgccagtggtgtctggggacacgtctccacggcatctcagcaatgtctcctccaccggcagcatcgacatggtagactcgccccagctcgccacgctagctgacgaggtgtctgcctccctggccaagcagggtttgtga

SEQ ID NO: 154012 - DNA, 2277 bp, Homo sapiens
  Payload ID: 10267
  Gene Symbol: MAPT
  Gene Name: microtubule-associated protein tau
  ENST ID: ENST00000633054
  CDS Start-End: 1-2277
atggctgagccccgccaggagttcgaagtgatggaagatcacgctgggacgtacgggttgggggacaggaaagatcaggggggctacaccatgcaccaagaccaagagggtgacacggacgctggcctgaaagaatctcccctgcagacccccactgaggacggatctgaggaaccgggctctgaaacctctgatgctaagagcactccaacagcggaagatgtgacagcacccttagtggatgagggagctcccggcaagcaggctgccgcgcagccccacacggagatcccagaaggaaccacagctgaagaagcaggcattggagacacccccagcctggaagacgaagctgctggtcacgtgacccaagagcctgaaagtggtaaggtggtccaggaaggcttcctccgagagccaggccccccaggtctgagccaccagctcatgtccggcatgcctggggctcccctcctgcctgagggccccagagaggccacacgccaaccttcggggacaggacctgaggacacagagggcggccgccacgcccctgagctgctcaagcaccagcttctaggagacctgcaccaggaggggccgccgctgaagggggcagggggcaaagagaggccggggagcaaggaggaggtggatgaagaccgcgacgtcgatgagtcctccccccaagactcccctccctccaaggcctccccagcccaagatgggcggcctccccagacagccgccagagaagccaccagcatcccaggcttcccagcggagggtgccatccccctccctgtggatttcctctccaaagtttccacagagatcccagcctcagagcccgatgggcccagtgtagggcgggccaaagggcaggatgcccccctggagttcacgtttcacgtggaaatcacacccaacgtgcagaaggagcaggcgcactcggaggagcatttgggaagggctgcatttccaggggcccctggagaggggccagaggcccggggcccctctttgggagaggacacaaaagaggctgaccttccagagccctctgaaaagcagcctgctgctgctccgcgggggaagcccgtcagccgggtccctcaactcaaagctcgcatggtcagtaaaagcaaagacgggactggaagcgatgacaaaaaagccaagacatccacacgttcctctgctaaaaccttgaaaaataggccttgccttagccccaaacaccccactcctggtagctcagaccctctgatccaaccctccagccctgctgtgtgcccagagccaccttcctctcctaaacacgtctcttctgtcacttcccgaactggcagttctggagcaaaggagatgaaactcaagggggctgatggtaaaacgaagatcgccacaccgcggggagcagcccctccaggccagaagggccaggccaacgccaccaggattccagcaaaaaccccgcccgctccaaagacaccacccagctctggtgaacctccaaaatcaggggatcgcagcggctacagcagccccggctccccaggcactcccggcagccgctcccgcaccccgtcccttccaaccccacccacccgggagcccaagaaggtggcagtggtccgtactccacccaagtcgccgtcttccgccaagagccgcctgcagacagcccccgtgcccatgccagacctgaagaatgtcaagtccaagatcggctccactgagaacctgaagcaccagccgggaggcgggaaggtgcagataattaataagaagctggatcttagcaacgtccagtccaagtgtggctcaaaggataatatcaaacacgtcccgggaggcggcagtgtgcaaatagtctacaaaccagttgacctgagcaaggtgacctccaagtgtggctcattaggcaacatccatcataaaccaggaggtggccaggtggaagtaaaatctgagaagcttgacttcaaggacagagtccagtcgaagattgggtccctggacaatatcacccacgtccctggcggaggaaataaaaagattgaaacccacaagctgaccttccgcgagaacgccaaagccaagacagaccacggggcggagatcgtgtacaagtcgccagtggtgtctggggacacgtctccacggcatctcagcaatgtctcctccaccggcagcatcgacatggtagactcgccccagctcgccacgctagctgacgaggtgtctgcctccctggccaagcagggtttgtga

SEQ ID NO: 154013 - DNA, 6778 bp, Homo sapiens
  Payload ID: 10267
  Gene Symbol: MAPT
  Gene Name: microtubule-associated protein tau
  ENST ID: ENST00000632122
  CDS Start-End: 5493-6518
aagggccctgaaactaaatgtgtccccttaggaaagcaggagttttcttgcaagtggcaatcttctgcttatgtctcattggccagagctgggtcttacggccaccccttgctgcgagcaaggctgggacattgagcattttgccgtccaacctctttagcagaataaaccaagggggaagaacgttaatagtggcttttgagtcactagttggcagtatctgcccctctatctttccatcctccccatggagtttcaaggttcctttctcagtacttcttcaggctctgcacgttcatttggatcttgtgtcttggggtgaaaaactggcccaagtgtctccccaagcatccacctttggattaatttggaaaatggctgtcaagtgcccgcctcttgcttggtataatgctacagctttagaggacgcagcaggcatgggccttgccgctgaggttcttagcctcatgagaatatccagatcagattctcttggctccttcttagagccagtgatgcaagacacttcctgctcatcttgtcgggacggttttacaagttgcctgccatcctgagaaagtctacaaaacgatgccagacctcatgccagcttcccaagccttgactctcagtgctccctcaacaggattctggaagaatctcccaaacaagtcgcaatcccctctggaccctgtgcaggcatgagactcaagagcattggctcccacccctggtggagggaacactgctggggctgggatcttgcctggttgctccgcctgcacccaagacaaccataattaaaatgtccttcattgaacttggaaagccttcaaagctgacaactccttatgtgtacccggaaaggcctgggagtgtgccagggcattgctcgggagggacgctgatttggaagcatttacctgatgagagactgacagcagctcctggtagccgagctttccctcctgcctctgctgtgaaggtggacccatccaacagtcaaatgcctgactctggacaggagcggacctatttattgccatgcaagggactctgcacttttgaattgtgggtcatgggcttggatttaggggttagagctgggagaagtcttggaagtcacctagagatgacactgccattttgcagatgaggaaaccgtccaatcaaaatggaccaaggacttgcccaaagcctcacagcaaaaccataggcccccgcactaaccccagagtccctgtgctgtcttaagaatcaaatagttgtaagcaatcatctggttttcagtatttcttcttttaaaatgcctggggccatgcccagcagtctgtttcactgcagcgtttacacagggctgccgggctttcctggtggatgagctgggcggttcatgagccagaaccactcagcagcatgtcagtgtgcttcctggggagctggtagcaggggctccgggccctacttcagggctgctttctggcatatggctgatcccctcctcactcctcctccctgcattgctcctgcgcaagaagcaaaggtgaggggctgggtatggctcgtcctggcccctctaaggtggatctcggtggtttctagatgtgacagcacccttagtggatgagggagctcccggcaagcaggctgccgcgcagccccacacggagatcccagaaggaaccacaggtgagggtaagccccagagacccccaggcagtcaaggccctgctgggtgccccagctgacctgtgacagaagtgagggagctttgcgtgtttatcctcctgtggggcaggaacatgggtggattctggctcctgggaatcttgggttgtgagtagctcgatgccttggtgctcagttacctccctggctgcctgccagcctctcagagcatttagggccttctggacttctagatgctcctcatcttgcctcagtcagcgcgtcagttccagagacttctctgcagggttttctggggcaggtggtggcagacccgtgccttcttgacacctgaggtcagtccaccctcctgctcagactgcccagcacagggtcacctcccaaggggtggaccccaagatcacctgagcgcacagagggtgcagatgactggaccacaccttttggtgatcttaatgaggtggtcccagaggagctcagacatgcaatctagcatccagttctgggactctgtctccttttcaaacgtattcatgtagaacaggcatgacgagaatgccttgtcaacatgggtgatggggaatcaatcagacagggcgccgggctcaaggctgcagtcacccaagagtggctcagcccaccaggccctaggaaacgcctgcacagcctggagctcctggagtcatttccttcatgtcttcttcactgcacttacgtaaagatgccagccattggtttggtgatttggagggtgcccagttgcccaacaagaaatgcagaagaggcctagccaggatttcaccagcagtggagagtagagaagatgtggccagaaaagagtttcctttccctcctaaagatggtactccctgcagctactggggaagcctgcagcattctctagggctctgtgtgttgagagcagccccaccctggccccttctgagtgcatttctgctttgtgacttgatccgtgaagtcccctgagatgggcagaggggatgtcctcgaagctggggcagagcctcatccttgaacgtgaaggacgtttgaagactgtggcatgatcacaggatgagatcacagggaacttgagtttctctcctcctctcccttcacagttatttcactgagggaaatccctcccctgcccagaatgaaaactctagccaactcttgacttttccatcactccaaagtagttgaaagtacattagtctccacagtggcaaaacagtgtgcaaaagctaaataattagaacagccagtcccatgtgacagtcaaagcttctaactccattcaaagttgcagccattcccctcgagggctggcagggaggggaggggtaagagaaacaggaaggttcttactgagttggtcctggtgtgagctgcgtcacactccctgcagaggtttcaaggagactctctctctctctgtctccatggggaccttatttgaattcttctactcttaccccagcctgccatctccagctatcctcccctgaagagcccttctgctgcgctggattctggtggccatgtcatctcctcggccccgtgggagtctgaagatctggctgcagcctcacctctgaggtcctgctagttgccacctcttaaacatgatctgaggctcccatgcactctgacctgtgcccacatggggcccacgggaaacacgccggcaagcaaactgtgggtgtgcagacggttctcagggctgcagcacctgtcctttgctctgcccccaaagcaaggccagcccatcttccatcctctagtgttccttggtggggccctgaccacagtccaccaggtccctaaccagaggggacacacaccaggtgtcctcaatgtattgccttgaaacagttgtgctgggactgtgatggggggtggccatgtagccacccccaccacccccaagccactctctccaaggaaatcctcctaaagatccctttacatcctccatgtggtggggaggttctagagttgggtgcatgtgtcttcagctactgacaatgcagaccttagttggcacctcgctctggcctatcctgtttgctgttcttggcgctccagtgaaactccccatgggccatccagttggggtgcagtgtggccacccccttgcaggttcctgccttgctggagagcacagggccctcctggctcttgtaaaacactccccatggtacagagaggccagcagtgatgtgaggcccaacctccctccatggtgttcccaagcagctccctttctggggtcaaggggtggcaaagacagtgcagcgtccaatttctgactcaagccgggcctggctatcgcagctctgcactgtgtgtgacagcaaggcaactcacccagtgccgtggcagtgaccgtgtccgaggaagcctcctcacaccctctgtctcaaggactctggcatttagctggacttgctgtagctctgagcctttctgccattgccatcaccttgtcagaaactcaggccgaatctgcactcagagttgtgcccaggcagttgagccaacacttgctcagcgatattgtcacatgacaaggcactgtcaccactgggcgtcgtgggtagcgcagtgtcggctggatggacccggagggtgtctgtgtcatgctagtgctagtgatgggagccccgtgagcccattgcccgccctcccatgccctcagcagctgcctggggacagccaatggcctgggtgtttctgaggctaccacatggcttccaggaaactcgagaacctttctctcccttgcctacactcttcacacaggcctgtgctggccagcggtggggatccggcattcctatcttaggtgcagaaagtgactgactcattgcaggcctgggagataagactgatggcccagccagcaagatgtatggatttctcagaggcagtggcctctgtcattgtcctcaggaaatgctggtgattctggtggcctgaggtcaatgcatgtcaacgtggccaacttgccttataaactttttttctggacaattgcgtgcactgtcctgtaacagtgtcctgttgtttatgatgcagaaataggtgtttttaaagcctattgattttggtactattaatgtggtcaggaactttctcagtctttcttgtttggggtgagctgtggcttcctaaacaggaacccaagacacccccaaaagctgctcaccagcactgccagcctccctcttaccaagtagcacccgttcaggacattctgcgaaaggcatttgcccagaagttgggaggaaggaaatgtaacattttggggcacctaccatatgccaggcaccaggctaaacgtgttcacacaaattctcttactaaccctcaccatccttctacaagacaaactagtatcttcatcttggggttcaagatgaggaaatggaggctcagagaggttgaatgaatgccggtgcctggatatgaaccccatctgcctgactccgcaacccaggcaaagtctttccttgaacttcccagcagccactgcttagacacagcctccacaaccatggctcagcagcaaattgcttctctgacctcactcagcctgtgtgtccttgttgagtgaggcattcaggaccctggtcccaaagtggagaaagtctttcctactaggtcatagctacacctgcatgtgggtgctgtgccttttgtttagtgaacttttatcaccagcatcctcagcaatgacatttgcagagaagccagagctgaggcaccttggtattcttgggatgtgactttcctgaatgtttaagggaaaatgcccgaaggtacagagagcttggtttctagtaaacaataactgtcttgcttttaccccccttcatttgctgacacatacaccagctgaagaagcaggcattggagacacccccagcctggaagacgaagctgctggtcacgtgacccaagctcgcatggtcagtaaaagcaaagacgggactggaagcgatgacaaaaaagccaagggggctgatggtaaaacgaagatcgccacaccgcggggagcagcccctccaggccagaagggccaggccaacgccaccaggattccagcaaaaaccccgcccgctccaaagacaccacccagctctggtgaacctccaaaatcaggggatcgcagcggctacagcagccccggctccccaggcactcccggcagccgctcccgcaccccgtcccttccaaccccacccacccgggagcccaagaaggtggcagtggtccgtactccacccaagtcgccgtcttccgccaagagccgcctgcagacagcccccgtgcccatgccagacctgaagaatgtcaagtccaagatcggctccactgagaacctgaagcaccagccgggaggcgggaaggtgcaaatagtctacaaaccagttgacctgagcaaggtgacctccaagtgtggctcattaggcaacatccatcataaaccaggaggtggccaggtggaagtaaaatctgagaagcttgacttcaaggacagagtccagtcgaagattgggtccctggacaatatcacccacgtccctggcggaggaaataaaaagattgaaacccacaagctgaccttccgcgagaacgccaaagccaagacagaccacggggcggagatcgtgtacaagtcgccagtggtgtctggggacacgtctccacggcatctcagcaatgtctcctccaccggcagcatcgacatggtagactcgccccagctcgccacgctagctgacgaggtgtctgcctccctggccaagcagggtttgtgatcaggcccctggggcggtcaataattgtggagaggagagaatgagagagtgtggaaaaaaaaagaataatgacccggcccccgccctctgcccccagctgctcctcgcagttcggttaattggttaatcacttaacctgcttttgtcactcggctttggctcgggacttcaaaatcagtgatgggagtaagagcaaatttcatctttccaaattgatgggtgggctagtaataaaatatttaaaaaaaaacattcaaaaa

SEQ ID NO: 154014 - DNA, 1107 bp, Homo sapiens; identical to SEQ ID NO: 153982
  Payload ID: 10267
  Gene Symbol: MAPT
  Gene Name: microtubule-associated protein tau
  Uniprot ID: P10636
  ENST ID: ENST00000633047
  CDS Start-End: 37-1095

SEQ ID NO: 154015 - DNA, 1233 bp, Homo sapiens; identical to SEQ ID NO: 153985
  Payload ID: 10267
  Gene Symbol: MAPT
  Gene Name: microtubule-associated protein tau
  Uniprot ID: P10636
  ENST ID: ENST00000631447
  CDS Start-End: 1-1233

SEQ ID NO: 154016 - DNA, 2623 bp, Homo sapiens
  Payload ID: 10268
  Gene Symbol: MAPRE1
  Gene Name: microtubule-associated protein, RP/EB family, member 1
  Uniprot ID: Q15691
  ENST ID: ENST00000375571
  CDS Start-End: 140-946
ctttacgtcggcgcgtaacgagggggtgcgtgtgaggtcatcgcgcgggcgggcgggcggggtctggcggtttgaacgagacgaagacggaaccggagccggttgcgggcagtggacgcggttctgccgagagccgaagatggcagtgaacgtatactcaacgtcagtgaccagtgataacctaagtcgacatgacatgctggcctggatcaatgagtctctgcagttgaatctgacaaagatcgaacagttgtgctcaggggctgcgtattgtcagtttatggacatgctgttccctggctccattgccttgaagaaagtgaaattccaagctaagctagaacacgagtacatccagaacttcaaaatactacaagcaggttttaagagaatgggtgttgacaaaataattcctgtggacaaattagtaaaaggaaagtttcaggacaattttgaattcgttcagtggttcaagaagtttttcgatgcaaactatgatggaaaagactatgaccctgtggctgccagacaaggtcaagaaactgcagtggctccttcccttgttgctccagctctgaataaaccgaagaaacctctcacttctagcagtgcagctccccagaggcccatctcaacacagagaaccgctgcggctcctaaggctggccctggtgtggtgcgaaagaaccctggtgtgggcaacggagacgacgaggcagctgagttgatgcagcaggtcaacgtattgaaacttactgttgaagacttggagaaagagagggatttctacttcggaaagctacggaacattgaattgatttgccaggagaacgagggggaaaacgaccctgtattgcagaggattgtagacattctgtatgccacagatgaaggctttgtgatacctgatgaagggggcccacaggaggagcaagaagagtattaacagcctggaccagcagagcaacatcggaattcttcactccaaatcatgtgcttaactgtaaaatactcccttttgttatccttagaggactcactggtttcttttcataagcaaaaagtacctcttcttaaagtgcactttgcagacgtttcactccttttccaataagtttgagttaggagcttttaccttgtagcagagcagtattaacacctagttggttcacctggaaaacagagaggctgaccgtggggctcaccatgcggatgcgggtcacactgaatgctggagagatgttatgtaatatgctgaggtggcgacctcagtggagaaatgtaaagactgaattgaattttaagctaatgtgaaatcagagaatgttgtaataagtaaatgccttaagagtatttaaaatatgcttccacatttcaaaatataaaatgtaacatgacaagagattttgcgtttgacattgtgtctgggaaggaagggccagaccttggaacctttggaacctgctgtcaacaggtcttacagggctgcttgaaccctcataggcctaggctttggtctaaaaggaacatttaaaaagttgccctgtaaagttatttggtgtcattgaccaattgcatcccagctaaaaagcaagaggcatcgttgcctggataatagaggatgtgtttcagccctgagatgttacagttgaagagcttggttttcattgagcatttctctatttttccagttatccccgaaatttctatgtattatattttttggggaagtgaggtgtgcccagttttttaatctaacaactacttttggggacttgcccacatctctgggatttgaatggggattgtatcccattttactgtcttttaggtttacatttaccacgtttctcttctctgctccccttgcccactggggactcctctttggctccttgaagtttgctgcttagagttggaagtgcagcaggcaggtgatcatgctgcaagttctttctggacctctggcaaagggagtggtcagtgaaggccatcgttaccttgggatctgccaggctggggtgttttcggtatctgctgttcacagctctccactgtaatccgaatactttgccagtgcactaatctctttggagataaaattcattagtgtgttactaaatgttaattttcttttgcggaaaatacagtaccgtgtctgaattaattattaatatttaaaatacttcattccttaactctccctcatttgctttgcccacagcctattcagttcctttgtttggcaggattctgcaaaatgtgtctcacccactactgagattgttcagcccctgatgtatttgtattgatttgtttctggtggtagcttgtcctgaaatgtgtgtagaaagcaagtattttatgataaaaatgttgtgtagtgcatgctctgtgtggaattcagaggaaaacccagattcagtgattaacaatgccaaaaaatgcaagtaactagccattgttcaaatgacagtggtgctatttctcttttgtggccttttagacttttgttgccctaaaattccattttattgggaacccattttccacctggtctttcttgacagggtttttttctactttaaacagtttctaaataaaattctgtatttcaagagta

SEQ ID NO: 154017 - DNA, 4265 bp, Homo sapiens
  Payload ID: 10269
  Gene Symbol: MAPRE2
  Gene Name: microtubule-associated protein, RP/EB family, member 2
  Uniprot ID: Q15555
  ENST ID: ENST00000300249
  CDS Start-End: 181-1164
gtcagctgccagagggcggggccgcaggagggcggggcgcgagcgagagctgggagaaggcagtgagcgagcaggcggcaggcacggtccgtgcggagcaggcgagcgagcgggaagacgcagccaccttcctcaccagccagcccacagcggtttgttccccttctcgggagtgcgccaatgcctgggccgacccaaaccctgtccccaaatggcgagaacaacaacgacatcatccaggataataacgggaccatcattcctttccggaagcacacagtgcgcggggagcgttcctacagttggggaatggcggtcaatgtgtattctacctcgataacccaagagactatgagcagacatgacatcattgcatgggttaatgacatagtatctttaaactacacaaaagtggaacagctttgttcaggagcggcctattgccaattcatggacatgctcttccctggctgcattagtttgaagaaagtaaaatttcaagcaaagctggaacatgaatatattcacaattttaaacttctgcaagcatcatttaagcgaatgaacgttgataaggtaattccagtggagaagctagtgaaaggacgtttccaggacaacctggattttattcaatggtttaagaaattctatgatgctaactacgatgggaaggagtatgatcctgtagaggcacgacaagggcaagatgcaattcctcctcctgaccctggtgaacagatcttcaacctgccaaaaaagtctcaccatgcaaactcccccacagcaggtgcagctaaatcaagtccagcagctaaaccaggatccacaccttctcgaccctcatcagccaaaagggcttcttccagtggctcagcatccaaatccgataaagatttagaaacgcaggtcatacagcttaatgaacaggtacattcattaaaacttgcccttgaaggcgtggaaaaggaaagggatttctactttgggaagttgagagagatcgagctactctgccaagaacacgggcaggaaaatgatgacctcgtgcagagactaatggacatcctgtatgcttcagaagaacacgagggccacacagaagagccggaagcagaggagcaagcccacgaacagcagcccccgcagcaggaagagtactgacccaccccggctgctcttgacacttccattgtgtgtgggaacgtttcttctggagaattggaacatgtgtggccccaagctcaacagaaaccagttgttcccaatctgccgttaccatcaacgcactgttgcatatgccagccactgcgcttggttcccattttctttgccaaggtgtattagcggacggccctctggccacctacccgagagatcgtagggtcacatacatccaacttcaccacttggctgcttgagattggttctgctcttttcttcatttctttccagaacaactctttcccaccccaacaccactgccaccacccctctttttatcctggtgtgaaacaatggtaatttgatatatggtatttatattggcatttttcaacccagtgtcactagatgtcacacacatttgtggtgctttgatgtttgcaagtctaacctctgaacataaatttggtcaaataattggaacaaagggaaacagatacttgatatgaaagccataatgacggtgacttgtgtcgtgggggaaaacataaggtcattttctccctctactcacaatactaaagggaaaaaatggattcaaagctaggatttcagggcccagcagtgttcctccatcagcatgttagacaactacacagtatgttgttagttttgaaagacattcactcaaggaaaacaccatctcaactttgcccgctcaccatgtcccttgcccccatgtagcccatttcccaggttatgctcttttctttctcagggtcctctttggtgggcagccactccccgagatgttgccatcagttttctgcagtccaaagagggtatggttaggtacgggtcttcctgcctcattcctcttcctctttgtgtaggtttcagccacaaaactgtcattcactctaggggacccctactaaagggtaacttcaggtgtgcagccctgagctccaaggctctgcaccatgccacacacttgctgtaaggctagaagtgaagaccttattaataggagcataattgcgagggagaatcatggttctgcagtctggtgtagacactggaataacagcacagaaaaatctatgactcccaatatcttctagaataaagaattttccctctttaacacaagggccctccttgtcattgaccttagctaaaccatggcaattcataaatagaggaaacattaatgaattaaaagcattccttattttttaactaatatttgtacattttcttagtctctttccaagtctttgcctcttttttttctttatttttattttttcctttgacagatggtatcccttcctggatcattcatttcaccttggtttctaactttaggtttactttcacttgttatttgacttagcaggtgcaacaaaaacaagaaacaaatgtgcccaccccactttccgcttaactgaaaagcttaaaataaatttctgaattatgtatcctgaagctttgaaatttctttattaatcgatgaaatatgaattctaaattctagcattgaagcttttcaccaaaagaagtctctccaaaataaatcttttgcagcaaagtgatatttattgagttatgtggaaaagatggcttgtatttttcagattattacaacacactgtgcagaattagacagatgttccgtggtgtttggtttccctttcttctctctcctgctcactctgcattatagcagcagcttatttctctaaggctggacagcctggctctcggcagtgacgtcctcccacacctggtcacaagtagtagtggctgtgctatacccagcatcatgcttaacagcgtgttgcccttctgagcctgttgtactcactgatctctttaaaaacaaaaaatagctcttgtaaaaggtcacaataactctatgcacctgatactgcagtggttcctaggccattcttcatctgctctggacatctcagtcatacccaatgctcagtggatcatgaccaaactcctgtcatgtggatgcacgtgagtgggtagcagggagtcaggatcctgccttctccagcaaccccttactgctgtataacttgcataagcctccctggtgactcttgcaggaaccactccattgccctccagctccccagccttctcagttataaacatgctggccagatctcttagcctgcaaagagaactttccccagtcaccatagaccattctccttcctgaaggcttggggcagaccattcgtttatttagagaagagctatacattcttctttctggtcccatcttaaacgtcttctgttgtgctgcaccccagatggtgtctcagatgctttggggaatctttaacagctgaatttgagtcagtcctcttaggctgcacctccagcctctgcagatcccccctcatttcccatggatggtgggaccccattattctctcatctcggcattcagggaacagtttccttagcggcccctggtcacatgtcatcgggctgggcaggaagcgtccctgattgcgtgctccacttctccctctcaggaagcccagtttcatccttagtaccccccctcgtgcccgctgtcggctggttatagcacttccactgctactgtcagataggaagtgatcgaagcagggggcaaagagaaagcccatatttgttctaagcagaaaagcaggaaaaaaaaaaaaaaaaaagaaagaaaaacacctgttgacctgagagaagtaaattccagaagggaaccaagaactcttcccttccctggtgagtatttccattattccgttaaggtttaatatgcattcagattacttttactaaataggacaccataaagcttttgttatatattaaatgtaaactgaaaggaatgtaaacatatgtattgttaattataaatatagataagtaatgacataatagatgaaaaagtcttattcagatgtatcacattcattttacattacccacctattgtcgcatggtagaatagttttttgtctctgaatatgtgaataacttgacttgcattgatctttttacatatttaataaaaaaaaaagtatatgttaaaa

SEQ ID NO: 154018 - DNA, 4173 bp, Homo sapiens
  Payload ID: 10269
  Gene Symbol: MAPRE2
  Gene Name: microtubule-associated protein, RP/EB family, member 2
  Uniprot ID: Q15555
  ENST ID: ENST00000413393
  CDS Start-End: 222-1076
ctctcgggtggactcccggagcggcggcggcggcggcggtggcagactgcgagtcacgtgcgacagaggaggcggagcacggcggccgggtgggtggagaaaacaaagcccccagctgtcagcagaggaaggaggcgacagcgccggagcagtgtcctgtttcccagaggaacagttcatttcaacagccagggagaaagcctggatgctcaagttggggaatggcggtcaatgtgtattctacctcgataacccaagagactatgagcagacatgacatcattgcatgggttaatgacatagtatctttaaactacacaaaagtggaacagctttgttcaggagcggcctattgccaattcatggacatgctcttccctggctgcattagtttgaagaaagtaaaatttcaagcaaagctggaacatgaatatattcacaattttaaacttctgcaagcatcatttaagcgaatgaacgttgataaggtaattccagtggagaagctagtgaaaggacgtttccaggacaacctggattttattcaatggtttaagaaattctatgatgctaactacgatgggaaggagtatgatcctgtagaggcacgacaagggcaagatgcaattcctcctcctgaccctggtgaacagatcttcaacctgccaaaaaagtctcaccatgcaaactcccccacagcaggtgcagctaaatcaagtccagcagctaaaccaggatccacaccttctcgaccctcatcagccaaaagggcttcttccagtggctcagcatccaaatccgataaagatttagaaacgcaggtcatacagcttaatgaacaggtacattcattaaaacttgcccttgaaggcgtggaaaaggaaagggatttctactttgggaagttgagagagatcgagctactctgccaagaacacgggcaggaaaatgatgacctcgtgcagagactaatggacatcctgtatgcttcagaagaacacgagggccacacagaagagccggaagcagaggagcaagcccacgaacagcagcccccgcagcaggaagagtactgacccaccccggctgctcttgacacttccattgtgtgtgggaacgtttcttctggagaattggaacatgtgtggccccaagctcaacagaaaccagttgttcccaatctgccgttaccatcaacgcactgttgcatatgccagccactgcgcttggttcccattttctttgccaaggtgtattagcggacggccctctggccacctacccgagagatcgtagggtcacatacatccaacttcaccacttggctgcttgagattggttctgctcttttcttcatttctttccagaacaactctttcccaccccaacaccactgccaccacccctctttttatcctggtgtgaaacaatggtaatttgatatatggtatttatattggcatttttcaacccagtgtcactagatgtcacacacatttgtggtgctttgatgtttgcaagtctaacctctgaacataaatttggtcaaataattggaacaaagggaaacagatacttgatatgaaagccataatgacggtgacttgtgtcgtgggggaaaacataaggtcattttctccctctactcacaatactaaagggaaaaaatggattcaaagctaggatttcagggcccagcagtgttcctccatcagcatgttagacaactacacagtatgttgttagttttgaaagacattcactcaaggaaaacaccatctcaactttgcccgctcaccatgtcccttgcccccatgtagcccatttcccaggttatgctcttttctttctcagggtcctctttggtgggcagccactccccgagatgttgccatcagttttctgcagtccaaagagggtatggttaggtacgggtcttcctgcctcattcctcttcctctttgtgtaggtttcagccacaaaactgtcattcactctaggggacccctactaaagggtaacttcaggtgtgcagccctgagctccaaggctctgcaccatgccacacacttgctgtaaggctagaagtgaagaccttattaataggagcataattgcgagggagaatcatggttctgcagtctggtgtagacactggaataacagcacagaaaaatctatgactcccaatatcttctagaataaagaattttccctctttaacacaagggccctccttgtcattgaccttagctaaaccatggcaattcataaatagaggaaacattaatgaattaaaagcattccttattttttaactaatatttgtacattttcttagtctctttccaagtctttgcctcttttttttctttatttttattttttcctttgacagatggtatcccttcctggatcattcatttcaccttggtttctaactttaggtttactttcacttgttatttgacttagcaggtgcaacaaaaacaagaaacaaatgtgcccaccccactttccgcttaactgaaaagcttaaaataaatttctgaattatgtatcctgaagctttgaaatttctttattaatcgatgaaatatgaattctaaattctagcattgaagcttttcaccaaaagaagtctctccaaaataaatcttttgcagcaaagtgatatttattgagttatgtggaaaagatggcttgtatttttcagattattacaacacactgtgcagaattagacagatgttccgtggtgtttggtttccctttcttctctctcctgctcactctgcattatagcagcagcttatttctctaaggctggacagcctggctctcggcagtgacgtcctcccacacctggtcacaagtagtagtggctgtgctatacccagcatcatgcttaacagcgtgttgcccttctgagcctgttgtactcactgatctctttaaaaacaaaaaatagctcttgtaaaaggtcacaataactctatgcacctgatactgcagtggttcctaggccattcttcatctgctctggacatctcagtcatacccaatgctcagtggatcatgaccaaactcctgtcatgtggatgcacgtgagtgggtagcagggagtcaggatcctgccttctccagcaaccccttactgctgtataacttgcataagcctccctggtgactcttgcaggaaccactccattgccctccagctccccagccttctcagttataaacatgctggccagatctcttagcctgcaaagagaactttccccagtcaccatagaccattctccttcctgaaggcttggggcagaccattcgtttatttagagaagagctatacattcttctttctggtcccatcttaaacgtcttctgttgtgctgcaccccagatggtgtctcagatgctttggggaatctttaacagctgaatttgagtcagtcctcttaggctgcacctccagcctctgcagatcccccctcatttcccatggatggtgggaccccattattctctcatctcggcattcagggaacagtttccttagcggcccctggtcacatgtcatcgggctgggcaggaagcgtccctgattgcgtgctccacttctccctctcaggaagcccagtttcatccttagtaccccccctcgtgcccgctgtcggctggttatagcacttccactgctactgtcagataggaagtgatcgaagcagggggcaaagagaaagcccatatttgttctaagcagaaaagcaggaaaaaaaaaaaaaaaaaagaaagaaaaacacctgttgacctgagagaagtaaattccagaagggaaccaagaactcttcccttccctggtgagtatttccattattccgttaaggtttaatatgcattcagattacttttactaaataggacaccataaagcttttgttatatattaaatgtaaactgaaaggaatgtaaacatatgtattgttaattataaatatagataagtaatgacataatagatgaaaaagtcttattcagatgtatcacattcattttacattacccacctattgtcgcatggtagaatagttttttgtctctgaatatgtgaataacttgacttgcattgatctttttacatatttaataaaaaaaaaagtatatgtt

SEQ ID NO: 154019 - DNA, 4323 bp, Homo sapiens
  Payload ID: 10269
  Gene Symbol: MAPRE2
  Gene Name: microtubule-associated protein, RP/EB family, member 2
  Uniprot ID: Q15555
  ENST ID: ENST00000436190
  CDS Start-End: 275-1222
gtagacccgctaggcaggaagaggtcactaaaaatactatcgtgctgtcaatgtagaatgaagggttaagcgctcaaacccgcgcccgcgcgcaccgaaacggaagaacttccttgattagcatagtatcgaccctggggccgcgctgcgaggcggaggttcggtcccagctggggtgaagtgtgcagaccggttgcgattgtggtcagacgcagcacctacttctaatctgaggacccgcgatttacacttttgctgaataggacactgtggaatgaaacagaacagagatcaaaagtgtcctgtttcccagaggaacagttcatttcaacagccagggagaaagcctggatgctcaagttggggaatggcggtcaatgtgtattctacctcgataacccaagagactatgagcagacatgacatcattgcatgggttaatgacatagtatctttaaactacacaaaagtggaacagctttgttcaggagcggcctattgccaattcatggacatgctcttccctggctgcattagtttgaagaaagtaaaatttcaagcaaagctggaacatgaatatattcacaattttaaacttctgcaagcatcatttaagcgaatgaacgttgataaggtaattccagtggagaagctagtgaaaggacgtttccaggacaacctggattttattcaatggtttaagaaattctatgatgctaactacgatgggaaggagtatgatcctgtagaggcacgacaagggcaagatgcaattcctcctcctgaccctggtgaacagatcttcaacctgccaaaaaagtctcaccatgcaaactcccccacagcaggtgcagctaaatcaagtccagcagctaaaccaggatccacaccttctcgaccctcatcagccaaaagggcttcttccagtggctcagcatccaaatccgataaagatttagaaacgcaggtcatacagcttaatgaacaggtacattcattaaaacttgcccttgaaggcgtggaaaaggaaagggatttctactttgggaagttgagagagatcgagctactctgccaagaacacgggcaggaaaatgatgacctcgtgcagagactaatggacatcctgtatgcttcagaagaacacgagggccacacagaagagccggaagcagaggagcaagcccacgaacagcagcccccgcagcaggaagagtactgacccaccccggctgctcttgacacttccattgtgtgtgggaacgtttcttctggagaattggaacatgtgtggccccaagctcaacagaaaccagttgttcccaatctgccgttaccatcaacgcactgttgcatatgccagccactgcgcttggttcccattttctttgccaaggtgtattagcggacggccctctggccacctacccgagagatcgtagggtcacatacatccaacttcaccacttggctgcttgagattggttctgctcttttcttcatttctttccagaacaactctttcccaccccaacaccactgccaccacccctctttttatcctggtgtgaaacaatggtaatttgatatatggtatttatattggcatttttcaacccagtgtcactagatgtcacacacatttgtggtgctttgatgtttgcaagtctaacctctgaacataaatttggtcaaataattggaacaaagggaaacagatacttgatatgaaagccataatgacggtgacttgtgtcgtgggggaaaacataaggtcattttctccctctactcacaatactaaagggaaaaaatggattcaaagctaggatttcagggcccagcagtgttcctccatcagcatgttagacaactacacagtatgttgttagttttgaaagacattcactcaaggaaaacaccatctcaactttgcccgctcaccatgtcccttgcccccatgtagcccatttcccaggttatgctcttttctttctcagggtcctctttggtgggcagccactccccgagatgttgccatcagttttctgcagtccaaagagggtatggttaggtacgggtcttcctgcctcattcctcttcctctttgtgtaggtttcagccacaaaactgtcattcactctaggggacccctactaaagggtaacttcaggtgtgcagccctgagctccaaggctctgcaccatgccacacacttgctgtaaggctagaagtgaagaccttattaataggagcataattgcgagggagaatcatggttctgcagtctggtgtagacactggaataacagcacagaaaaatctatgactcccaatatcttctagaataaagaattttccctctttaacacaagggccctccttgtcattgaccttagctaaaccatggcaattcataaatagaggaaacattaatgaattaaaagcattccttattttttaactaatatttgtacattttcttagtctctttccaagtctttgcctcttttttttctttatttttattttttcctttgacagatggtatcccttcctggatcattcatttcaccttggtttctaactttaggtttactttcacttgttatttgacttagcaggtgcaacaaaaacaagaaacaaatgtgcccaccccactttccgcttaactgaaaagcttaaaataaatttctgaattatgtatcctgaagctttgaaatttctttattaatcgatgaaatatgaattctaaattctagcattgaagcttttcaccaaaagaagtctctccaaaataaatcttttgcagcaaagtgatatttattgagttatgtggaaaagatggcttgtatttttcagattattacaacacactgtgcagaattagacagatgttccgtggtgtttggtttccctttcttctctctcctgctcactctgcattatagcagcagcttatttctctaaggctggacagcctggctctcggcagtgacgtcctcccacacctggtcacaagtagtagtggctgtgctatacccagcatcatgcttaacagcgtgttgcccttctgagcctgttgtactcactgatctctttaaaaacaaaaaatagctcttgtaaaaggtcacaataactctatgcacctgatactgcagtggttcctaggccattcttcatctgctctggacatctcagtcatacccaatgctcagtggatcatgaccaaactcctgtcatgtggatgcacgtgagtgggtagcagggagtcaggatcctgccttctccagcaaccccttactgctgtataacttgcataagcctccctggtgactcttgcaggaaccactccattgccctccagctccccagccttctcagttataaacatgctggccagatctcttagcctgcaaagagaactttccccagtcaccatagaccattctccttcctgaaggcttggggcagaccattcgtttatttagagaagagctatacattcttctttctggtcccatcttaaacgtcttctgttgtgctgcaccccagatggtgtctcagatgctttggggaatctttaacagctgaatttgagtcagtcctcttaggctgcacctccagcctctgcagatcccccctcatttcccatggatggtgggaccccattattctctcatctcggcattcagggaacagtttccttagcggcccctggtcacatgtcatcgggctgggcaggaagcgtccctgattgcgtgctccacttctccctctcaggaagcccagtttcatccttagtaccccccctcgtgcccgctgtcggctggttatagcacttccactgctactgtcagataggaagtgatcgaagcagggggcaaagagaaagcccatatttgttctaagcagaaaagcaggaaaaaaaaaaaaaaaaaagaaagaaaaacacctgttgacctgagagaagtaaattccagaagggaaccaagaactcttcccttccctggtgagtatttccattattccgttaaggtttaatatgcattcagattacttttactaaataggacaccataaagcttttgttatatattaaatgtaaactgaaaggaatgtaaacatatgtattgttaattataaatatagataagtaatgacataatagatgaaaaagtcttattcagatgtatcacattcattttacattacccacctattgtcgcatggtagaatagttttttgtctctgaatatgtgaataacttgacttgcattgatctttttacatatttaataaaaaaaaaagtatatgttaaaa

SEQ ID NO: 154020 - DNA, 4093 bp, Homo sapiens
  Payload ID: 10269
  Gene Symbol: MAPRE2
  Gene Name: microtubule-associated protein, RP/EB family, member 2
  Uniprot ID: Q15555
  ENST ID: ENST00000538170
  CDS Start-End: 168-992
gagagctgggagaaggcagtgagcgagcaggcggcaggcacggtccgtgcggagcaggcgagcgagcgggaagacgcagccaccttcctcaccagccagcccacagcggtttgttccccttctcgggagtgcgccaatgcctgggccgacccaaaccctgtccccaaatggcgagaacaacaacgacatcatccaggataataacgggaccatcattcctttccggaagcacacagtgcgcggggagcgttcctacaggagcggcctattgccaattcatggacatgctcttccctggctgcattagtttgaagaaagtaaaatttcaagcaaagctggaacatgaatatattcacaattttaaacttctgcaagcatcatttaagcgaatgaacgttgataaggtaattccagtggagaagctagtgaaaggacgtttccaggacaacctggattttattcaatggtttaagaaattctatgatgctaactacgatgggaaggagtatgatcctgtagaggcacgacaagggcaagatgcaattcctcctcctgaccctggtgaacagatcttcaacctgccaaaaaagtctcaccatgcaaactcccccacagcaggtgcagctaaatcaagtccagcagctaaaccaggatccacaccttctcgaccctcatcagccaaaagggcttcttccagtggctcagcatccaaatccgataaagatttagaaacgcaggtcatacagcttaatgaacaggtacattcattaaaacttgcccttgaaggcgtggaaaaggaaagggatttctactttgggaagttgagagagatcgagctactctgccaagaacacgggcaggaaaatgatgacctcgtgcagagactaatggacatcctgtatgcttcagaagaacacgagggccacacagaagagccggaagcagaggagcaagcccacgaacagcagcccccgcagcaggaagagtactgacccaccccggctgctcttgacacttccattgtgtgtgggaacgtttcttctggagaattggaacatgtgtggccccaagctcaacagaaaccagttgttcccaatctgccgttaccatcaacgcactgttgcatatgccagccactgcgcttggttcccattttctttgccaaggtgtattagcggacggccctctggccacctacccgagagatcgtagggtcacatacatccaacttcaccacttggctgcttgagattggttctgctcttttcttcatttctttccagaacaactctttcccaccccaacaccactgccaccacccctctttttatcctggtgtgaaacaatggtaatttgatatatggtatttatattggcatttttcaacccagtgtcactagatgtcacacacatttgtggtgctttgatgtttgcaagtctaacctctgaacataaatttggtcaaataattggaacaaagggaaacagatacttgatatgaaagccataatgacggtgacttgtgtcgtgggggaaaacataaggtcattttctccctctactcacaatactaaagggaaaaaatggattcaaagctaggatttcagggcccagcagtgttcctccatcagcatgttagacaactacacagtatgttgttagttttgaaagacattcactcaaggaaaacaccatctcaactttgcccgctcaccatgtcccttgcccccatgtagcccatttcccaggttatgctcttttctttctcagggtcctctttggtgggcagccactccccgagatgttgccatcagttttctgcagtccaaagagggtatggttaggtacgggtcttcctgcctcattcctcttcctctttgtgtaggtttcagccacaaaactgtcattcactctaggggacccctactaaagggtaacttcaggtgtgcagccctgagctccaaggctctgcaccatgccacacacttgctgtaaggctagaagtgaagaccttattaataggagcataattgcgagggagaatcatggttctgcagtctggtgtagacactggaataacagcacagaaaaatctatgactcccaatatcttctagaataaagaattttccctctttaacacaagggccctccttgtcattgaccttagctaaaccatggcaattcataaatagaggaaacattaatgaattaaaagcattccttattttttaactaatatttgtacattttcttagtctctttccaagtctttgcctcttttttttctttatttttattttttcctttgacagatggtatcccttcctggatcattcatttcaccttggtttctaactttaggtttactttcacttgttatttgacttagcaggtgcaacaaaaacaagaaacaaatgtgcccaccccactttccgcttaactgaaaagcttaaaataaatttctgaattatgtatcctgaagctttgaaatttctttattaatcgatgaaatatgaattctaaattctagcattgaagcttttcaccaaaagaagtctctccaaaataaatcttttgcagcaaagtgatatttattgagttatgtggaaaagatggcttgtatttttcagattattacaacacactgtgcagaattagacagatgttccgtggtgtttggtttccctttcttctctctcctgctcactctgcattatagcagcagcttatttctctaaggctggacagcctggctctcggcagtgacgtcctcccacacctggtcacaagtagtagtggctgtgctatacccagcatcatgcttaacagcgtgttgcccttctgagcctgttgtactcactgatctctttaaaaacaaaaaatagctcttgtaaaaggtcacaataactctatgcacctgatactgcagtggttcctaggccattcttcatctgctctggacatctcagtcatacccaatgctcagtggatcatgaccaaactcctgtcatgtggatgcacgtgagtgggtagcagggagtcaggatcctgccttctccagcaaccccttactgctgtataacttgcataagcctccctggtgactcttgcaggaaccactccattgccctccagctccccagccttctcagttataaacatgctggccagatctcttagcctgcaaagagaactttccccagtcaccatagaccattctccttcctgaaggcttggggcagaccattcgtttatttagagaagagctatacattcttctttctggtcccatcttaaacgtcttctgttgtgctgcaccccagatggtgtctcagatgctttggggaatctttaacagctgaatttgagtcagtcctcttaggctgcacctccagcctctgcagatcccccctcatttcccatggatggtgggaccccattattctctcatctcggcattcagggaacagtttccttagcggcccctggtcacatgtcatcgggctgggcaggaagcgtccctgattgcgtgctccacttctccctctcaggaagcccagtttcatccttagtaccccccctcgtgcccgctgtcggctggttatagcacttccactgctactgtcagataggaagtgatcgaagcagggggcaaagagaaagcccatatttgttctaagcagaaaagcaggaaaaaaaaaaaaaaaaaagaaagaaaaacacctgttgacctgagagaagtaaattccagaagggaaccaagaactcttcccttccctggtgagtatttccattattccgttaaggtttaatatgcattcagattacttttactaaataggacaccataaagcttttgttatatattaaatgtaaactgaaaggaatgtaaacatatgtattgttaattataaatatagataagtaatgacataatagatgaaaaagtcttattcagatgtatcacattcattttacattacccacctattgtcgcatggtagaatagttttttgtctctgaatatgtgaataacttgacttgcattgatctttttacatatttaataaaaaaaaaagtatatgttaaaa

SEQ ID NO: 154021 - DNA, 4080 bp, Homo sapiens
  Payload ID: 10269
  Gene Symbol: MAPRE2
  Gene Name: microtubule-associated protein, RP/EB family, member 2
  Uniprot ID: Q15555
  ENST ID: ENST00000589699
  CDS Start-End: 125-979
gcgttcctacaggtaatggggctggcacgagagcagcgccggggaccgccgtgagggcgcgcggaaatccagcccgttatataatggagcagacactgcctgcgacccctgctgcagttggggaatggcggtcaatgtgtattctacctcgataacccaagagactatgagcagacatgacatcattgcatgggttaatgacatagtatctttaaactacacaaaagtggaacagctttgttcaggagcggcctattgccaattcatggacatgctcttccctggctgcattagtttgaagaaagtaaaatttcaagcaaagctggaacatgaatatattcacaattttaaacttctgcaagcatcatttaagcgaatgaacgttgataaggtaattccagtggagaagctagtgaaaggacgtttccaggacaacctggattttattcaatggtttaagaaattctatgatgctaactacgatgggaaggagtatgatcctgtagaggcacgacaagggcaagatgcaattcctcctcctgaccctggtgaacagatcttcaacctgccaaaaaagtctcaccatgcaaactcccccacagcaggtgcagctaaatcaagtccagcagctaaaccaggatccacaccttctcgaccctcatcagccaaaagggcttcttccagtggctcagcatccaaatccgataaagatttagaaacgcaggtcatacagcttaatgaacaggtacattcattaaaacttgcccttgaaggcgtggaaaaggaaagggatttctactttgggaagttgagagagatcgagctactctgccaagaacacgggcaggaaaatgatgacctcgtgcagagactaatggacatcctgtatgcttcagaagaacacgagggccacacagaagagccggaagcagaggagcaagcccacgaacagcagcccccgcagcaggaagagtactgacccaccccggctgctcttgacacttccattgtgtgtgggaacgtttcttctggagaattggaacatgtgtggccccaagctcaacagaaaccagttgttcccaatctgccgttaccatcaacgcactgttgcatatgccagccactgcgcttggttcccattttctttgccaaggtgtattagcggacggccctctggccacctacccgagagatcgtagggtcacatacatccaacttcaccacttggctgcttgagattggttctgctcttttcttcatttctttccagaacaactctttcccaccccaacaccactgccaccacccctctttttatcctggtgtgaaacaatggtaatttgatatatggtatttatattggcatttttcaacccagtgtcactagatgtcacacacatttgtggtgctttgatgtttgcaagtctaacctctgaacataaatttggtcaaataattggaacaaagggaaacagatacttgatatgaaagccataatgacggtgacttgtgtcgtgggggaaaacataaggtcattttctccctctactcacaatactaaagggaaaaaatggattcaaagctaggatttcagggcccagcagtgttcctccatcagcatgttagacaactacacagtatgttgttagttttgaaagacattcactcaaggaaaacaccatctcaactttgcccgctcaccatgtcccttgcccccatgtagcccatttcccaggttatgctcttttctttctcagggtcctctttggtgggcagccactccccgagatgttgccatcagttttctgcagtccaaagagggtatggttaggtacgggtcttcctgcctcattcctcttcctctttgtgtaggtttcagccacaaaactgtcattcactctaggggacccctactaaagggtaacttcaggtgtgcagccctgagctccaaggctctgcaccatgccacacacttgctgtaaggctagaagtgaagaccttattaataggagcataattgcgagggagaatcatggttctgcagtctggtgtagacactggaataacagcacagaaaaatctatgactcccaatatcttctagaataaagaattttccctctttaacacaagggccctccttgtcattgaccttagctaaaccatggcaattcataaatagaggaaacattaatgaattaaaagcattccttattttttaactaatatttgtacattttcttagtctctttccaagtctttgcctcttttttttctttatttttattttttcctttgacagatggtatcccttcctggatcattcatttcaccttggtttctaactttaggtttactttcacttgttatttgacttagcaggtgcaacaaaaacaagaaacaaatgtgcccaccccactttccgcttaactgaaaagcttaaaataaatttctgaattatgtatcctgaagctttgaaatttctttattaatcgatgaaatatgaattctaaattctagcattgaagcttttcaccaaaagaagtctctccaaaataaatcttttgcagcaaagtgatatttattgagttatgtggaaaagatggcttgtatttttcagattattacaacacactgtgcagaattagacagatgttccgtggtgtttggtttccctttcttctctctcctgctcactctgcattatagcagcagcttatttctctaaggctggacagcctggctctcggcagtgacgtcctcccacacctggtcacaagtagtagtggctgtgctatacccagcatcatgcttaacagcgtgttgcccttctgagcctgttgtactcactgatctctttaaaaacaaaaaatagctcttgtaaaaggtcacaataactctatgcacctgatactgcagtggttcctaggccattcttcatctgctctggacatctcagtcatacccaatgctcagtggatcatgaccaaactcctgtcatgtggatgcacgtgagtgggtagcagggagtcaggatcctgccttctccagcaaccccttactgctgtataacttgcataagcctccctggtgactcttgcaggaaccactccattgccctccagctccccagccttctcagttataaacatgctggccagatctcttagcctgcaaagagaactttccccagtcaccatagaccattctccttcctgaaggcttggggcagaccattcgtttatttagagaagagctatacattcttctttctggtcccatcttaaacgtcttctgttgtgctgcaccccagatggtgtctcagatgctttggggaatctttaacagctgaatttgagtcagtcctcttaggctgcacctccagcctctgcagatcccccctcatttcccatggatggtgggaccccattattctctcatctcggcattcagggaacagtttccttagcggcccctggtcacatgtcatcgggctgggcaggaagcgtccctgattgcgtgctccacttctccctctcaggaagcccagtttcatccttagtaccccccctcgtgcccgctgtcggctggttatagcacttccactgctactgtcagataggaagtgatcgaagcagggggcaaagagaaagcccatatttgttctaagcagaaaagcaggaaaaaaaaaaaaaaaaaagaaagaaaaacacctgttgacctgagagaagtaaattccagaagggaaccaagaactcttcccttccctggtgagtatttccattattccgttaaggtttaatatgcattcagattacttttactaaataggacaccataaagcttttgttatatattaaatgtaaactgaaaggaatgtaaacatatgtattgttaattataaatatagataagtaatgacataatagatgaaaaagtcttattcagatgtatcacattcattttacattacccacctattgtcgcatggtagaatagttttttgtctctgaatatgtgaataacttgacttgcattgatctttttacatatttaataaaaaaaaaagtatatgttaaaa

SEQ ID NO: 154022 - DNA, 553 bp, Homo sapiens
  Payload ID: 10269
  Gene Symbol: MAPRE2
  Gene Name: microtubule-associated protein, RP/EB family, member 2
  ENST ID: ENST00000589180
  CDS Start-End: 151-553
agaggaaggaggcgacagcgccggagcagtgtcctgtttcccagaggaacagttcatttcaacagccagggagaaagcctggatgctcaagttggggaatggcggtcaatgtgtattctacctcgataacccaagagactatgagcagacatgacatcattgcatggtttgaagaaagtaaaatttcaagcaaagctggaacatgaatatattcacaattttaaacttctgcaagcatcatttaagcgaatgaacgttgataaggtaattccagtggagaagctagtgaaaggacgtttccaggacaacctggattttattcaatggtttaagaaattctatgatgctaactacgatgggaaggagtatgatcctgtagaggcacgacaagggcaagatgcaattcctcctcctgaccctggtgaacagatcttcaacctgccaaaaaagtctcaccatgcaaactcccccacagcaggtgcagctaaatcaagtccagcagctaaaccaggatccacaccttctcgaccctcatcagccaaaagggcttctt

SEQ ID NO: 154023 - DNA, 584 bp, Homo sapiens
  Payload ID: 10269
  Gene Symbol: MAPRE2
  Gene Name: microtubule-associated protein, RP/EB family, member 2
  ENST ID: ENST00000587359
  CDS Start-End: 351-584
gaaggaggcgacagcgccggagcagggctgcagttgactattataggatgtggtttcctgcaacatgcctgattttgaagaagggtgatctacacactgggaatgaagccacagagcatgtatgttacatgtagctgctggctatatatgtccacgtcagccacacactcccttctgctcctcagaaccttaaagttctcctcatggctggggaacagtgatgtgctccagggctccaagcaatggattcctcagcagacattgctctgtgaaatcaaaagtgtcctgtttcccagaggaacagttcatttcaacagccagggagaaagcctggatgctcaagttggggaatggcggtcaatgtgtattctacctcgataacccaagagactatgagcagacatgacatcattgcatgggttaatgacatagtatctttaaactacacaaaagtggaacagctttgttcaggagcggcctattgccaattcatggacatgctcttccctggctgcattagtttgaagaaagtaaaatttcaagcaaagctggaacatgaatatattcacaattttaaacttctg

SEQ ID NO: 154024 - DNA, 803 bp, Homo sapiens
  Payload ID: 10269
  Gene Symbol: MAPRE2
  Gene Name: microtubule-associated protein, RP/EB family, member 2
  ENST ID: ENST00000591734
  CDS Start-End: 222-803
ctctcgggtggactcccggagcggcggcggcggcggcggtggcagactgcgagtcacgtgcgacagaggaggcggagcacggcggccgggtgggtggagaaaacaaagcccccagctgtcagcagaggaaggaggcgacagcgccggagcagtgtcctgtttcccagaggaacagttcatttcaacagccagggagaaagcctggatgctcaagttggggaatggcggtcaatgtgtattctacctcgataacccaagagactatgagcagacatgacatcattgcatgggttaatgacatagtatctttaaactacacaaaagtggaacagctttgttcaggagcggcctattgccaattcatggacatgctcttccctggctgcattagtttgaagaaagtaaaatttcaagcaaagctggaacatgaatatattcacaattttaaacttctgcaagcatcatttaagcgaatgaacgttgataaggtaattccagtggagaagctagtgaaaggacgtttccaggacaacctggattttattcaatggtttaagaaattctatgatgctaactacgatgggaaggagtatgatcctgtagaggcacgacaagggcaagatgcaattcctcctcctgaccctggtgaacagatcttcaacctgccaaaaaagtctcaccatgcaaactcccccacagcaggtgcagctaaatcaagtccagcagctaaaccaggatccacaccttctcgaccctcatcagccaaaagggcttcttccagtggctcagcatccaaatccgat

SEQ ID NO: 154025 - DNA, 1389 bp, Homo sapiens
  Payload ID: 10269
  Gene Symbol: MAPRE2
  Gene Name: microtubule-associated protein, RP/EB family, member 2
  Uniprot ID: Q15555
  ENST ID: ENST00000588910
  CDS Start-End: 110-889
caggcggcaggcacggtccgtgcggagcaggcgagcgagcgggaagacgcagccaccttcctcaccagccagcccacagcggtttgttccccttctcgggagtgcgccaatgcctgggccgacccaaaccctgtccccaaatggcgagaacaacaacgacatcatccaggataataacgggaccatcattcctttccggaagcacacagtgcgcggggagcgttcctacagttggggaatggcggtcaatgtgtattctacctcgataacccaagagactatgagcagacatgacatcattgcatgggttaatgacatagtatctttaaactacacaaaagtggaacagctttgttcaggagcggcctattgccaattcatggacatgctcttccctggctgcattagtttgaagaaagtaaaatttcaagcaaagctggaacatgaatatattcacaattttaaacttctgcaagcatcatttaagcgaatgaacgttgataaggtaattccagtggagaagctagtgaaaggacgtttccaggacaacctggattttattcaatggtttaagaaattctatgatgctaactacgatgggaaggagtatgatcctgtagaggcacgacaagggcaagatgcaattcctcctcctgaccctggtgaacagatcttcaacctgccaaaaaagtctcaccatgcaaactcccccacagcaggtgcagctaaatcaagtccagcagctaaaccaggatccacaccttctcgaccctcatcagccaaaagggcttcttccagtggctcagcatccaaatccgataaagatttagaaacgcaggtcatacagcttaatgaacaggtaatgcatcagctctggccacgcctctaggagcagtgacgtgtgtaagaggtagggggcctaggatcccctaggactggggtaagggagggaagggtaaggaagaatccttggtttcaagtaagtgagaataaaaagaattgttcgaagacaaaatcagtagcccatgatgaataaaaagtgttagtcacaaatctcaaagctgtacattaagatggggcagatggctcagccttgctgcagacttcaggctaccttcccctcccctgctcctcagggccgtcaagagctccaggctagaccgttgcccatcctgcccacttctggccattctagatagtgctgcattagggtgagtctgcctccctctctttttaaaggctgggtcagggttagtctgtctccctcccactctcttcttttttcccttcttcctttctttcttcagctattagtagttgagcttattctatatgaaagatattacgcttaatgctggtaatataaaggtagtaaaatagatacctttc

SEQ ID NO: 154026 - DNA, 543 bp, Homo sapiens
  Payload ID: 10269
  Gene Symbol: MAPRE2
  Gene Name: microtubule-associated protein, RP/EB family, member 2
  ENST ID: ENST00000588349
  CDS Start-End: 163-543
gtgcagaccggttgcgattgtggtcagacgcagcacctacttctaatctgaggacccgcgatttacacttttgctgaataggacactgtggaatgaaacagaacagagatcaaaagttcatttcaacagccagggagaaagcctggatgctcaagttggggaatggcggtcaatgtgtattctacctcgataacccaagagactatgagcagacatgacatcattgcatgggttaatgacatagtatctttaaactacacaaaagtggaacagctttgttcaggagcggcctattgccaattcatggacatgctcttccctggctgcattagtttgaagaaagtaaaatttcaagcaaagctggaacatgaatatattcacaattttaaacttctgcaagcatcatttaagcgaatgaacgttgataaggtaattccagtggagaagctagtgaaaggacgtttccaggacaacctggattttattcaatggtttaagaaattctatgatgctaactacgatgggaaggagtatgatcctgta

SEQ ID NO: 154027 - DNA, 1892 bp, Homo sapiens
  Payload ID: 10270
  Gene Symbol: MAPRE3
  Gene Name: microtubule-associated protein, RP/EB family, member 3
  Uniprot ID: Q9UPY8
  ENST ID: ENST00000233121
  CDS Start-End: 199-1044
agcggcggccgcatcgcgcctgcgcagtgccctcgtcccccgcagtctctgtgcgttgaagccggagaccgcggcggcctcagcgaggaccctccgccccggagccgccggccggagccgcagcctctgccgcagcgcccccgccacctgtcccctccccctccgcctccgccggagccgcctcgtgcactctggggtatggccgtcaatgtgtactccacatctgtgaccagtgaaaatctgagtcgccatgatatgcttgcatgggtcaacgactccctgcacctcaactataccaagatagaacagctttgttcaggggcagcctactgccagttcatggacatgctcttccccggctgtgtgcacttgaggaaagtgaagttccaggccaaactagagcacgaatacatccacaacttcaaggtgctgcaagcagctttcaagaagatgggtgttgacaaaatcattcctgtagagaaattagtgaaaggaaaattccaagataattttgagtttattcagtggtttaagaaattctttgacgcaaactatgatggaaaggattacaaccctctgctggcgcggcagggccaggacgtagcgccacctcctaacccaggtgatcagatcttcaacaaatccaagaaactcattggcacagcagttccacagaggacgtcccccacaggcccaaaaaacatgcagacctctggccggctgagcaatgtggcccccccctgcattctccggaagaatcctccatcagcccgaaatggcggccatgagactgatgcccaaattcttgaactcaaccaacagctggtggacttgaagctgacagtggatgggctggagaaggaacgtgacttctacttcagcaaacttcgtgacatcgagctcatctgccaggagcatgaaagtgaaaacagccctgttatctcaggcatcattggcatcctctatgccacagaggaaggattcgcaccccctgaggacgatgagattgaagagcatcaacaagaagaccaggacgagtactgagggcggccgcagccctggctgactgcacagcttccccgtgcctccctccctgctccactcccacattatagtcctttcctaacacggtcggccgggtgctttgtgtcagtgctgcagcactggggagccaggcgaggggggcttgggggcatggggccggaaagcaggcagaagcccgtcctgggtggtgctggcccagttggtgggacccctgtccacacccaccctatttatttccgttgtctctctgctgtgtcgcccaacacttcccagggtgctgctgccacccgccccagccagccacctgctcctgacagccagcagctgtgtatttgacaaagtcattggtatatttttacttactggattctccttgcactttacctgttcttttccagagctgacagcacgggctccggcgcagtgtgcctggcttggcttcccttccccatggctgggggctggggtaggactcacccattctaatttattttgtcttttggcttctcagtagctaaggggaaggctgatgtcaggagagggagagggggctgaggaggtagtgctgtaggcccagggggtcagggaaagggaggggggcatgtgagggatggaaatgacctcctggcaccaggctcacccacccaaggccccctgccccagcactgaatcccagcgctgccctgaggcccccagccactccctccagcagcctggttcaccacacaaactctgcctggaccccattgtctgtctgcttcccacctgccctccccaccccctgcccctcgggcaccagcctgcatatgtgttcacttttatttaaataaacttgtgtggtaaaagta

SEQ ID NO: 154028 - DNA, 1801 bp, Homo sapiens
  Payload ID: 10270
  Gene Symbol: MAPRE3
  Gene Name: microtubule-associated protein, RP/EB family, member 3
  Uniprot ID: Q9UPY8
  ENST ID: ENST00000405074
  CDS Start-End: 153-953
ctctgtgcgttgaagccggagaccgcggcggcctcagcgaggaccctccgccccggagccgccggccggagccgcagcctctgccgcagcgcccccgccacctgtcccctccccctccgcctccgccggagccgcctcgtgcactctggggtatggccgtcaatgtgtactccacatctgtgaccagtgaaaatctgagtcgccatgatatgcttgcatgggtcaacgactccctgcacctcaactataccaagatagaacagctttgttcaggggcagcctactgccagttcatggacatgctcttccccggctgtgtgcacttgaggaaagtgaagttccaggccaaactagagcacgaatacatccacaacttcaaggtgctgcaagcagctttcaagaagatgggtgttgacaaaatcattcctgtagagaaattagtgaaaggaaaattccaagataattttgagtttattcagtggtttaagaaattctttgacgcaaactatgatggaaaggattacaaccctctgctggcgcggcagggccaggacgtagcgccacctcctaacccagttccacagaggacgtcccccacaggcccaaaaaacatgcagacctctggccggctgagcaatgtggcccccccctgcattctccggaagaatcctccatcagcccgaaatggcggccatgagactgatgcccaaattcttgaactcaaccaacagctggtggacttgaagctgacagtggatgggctggagaaggaacgtgacttctacttcagcaaacttcgtgacatcgagctcatctgccaggagcatgaaagtgaaaacagccctgttatctcaggcatcattggcatcctctatgccacagaggaaggattcgcaccccctgaggacgatgagattgaagagcatcaacaagaagaccaggacgagtactgagggcggccgcagccctggctgactgcacagcttccccgtgcctccctccctgctccactcccacattatagtcctttcctaacacggtcggccgggtgctttgtgtcagtgctgcagcactggggagccaggcgaggggggcttgggggcatggggccggaaagcaggcagaagcccgtcctgggtggtgctggcccagttggtgggacccctgtccacacccaccctatttatttccgttgtctctctgctgtgtcgcccaacacttcccagggtgctgctgccacccgccccagccagccacctgctcctgacagccagcagctgtgtatttgacaaagtcattggtatatttttacttactggattctccttgcactttacctgttcttttccagagctgacagcacgggctccggcgcagtgtgcctggcttggcttcccttccccatggctgggggctggggtaggactcacccattctaatttattttgtcttttggcttctcagtagctaaggggaaggctgatgtcaggagagggagagggggctgaggaggtagtgctgtaggcccagggggtcagggaaagggaggggggcatgtgagggatggaaatgacctcctggcaccaggctcacccacccaaggccccctgccccagcactgaatcccagcgctgccctgaggcccccagccactccctccagcagcctggttcaccacacaaactctgcctggaccccattgtctgtctgcttcccacctgccctccccaccccctgcccctcgggcaccagcctgcatatgtgttcacttttatttaaataaacttgtgtggtaaaagta

SEQ ID NO: 154029 - DNA, 1001 bp, Homo sapiens
  Payload ID: 10270
  Gene Symbol: MAPRE3
  Gene Name: microtubule-associated protein, RP/EB family, member 3
  Uniprot ID: Q9UPY8
  ENST ID: ENST00000402218
  CDS Start-End: 194-994
caggggtaggggtagcaattttgcagattttccaaacaggtgacttcagcccccgggcctgggcaggaaggggtagcccagtgacaatgggcatagtcccacttcaggaacgggaaacgtgttggctggctctgtggagttctctctcttctgatcccacagcatctgttccagttgtcttggccgctggggtatggccgtcaatgtgtactccacatctgtgaccagtgaaaatctgagtcgccatgatatgcttgcatgggtcaacgactccctgcacctcaactataccaagatagaacagctttgttcaggggcagcctactgccagttcatggacatgctcttccccggctgtgtgcacttgaggaaagtgaagttccaggccaaactagagcacgaatacatccacaacttcaaggtgctgcaagcagctttcaagaagatgggtgttgacaaaatcattcctgtagagaaattagtgaaaggaaaattccaagataattttgagtttattcagtggtttaagaaattctttgacgcaaactatgatggaaaggattacaaccctctgctggcgcggcagggccaggacgtagcgccacctcctaacccagttccacagaggacgtcccccacaggcccaaaaaacatgcagacctctggccggctgagcaatgtggcccccccctgcattctccggaagaatcctccatcagcccgaaatggcggccatgagactgatgcccaaattcttgaactcaaccaacagctggtggacttgaagctgacagtggatgggctggagaaggaacgtgacttctacttcagcaaacttcgtgacatcgagctcatctgccaggagcatgaaagtgaaaacagccctgttatctcaggcatcattggcatcctctatgccacagaggaaggattcgcaccccctgaggacgatgagattgaagagcatcaacaagaagaccaggacgagtactgagggcggc

SEQ ID NO: 154030 - DNA, 878 bp, Homo sapiens
  Payload ID: 10270
  Gene Symbol: MAPRE3
  Gene Name: microtubule-associated protein, RP/EB family, member 3
  ENST ID: ENST00000458529
  CDS Start-End: 225-878
caagcccagaataacctggatgtgtgactcacaggggtaggggtagcaattttgcagattttccaaacaggtgacttcagcccccgggcctgggcaggaaggggtagcccagtgacaatgggcatagtcccacttcaggaacgggaaacgtgttggctggctctgtggagttctctctcttctgatcccacagcatctgttccagttgtcttggccgctggggtatggccgtcaatgtgtactccacatctgtgaccagtgaaaatctgagtcgccatgatatgcttgcatgggtcaacgactccctgcacctcaactataccaagatagaacagctttgttcaggggcagcctactgccagttcatggacatgctcttccccggctgtgtgcacttgaggaaagtgaagttccaggccaaactagagcacgaatacatccacaacttcaaggtgctgcaagcagctttcaagaagatgggtgttgacaaaatcattcctgtagagaaattagtgaaaggaaaattccaagataattttgagtttattcagtggtttaagaaattctttgacgcaaactatgatggaaaggattacaaccctctgctggcgcggcagggccaggacgtagcgccacctcctaacccaggtgatcagatcttcaacaaatccaagaaactcattggcacagcagttccacagaggacgtcccccacaggcccaaaaaacatgcagacctctggccggctgagcaatgtggcccccccctgcattctccggaagaatcctccatcagcccgaaatggcggccatgagactgatgcccaaattcttgaactcaaccaacagctggtggacttgaagctgacagtggatggg

SEQ ID NO: 154031 - DNA, 2536 bp, Homo sapiens
  Payload ID: 10271
  Gene Symbol: MID1IP1
  Gene Name: MID1 interacting protein 1
  Uniprot ID: Q9NPA3
  ENST ID: ENST00000336949
  CDS Start-End: 946-1497
ctgctgccggcccctcttccccgacggctaataataaacccgggttcctgtttcccggccgcggccactccagattcggggctgaggggctcactctgcaaccaaggcacgtgcattctggtcatcccacgcggggagcgcgcgcaaggcccgcccagcccccacatgccagccccaccctccagtcggtccggacgccgacgcctttttgaccctcgctgtgcccggccctcctcatctggcctgcccagggcttggtgctggcggggtccagctgctccaatccctcctcctctgctctgccctgccctgccctggcctgccccggcgccctccctcagcccgggtatcaggcgagaggcggagctggcccggcgcgccccgcccccgctgtagaaagggccgggcgagtgttactcgcggtcatcccggcctgggccttttatctcggtgctgccgggggaggcgggaggaggagacaccaggggtggccctgagcgccggcgacacctttcctggactataaattgagcacctgggatgggtagggggccaacgcagtcaccgccgtccgcagtcacagtccagccactgaccgcagcagcgcccttgcgtagcagccgcttgcagcgagaacactgaattgccaacgagcaggagagtctcaaggcgcaagaggaggccagggctcgacccacagagcaccctcagccatcgcgagtttccgggcgccaaagccaggagaagccgcccatcccgcagggccggtctgccagcgagacgagagttggcgagggcggaggagtgccgggaatcccgccacaccggctatagccaggcccccagcgcgggccttggagagcgcgtgaaggcgggcatccccttgacccggccgaccatccccgtgcccctgcgtccctgcgctccaacgtccgcgcggccaccatgatgcaaatctgcgacacctacaaccagaagcactcgctctttaacgccatgaatcgcttcattggcgccgtgaacaacatggaccagacggtgatggtgcccagcttgctgcgcgacgtgcccctggctgaccccgggttagacaacgatgttggcgtggaggtaggcggcagtggcggctgcctggaggagcgcacgcccccagtccccgactcgggaagcgccaatggcagctttttcgcgccctctcgggacatgtacagccactacgtgcttctcaagtccatccgcaacgacatcgagtggggggtcctgcaccagccgcctccaccggctgggagcgaggagggcagtgcctggaagtccaaggacatcctggtggacctgggccacttggagggtgcggacgccggcgaagaagacctggaacagcagttccactaccacctgcgcgggctgcacactgtgctctcgaaactcacgcgcaaagccaacatcctcactaacagatacaagcaggagatcggcttcggcaattggggccactgaggcgtggcgcccgtggctgcccagcaccttcttcgacccatctcaccctctctcattcctcaaagctttttttttttttcctggctggggggcgggaagggcagactgcaaactggggggctgcgtacgtgcaggaggcgcggtggggctgcgtggaggagggggccacgtgtgagagagaagaaaatggtggccggagatgggagggcccaaggaacctcctgggagggggcctgcattctatgttggtgggaatgggactgggctgacgccctgcattcagcctgtgcctttcctggggtttcttttctgttcttttcggaggagagggcccgagaaggggccataccagggcgcggcgctgggttgccacacttgggaaagcagcccggagctgggtgctggggaaggcggggcgcgtagcctcccgccgccctgcggttgggccggtggaggcccaggcgttgctaggattgcatcagttttcctgtttgcactatttctttttgtaacattggccctgtgtgaagtatttcgaatctcctccttgctctgaaacttcagcgattccattgtgataagcgcacaaacagcactgtctgtcggtaatcggtactactttattaatgattttctgttacactgtatagtagtcctatggcacccccaccccatccctttcgtgccactcccgtccccacccccaccccagtgtgtataagctggcatttcgccagcttgtacgtagcttgccactcagtgaaaataataacattattatgagaaagtggacttaaccgaaatggaaccaactgacattctatcgtgttgtacatagaatgatgaagggttccactgttgttgtatgtcttaaatttatttaaaactttttttaatccagatgtagactatattctaaaaaataaaaaagcaaatgtgtcaactaaattggacaagcgtctggtcctcattaatctgccaatgaatggtttcgtcattaaataaaaatcaatttaattgatttactagcaaaagtaaa

SEQ ID NO: 154032 - DNA, 1889 bp, Homo sapiens
  Payload ID: 10271
  Gene Symbol: MID1IP1
  Gene Name: MID1 interacting protein 1
  Uniprot ID: Q9NPA3
  ENST ID: ENST00000378474
  CDS Start-End: 403-954
cggaccttttccttctggagtttccccggcgggttcacagtccagccactgaccgcagcagcgcccttgcgtagcagccgcttgcagcgagaacactgaattgccaacgagcaggagagtctcaaggcgcaagaggaggccagggctcgacccacagagcaccctcagccatcgcgagtttccgggcgccaaagccaggagaagccgcccatcccgcagggccggtctgccagcgagacgagagttggcgagggcggaggagtgccgggaatcccgccacaccggctatagccaggcccccagcgcgggccttggagagcgcgtgaaggcgggcatccccttgacccggccgaccatccccgtgcccctgcgtccctgcgctccaacgtccgcgcggccaccatgatgcaaatctgcgacacctacaaccagaagcactcgctctttaacgccatgaatcgcttcattggcgccgtgaacaacatggaccagacggtgatggtgcccagcttgctgcgcgacgtgcccctggctgaccccgggttagacaacgatgttggcgtggaggtaggcggcagtggcggctgcctggaggagcgcacgcccccagtccccgactcgggaagcgccaatggcagctttttcgcgccctctcgggacatgtacagccactacgtgcttctcaagtccatccgcaacgacatcgagtggggggtcctgcaccagccgcctccaccggctgggagcgaggagggcagtgcctggaagtccaaggacatcctggtggacctgggccacttggagggtgcggacgccggcgaagaagacctggaacagcagttccactaccacctgcgcgggctgcacactgtgctctcgaaactcacgcgcaaagccaacatcctcactaacagatacaagcaggagatcggcttcggcaattggggccactgaggcgtggcgcccgtggctgcccagcaccttcttcgacccatctcaccctctctcattcctcaaagctttttttttttttcctggctggggggcgggaagggcagactgcaaactggggggctgcgtacgtgcaggaggcgcggtggggctgcgtggaggagggggccacgtgtgagagagaagaaaatggtggccggagatgggagggcccaaggaacctcctgggagggggcctgcattctatgttggtgggaatgggactgggctgacgccctgcattcagcctgtgcctttcctggggtttcttttctgttcttttcggaggagagggcccgagaaggggccataccagggcgcggcgctgggttgccacacttgggaaagcagcccggagctgggtgctggggaaggcggggcgcgtagcctcccgccgccctgcggttgggccggtggaggcccaggcgttgctaggattgcatcagttttcctgtttgcactatttctttttgtaacattggccctgtgtgaagtatttcgaatctcctccttgctctgaaacttcagcgattccattgtgataagcgcacaaacagcactgtctgtcggtaatcggtactactttattaatgattttctgttacactgtatagtagtcctatggcacccccaccccatccctttcgtgccactcccgtccccacccccaccccagtgtgtataagctggcatttcgccagcttgtacgtagcttgccactcagtgaaaataataacattattatgagaaagtggacttaaccgaaatggaaccaactgacattctatcgtgttgtacatagaatgatgaagggttccactgttgttgtatgtcttaaatttatttaaaactttttttaatccagatgtagactatattctaaaaaataaaaaagcaaa

SEQ ID NO: 154033 - DNA, 1902 bp, Homo sapiens
  Payload ID: 10271
  Gene Symbol: MID1IP1
  Gene Name: MID1 interacting protein 1
  Uniprot ID: Q9NPA3
  ENST ID: ENST00000457894
  CDS Start-End: 321-872
aagggcccagagctctggccggcggaccttttccttctggagtttccccggcgggtgccagggctcgacccacagagcaccctcagccatcgcgagtttccgggcgccaaagccaggagaagccgcccatcccgcagggccggtctgccagcgagacgagagttggcgagggcggaggagtgccgggaatcccgccacaccggctatagccaggcccccagcgcgggccttggagagcgcgtgaaggcgggcatccccttgacccggccgaccatccccgtgcccctgcgtccctgcgctccaacgtccgcgcggccaccatgatgcaaatctgcgacacctacaaccagaagcactcgctctttaacgccatgaatcgcttcattggcgccgtgaacaacatggaccagacggtgatggtgcccagcttgctgcgcgacgtgcccctggctgaccccgggttagacaacgatgttggcgtggaggtaggcggcagtggcggctgcctggaggagcgcacgcccccagtccccgactcgggaagcgccaatggcagctttttcgcgccctctcgggacatgtacagccactacgtgcttctcaagtccatccgcaacgacatcgagtggggggtcctgcaccagccgcctccaccggctgggagcgaggagggcagtgcctggaagtccaaggacatcctggtggacctgggccacttggagggtgcggacgccggcgaagaagacctggaacagcagttccactaccacctgcgcgggctgcacactgtgctctcgaaactcacgcgcaaagccaacatcctcactaacagatacaagcaggagatcggcttcggcaattggggccactgaggcgtggcgcccgtggctgcccagcaccttcttcgacccatctcaccctctctcattcctcaaagctttttttttttttcctggctggggggcgggaagggcagactgcaaactggggggctgcgtacgtgcaggaggcgcggtggggctgcgtggaggagggggccacgtgtgagagagaagaaaatggtggccggagatgggagggcccaaggaacctcctgggagggggcctgcattctatgttggtgggaatgggactgggctgacgccctgcattcagcctgtgcctttcctggggtttcttttctgttcttttcggaggagagggcccgagaaggggccataccagggcgcggcgctgggttgccacacttgggaaagcagcccggagctgggtgctggggaaggcggggcgcgtagcctcccgccgccctgcggttgggccggtggaggcccaggcgttgctaggattgcatcagttttcctgtttgcactatttctttttgtaacattggccctgtgtgaagtatttcgaatctcctccttgctctgaaacttcagcgattccattgtgataagcgcacaaacagcactgtctgtcggtaatcggtactactttattaatgattttctgttacactgtatagtagtcctatggcacccccaccccatccctttcgtgccactcccgtccccacccccaccccagtgtgtataagctggcatttcgccagcttgtacgtagcttgccactcagtgaaaataataacattattatgagaaagtggacttaaccgaaatggaaccaactgacattctatcgtgttgtacatagaatgatgaagggttccactgttgttgtatgtcttaaatttatttaaaactttttttaatccagatgtagactatattctaaaaaataaaaaagcaaatgtgtcaactaaattggacaagcgtctggtcctcattaatctgccaatgaatggtttcgtcattaaataaaaatcaatttaattgatttactagc

SEQ ID NO: 154034 - DNA, 3781 bp, Homo sapiens
  Payload ID: 10271
  Gene Symbol: MID1IP1
  Gene Name: MID1 interacting protein 1
  Uniprot ID: Q9NPA3
  ENST ID: ENST00000614558
  CDS Start-End: 2200-2751
aagggcccagagctctggccggcggaccttttccttctggagtttccccggcgggtattagtccttgtggcaccaagtcagaatttcattcaaaagacaattaggaagatggttttctatggaaaatatttaagtgtaggtcttaatgtgaaagaaagagggagagaaagaaacccctttattatgttctcccttccttaggcattttttgtcccgtgggaaaaaactgtactagggacagagacctctgttaagttttagagaaaagggatcttttttttttttatttgagacagagtcttgctctgtcgcccaggctggagtgcagtggcacgatctcggctcactgcaactccgcctcctgggttcaagcaattctcctgcttcatcctcccgagtagctgggattacaggcgctggccaccacgcccggctaatttttgtatttttagtagagaccgggtttcaccatgttggccaggctagtctggaacccctgactttgtgatccgcccgcctcggcctcccaaagtgctgggattacaggcgtgagccaccgtttcaggccgagaaaagggatttaaaatgagaagcttgaatcttattgaacataattgtaggactgccagagaggactggtggatgaggaatatggcaagggacatgagatgggaaaaattaaataggctgtggtttggaagtctcaaagtgaaattcaaggtgcaaggctcttaaaagttaaatccagcgattcggtacatagcttaggccctattaaatgacccagtgctttaagaactatcttttgaaaggaacacttcacacaagcaccctcaaaaataattagacacctccccatttctctgttaaatggtgaaagacacccaagactagacctaactactgtcaccctctcctggcctcttggcagccaaaaggccacatggcccaggctctccagcatcactgtgtagccgacttggacaaaaatggacttctccccattgccacttgcagatctcttcaaagaatcagcagatctgatagtgtgcccctcttcatccccggcaaccactgttaaaggaaagattgggaaagatcccaccccgccaggagggaggcaaaagcctctgacgctcccctccccccatagctgaccaaggccagggccactgcgggagcaccgcgcgtccacgtgcacccagcatgcccggtcaccctttattacgtaagagtcccaggatggagttgtacctgctgccggcccctcttccccgacggctaataataaacccgggttcctgtttcccggccgcggccactccagattcggggctgaggggctcactctgcaaccaaggcacgtgcattctggtcatcccacgcggggagcgcgcgcaaggcccgcccagcccccacatgccagccccaccctccagtcggtccggacgccgacgcctttttgaccctcgctgtgcccggccctcctcatctggcctgcccagggcttggtgctggcggggtccagctgctccaatccctcctcctctgctctgccctgccctgccctggcctgccccggcgccctccctcagcccgggtatcaggcgagaggcggagctggcccggcgcgccccgcccccgctgtagaaagggccgggcgagtgttactcgcggtcatcccggcctgggccttttatctcggtgctgccgggggaggcgggaggaggagacaccaggggtggccctgagcgccggcgacacctttcctggactataaattgagcacctgggatgggtagggggccaacgcagtcaccgccgtccgcagtcacagtccagccactgaccgcagcagcgcccttgcgtagcagccgcttgcagcgagaacactgaattgccaacgagcaggagagtctcaaggcgcaagaggaggccagggctcgacccacagagcaccctcagccatcgcgagtttccgggcgccaaagccaggagaagccgcccatcccgcagggccggtctgccagcgagacgagagttggcgagggcggaggagtgccgggaatcccgccacaccggctatagccaggcccccagcgcgggccttggagagcgcgtgaaggcgggcatccccttgacccggccgaccatccccgtgcccctgcgtccctgcgctccaacgtccgcgcggccaccatgatgcaaatctgcgacacctacaaccagaagcactcgctctttaacgccatgaatcgcttcattggcgccgtgaacaacatggaccagacggtgatggtgcccagcttgctgcgcgacgtgcccctggctgaccccgggttagacaacgatgttggcgtggaggtaggcggcagtggcggctgcctggaggagcgcacgcccccagtccccgactcgggaagcgccaatggcagctttttcgcgccctctcgggacatgtacagccactacgtgcttctcaagtccatccgcaacgacatcgagtggggggtcctgcaccagccgcctccaccggctgggagcgaggagggcagtgcctggaagtccaaggacatcctggtggacctgggccacttggagggtgcggacgccggcgaagaagacctggaacagcagttccactaccacctgcgcgggctgcacactgtgctctcgaaactcacgcgcaaagccaacatcctcactaacagatacaagcaggagatcggcttcggcaattggggccactgaggcgtggcgcccgtggctgcccagcaccttcttcgacccatctcaccctctctcattcctcaaagctttttttttttttcctggctggggggcgggaagggcagactgcaaactggggggctgcgtacgtgcaggaggcgcggtggggctgcgtggaggagggggccacgtgtgagagagaagaaaatggtggccggagatgggagggcccaaggaacctcctgggagggggcctgcattctatgttggtgggaatgggactgggctgacgccctgcattcagcctgtgcctttcctggggtttcttttctgttcttttcggaggagagggcccgagaaggggccataccagggcgcggcgctgggttgccacacttgggaaagcagcccggagctgggtgctggggaaggcggggcgcgtagcctcccgccgccctgcggttgggccggtggaggcccaggcgttgctaggattgcatcagttttcctgtttgcactatttctttttgtaacattggccctgtgtgaagtatttcgaatctcctccttgctctgaaacttcagcgattccattgtgataagcgcacaaacagcactgtctgtcggtaatcggtactactttattaatgattttctgttacactgtatagtagtcctatggcacccccaccccatccctttcgtgccactcccgtccccacccccaccccagtgtgtataagctggcatttcgccagcttgtacgtagcttgccactcagtgaaaataataacattattatgagaaagtggacttaaccgaaatggaaccaactgacattctatcgtgttgtacatagaatgatgaagggttccactgttgttgtatgtcttaaatttatttaaaactttttttaatccagatgtagactatattctaaaaaataaaaaagcaaatgtgtcaactaaattggacaagcgtctggtcctcattaatctgccaatgaatggtttcgtcattaaataaaaatcaatttaattgatttactagc

SEQ ID NO: 154035 - DNA, 18413 bp, Homo sapiens
  Payload ID: 10272
  Gene Symbol: MDN1
  Gene Name: midasin AAA ATPase 1
  Uniprot ID: Q9NU22
  ENST ID: ENST00000369393
  CDS Start-End: 117-16907
cgcctttcctgcgggcgtagttgctggctgctcgggcactgggacctcggcggcttggggacgctggccgcgaagtagggagcgcaggtggccgctcggggtgagggccctgggtcatggagcacttcttgctggaggtggcagccgcgccgctgcggttaatcgcagccaagaacgagaagagccgcagtgagttgggcaggttcttggccaagcaggtgtggacacctcaagatcgccagtgtgtcctgagtaccttagcacagttgcttttggataaggactgtactgtgctggttggtcgccagcttcgccctctccttttggatttgctggaaaggaatgccgaagccattaaagctggaggccaaatcaaccatgatctgcatgaacggctatgtgtgtcgatgagcaaactcattggtaaccatcctgatgtcctcccgtttgccctgagatatttcaaggacacatccccagtctttcaaagacttttcctagagagttcagatgctaatccagtacgctatggacgtaggaggatgaagctccgggacctaatggaagcagccttcaagtttctgcagcaggagcagtctgtgttccgggagctctgggactggagtgtgtgtgtccctctcctcagaagccatgacaccttggttcgctggtatacagccaattgtcttgctttggttacctgtatgaatgaagagcacaagttatcatttcttaagaagatatttaatagtgatgaattgatccatttcaggttgaggttattagaagaggcccagttgcaggacttggagaaggccttggttttggccaatccagaagtctccctttggcgtaagcagaaggagctgcagtacttacagggacatcttgtttcgtctgacctctcccctagggtgacagctgtttgtggtgtggtgctgcctgggcagctgccagcccctggagagctgggtggtaataggagttcttcacgtgaacaggagctggcccttaggtcttatgtgctggttgagtctgtctgcaaaagtcttcagaccctggctatggcggttgcttctcagaatgctgtgttgttggaaggaccaataggatgtggcaaaacttccttagttgaatatttagctgcagtgacaggtagaacaaagcctcctcagcttctcaaagtccagcttggagatcagactgacagtaagatgcttttggggatgtatcgctgcacagatgttcctggagagtttgtgtggcagcctggcaccctgacacaggcagccacaatgggccactggatccttctggaggatattgactatgcccccttagacgtggtttctgtgctgatccctctcttggagaatggagagctcttgattcctggccgaggtgactgtctgaaagtggcacctggatttcagttttttgcaaccaggagactcttgagctgtggaggaaattggtatcgaccgctaaacagtcatgctactttgctagacaaatattggaccaaaattcacctggataacctggataagagagaactgaatgaggttcttcagagcagatatcctagcctattggcagtggttgatcacctgcttgacatttatatccaacttactggagagaaacatcactcttggagtgatagttctgttggatgtgaacaggcacctgaagaagtttcagaagccagaagagaaaacaaaagaccaacccttgagggaagagaattatctctaagggatctgctgaattggtgtaataggattgcccatagctttgacagttcatctttatcagcatcattaaatatttttcaagaggctctagactgtttcacagcaatgctttctgagcatacaagcaaactgaaaatggcagaagttattggaagcaaattgaacatttctagaaaaaaggctgaattcttttgtcaactttataaaccagaaattgtgatcaatgagctagatttgcaagtgggtcgagtgcggcttctacggaaacaaagtgaggctgttcacctacagagggagaagttcactttcgctgctacacggccgtcctctgttctcatcgagcagcttgcagtgtgtgtcagcaaaggggagcctgtgttgctggtgggagagaccgggactggcaaaacctctaccatccaatacttggctcacattacaggccaccgtttgagggttgtcaatatgaatcaacaaagtgatactgcagacttgcttggaggttataaaccggtggaccataagcttatttggctacccttacgggaggcatttgaggaactctttgctcagacattttccaagaaacaaaactttacgttcttggggcacattcagacctgttacagacagaaacggtggcatgatctcctgagactaatgcagcatgtacacaagtctgctgttaacaaggatggaaaagacagtgaaactgggttactcataaaagagaaatgggaagcatttggtcttagactcaaccatgcccaacaacagatgaaaatgactgaaaataccttattgttcgcatttgtagagggtacattagctcaggctgtaaagaaaggagagtggatcttgttggatgagattaacttggctgctccagaaatactagaatgtctgagtggtttgcttgaaggatcttctggatccctggtgttgctggatcgaggagacacagagccactggttcggcatcctgacttccgtttatttgcctgtatgaatccagcaactgatgtaggcaaaagaaatctcccaccaggaataagaaacaggttcacagaactttatgtagaagaattagaaagcaaagaagacttacaggttcttattgtagattatctgaaaggattgagtgtgaacaagaatacagtgcaaggaatcataaacttctacacagctttgcggaaagagtctgggaccaaactggtggatggcactggccatagacctcactacagccttcggactctgtgccgggccctgcgatttgcagcctccaatccatgtggcaacattcagcgctcactctatgagggtttttgtttgggtttcttaacacagcttgacagggcatcacacccaatagttcagaagctcatctgtcaacacattgtccctggcaatgtcaagagtctgctgaagcagcctattccagagccaaaaggaggtcggcttatccaggttgaaggctactggattgcggtgggagacaaggagcctacaatagatgagacgtacattctgacatcttctgtgaagctgaacctgagagatatagtccgagttgtctctgcaggaacctatccagtgctgattcagggagagacatcagttggtaaaacaagcctgatccagtggctggctgcagctactggcaaccactgtgtgcgtattaataatcacgaacacacggatattcaggagtacattggttgttacacgtctgactcctcagggaagcttgtctttaaggaaggtgttcttattgatgccatgagaaaaggctattggattattttagatgaattaaatttggcccctactgatgtgttagaggcgctgaataggctgttggatgataaccgtgaattgctagtaacagaaacacaggaagttgttaaagcacaccctcggtttatgctttttgccacccaaaatcccccaggactttatggaggcagaaaggtcctttctagagccttcaggaatcggtttgtggaattgcactttgatgagttacctagctccgagttggaaacaatcttgcacaagcggtgtagtttgccaccctcctattgcagcaagttggttaaagtcatgctggatcttcagtcctatcgcagaagttcttcagtgtttgctggaaagcagggcttcatcacccttcgtgatctgttccgatgggctgaaagatacagattggctgagccgaccgagaaggagtatgactggctacagcatttagccaatgatggttatatgcttctggcaggtcgagtcaggaagcaggaggaaattgatgtgattcaagaagtccttgagaaacatttcaagaaaaaattgtgtcctcaatctcttttctccaaagaaaatgttctaaaattgctgggtaaattgtctactcagatatccacattggagtgtaactttggccatatcgtgtggactgagggcatgcggagactcgcgatgctagtgggaagggcattggaatttggtgaacctgtgctgctggttggagacactgggtgtgggaaaactactatctgtcaggtatttgcagccttggcaaatcagaaattatactctgtcagctgccacttacacatggagacatcagacttcctgggtggcctgcggccagtgagacaaaagccaaacgacaaggaagaaattgacacatcaagactctttgagtggcatgatgggcctctggttcaggccatgaaggaggacggctttttcctcttggatgagatctcattggccgatgactctgtcttggaaagactcaacagtgtccttgaagtagaaaagtctctggtattagctgaaaaaggcagtccagaggacaaggatagtgaaatagagctgttgactgctgggaaaaaatttcgtattctagcaaccatgaaccctgggggtgactttggaaaaaaggagctgtctcctgccttaagaaaccggtttacagaaatatggtgccctcaaagcacaagccgtgaagatttaattcagatcatcagtcataatcttcgtccaggattgtgtctgggcagaatagatcctaaagggtctgacatacctgaagtgatgctggatttcattgactggctgacccaccaagagtttggcagaaagtgtgtggtcagtatcagagatatcctgtcctgggttaacttcatgaacaaaatgggggaggaagctgctttgaaaaggccagagatcatctccactgtgacatcttttgtccatgctgcatgcctggtgtacatagatggaataggttcaggggtaacttcctctgggtttggtacagcccttttggcacgaaaagaatgtctgaaatttctaatcaagaggcttgccaagatagtacgacttacagaatatcagaaaaatgagttgaagatttatgacagaatgaaggccaaagaattcactggaatagataacctttggggaattcatccattttttataccaaggggacctgtcctacacaggaataatattgcagactatgcactcagtgcagggaccactgctatgaatgcacagaggctcttaagagctaccaaactgaagaagcccattctcctggagggttcccctggtgttggcaagacaagtttggtgggagcattagcaaaggcttcaggaaatacccttgttagaatcaacttatcagagcaaacggacatcacagacctgtttggagcagatctacctgttgaaggtggcaagggaggagagtttgcctggcgtgatggccccttactggcagctttgaaggcaggccattgggtggtgttggatgagcttaacctggcttctcagtctgtattggaaggactcaatgcttgttttgaccaccgaggagaaatctatgtgcctgagttaggaatgagctttcaagtgcagcatgaaaagacgaagatttttgggtgtcagaatccctttagacaaggaggtgggaggaaaggcttgcccaggtctttccttaacagattcactcaggtcttcgttgatccccttacagtaattgacatggagttcattgccagtactttgtttccagccattgagaaaaatattgttaagaaaatggttgctttcaataaccaaattgatcatgaagtgactgttgagaagaaatgggggcaaaaaggaggaccctgggaattcaacctccgggaccttttccgctggtgtcagttgatgctggttgaccagtcccctgggtgttatgatcctggtcagcatgtgtttttggtctatggtgaaagaatgagaaccgaagaggacaaaaaaaaggtcattgctgtattcaaggatgtgtttggttcaaattccaacccatacatgggaaccagactatttcgtatcactccctatgatgttcagttgggctactcagtcctttcccgtgggagctgtgttcctcacccgtcccgccatcccctgttgctcctgcaccagtcattccaacccctggagtcaatcatgaagtgtgtgcagatgagctggatggtcatcctggtcgggccagcctctgtgggcaagaccagcctggtccagcttctggcacaccttactggccacacattaaagatcatggctatgaacagtgcaatggatactactgagctgctgggtggatttgagcaggttgatcttatacgaccttggaggaggctgctagagaaggtggagggaactgtaagggcactgttaagggatagcctccttatcagtgctgatgatgcagaagtagtgctgcgagcctggagtcattttcttctgacatataagcctaagtgtcttggagaaggtggtaaagctatcacgatggagattgtcaacaaactagaagcagtgttattgcttatgcagcgactcaacaataaaatcaactcatactgcaaggcagagtttgccaaacttgttgaagagttccgaagctttggtgtgaagcttacgcagttggccagtggccatagccatggcacatttgaatgggttgacagcatgttggttcaggccctgaagtctggagactggcttctgatggacaatgttaacttctgcaacccatcagtgttggatcgtttgaatgctttgcttgaacccggaggtgtcctcactattagtgagagaggaatgatagatggatccactcccacgataacaccaaatcccaatttcagacttttcctctcgatggatcctgttcatggagatatatcccgagctatgaggaatcgtggacttgaaatctacatttcaggggaaggggatgcaagcaccccagacaacctggatttgaaagttctgctgcacagccttggattggtggggaacagtgtatgtgacatcctcttggctttacacacagagacccggagcactgttgtaggttctccaacatcttctgtatcaactctaatccagacagccatactaattgtccagtacctgcagcgagggctgagtttagacagagccttttctgaagcatgctgggaagtatatgtctgttcccagcattcaccagcaaaccggaagcttgtacaggctttactggagaaacatgtttcttctttgcgagcacatgaaacctggggagactccattcttggcatgggactgtggccagattctgtgccctcagctctctttgctactgaagattcacacctgtctacagtccgaagagatggacagatcttagtatattgtctcaacaggatgagcatgaaaaccagcagctggacaaggagtcagccttttaccttgcaagacttagagaaaattatgcagtcccccagccctgagaacctgaaattcaatgcagtcgaagtgaatacttactggatcgatgaaccagatgttttggtcatggctgttaaattgctcatagaaagagcaaccaatcaggattggatgctcagagttaaatggctttatcatttagccaagaatataccgcaggggcttgagtccatacaaattcatttggaagccagtgctgcatctctcaggaatttttactcacattccctctcaggtgcagtcagtaatgttttcaaaatattacaaccaaatacaacagatgaatttgtgatccctctggatccccgatggaatatgcaggctctggacatgattagaaatttgatggactttgacccacaaacggaccagcctgaccagctctttgcccttttagaatcagctgcaaacaagacaatcatatatcttgaccgggaaaaacgggtttttactgaagcaaatttggtttctgttggtagcaaaaagctaagagagagtgttttgagaatgtcctttgaattccatcaagatccagaaagctatcacactctgccccatgaaattgtggtcaatcttgctgctttttttgaactttgtgatgcactagtcctgctctgggtacagtcctcccagggaatggtgtctgatgccagtgccaatgagatcttaggttctctgcggtggcgggaccggttctggactgtggccgacacagtaaaagtagatgccccaggtctggcccttcttgccctccattggcactgggttttaaaacatctggtccaccagatcccccgacttctgatgaattatgaagacaaatattacaaagaagttcagactgtctcagaacatattcagaattgtctggggagccagactggtggcttcgctggtataaagaagttgcagaagttcctgggacgaccgtttccttttaaggacaagctggtggtggagtgtttttcacaactgaaggtccttaacaaagtccttgccatcagggagcagatgtctgcccttggggagagtggatggcaggaagacattaaccgtctccaagtggttgcttctcagtggacattaaagaaaagtctcctgcaagcctggggactgatcctcagagcaaatattttggaagatgtcagcctagatgaattgaagaattttgtgcatgctcagtgtttagaactgaaagccaaaggactctcacttggttttctggagaaaaagcatgatgaagcttcctccctgtcccatccagacttgacctccgtaatccacctcaccaggagtgttcagttgtggcctgcaatggagtacctggctatgctttggcggtacaaagtgacagctgattttatggcacaagcttgtctcagaagatgcagcaaaaatcaacaaccccagataaatgaggagataagtcacctcatctcattttgtctttatcacacacctgttacacctcaagagcttcgagatctgtggtccttgctgcatcatcagaaggtgtctcctgaagaaattacatctttgtggtccgagttatttaattccatgtttatgtctttctggagcagtactgtgaccacaaatccagagtactggctaatgtggaaccctttgcctggtatgcagcagagggaggcacccaagtctgttttggactccacattgaagggccccggcaatctcaatagacccatattctctaagtgctgctttgaagtcttaaccagcagctggagagcaagtccctgggatgtgagtggcctccccattctttcctcctctcacgtgaccctaggagagtgggttgagagaactcagcagctccaggacatcagttcgatgctttggactaacatggctatctcttcagtagcagaattcagacgcacggattcccaactccaggggcaggtgctgttccggcacctggcaggcctagcagagctgctcccagagtcccggcggcaggagtacatgcagaactgtgagcagctgctgcttgggagcagccaggccttccagcatgtgggccagacacttggggacatggctggtcaggaggtgctgcccaaggaactgctctgccagttgctcacctccctgcaccactttgttggtgaaggggagagtaagaggagcctgcctgagccagcccagcgtgggagcctctgggtgagcctcggcttgctccagattcagacatggcttccccaggcacgctttgaccctgcggtgaagagggagtacaagctcaattacgtcaaggaagagttacaccaactgcagtgtgaatggaagacccggaacctgtcatcccagctgcagactggaagagacctggaagatgaagtcgttgtcagctactctcatcctcacgtcaggctgcttcgccaaaggatggatcggctggataatttaacctgtcacctgttgaagaaacaggcctttagaccccagctgcctgcctacgagtccctggttcaggagatccaccactacgtcaccagcatcgccaaggcccctgctgttcaggatctgctcacacggcttctgcaggccctccacatagatgggccacggtctgcccaagtagcccagagccttctaaaggaggaggcctcttggcagcagtcacaccaccagttccggaagcggctgtcagaggagtacaccttctatccagatgccgtgagcccactgcaggcatccatattgcagttacaacatggcatgaggctggtggcctctgagctccacacctcactccacagcagtatggttggtgcagacaggctggggaccctggccacagccttgctggctttcccatcggtgggccccaccttcccgacttactatgctcatgcagacactttgtgctcggtgaagtctgaggaggttctacgaggccttgggaagctaatcctcaagcgctcaggaggaaaggagctggaaggcaagggccagaaagcctgtcccactcgggagcagctgctgatgaatgctctcctttacctgcgctcccacgtgttatgcaagggagagttggaccagagggccctgcagctcttcagacatgtgtgtcaggaaatcatcagtgagtgggatgagcaggaacgcatagcccaagagaaggctgagcaggaaagcggcctgtatagatacaggagcaggaactctaggacagccctgagtgaagaggaggaggaagaacgggagttcagaaaacagttccccctgcatgaaaaggactttgcagatattttggtgcagccaacgttggaggagaacaaaggaacttcagatgggcaagaagaggaagcaggcacaaacccagctctcctctcccagaattcaatgcaggcagtaatgctgatacaccagcaattgtgtctcaactttgctcgatccctctggtatcaacagactctgccgccacatgaagcaaagcattacctcagcctgtttctgtcttgctatcagactggggcatcgcttgtgacacacttctaccccctgatgggagttgaactgaatgaccgactcttgggcagccaacttttggcctgtaccctctcccataacactctttttggggaggcaccctcagacctgatggtgaaacctgatgggccctatgacttctaccagcatcccaatgttccagaagcacggcagtgtcaacctgtgcttcaaggtttctcagaggctgtcagtcacttgctacaggactggccagaacacccagcgcttgaacagctcctggttgtaatggacagaattcgtagtttcccactttccagtcccatctcaaagttcctgaatggcttagagatccttctggcaaaggcacaggattgggaggaaaatgcaagtcgagctttgtctttgcggaaacatcttgatttgatcagtcagatgatcattcggtggcgtaaactggagctgaactgctggtccatgagtttggataatactatgaagcgccacaccgagaaatccaccaagcactggttctccatctatcagatgcttgagaagcacatgcaggaacaaacagaagaacaggaagatgacaaacagatgaccttgatgttgctggtcagcacattacaagcatttattgaaggatcctcgctgggagagttccatgtgcgacttcagatgttactggttttccattgtcatgtcttgctgatgccacaggttgaaggaaaggattcactttgcagtgttctatggaatttgtaccattattacaagcaattctttgaccgggtccaggccaaaattgtggaacttcgttcccccctagaaaaagaacttaaagaatttgttaagatttccaagtggaatgatgtcagcttctggtccattaagcaatctgtagaaaagacacacaggacactctttaaattcatgaagaaatttgaagcagtcctgagtgaaccctgccggtcatccctggtggagagtgacaaggaagaacagcctgactttttgcccaggccaacagatggagctgcaagtgaactgtcttccattcagaatctgaacagggcactgagggagaccctgttagcccaaccagcagctgggcaggccacaattccagagtggtgtcagggcgctgctccttccggcttggaaggggagcttctgcgtcgcttgccaaagctcaggaaacgcatgaggaagatgtgcctgacgttcatgaaggagagccccctgcctcgccttgtggagggccttgatcagttcacaggtgaagtgatttcctctgtgagtgagctgcagagcttaaaggtggaaccctctgcagagaaggagaagcagcggtcagaagccaagcacattctcatgcaaaaacagcgagctttgtcagacctctttaaacaccttgcaaaaattggtttgtcgtatcgcaaaggtcttgcttgggcccgttcaaaaaaccctcaagagatgcttcatcttcacccattagatctccagagcgcattgtccatcgtcagcagcactcaggaggctgattctaggctgcttacagaaatctcgtcttcatgggatggatgccagaagtatttttatcgctctcttgcacggcatgccaggcttaacgcagcactagcaactcctgccaaggaaatgggcatgggcaacgtggagaggtgcagagggttctcagcacatttgatgaagatgctcgtccgacagcggcgctccctgaccacgctcagtgagcagtggatcatcctcaggaacctcctcagctgtgtgcaagagattcacagcaggctgatggggccccaggcctaccccgtggccttcccccctcaggatggcgtgcagcagtggacagagcgcctgcagcacctggccatgcagtgccagatcctgcttgagcagctctcctggctcctccagtgctgccccagtgtagggccagctccaggccatggcaatgtccaggtactggggcagcctcctggcccctgcctggaaggaccagaacttagcaagggacaactttgtggagtagtgctggacctaattccttccaatctgagctacccatctccaatacctggaagtcagctgccctctggttgccggatgcggaaacaggatcacctttggcaacagtcaactacgagattaacagagatgctaaaaaccattaaaacagtgaaagctgacgtcgacaaaattagacagcagtcttgtgagactctctttcattcttggaaagattttgaagtttgctcttctgcgctgagttgcttgtcccaggtgtcagttcatttgcagggcctagagtccttgttcattcttccagggatggaggttgagcaaagagactcacaaatggcactagttgaaagtctggaatatgtaagaggagaaattagtaaagccatggctgactttactacctggaagacccatctgcttacttcagatagccaaggaggaaatcaaatgttggacgaaggatttgtggaagatttttcagagcaaatggaaattgccatccgagccatcctctgtgccatccagaacttagaagaaagaaagaatgaaaaagcagaggagaacactgaccaagcaagcccacaagaagattatgcaggctttgagagactgcaatcaggacatctaacaaaactcttagaggatgacttctgggccgatgtgagcactttgcacgtgcagaaaataatttctgccatctccgagctgttggagaggctgaaatcgtacggtgaggatggcacagcagcaaagcacctgttcttcagccaatcctgttccttgctggtgcgcctggtgccggtcctctccagctactcagacctcgtcctcttcttcctgaccatgtctttagcaactcaccgtagtactgcaaagctgctctctgtgcttgcccaggtctttacagagcttgcccagaagggattttgcttgcccaaagaatttatggaagattcagctggagagggagcaactgagttccatgactatgagggaggtggaattggagaaggcgagggcatgaaggatgtgagtgaccagatcggaaatgaagaacaggtggaagatacatttcagaagggtcaagaaaaagacaaagaggatcctgattcaaaatctgatattaagggcgaggataatgccattgagatgtcggaagattttgatgggaaaatgcatgatggggagcttgaagaacaagaagaggatgatgagaaatcagatagtgagggcggagacctggataaacacatgggcgatctcaatggtgaggaagctgacaaactagatgagaggctttggggtgatgatgatgaggaggaagatgaggaggaagaagacaataaaactgaagaaacaggaccaggaatggatgaggaagattctgaacttgttgctaaagatgacaacttggatagtggcaattcaaacaaagataaaagccagcaagataagaaggaagaaaaggaagaagcagaagctgatgatggtggacaaggtgaagacaaaattaatgaacaaatagatgagagggactatgatgaaaatgaggtggacccttaccatggcaatcaggaaaaggtgccagaacccgaggctttggaccttccagatgacttgaacctcgacagtgaagacaagaatggtggtgaggacaccgacaatgaagaaggagaagaagagaatcctttggagataaaagaaaaaccagaagaagcaggtcatgaagctgaggaaagaggagagaccgagaccgaccagaacgaaagtcagagtccacaggagcctgaggaaggccccagtgaagatgacaaggcagaaggggaagaggaaatggacacaggagctgatgaccaagatggagatgctgctcagcatcctgaagaacactctgaggagcagcagcagtctgtggaggaaaaagacaaggaagccgatgaagaaggtggagagaatggccctgctgaccaaggtttccagccccaggaggaagaagaacgggaggactctgatacagaggagcaggtgccagaggctttggagaggaaggagcatgcctcctgtgggcagactggtgtggagaacatgcagaacacacaggccatggagctggctggggccgcacctgagaaggagcaggggaaagaggaacacggaagtggagctgcagatgcaaaccaggcagaaggccatgaatcgaatttcattgcccagttggcctcccagaagcacaccaggaaaaacacacagagttttaagaggaaacctgggcaggctgacaatgaacgttccatgggtgatcacaatgagcgtgtgcacaagaggctgaggactgtggatacggacagccatgccgagcaggggccagctcagcagccccaggcccaggtggaggatgcagatgcattcgagcacattaaacaaggcagtgacgcatacgatgcacagacctatgatgtggccagcaaagaacagcaacagtctgcaaaagactctggcaaagatcaggaagaggaggagatagaggacacccttatggacacagaggagcaggaggagttcaaagcagcagacgtggagcagctgaagccagaggaaatcaagtcgggcaccacagcacccttgggctttgatgagatggaagtggagatccaaactgttaaaacagaggaagaccaagaccccagaacagacaaagcccataaggagacagaaaatgagaaaccagaaagaagccgagagtctaccattcatacagctcatcaattcctcatggacacgatcttccagccctttttaaaagatgtcaatgagctaagacaggagctggagagacagctggaaatgtggcagccacgtgaatctggaaacccagaggaggagaaggttgcagctgagatgtggcagagttacctgatcttaacagcgcctctttcacaacggttatgtgaagagcttcgtctcatattagagcctacccaggcagccaagctgaaaggagactatcgaactgggaaacgactaaacatacggaaagtcattccatacattgctagtcaatttcggaaagacaagatttggcttcgaaggaccaagcccagtaaacgccagtatcagatttgtttggctatcgatgactcttctagtatggtagacaatcataccaagcagcttgcatttgaatctttggctgtgattggaaatgctctaaccctcctggaagtgggtcagattgcagtgtgtagttttggagaatctgtaaagctgttacacccatttcatgagcagttcagtgattactctgggtcccagattctacgtctctgcaaattccaacaaaagaaaaccaagattgctcagtttctagagtctgttgccaacatgtttgcagctgctcagcagctctcgcagaacatcagttcagaaactgcacaactcctcctggtagtctctgatgggcgaggccttttccttgagggcaaagaaagagtcctggcagcagttcaggctgcccggaatgcaaatatctttgtcatctttgttgtattggacaatcccagttcacgggattctatcttggacattaaagtaccgatatttaaaggacctggagagatgcctgaaatccgatcctacatggaagagttcccattcccatactatatcattcttcgagatgtaaacgcacttcctgagacactcagcgatgccctcagacagtggtttgagttggtgacagcctctgaccacccatagaacagaaagaagagtccaaagtgagacttaactgtggtcagaaggtcacattgcttacccaggtgctcccttttggacaactacaaaaaattttattgtaatatttttattttacaacgtgatcttacagcctacagaatgctctctggctcccggctttgcctgggctgaggtttttataccaaacctggaagcagcagcaggtgcctgaactcgtaactagagaagagttatccttcttccctgccttggaagccctggcctgggaggaggtcataccccaccgttggagcccagctgcctgttttcttttgcaggggatctgggcacctgtgccttgaggagatgctgccaggagcatgggactctgacagtcctttgtataaaggactaaagggagctgcccttttgaccctgttctaagctctgccttgccaagcccatagtgtgtgcccaaaagctgtcaagtggccaagacagctcgtttctggagagtatgagggtgtgttttcttattgtgaaaggaactaccttctcttagagggtaggaagaatgtggtgtgtgtgtgttctcataaagcaactggacattataggtgcccaggtcatctataaaaacgatccttgggctgtgtaaaaatgaagtggcttttcagtatcctctttcacacttgctgcttcgggagactatgcaatgatgggaaggtgattgcccctttatttcattcagtgccatggtccctgttgttgtagtaatttatttgtttagttcatttttttttttcttaacagtcaaggggaagagtgattcctcacactgctttcaagctggactgagccagtctcattctgggaaagaaacgctgtgtccagaactcagcagctccatctattttttccagtcgaaagaaactgatctttaggcagtttttacttggccagaaagcagtgctgaatacttgaaactgtgtgctctgttctacttaatgttctgtcagaatgttcttttgtaggcagtatgtcatgatgtaatcatctatctccttgtctgtttccaagttacactgtgaagtctgcgacccttttgaggtggtcatcaaagacacagattccttgtttaaccaagtgtcccaaagcatgtacctgaagttatatcattttttattctaaaaagctatgcagcttatattctgaaaactattaaaacatataccactgttgttgatgtaatttgtgactcttcttaatggaagatgacaggattgtaaaaggtatgctaggggactgatcttctctgctggatcagtcagtcagctgttactagttgatgctgtgctaacatgatcccctcctacttccatgttgctcttactacaaaggttatcatttgcatttatgtccatggtaggctgagctataatatgctggctttgcagcagaatgaaaaggatgagttggtgtagccttataaggaggcttataaaaattaattatcctccataaatg

SEQ ID NO: 154036 - DNA, 3654 bp, Homo sapiens
  Payload ID: 10272
  Gene Symbol: MDN1
  Gene Name: midasin AAA ATPase 1
  ENST ID: ENST00000439638
  CDS Start-End: 112-3654
ttcctgcgggcgtagttgctggctgctcgggcactgggacctcggcggcttggggacgctggccgcgaagtagggagcgcaggtggccgctcggggtgagggccctgggtcatggagcacttcttgctggaggtggcagccgcgccgctgcggttaatcgcagccaagaacgagaagagccgcagtgagttgggcaggttcttggccaagcaggtgtggacacctcaagatcgccagtgtgtcctgagtaccttagcacagttgcttttggataaggactgtactgtgctggttggtcgccagcttcgccctctccttttggatttgctggaaaggaatgccgaagccattaaagctggaggccaaatcaaccatgatctgcatgaacggctatgtgtgtcgatgagcaaactcattggtaaccatcctgatgtcctcccgtttgccctgagatatttcaaggacacatccccagtctttcaaagacttttcctagagagttcagatgctaatccagtacgctatggacgtaggaggatgaagctccgggacctaatggaagcagccttcaagtttctgcagcaggagcagtctgtgttccgggagctctgggactggagtgtgtgtgtccctctcctcagaagccatgacaccttggttcgctggtatacagccaattgtcttgctttggttacctgtatgaatgaagagcacaagttatcatttcttaagaagatatttaatagtgatgaattgatccatttcaggttgaggttattagaagaggcccagttgcaggacttggagaaggccttggttttggccaatccagaagtctccctttggcgtaagcagaaggagctgcagtacttacagggacatcttgtttcgtctgacctctcccctagggtgacagctgtttgtggtgtggtgctgcctgggcagctgccagcccctggagagctgggtggtaataggagttcttcacgtgaacaggagctggcccttaggtcttatgtgctggttgagtctgtctgcaaaagtcttcagaccctggctatggcggttgcttctcagaatgctgtgttgttggaaggaccaataggatgtggcaaaacttccttagttgaatatttagctgcagtgacaggtagaacaaagcctcctcagcttctcaaagtccagcttggagatcagactgacagtaagatgcttttggggatgtatcgctgcacagatgttcctggagagtttgtgtggcagcctggcaccctgacacaggcagccacaatgggccactggatccttctggaggatattgactatgcccccttagacgtggttcttcagagcagatatcctagcctattggcagtggttgatcacctgcttgacatttatatccaacttactggagagaaacatcactcttggagtgatagttctgttggatgtgaacaggcacctgaagaagtttcagaagccagaagagaaaacaaaagaccaacccttgagggaagagaattatctctaagggatctgctgaattggtgtaataggattgcccatagctttgacagttcatctttatcagcatcattaaatatttttcaagaggctctagactgtttcacagcaatgctttctgagcatacaagcaaactgaaaatggcagaagttattggaagcaaattgaacatttctagaaaaaaggctgaattcttttgtcaactttataaaccagaaattgtgatcaatgagctagatttgcaagtgggtcgagtgcggcttctacggaaacaaagtgaggctgttcacctacagagggagaagttcactttcgctgctacacggccgtcctctgttctcatcgagcagcttgcagtgtgtgtcagcaaaggggagcctgtgttgctggtgggagagaccgggactggcaaaacctctaccatccaatacttggctcacattacaggccaccgtttgagggttgtcaatatgaatcaacaaagtgatactgcagacttgcttggaggttataaaccggtggaccataagcttatttggctacccttacgggaggcatttgaggaactctttgctcagacattttccaagaaacaaaactttacgttcttggggcacattcagacctgttacagacagaaacggtggcatgatctcctgagactaatgcagcatgtacacaagtctgctgttaacaaggatggaaaagacagtgaaactgggttactcataaaagagaaatgggaagcatttggtcttagactcaaccatgcccaacaacagatgaaaatgactgaaaataccttattgttcgcatttgtagagggtacattagctcaggctgtaaagaaaggagagtggatcttgttggatgagattaacttggctgctccagaaatactagaatgtctgagtggtttgcttgaaggatcttctggatccctggtgttgctggatcgaggagacacagagccactggttcggcatcctgacttccgtttatttgcctgtatgaatccagcaactgatgtaggcaaaagaaatctcccaccaggaataagaaacaggttcacagaactttatgtagaagaattagaaagcaaagaagacttacaggttcttattgtagattatctgaaaggattgagtgtgaacaagaatacagtgcaaggaatcataaacttctacacagctttgcggaaagagtctgggaccaaactggtggatggcactggccatagacctcactacagccttcggactctgtgccgggccctgcgatttgcagcctccaatccatgtggcaacattcagcgctcactctatgagggtttttgtttgggtttcttaacacagcttgacagggcatcacacccaatagttcagaagctcatctgtcaacacattgtccctggcaatgtcaagagtctgctgaagcagcctattccagagccaaaaggaggtcggcttatccaggttgaaggctactggattgcggtgggagacaaggagcctacaatagatgagacgtacattctgacatcttctgtgaagctgaacctgagagatatagtccgagttgtctctgcaggaacctatccagtgctgattcagggagagacatcagttggtaaaacaagcctgatccagtggctggctgcagctactggcaaccactgtgtgcgtattaataatcacgaacacacggatattcaggagtacattggttgttacacgtctgactcctcagggaagcttgtctttaaggaaggtgttcttattgatgccatgagaaaaggctattggattattttagatgaattaaatttggcccctactgatgtgttagaggcgctgaataggctgttggatgataaccgtgaattgctagtaacagaaacacaggaagttgttaaagcacaccctcggtttatgctttttgccacccaaaatcccccaggactttatggaggcagaaaggtcctttctagagccttcaggaatcggtttgtggaattgcactttgatgagttacctagctccgagttggaaacaatcttgcacaagcggtgtagtttgccaccctcctattgcagcaagttggttaaagtcatgctggatcttcag

SEQ ID NO: 154037 - DNA, 689 bp, Homo sapiens
  Payload ID: 10272
  Gene Symbol: MDN1
  Gene Name: midasin AAA ATPase 1
  ENST ID: ENST00000487831
  CDS Start-End: 1-189
gattctatcttggacattaaagtaccgatatttaaaggacctggagagatgcctgaaatccgatcctacatggaagagttcccattcccatactatatcattcttcgagatgtaaacgcacttcctgagacactcagcgatgccctcagacagtggtttgagttggtgacagcctctgaccacccatagaacagaaagaagagtccaaagtgagacttaactgtggtcagaaggtcacattgcttacccagtcaaggggaagagtgattcctcacactgctttcaagctggactgagccagtctcattctgggaaagaaacgctgtgtccagaactcagcagctccatctattttttccagtcgaaagaaactgatctttaggcagtttttacttggccagaaagcagtgctgaatacttgaaactgtgtgctctgttctacttaatgttctgtcagaatgttcttttgtaggcagtatgtcatgatgtaatcatctatctccttgtctgtttccaagttacactgtgaagtctgcgacccttttgaggtggtcatcaaagacacagattccttgtttaaccaagtgtcccaaagcatgtacctgaagttatatcattttttattctaaaaagctatgcagcttatattctgaaaactattaaaacatataccactgttgttgatgtaa

SEQ ID NO: 154038 - DNA, 17400 bp, Homo sapiens
  Payload ID: 10272
  Gene Symbol: MDN1
  Gene Name: midasin AAA ATPase 1
  Uniprot ID: Q9NU22
  ENST ID: ENST00000629399
  CDS Start-End: 117-16907
cgcctttcctgcgggcgtagttgctggctgctcgggcactgggacctcggcggcttggggacgctggccgcgaagtagggagcgcaggtggccgctcggggtgagggccctgggtcatggagcacttcttgctggaggtggcagccgcgccgctgcggttaatcgcagccaagaacgagaagagccgcagtgagttgggcaggttcttggccaagcaggtgtggacacctcaagatcgccagtgtgtcctgagtaccttagcacagttgcttttggataaggactgtactgtgctggttggtcgccagcttcgccctctccttttggatttgctggaaaggaatgccgaagccattaaagctggaggccaaatcaaccatgatctgcatgaacggctatgtgtgtcgatgagcaaactcattggtaaccatcctgatgtcctcccgtttgccctgagatatttcaaggacacatccccagtctttcaaagacttttcctagagagttcagatgctaatccagtacgctatggacgtaggaggatgaagctccgggacctaatggaagcagccttcaagtttctgcagcaggagcagtctgtgttccgggagctctgggactggagtgtgtgtgtccctctcctcagaagccatgacaccttggttcgctggtatacagccaattgtcttgctttggttacctgtatgaatgaagagcacaagttatcatttcttaagaagatatttaatagtgatgaattgatccatttcaggttgaggttattagaagaggcccagttgcaggacttggagaaggccttggttttggccaatccagaagtctccctttggcgtaagcagaaggagctgcagtacttacagggacatcttgtttcgtctgacctctcccctagggtgacagctgtttgtggtgtggtgctgcctgggcagctgccagcccctggagagctgggtggtaataggagttcttcacgtgaacaggagctggcccttaggtcttatgtgctggttgagtctgtctgcaaaagtcttcagaccctggctatggcggttgcttctcagaatgctgtgttgttggaaggaccaataggatgtggcaaaacttccttagttgaatatttagctgcagtgacaggtagaacaaagcctcctcagcttctcaaagtccagcttggagatcagactgacagtaagatgcttttggggatgtatcgctgcacagatgttcctggagagtttgtgtggcagcctggcaccctgacacaggcagccacaatgggccactggatccttctggaggatattgactatgcccccttagacgtggtttctgtgctgatccctctcttggagaatggagagctcttgattcctggccgaggtgactgtctgaaagtggcacctggatttcagttttttgcaaccaggagactcttgagctgtggaggaaattggtatcgaccgctaaacagtcatgctactttgctagacaaatattggaccaaaattcacctggataacctggataagagagaactgaatgaggttcttcagagcagatatcctagcctattggcagtggttgatcacctgcttgacatttatatccaacttactggagagaaacatcactcttggagtgatagttctgttggatgtgaacaggcacctgaagaagtttcagaagccagaagagaaaacaaaagaccaacccttgagggaagagaattatctctaagggatctgctgaattggtgtaataggattgcccatagctttgacagttcatctttatcagcatcattaaatatttttcaagaggctctagactgtttcacagcaatgctttctgagcatacaagcaaactgaaaatggcagaagttattggaagcaaattgaacatttctagaaaaaaggctgaattcttttgtcaactttataaaccagaaattgtgatcaatgagctagatttgcaagtgggtcgagtgcggcttctacggaaacaaagtgaggctgttcacctacagagggagaagttcactttcgctgctacacggccgtcctctgttctcatcgagcagcttgcagtgtgtgtcagcaaaggggagcctgtgttgctggtgggagagaccgggactggcaaaacctctaccatccaatacttggctcacattacaggccaccgtttgagggttgtcaatatgaatcaacaaagtgatactgcagacttgcttggaggttataaaccggtggaccataagcttatttggctacccttacgggaggcatttgaggaactctttgctcagacattttccaagaaacaaaactttacgttcttggggcacattcagacctgttacagacagaaacggtggcatgatctcctgagactaatgcagcatgtacacaagtctgctgttaacaaggatggaaaagacagtgaaactgggttactcataaaagagaaatgggaagcatttggtcttagactcaaccatgcccaacaacagatgaaaatgactgaaaataccttattgttcgcatttgtagagggtacattagctcaggctgtaaagaaaggagagtggatcttgttggatgagattaacttggctgctccagaaatactagaatgtctgagtggtttgcttgaaggatcttctggatccctggtgttgctggatcgaggagacacagagccactggttcggcatcctgacttccgtttatttgcctgtatgaatccagcaactgatgtaggcaaaagaaatctcccaccaggaataagaaacaggttcacagaactttatgtagaagaattagaaagcaaagaagacttacaggttcttattgtagattatctgaaaggattgagtgtgaacaagaatacagtgcaaggaatcataaacttctacacagctttgcggaaagagtctgggaccaaactggtggatggcactggccatagacctcactacagccttcggactctgtgccgggccctgcgatttgcagcctccaatccatgtggcaacattcagcgctcactctatgagggtttttgtttgggtttcttaacacagcttgacagggcatcacacccaatagttcagaagctcatctgtcaacacattgtccctggcaatgtcaagagtctgctgaagcagcctattccagagccaaaaggaggtcggcttatccaggttgaaggctactggattgcggtgggagacaaggagcctacaatagatgagacgtacattctgacatcttctgtgaagctgaacctgagagatatagtccgagttgtctctgcaggaacctatccagtgctgattcagggagagacatcagttggtaaaacaagcctgatccagtggctggctgcagctactggcaaccactgtgtgcgtattaataatcacgaacacacggatattcaggagtacattggttgttacacgtctgactcctcagggaagcttgtctttaaggaaggtgttcttattgatgccatgagaaaaggctattggattattttagatgaattaaatttggcccctactgatgtgttagaggcgctgaataggctgttggatgataaccgtgaattgctagtaacagaaacacaggaagttgttaaagcacaccctcggtttatgctttttgccacccaaaatcccccaggactttatggaggcagaaaggtcctttctagagccttcaggaatcggtttgtggaattgcactttgatgagttacctagctccgagttggaaacaatcttgcacaagcggtgtagtttgccaccctcctattgcagcaagttggttaaagtcatgctggatcttcagtcctatcgcagaagttcttcagtgtttgctggaaagcagggcttcatcacccttcgtgatctgttccgatgggctgaaagatacagattggctgagccgaccgagaaggagtatgactggctacagcatttagccaatgatggttatatgcttctggcaggtcgagtcaggaagcaggaggaaattgatgtgattcaagaagtccttgagaaacatttcaagaaaaaattgtgtcctcaatctcttttctccaaagaaaatgttctaaaattgctgggtaaattgtctactcagatatccacattggagtgtaactttggccatatcgtgtggactgagggcatgcggagactcgcgatgctagtgggaagggcattggaatttggtgaacctgtgctgctggttggagacactgggtgtgggaaaactactatctgtcaggtatttgcagccttggcaaatcagaaattatactctgtcagctgccacttacacatggagacatcagacttcctgggtggcctgcggccagtgagacaaaagccaaacgacaaggaagaaattgacacatcaagactctttgagtggcatgatgggcctctggttcaggccatgaaggaggacggctttttcctcttggatgagatctcattggccgatgactctgtcttggaaagactcaacagtgtccttgaagtagaaaagtctctggtattagctgaaaaaggcagtccagaggacaaggatagtgaaatagagctgttgactgctgggaaaaaatttcgtattctagcaaccatgaaccctgggggtgactttggaaaaaaggagctgtctcctgccttaagaaaccggtttacagaaatatggtgccctcaaagcacaagccgtgaagatttaattcagatcatcagtcataatcttcgtccaggattgtgtctgggcagaatagatcctaaagggtctgacatacctgaagtgatgctggatttcattgactggctgacccaccaagagtttggcagaaagtgtgtggtcagtatcagagatatcctgtcctgggttaacttcatgaacaaaatgggggaggaagctgctttgaaaaggccagagatcatctccactgtgacatcttttgtccatgctgcatgcctggtgtacatagatggaataggttcaggggtaacttcctctgggtttggtacagcccttttggcacgaaaagaatgtctgaaatttctaatcaagaggcttgccaagatagtacgacttacagaatatcagaaaaatgagttgaagatttatgacagaatgaaggccaaagaattcactggaatagataacctttggggaattcatccattttttataccaaggggacctgtcctacacaggaataatattgcagactatgcactcagtgcagggaccactgctatgaatgcacagaggctcttaagagctaccaaactgaagaagcccattctcctggagggttcccctggtgttggcaagacaagtttggtgggagcattagcaaaggcttcaggaaatacccttgttagaatcaacttatcagagcaaacggacatcacagacctgtttggagcagatctacctgttgaaggtggcaagggaggagagtttgcctggcgtgatggccccttactggcagctttgaaggcaggccattgggtggtgttggatgagcttaacctggcttctcagtctgtattggaaggactcaatgcttgttttgaccaccgaggagaaatctatgtgcctgagttaggaatgagctttcaagtgcagcatgaaaagacgaagatttttgggtgtcagaatccctttagacaaggaggtgggaggaaaggcttgcccaggtctttccttaacagattcactcaggtcttcgttgatccccttacagtaattgacatggagttcattgccagtactttgtttccagccattgagaaaaatattgttaagaaaatggttgctttcaataaccaaattgatcatgaagtgactgttgagaagaaatgggggcaaaaaggaggaccctgggaattcaacctccgggaccttttccgctggtgtcagttgatgctggttgaccagtcccctgggtgttatgatcctggtcagcatgtgtttttggtctatggtgaaagaatgagaaccgaagaggacaaaaaaaaggtcattgctgtattcaaggatgtgtttggttcaaattccaacccatacatgggaaccagactatttcgtatcactccctatgatgttcagttgggctactcagtcctttcccgtgggagctgtgttcctcacccgtcccgccatcccctgttgctcctgcaccagtcattccaacccctggagtcaatcatgaagtgtgtgcagatgagctggatggtcatcctggtcgggccagcctctgtgggcaagaccagcctggtccagcttctggcacaccttactggccacacattaaagatcatggctatgaacagtgcaatggatactactgagctgctgggtggatttgagcaggttgatcttatacgaccttggaggaggctgctagagaaggtggagggaactgtaagggcactgttaagggatagcctccttatcagtgctgatgatgcagaagtagtgctgcgagcctggagtcattttcttctgacatataagcctaagtgtcttggagaaggtggtaaagctatcacgatggagattgtcaacaaactagaagcagtgttattgcttatgcagcgactcaacaataaaatcaactcatactgcaaggcagagtttgccaaacttgttgaagagttccgaagctttggtgtgaagcttacgcagttggccagtggccatagccatggcacatttgaatgggttgacagcatgttggttcaggccctgaagtctggagactggcttctgatggacaatgttaacttctgcaacccatcagtgttggatcgtttgaatgctttgcttgaacccggaggtgtcctcactattagtgagagaggaatgatagatggatccactcccacgataacaccaaatcccaatttcagacttttcctctcgatggatcctgttcatggagatatatcccgagctatgaggaatcgtggacttgaaatctacatttcaggggaaggggatgcaagcaccccagacaacctggatttgaaagttctgctgcacagccttggattggtggggaacagtgtatgtgacatcctcttggctttacacacagagacccggagcactgttgtaggttctccaacatcttctgtatcaactctaatccagacagccatactaattgtccagtacctgcagcgagggctgagtttagacagagccttttctgaagcatgctgggaagtatatgtctgttcccagcattcaccagcaaaccggaagcttgtacaggctttactggagaaacatgtttcttctttgcgagcacatgaaacctggggagactccattcttggcatgggactgtggccagattctgtgccctcagctctctttgctactgaagattcacacctgtctacagtccgaagagatggacagatcttagtatattgtctcaacaggatgagcatgaaaaccagcagctggacaaggagtcagccttttaccttgcaagacttagagaaaattatgcagtcccccagccctgagaacctgaaattcaatgcagtcgaagtgaatacttactggatcgatgaaccagatgttttggtcatggctgttaaattgctcatagaaagagcaaccaatcaggattggatgctcagagttaaatggctttatcatttagccaagaatataccgcaggggcttgagtccatacaaattcatttggaagccagtgctgcatctctcaggaatttttactcacattccctctcaggtgcagtcagtaatgttttcaaaatattacaaccaaatacaacagatgaatttgtgatccctctggatccccgatggaatatgcaggctctggacatgattagaaatttgatggactttgacccacaaacggaccagcctgaccagctctttgcccttttagaatcagctgcaaacaagacaatcatatatcttgaccgggaaaaacgggtttttactgaagcaaatttggtttctgttggtagcaaaaagctaagagagagtgttttgagaatgtcctttgaattccatcaagatccagaaagctatcacactctgccccatgaaattgtggtcaatcttgctgctttttttgaactttgtgatgcactagtcctgctctgggtacagtcctcccagggaatggtgtctgatgccagtgccaatgagatcttaggttctctgcggtggcgggaccggttctggactgtggccgacacagtaaaagtagatgccccaggtctggcccttcttgccctccattggcactgggttttaaaacatctggtccaccagatcccccgacttctgatgaattatgaagacaaatattacaaagaagttcagactgtctcagaacatattcagaattgtctggggagccagactggtggcttcgctggtataaagaagttgcagaagttcctgggacgaccgtttccttttaaggacaagctggtggtggagtgtttttcacaactgaaggtccttaacaaagtccttgccatcagggagcagatgtctgcccttggggagagtggatggcaggaagacattaaccgtctccaagtggttgcttctcagtggacattaaagaaaagtctcctgcaagcctggggactgatcctcagagcaaatattttggaagatgtcagcctagatgaattgaagaattttgtgcatgctcagtgtttagaactgaaagccaaaggactctcacttggttttctggagaaaaagcatgatgaagcttcctccctgtcccatccagacttgacctccgtaatccacctcaccaggagtgttcagttgtggcctgcaatggagtacctggctatgctttggcggtacaaagtgacagctgattttatggcacaagcttgtctcagaagatgcagcaaaaatcaacaaccccagataaatgaggagataagtcacctcatctcattttgtctttatcacacacctgttacacctcaagagcttcgagatctgtggtccttgctgcatcatcagaaggtgtctcctgaagaaattacatctttgtggtccgagttatttaattccatgtttatgtctttctggagcagtactgtgaccacaaatccagagtactggctaatgtggaaccctttgcctggtatgcagcagagggaggcacccaagtctgttttggactccacattgaagggccccggcaatctcaatagacccatattctctaagtgctgctttgaagtcttaaccagcagctggagagcaagtccctgggatgtgagtggcctccccattctttcctcctctcacgtgaccctaggagagtgggttgagagaactcagcagctccaggacatcagttcgatgctttggactaacatggctatctcttcagtagcagaattcagacgcacggattcccaactccaggggcaggtgctgttccggcacctggcaggcctagcagagctgctcccagagtcccggcggcaggagtacatgcagaactgtgagcagctgctgcttgggagcagccaggccttccagcatgtgggccagacacttggggacatggctggtcaggaggtgctgcccaaggaactgctctgccagttgctcacctccctgcaccactttgttggtgaaggggagagtaagaggagcctgcctgagccagcccagcgtgggagcctctgggtgagcctcggcttgctccagattcagacatggcttccccaggcacgctttgaccctgcggtgaagagggagtacaagctcaattacgtcaaggaagagttacaccaactgcagtgtgaatggaagacccggaacctgtcatcccagctgcagactggaagagacctggaagatgaagtcgttgtcagctactctcatcctcacgttaggctgcttcgccaaaggatggatcggctggataatttaacctgtcacctgttgaagaaacaggcctttagaccccagctgcctgcctacgagtccctggttcaggagatccaccactacgtcaccagcatcgccaaggcccctgctgttcaggatctgctcacacggcttctgcaggccctccacatagatgggccacggtctgcccaagtagcccagagccttctaaaggaggaggcctcttggcagcagtcacaccaccagttccggaagcggctgtcagaggagtacaccttctatccagatgccgtgagcccactgcaggcatccatattgcagttacaacatggcatgaggctggtggcctctgagctccacacctcactccacagcagtatggttggtgcagacaggctggggaccctggccacagccttgctggctttcccatcggtgggccccaccttcccgacttactatgctcatgcagacactttgtgctcggtgaagtctgaggaggttctacgaggccttgggaagctaatcctcaagcgctcaggaggaaaggagctggaaggcaagggccagaaagcctgtcccactcgggagcagctgctgatgaatgctctcctttacctgcgctcccacgtgttatgcaagggagagttggaccagagggccctgcagctcttcagacatgtgtgtcaggaaatcatcagtgagtgggatgagcaggaacgcatagcccaagagaaggctgagcaggaaagcggcctgtatagatacaggagcaggaactctaggacagccctgagtgaagaggaggaggaagaacgggagttcagaaaacagttccccctgcatgaaaaggactttgcagatattttggtgcagccaacgttggaggagaacaaaggaacttcagatgggcaagaagaggaagcaggcacaaacccagctctcctctcccagaattcaatgcaggcagtaatgctgatacaccagcaattgtgtctcaactttgctcgatccctctggtatcaacagactctgccgccacatgaagcaaagcattacctcagcctgtttctgtcttgctatcagactggggcatcgcttgtgacacacttctaccccctgatgggagttgaactgaatgaccgactcttgggcagccaacttttggcctgtaccctctcccataacactctttttggggaggcaccctcagacctgatggtgaaacctgatgggccctatgacttctaccagcatcccaatgttccagaagcacggcagtgtcaacctgtgcttcaaggtttctcagaggctgtcagtcacttgctacaggactggccagaacacccagcgcttgaacagctcctggttgtaatggacagaattcgtagtttcccactttccagtcccatctcaaagttcctgaatggcttagagatccttctggcaaaggcacaggattgggaggaaaatgcaagtcgagctttgtctttgcggaaacatcttgatttgatcagtcagatgatcattcggtggcgtaaactggagctgaactgctggtccatgagtttggataatactatgaagcgccacaccgagaaatccaccaagcactggttctccatctatcagatgcttgagaagcacatgcaggaacaaacagaagaacaggaagatgacaaacagatgaccttgatgttgctggtcagcacattacaagcatttattgaaggatcctcgctgggagagttccatgtgcgacttcagatgttactggttttccattgtcatgtcttgctgatgccacaggttgaaggaaaggattcactttgcagtgttctatggaatttgtaccattattacaagcaattctttgaccgggtccaggccaaaattgtggaacttcgttcccccctagaaaaagaacttaaagaatttgttaagatttccaagtggaatgatgtcagcttctggtccattaagcaatctgtagaaaagacacacaggacactctttaaattcatgaagaaatttgaagcagtcctgagtgaaccctgccggtcatccctggtggagagtgacaaggaagaacagcctgactttttgcccaggccaacagatggagctgcaagtgaactgtcttccattcagaatctgaacagggcactgagggagaccctgttagcccaaccagcagctgggcaggccacaattccagagtggtgtcagggcgctgctccttccggcttggaaggggagcttctgcgtcgcttgccaaagctcaggaaacgcatgaggaagatgtgcctgacgttcatgaaggagagccccctgcctcgccttgtggagggccttgatcagttcacaggtgaagtgatttcctctgtgagtgagctgcagagcttaaaggtggaaccctctgcagagaaggagaagcagcggtcagaagccaagcacattctcatgcaaaaacagcgagctttgtcagacctctttaaacaccttgcaaaaattggtttgtcgtatcgcaaaggtcttgcttgggcccgttcaaaaaaccctcaagagatgcttcatcttcacccattagatctccagagcgcattgtccatcgtcagcagcactcaggaggctgattctaggctgcttacagaaatctcgtcttcatgggatggatgccagaagtatttttatcgctctcttgcacggcatgccaggcttaacgcagcactagcaactcctgccaaggaaatgggcatgggcaacgtggagaggtgcagagggttctcagcacatttgatgaagatgctcgtccgacagcggcgctccctgaccacgctcagtgagcagtggatcatcctcaggaacctcctcagctgtgtgcaagagattcacagcaggctgatggggccccaggcctaccccgtggccttcccccctcaggatggcgtgcagcagtggacagagcgcctgcagcacctggccatgcagtgccagatcctgcttgagcagctctcctggctcctccagtgctgccccagtgtagggccagctccaggccatggcaatgtccaggtactggggcagcctcctggcccctgcctggaaggaccagaacttagcaagggacaactttgtggagtagtgctggacctaattccttccaatctgagctacccatctccaatacctggaagtcagctgccctctggttgccggatgcggaaacaggatcacctttggcaacagtcaactacgagattaacagagatgctaaaaaccattaaaacagtgaaagctgacgtcgacaaaattagacagcagtcttgtgagactctctttcattcttggaaagattttgaagtttgctcttctgcgctgagttgcttgtcccaggtgtcagttcatttgcagggcctagagtccttgttcattcttccagggatggaggttgagcaaagagactcacaaatggcactagttgaaagtctggaatatgtaagaggagaaattagtaaagccatggctgactttactacctggaagacccatctgcttacttcagatagccaaggaggaaatcaaatgttggacgaaggatttgtggaagatttttcagagcaaatggaaattgccatccgagccatcctctgtgccatccagaacttagaagaaagaaagaatgaaaaagcagaggagaacactgaccaagcaagcccacaagaagattatgcaggctttgagagactgcaatcaggacatctaacaaaactcttagaggatgacttctgggccgatgtgagcactttgcacgtgcagaaaataatttctgccatctccgagctgttggagaggctgaaatcgtacggtgaggatggcacagcagcaaagcacctgttcttcagccaatcctgttccttgctggtgcgcctggtgccggtcctctccagctactcagacctcgtcctcttcttcctgaccatgtctttagcaactcaccgtagtactgcaaagctgctctctgtgcttgcccaggtctttacagagcttgcccagaagggattttgcttgcccaaagaatttatggaagattcagctggagagggagcaactgagttccatgactatgagggaggtggaattggagaaggcgagggcatgaaggatgtgagtgaccagatcggaaatgaagaacaggtggaagatacatttcagaagggtcaagaaaaagacaaagaggatcctgattcaaaatctgatattaagggcgaggataatgccattgagatgtcggaagattttgatgggaaaatgcatgatggggagcttgaagaacaagaagaggatgatgagaaatcagatagtgagggcggagacctggataaacacatgggcgatctcaatggtgaggaagctgacaaactagatgagaggctttggggtgatgatgatgaggaggaagatgaggaggaagaagacaataaaactgaagaaacaggaccaggaatggatgaggaagattctgaacttgttgctaaagatgacaacttggatagtggcaattcaaacaaagataaaagccagcaagataagaaggaagaaaaggaagaagcagaagctgatgatggtggacaaggtgaagacaaaattaatgaacaaatagatgagagggactatgatgaaaatgaggtggacccttaccatggcaatcaggaaaaggtgccagaacccgaggctttggaccttccagatgacttgaacctcgacagtgaagacaagaatggtggtgaggacaccgacaatgaagaaggagaagaagagaatcctttggagataaaagaaaaaccagaagaagcaggtcatgaagctgaggaaagaggagagaccgagaccgaccagaacgaaagtcagagtccacaggagcctgaggaaggccccagtgaagatgacaaggcagaaggggaagaggaaatggacacaggagctgatgaccaagatggagatgctgctcagcatcctgaagaacactctgaggagcagcagcagtctgtggaggaaaaagacaaggaagccgatgaagaaggtggagagaatggccctgctgaccaaggtttccagccccaggaggaagaagaacgggaggactctgatacagaggagcaggtgccagaggctttggagaggaaggagcatgcctcctgtgggcagactggtgtggagaacatgcagaacacacaggccatggagctggctggggccgcacctgagaaggagcaggggaaagaggaacacggaagtggagctgcagatgcaaaccaggcagaaggccatgaatcgaatttcattgcccagttggcctcccagaagcacaccaggaaaaacacacagagttttaagaggaaacctgggcaggctgacaatgaacgttccatgggtgatcacaatgagcgtgtgcacaagaggctgaggactgtggatacggacagccatgccgagcaggggccagctcagcagccccaggcccaggtggaggatgcagatgcattcgagcacattaaacaaggcagtgacgcatacgatgcacagacctatgatgtggccagcaaagaacagcaacagtctgcaaaagactctggcaaagatcaggaagaggaggagatagaggacacccttatggacacagaggagcaggaggagttcaaagcagcagacgtggagcagctgaagccagaggaaatcaagtcgggcaccacagcacccttgggctttgatgagatggaagtggagatccaaactgttaaaacagaggaagaccaagaccccagaacagacaaagcccataaggagacagaaaatgagaaaccagaaagaagccgagagtctaccattcatacagctcatcaattcctcatggacacgatcttccagccctttttaaaagatgtcaatgagctaagacaggagctggagagacagctggaaatgtggcagccacgtgaatctggaaacccagaggaggagaaggttgcagctgagatgtggcagagttacctgatcttaacagcgcctctttcacaacggttatgtgaagagcttcgtctcatattagagcctacccaggcagccaagctgaaaggagactatcgaactgggaaacgactaaacatacggaaagtcattccatacattgctagtcaatttcggaaagacaagatttggcttcgaaggaccaagcccagtaaacgccagtatcagatttgtttggctatcgatgactcttctagtatggtagacaatcataccaagcagcttgcatttgaatctttggctgtgattggaaatgctctaaccctcctggaagtgggtcagattgcagtgtgtagttttggagaatctgtaaagctgttacacccatttcatgagcagttcagtgattactctgggtcccagattctacgtctctgcaaattccaacaaaagaaaaccaagattgctcagtttctagagtctgttgccaacatgtttgcagctgctcagcagctctcgcagaacatcagttcagaaactgcacaactcctcctggtagtctctgatgggcgaggccttttccttgagggcaaagaaagagtcctggcagcagttcaggctgcccggaatgcaaatatctttgtcatctttgttgtattggacaatcccagttcacgggattctatcttggacattaaagtaccgatatttaaaggacctggagagatgcctgaaatccgatcctacatggaagagttcccattcccatactatatcattcttcgagatgtaaacgcacttcctgagacactcagcgatgccctcagacagtggtttgagttggtgacagcctctgaccacccatagaacagaaagaagagtccaaagtgagacttaactgtggtcagaaggtcacattgcttacccaggtgctcccttttggacaactacaaaaaattttattgtaatatttttattttacaacgtgatcttacagcctacagaatgctctctggctcccggctttgcctgggctgaggtttttataccaaacctggaagcagcagcaggtgcctgaactcgtaactagagaagagttatccttcttccctgccttggaagccctggcctgggaggaggtcataccccaccgttggagcccagctgcctgttttcttttgcaggggatctgggcacctgtgccttgaggagatgctgccaggagcatgggactctgacagtcctttgtataaaggactaaagggagctgcccttttgaccctgttctaagctctgccttgccaagcccatagtgtgtgcccaaaagctgtcaagtggccaagacagctcgtttctggag

SEQ ID NO: 154039 - DNA, 985 bp, Homo sapiens
  Payload ID: 10273
  Gene Symbol: MDK
  Gene Name: midkine (neurite growth-promoting factor 2)
  Uniprot ID: P21741
  ENST ID: ENST00000359803
  CDS Start-End: 223-654
gtgctcccggaaaggcactgggcgaccgcacccgtggctttctctgggcgaccgggtcccagactccccccagcacagcagagcgcttccctgcccacccgcggaaaccgccccaggtgggccgcgccccctccccagcagccagcagggcgccagggctgagccggccgtggaggggagcgggtcccgcgggttatacaggcgccggggctccgcggcaggatgcagcaccgaggcttcctcctcctcaccctcctcgccctgctggcgctcacctccgcggtcgccaaaaagaaagataaggtgaagaagggcggcccggggagcgagtgcgctgagtgggcctgggggccctgcacccccagcagcaaggattgcggcgtgggtttccgcgagggcacctgcggggcccagacccagcgcatccggtgcagggtgccctgcaactggaagaaggagtttggagccgactgcaagtacaagtttgagaactggggtgcgtgtgatgggggcacaggcaccaaagtccgccaaggcaccctgaagaaggcgcgctacaatgctcagtgccaggagaccatccgcgtcaccaagccctgcacccccaagaccaaagcaaaggccaaagccaagaaagggaagggaaaggactagacgccaagcctggatgccaaggagcccctggtgtcacatggggcctggcccacgccctccctctcccaggcccgagatgtgacccaccagtgccttctgtctgctcgttagctttaatcaatcatgccctgccttgtccctctcactccccagccccacccctaagtgcccaaagtggggagggacaagggattctgggaagcttgagcctcccccaaagcaatgtgagtcccagagcccgcttttgttcttccccacaattccattactaagaaacacatcaaataaactgactttttccccccaataaaagctcttcttttttaatata

SEQ ID NO: 154040 - DNA, 951 bp, Homo sapiens
  Payload ID: 10273
  Gene Symbol: MDK
  Gene Name: midkine (neurite growth-promoting factor 2)
  Uniprot ID: P21741
  ENST ID: ENST00000395565
  CDS Start-End: 177-608
ggacgggcccggcgcgggagggagcgaagcagcgcgggcagcgagcgagtgagcgcgcggcggcccctggtccgcccggccgcggccgatctaggggctgggggctggaggcgggggtgggggtctgagctgcgtcctgggctcgaggcgtcccccggggagtcgcctcttagcggatgcagcaccgaggcttcctcctcctcaccctcctcgccctgctggcgctcacctccgcggtcgccaaaaagaaagataaggtgaagaagggcggcccggggagcgagtgcgctgagtgggcctgggggccctgcacccccagcagcaaggattgcggcgtgggtttccgcgagggcacctgcggggcccagacccagcgcatccggtgcagggtgccctgcaactggaagaaggagtttggagccgactgcaagtacaagtttgagaactggggtgcgtgtgatgggggcacaggcaccaaagtccgccaaggcaccctgaagaaggcgcgctacaatgctcagtgccaggagaccatccgcgtcaccaagccctgcacccccaagaccaaagcaaaggccaaagccaagaaagggaagggaaaggactagacgccaagcctggatgccaaggagcccctggtgtcacatggggcctggcccacgccctccctctcccaggcccgagatgtgacccaccagtgccttctgtctgctcgttagctttaatcaatcatgccctgccttgtccctctcactccccagccccacccctaagtgcccaaagtggggagggacaagggattctgggaagcttgagcctcccccaaagcaatgtgagtcccagagcccgcttttgttcttccccacaattccattactaagaaacacatcaaataaactgactttttccccccaataaaagctcttcttttttaatatataaaagcccctt

SEQ ID NO: 154041 - DNA, 828 bp, Homo sapiens
  Payload ID: 10273
  Gene Symbol: MDK
  Gene Name: midkine (neurite growth-promoting factor 2)
  Uniprot ID: P21741
  ENST ID: ENST00000395566
  CDS Start-End: 85-516
ttctggagacaaaaggggccgcggcggccggagcgggacgggcccggcgcgggagggagcgaagcagcgcgggcagcgagcgagatgcagcaccgaggcttcctcctcctcaccctcctcgccctgctggcgctcacctccgcggtcgccaaaaagaaagataaggtgaagaagggcggcccggggagcgagtgcgctgagtgggcctgggggccctgcacccccagcagcaaggattgcggcgtgggtttccgcgagggcacctgcggggcccagacccagcgcatccggtgcagggtgccctgcaactggaagaaggagtttggagccgactgcaagtacaagtttgagaactggggtgcgtgtgatgggggcacaggcaccaaagtccgccaaggcaccctgaagaaggcgcgctacaatgctcagtgccaggagaccatccgcgtcaccaagccctgcacccccaagaccaaagcaaaggccaaagccaagaaagggaagggaaaggactagacgccaagcctggatgccaaggagcccctggtgtcacatggggcctggcccacgccctccctctcccaggcccgagatgtgacccaccagtgccttctgtctgctcgttagctttaatcaatcatgccctgccttgtccctctcactccccagccccacccctaagtgcccaaagtggggagggacaagggattctgggaagcttgagcctcccccaaagcaatgtgagtcccagagcccgcttttgttcttccccacaattccattactaagaaacacatcaaataaactgactttttccccccaataaaa

SEQ ID NO: 154042 - DNA, 686 bp, Homo sapiens
  Payload ID: 10273
  Gene Symbol: MDK
  Gene Name: midkine (neurite growth-promoting factor 2)
  Uniprot ID: P21741
  ENST ID: ENST00000395569
  CDS Start-End: 92-355
agaccggttctggagacaaaaggggccgcggcggccggagcgggacgggcccggcgcgggagggagcgaagcagcgcgggcagcgagcgagatgcagcaccgaggcttcctcctcctcaccctcctcgccctgctggcgctcacctccgcggtcgccaaaaagaaagccgactgcaagtacaagtttgagaactggggtgcgtgtgatgggggcacaggcaccaaagtccgccaaggcaccctgaagaaggcgcgctacaatgctcagtgccaggagaccatccgcgtcaccaagccctgcacccccaagaccaaagcaaaggccaaagccaagaaagggaagggaaaggactagacgccaagcctggatgccaaggagcccctggtgtcacatggggcctggcccacgccctccctctcccaggcccgagatgtgacccaccagtgccttctgtctgctcgttagctttaatcaatcatgccctgccttgtccctctcactccccagccccacccctaagtgcccaaagtggggagggacaagggattctgggaagcttgagcctcccccaaagcaatgtgagtcccagagcccgcttttgttcttccccacaattccattactaagaaacacatcaaataaactgactttttccccccaataaaagctcttcttttttaatata

SEQ ID NO: 154043 - DNA, 1026 bp, Homo sapiens
  Payload ID: 10273
  Gene Symbol: MDK
  Gene Name: midkine (neurite growth-promoting factor 2)
  Uniprot ID: P21741
  ENST ID: ENST00000407067
  CDS Start-End: 306-737
gagcgagtgagcgcgcggcggcccctggtccgcccggccgcggccgatctaggggctgggggctggaggcgggggtgggggtctgagctgcgtcctgggctcgaggcgtcccccggggagtcgcctcttagcggtgcgtccgggctagcggcgaggggccgccccaagtcttcccaccgccgccaccttagcagcccgacttggggcctggaaagtggagcacgcggaggtgggagggccctgcacgcggcccccggtggggaaggggacgggccagggattcagactcgggctctcccctcaggatgcagcaccgaggcttcctcctcctcaccctcctcgccctgctggcgctcacctccgcggtcgccaaaaagaaagataaggtgaagaagggcggcccggggagcgagtgcgctgagtgggcctgggggccctgcacccccagcagcaaggattgcggcgtgggtttccgcgagggcacctgcggggcccagacccagcgcatccggtgcagggtgccctgcaactggaagaaggagtttggagccgactgcaagtacaagtttgagaactggggtgcgtgtgatgggggcacaggcaccaaagtccgccaaggcaccctgaagaaggcgcgctacaatgctcagtgccaggagaccatccgcgtcaccaagccctgcacccccaagaccaaagcaaaggccaaagccaagaaagggaagggaaaggactagacgccaagcctggatgccaaggagcccctggtgtcacatggggcctggcccacgccctccctctcccaggcccgagatgtgacccaccagtgccttctgtctgctcgttagctttaatcaatcatgccctgccttgtccctctcactccccagccccacccctaagtgcccaaagtggggagggacaagggattctgggaagcttgagcctcccccaaagcaatgtgagtcccagagcccgcttttgttcttccccacaattccattactaagaaacacatcaaataaa

SEQ ID NO: 154044 - DNA, 1166 bp, Homo sapiens
  Payload ID: 10273
  Gene Symbol: MDK
  Gene Name: midkine (neurite growth-promoting factor 2)
  Uniprot ID: P21741
  ENST ID: ENST00000405308
  CDS Start-End: 430-861
cggcttcccgcttcccgcggagaacaacaatgaaagtgaaagaggggtggggcgggggcgagcccgggttctgtggcccatttgccctgtggccttgagcaagcccctcccccaggcctcgggggctctcccggtttgggggaaccgggcgaggcaatgccacaggcccagggttagagggggtgggcacttgcagctgccgatgtggctggatctggaacttctcagacggctcctgtcagcgccaagtttcaccaaatccaggcctgcgggctcctcccccaggacccccactcgcagtccctcaagcctgtgctcccggaaaggcactgggcgaccgcacccgtggctttctctgggcgaccgggtcccagactccccccagcacagcagagcgcttccctgcccacccgcggaaaccgccccaggatgcagcaccgaggcttcctcctcctcaccctcctcgccctgctggcgctcacctccgcggtcgccaaaaagaaagataaggtgaagaagggcggcccggggagcgagtgcgctgagtgggcctgggggccctgcacccccagcagcaaggattgcggcgtgggtttccgcgagggcacctgcggggcccagacccagcgcatccggtgcagggtgccctgcaactggaagaaggagtttggagccgactgcaagtacaagtttgagaactggggtgcgtgtgatgggggcacaggcaccaaagtccgccaaggcaccctgaagaaggcgcgctacaatgctcagtgccaggagaccatccgcgtcaccaagccctgcacccccaagaccaaagcaaaggccaaagccaagaaagggaagggaaaggactagacgccaagcctggatgccaaggagcccctggtgtcacatggggcctggcccacgccctccctctcccaggcccgagatgtgacccaccagtgccttctgtctgctcgttagctttaatcaatcatgccctgccttgtccctctcactccccagccccacccctaagtgcccaaagtggggagggacaagggattctgggaagcttgagcctcccccaaagcaatgtgagtcccagagcccgcttttgttcttccccacaattccattactaagaaacacatcaaataaactgactttttcccccc

SEQ ID NO: 154045 - DNA, 540 bp, Homo sapiens
  Payload ID: 10273
  Gene Symbol: MDK
  Gene Name: midkine (neurite growth-promoting factor 2)
  ENST ID: ENST00000441869
  CDS Start-End: 394-540
ggtgggcacttgcagctgccgatgtggctggatctggaacttctcagacggctcctgtcagcgccaagtttcaccaaatccaggcctgcgggctcctcccccaggacccccactcgcagtccctcaagcctgtgctcccggaaaggcactgggcgaccgcacccgtggctttctctgggcgaccgggtcccagactccccccagcacagcagagcgcttccctgcccacccgcggaaaccgccccaggtgggccgcgccccctccccagcagccagcagggcgccagggctgagccggccgtggaggggagcgggtcccgcgggttatacaggcgccggggctccgcggcaggcaagagaagctgaggcctgagaacggcccgggccttggcgatgcagcaccgaggcttcctcctcctcaccctcctcgccctgctggcgctcacctccgcggtcgccaaaaagaaagataaggtgaagaagggcggcccggggagcgagtgcgctgagtgggcctgggggccctgcacccccagcagc

SEQ ID NO: 154046 - DNA, 477 bp, Homo sapiens
  Payload ID: 10273
  Gene Symbol: MDK
  Gene Name: midkine (neurite growth-promoting factor 2)
  ENST ID: ENST00000533952
  CDS Start-End: 84-477
agccagcagggcgccagggctgagccggccgtggaggggagcgggtcccgcgggttatacaggcgccggggctccgcggcaggatgcagcaccgaggcttcctcctcctcaccctcctcgccctgctggcgctcacctccgcggtcgccaaaaagaaagataaggtgaagaagggcggcccggggagcgagtgcgctgagtgggcctgggggccctgcacccccagcagcaaggattgcggcgtgggtttccgcgagggcacctgcggggcccagacccagcgcatccggtgcagggtgccctgcaactggaagaaggagtttggagccgactgcaagtacaagtttgagaactggggtgcgtgtgatgggggcacaggcaccaaagtccgccaaggcaccctgaagaaggcgcgctacaatgctcagtgccaggagaccatccgcgtcaccaagccctgcacccccaagaccaaag

SEQ ID NO: 154047 - DNA, 1339 bp, Homo sapiens
  Payload ID: 10273
  Gene Symbol: MDK
  Gene Name: midkine (neurite growth-promoting factor 2)
  ENST ID: ENST00000489525
  CDS Start-End: 151-621
aagcagcgcgggcagcgagcgagtgagcgcgcggcggcccctggtccgcccggccgcggccgatctaggggctgggggctggaggcgggggtgggggtctgagctgcgtcctgggctcgaggcgtcccccggggagtcgcctcttagcggatgcagcaccgaggcttcctcctcctcaccctcctcgccctgctggcgctcacctccgcggtcgccaaaaagaaagataaggtgaagaagggcggcccggggagcgagtgcgctgagtgggcctgggggccctgcacccccagcagcaaggattgcggcgtgggtttccgcgagggcacctgcggggcccagacccagcgcatccggtgcagggtgccctgcaactggaagaaggagtttggagccgactgcaagtacaagtttgagaactggggtgcgtgtgatgggggcacaggcaccaaagtccgccaaggcaccctgaagaaggcgcgctacaatgctcagtgccaggagaccatccgcgtcaccaagccctgcacccccaagaccaaagcaaaggccaaaggtcagcgaaaggagaagggggtggggctgtcgcggggggctgcccccccccccccccgcctgtgaggggacaattccaagttaaaccttaagttttgagtcctggccagtggcttcctgacatcgcctcacttggcttccctgcctggaaaagtctgaagatgggcactacaagagaggccgcaggtgatgctggggacataaatcctccctggcccaaatagggaccaactcaaactactccattggagcatctggcttaggacccagggagagtgtcctggaacggcttgcctttgtcagctctccagccacgggcagcatttggtcagctctgccctttctagtgttgggaggaggtcaaggcccaccctgggcctctcagctcactcgtgactcagcccagcgaggccagcagggcaggggtgaatctgcccgcttctcagccaagaaagggaagggaaaggactagacgccaagcctggatgccaaggagcccctggtgtcacatggggcctggcccacgccctccctctcccaggcccgagatgtgacccaccagtgccttctgtctgctcgttagctttaatcaatcatgccctgccttgtccctctcactccccagccccacccctaagtgcccaaagtggggagggacaagggattctgggaagcttgagcctcccccaaagcaatgtgagtcccagagcccgcttttgttcttccccacaattccattactaagaaacacatcaaataaactgactttttccccccaataaaa

SEQ ID NO: 154048 - DNA, 635 bp, Homo sapiens
  Payload ID: 10273
  Gene Symbol: MDK
  Gene Name: midkine (neurite growth-promoting factor 2)
  ENST ID: ENST00000617138
  CDS Start-End: 106-564
catgtgaccggctcagaccggttctggagacaaaaggggccgcggcggccggagcgggacgggcccggcgcgggagggagcgaagcagcgcgggcagcgagcgagatgcagcaccgaggcttcctcctcctcaccctcctcgccctgctggcgctcacctccgcggtcgccaaaaagaaagaagaaggcgcgctacaatgctcagtgccaggagaccatccgcgtcaccaagccctgcacccccaagaccaaagcaaaggccaaagccaagaaagggaagggaaaggactagacgccaagcctggatgccaaggagcccctggtgtcacatggggcctggcccacgccctccctctcccaggcccgagatgtgacccaccagtgccttctgtctgctcgttagctttaatcaatcatgccctgccttgtccctctcactccccagccccacccctaagtgcccaaagtggggagggacaagggattctgggaagcttgagcctcccccaaagcaatgtgagtcccagagcccgcttttgttcttccccacaattccattactaagaaacacatcaaataaactgactttttccccccaataaaagctcttcttttttaatatataaaagcccctt

SEQ ID NO: 154049 - DNA, 6463 bp, Homo sapiens
  Payload ID: 10274
  Gene Symbol: MID1
  Gene Name: midline 1
  Uniprot ID: O15344
  ENST ID: ENST00000317552
  CDS Start-End: 402-2405
gattggcgaagctcctccgcggcccaagccagccacctacaacgtctctgagaactgatttgaaataagagccaggcggtcctcgcttccctgcgaccgacttttcataggctgggggagaaaaggttgagaaacttgacattgtctcgagcagagtgcgtgtagcaacagatcaaagaaaaagaggacgaaaacgtgctctttgctgcccgtagatttcgccgggttgcttttgtcttgcgggctcctgtcgggttcggtgtttccgctctgaagactgcgacgcgggctccgatgcagctcgctccctgccggatgggtcatgggattctaaacatgaggcagatagctgatcagcttccttgggttttgctgatgacacaagagagctttgcctgaagatggaaacactggagtcagaactgacctgccctatttgtctggagctctttgaggaccctcttctactgccctgcgcacacagcctctgcttcaactgcgcccaccgcatcctagtatcacactgtgccaccaacgagtctgtggagtccatcaccgccttccagtgccccacctgccggcatgtcatcaccctcagccagcgaggtctagacgggctcaagcgcaacgtcaccctacagaacatcatcgacaggttccagaaagcatcagtgagcgggcccaactctcccagcgagacccgtcgggagcgggcctttgacgccaacaccatgacctccgccgagaaggtcctctgccagttttgtgaccaggatcctgcccaggacgctgtgaagacctgtgtcacttgtgaagtatcctactgtgacgagtgcctgaaagccactcacccgaataagaagccctttacaggccatcgtctgattgagccaattccggactctcacatccgggggctgatgtgcttggagcatgaggatgagaaggtgaatatgtactgtgtgaccgatgaccagttaatctgtgccttgtgtaaactggttgggcggcaccgcgatcatcaggtggcagctttgagtgagcgctatgacaaattgaagcaaaacttagagagtaacctcaccaaccttattaagaggaacacagaactggagacccttttggctaaactcatccaaacctgtcaacatgttgaagtcaatgcatcacgtcaagaagccaaattgacagaggagtgtgatcttctcattgagatcattcagcaaagacgacagattattggaaccaagatcaaagaagggaaggtgatgaggcttcgcaaactggctcagcagattgcaaactgcaaacagtgcattgagcggtcagcatcactcatctcccaagcggaacactctctgaaggagaatgatcatgcgcgtttcctacagactgctaagaatatcaccgagagagtctccatggcaactgcatcctcccaggttctaattcctgaaatcaacctcaatgacacatttgacacctttgccttagatttttcccgagagaagaaactgctagaatgtctggattaccttacagctcccaaccctcccacaattagagaagagctctgcacagcttcatatgacaccatcactgtgcattggacctccgatgatgagttcagcgtggtctcctacgagctccagtacaccatattcaccggacaagccaacgtcgttagtctgtgtaattcggctgatagctggatgatagtacccaacatcaagcagaaccactacacggtgcacggtctgcagagcggcaccaagtacatcttcatggtcaaggccatcaaccaggcgggcagccgcagcagtgagcctgggaagttgaagacaaacagccaaccatttaaactggatcccaaatctgctcatcgaaaactgaaggtgtcccatgataacttgacagtagaacgtgatgagtcatcatccaagaagagtcacacacctgaacgcttcaccagccaggggagctatggagtagctggaaatgtgtttattgatagtggccggcattattgggaagtggtcataagtggaagcacatggtatgccattggtcttgcttacaaatcagccccgaagcatgaatggattgggaagaactctgcttcctgggcgctctgccgctgcaacaataactgggtggtgagacacaatagcaaggaaatccccattgagcctgccccccacctccggcgcgtgggcatcctgctggactatgataacggctctatcgccttttatgatgctttgaactccatccacctctacaccttcgacgtcgcatttgcgcagcctgtttgccccaccttcaccgtgtggaacaagtgtctgacgattatcactgggctccctatcccagaccatttggactgcacagagcagctgccgtgagcgtctggccacatggagctgctttctggggaacagtaaggttcaggccactatttaggggactgagaaagcacaggcttcatgagtgtaatgaaatctcaccagaagtgtcccgaaatcggctcagatagggctcaaaacaagagattcctctccttttactgtgtcttgtattaagtacgggctttaataatttctttaatttttttgtatttagaggaaaatctatagattatttataagagaaacataatcaggattacaacttttaggaattacttggttttgcacattaagaggcccataagtttatcagctatttacaaccttcatttcatcacaatctgtgggcttacaaaaaaacaaaaacttttgtagttttgtatgttactcatcttcttacctgatatcccatgatgatcccatggtaggtcttctcacctcgatggtgcataacaggatgtgtttgaacctagtaggggaggaaacaggctttcttactctggtttaatttgaagtgttttaattgtgatgtcaaaaagttgtatcagatcaactaaaatggagagcaagacagagaatgaaaagagttgattttggacctcggaccttgccgtggctaaatctttaccttctcatagctgatgggataatgttggaaagaaaggttctgaatcctttggccacattttgccctgcttctctcagggttaagggttctggaagaacattaagaatgagattgcaattgaaaatagtcattttgaatcctattgattattcaaaaattcaggctgatttgtcttttatcagaggtaggattctgttttatagtatagaatctactttatccttccttttaatagttcctttagacctgtgaaatttcttcactacatttaatagttctcctatttcccgctcccccatatcaattttccttttgtctccggggctgagtaaataaacatgttctgtcacaaatagcagcaccactttggattgattttgctctccaggacatcagcacatggccctgatcagcactaccacatccaaacataagtcactgaaaaacacttaatatttatgagttggtaatgacaagggacattgtataaagtactatttgctagattcatgcctcaaaagttattataaacagacctttattaaacacatcttgaaagatgtagaagtccctctatagtctagtatagtttacaatagagttgtaagaccaaaaaaaaaaaaaaaaaattcaaactcgttattcaggaacctgcttataaaatgtcagctgggattctttgcatgccaatctgatgcgttggaatggtccatgaattaaggctttcttgagcagttcttggcccagaactctggcattggttctagtttgatgaagggcatgacctctataaatggtttcaattgctaaaatatttacctgggatactgggtcagccattttgactgagcagactagtggatttagacattgtttttagttattttgtttttaaccaaatcaaccaactgcctccctgaaataagtcaatgaactcattgtttcagcatcacgtggccaaaggtcatgtgattgcaaatctggatttcaagggaggccaagccagcttcctgggtccttccatcctcttccctagcagacactctcctttttcttaacagatagattctatatatttactatattatttatacccagatgaatattttgatagatacctaagacaatttcacatctaaaagatggacgcctcaatggaaaaaaaacaatctttctctggaaaccttataggtttttctttttattacaatataaaagcaatgtgtgtttgccttctctgagtaaactgaaagggttgtctcagtaatttttacatacattttgggtaactggataatggatattttaatgcactttgtacactaacaggttctaaataaaagggtctaaaactcagcttctgagtttttaaaatcacggtctccaggtaccaataaatgctacagtttgccttatgatgttaacataaaacacttagtagaaggacaatatttccatgaaaataatgtttttcaatattaagaagttactactcaaattttcacagtaagccatttagggtatgtttggctatttttataaggacatgagagattatgtcataattttgttgtggaagtctcactcttggctaacttaaaagcattgtggatagtagcagttactagttccaggttgtcatatttacaggaaaatatgtatatggtgaaaggccaccgtgtttaattactataatgatgtagaaaagattcccgtgtgaattttttttttgaaagtctaaaaaatgtatgctgtaaaaatttgctgcagtgtaattttgcattctctttaaactgattgaggtcacagtattttattatttggggtcctcaccacaggaaacactgcgatacaggggcaaaagagatggcagtgccaattaaattaatacaacaaaatcaatgcagcaccaaccaagactgccaggtctggtgtcatgggtatgcccagagcccaggagttcagaagggccctaagcctgatttaatgctctgctgttgatgtcttgaaattcttaacaatttttgaacaaggggcctgcgttttcacttcgcactgggccttgcaaattacatagcgagtgctcataaaagaactcagaaacgtggtacctctcttcctggtggatacaaataaagaaatctggatccaaagttgaaagttgctggcgatatcattcaagtaggactctaaatagtggattaagatgagggtgggcctgggtgaagattctttccagctttaaaagaaagtgacttcaaaaactgactgcaaatattgacgatggtttctgctggaggaaaagaaacagcttgaatacagacaggcttttttattacggtactgatatattgaccttaaacttgctgaggaactgaactaacgtcctccagtgaccgtggaattccatctcagctccaggaacatgcagatacctgcaaagagacacgcatatatgctggcatacatgtgcatttggtgttgggaagttgaccatctggtctatcttaataaaatggtaaaaagcacaccaagacaatgatgggggcaggaggatgtttttgaaaacagcgcttctcaaccagtgctcgattttgccccccaggagacatttggcaatgcaatggcaacttttggttgtcgcagccggggaagggaagctaccagcatctagtgcgtagaggtcatggacgccgttaaacatcctacagtgcaagcgcagcccccgaccacgaagagttgtcttgctcaaatatcaacagtgctgcagtgtagaaacttgatcgttggttttcttttaatgcaaaactctcataaaaacctttcacttttcctgtcattgattatatgcttgatacacccaaaaagaaaaggggaggggcaccaattcacctacactccagtggctccatcacctttaaaaatatttataaaatagttccaaaaatctgatatctgaaaagcaatccaagcctgtgtaaatgggaatcactgataagtatcatcatctgtatcagcttggcttggacatgaaaaattgattctctttatgtcactccttgcacctggacaaattcaatccccggtacttaagtcacactgccaagccctcggccctgactattgtcttgattgctgttcctttctggttcaaaataaaatcatttttgtggcaccaagaccctctgtctctgcctgtctctgttgccttttcatcattttgtgtttttgcagttatgatgttgacaaatatttattcaacatctaccatttattcatactactttatgacatataattcattttcttttactgtctctcatccactatttgcctttccctattcaaaatacaattcttttgcaacactcaaaatattctccagggaatttttaaaacacaataaaagaaagcctatatagaagtg

SEQ ID NO: 154050 - DNA, 6044 bp, Homo sapiens
  Payload ID: 10274
  Gene Symbol: MID1
  Gene Name: midline 1
  Uniprot ID: O15344
  ENST ID: ENST00000380779
  CDS Start-End: 229-2232
gaccgattttcctgttgtgtttcactgttgacgcactcacagacacacaggaccgctccagcactgcctgccacccaccgtctggtctcggtggcctgtctatcatttcgtgggtccccatcctctgcctacggcgatgtttcttcaaaaagaactagtgtgcagtccattgatagctgatcagcttccttgggttttgctgatgacacaagagagctttgcctgaagatggaaacactggagtcagaactgacctgccctatttgtctggagctctttgaggaccctcttctactgccctgcgcacacagcctctgcttcaactgcgcccaccgcatcctagtatcacactgtgccaccaacgagtctgtggagtccatcaccgccttccagtgccccacctgccggcatgtcatcaccctcagccagcgaggtctagacgggctcaagcgcaacgtcaccctacagaacatcatcgacaggttccagaaagcatcagtgagcgggcccaactctcccagcgagacccgtcgggagcgggcctttgacgccaacaccatgacctccgccgagaaggtcctctgccagttttgtgaccaggatcctgcccaggacgctgtgaagacctgtgtcacttgtgaagtatcctactgtgacgagtgcctgaaagccactcacccgaataagaagccctttacaggccatcgtctgattgagccaattccggactctcacatccgggggctgatgtgcttggagcatgaggatgagaaggtgaatatgtactgtgtgaccgatgaccagttaatctgtgccttgtgtaaactggttgggcggcaccgcgatcatcaggtggcagctttgagtgagcgctatgacaaattgaagcaaaacttagagagtaacctcaccaaccttattaagaggaacacagaactggagacccttttggctaaactcatccaaacctgtcaacatgttgaagtcaatgcatcacgtcaagaagccaaattgacagaggagtgtgatcttctcattgagatcattcagcaaagacgacagattattggaaccaagatcaaagaagggaaggtgatgaggcttcgcaaactggctcagcagattgcaaactgcaaacagtgcattgagcggtcagcatcactcatctcccaagcggaacactctctgaaggagaatgatcatgcgcgtttcctacagactgctaagaatatcaccgagagagtctccatggcaactgcatcctcccaggttctaattcctgaaatcaacctcaatgacacatttgacacctttgccttagatttttcccgagagaagaaactgctagaatgtctggattaccttacagctcccaaccctcccacaattagagaagagctctgcacagcttcatatgacaccatcactgtgcattggacctccgatgatgagttcagcgtggtctcctacgagctccagtacaccatattcaccggacaagccaacgtcgttagtctgtgtaattcggctgatagctggatgatagtacccaacatcaagcagaaccactacacggtgcacggtctgcagagcggcaccaagtacatcttcatggtcaaggccatcaaccaggcgggcagccgcagcagtgagcctgggaagttgaagacaaacagccaaccatttaaactggatcccaaatctgctcatcgaaaactgaaggtgtcccatgataacttgacagtagaacgtgatgagtcatcatccaagaagagtcacacacctgaacgcttcaccagccaggggagctatggagtagctggaaatgtgtttattgatagtggccggcattattgggaagtggtcataagtggaagcacatggtatgccattggtcttgcttacaaatcagccccgaagcatgaatggattgggaagaactctgcttcctgggcgctctgccgctgcaacaataactgggtggtgagacacaatagcaaggaaatccccattgagcctgccccccacctccggcgcgtgggcatcctgctggactatgataacggctctatcgccttttatgatgctttgaactccatccacctctacaccttcgacgtcgcatttgcgcagcctgtttgccccaccttcaccgtgtggaacaagtgtctgacgattatcactgggctccctatcccagaccatttggactgcacagagcagctgccgtgagcgtctggccacatggagctgctttctggggaacagtaaggttcaggccactatttaggggactgagaaagcacaggcttcatgagtgtaatgaaatctcaccagaagtgtcccgaaatcggctcagatagggctcaaaacaagagattcctctccttttactgtgtcttgtattaagtacgggctttaataatttctttaatttttttgtatttagaggaaaatctatagattatttataagagaaacataatcaggattacaacttttaggaattacttggttttgcacattaagaggcccataagtttatcagctatttacaaccttcatttcatcacaatctgtgggcttacaaaaaaacaaaaacttttgtagttttgtatgttactcatcttcttacctgatatcccatgatgatcccatggtaggtcttctcacctcgatggtgcataacaggatgtgtttgaacctagtaggggaggaaacaggctttcttactctggtttaatttgaagtgttttaattgtgatgtcaaaaagttgtatcagatcaactaaaatggagagcaagacagagaatgaaaagagttgattttggacctcggaccttgccgtggctaaatctttaccttctcatagctgatgggataatgttggaaagaaaggttctgaatcctttggccacattttgccctgcttctctcagggttaagggttctggaagaacattaagaatgagattgcaattgaaaatagtcattttgaatcctattgattattcaaaaattcaggctgatttgtcttttatcagaggtaggattctgttttatagtatagaatctactttatccttccttttaatagttcctttagacctgtgaaatttcttcactacatttaatagttctcctatttcccgctcccccatatcaattttccttttgtctccggggctgagtaaataaacatgttctgtcacaaatagcagcaccactttggattgattttgctctccaggacatcagcacatggccctgatcagcactaccacatccaaacataagtcactgaaaaacacttaatatttatgagttggtaatgacaagggacattgtataaagtactatttgctagattcatgcctcaaaagttattataaacagacctttattaaacacatcttgaaagatgtagaagtccctctatagtctagtatagtttacaatagagttgtaagaccaaaaaaaaaaaaaaaaaattcaaactcgttattcaggaacctgcttataaaatgtcagctgggattctttgcatgccaatctgatgcgttggaatggtccatgaattaaggctttcttgagcagttcttggcccagaactctggcattggttctagtttgatgaagggcatgacctctataaatggtttcaattgctaaaatatttacctgggatactgggtcagccattttgactgagcagactagtggatttagacattgtttttagttattttgtttttaaccaaatcaaccaactgcctccctgaaataagtcaatgaactcattgtttcagcatcacgtggccaaaggtcatgtgattgcaaatctggatttcaagggaggccaagccagcttcctgggtccttccatcctcttccctagcagacactctcctttttcttaacagatagattctatatatttactatattatttatacccagatgaatattttgatagatacctaagacaatttcacatctaaaagatggacgcctcaatggaaaaaaaacaatctttctctggaaaccttataggtttttctttttattacaatataaaagcaatgtgtgtttgccttctctgagtaaactgaaagggttgtctcagtaatttttacatacattttgggtaactggataatggatattttaatgcactttgtacactaacaggttctaaataaaagggtctaaaactcagcttctgagtttttaaaatcacggtctccaggtaccaataaatgctacagtttgccttatgatgttaacataaaacacttagtagaaggacaatatttccatgaaaataatgtttttcaatattaagaagttactactcaaattttcacagtaagccatttagggtatgtttggctatttttataaggacatgagagattatgtcataattttgttgtggaagtctcactcttggctaacttaaaagcattgtggatagtagcagttactagttccaggttgtcatatttacaggaaaatatgtatatggtgaaaggccaccgtgtttaattactataatgatgtagaaaagattcccgtgtgaattttttttttgaaagtctaaaaaatgtatgctgtaaaaatttgctgcagtgtaattttgcattctctttaaactgattgaggtcacagtattttattatttggggtcctcaccacaggaaacactgcgatacaggggcaaaagagatggcagtgccaattaaattaatacaacaaaatcaatgcagcaccaaccaagactgccaggtctggtgtcatgggtatgcccagagcccaggagttcagaagggccctaagcctgatttaatgctctgctgttgatgtcttgaaattcttaacaatttttgaacaaggggcctgcgttttcacttcgcactgggccttgcaaattacatagcgagtgctcataaaagaactcagaaacgtggtacctctcttcctggtggatacaaataaagaaatctggatccaaagttgaaagttgctggcgatatcattcaagtaggactctaaatagtggattaagatgagggtgggcctgggtgaagattctttccagctttaaaagaaagtgacttcaaaaactgactgcaaatattgacgatggtttctgctggaggaaaagaaacagcttgaatacagacaggcttttttattacggtactgatatattgaccttaaacttgctgaggaactgaactaacgtcctccagtgaccgtggaattccatctcagctccaggaacatgcagatacctgcaaagagacacgcatatatgctggcatacatgtgcatttggtgttgggaagttgaccatctggtctatcttaataaaatggtaaaaagcacaccaagacaatgatgggggcaggaggatgtttttgaaaacagcgcttctcaaccagtgctcgattttgccccccaggagacatttggcaatgcaatggcaacttttggttgtcgcagccggggaagggaagctaccagcatctagtgcgtagaggtcatggacgccgttaaacatcctacagtgcaagcgcagcccccgaccacgaagagttgtcttgctcaaatatcaacagtgctgcagtgtagaaacttgatcgttggttttcttttaatgcaaaactctcataaaaacctttcacttttcctgtcattgattatatgcttgatacacccaaaaagaaaaggggaggggcaccaattcacctacactccagtggctccatcacctttaaaaatatttataaaatagttccaaaaatctgatatctgaaaagcaatccaagcctgtgtaaatgggaatcactgataagtatcatcatctgtatcagcttggcttggacatgaaaaattgattctctttatgtcactccttgcacctggacaaattcaatccccggtacttaagtcacactgccaagccctcggccctgactattgtcttgattgctgttcctttctggttcaaaataaaatcatttttgtggcaccaaga

SEQ ID NO: 154051 - DNA, 6195 bp, Homo sapiens
  Payload ID: 10274
  Gene Symbol: MID1
  Gene Name: midline 1
  Uniprot ID: O15344
  ENST ID: ENST00000380780
  CDS Start-End: 380-2383
ccctttcttctttatctcggtgtctgaggagttttgtctgcggcttgtcttgctacatttcttggttccctgaccaggaagcgaggtgattaacagacggttgaggcagctccttaggtggctttagcctgccctgtggaacatccctgcgggggactccaaccagccggagcgacgcggatcctgagagcgctcccgggtaggcatttgcccaggtgggacgcctcgccagagccgtgtgtggcaggcccccgtggaggatcaacgcagtggctgaacactgggaaggaactggcacttggagtccagacatctaaaacttgatagctgatcagcttccttgggttttgctgatgacacaagagagctttgcctgaagatggaaacactggagtcagaactgacctgccctatttgtctggagctctttgaggaccctcttctactgccctgcgcacacagcctctgcttcaactgcgcccaccgcatcctagtatcacactgtgccaccaacgagtctgtggagtccatcaccgccttccagtgccccacctgccggcatgtcatcaccctcagccagcgaggtctagacgggctcaagcgcaacgtcaccctacagaacatcatcgacaggttccagaaagcatcagtgagcgggcccaactctcccagcgagacccgtcgggagcgggcctttgacgccaacaccatgacctccgccgagaaggtcctctgccagttttgtgaccaggatcctgcccaggacgctgtgaagacctgtgtcacttgtgaagtatcctactgtgacgagtgcctgaaagccactcacccgaataagaagccctttacaggccatcgtctgattgagccaattccggactctcacatccgggggctgatgtgcttggagcatgaggatgagaaggtgaatatgtactgtgtgaccgatgaccagttaatctgtgccttgtgtaaactggttgggcggcaccgcgatcatcaggtggcagctttgagtgagcgctatgacaaattgaagcaaaacttagagagtaacctcaccaaccttattaagaggaacacagaactggagacccttttggctaaactcatccaaacctgtcaacatgttgaagtcaatgcatcacgtcaagaagccaaattgacagaggagtgtgatcttctcattgagatcattcagcaaagacgacagattattggaaccaagatcaaagaagggaaggtgatgaggcttcgcaaactggctcagcagattgcaaactgcaaacagtgcattgagcggtcagcatcactcatctcccaagcggaacactctctgaaggagaatgatcatgcgcgtttcctacagactgctaagaatatcaccgagagagtctccatggcaactgcatcctcccaggttctaattcctgaaatcaacctcaatgacacatttgacacctttgccttagatttttcccgagagaagaaactgctagaatgtctggattaccttacagctcccaaccctcccacaattagagaagagctctgcacagcttcatatgacaccatcactgtgcattggacctccgatgatgagttcagcgtggtctcctacgagctccagtacaccatattcaccggacaagccaacgtcgttagtctgtgtaattcggctgatagctggatgatagtacccaacatcaagcagaaccactacacggtgcacggtctgcagagcggcaccaagtacatcttcatggtcaaggccatcaaccaggcgggcagccgcagcagtgagcctgggaagttgaagacaaacagccaaccatttaaactggatcccaaatctgctcatcgaaaactgaaggtgtcccatgataacttgacagtagaacgtgatgagtcatcatccaagaagagtcacacacctgaacgcttcaccagccaggggagctatggagtagctggaaatgtgtttattgatagtggccggcattattgggaagtggtcataagtggaagcacatggtatgccattggtcttgcttacaaatcagccccgaagcatgaatggattgggaagaactctgcttcctgggcgctctgccgctgcaacaataactgggtggtgagacacaatagcaaggaaatccccattgagcctgccccccacctccggcgcgtgggcatcctgctggactatgataacggctctatcgccttttatgatgctttgaactccatccacctctacaccttcgacgtcgcatttgcgcagcctgtttgccccaccttcaccgtgtggaacaagtgtctgacgattatcactgggctccctatcccagaccatttggactgcacagagcagctgccgtgagcgtctggccacatggagctgctttctggggaacagtaaggttcaggccactatttaggggactgagaaagcacaggcttcatgagtgtaatgaaatctcaccagaagtgtcccgaaatcggctcagatagggctcaaaacaagagattcctctccttttactgtgtcttgtattaagtacgggctttaataatttctttaatttttttgtatttagaggaaaatctatagattatttataagagaaacataatcaggattacaacttttaggaattacttggttttgcacattaagaggcccataagtttatcagctatttacaaccttcatttcatcacaatctgtgggcttacaaaaaaacaaaaacttttgtagttttgtatgttactcatcttcttacctgatatcccatgatgatcccatggtaggtcttctcacctcgatggtgcataacaggatgtgtttgaacctagtaggggaggaaacaggctttcttactctggtttaatttgaagtgttttaattgtgatgtcaaaaagttgtatcagatcaactaaaatggagagcaagacagagaatgaaaagagttgattttggacctcggaccttgccgtggctaaatctttaccttctcatagctgatgggataatgttggaaagaaaggttctgaatcctttggccacattttgccctgcttctctcagggttaagggttctggaagaacattaagaatgagattgcaattgaaaatagtcattttgaatcctattgattattcaaaaattcaggctgatttgtcttttatcagaggtaggattctgttttatagtatagaatctactttatccttccttttaatagttcctttagacctgtgaaatttcttcactacatttaatagttctcctatttcccgctcccccatatcaattttccttttgtctccggggctgagtaaataaacatgttctgtcacaaatagcagcaccactttggattgattttgctctccaggacatcagcacatggccctgatcagcactaccacatccaaacataagtcactgaaaaacacttaatatttatgagttggtaatgacaagggacattgtataaagtactatttgctagattcatgcctcaaaagttattataaacagacctttattaaacacatcttgaaagatgtagaagtccctctatagtctagtatagtttacaatagagttgtaagaccaaaaaaaaaaaaaaaaaattcaaactcgttattcaggaacctgcttataaaatgtcagctgggattctttgcatgccaatctgatgcgttggaatggtccatgaattaaggctttcttgagcagttcttggcccagaactctggcattggttctagtttgatgaagggcatgacctctataaatggtttcaattgctaaaatatttacctgggatactgggtcagccattttgactgagcagactagtggatttagacattgtttttagttattttgtttttaaccaaatcaaccaactgcctccctgaaataagtcaatgaactcattgtttcagcatcacgtggccaaaggtcatgtgattgcaaatctggatttcaagggaggccaagccagcttcctgggtccttccatcctcttccctagcagacactctcctttttcttaacagatagattctatatatttactatattatttatacccagatgaatattttgatagatacctaagacaatttcacatctaaaagatggacgcctcaatggaaaaaaaacaatctttctctggaaaccttataggtttttctttttattacaatataaaagcaatgtgtgtttgccttctctgagtaaactgaaagggttgtctcagtaatttttacatacattttgggtaactggataatggatattttaatgcactttgtacactaacaggttctaaataaaagggtctaaaactcagcttctgagtttttaaaatcacggtctccaggtaccaataaatgctacagtttgccttatgatgttaacataaaacacttagtagaaggacaatatttccatgaaaataatgtttttcaatattaagaagttactactcaaattttcacagtaagccatttagggtatgtttggctatttttataaggacatgagagattatgtcataattttgttgtggaagtctcactcttggctaacttaaaagcattgtggatagtagcagttactagttccaggttgtcatatttacaggaaaatatgtatatggtgaaaggccaccgtgtttaattactataatgatgtagaaaagattcccgtgtgaattttttttttgaaagtctaaaaaatgtatgctgtaaaaatttgctgcagtgtaattttgcattctctttaaactgattgaggtcacagtattttattatttggggtcctcaccacaggaaacactgcgatacaggggcaaaagagatggcagtgccaattaaattaatacaacaaaatcaatgcagcaccaaccaagactgccaggtctggtgtcatgggtatgcccagagcccaggagttcagaagggccctaagcctgatttaatgctctgctgttgatgtcttgaaattcttaacaatttttgaacaaggggcctgcgttttcacttcgcactgggccttgcaaattacatagcgagtgctcataaaagaactcagaaacgtggtacctctcttcctggtggatacaaataaagaaatctggatccaaagttgaaagttgctggcgatatcattcaagtaggactctaaatagtggattaagatgagggtgggcctgggtgaagattctttccagctttaaaagaaagtgacttcaaaaactgactgcaaatattgacgatggtttctgctggaggaaaagaaacagcttgaatacagacaggcttttttattacggtactgatatattgaccttaaacttgctgaggaactgaactaacgtcctccagtgaccgtggaattccatctcagctccaggaacatgcagatacctgcaaagagacacgcatatatgctggcatacatgtgcatttggtgttgggaagttgaccatctggtctatcttaataaaatggtaaaaagcacaccaagacaatgatgggggcaggaggatgtttttgaaaacagcgcttctcaaccagtgctcgattttgccccccaggagacatttggcaatgcaatggcaacttttggttgtcgcagccggggaagggaagctaccagcatctagtgcgtagaggtcatggacgccgttaaacatcctacagtgcaagcgcagcccccgaccacgaagagttgtcttgctcaaatatcaacagtgctgcagtgtagaaacttgatcgttggttttcttttaatgcaaaactctcataaaaacctttcacttttcctgtcattgattatatgcttgatacacccaaaaagaaaaggggaggggcaccaattcacctacactccagtggctccatcacctttaaaaatatttataaaatagttccaaaaatctgatatctgaaaagcaatccaagcctgtgtaaatgggaatcactgataagtatcatcatctgtatcagcttggcttggacatgaaaaattgattctctttatgtcactccttgcacctggacaaattcaatccccggtacttaagtcacactgccaagccctcggccctgactattgtcttgattgctgttcctttctggttcaaaataaaatcatttttgtggcaccaaga

SEQ ID NO: 154052 - DNA, 3352 bp, Homo sapiens
  Payload ID: 10274
  Gene Symbol: MID1
  Gene Name: midline 1
  Uniprot ID: O15344
  ENST ID: ENST00000380782
  CDS Start-End: 187-1845
atttcgccgggttgcttttgtcttgcgggctcctgtcgggttcggtgtttccgctctgaagactgcgacgcgggctccgatgcagctcgctccctgccggatgggtcatgggattctaaacatgaggcagatagctgatcagcttccttgggttttgctgatgacacaagagagctttgcctgaagatggaaacactggagtcagaactgacctgccctatttgtctggagctctttgaggaccctcttctactgccctgcgcacacagcctctgcttcaactgcgcccaccgcatcctagtatcacactgtgccaccaacgagtctgtggagtccatcaccgccttccagtgccccacctgccggcatgtcatcaccctcagccagcgaggtctagacgggctcaagcgcaacgtcaccctacagaacatcatcgacaggttccagaaagcatcagtgagcgggcccaactctcccagcgagacccgtcgggagcgggcctttgacgccaacaccatgacctccgccgagaaggtcctctgccagttttgtgaccaggatcctgcccaggacgctgtgaagacctgtgtcacttgtgaagtatcctactgtgacgagtgcctgaaagccactcacccgaataagaagccctttacaggccatcgtctgattgagccaattccggactctcacatccgggggctgatgtgcttggagcatgaggatgagaaggtgaatatgtactgtgtgaccgatgaccagttaatctgtgccttgtgtaaactggttgggcggcaccgcgatcatcaggtggcagctttgagtgagcgctatgacaaattgaagcaaaacttagagagtaacctcaccaaccttattaagaggaacacagaactggagacccttttggctaaactcatccaaacctgtcaacatgttgaagtcaatgcatcacgtcaagaagccaaattgacagaggagtgtgatcttctcattgagatcattcagcaaagacgacagattattggaaccaagatcaaagaagggaaggtgatgaggcttcgcaaactggctcagcagattgcaaactgcaaacagtgcattgagcggtcagcatcactcatctcccaagcggaacactctctgaaggagaatgatcatgcgcgtttcctacagactgctaagaatatcaccgagagagtctccatggcaactgcatcctcccaggttctaattcctgaaatcaacctcaatgacacatttgacacctttgccttagatttttcccgagagaagaaactgctagaatgtctggattaccttacagctcccaaccctcccacaattagagaagagctctgcacagcttcatatgacaccatcactgtgcattggacctccgatgatgagttcagcgtggtctcctacgagctccagtacaccatattcaccggacaagccaacgtcgttagtctgtgtaattcggctgatagctggatgatagtacccaacatcaagcagaaccactacacggtgcacggtctgcagagcggcaccaagtacatcttcatggtcaaggccatcaaccaggcgggcagccgcagcagtgagcctgggaagttgaagacaaacagccaaccatttaaactggatcccaaatctgctcatcgaaaactgaaggtgtcccatgataacttgacagtagaacgtgatgagtcatcatccaagaagagtcacacacctgaacgcttcaccagccaggggagctatggagtagctggaaatgtgtttattgatagtggccggcattattgggaagtggtcataagtggaagcacatggtgagacacaatagcaaggaaatccccattgagcctgccccccacctccggcgcgtgggcatcctgctggactatgataacggctctatcgccttttatgatgctttgaactccatccacctctacaccttcgacgtcgcatttgcgcagcctgtttgccccaccttcaccgtgtggaacaagtgtctgacgattatcactgggctccctatcccagaccatttggactgcacagagcagctgccgtgagcgtctggccacatggagctgctttctggggaacagtaaggttcaggccactatttaggggactgagaaagcacaggcttcatgagtgtaatgaaatctcaccagaagtgtcccgaaatcggctcagatagggctcaaaacaagagattcctctccttttactgtgtcttgtattaagtacgggctttaataatttctttaatttttttgtatttagaggaaaatctatagattatttataagagaaacataatcaggattacaacttttaggaattacttggttttgcacattaagaggcccataagtttatcagctatttacaaccttcatttcatcacaatctgtgggcttacaaaaaaacaaaaacttttgtagttttgtatgttactcatcttcttacctgatatcccatgatgatcccatggtaggtcttctcacctcgatggtgcataacaggatgtgtttgaacctagtaggggaggaaacaggctttcttactctggtttaatttgaagtgttttaattgtgatgtcaaaaagttgtatcagatcaactaaaatggagagcaagacagagaatgaaaagagttgattttggacctcggaccttgccgtggctaaatctttaccttctcatagctgatgggataatgttggaaagaaaggttctgaatcctttggccacattttgccctgcttctctcagggttaagggttctggaagaacattaagaatgagattgcaattgaaaatagtcattttgaatcctattgattattcaaaaattcaggctgatttgtcttttatcagaggtaggattctgttttatagtatagaatctactttatccttccttttaatagttcctttagacctgtgaaatttcttcactacatttaatagttctcctatttcccgctcccccatatcaattttccttttgtctccggggctgagtaaataaacatgttctgtcacaaatagcagcaccactttggattgattttgctctccaggacatcagcacatggccctgatcagcactaccacatccaaacataagtcactgaaaaacacttaatatttatgagttggtaatgacaagggacattgtataaagtactatttgctagattcatgcctcaaaagttattataaacagacctttattaaacacatcttgaaagatgtagaagtccctctatagtctagtatagtttacaatagagttgtaagaccaaaaaaaaaaaaaaaaaatt

SEQ ID NO: 154053 - DNA, 6092 bp, Homo sapiens
  Payload ID: 10274
  Gene Symbol: MID1
  Gene Name: midline 1
  Uniprot ID: O15344
  ENST ID: ENST00000380785
  CDS Start-End: 277-2280
cccagcctgcttgaaggacctacaggtttgtctcttccagatcagaactgaggaacaaaaacccccatcctgggaaaaatggggaagctgatttcgccgggttgcttttgtcttgcgggctcctgtcgggttcggtgtttccgctctgaagactgcgacgcgggctccgatgcagctcgctccctgccggatgggtcatgggattctaaacatgaggcagatagctgatcagcttccttgggttttgctgatgacacaagagagctttgcctgaagatggaaacactggagtcagaactgacctgccctatttgtctggagctctttgaggaccctcttctactgccctgcgcacacagcctctgcttcaactgcgcccaccgcatcctagtatcacactgtgccaccaacgagtctgtggagtccatcaccgccttccagtgccccacctgccggcatgtcatcaccctcagccagcgaggtctagacgggctcaagcgcaacgtcaccctacagaacatcatcgacaggttccagaaagcatcagtgagcgggcccaactctcccagcgagacccgtcgggagcgggcctttgacgccaacaccatgacctccgccgagaaggtcctctgccagttttgtgaccaggatcctgcccaggacgctgtgaagacctgtgtcacttgtgaagtatcctactgtgacgagtgcctgaaagccactcacccgaataagaagccctttacaggccatcgtctgattgagccaattccggactctcacatccgggggctgatgtgcttggagcatgaggatgagaaggtgaatatgtactgtgtgaccgatgaccagttaatctgtgccttgtgtaaactggttgggcggcaccgcgatcatcaggtggcagctttgagtgagcgctatgacaaattgaagcaaaacttagagagtaacctcaccaaccttattaagaggaacacagaactggagacccttttggctaaactcatccaaacctgtcaacatgttgaagtcaatgcatcacgtcaagaagccaaattgacagaggagtgtgatcttctcattgagatcattcagcaaagacgacagattattggaaccaagatcaaagaagggaaggtgatgaggcttcgcaaactggctcagcagattgcaaactgcaaacagtgcattgagcggtcagcatcactcatctcccaagcggaacactctctgaaggagaatgatcatgcgcgtttcctacagactgctaagaatatcaccgagagagtctccatggcaactgcatcctcccaggttctaattcctgaaatcaacctcaatgacacatttgacacctttgccttagatttttcccgagagaagaaactgctagaatgtctggattaccttacagctcccaaccctcccacaattagagaagagctctgcacagcttcatatgacaccatcactgtgcattggacctccgatgatgagttcagcgtggtctcctacgagctccagtacaccatattcaccggacaagccaacgtcgttagtctgtgtaattcggctgatagctggatgatagtacccaacatcaagcagaaccactacacggtgcacggtctgcagagcggcaccaagtacatcttcatggtcaaggccatcaaccaggcgggcagccgcagcagtgagcctgggaagttgaagacaaacagccaaccatttaaactggatcccaaatctgctcatcgaaaactgaaggtgtcccatgataacttgacagtagaacgtgatgagtcatcatccaagaagagtcacacacctgaacgcttcaccagccaggggagctatggagtagctggaaatgtgtttattgatagtggccggcattattgggaagtggtcataagtggaagcacatggtatgccattggtcttgcttacaaatcagccccgaagcatgaatggattgggaagaactctgcttcctgggcgctctgccgctgcaacaataactgggtggtgagacacaatagcaaggaaatccccattgagcctgccccccacctccggcgcgtgggcatcctgctggactatgataacggctctatcgccttttatgatgctttgaactccatccacctctacaccttcgacgtcgcatttgcgcagcctgtttgccccaccttcaccgtgtggaacaagtgtctgacgattatcactgggctccctatcccagaccatttggactgcacagagcagctgccgtgagcgtctggccacatggagctgctttctggggaacagtaaggttcaggccactatttaggggactgagaaagcacaggcttcatgagtgtaatgaaatctcaccagaagtgtcccgaaatcggctcagatagggctcaaaacaagagattcctctccttttactgtgtcttgtattaagtacgggctttaataatttctttaatttttttgtatttagaggaaaatctatagattatttataagagaaacataatcaggattacaacttttaggaattacttggttttgcacattaagaggcccataagtttatcagctatttacaaccttcatttcatcacaatctgtgggcttacaaaaaaacaaaaacttttgtagttttgtatgttactcatcttcttacctgatatcccatgatgatcccatggtaggtcttctcacctcgatggtgcataacaggatgtgtttgaacctagtaggggaggaaacaggctttcttactctggtttaatttgaagtgttttaattgtgatgtcaaaaagttgtatcagatcaactaaaatggagagcaagacagagaatgaaaagagttgattttggacctcggaccttgccgtggctaaatctttaccttctcatagctgatgggataatgttggaaagaaaggttctgaatcctttggccacattttgccctgcttctctcagggttaagggttctggaagaacattaagaatgagattgcaattgaaaatagtcattttgaatcctattgattattcaaaaattcaggctgatttgtcttttatcagaggtaggattctgttttatagtatagaatctactttatccttccttttaatagttcctttagacctgtgaaatttcttcactacatttaatagttctcctatttcccgctcccccatatcaattttccttttgtctccggggctgagtaaataaacatgttctgtcacaaatagcagcaccactttggattgattttgctctccaggacatcagcacatggccctgatcagcactaccacatccaaacataagtcactgaaaaacacttaatatttatgagttggtaatgacaagggacattgtataaagtactatttgctagattcatgcctcaaaagttattataaacagacctttattaaacacatcttgaaagatgtagaagtccctctatagtctagtatagtttacaatagagttgtaagaccaaaaaaaaaaaaaaaaaattcaaactcgttattcaggaacctgcttataaaatgtcagctgggattctttgcatgccaatctgatgcgttggaatggtccatgaattaaggctttcttgagcagttcttggcccagaactctggcattggttctagtttgatgaagggcatgacctctataaatggtttcaattgctaaaatatttacctgggatactgggtcagccattttgactgagcagactagtggatttagacattgtttttagttattttgtttttaaccaaatcaaccaactgcctccctgaaataagtcaatgaactcattgtttcagcatcacgtggccaaaggtcatgtgattgcaaatctggatttcaagggaggccaagccagcttcctgggtccttccatcctcttccctagcagacactctcctttttcttaacagatagattctatatatttactatattatttatacccagatgaatattttgatagatacctaagacaatttcacatctaaaagatggacgcctcaatggaaaaaaaacaatctttctctggaaaccttataggtttttctttttattacaatataaaagcaatgtgtgtttgccttctctgagtaaactgaaagggttgtctcagtaatttttacatacattttgggtaactggataatggatattttaatgcactttgtacactaacaggttctaaataaaagggtctaaaactcagcttctgagtttttaaaatcacggtctccaggtaccaataaatgctacagtttgccttatgatgttaacataaaacacttagtagaaggacaatatttccatgaaaataatgtttttcaatattaagaagttactactcaaattttcacagtaagccatttagggtatgtttggctatttttataaggacatgagagattatgtcataattttgttgtggaagtctcactcttggctaacttaaaagcattgtggatagtagcagttactagttccaggttgtcatatttacaggaaaatatgtatatggtgaaaggccaccgtgtttaattactataatgatgtagaaaagattcccgtgtgaattttttttttgaaagtctaaaaaatgtatgctgtaaaaatttgctgcagtgtaattttgcattctctttaaactgattgaggtcacagtattttattatttggggtcctcaccacaggaaacactgcgatacaggggcaaaagagatggcagtgccaattaaattaatacaacaaaatcaatgcagcaccaaccaagactgccaggtctggtgtcatgggtatgcccagagcccaggagttcagaagggccctaagcctgatttaatgctctgctgttgatgtcttgaaattcttaacaatttttgaacaaggggcctgcgttttcacttcgcactgggccttgcaaattacatagcgagtgctcataaaagaactcagaaacgtggtacctctcttcctggtggatacaaataaagaaatctggatccaaagttgaaagttgctggcgatatcattcaagtaggactctaaatagtggattaagatgagggtgggcctgggtgaagattctttccagctttaaaagaaagtgacttcaaaaactgactgcaaatattgacgatggtttctgctggaggaaaagaaacagcttgaatacagacaggcttttttattacggtactgatatattgaccttaaacttgctgaggaactgaactaacgtcctccagtgaccgtggaattccatctcagctccaggaacatgcagatacctgcaaagagacacgcatatatgctggcatacatgtgcatttggtgttgggaagttgaccatctggtctatcttaataaaatggtaaaaagcacaccaagacaatgatgggggcaggaggatgtttttgaaaacagcgcttctcaaccagtgctcgattttgccccccaggagacatttggcaatgcaatggcaacttttggttgtcgcagccggggaagggaagctaccagcatctagtgcgtagaggtcatggacgccgttaaacatcctacagtgcaagcgcagcccccgaccacgaagagttgtcttgctcaaatatcaacagtgctgcagtgtagaaacttgatcgttggttttcttttaatgcaaaactctcataaaaacctttcacttttcctgtcattgattatatgcttgatacacccaaaaagaaaaggggaggggcaccaattcacctacactccagtggctccatcacctttaaaaatatttataaaatagttccaaaaatctgatatctgaaaagcaatccaagcctgtgtaaatgggaatcactgataagtatcatcatctgtatcagcttggcttggacatgaaaaattgattctctttatgtcactccttgcacctggacaaattcaatccccggtacttaagtcacactgccaagccctcggccctgactattgtcttgattgctgttcctttctggttcaaaataaaatcatttttgtggcaccaaga

SEQ ID NO: 154054 - DNA, 5973 bp, Homo sapiens
  Payload ID: 10274
  Gene Symbol: MID1
  Gene Name: midline 1
  Uniprot ID: O15344
  ENST ID: ENST00000380787
  CDS Start-End: 158-2161
acttgccccagcccagcctgcttgaaggacctacaggtttgtctcttccagatcagaactgaggaacaaaaacccccatcctgggaaaaatggggaagctgatagctgatcagcttccttgggttttgctgatgacacaagagagctttgcctgaagatggaaacactggagtcagaactgacctgccctatttgtctggagctctttgaggaccctcttctactgccctgcgcacacagcctctgcttcaactgcgcccaccgcatcctagtatcacactgtgccaccaacgagtctgtggagtccatcaccgccttccagtgccccacctgccggcatgtcatcaccctcagccagcgaggtctagacgggctcaagcgcaacgtcaccctacagaacatcatcgacaggttccagaaagcatcagtgagcgggcccaactctcccagcgagacccgtcgggagcgggcctttgacgccaacaccatgacctccgccgagaaggtcctctgccagttttgtgaccaggatcctgcccaggacgctgtgaagacctgtgtcacttgtgaagtatcctactgtgacgagtgcctgaaagccactcacccgaataagaagccctttacaggccatcgtctgattgagccaattccggactctcacatccgggggctgatgtgcttggagcatgaggatgagaaggtgaatatgtactgtgtgaccgatgaccagttaatctgtgccttgtgtaaactggttgggcggcaccgcgatcatcaggtggcagctttgagtgagcgctatgacaaattgaagcaaaacttagagagtaacctcaccaaccttattaagaggaacacagaactggagacccttttggctaaactcatccaaacctgtcaacatgttgaagtcaatgcatcacgtcaagaagccaaattgacagaggagtgtgatcttctcattgagatcattcagcaaagacgacagattattggaaccaagatcaaagaagggaaggtgatgaggcttcgcaaactggctcagcagattgcaaactgcaaacagtgcattgagcggtcagcatcactcatctcccaagcggaacactctctgaaggagaatgatcatgcgcgtttcctacagactgctaagaatatcaccgagagagtctccatggcaactgcatcctcccaggttctaattcctgaaatcaacctcaatgacacatttgacacctttgccttagatttttcccgagagaagaaactgctagaatgtctggattaccttacagctcccaaccctcccacaattagagaagagctctgcacagcttcatatgacaccatcactgtgcattggacctccgatgatgagttcagcgtggtctcctacgagctccagtacaccatattcaccggacaagccaacgtcgttagtctgtgtaattcggctgatagctggatgatagtacccaacatcaagcagaaccactacacggtgcacggtctgcagagcggcaccaagtacatcttcatggtcaaggccatcaaccaggcgggcagccgcagcagtgagcctgggaagttgaagacaaacagccaaccatttaaactggatcccaaatctgctcatcgaaaactgaaggtgtcccatgataacttgacagtagaacgtgatgagtcatcatccaagaagagtcacacacctgaacgcttcaccagccaggggagctatggagtagctggaaatgtgtttattgatagtggccggcattattgggaagtggtcataagtggaagcacatggtatgccattggtcttgcttacaaatcagccccgaagcatgaatggattgggaagaactctgcttcctgggcgctctgccgctgcaacaataactgggtggtgagacacaatagcaaggaaatccccattgagcctgccccccacctccggcgcgtgggcatcctgctggactatgataacggctctatcgccttttatgatgctttgaactccatccacctctacaccttcgacgtcgcatttgcgcagcctgtttgccccaccttcaccgtgtggaacaagtgtctgacgattatcactgggctccctatcccagaccatttggactgcacagagcagctgccgtgagcgtctggccacatggagctgctttctggggaacagtaaggttcaggccactatttaggggactgagaaagcacaggcttcatgagtgtaatgaaatctcaccagaagtgtcccgaaatcggctcagatagggctcaaaacaagagattcctctccttttactgtgtcttgtattaagtacgggctttaataatttctttaatttttttgtatttagaggaaaatctatagattatttataagagaaacataatcaggattacaacttttaggaattacttggttttgcacattaagaggcccataagtttatcagctatttacaaccttcatttcatcacaatctgtgggcttacaaaaaaacaaaaacttttgtagttttgtatgttactcatcttcttacctgatatcccatgatgatcccatggtaggtcttctcacctcgatggtgcataacaggatgtgtttgaacctagtaggggaggaaacaggctttcttactctggtttaatttgaagtgttttaattgtgatgtcaaaaagttgtatcagatcaactaaaatggagagcaagacagagaatgaaaagagttgattttggacctcggaccttgccgtggctaaatctttaccttctcatagctgatgggataatgttggaaagaaaggttctgaatcctttggccacattttgccctgcttctctcagggttaagggttctggaagaacattaagaatgagattgcaattgaaaatagtcattttgaatcctattgattattcaaaaattcaggctgatttgtcttttatcagaggtaggattctgttttatagtatagaatctactttatccttccttttaatagttcctttagacctgtgaaatttcttcactacatttaatagttctcctatttcccgctcccccatatcaattttccttttgtctccggggctgagtaaataaacatgttctgtcacaaatagcagcaccactttggattgattttgctctccaggacatcagcacatggccctgatcagcactaccacatccaaacataagtcactgaaaaacacttaatatttatgagttggtaatgacaagggacattgtataaagtactatttgctagattcatgcctcaaaagttattataaacagacctttattaaacacatcttgaaagatgtagaagtccctctatagtctagtatagtttacaatagagttgtaagaccaaaaaaaaaaaaaaaaaattcaaactcgttattcaggaacctgcttataaaatgtcagctgggattctttgcatgccaatctgatgcgttggaatggtccatgaattaaggctttcttgagcagttcttggcccagaactctggcattggttctagtttgatgaagggcatgacctctataaatggtttcaattgctaaaatatttacctgggatactgggtcagccattttgactgagcagactagtggatttagacattgtttttagttattttgtttttaaccaaatcaaccaactgcctccctgaaataagtcaatgaactcattgtttcagcatcacgtggccaaaggtcatgtgattgcaaatctggatttcaagggaggccaagccagcttcctgggtccttccatcctcttccctagcagacactctcctttttcttaacagatagattctatatatttactatattatttatacccagatgaatattttgatagatacctaagacaatttcacatctaaaagatggacgcctcaatggaaaaaaaacaatctttctctggaaaccttataggtttttctttttattacaatataaaagcaatgtgtgtttgccttctctgagtaaactgaaagggttgtctcagtaatttttacatacattttgggtaactggataatggatattttaatgcactttgtacactaacaggttctaaataaaagggtctaaaactcagcttctgagtttttaaaatcacggtctccaggtaccaataaatgctacagtttgccttatgatgttaacataaaacacttagtagaaggacaatatttccatgaaaataatgtttttcaatattaagaagttactactcaaattttcacagtaagccatttagggtatgtttggctatttttataaggacatgagagattatgtcataattttgttgtggaagtctcactcttggctaacttaaaagcattgtggatagtagcagttactagttccaggttgtcatatttacaggaaaatatgtatatggtgaaaggccaccgtgtttaattactataatgatgtagaaaagattcccgtgtgaattttttttttgaaagtctaaaaaatgtatgctgtaaaaatttgctgcagtgtaattttgcattctctttaaactgattgaggtcacagtattttattatttggggtcctcaccacaggaaacactgcgatacaggggcaaaagagatggcagtgccaattaaattaatacaacaaaatcaatgcagcaccaaccaagactgccaggtctggtgtcatgggtatgcccagagcccaggagttcagaagggccctaagcctgatttaatgctctgctgttgatgtcttgaaattcttaacaatttttgaacaaggggcctgcgttttcacttcgcactgggccttgcaaattacatagcgagtgctcataaaagaactcagaaacgtggtacctctcttcctggtggatacaaataaagaaatctggatccaaagttgaaagttgctggcgatatcattcaagtaggactctaaatagtggattaagatgagggtgggcctgggtgaagattctttccagctttaaaagaaagtgacttcaaaaactgactgcaaatattgacgatggtttctgctggaggaaaagaaacagcttgaatacagacaggcttttttattacggtactgatatattgaccttaaacttgctgaggaactgaactaacgtcctccagtgaccgtggaattccatctcagctccaggaacatgcagatacctgcaaagagacacgcatatatgctggcatacatgtgcatttggtgttgggaagttgaccatctggtctatcttaataaaatggtaaaaagcacaccaagacaatgatgggggcaggaggatgtttttgaaaacagcgcttctcaaccagtgctcgattttgccccccaggagacatttggcaatgcaatggcaacttttggttgtcgcagccggggaagggaagctaccagcatctagtgcgtagaggtcatggacgccgttaaacatcctacagtgcaagcgcagcccccgaccacgaagagttgtcttgctcaaatatcaacagtgctgcagtgtagaaacttgatcgttggttttcttttaatgcaaaactctcataaaaacctttcacttttcctgtcattgattatatgcttgatacacccaaaaagaaaaggggaggggcaccaattcacctacactccagtggctccatcacctttaaaaatatttataaaatagttccaaaaatctgatatctgaaaagcaatccaagcctgtgtaaatgggaatcactgataagtatcatcatctgtatcagcttggcttggacatgaaaaattgattctctttatgtcactccttgcacctggacaaattcaatccccggtacttaagtcacactgccaagccctcggccctgactattgtcttgattgctgttcctttctggttcaaaataaaatcatttttgtggcaccaaga

SEQ ID NO: 154055 - DNA, 945 bp, Homo sapiens
  Payload ID: 10274
  Gene Symbol: MID1
  Gene Name: midline 1
  ENST ID: ENST00000423614
  CDS Start-End: 353-945
gagaactgatttgaaataagagccaggcggtcctcgcttccctgcgaccgacttttcataggctgggggagaaaaggttgagaaacttgacattgtctcgagcagagtgcgtgtagcaacagatcaaagaaaaagaggacgaaaacgtgctctttgctgcccgtagatttcgccgggttgcttttgtcttgcgggctcctgtcgggttcggtgtttccgctctgaagactgcgacgcgggctccgatgcagctcgctccctgccggatgggtcatgggattctaaacatgaggcagatagctgatcagcttccttgggttttgctgatgacacaagagagctttgcctgaagatggaaacactggagtcagaactgacctgccctatttgtctggagctctttgaggaccctcttctactgccctgcgcacacagcctctgcttcaactgcgcccaccgcatcctagtatcacactgtgccaccaacgagtctgtggagtccatcaccgccttccagtgccccacctgccggcatgtcatcaccctcagccagcgaggtctagacgggctcaagcgcaacgtcaccctacagaacatcatcgacaggttccagaaagcatcagtgagcgggcccaactctcccagcgagacccgtcgggagcgggcctttgacgccaacaccatgacctccgccgagaaggtcctctgccagttttgtgaccaggatcctgcccaggacgctgtgaagacctgtgtcacttgtgaagtatcctactgtgacgagtgcctgaaagccactcacccgaataagaagccctttacaggccatcgtctgattgagccaattccggactctcacatccgggggctgatgtgcttggagcatgaggatgagaaggtgaatatgtactgtgtgaccgatgaccagttaatctgtgccttgtg

SEQ ID NO: 154056 - DNA, 1729 bp, Homo sapiens
  Payload ID: 10274
  Gene Symbol: MID1
  Gene Name: midline 1
  ENST ID: ENST00000413894
  CDS Start-End: 280-1729
ctgaagtgttagtatgtagtggagctggtggtgtgaagctgattcattttgtttcaaagccccaaatggcatgctgccgaacacaggcacaagcacagcagcgtctccttagaaataatgactccaaggcaaacagccctcattgcaaaatgtagaagactgccatctgcttgtctccactgtggtttattcgtttcagggttttaaatgacgtaataaaaagatagctgatcagcttccttgggttttgctgatgacacaagagagctttgcctgaagatggaaacactggagtcagaactgacctgccctatttgtctggagctctttgaggaccctcttctactgccctgcgcacacagcctctgcttcaactgcgcccaccgcatcctagtatcacactgtgccaccaacgagtctgtggagtccatcaccgccttccagtgccccacctgccggcatgtcatcaccctcagccagcgaggtctagacgggctcaagcgcaacgtcaccctacagaacatcatcgacaggttccagaaagcatcagtgagcgggcccaactctcccagcgagacccgtcgggagcgggcctttgacgccaacaccatgacctccgccgagaaggtcctctgccagttttgtgaccaggatcctgcccaggacgctgtgaagacctgtgtcacttgtgaagtatcctactgtgacgagtgcctgaaagccactcacccgaataagaagccctttacaggccatcgtctgattgagccaattccggactctcacatccgggggctgatgtgcttggagcatgaggatgagaaggtgaatatgtactgtgtgaccgatgaccagttaatctgtgccttgtgtaaactggttgggcggcaccgcgatcatcaggtggcagctttgagtgagcgctatgacaaattgaagcaaaacttagagagtaacctcaccaaccttattaagaggaacacagaactggagacccttttggctaaactcatccaaacctgtcaacatgttgaagtcaatgcatcacgtcaagaagccaaattgacagaggagtgtgatcttctcattgagatcattcagcaaagacgacagattattggaaccaagatcaaagaagggaaggtgatgaggcttcgcaaactggctcagcagattgcaaactgcaaacagtgcattgagcggtcagcatcactcatctcccaagcggaacactctctgaaggagaatgatcatgcgcgtttcctacagactgctaagaatatcaccgagagagtctccatggcaactgcatcctcccaggttctaattcctgaaatcaacctcaatgacacatttgacacctttgccttagatttttcccgagagaagaaactgctagaatgtctggattaccttacagctcccaaccctcccacaattagagaagagctctgcacagcttcatatgacaccatcactgtgcattggacctccgatgatgagttcagcgtggtctcctacgagctccagtacaccatattcaccggacaagccaacgtcgttagtctgtgtaattcggctgatagctggatgatagtacccaacatcaagcagaaccactacacggtgcacggtctgcagagcggcaccaagtacatcttcatggtcaaggccatcaaccaggcgggcagccgcagcagtgagcctgggaagttgaagacaaacagcc

SEQ ID NO: 154057 - DNA, 6393 bp, Homo sapiens
  Payload ID: 10274
  Gene Symbol: MID1
  Gene Name: midline 1
  Uniprot ID: O15344
  ENST ID: ENST00000453318
  CDS Start-End: 332-2335
gattctatgcagggtcactatgaaagaggcagcctgccccagtttgggtattctgaagtgttagtatgtagtggagctggtggtgtgaagctgattcattttgtttcaaagccccaaatggcatgctgccgaacacaggcacaagcacagcagcgtctccttagaaataatgactccaaggcaaacagccctcattgcaaaatgtagaagactgccatctgcttgtctccactgtggtttattcgtttcagggttttaaatgacgtaataaaaagatagctgatcagcttccttgggttttgctgatgacacaagagagctttgcctgaagatggaaacactggagtcagaactgacctgccctatttgtctggagctctttgaggaccctcttctactgccctgcgcacacagcctctgcttcaactgcgcccaccgcatcctagtatcacactgtgccaccaacgagtctgtggagtccatcaccgccttccagtgccccacctgccggcatgtcatcaccctcagccagcgaggtctagacgggctcaagcgcaacgtcaccctacagaacatcatcgacaggttccagaaagcatcagtgagcgggcccaactctcccagcgagacccgtcgggagcgggcctttgacgccaacaccatgacctccgccgagaaggtcctctgccagttttgtgaccaggatcctgcccaggacgctgtgaagacctgtgtcacttgtgaagtatcctactgtgacgagtgcctgaaagccactcacccgaataagaagccctttacaggccatcgtctgattgagccaattccggactctcacatccgggggctgatgtgcttggagcatgaggatgagaaggtgaatatgtactgtgtgaccgatgaccagttaatctgtgccttgtgtaaactggttgggcggcaccgcgatcatcaggtggcagctttgagtgagcgctatgacaaattgaagcaaaacttagagagtaacctcaccaaccttattaagaggaacacagaactggagacccttttggctaaactcatccaaacctgtcaacatgttgaagtcaatgcatcacgtcaagaagccaaattgacagaggagtgtgatcttctcattgagatcattcagcaaagacgacagattattggaaccaagatcaaagaagggaaggtgatgaggcttcgcaaactggctcagcagattgcaaactgcaaacagtgcattgagcggtcagcatcactcatctcccaagcggaacactctctgaaggagaatgatcatgcgcgtttcctacagactgctaagaatatcaccgagagagtctccatggcaactgcatcctcccaggttctaattcctgaaatcaacctcaatgacacatttgacacctttgccttagatttttcccgagagaagaaactgctagaatgtctggattaccttacagctcccaaccctcccacaattagagaagagctctgcacagcttcatatgacaccatcactgtgcattggacctccgatgatgagttcagcgtggtctcctacgagctccagtacaccatattcaccggacaagccaacgtcgttagtctgtgtaattcggctgatagctggatgatagtacccaacatcaagcagaaccactacacggtgcacggtctgcagagcggcaccaagtacatcttcatggtcaaggccatcaaccaggcgggcagccgcagcagtgagcctgggaagttgaagacaaacagccaaccatttaaactggatcccaaatctgctcatcgaaaactgaaggtgtcccatgataacttgacagtagaacgtgatgagtcatcatccaagaagagtcacacacctgaacgcttcaccagccaggggagctatggagtagctggaaatgtgtttattgatagtggccggcattattgggaagtggtcataagtggaagcacatggtatgccattggtcttgcttacaaatcagccccgaagcatgaatggattgggaagaactctgcttcctgggcgctctgccgctgcaacaataactgggtggtgagacacaatagcaaggaaatccccattgagcctgccccccacctccggcgcgtgggcatcctgctggactatgataacggctctatcgccttttatgatgctttgaactccatccacctctacaccttcgacgtcgcatttgcgcagcctgtttgccccaccttcaccgtgtggaacaagtgtctgacgattatcactgggctccctatcccagaccatttggactgcacagagcagctgccgtgagcgtctggccacatggagctgctttctggggaacagtaaggttcaggccactatttaggggactgagaaagcacaggcttcatgagtgtaatgaaatctcaccagaagtgtcccgaaatcggctcagatagggctcaaaacaagagattcctctccttttactgtgtcttgtattaagtacgggctttaataatttctttaatttttttgtatttagaggaaaatctatagattatttataagagaaacataatcaggattacaacttttaggaattacttggttttgcacattaagaggcccataagtttatcagctatttacaaccttcatttcatcacaatctgtgggcttacaaaaaaacaaaaacttttgtagttttgtatgttactcatcttcttacctgatatcccatgatgatcccatggtaggtcttctcacctcgatggtgcataacaggatgtgtttgaacctagtaggggaggaaacaggctttcttactctggtttaatttgaagtgttttaattgtgatgtcaaaaagttgtatcagatcaactaaaatggagagcaagacagagaatgaaaagagttgattttggacctcggaccttgccgtggctaaatctttaccttctcatagctgatgggataatgttggaaagaaaggttctgaatcctttggccacattttgccctgcttctctcagggttaagggttctggaagaacattaagaatgagattgcaattgaaaatagtcattttgaatcctattgattattcaaaaattcaggctgatttgtcttttatcagaggtaggattctgttttatagtatagaatctactttatccttccttttaatagttcctttagacctgtgaaatttcttcactacatttaatagttctcctatttcccgctcccccatatcaattttccttttgtctccggggctgagtaaataaacatgttctgtcacaaatagcagcaccactttggattgattttgctctccaggacatcagcacatggccctgatcagcactaccacatccaaacataagtcactgaaaaacacttaatatttatgagttggtaatgacaagggacattgtataaagtactatttgctagattcatgcctcaaaagttattataaacagacctttattaaacacatcttgaaagatgtagaagtccctctatagtctagtatagtttacaatagagttgtaagaccaaaaaaaaaaaaaaaaaattcaaactcgttattcaggaacctgcttataaaatgtcagctgggattctttgcatgccaatctgatgcgttggaatggtccatgaattaaggctttcttgagcagttcttggcccagaactctggcattggttctagtttgatgaagggcatgacctctataaatggtttcaattgctaaaatatttacctgggatactgggtcagccattttgactgagcagactagtggatttagacattgtttttagttattttgtttttaaccaaatcaaccaactgcctccctgaaataagtcaatgaactcattgtttcagcatcacgtggccaaaggtcatgtgattgcaaatctggatttcaagggaggccaagccagcttcctgggtccttccatcctcttccctagcagacactctcctttttcttaacagatagattctatatatttactatattatttatacccagatgaatattttgatagatacctaagacaatttcacatctaaaagatggacgcctcaatggaaaaaaaacaatctttctctggaaaccttataggtttttctttttattacaatataaaagcaatgtgtgtttgccttctctgagtaaactgaaagggttgtctcagtaatttttacatacattttgggtaactggataatggatattttaatgcactttgtacactaacaggttctaaataaaagggtctaaaactcagcttctgagtttttaaaatcacggtctccaggtaccaataaatgctacagtttgccttatgatgttaacataaaacacttagtagaaggacaatatttccatgaaaataatgtttttcaatattaagaagttactactcaaattttcacagtaagccatttagggtatgtttggctatttttataaggacatgagagattatgtcataattttgttgtggaagtctcactcttggctaacttaaaagcattgtggatagtagcagttactagttccaggttgtcatatttacaggaaaatatgtatatggtgaaaggccaccgtgtttaattactataatgatgtagaaaagattcccgtgtgaattttttttttgaaagtctaaaaaatgtatgctgtaaaaatttgctgcagtgtaattttgcattctctttaaactgattgaggtcacagtattttattatttggggtcctcaccacaggaaacactgcgatacaggggcaaaagagatggcagtgccaattaaattaatacaacaaaatcaatgcagcaccaaccaagactgccaggtctggtgtcatgggtatgcccagagcccaggagttcagaagggccctaagcctgatttaatgctctgctgttgatgtcttgaaattcttaacaatttttgaacaaggggcctgcgttttcacttcgcactgggccttgcaaattacatagcgagtgctcataaaagaactcagaaacgtggtacctctcttcctggtggatacaaataaagaaatctggatccaaagttgaaagttgctggcgatatcattcaagtaggactctaaatagtggattaagatgagggtgggcctgggtgaagattctttccagctttaaaagaaagtgacttcaaaaactgactgcaaatattgacgatggtttctgctggaggaaaagaaacagcttgaatacagacaggcttttttattacggtactgatatattgaccttaaacttgctgaggaactgaactaacgtcctccagtgaccgtggaattccatctcagctccaggaacatgcagatacctgcaaagagacacgcatatatgctggcatacatgtgcatttggtgttgggaagttgaccatctggtctatcttaataaaatggtaaaaagcacaccaagacaatgatgggggcaggaggatgtttttgaaaacagcgcttctcaaccagtgctcgattttgccccccaggagacatttggcaatgcaatggcaacttttggttgtcgcagccggggaagggaagctaccagcatctagtgcgtagaggtcatggacgccgttaaacatcctacagtgcaagcgcagcccccgaccacgaagagttgtcttgctcaaatatcaacagtgctgcagtgtagaaacttgatcgttggttttcttttaatgcaaaactctcataaaaacctttcacttttcctgtcattgattatatgcttgatacacccaaaaagaaaaggggaggggcaccaattcacctacactccagtggctccatcacctttaaaaatatttataaaatagttccaaaaatctgatatctgaaaagcaatccaagcctgtgtaaatgggaatcactgataagtatcatcatctgtatcagcttggcttggacatgaaaaattgattctctttatgtcactccttgcacctggacaaattcaatccccggtacttaagtcacactgccaagccctcggccctgactattgtcttgattgctgttcctttctggttcaaaataaaatcatttttgtggcaccaagaccctctgtctctgcctgtctctgttgccttttcatcattttgtgtttttgcagttatgatgttgacaaatatttattcaacatctaccatttattcatactactttatgacatataattcattttcttttactgtctctcatccactatttgcctttccctattcaaaatacaattcttttgcaacactcaaaatattctccagggaatttttaaaacacaataaaagaaagcctatatagaagtg

SEQ ID NO: 154058 - DNA, 1839 bp, Homo sapiens
  Payload ID: 10274
  Gene Symbol: MID1
  Gene Name: midline 1
  ENST ID: ENST00000610939
  CDS Start-End: 57-743
atagctgatcagcttccttgggttttgctgatgacacaagagagctttgcctgaagatggaaacactggagtcagaactgacctgccctatttgtctggagctctttgaggaccctcttctactgccctgcgcacacagcctctgcttcaactgcgcccaccgcatcctagtatcacactgtgccaccaacgagtctgtggagtccatcaccgccttccagtgccccacctgccggcatgtcatcaccctcagccagcgaggtctagacgggctcaagcgcaacgtcaccctacagaacatcatcgacaggttccagaaagcatcagtgagcgggcccaactctcccagcgagacccgtcgggagcgggcctttgacgccaacaccatgacctccgccgagaaggtcctctgccagttttgtgaccaggatcctgcccaggacgctgtgaagacctgtgtcacttgtgaagtatcctactgtgacgagtgcctgaaagccactcacccgaataagaagccctttacaggccatcgtctgattgagccaattccggactctcacatccgggggctgatgtgcttggagcatgaggatgagaagcaaaacttagagagtaacctcaccaaccttattaagaggaacacagaactggagacccttttggctaaactcatccaaacctgtcaacatgttgaactggaatgttctgtactgtttcccagagttgcccaatggggttaatctccagttgcccaaggtggtcttggtaagtcacactttactggcttcgtagttgtccctgtttcacttcctacccagtactggtgttttctggcaacaatttgaccatccattcttgtctcatatccttcttggggaggatacaactgccaaccatgtctaaaatgaaatgatagcacaagtctctttttctagtcatggctatagctcacatgttcaatttctctaaactcaagtctctttcattgtgtttgaataaacgtacatgtgaatcactggacatcaaagatatttaaaaatcaatctactcacttctcctgatattctagaatgacaacaacagggcaagatatttcatagatatcacttgtgggtgcgtcatgaaggcagaacaaagcttaacattttccagttgtacctcccagttaagttctatcagtgacgtaatcacgtgtatttcactcactgtacggaataccaaagagcagaaacccaatgttcattttccagaactttgcagaagcagatggcttctatacctgagtaactgaaacccaaaaaggggtccaactcagtatttttccagtacatcacttttcaggaatcatggcacaacaactaaaaggaatgtcacttaatgagaaataacatgtaagattgaaagtgattaaggtaaagtcatagagtagaggtttcctctttccattagaaataacttcccttcccttaaacacgtcacctccatctttcctggcactccattaatggtcatctgctaaaagttattgtttaccctctgaccacaacatcaaatgccaaacacatttgttgaaaattatttaatagaaatcgctacttttcagaaactttatgaaaaagacgtgatagagacaaacacccatggcaggttaagtagatttcttttcattcagtgtgcccagcccaaacggaagggtgtgaagcatttgttttataaagtgtgtaattaataagagaaaggaagggaggagtttattgtttttcaatgaattatgagcaaccccttccattctgcttcttcattttggaactgcttctaacaaagttaccattaaac

SEQ ID NO: 154059 - DNA, 1926 bp, Homo sapiens
  Payload ID: 10274
  Gene Symbol: MID1
  Gene Name: midline 1
  ENST ID: ENST00000616003
  CDS Start-End: 57-1679
atagctgatcagcttccttgggttttgctgatgacacaagagagctttgcctgaagatggaaacactggagtcagaactgacctgccctatttgtctggagctctttgaggaccctcttctactgccctgcgcacacagcctctgcttcaactgcgcccaccgcatcctagtatcacactgtgccaccaacgagtctgtggagtccatcaccgccttccagtgccccacctgccggcatgtcatcaccctcagccagcgaggtctagacgggctcaagcgcaacgtcaccctacagaacatcatcgacaggttccagaaagcatcagtgagcgggcccaactctcccagcgagacccgtcgggagcgggcctttgacgccaacaccatgacctccgccgagaaggtcctctgccagttttgtgaccaggatcctgcccaggacgctgtgaagacctgtgtcacttgtgaagtatcctactgtgacgagtgcctgaaagccactcacccgaataagaagccctttacaggccatcgtctgattgagccaattccggactctcacatccgggggctgatgtgcttggagcatgaggatgagaaggtgaatatgtactgtgtgaccgatgaccagttaatctgtgccttgtgtaaactggttgggcggcaccgcgatcatcaggtggcagctttgagtgagcgctatgacaaattgaagcaaaacttagagagtaacctcaccaaccttattaagaggaacacagaactggagacccttttggctaaactcatccaaacctgtcaacatgttgaaactgtaaaggatcagaaagtcattggcagagagaagcagcagtattaccctaggaataggagaaagtgggtcagcaactccctacaggcaagactgatggggagaagatgcatttcaagacgcgaaagaaaactgactctagatgtagagaaggtcaatgcatcacgtcaagaagccaaattgacagaggagtgtgatcttctcattgagatcattcagcaaagacgacagattattggaaccaagatcaaagaagggaaggtgatgaggcttcgcaaactggctcagcagattgcaaactgcaaacagtgcattgagcggtcagcatcactcatctcccaagcggaacactctctgaaggagaatgatcatgcgcgtttcctacagactgctaagaatatcaccgagagagtctccatggcaactgcatcctcccaggttctaattcctgaaatcaacctcaatgacacatttgacacctttgccttagatttttcccgagagaagaaactgctagaatgtctggattaccttacagctcccaaccctcccacaattagagaagagctctgcacagcttcatatgacaccatcactgtgcattggacctccgatgatgagttcagcgtggtctcctacgagctccagtacaccatattcaccggacaagccaacgtcgttagtgagtatctcatggcctatttatttctgtctttggtggctttcttcagattgattgcattcctgaatttaaacttcaaaggaagacaaggaaggaaagaacacacaatatttattgacttgtctttcttgaacaaaaaagtgatagcactcacttgtactacattagtaaaaacagctggctaaatattgatgaaaattaatgacctctagcaaaccacatggatgttaagggaaagaagccagaaacaaatatatagagagaaacaaatatatagagagatacatagagagagaaacaaatatatatatatagtattaatccacatataggttcataacttaaagatcaaaataaactattttgcttaaagaaacattcataggtgttaaaactataaaccctgggcaacctggtgaaaccccatctcta

SEQ ID NO: 154060 - DNA, 2876 bp, Homo sapiens
  Payload ID: 10275
  Gene Symbol: MID2
  Gene Name: midline 2
  Uniprot ID: Q9UJV3
  ENST ID: ENST00000262843
  CDS Start-End: 549-2756
gagaagacatgtaaacgtgcctccagaggaagggctgggggagctgggagtggcgggggcggcggaaggtgagcctgggaaggtggccgagcaccccttcttcttgggcccttcccagtgctcccttggggtgtcagccccagccccgtttgcccccactccgcctcccttttggaagggattgccttttttttcctctgcggcggcggaaatgacagtgtggtgctgccgtggtgtcatggtgctgcccctggactgaggggcgaaaactcttaagtttagctcgggaggcccagctgcggtagcatcgcggccgccgtgctgtcccctgcggggcgcgcgggctggcggatcccggctgctgcgcggcgtcggcgacggtagcggcagcggcggcgaaggcgggcggcggcctacagtggtagcggcggcggcggcgaccggggcccgggagctcgcgccggagcccgagccaacccgctgcggaggcagacgagagcccagcgccctcgagcgagcggaggagatggctggcacctgggaacgctatgggtgaaagcccagcctccgtggttcttaatgcctcaggaggactattttcactaaagatggaaacactggagtctgaattgacctgtccaatctgcctagagttgtttgaagacccccttctgctcccttgtgctcacagcctctgcttcagctgtgcccatcgcattttggtatcaagctgcagctctggtgaatccattgaacccattactgctttccagtgtcctacctgcaggtatgttatctcgctgaaccaccggggcctggatggcctcaagaggaatgtgactctgcagaacattattgatcgcttccagaaggcttcagtcagtgggcccaattcccctagtgagagccgccgggaaaggacttacaggcccaccactgccatgtctagcgagcgaattgcttgccaattctgtgagcaggacccgccaagggatgcagtaaaaacatgcatcacctgtgaggtctcctactgtgaccgttgcctgcgggccacgcaccccaacaagaaacctttcaccagccaccgcctggtggaaccagtgccagacacacatcttcgagggatcacctgcctggaccatgagaatgagaaagtgaacatgtactgtgtatctgatgaccaattgatctgtgccttatgcaaactggtgggtcgtcaccgagaccatcaggtcgcatccctgaatgatcgatttgagaaactcaagcaaactctggagatgaacctcaccaacctggttaagcgcaacagcgaactagaaaatcaaatggccaaactaatacagatctgccagcaggttgaggtgaatactgctatgcatgaggcaaaacttatggaagaatgtgacgagttggtagagatcatccagcagaggaagcaaatgatcgctgtcaaaatcaaagagacaaaggttatgaaactgagaaagttggcacagcaggttgctaattgccgccagtgtcttgaacggtcaacagtcctcatcaaccaagctgagcatatcctgaaagaaaatgaccaggcacggtttctacagtctgcaaaaaatattgctgagagggtcgctatggcaactgcatcttctcaagttctgattccagacatcaattttaatgatgcctttgaaaactttgctttagatttttccagagaaaagaaactgctagaggggttagattatttaacagccccaaacccaccatctatccgagaagaactctgtactgcctcccatgacaccattacagtccactggatctcggatgatgagttcagcatcagctcctatgagcttcagtacaccatattcactggccaggctaacttcatcagtaagtcatggtgtagttggggcctgtggccagagataaggaaatgtaaggaagcagtaagctgctcaagattggccggggcgccacgaggcctgtataattcagtagacagctggatgattgttcccaacattaaacagaaccattacacagtgcatggactccagagcgggactcgctacatcttcatcgttaaagccataaaccaagccggcagccggaacagtgaacctacccgactaaaaacaaacagccaaccctttaaattggatcccaaaatgactcacaagaagttgaagatctccaatgatggattgcagatggagaaggatgaaagctctctaaagaagagccacaccccagagaggtttagtggcacagggtgctatggggcagcaggaaatatattcattgacagtggctgccactattgggaggtggtcatgggttcctcaacatggtatgcaattggcattgcctacaaatcagctccaaagaatgaatggattggcaagaatgcctcctcatgggtcttctctcgctgcaatagtaacttcgtggtgagacacaacaacaaggaaatgctggtggatgtgcccccacacctgaagcgtctgggtgtcctcctggattatgacaacaatatgctgtctttctatgacccagctaactctctccatcttcatacttttgatgtgaccttcattcttccagtttgtccaacatttacaatctggaacaaatccctaatgatcctgtctggcttgcctgccccagattttattgattaccctgagcggcaggaatgcaactgcaggcctcaagaatccccttatgtttctgggatgaaaacctgtcattaagtttcaggagagtatataattcactggctctctagttcagcagttcttcccctcctacacctaagttagcgttcaatatacgagacacaaaataaagtttgtttgaagcatccaaaataa

SEQ ID NO: 154061 - DNA, 758 bp, Homo sapiens
  Payload ID: 10275
  Gene Symbol: MID2
  Gene Name: midline 2
  ENST ID: ENST00000451923
  CDS Start-End: 103-758
cttcaagatgacagggcgctggagaaaaggctgctggaatcagctggtgaaagcccagcctccgtggttcttaatgcctcaggaggactattttcactaaagatggaaacactggagtctgaattgacctgtccaatctgcctagagttgtttgaagacccccttctgctcccttgtgctcacagcctctgcttcagctgtgcccatcgcattttggtatcaagctgcagctctggtgaatccattgaacccattactgctttccagtgtcctacctgcaggtatgttatctcgctgaaccaccggggcctggatggcctcaagaggaatgtgactctgcagaacattattgatcgcttccagaaggcttcagtcagtgggcccaattcccctagtgagagccgccgggaaaggacttacaggcccaccactgccatgtctagcgagcgaattgcttgccaattctgtgagcaggacccgccaagggatgcagtaaaaacatgcatcacctgtgaggtctcctactgtgaccgttgcctgcgggccacgcaccccaacaagaaacctttcaccagccaccgcctggtggaaccagtgccagacacacatcttcgagggatcacctgcctggaccatgagaatgagaaagtgaacatgtactgtgtatctgatgaccaattgatctgtgccttatgcaaactggtgggtcgtcaccgagaccatcaggtcgcatccctgaatgatcgatttgagaaact

SEQ ID NO: 154062 - DNA, 2251 bp, Homo sapiens
  Payload ID: 10275
  Gene Symbol: MID2
  Gene Name: midline 2
  Uniprot ID: Q9UJV3
  ENST ID: ENST00000443968
  CDS Start-End: 14-2131
acctgggaacgctatgggtgaaagcccagcctccgtggttcttaatgcctcaggaggactattttcactaaagatggaaacactggagtctgaattgacctgtccaatctgcctagagttgtttgaagacccccttctgctcccttgtgctcacagcctctgcttcagctgtgcccatcgcattttggtatcaagctgcagctctggtgaatccattgaacccattactgctttccagtgtcctacctgcaggtatgttatctcgctgaaccaccggggcctggatggcctcaagaggaatgtgactctgcagaacattattgatcgcttccagaaggcttcagtcagtgggcccaattcccctagtgagagccgccgggaaaggacttacaggcccaccactgccatgtctagcgagcgaattgcttgccaattctgtgagcaggacccgccaagggatgcagtaaaaacatgcatcacctgtgaggtctcctactgtgaccgttgcctgcgggccacgcaccccaacaagaaacctttcaccagccaccgcctggtggaaccagtgccagacacacatcttcgagggatcacctgcctggaccatgagaatgagaaagtgaacatgtactgtgtatctgatgaccaattgatctgtgccttatgcaaactggtgggtcgtcaccgagaccatcaggtcgcatccctgaatgatcgatttgagaaactcaagcaaactctggagatgaacctcaccaacctggttaagcgcaacagcgaactagaaaatcaaatggccaaactaatacagatctgccagcaggttgaggtgaatactgctatgcatgaggcaaaacttatggaagaatgtgacgagttggtagagatcatccagcagaggaagcaaatgatcgctgtcaaaatcaaagagacaaaggttatgaaactgagaaagttggcacagcaggttgctaattgccgccagtgtcttgaacggtcaacagtcctcatcaaccaagctgagcatatcctgaaagaaaatgaccaggcacggtttctacagtctgcaaaaaatattgctgagagggtcgctatggcaactgcatcttctcaagttctgattccagacatcaattttaatgatgcctttgaaaactttgctttagatttttccagagaaaagaaactgctagaggggttagattatttaacagccccaaacccaccatctatccgagaagaactctgtactgcctcccatgacaccattacagtccactggatctcggatgatgagttcagcatcagctcctatgagcttcagtacaccatattcactggccaggctaacttcatcagcctgtataattcagtagacagctggatgattgttcccaacattaaacagaaccattacacagtgcatggactccagagcgggactcgctacatcttcatcgttaaagccataaaccaagccggcagccggaacagtgaacctacccgactaaaaacaaacagccaaccctttaaattggatcccaaaatgactcacaagaagttgaagatctccaatgatggattgcagatggagaaggatgaaagctctctaaagaagagccacaccccagagaggtttagtggcacagggtgctatggggcagcaggaaatatattcattgacagtggctgccactattgggaggtggtcatgggttcctcaacatggtatgcaattggcattgcctacaaatcagctccaaagaatgaatggattggcaagaatgcctcctcatgggtcttctctcgctgcaatagtaacttcgtggtgagacacaacaacaaggaaatgctggtggatgtgcccccacacctgaagcgtctgggtgtcctcctggattatgacaacaatatgctgtctttctatgacccagctaactctctccatcttcatacttttgatgtgaccttcattcttccagtttgtccaacatttacaatctggaacaaatccctaatgatcctgtctggcttgcctgccccagattttattgattaccctgagcggcaggaatgcaactgcaggcctcaagaatccccttatgtttctgggatgaaaacctgtcattaagtttcaggagagtatataattcactggctctctagttcagcagttcttcccctcctacacctaagttagcgttcaatatacgagacacaaaataaagtttgtttgaagcatccaaaataa

SEQ ID NO: 154063 - DNA, 3790 bp, Homo sapiens
  Payload ID: 10276
  Gene Symbol: MIDN
  Gene Name: midnolin
  Uniprot ID: Q504T8
  ENST ID: ENST00000300952
  CDS Start-End: 516-1922
gataaaggctgagggccgcgcgcttggcccagaccggcccggccagcgcgcattcggccccggacgaaggtactcgcagcacttggagcgcagaaccggccgcgcccgatcctccgagcggcggcgacggctgttgctaagggaggggacgcgcgaggaagcgcgacccgggcggcagacggcacccagcgccaccagccgagcggcgccccctccccaggacccttaaccgcgccgcgtcccggtcgcgcccgccgccctttgaaggagaagcaagtgccgtccccacccccggaaggcgcccccaggagccggagcgacctcggagcgccactcggattttggatttcggtctcgcattccgcggccgggactttctcgaggaggacgcgcgctgctccgcgcccccgagtgcccggaggacccggcatccggggagcctctcgcccctgtcccggaggcgcggcgaggattggcggcgcccgccgcccccagccccccagcgcgcgccggggatggagccgcagcccggcggcgcccggagctgccggcgcggggcccccggcggcgcctgcgagctgggcccggcggccgaggcggcgcccatgagcctcgccatccacagcaccacgggcacccgctacgacctggccgtgccgcccgacgagacggtggaggggctgcgcaagcggttgtcccagcgcctcaaagtgcccaaggagcgcctggctcttctccacaaagacacccggctcagttcggggaagctgcaggagttcggcgtgggtgatggcagcaagctgaccttggtacccaccgtggaagcgggcctcatgtctcaggcctcaaggccggaacagtccgtgatgcaagctctcgagagtctcacggagacgcaggtcagtgacttcctgtcgggccgttcgccactgacactggccttgcgtgtgggcgaccacatgatgttcgtgcagctgcagctcgcggcccagcacgctccactgcaacaccgccatgtgctggccgctgcggccgccgccgctgctgcgcggggggaccccagcatagcctcccccgtgtcctcgccctgccggccggtgtccagtgccgcccgagtccccccggtgcccaccagcccgtcccctgcatctccctcgcccatcacagccggctccttccggtcccacgcagcctccaccacctgcccggagcagatggactgctcccccacggccagcagcagtgccagtcctggtgccagcaccacgtctaccccaggggccagccctgccccccgctcccgaaaacccggcgccgtcatcgagagctttgtgaatcacgccccgggggtcttctcagggaccttctctggcacgctacaccccaactgccaagacagcagcgggcggccgcggcgtgacatcggcaccatcctgcagatcctgaacgacctcctgagcgccacccggcactaccagggcatgcccccttcgctggcccagctccgctgccacgcccagtgctccccggcctcaccggcccccgacctggcccccagaactacctcctgcgagaagctcacggctgccccctcagcctccctgctgcagggccagagccagatccgcatgtgcaagcccccgggggaccggcttcggcagacagaaaaccgcgccacgcgctgcaaggtggaacggctgcagctgcttctgcagcagaaacggctccgtagaaaggcccggcgggacgcgcggggtccgtaccactggtcacccagccgcaaggccggccgcagcgacagcagtagcagcgggggcggcggcagccccagcgaggcctccggcttgggcctcgacttcgaggactccgtgtggaagccagaagtcaaccctgacatcaagtcagagttcgtggtggcttaggatcttcggatcggccaccctcgcccctcgcaccccagcccagggcggcggggactccgagagccccggagagaacgtggcccagccctggagggcaggcggccactcccccagccagaagtctttttttcttttcttcttttttattatttttttctttttttaaaaagttctgaccgtggtttcctggactcttcatgggctttgcttcctacctccttcacccttcactcctgccctcctcttcctcctcctcctcctcctccgtctgtctcctttcacctctgcgccaggtcggtcctccctgccaaccttccccagctccaatatgtagcagtctctctggatggcggagagtgaaggagacggagaaacgcgccccatcccttccgccgcctcctttcccccccgaccctattcaggttttaagtcaaaaatgtcgatatgtcattatgcactttacagatgaggggaggggccgcagtgcgcagaacccaccccaccccccagtgcagacttcggggtctccaccccaggccagcagcgcccactgggctacagcaagccaacaggtcacagaagccaacgaggggactgtttctcttccactcctatcctcttttcttgatcttttttttgcattttccttcatttctttaacaaggagagcaaagctgttttagcagaggctggggctgaggtccccatggggtttgggtgcaggggcatggcaccctttcctgtcgggaagggagaggggaactacccccccagcctgccctccgccccgccccagccggcggactgtgctgtttcctccgcccccactcccgtgttttctgacctcctgcctgagtttggggtatttatagactattaattttctgactgagccaatagtggttggggaactcttgaaaaaggggagagaatggctgggtgctggggagttcccccctccgagccctccttcccggcccaacctgagggatgtggatttgggactgtctgggggcccctcctgcagcgaggatgggagggggtgctgagctgtgaatcccctgggcagggggcgacaactccgtgtagcattaacccccgtggcggggtccgctgctggtctaatttggaccccctgcctctcagtgcccctgccctaggggtgtctgtctccagaggggagggacaaatcccctactggggccatttcaatggggtagtttttggatttttttccccactcactttttattttttaatgataatggagatgtctggacccttcctcaccccacctgtcggtcttgtcctggctctgcctgtcccccaccgttgttctcgtaggtgaaccccaggtcctcaactccccccctttatgtgttgaaagttaatggtttcagatgtgaacatcacgtgttataactgtagcgctgtaaatttttttgtgggagggtgggcagggaggggtcccagagggtagagctcaaggattttgggttttgttttgttttcatttttccaaaaaaaaaagaaaaaaaaatagaaaaaaaaggagtaaaaggggcgggtttgttttttgaagaactgtcttggatacctatttaaatgtgtgttctgttttgttttttaacgatttttaaataacgtctgtgcctccactggttgagggtggaacctccaggcaggaaccggctcgccaccctctgcccggtaagggctgcccaagaaagcattacccgccctcggggggtcgggctgtgggggtcccggcacctggcgtgagtttcatgtatgaaaacataaaattgaaaaaaaaaaaaaaacctacacgagcaccgtgatttcaagtaataaacagaaaatgaaac

SEQ ID NO: 154064 - DNA, 416 bp, Homo sapiens
  Payload ID: 10276
  Gene Symbol: MIDN
  Gene Name: midnolin
  ENST ID: ENST00000586843
  CDS Start-End: 1-416
ccggctcagttcggggaagctgcaggagttcggcgtgggtgatggcagcaagctgaccttggtacccaccgtggaagcgggcctcatgtctcaggcctcaaggccggaacagtccgtgatgcaagctctcgagagtctcacggagacgcagcccccagcggcgcccgggccgggccgggctggcggaggaggcttccggaaatacagattcattttatttaagcgtccgtggcaccgacagggaccccagagcccagagaggggcggcgagaggccccaggtcagtgacttcctgtcgggccgttcgccactgacactggccttgcgtgtgggcgaccacatgatgttcgtgcagctgcagctcgcggcccagcacgctccactgcaacaccgccatgtgctggccgctgcggccg

SEQ ID NO: 154065 - DNA, 1163 bp, Homo sapiens
  Payload ID: 10276
  Gene Symbol: MIDN
  Gene Name: midnolin
  ENST ID: ENST00000586757
  CDS Start-End: 516-1163
gataaaggctgagggccgcgcgcttggcccagaccggcccggccagcgcgcattcggccccggacgaaggtactcgcagcacttggagcgcagaaccggccgcgcccgatcctccgagcggcggcgacggctgttgctaagggaggggacgcgcgaggaagcgcgacccgggcggcagacggcacccagcgccaccagccgagcggcgccccctccccaggacccttaaccgcgccgcgtcccggtcgcgcccgccgccctttgaaggagaagcaagtgccgtccccacccccggaaggcgcccccaggagccggagcgacctcggagcgccactcggattttggatttcggtctcgcattccgcggccgggactttctcgaggaggacgcgcgctgctccgcgcccccgagtgcccggaggacccggcatccggggagcctctcgcccctgtcccggaggcgcggcgaggattggcggcgcccgccgcccccagccccccagcgcgcgccggggatggagccgcagcccggcggcgcccggagctgccggcgcggggcccccggcggcgcctgcgagctgggcccggcggccgaggcggcgcccatgagcctcgccatccacagcaccacgggcacccgctacgacctggccgtgccgcccgacgagacggtggaggggctgcgcaagcggttgtcccagcgcctcaaagtgcccaaggagcgcctggctcttctccacaaagacacccggctcagttcggggaagctgcaggagttcggcgtgggtgatggcagcaagctgaccttggtacccaccgtggaagcgggcctcatgtctcaggcctcaaggccggaacagtccgtgatgcaagctctcgagagtctcacggagacgcaggtcagtgacttcctgtcgggccgttcgccactgacactggccttgcgtgtgggcgaccacatgatgttcgtgcagctgcagctcgcggcccagcacgctccactgcaacaccgccatgtgctggccgctgcggccgccgccgctgctgcgcggggggaccccagcatagcctcccccgtgtcctcgccctgccggccggtgtccagtgccgcccgagtccccccggtgcccaccagcccgtcccctgcatctccctcgcccatc

SEQ ID NO: 154066 - DNA, 3243 bp, Homo sapiens
  Payload ID: 10276
  Gene Symbol: MIDN
  Gene Name: midnolin
  Uniprot ID: Q504T8
  ENST ID: ENST00000591446
  CDS Start-End: 410-1816
agatcctccgagcggcggcgacggctgttgctaagggaggggacgcgcgaggaagcgcgacccgggcggcagacggcacccagcgccaccagccgagcggcgccccctccccaggacccttaaccgcgccgcgtcccggtcgcgcccgccgccctttgaaggagaagcaagtgccgtccccacccccggaaggcgcccccaggagccggagcgacctcggagcgccactcggattttggatttcggtctcgcattccgcggccgggactttctcgaggaggacgcgcgctgctccgcgcccccgagtgcccggaggacccggcatccggggagcctctcgcccctgtcccggaggcgcggcgaggattggcggcgcccgccgcccccagccccccagcgcgcgccggggatggagccgcagcccggcggcgcccggagctgccggcgcggggcccccggcggcgcctgcgagctgggcccggcggccgaggcggcgcccatgagcctcgccatccacagcaccacgggcacccgctacgacctggccgtgccgcccgacgagacggtggaggggctgcgcaagcggttgtcccagcgcctcaaagtgcccaaggagcgcctggctcttctccacaaagacacccggctcagttcggggaagctgcaggagttcggcgtgggtgatggcagcaagctgaccttggtacccaccgtggaagcgggcctcatgtctcaggcctcaaggccggaacagtccgtgatgcaagctctcgagagtctcacggagacgcaggtcagtgacttcctgtcgggccgttcgccactgacactggccttgcgtgtgggcgaccacatgatgttcgtgcagctgcagctcgcggcccagcacgctccactgcaacaccgccatgtgctggccgctgcggccgccgccgctgctgcgcggggggaccccagcatagcctcccccgtgtcctcgccctgccggccggtgtccagtgccgcccgagtccccccggtgcccaccagcccgtcccctgcatctccctcgcccatcacagccggctccttccggtcccacgcagcctccaccacctgcccggagcagatggactgctcccccacggccagcagcagtgccagtcctggtgccagcaccacgtctaccccaggggccagccctgccccccgctcccgaaaacccggcgccgtcatcgagagctttgtgaatcacgccccgggggtcttctcagggaccttctctggcacgctacaccccaactgccaagacagcagcgggcggccgcggcgtgacatcggcaccatcctgcagatcctgaacgacctcctgagcgccacccggcactaccagggcatgcccccttcgctggcccagctccgctgccacgcccagtgctccccggcctcaccggcccccgacctggcccccagaactacctcctgcgagaagctcacggctgccccctcagcctccctgctgcagggccagagccagatccgcatgtgcaagcccccgggggaccggcttcggcagacagaaaaccgcgccacgcgctgcaaggtggaacggctgcagctgcttctgcagcagaaacggctccgtagaaaggcccggcgggacgcgcggggtccgtaccactggtcacccagccgcaaggccggccgcagcgacagcagtagcagcgggggcggcggcagccccagcgaggcctccggcttgggcctcgacttcgaggactccgtgtggaagccagaagtcaaccctgacatcaagtcagagttcgtggtggcttaggatcttcggatcggccaccctcgcccctcgcaccccagcccagggcggcggggactccgagagccccggagagaacgtggcccagccctggagggcaggcggccactcccccagccagaagtctttttttcttttcttcttttttattatttttttctttttttaaaaagttctgaccgtggtttcctggactcttcatgggctttgcttcctacctccttcacccttcactcctgccctcctcttcctcctcctcctcctcctccgtctgtctcctttcacctctgcgccaggtcggtcctccctgccaaccttccccagctccaatatgtagcagtctctctggatggcggagagtgaaggagacggagaaacgcgccccatcccttccgccgcctcctttcccccccgaccctattcaggttttaagtcaaaaatgtcgatatgtcattatgcactttacagatgaggggaggggccgcagtgcgcagaacccaccccaccccccagtgcagacttcggggtctccaccccaggccagcagcgcccactgggctacagcaagccaacaggtcacagaagccaacgaggggactgtttctcttccactcctatcctcttttcttgatcttttttttgcattttccttcatttctttaacaaggagagcaaagctgttttagcagaggctggggctgaggtccccatggggtttgggtgcaggggcatggcaccctttcctgtcgggaagggagaggggaactacccccccagcctgccctccgccccgccccagccggcggactgtgctgtttcctccgcccccactcccgtgttttctgacctcctgcctgagtttggggtatttatagactattaattttctgactgagccaatagtggttggggaactcttgaaaaaggggagagaatggctgggtgctggggagttcccccctccgagccctccttcccggcccaacctgagggatgtggatttgggactgtctgggggcccctcctgcagcgaggatgggagggggtgctgagctgtgaatcccctgggcagggggcgacaactccgtgtagcattaacccccgtggcggggtccgctgctggtctaatttggaccccctgcctctcagtgcccctgccctaggggtgtctgtctccagaggggagggacaaatcccctactggggccatttcaatggggtagtttttggatttttttccccactcactttttattttttaatgataatggagatgtctggacccttcctcaccccacctgtcggtcttgtcctggctctgcctgtcccccaccgttgttctcgtaggtgaaccccaggtcctcaactccccccctttatgtgttgaaagttaatggtttcagatgtgaacatcacgtgttataactgta

SEQ ID NO: 154067 - DNA, 1358 bp, Homo sapiens
  Payload ID: 10277
  Gene Symbol: MIF4GD
  Gene Name: MIF4G domain containing
  Uniprot ID: A9UHW6
  ENST ID: ENST00000245551
  CDS Start-End: 81-851
gggcacgcgcgcgcgccaccggcccggcaggtgctgtccttattcccagcccagtcaagagctaccggggctggctagtcatgggggagcccagtagagaggagtataaaatccagtcctttgatgcagagacccagcagctgctgaagacagcactcaaagttgcctgctttgagacagaagatggagaatattccgtttgccagaggagctatagtaattgctctcgcctgatgccttcccgctgtaacacgcagtacagagatccgggtgctgtggacttggagaaagtggccaatgtgattgtggaccattctctgcaggactgtgtgttcagcaaggaagcaggacgcatgtgctacgccatcattcaggcagagagtaaacaagcaggccagagtgtcttccgacgtggactcctcaaccggctgcagcaggagtaccaggctcgggagcagctgcgagcacgctccctgcagggctgggtctgctatgtcacctttatctgcaacatctttgactacctgagggtgaacaacatgcccatgatggccctggtgaaccctgtctatgactgcctcttccggctggcccagccagacagtttgagcaaggaggaggaggtggactgtttggtgctgcagctgcaccgggttggggagcagctggagaaaatgaatgggcagcgcatggatgagctctttgtgctgatccgggatggcttcctgctcccaactggcctcagctccctggcccagctgctgctgctggagatcattgagttccgggcggccggctggaagacaacgccagctgcccacaagtattactacagcgaagtctccgactaggcctccagatcagggcttcctcaccagcactggcctttcttctacccacctctaaagctggcagtggagtctctgcctcacccaaagacttttcccttccagactttgagtgtcttcccttctagactttcccatctcctggtgagatgtttcccacttatgccgtggtcctgccctgagcccctttccccaccacaacccaccacggccaggcagagaagggcaactcccaagagccactgcactgtgtaaccattagtgcaactactaccttggtgcctcagtttacccatctgtaaaatgggtaagcatagccactggtgggatattttgggatgtcaaggggtggaggcagagcacaagtcacaccagaaactgctttttatacattttgtataaggacaactctggaaacaagcctatttcctccagccagtttcactgaatgctgcaccacatgctacaccagttcagcgtgagaattttctaataaatcttttctgatac

SEQ ID NO: 154068 - DNA, 1306 bp, Homo sapiens
  Payload ID: 10277
  Gene Symbol: MIF4GD
  Gene Name: MIF4G domain containing
  Uniprot ID: A9UHW6
  ENST ID: ENST00000325102
  CDS Start-End: 126-794
cagcgccggacgctggttgcgcgctcccaggcgccgagcggccccgggcacgcgcgcgcgccaccggcccggcaggtgctgtccttattcccagcccagtcaagagctaccggggctggctagtcatgggggagcccagtagagaggagtataaaatccagtcctttgatgcagagacccagcagctgctgaagacagcactcaaagatccgggtgctgtggacttggagaaagtggccaatgtgattgtggaccattctctgcaggactgtgtgttcagcaaggaagcaggacgcatgtgctacgccatcattcaggcagagagtaaacaagcaggccagagtgtcttccgacgtggactcctcaaccggctgcagcaggagtaccaggctcgggagcagctgcgagcacgctccctgcagggctgggtctgctatgtcacctttatctgcaacatctttgactacctgagggtgaacaacatgcccatgatggccctggtgaaccctgtctatgactgcctcttccggctggcccagccagacagtttgagcaaggaggaggaggtggactgtttggtgctgcagctgcaccgggttggggagcagctggagaaaatgaatgggcagcgcatggatgagctctttgtgctgatccgggatggcttcctgctcccaactggcctcagctccctggcccagctgctgctgctggagatcattgagttccgggcggccggctggaagacaacgccagctgcccacaagtattactacagcgaagtctccgactaggcctccagatcagggcttcctcaccagcactggcctttcttctacccacctctaaagctggcagtggagtctctgcctcacccaaagacttttcccttccagactttgagtgtcttcccttctagactttcccatctcctggtgagatgtttcccacttatgccgtggtcctgccctgagcccctttccccaccacaacccaccacggccaggcagagaagggcaactcccaagagccactgcactgtgtaaccattagtgcaactactaccttggtgcctcagtttacccatctgtaaaatgggtaagcatagccactggtgggatattttgggatgtcaaggggtggaggcagagcacaagtcacaccagaaactgctttttatacattttgtataaggacaactctggaaacaagcctatttcctccagccagtttcactgaatgctgcaccacatgctacaccagttcagcgtgagaattttctaataaatcttttctgatactaaaa

SEQ ID NO: 154069 - DNA, 952 bp, Homo sapiens
  Payload ID: 10277
  Gene Symbol: MIF4GD
  Gene Name: MIF4G domain containing
  ENST ID: ENST00000580571
  CDS Start-End: 135-647
cgggccccgcagcgccggacgctggttgcgcgctcccaggcgccgagcggccccgggcacgcgcgcgcgccaccggcccggcaggtgctgtccttattcccagcccagtcaagagctaccggggctggctagtcatgggggagcccagtagagaggagtataaaatccagtcctttgatgcagagacccagcagctgctgaagacagcactcaaagatccgggtgctgtggacttggagaaagtggccaatgtgattgtggaccattctctgcaggactgtgtgttcagcaaggaagcaggacgcatgtgctacgccatcattcaggtgaacaacatgcccatgatggccctggtgaaccctgtctatgactgcctcttccggctggcccagccagacagtttgagcaaggaggaggaggtggactgtttggtgctgcagctgcaccgggttggggagcagctggagaaaatgaatgggcagcgcatggatgagctctttgtgctgatccgggatggcttcctgctcccaactggcctcagctccctggcccagctgctgctgctggagatcattgagttccgggcggccggctggaagacaacgccagctgcccacaagtattactacagcgaagtctccgactaggcctccagatcagggcttcctcaccagcactggcctttcttctacccacctctaaagctggcagtggagtctctgcctcacccaaagacttttcccttccagactttgagtgtcttcccttctagactttcccatctcctggtgagatgtttcccacttatgccgtggtcctgccctgagcccctttccccaccacaacccaccacggccaggcagagaagggcaactcccaagagccactgcactgtgtaaccattagtgcaactactaccttggtgcctcagtttacccatctgtaaaatggg

SEQ ID NO: 154070 - DNA, 1419 bp, Homo sapiens
  Payload ID: 10277
  Gene Symbol: MIF4GD
  Gene Name: MIF4G domain containing
  Uniprot ID: A9UHW6
  ENST ID: ENST00000579297
  CDS Start-End: 135-926
cgggccccgcagcgccggacgctggttgcgcgctcccaggcgccgagcggccccgggcacgcgcgcgcgccaccggcccggcaggtgctgtccttattcccagcccagtcaagagctaccggggctggctagtcatgggggagcccagtagagaggagtataaaatccagtcctttgatgcagagacccagcagctgctgaagacagcactcaaagccccgtctcttgaatgcacagttgcctgctttgagacagaagatggagaatattccgtttgccagaggagctatagtaattgctctcgcctgatgccttcccgctgtaacacgcagtacagagatccgggtgctgtggacttggagaaagtggccaatgtgattgtggaccattctctgcaggactgtgtgttcagcaaggaagcaggacgcatgtgctacgccatcattcaggcagagagtaaacaagcaggccagagtgtcttccgacgtggactcctcaaccggctgcagcaggagtaccaggctcgggagcagctgcgagcacgctccctgcagggctgggtctgctatgtcacctttatctgcaacatctttgactacctgagggtgaacaacatgcccatgatggccctggtgaaccctgtctatgactgcctcttccggctggcccagccagacagtttgagcaaggaggaggaggtggactgtttggtgctgcagctgcaccgggttggggagcagctggagaaaatgaatgggcagcgcatggatgagctctttgtgctgatccgggatggcttcctgctcccaactggcctcagctccctggcccagctgctgctgctggagatcattgagttccgggcggccggctggaagacaacgccagctgcccacaagtattactacagcgaagtctccgactaggcctccagatcagggcttcctcaccagcactggcctttcttctacccacctctaaagctggcagtggagtctctgcctcacccaaagacttttcccttccagactttgagtgtcttcccttctagactttcccatctcctggtgagatgtttcccacttatgccgtggtcctgccctgagcccctttccccaccacaacccaccacggccaggcagagaagggcaactcccaagagccactgcactgtgtaaccattagtgcaactactaccttggtgcctcagtttacccatctgtaaaatgggtaagcatagccactggtgggatattttgggatgtcaaggggtggaggcagagcacaagtcacaccagaaactgctttttatacattttgtataaggacaactctggaaacaagcctatttcctccagccagtttcactgaatgctgcaccacatgctacaccagttcagcgtgagaattttctaataa

SEQ ID NO: 154071 - DNA, 890 bp, Homo sapiens
  Payload ID: 10277
  Gene Symbol: MIF4GD
  Gene Name: MIF4G domain containing
  ENST ID: ENST00000579194
  CDS Start-End: 425-890
tcacccggcatcttcctgggccagcaacgtcaggccggtttatttaagcaactgtaacgtccgcccgcacacaccctgccccagtctactcctgcctcctgctgggactggagggtgggcgctttcctgcttcagcttctcgctcttgtgtaatcccacaagcgagggatttctaaactgagcagcaggtgcctggctgatgcccagtccccaccagaagccaagcctggtgggccttcagccaaccaccgcacgccacggaccgcccaggagtccctgtcccgagcgcgccgtcagccccgtccagggcctgcaggacggaacccgccctgcgctccacacctgaggccgctcccttcgcctcttctcctcaggtgctgtccttattcccagcccagtcaagagctaccggggctggctagtcatgggggagcccagtagagaggagtataaaatccagtcctttgatgcagagacccagcagctgctgaagacagcactcaaagccccgtctcttgaatgcacagttgcctgctttgagacagaagatggagaatattccgtttgccagaggagctatagtaattgctctcgcctgatgccttcccgctgtaacacgcagtacagagatccgggtgctgtggacttggagaaagtggccaatgtgattgtggaccattctctgcaggactgtgtgttcagcaaggaagcaggacgcatgtgctacgccatcattcaggcagagagtaaacaagcaggccagagtgtcttccgacgtggactcctcaaccggctgcagcaggagtaccaggctcgggagcagctgcgagcacgctccctgcagggctgggtctgctatgtcacctttatctgcaacatctttgactacc

SEQ ID NO: 154072 - DNA, 586 bp, Homo sapiens
  Payload ID: 10277
  Gene Symbol: MIF4GD
  Gene Name: MIF4G domain containing
  ENST ID: ENST00000579612
  CDS Start-End: 78-586
cacgcgcgcgcgccaccggcccggcaggtgctgtccttattcccagcccagtcaagagctaccggggctggctagtcatgggggagcccagtagagaggagtataaaatccagtcctttgatgcagagacccagcagctgctgaagacagcactcaaagttgcctgctttgagacagaagatggagaatattccgtttgccagaggagctatagtaattgctctcgcctgatgccttcccgctgtaacacgcagtacagagatccgggtgctgtggacttggagaaagtggccaatgtgattgtggaccattctctgcaggactgtgtgttcagcaaggaagcaggacgcatgtgctacgccatcattcaggtgaacaacatgcccatgatggccctggtgaaccctgtctatgactgcctcttccggctggcccagccagacagtttgagcaaggaggaggaggtgggtggccccagccctggcacaagcacagaaggctgcaggatggacagtccagctcagccgtgtgtcagcccactgctcacggaggtggactgtttggtgctgcagctgcaccgggttgg

SEQ ID NO: 154073 - DNA, 1531 bp, Homo sapiens
  Payload ID: 10277
  Gene Symbol: MIF4GD
  Gene Name: MIF4G domain containing
  Uniprot ID: A9UHW6
  ENST ID: ENST00000577542
  CDS Start-End: 264-1055
ccggcccggcaggtgggtcccggctcccacgccgcctctcccgcccgcgggaccctgggccgtgggctccgcagcccgccctgtgcctccgggaggggcgttccgggcgcggggggaacggccgagggctggagaccctaaaggcgcctcctacggccagaggggagcctccggcgggagccacctctccggggcgcatcatcctgccccccagtgctgtccttattcccagcccagtcaagagctaccggggctggctagtcatgggggagcccagtagagaggagtataaaatccagtcctttgatgcagagacccagcagctgctgaagacagcactcaaagccccgtctcttgaatgcacagttgcctgctttgagacagaagatggagaatattccgtttgccagaggagctatagtaattgctctcgcctgatgccttcccgctgtaacacgcagtacagagatccgggtgctgtggacttggagaaagtggccaatgtgattgtggaccattctctgcaggactgtgtgttcagcaaggaagcaggacgcatgtgctacgccatcattcaggcagagagtaaacaagcaggccagagtgtcttccgacgtggactcctcaaccggctgcagcaggagtaccaggctcgggagcagctgcgagcacgctccctgcagggctgggtctgctatgtcacctttatctgcaacatctttgactacctgagggtgaacaacatgcccatgatggccctggtgaaccctgtctatgactgcctcttccggctggcccagccagacagtttgagcaaggaggaggaggtggactgtttggtgctgcagctgcaccgggttggggagcagctggagaaaatgaatgggcagcgcatggatgagctctttgtgctgatccgggatggcttcctgctcccaactggcctcagctccctggcccagctgctgctgctggagatcattgagttccgggcggccggctggaagacaacgccagctgcccacaagtattactacagcgaagtctccgactaggcctccagatcagggcttcctcaccagcactggcctttcttctacccacctctaaagctggcagtggagtctctgcctcacccaaagacttttcccttccagactttgagtgtcttcccttctagactttcccatctcctggtgagatgtttcccacttatgccgtggtcctgccctgagcccctttccccaccacaacccaccacggccaggcagagaagggcaactcccaagagccactgcactgtgtaaccattagtgcaactactaccttggtgcctcagtttacccatctgtaaaatgggtaagcatagccactggtgggatattttgggatgtcaaggggtggaggcagagcacaagtcacaccagaaactgctttttatacattttgtataaggacaactctggaaacaagcctatttcctccagccagtttcactgaatgctgcaccacatgctacaccagttcagcg

SEQ ID NO: 154074 - DNA, 696 bp, Homo sapiens
  Payload ID: 10277
  Gene Symbol: MIF4GD
  Gene Name: MIF4G domain containing
  ENST ID: ENST00000581777
  CDS Start-End: 427-696
cctcacccggcatcttcctgggccagcaacgtcaggccggtttatttaagcaactgtaacgtccgcccgcacacaccctgccccagtctactcctgcctcctgctgggactggagggtgggcgctttcctgcttcagcttctcgctcttgtgtaatcccacaagcgagggatttctaaactgagcagcaggtgcctggctgatgcccagtccccaccagaagccaagcctggtgggccttcagccaaccaccgcacgccacggaccgcccaggagtccctgtcccgagcgcgccgtcagccccgtccagggcctgcaggacggaacccgccctgcgctccacacctgaggccgctcccttcgcctcttctcctcaggtgctgtccttattcccagcccagtcaagagctaccggggctggctagtcatgggggagcccagtagagaggagtataaaatccagtcctttgatgcagagacccagcagctgctgaagacagcactcaaagatccgggtgctgtggacttggagaaagtggccaatgtgattgtggaccattctctgcaggactgtgtgttcagcaaggaagcaggacgcatgtgctacgccatcattcaggcagagagtaaacaagcaggccagagtgtcttccgacgtggactcctcaaccggctgcagcaggagtaccaggctcgg

SEQ ID NO: 154075 - DNA, 856 bp, Homo sapiens
  Payload ID: 10277
  Gene Symbol: MIF4GD
  Gene Name: MIF4G domain containing
  ENST ID: ENST00000579119
  CDS Start-End: 33-788
gcccagtcaagagctaccggggctggctagtcatgggggagcccagtagagaggagtataaaatccagtcctttgatgcagagacccagcagctgctgaagacagcactcaaagatccgggtgctgtggacttggagaaagtggccaatgtgattgtggaccattctctgcaggactgtgtgttcagcaaggaagcaggacgcatgtgctacgccatcattcaggcagagagtaaacaagcaggccagagtgtcttccgacgtggactcctcaaccggctgcagcaggagtaccaggctcgggagcagctgcgagcacgctccctgcagggctgggtctgctatgtcacctttatctgcaacatctttgactacctgagggtgaacaacatgcccatgatggccctggtgaaccctgtctatgactgcctcttccggctggcccagccagacagtttgagcaaggaggaggaggtgggtggccccagccctggcacaagcacagaaggctgcaggatggacagtccagctcagccgtgtgtcagcccactgctcacggaggtggactgtttggtgctgcagctgcaccgggttggggagcagctggagaaaatgaatgggcagcgcatggatgagctctttgtgctgatccgggatggcttcctgctcccaactggcctcagctccctggcccagctgctgctgctggagatcattgagttccgggcggccggctggaagacaacgccagctgcccacaagtattactacagcgaagtctccgactaggcctccagatcagggcttcctcaccagcactggcctttcttctacccacctctaaagctggcagtgga

SEQ ID NO: 154076 - DNA, 569 bp, Homo sapiens
  Payload ID: 10277
  Gene Symbol: MIF4GD
  Gene Name: MIF4G domain containing
  ENST ID: ENST00000578305
  CDS Start-End: 108-233
gcgcgctcccaggcgccgagcggccccgggcacgcgcgcgcgccaccggcccggcaggtgctgtccttattcccagcccagtcaagagctaccggggctggctagtcatgggggagcccagtagagaggagtataaaatccagtcctttgatgcagagacccagcagctgctgaagacagcactcaaaggtgaacaacatgcccatgatggccctggtgaaccctgtctatgactgcctcttccggctggcccagccagacagtttgagcaaggaggaggaggtggactgtttggtgctgcagctgcaccgggttggggagcagctggagaaaatgaatgggcagcgcatggatgagctctttgtgctgatccgggatggcttcctgctcccaactggcctcagctccctggcccagctgctgctgctggagatcattgagttccgggcggccggctggaagacaacgccagctgcccacaagtattactacagcgaagtctccgactaggcctccagatcagggcttcctcaccagcactggcctttcttctacccacctctaaagct

SEQ ID NO: 154077 - DNA, 855 bp, Homo sapiens
  Payload ID: 10277
  Gene Symbol: MIF4GD
  Gene Name: MIF4G domain containing
  ENST ID: ENST00000580717
  CDS Start-End: 242-855
gctcccacgccgcctctcccgcccgcgggaccctgggccgtgggctccgcagcccgccctgtgcctccgggaggggcgttccgggcgcggggggaacggccgagggctggagaccctaaaggcgcctcctacggccagaggggagcctccggcgggagccacctctccggggcgcatcatcctgccccccagtgctgtccttattcccagcccagtcaagagctaccggggctggctagtcatgggggagcccagtagagaggagtataaaatccagtcctttgatgcagagacccagcagctgctgaagacagcactcaaagatccgggtgctgtggacttggagaaagtggccaatgtgattgtggaccattctctgcaggactgtgtgttcagcaaggaagcaggacgcatgtgctacgccatcattcaggcagagagtaaacaagcaggccagagtgtcttccgacgtggactcctcaaccggctgcagcaggagtaccaggctcgggagcagctgcgagcacgctccctgcagggctgggtctgctatgtcacctttatctgcaacatctttgactacctgagggtgaacaacatgcccatgatggccctggtgaaccctgtctatgactgcctcttccggctggcccagccagacagtttgagcaaggaggaggaggtggactgtttggtgctgcagctgcaccgggttggggagcagctggagaaaatgaatgggcagcgcatggatgagctctttgtgctgatccgggatggcttcctgctcccaactggcctcagctccctggcccagctgctgctgctggagatcattgagttccgggcggccgg

SEQ ID NO: 154078 - DNA, 1230 bp, Homo sapiens
  Payload ID: 10277
  Gene Symbol: MIF4GD
  Gene Name: MIF4G domain containing
  Uniprot ID: A9UHW6
  ENST ID: ENST00000618645
  CDS Start-End: 54-722
caggtgctgtccttattcccagcccagtcaagagctaccggggctggctagtcatgggggagcccagtagagaggagtataaaatccagtcctttgatgcagagacccagcagctgctgaagacagcactcaaagatccgggtgctgtggacttggagaaagtggccaatgtgattgtggaccattctctgcaggactgtgtgttcagcaaggaagcaggacgcatgtgctacgccatcattcaggcagagagtaaacaagcaggccagagtgtcttccgacgtggactcctcaaccggctgcagcaggagtaccaggctcgggagcagctgcgagcacgctccctgcagggctgggtctgctatgtcacctttatctgcaacatctttgactacctgagggtgaacaacatgcccatgatggccctggtgaaccctgtctatgactgcctcttccggctggcccagccagacagtttgagcaaggaggaggaggtggactgtttggtgctgcagctgcaccgggttggggagcagctggagaaaatgaatgggcagcgcatggatgagctctttgtgctgatccgggatggcttcctgctcccaactggcctcagctccctggcccagctgctgctgctggagatcattgagttccgggcggccggctggaagacaacgccagctgcccacaagtattactacagcgaagtctccgactaggcctccagatcagggcttcctcaccagcactggcctttcttctacccacctctaaagctggcagtggagtctctgcctcacccaaagacttttcccttccagactttgagtgtcttcccttctagactttcccatctcctggtgagatgtttcccacttatgccgtggtcctgccctgagcccctttccccaccacaacccaccacggccaggcagagaagggcaactcccaagagccactgcactgtgtaaccattagtgcaactactaccttggtgcctcagtttacccatctgtaaaatgggtaagcatagccactggtgggatattttgggatgtcaaggggtggaggcagagcacaagtcacaccagaaactgctttttatacattttgtataaggacaactctggaaacaagcctatttcctccagccagtttcactgaatgctgcaccacatgctacaccagttcagcgtgagaattttctaataaatcttttctgatact

SEQ ID NO: 154079 - DNA, 1006 bp, Homo sapiens
  Payload ID: 10278
  Gene Symbol: MIEN1
  Gene Name: migration and invasion enhancer 1
  Uniprot ID: Q9BRT3
  ENST ID: ENST00000394231
  CDS Start-End: 293-640
cattagagtaaatgaagccatgaagtccagcggacaccgggagtggggagtggggaagcccggcactccgggagaccgggccagggaaggagggtctggaccggacccagcccctgcccggggagcgagctccggagctgccctacgaggtcaaaacgtagcagtggcggagacccgcagggggcgcccgaacgccaccctcggcccctccccgctccagaggccccgccccgtcacgtgcccgcggttcgcgtcacacccggaagcaggggcccgagcggagccggccgcgatgagcggggagccggggcagacgtccgtagcgccccctcccgaggaggtcgagccgggcagtggggtccgcatcgtggtggagtactgtgaaccctgcggcttcgaggcgacctacctggagctggccagtgctgtgaaggagcagtatccgggcatcgagatcgagtcgcgcctcgggggcacaggtgcctttgagatagagataaatggacagctggtgttctccaagctggagaatgggggctttccctatgagaaagatctcattgaggccatccgaagagccagtaatggagaaaccctagaaaagatcaccaacagccgtcctccctgcgtcatcctgtgactgcacaggactctgggttcctgctctgttctggggtccaaaccttggtctccctttggtcctgctgggagctccccctgcctctttcccctacttagctccttagcaaagagaccctggcctccactttgccctttgggtacaaagaaggaatagaagattccgtggccttgggggcaggagagagacactctccatgaacacttctccagccacctcatacccccttcccagggtaagtgcccacgaaagcccagtccactcttcgcctcggtaatacctgtctgatgccacagattttatttattctcccctaacccagggcaatgtcagctattggcagtaaagtggcgctacaaacactaa

SEQ ID NO: 154080 - DNA, 806 bp, Homo sapiens
  Payload ID: 10278
  Gene Symbol: MIEN1
  Gene Name: migration and invasion enhancer 1
  ENST ID: ENST00000577810
  CDS Start-End: 16-366
gcggagccggccgcgatgagcggggagccggggcagacgtccgtagcgccccctcccgaggaggtcgagccgggcagtggggtccgcatcgtggtggagtactgtgaaccctgcggcttcgaggcgacctacctggagctggccagtgctgtgaaggagcagtatccgggcatcgagatcgagtcgcgcctcgggggcacaggtgcctttgagatagagataaatggacagctggtgttctccaagctggagaatgggggctttccctatgagaaagatgtgagtatttacagcgttgggaggacctcttggtcaccctaccccaacagtgcatcatcctgtcattccactcctctagctcattgaggccatccgaagagccagtaatggagaaaccctagaaaagatcaccaacagccgtcctccctgcgtcatcctgtgactgcacaggactctgggttcctgctctgttctggggtccaaaccttggtctccctttggtcctgctgggagctccccctgcctctttcccctacttagctccttagcaaagagaccctggcctccactttgccctttgggtacaaagaaggaatagaagattccgtggccttgggggcaggagagagacactctccatgaacacttctccagccacctcatacccccttcccagggtaagtgcccacgaaagcccagtccactcttcgcctcggtaatacctgtctgatgccacagattttatttattctcccctaacccagggcaatgtcagctattggcagtaaagtggcgctacaaacact

SEQ ID NO: 154081 - DNA, 1573 bp, Homo sapiens
  Payload ID: 10279
  Gene Symbol: MIIP
  Gene Name: migration and invasion inhibitory protein
  Uniprot ID: Q5JXC2
  ENST ID: ENST00000235332
  CDS Start-End: 170-1336
gaccaatcaagacggccggccgaggcccctggaacggctcaggcggctgcggctgctacggcggcgcatgctaggggattctgccgggtagaagagctgggcctggaacccagccctgaggacatcctgcggcccaggggcaagtgacacctgctgagagaggcccaggatggtggaggctgaggaactggcacagctgcggctgctcaatctggagctcctgaggcagctgtgggtggggcaggatgctgtgcggcggtcagtggccagggcagcctcggagtcaagcctggaatccagcagcagctacaactcagagactccatcgaccccagagacgtcctcaacttccttgagcacctcctgcccacggggccggtcctccgtgtggggcccaccagatgcctgtcgaggggacctccgtgatgtggccagatcgggggtggcctctctcccacctgccaaatgccagcaccaggagtccctgggccgaccgagaccccactcagcaccctcgctgggcacctcaagcctgagggacccagagccctcagggaggctgggtgatccaggaccccaggaggcacagaccccgaggtccatcctggctcaacagagcaagctgtccaagcccagggtgaccttctctgaggagtctgcagttcctaagaggagctggcgcctcaggccatacctgggctatgactggattgcagggtctctggacaccagctcttccatcaccagccagcctgaggccttcttctccaagctgcaggagtttcgggaaaccaacaaggaggagtgtatctgcagccatcctgaaccccagttgccaggcctgcgtgagagcagtggcagcggcgtggaggaagaccatgaatgcgtgtactgttaccgtgtcaaccggcgcctgttcccggtgcctgtggatcccggtaccccctgccgcctgtgcaggacaccgcgagaccagcagggccctgggaccctggcgcagccagcgcacgtcagggtgagcatcccgctgtcgatcctggagcccccgcaccggtaccacatccaccggcgaaagagctttgacgcctctgacacactggccctgccccggcactgcctgctgggctgggacatttttcctccgaagtctgagaaaagctcagcccccaggaacctggacctctggtcctctgtctccgctgaggcccagcaccagaagctgtccggcaccagcagcccttttcacccggcctcaccaatgcagatgctgcccccgaccccgacctggtcagtgccccaggtccctcggccccacgtcccacggcagaagccctgaggactgactcctgggggagaacagcattcccgccgcctccagcctctcccctctggcaggcgcacccaggagatggaatcccctgcccgcccagctcaggcccagctgtcctaggttgggcaggtgggtggacccaagcttgtctgctgcctgagttccagagagggaggaccctggggtggagggtgagggattctgtggaagtttgtaaataaagctcagtgctctgcagctcaa

SEQ ID NO: 154082 - DNA, 1937 bp, Homo sapiens
  Payload ID: 10280
  Gene Symbol: MFGE8
  Gene Name: milk fat globule-EGF factor 8 protein
  Uniprot ID: Q08431
  ENST ID: ENST00000268150
  CDS Start-End: 93-1256
tgatttattccggtcccagaggagaaggcgccagaaccccgcggggtctgagcagcccagcgtgcccattccagcgcccgcgtccccgcagcatgccgcgcccccgcctgctggccgcgctgtgcggcgcgctgctctgcgcccccagcctcctcgtcgccctggatatctgttccaaaaacccctgccacaacggtggtttatgcgaggagatttcccaagaagtgcgaggagatgtcttcccctcgtacacctgcacgtgccttaagggctacgcgggcaaccactgtgagacgaaatgtgtcgagccactgggcctggagaatgggaacattgccaactcacagatcgccgcctcgtctgtgcgtgtgaccttcttgggtttgcagcattgggtcccggagctggcccgcctgaaccgcgcaggcatggtcaatgcctggacacccagcagcaatgacgataacccctggatccaggtgaacctgctgcggaggatgtgggtaacaggtgtggtgacgcagggtgccagccgcttggccagtcatgagtacctgaaggccttcaaggtggcctacagccttaatggacacgaattcgatttcatccatgatgttaataaaaaacacaaggagtttgtgggtaactggaacaaaaacgcggtgcatgtcaacctgtttgagacccctgtggaggctcagtacgtgagattgtaccccacgagctgccacacggcctgcactctgcgctttgagctactgggctgtgagctgaacggatgcgccaatcccctgggcctgaagaataacagcatccctgacaagcagatcacggcctccagcagctacaagacctggggcttgcatctcttcagctggaacccctcctatgcacggctggacaagcagggcaacttcaacgcctgggttgcggggagctacggtaacgatcagtggctgcaggtggacctgggctcctcgaaggaggtgacaggcatcatcacccagggggcccgtaactttggctctgtccagtttgtggcatcctacaaggttgcctacagtaatgacagtgcgaactggactgagtaccaggaccccaggactggcagcagtaagatcttccctggcaactgggacaaccactcccacaagaagaacttgtttgagacgcccatcctggctcgctatgtgcgcatcctgcctgtagcctggcacaaccgcatcgccctgcgcctggagctgctgggctgttagtggccacctgccacccccaggtcttcctgctttccatgggcccgctgcctcttggcttctcagcccctttaaatcaccatagggctggggactggggaaggggagggtgttcagaggcagcaccaccacacagtcacccctccctccctctttcccaccctccacctctcacgggccctgccccagcccctaagccccgtcccctaacccccagtcctcactgtcctgttttcttaggcactgagggatctgagtaggtctgggatggacaggaaagggcaaagtagggcgtgtggtttccctgcccctgtccggaccgccgatcccaggtgcgtgtgtctctgtctctcctagcccctctctcacacatcacattcccatggtggcctcaagaaaggcccggaagcgccaggctggagataacagcctcttgcccgtcggccctgcgtcggccctggggtaccatgtggccacaactgctgtggccccctgtccccaagacacttccccttgtctccctggttgcctctcttgccccttgtcctgaagcccagcgacacagaagggggtggggcgggtctatggggagaaagggagcgaggtcagaggagggcatgggttggcagggtgggcgtttggggccctctatgctggcttttcaccccagaggacacaggcagc

SEQ ID NO: 154083 - DNA, 1752 bp, Homo sapiens
  Payload ID: 10280
  Gene Symbol: MFGE8
  Gene Name: milk fat globule-EGF factor 8 protein
  ENST ID: ENST00000268151
  CDS Start-End: 63-1070
ccagaaccccgcggggtctgagcagcccagcgtgcccattccagcgcccgcgtccccgcagcatgccgcgcccccgcctgctggccgcgctgtgcggcgcgctgctctgcgcccccagcctcctcgtcgccctggatatctgttccaaaaacccctgccacaacggtggtttatgcgaggagatttcccaagaagtgcgaggagatgtcttcccctcgtacacctgcacgtgccttaagggctacgcgggcaaccactgtgagacgaaatgtgtcgagccactgggcctggagaatgggaacattgccaactcacagatcgccgcctcgtctgtgcgtgtgaccttcttgggtttgcagcattgggtcccggagctggcccgcctgaaccgcgcaggcatggtcaatgcctggacacccagcagcaatgacgataacccctggatccaggtgaacctgctgcggaggatgtgggtaacaggtgtggtgacgcagggtgccagccgcttggccagtcatgagtacctgaaggccttcaaggtggcctacagccttaatggacacgaattcgatttcatccatgatgttaataaaaaacacaaggagtttgtgggtaactggaacaaaaacgcggtgcatgtcaacctgtttgagacccctgtggaggctcagtacgtgagattgtaccccacgagctgccacacggcctgcactctgcgctttgagctactgggctgtgagctgaacggatgcgccaatcccctgggcctgaagaataacagcatccctgacaagcagatcacggcctccagcagctacaagacctggggcttgcatctcttcagctggaacccctcctatgcacggctggacaagcagggcaacttcaacgcctgggttgcggggagctacggtaacgatcagtggctgcagatcttccctggcaactgggacaaccactcccacaagaagaacttgtttgagacgcccatcctggctcgctatgtgcgcatcctgcctgtagcctggcacaaccgcatcgccctgcgcctggagctgctgggctgttagtggccacctgccacccccaggtcttcctgctttccatgggcccgctgcctcttggcttctcagcccctttaaatcaccatagggctggggactggggaaggggagggtgttcagaggcagcaccaccacacagtcacccctccctccctctttcccaccctccacctctcacgggccctgccccagcccctaagccccgtcccctaacccccagtcctcactgtcctgttttcttaggcactgagggatctgagtaggtctgggatggacaggaaagggcaaagtagggcgtgtggtttccctgcccctgtccggaccgccgatcccaggtgcgtgtgtctctgtctctcctagcccctctctcacacatcacattcccatggtggcctcaagaaaggcccggaagcgccaggctggagataacagcctcttgcccgtcggccctgcgtcggccctggggtaccatgtggccacaactgctgtggccccctgtccccaagacacttccccttgtctccctggttgcctctcttgccccttgtcctgaagcccagcgacacagaagggggtggggcgggtctatggggagaaagggagcgaggtcagaggagggcatgggttggcagggtgggcgtttggggccctctatgctggcttttcaccccagaggacacaggcagct

SEQ ID NO: 154084 - DNA, 1172 bp, Homo sapiens
  Payload ID: 10280
  Gene Symbol: MFGE8
  Gene Name: milk fat globule-EGF factor 8 protein
  ENST ID: ENST00000542878
  CDS Start-End: 61-1092
agaaccccgcggggtctgagcagcccagcgtgcccattccagcgcccgcgtccccgcagcatgccgcgcccccgcctgctggccgcgctgtgcggcgcgctgctctgcgcccccagcctcctcgtcgccctggaatgtgtcgagccactgggcctggagaatgggaacattgccaactcacagatcgccgcctcgtctgtgcgtgtgaccttcttgggtttgcagcattgggtcccggagctggcccgcctgaaccgcgcaggcatggtcaatgcctggacacccagcagcaatgacgataacccctggatccaggtgaacctgctgcggaggatgtgggtaacaggtgtggtgacgcagggtgccagccgcttggccagtcatgagtacctgaaggccttcaaggtggcctacagccttaatggacacgaattcgatttcatccatgatgttaataaaaaacacaaggagtttgtgggtaactggaacaaaaacgcggtgcatgtcaacctgtttgagacccctgtggaggctcagtacgtgagattgtaccccacgagctgccacacggcctgcactctgcgctttgagctactgggctgtgagctgaacggatgcgccaatcccctgggcctgaagaataacagcatccctgacaagcagatcacggcctccagcagctacaagacctggggcttgcatctcttcagctggaacccctcctatgcacggctggacaagcagggcaacttcaacgcctgggttgcggggagctacggtaacgatcagtggctgcaggtggacctgggctcctcgaaggaggtgacaggcatcatcacccagggggcccgtaactttggctctgtccagtttgtggcatcctacaaggttgcctacagtaatgacagtgcgaactggactgagtaccaggaccccaggactggcagcagtaagatcttccctggcaactgggacaaccactcccacaagaagaacttgtttgagacgcccatcctggctcgctatgtgcgcatcctgcctgtagcctggcacaaccgcatcgccctgcgcctggagctgctgggctgttagtggccacctgccacccccaggtcttcctgctttccatgggcccgctgcctcttggcttctcagcccctttaaatcaccat

SEQ ID NO: 154085 - DNA, 1989 bp, Homo sapiens
  Payload ID: 10280
  Gene Symbol: MFGE8
  Gene Name: milk fat globule-EGF factor 8 protein
  ENST ID: ENST00000558018
  CDS Start-End: 61-138
agaaccccgcggggtctgagcagcccagcgtgcccattccagcgcccgcgtccccgcagcatgccgcgcccccgcctgctggccgcgctgtgcggcgcgctgctctgcgcccccagcctcctcgtcgccctggggtgatgtggccttttccagaaggaggaaacaccatacctatcttacacacagatatctgttccaaaaacccctgccacaacggtggtttatgcgaggagatttcccaagaagtgcgaggagatgtcttcccctcgtacacctgcacgtgccttaagggctacgcgggcaaccactgtgagacgaaatgtgtcgagccactgggcctggagaatgggaacattgccaactcacagatcgccgcctcgtctgtgcgtgtgaccttcttgggtttgcagcattgggtcccggagctggcccgcctgaaccgcgcaggcatggtcaatgcctggacacccagcagcaatgacgataacccctggatccaggtgaacctgctgcggaggatgtgggtaacaggtgtggtgacgcagggtgccagccgcttggccagtcatgagtacctgaaggccttcaaggtggcctacagccttaatggacacgaattcgatttcatccatgatgttaataaaaaacacaaggagtttgtgggtaactggaacaaaaacgcggtgcatgtcaacctgtttgagacccctgtggaggctcagtacgtgagattgtaccccacgagctgccacacggcctgcactctgcgctttgagctactgggctgtgagctgaacggatgcgccaatcccctgggcctgaagaataacagcatccctgacaagcagatcacggcctccagcagctacaagacctggggcttgcatctcttcagctggaacccctcctatgcacggctggacaagcagggcaacttcaacgcctgggttgcggggagctacggtaacgatcagtggctgcaggtggacctgggctcctcgaaggaggtgacaggcatcatcacccagggggcccgtaactttggctctgtccagtttgtggcatcctacaaggttgcctacagtaatgacagtgcgaactggactgagtaccaggaccccaggactggcagcagtaagatcttccctggcaactgggacaaccactcccacaagaagaacttgtttgagacgcccatcctggctcgctatgtgcgcatcctgcctgtagcctggcacaaccgcatcgccctgcgcctggagctgctgggctgttagtggccacctgccacccccaggtcttcctgctttccatgggcccgctgcctcttggcttctcagcccctttaaatcaccatagggctggggactggggaaggggagggtgttcagaggcagcaccaccacacagtcacccctccctccctctttcccaccctccacctctcacgggccctgccccagcccctaagccccgtcccctaacccccagtcctcactgtcctgttttcttaggcactgagggatctgagtaggtctgggatggacaggaaagggcaaagtagggcgtgtggtttccctgcccctgtccggaccgccgatcccaggtgcgtgtgtctctgtctctcctagcccctctctcacacatcacattcccatggtggcctcaagaaaggcccggaagcgccaggctggagataacagcctcttgcccgtcggccctgcgtcggccctggggtaccatgtggccacaactgctgtggccccctgtccccaagacacttccccttgtctccctggttgcctctcttgccccttgtcctgaagcccagcgacacagaagggggtggggcgggtctatggggagaaagggagcgaggtcagaggagggcatgggttggcagggtgggcgtttggggccctctatgctggcttttcaccccagaggacacaggcagcttccaaaatatatttatcttcttcacgggaa

SEQ ID NO: 154086 - DNA, 849 bp, Homo sapiens
  Payload ID: 10280
  Gene Symbol: MFGE8
  Gene Name: milk fat globule-EGF factor 8 protein
  ENST ID: ENST00000558029
  CDS Start-End: 44-849
gagcagcccagcgtgcccattccagcgcccgcgtccccgcagcatgccgcgcccccgcctgctggccgcgctgtgcggcgcgctgctctgcgcccccagcctcctcgtcgccctggatatctgttccaaaaacccctgccacaacggtggtttatgcgaggagatttcccaagaagtgcgaggagatgtcttcccctcgtacacctgcacgtgccttaagggctacgcgggcaaccactgtgagacgaaatgtgtcgagccactgggcctggagaatgggaacattgccaactcacagatcgccgcctcgtctgtgcgtgtgaccttcttgggtttgcagcattgggtcccggagctggcccgcctgaaccgcgcaggcatggtcaatgcctggacacccagcagcaatgacgataacccctggatccaggtgaacctgctgcggaggatgtgggtaacaggtgtggtgacgcagggtgccagccgcttggccagtcatgagtacctgaaggccttcaaggtggcctacagccttaatggacacgaattcgatttcatccatgatgttaataaaaaacacaaggagtttgtgggtaactggaacaaaaacgcggtgcatgtcaacctgtttgagacccctgtggaggctcagtacgtgagattgtaccccacgagctgccacacggcctgcactctgcgctttgagctactgggctgtgagctgaacgcagctacaagacctggggcttgcatctcttcagctggaacccctcctatgcacggctggacaagcagggcaacttcaacgcctgggttgcggggagctacggtaacgatcagtggctgcag

SEQ ID NO: 154087 - DNA, 1689 bp, Homo sapiens
  Payload ID: 10280
  Gene Symbol: MFGE8
  Gene Name: milk fat globule-EGF factor 8 protein
  Uniprot ID: Q08431
  ENST ID: ENST00000566497
  CDS Start-End: 63-1226
ccagaaccccgcggggtctgagcagcccagcgtgcccattccagcgcccgcgtccccgcagcatgccgcgcccccgcctgctggccgcgctgtgcggcgcgctgctctgcgcccccagcctcctcgtcgccctggatatctgttccaaaaacccctgccacaacggtggtttatgcgaggagatttcccaagaagtgcgaggagatgtcttcccctcgtacacctgcacgtgccttaagggctacgcgggcaaccactgtgagacgaaatgtgtcgagccactgggcctggagaatgggaacattgccaactcacagatcgccgcctcgtctgtgcgtgtgaccttcttgggtttgcagcattgggtcccggagctggcccgcctgaaccgcgcaggcatggtcaatgcctggacacccagcagcaatgacgataacccctggatccaggtgaacctgctgcggaggatgtgggtaacaggtgtggtgacgcagggtgccagccgcttggccagtcatgagtacctgaaggccttcaaggtggcctacagccttaatggacacgaattcgatttcatccatgatgttaataaaaaacacaaggagtttgtgggtaactggaacaaaaacgcggtgcatgtcaacctgtttgagacccctgtggaggctcagtacgtgagattgtaccccacgagctgccacacggcctgcactctgcgctttgagctactgggctgtgagctgaacggatgcgccaatcccctgggcctgaagaataacagcatccctgacaagcagatcacggcctccagcagctacaagacctggggcttgcatctcttcagctggaacccctcctatgcacggctggacaagcagggcaacttcaacgcctgggttgcggggagctacggtaacgatcagtggctgcaggtggacctgggctcctcgaaggaggtgacaggcatcatcacccagggggcccgtaactttggctctgtccagtttgtggcatcctacaaggttgcctacagtaatgacagtgcgaactggactgagtaccaggaccccaggactggcagcagtaagatcttccctggcaactgggacaaccactcccacaagaagaacttgtttgagacgcccatcctggctcgctatgtgcgcatcctgcctgtagcctggcacaaccgcatcgccctgcgcctggagctgctgggctgttagtggccacctgccacccccaggcactgagggatctgagtaggtctgggatggacaggaaagggcaaagtagggcgtgtggtttccctgcccctgtccggaccgccgatcccaggtgcgtgtgtctctgtctctcctagcccctctctcacacatcacattcccatggtggcctcaagaaaggcccggaagcgccaggctggagataacagcctcttgcccgtcggccctgcgtcggccctggggtaccatgtggccacaactgctgtggccccctgtccccaagacacttccccttgtctccctggttgcctctcttgccccttgtcctgaagcccagcgacacagaagggggtggggcgggtctatggggagaaagggagcgaggtcagaggagggcatgggttggcagggtgggcgtttggggccctctatgctggcttttcaccccagaggacacaggcag

SEQ ID NO: 154088 - DNA, 456 bp, Homo sapiens
  Payload ID: 10280
  Gene Symbol: MFGE8
  Gene Name: milk fat globule-EGF factor 8 protein
  ENST ID: ENST00000613965
  CDS Start-End: 1-228
ttcgatttcatccatgatgttaataaaaaacacaaggagtttgtgggtaactggaacaaaaacgcggtgcatgtcaacctgtttgagacccctgtggaggctcagtacgtgagattgtaccccacgagctgccacacggcctgcactctgcgctttgagctactgggctgtgagctgaacgcaaggaaggcagacttgaggcgaggagcagatgacagagagcagtaacagctctgaagaaaagctagaggctgatgagatgaccatgacttggggtgaggggagagagcaagacaaggactgctctgtcgggaaggcctttgactgggggcctgaatgatggagagccagccacatgaaaaacttaaaaacagcactgcaaaaagagcactgcaggcaaggaattggttaaatgactgaagtaagcactgaataaacaatgtggttgttattaaa

SEQ ID NO: 154089 - DNA, 9576 bp, Homo sapiens
  Payload ID: 10281
  Gene Symbol: MIB1
  Gene Name: mindbomb E3 ubiquitin protein ligase 1
  Uniprot ID: Q86YT6
  ENST ID: ENST00000261537
  CDS Start-End: 265-3285
tgcccgctctccgccgccgcctccgagcagccgcgggccgccctccactccgagcggggggcgcggcggcgacagctgggcagcggctttgggctccgcggggaccgcgccgccgcccccgtgagttattctcacgtcccccggggctcgctgccgcccccgccgacgcctagagtccggcccgggcccaactccctcacgggccccccggcggcagcggcggcggcggcggcggcagcggcggagcccaccgcccgggccccgatgagtaactcccggaataaccgggtgatggtggaaggggttggcgctcgggtagtgcgcggcccggactggaagtgggggaagcaggacggcggcgagggccatgtgggcaccgtccggagcttcgagagccccgaggaggtggtggtagtgtgggacaacggcacagctgccaactaccgctgctccggggcttacgacctccgcatcctggacagcgcgcccaccggcatcaagcatgatggaaccatgtgtgatacctgccgccagcaaccaatcattggcattcgatggaagtgtgcagagtgtacaaattatgatttgtgcacagtgtgttatcatggagataaacatcatttaagacatcgcttttaccgaattactacaccgggaagtgagagggttctgttagagtctcgtaggaaatctaagaagattacagccagaggaatctttgcaggtgccagagtggtgcgaggagtggactggcagtgggaagatcaagatggaggaaatggacgtaggggaaaggtaacagaaatccaggactggagtgcatcaagcccacatagcgcagcatatgtcctctgggataatggtgctaagaacctttacagagttggctttgagggcatgtctgatctgaaatgtgtccaggatgccaagggaggttctttctacagagatcactgccctgtgctaggtgagcagaatggcaacaggaatcctggtggattgcagattggtgacctggtaaatatagatctcgacctcgaaattgtacagtctttgcagcatggtcatggaggatggactgatggaatgtttgagactttaactacaactggaactgtttgtggcattgatgaagatcatgacattgtagtacagtatccaagtggcaataggtggaccttcaatcctgctgttctcactaaagcgaacattgtccgaagtggagatgctgctcagggtgcagaaggaggcacctcgcagtttcaagtgggtgatcttgtacaagtttgttatgacctggaacgaattaaacttctacaaagaggacatggagaatgggctgaagcgatgcttccaactttaggtaaagttggccgagtacaacagatttattcagacagtgatttaaaggtggaagtttgtggaacatcttggacatacaatccagcagcagtttccaaggtggcatctgcaggatcagccattagcaatgcatctggtgaaagactctcacaactcctgaagaaattatttgaaacccaagaatctggtgacctcaatgaagaattagttaaggctgctgccaatggagatgttgctaaagtggaagatttgcttaaaagaccagatgtggatgtaaatgggcaatgtgctggccacacagctatgcaagctgctagtcagaatggacatgttgacattttgaagttacttttgaagcaaaacgtggatgtcgaagcagaggataaagatggtgatagagcagttcaccatgcagcttttggagatgaaggcgctgttatagaagtactacatcgaggtagtgctgatttgaatgctcgaaacaagcgccgacagacaccacttcatattgctgtcaataaaggtcatcttcaagttgtgaagactttattggactttggctgtcatcccagtctccaggattctgaaggtgatacccctcttcatgatgcaataagtaagaaacgtgatgatatcctagcagttcttttggaagctggagcagatgttaccatcacaaacaataatggatttaatgctctgcatcatgctgcactaaggggaaatcccagtgcaatgcgtgttttactatctaaattaccaagaccatggattgtggatgagaagaaagatgatggttatactgccttacatctggctgcccttaataatcacgtagaagtggctgaactgttggtacatcagggtaatgcaaacctggatatccagaatgtgaaccaacaaactgccctacaccttgctgttgaacgacagcatacccagattgttaggcttttggtccgtgcaggtgccaagcttgatattcaggataaggatggggatactcctttgcatgaagctctaaggcatcacactttgtctcagctacgtcagctccaagatatgcaagatgtggggaaggtggatgctgcctgggagccatccaaaaacacgttaataatgggacttggtacccagggggcagagaagaagagtgcagcatctattgcctgtttcttggcagccaatggtgctgacctgagcattcgaaataagaagggtcaatcgccacttgatctctgtcctgatccgaatctctgcaaagcactggcaaagtgtcataaggaaaaagtcagtggtcaagtgggttctcggagtccttctatgattagtaatgattctgaaaccttagaagagtgtatggtgtgctcagatatgaagagagatactctttttggtccatgtggacatattgctacctgttctttatgttctccacgtgtcaagaaatgcctcatctgtaaagaacaggttcaatccaggacaaagattgaagaatgtgtggtatgctctgacaagaaagcagctgttctttttcaaccctgtggccacatgtgtgcttgtgagaactgtgctaacctgatgaaaaagtgtgtgcagtgtcgagcagtagttgaacgaagagtgcctttcattatgtgctgtggagggaaaagttcagaagatgccactgatgatatctcaagtgggaatattccagtattacaaaaggacaaggataataccaatgtcaatgcagatgtgcaaaagttgcagcaacagttacaagacattaaagagcagacaatgtgccctgtgtgtctagatcgtctgaagaatatgattttcctttgtggtcacggaacctgtcaactctgtggagaccgcatgagtgaatgtcctatctgtcgcaaggctattgaacgaaggattcttttgtattaactaagacacatggtgtattttgttagctaatgtatctagtcatgagatcttaataggcttttgatctagttggaagttctgatgagttaatttctaatatcatagtttctttactagagtataattgggctgtaaatgtaccagaacaaaaaaccctacaaaatggtgttggaaattgtgttttttgtttttgttttaaatttgaaacatcaaattcatgtaactcataggataatttacctttggcttctaagaggaaagtcctttaaggatatccttttttaaaaaattgcatttttctcttataatttgtaaatttgttggatctcaaaagacataattctttgtgatcagttatccttcatttcatcgtggttttacacagtgagttgataacaggttctctgagaagtcatgcatcaaataaaagaggcaggtcaaacaattatgtcacatggtaaattataaaatgacagtacaagttccagatagttaagggaataccgaagggatgattctttttttaagataacaggaagttacccacatgtttgtttctgaattcttagagtaaatggaagcatagaatgagggaataatgactttgcatttctcttgttttctagattcaaaaggaacattgtttaacttgaatcagattaccagtttcaaggtgactgatagacaagaaaaggaaaaataagcaataatagtgggcaactgaagagaaaaaaaaaacgagtatctattaactggccactaacagttgcctttcttacattaatttatacactattttgttcagccagtgtttttaaaaaaaatctatgaaaagtgtacttccggttttctgtgattacttatctgggcttgatctgaccagtgaaatgacattgccctatttggacctctgaggttctatttagctttgcagatgtacatagtatcccagtgatctgcaaaattaatgccttttccaagaaaaaatcttttcttctctgtatcagttaattctgacagtgttagtgattctgtcttcattataggccttatttccattatctctttctttatagtattttttgttataaagaaaacagtctttctgtgtatacctacggatgagggtattatttaaactgccaacaatatccaagacatggtcaataacctaattataaatactttagaaagagtgaccaggacatgtatagaaatgtctgcttacctgtagactttaaaaacaaacaaaatttttggagcatttaatcattttttttctccttttatctcctttgtaatcttattgtctcctgagtaaatatacacataaatgtttggggattcattgctgctagattatatcaggtgtttacatagtgtctactatatgctgttgataagctttttcctaaaaatagttatcctcttttgtagtttttttccctcctttaaatctggctagcttttcttacttcagtttttatagaacaccaactaaatttgaaagtatgaagtctctagccctcttacactgtttctggctgtttaatccttgctgcctttgcaagtcctggtgaaagcaatggggagctttgctggctggttttgtagtctcaacaattccatgtctgtgtttagctgagtaactgctatcatttagaacagtaaaatttttatagatttcaaatttgaaaattcatgtacactcagttatctaataaggggccaccgacgctgtttttaaaactattttgaagttataaaaaggtagaacatctgactgatgatgttcacataaagagacagacagactatcatgttgcagacatgaaaacagcatgtcaggtttttcctttccttccatgccatgggctacccatctcttcccactagatcacctggtgaggagggagcacctggctgactcatgcagagtttggccaatcagagaattgtgtggtctccagctctactttccttaaacaaatcctttctgttttctgagctgcagtgctaaaacagatccctaaaaggtaatagcatcttccagactagtttaattatttcctttataagaatatgacataaatttttattatagaaataatgtcattataattttagtgctagtacttgtgggttttctgtatttgtatcaccttgaaatttgttccatgaatagaaaatacttctttattcatgttttcaatcacttagaattattttaaatttattttgggtttgtgagagataataagattaagaacttcatcatttcagtgactttcctccaactctctgaatctgctacctcttattatatgtcccttagcagtacttttccagttaggttcgttaccctgctcattagctaaacctctttatcttgtgcctcaaaagagcttttacttttcttagaaacatttataaaaaagaaaaaaactgacacgcattcattcaaaaaagtatttattgggctttagggattagatacacaacagtggaaaaatggcatcttagcacactcagaatttattgtgcagcagttgtgtattttaaggaatctgtagttaaaaggaagagatccaaaggtcctgataacatttcctaacgtttcagaagagttgtcattgagtagtgtttggatttcctctctgtatccctcaccctaccattttctcctttattcttctaagattgttagcgttgttactcaaaacatacacatacaacataccagatggtgctgttctaatggtatttgttcacgtaatttaacgttcttactgcttatactatatacatatttaattttgttgggagcaagaaggttttcaagaaaagataattttgtattagtgtaggaatatattagacaaatgtttagttggtcaaattatgcataagatatttgtaactttaaacattgcaaattgaccagctagctatggaagcataaaattaattgataattaatgttggaaatacatttctaaaatttatatttttatggtgttagcctgtaagagcattttagcatattgaaatgcatgctgcttaagatgtgtctggttcaaatatcaaaacttgctgggtcatttttacatagtagaaacatactgtctatgtgttgcccaattgctgtttgtccactctgaattctggaccctttttggactaagaattagttaaattcatgaactaagagaattagagatggggtagagtaggatcaggacagtggggttacaacagataggaaaggaaagtcagcatttgagtgtagagaaaaaaagaggatcatacagatgtcatcaaattataggctttaatacaggttgctttttttaatccaaaaggaaaagcacttatcctatcagaatgtctaccatgttttatagtaataatttgtgtaaaaaattgaatttttgaatagttttttgtattttttgtgatgaaaaactcataacataaaatttaccatattaactgtttctaaagaatacagttcagccatgtgaagtacatttacactgttgtgaagcagatctccagaactttttcatcttgcaaaactgaaactccatacccattaaacaactcccctttttgttttctcctcagtggaatagaattttgactccatataaatcaagaaacacctaaattctttagttgtttgtgtttgcaagatctaaggtcatggtaaacattaagttcttaaaatttttgggagggacagtgcacctctcctctgaattgttagcaattaaattgagtaggttttaaatgtctattcattggaagggtttgttatttcattttgagccagaggggagaggcacattttaaatatcagaattagattagctttgagtttgtacaattgggaacataatagattttcataaattatgtgtgccttgttggaagtgtcaactgtctttatgtctgcttgtaaaagtttcaaaatatgttttccctcaaaaaggcaacgttacttcatttgcttgaatattatgataggaatgcttactgatattacttgatagtcatatatagcctaggaaatttaacatatatataactatagcagtattaataatgatagttgtacttctttaaaacattaaatttgaggaaactttaatgctgtctcgtgtacattgctttactacagtgagggggaatatcctttagattgagcctcaatttactggttagtagtatgtgaaactctggtataaaaacgtaaactagacagtagagccgatgaattaaaattgtaaattgctacattggcattttctacctccttttctgtcagagtattactttttccagcatttattcttatttgtgagtaaagaggaaatgggaacctgaggttaaaattgacatttttgtttcattgagaatttaagcagtaggtacaggagaagtgacttgtcacattaatttggtgcctaaatctgtaactacaagttgtgatcgacatgtacaaaatgtctaagaaaggtcatatgctgaatattttacttttcctgtatagtctgcatgatttgtttcataaacccagcttatttcctccaaaaagcaaaatggtcctgtaatttttaaagtaaaataaacgtgccattttgtctgcaatctataatttcaggaagttattgaaagttctgactcagggctttttaacagttcaagcaattgtcagttatattttggaaactccatctgtgtaattctccagtgccttgaaagaattattaacttggcaacactattaaaactttataaaagatggtctttagtgcacgtgtatcattatatacacgttttaaagtcatattgcttagcttgttaataatgattctgcatgtgtgctgggtttgggtaattctttaaaggaagttttctagatttgcacttgatgtttgttttttaaaaactgattatttatggccgtgacactgttaccagaaaagtaattctaattaagttattatgcaaagtcatctataagtagcatctgggaagaggagatcgaggccacagtttgctattttagtatgaaaggaggatctgtttgggaaacatagattgtcttcccctcaaatgaggggaaaaaaaaaagaccctttgttcaaatggattctgttgtaaaaaattatttttaaaggaaatcacaaattgtatgtcattcttaatgctagtcttatagaataaatccataaaattgtttttatgttcagtatgtttatgtcattctaaatgcagcaaattcaatgatagcagttcaattgactcatagcagtgttttgtattttttctaattctttagctttcaatattggattaaagtcttgtttgtgaatatagtttccgtatggcaaatgatttcttgcttattagcttttgttaaagaatgcttagtaagagctaagcttttaaaagtaatgcaaacatttatcgttaataaaacctatggtgtaatatcatataatgcttttctttgatctttggagaattattcttttatagtagtatacatgaattttgatttttaaagcatttaaaaacaaatctcaatacattaaaaaacctgttattgttaaaaaggaaattaccatgcctttaagaaacaaggatgtacatcttcaattcagcataagtgtccacatctagaaggctctcattgcagttgtttacagttaaggtacctctatctaaagggccaaagaagcatttcatattttaacacctcacattctttcaggattaagacatatgaaaatagtctgaataggataaatttgataggaagtaacttaaccagtctggaagattcagctttttctataaaaagcttattcctcttcacaactcagatgtagatttcattttcaagaggtagatattttaaagcaatgatctatttgggttttagttttatgagtaaatcattaattgtatggtttgggggttattttattttccatgttaatataagcacttatttctgaagttattgagaggtcatctagctccagttcaaaagattatgtatatctgatgtttaagaggaaaaacatctgaaaaaatatcttttgtttatttgaaaaaagcatatatattccaactttaaaattgtgaatttattttgagtaacctctaattaactgtatttttttgtttctgttgctgtatagttagaaatttcatggcaatattttttactaaattgaaactataggttttaaaaataaagacattttagaaaatttg

SEQ ID NO: 154090 - DNA, 3290 bp, Homo sapiens
  Payload ID: 10282
  Gene Symbol: MIB2
  Gene Name: mindbomb E3 ubiquitin protein ligase 2
  Uniprot ID: Q96AX9
  ENST ID: ENST00000355826
  CDS Start-End: 40-3210
ggtgcttgccctgcccatccccgtggcgggggcgtggccatggcgggggcgctccggcgggggcgggccctgggctcccgcccttcgggtcccacagtttccagccgccgctctcctcagtgcccggtggcccaggagggcctgggagcccgaagccgtccccgagtcgctcctaggtcactggcgcgatgcgggccgtcctctcggctgatgggttggaagcccagcgaggctagaggccagtcccaaagtttccaggcatcagggctgcagcccaggagcctcaaggcggcccggcgggcgactggacggccggacaggtcccgagcagccccgcccaacatggacccagacccccaggcgggcgtgcaggtgggcatgcgggtggtgcgcggcgtggactggaagtggggccagcaggacggcggcgagggcggcgtgggcacggtggtggagcttggccgccacggcagcccctcgacacccgaccgcacagtggtcgtgcagtgggaccagggcacgcgcaccaactaccgcgccggctaccagggcgcgcacgacctgctgctgtacgacaacgcccagatcggcgtccggcaccccaacatcatctgtgactgctgcaagaagcacgggctgcgggggatgcgctggaagtgccgtgtgtgcctggactacgacctctgcacgcagtgctacatgcacaacaagcatgagctcgcccacgccttcgaccgctacgagaccgctcactcgcgccctgtcacactgagtccccgccagggcctcccgaggatcccactaaggggcatcttccagggagcgaaggtggtgcgaggccccgactgggagtggggctcacaggatggaggggaagggaaaccgggccgtgtggtggacatccgtggctgggatgtggagacaggccggagtgtggccagcgtgacgtgggctgatggtaccaccaatgtgtaccgtgtgggccacaagggcaaggtggacctcaagtgtgtgggcgaggcagcgggcggcttctactacaaggaccacctcccaaggctcggcaagccggcggagctgcagcgcagggtgagtgctgacagccagcccttccagcacggggacaaggtcaagtgtctgctggacactgatgtcctgcgggagatgcaggaaggccacggcggctggaaccccaggatggcggagtttatcggacagacgggcaccgtgcatcgtatcacggaccgcggggacgtgcgcgtgcagttcaaccacgagacgcgctggaccttccaccccggggcgctcaccaagcaccactccttctgggtgggcgacgtggtccgggtcatcggcgaccttgacacagtgaagcggctgcaggctgggcatggcgagtggacggacgacatggcccctgccctgggccgcgtcgggaaggtggtgaaagtgtttggagacgggaacctgcgtgtagcagtcgctggtcagcggtggaccttcagcccctcctgcctggtggcctaccggcccgaggaggatgccaacctggacgtggccgagcgcgcccgggagaacaaaagctcactgagcgtggccctggacaagcttcgggcccagaagagtgacccagagcacccgggaaggctggtggtggaggtggcgctgggtaacgcagcccgggctctggacctgctgcggaggcgcccagagcaggtggacaccaagaaccaaggcaggaccgctctgcaagtggctgcctacctgggccaggtggagttgatacggctgctgctacaagccagggcgggcgtggacctgccggacgacgagggcaacacggcactgcactacgcggccctggggaaccagcccgaggccaccagggtgctcctgagtgctgggtgccgggcggacgccatcaacagcacccagagcacagcactgcacgtggccgtgcagaggggcttcctggaggtggtgcgggccctgtgtgagcgcggctgtgacgtcaacctgcccgacgcccactcggacacgcccctgcactccgccatctcggcgggcactggagccagcggcattgtcgaggtcctcacggaggtgccaaacatcgatgttaccgccaccaacagccagggtttcaccctgctgcaccatgcctccctcaagggtcacgcgctagctgtgagaaagattctggctcgggcgcggcagctggtggacgccaagaaggaggacggcttcacggcgctgcatctggctgccctcaacaaccaccgcgaggtggcccagatcctcatccgggagggccgctgtgacgtgaacgtgcgcaaccggaagctgcagtccccgctgcatctcgccgtgcaacaggcccacgtggggctggtgccgctactggtggacgctgggtgcagtgtcaacgccgaggacgaggagggggacacagccctgcacgtggcgctgcagcgtcatcagctgctgcccctggtggctgatggggccgggggggacccagggcccttgcagctgctgtccaggctacaggcctcgggcctccccggcagcgcggagctgacggtgggcgcggcggtcgcctgcttcctggcgctggagggcgccgacgtgagctacaccaaccaccgcggtcggagcccgctggacctggccgccgagggtcgcgtgctcaaggcccttcagggctgcgcccagcgcttccgggagcggcaggcgggcgggggcgcggccccgggccccaggcaaacgctcgggacccccaacaccgtgacgaacctgcacgtgggcgccgcgccggggcccgaggccgctgagtgcctggtgtgctccgagctggcgctgctggtgctgttctcgccgtgccagcaccgcaccgtgtgtgaggagtgcgcgcgcaggatgaagaagtgcatcaggtgccaggtggtcgtcagcaagaaactgcgcccagacggctctgaggtggcgagcgccgcccccgcccccggcccgccgcgccagctggtggaggagctgcagagccgctaccggcagatggaggaacgcatcacctgccccatctgcatcgacagccacatccgcctcgtgttccagtgcggccacggcgcatgcgccccctgcggctccgcgctcagcgcctgccccatctgccgccagcccatccgcgaccgcatccagatcttcgtgtgagccgcgccgtccgccgcgcccgagctgccttcgcgtgcccccgccctgtgttttataaaaagaaagattctcggacgttg

SEQ ID NO: 154091 - DNA, 3012 bp, Homo sapiens
  Payload ID: 10282
  Gene Symbol: MIB2
  Gene Name: mindbomb E3 ubiquitin protein ligase 2
  ENST ID: ENST00000378708
  CDS Start-End: 179-2938
cagcctggcttgctggctgcccgtctggtttgctgtgttgtgtctccagtggctttagcttccaacaggaaagcctggtagccgagcgaatctgtgacccaggaagtagcaattaaatgcctgggacgctgcctcgaggctggtgtgtgctctgaggtcccgagcagccccgcccaacatggacccagacccccaggcgggcgtgcaggtgggcatgcgggtggtgcgcggcgtggactggaagtggggccagcaggacggcggcgagggcggcgtgggcacggtggtggagcttggccgccacggcagcccctcgacacccgaccgcacagtggtcgtgcagtgggaccagggcacgcgcaccaactaccgcgccggctaccagggcgcgcacgacctgctgctgtacgacaacgcccagatcggcgtccggcaccccaacatcatctgtgactgctgcaagaagcacgggctgcgggggatgcgctggaagtgccgtgtgtgcctggactacgacctctgcacgcagtgctacatgcacaacaagcatgagctcgcccacgccttcgaccgctacgagaccgctcactcgcgccctgtcacactgagtccccgccagggcctcccgaggatcccactaaggggcatcttccagggagcgaaggtggtgcgaggccccgactgggagtggggctcacaggatggaggggaagggaaaccgggccgtgtggtggacatccgtggctgggatgtggagacaggccggagtgtggccagcgtgacgtgggctgatggtaccaccaatgtgtaccgtgtgggccacaagggcaaggtggacctcaagtgtgtgggcgaggcagcgggcggcttctactacaaggaccacctcccaaggctcggcaagccggcggagctgcagcgcagggtgagtgctgacagccagcccttccagcacggggacaaggtcaagtgtctgctggacactgatgtcctgcgggagatgcaggaaggccacggcggctggaaccccaggatggcggagcaccactccttctgggtgggcgacgtggtccgggtcatcggcgaccttgacacagtgaagcggctgcaggctgggcatggcgagtggacggacgacatggcccctgccctgggccgcgtcgggaaggtggtgaaagtgtttggagacgggaacctgcgtgtagcagtcgctggtcagcggtggaccttcagcccctcctgcctggtggcctaccggcccgaggaggatgccaacctggacgtggccgagcgcgcccgggagaacaaaagctcactgagcgtggccctggacaagcttcgggcccagaagagtgacccagagcacccgggaaggctggtggtggaggtggcgctgggtaacgcagcccgggctctggacctgctgcggaggcgcccagagcaggtggacaccaagaaccaaggcaggaccgctctgcaagtggctgcctacctgggccaggtggagttgatacggctgctgctacaagccagggcgggcgtggacctgccggacgacgagggcaacacggcactgcactacgcggccctggggaaccagcccgaggccaccagggtgctcctgagtgctgggtgccgggcggacgccatcaacagcacccagagcacagcactgcacgtggccgtgcagaggggcttcctggaggtggtgcgggccctgtgtgagcgcggctgtgacgtcaacctgcccgacgcccactcggacacgcccctgcactccgccatctcggcgggcactggagccagcggcattgtcgaggtcctcacggaggtgccaaacatcgatgttaccgccaccaacagccagggtttcaccctgctgcaccatgcctccctcaagggtcacgcgctagctgtgagaaagattctggctcgggcgcggcagctggtggacgccaagaaggaggacggcttcacggcgctgcatctggctgccctcaacaaccaccgcgaggtggcccagatcctcatccgggagggccgctgtgacgtgaacgtgcgcaaccggaagctgcagtccccgctgcatctcgccgtgcaacaggcccacgtggggctggtgccgctactggtggacgctgggtgcagtgtcaacgccgaggacgaggagggggacacagccctgcacgtggcgctgcagcgtcatcagctgctgcccctggtggctgatggggccgggggggacccagggcccttgcagctgctgtccaggctacaggcctcgggcctccccggcagcgcggagctgacggtgggcgcggcggtcgcctgcttcctggcgctggagggcgccgacgtgagctacaccaaccaccgcggtcggagcccgctggacctggccgccgagggtcgcgtgctcaaggcccttcagggctgcgcccagcgcttccgggagcggcaggcgggcgggggcgcggccccgggccccaggcaaacgctcgggacccccaacaccgtgacgaacctgcacgtgggcgccgcgccggggcccgaggccgctgagtgcctggtgtgctccgagctggcgctgctggtgctgttctcgccgtgccagcaccgcaccgtgtgtgaggagtgcgcgcgcaggatgaagaagtgcatcaggtgccaggtggtcgtcagcaagaaactgcgcccagacggctctgaggtggcgagcgccgcccccgcccccggcccgccgcgccagctggtggaggagctgcagagccgctaccggcagatggaggaacgcatcacctgccccatctgcatcgacagccacatccgcctcgtgttccagtgcggccacggcgcatgcgccccctgcggctccgcgctcagcgcctgccccatctgccgccagcccatccgcgaccgcatccagatcttcgtgtgagccgcgccgtccgccgcgcccgagctgccttcgcgtgcccccgccctgtgttttataaaaagaaagattctcgg

SEQ ID NO: 154092 - DNA, 2890 bp, Homo sapiens
  Payload ID: 10282
  Gene Symbol: MIB2
  Gene Name: mindbomb E3 ubiquitin protein ligase 2
  Uniprot ID: Q96AX9
  ENST ID: ENST00000378712
  CDS Start-End: 326-2587
gctggggtcgtcgtccgggccgggtgggctgcggcgcgcggcaggcgctctggcctggcctggccgccgctgagcagtcggggccggtgggtggcctcgaacgccgggacagaccgacagacggactggccggcggtcccgcgcccccgagcggagcgggcgggacggaaacgtccgggcaagttggggtcggcagggttggaagcccagcgaggctagaggccagtcccaaagtttccaggcatcagggctgcagcccaggagcctcaaggcggcccggcgggcgactggacggccggacaggtcccgagcagccccgcccaacatggacccagacccccaggcgggcgtgcaggtgggcatgcgggtggtgcgcggcgtggactggaagtggggccagcaggacggcggcgagggcggcgtgggcacggtggtggagcttggccgccacggcagcccctcgacacccgaccgcacagtggtcgtgcagtgggaccagggcacgcgcaccaactaccgcgccggctaccagggcgcgcacgacctgctgctgtacgacaacgcccagatcggcgtccggcaccccaacatcatctgtgactgctgcaagaagcacgggctgcgggggatgcgctggaagtgccgtgtgtgcctggactacgacctctgcacgcagtgctacatgcacaacaagcatgagctcgcccacgccttcgaccgctacgagaccgctcactcgcgccctgtcacactgagtccccgccagggcctcccgaggatcccactaaggggcatcttccagggagcgaaggtggtgcgaggccccgactgggagtggggctcacaggatggcaagccggcggagctgcagcgcagggtgagtgctgacagccagcccttccagcacggggacaaggtcaagtgtctgctggacactgatgtcctgcgggagatgcaggaaggccacggcggctggaaccccaggatggcggagtttatcggacagacgggcaccgtgcatcgtatcacggaccgcggggacgtgcgcgtgcagttcaaccacgagacgcgctggaccttccaccccggggcgctcaccaagcaccactccttctgggtgggcgacgtggtccgggtcatcggcgaccttgacacagtgaagcggctgcaggctgggcatggcgagtggacggacgacatggcccctgccctgggccgcgtcgggaaggtggtgaaagtgtttggagacgggaacctgcgtgtagcagtcgctggtcagcggtggaccttcagcccctcctgcctggtggcctaccggcccgaggaggatgccaacctggacgtggccgagcgcgcccgggagaacaaaagctcactgagcgtggccctggacaagcttcgggcccagaagagtgacccagagcacccgggaaggctggtggtggaggtggcgctgggtaacgcagcccgggctctggacctgctgcggaggcgcccagagcaggtggacaccaagaaccaaggcaggaccgctctgcaagtggctgcctacctgggccaggtggagttgatacggctgctgctacaagccagggcgggcgtggacctgccggacgacgagggcaacacggcactgcactacgcggccctggggaaccagcccgaggccaccagggtgctcctgagtgctgggtgccgggcggacgccatcaacagcacccagagcacagcactgcacgtggccgtgcagaggggcttcctggaggtggtgcgggccctgtgtgagcgcggctgtgacgtcaacctgcccgacgcccactcggacacgcccctgcactccgccatctcggcgggcactggagccagcggcattgtcgaggtcctcacggaggtgccaaacatcgatgttaccgccaccaacagccagggtttcaccctgctgcaccatgcctccctcaagggtcacgcgctagctgtgagaaagattctggctcgggcgcggcagctggtggacgccaagaaggaggacggcttcacggcgctgcatctggctgccctcaacaaccaccgcgaggtggcccagatcctcatccgggagggccgctgtgacgtgaacgtgcgcaaccggaagctgcagtccccgctgcatctcgccgtgcaacaggcccacgtggggctggtgccgctactggtggacgctgggtgcagtgtcaacgccgaggacgaggagggggacacagccctgcacgtggcgctgcagcgtcatcagctgctgcccctggtggctgatggggccgggggggacccagggcccttgcagctgctgtccaggctacaggcctcgggcctccccggcagcgcggagctgacggtgggcgcggcggtcgcctgcttcctggcgctggagggcgccgacgtgagctacaccaaccaccgcggtcggagcccgctggacctggccgccgagggtcgcgtgctcaaggcccttcagggctgcgcccagcgcttccgagtgcgcgcgcaggatgaagaagtgcatcaggtgccaggtggtcgtcagcaagaaactgcgcccagacggctctgaggtggcgagcgccgcccccgcccccggcccgccgcgccagctggtggaggagctgcagagccgctaccggcagatggaggaacgcatcacctgccccatctgcatcgacagccacatccgcctcgtgttccagtgcggccacggcgcatgcgccccctgcggctccgcgctcagcgcctgccccatctgccgccagcccatccgcgaccgcatccagatcttcgtgtgagccgcgccgtccgccgcgcccgagctgccttcgcgtgcccccgccctgtgttttataaaaagaaagattctcgg

SEQ ID NO: 154093 - DNA, 592 bp, Homo sapiens
  Payload ID: 10282
  Gene Symbol: MIB2
  Gene Name: mindbomb E3 ubiquitin protein ligase 2
  ENST ID: ENST00000514363
  CDS Start-End: 102-446
gctctcctcagtgcccggtggcccaggagggcctgggagcccgaagccgtccccgagtcgctcctaggtcactggcgcgatgcgggccgtcctctcggctgatgggttggaagcccagcgaggctagaggccagtcccaaagtttccaggcatcagggctgcagcccaggagcctcaaggcggcccggcgggcgactggacggccggacaggtcccgagcagccccgcccaacatggacccagacccccaggcgggcgtgcaggcgtccggcaccccaacatcatctgtgactgctgcaagaagcacgggctgcgggggatgcgctggaagtgccgtgtgtgcctggactacgacctctgcacgcagtgctacatgcacaacaagcatgagctcgcccacgccttcgaccgctacgagaccgctcactcgcgccctgtcacactgagtccccgccagggcctcccgaggatcccactaaggggcatcttccagggagcgaaggtggtgcgaggccccgactgggagtggggctcacaggatggaggggaagggaaaccgggccgtgtggtggacatccgtggctgggatgtg

SEQ ID NO: 154094 - DNA, 780 bp, Homo sapiens
  Payload ID: 10282
  Gene Symbol: MIB2
  Gene Name: mindbomb E3 ubiquitin protein ligase 2
  ENST ID: ENST00000502470
  CDS Start-End: 344-598
agcggcgctggggtcggcgctggggtcgtcgtccgggccgggtgggctgcggcgcgcggcaggcgctctggcctggcctggccgccgctgagcagtcggggccggtgggtggcctcgaacgccgggacagaccgacagacggactggccggcggtcccgcgcccccgagcggagcgggcgggacggaaacgtccgggcaagttggggtcggcagggttggaagcccagcgaggctagaggccagtcccaaagtttccaggcatcagggctgcagcccaggagcctcaaggcggcccggcgggcgactggacggccggacaggtcccgagcagccccgcccaacatggacccagacccccaggcgggcgtgcaggtgggcatgcgggtggtgcgcggcgtggactggaagtggggccagcaggacggcggcgagggcggcgtgggcacggtggtggagcttggccgccacggcagcccctcgacacccgaccgcacagtggtcgtgcagtgggaccagggcacgcgcaccaactaccgcgccggctaccagggcgcgcacgacctgctgctgcgtccggcaccccaacatcatctgtgactgctgcaagaagcacgggctgcgggggatgcgctggaagtgccgtgtgtgcctggactacgacctctgcacgcagtgctacatgcacaacaagcatgagctcgcccacgccttcgaccgctacgagaccgctcactcgcgccctgtcacactgagtccccgccagggcctcccgaggatcc

SEQ ID NO: 154095 - DNA, 3252 bp, Homo sapiens
  Payload ID: 10282
  Gene Symbol: MIB2
  Gene Name: mindbomb E3 ubiquitin protein ligase 2
  ENST ID: ENST00000487053
  CDS Start-End: 352-2802
ccggggccagcggcgctggggtcggcgctggggtcgtcgtccgggccgggtgggctgcggcgcgcggcaggcgctctggcctggcctggccgccgctgagcagtcggggccggtgggtggcctcgaacgccgggacagaccgacagacggactggccggcggtcccgcgcccccgagcggagcgggcgggacggaaacgtccgggcaagttggggtcggcagggttggaagcccagcgaggctagaggccagtcccaaagtttccaggcatcagggctgcagcccaggagcctcaaggcggcccggcgggcgactggacggccggacaggtcccgagcagcccggcccaccatggacccctctgcccacaggtcccgagcagccccgcccaacatggacccagacccccaggcgggcgtgcaggtgggcatgcgggtggtgcgcggcgtggactggaagtggggccagcaggacggcggcgagggcggcgtgggcacggtggtggagcttggccgccacggcagcccctcgacacccgaccgcacagtggtcgtgcagtgggaccagggcacgcgcaccaactaccgcgccggctaccagggcgcgcacgacctgctgctgtacgacaacgcccagatcggcgtccggcaccccaacatcatctgtgactgctgcaagaagcacgggctgcgggggatgcgctggaagtgccgtgtgtgcctggactacgacctctgcacgcagtgctacatgcacaacaagcatgagctcgcccacgccttcgaccgctacgagaccgctcactcgcgccctgtcacactgagtccccgccagggcctcccgaggatcccactaaggggcatcttccagggagcgaaggtggtgcgaggccccgactgggagtggggctcacaggatggaggggaagggaaaccgggccgtgtggtggacatccgtggctgggatgtggagacaggccggagtgtggccagcgtgacgtgggctgatggtaccaccaatgtgtaccgtgtgggccacaagggcaaggtggacctcaagtgtgtgggcgaggcagcgggcggcttctactacaaggaccacctcccaaggctcggcaagccggcggagctgcagcgcagggtgagtgctgacagccagcccttccagcacggggacaaggtcaagtgtctgctggacactgatgtcctgcgggagatgcaggaaggccacggcggctggaaccccaggatggcggagtttatcggacagacgggcaccgtgcatcgtatcacggaccgcggggacgtgcgcgtgcagttcaaccacgagacgcgctggaccttccaccccggggcgctcaccaagcaccactccttctgggtgggcgacgtggtccgggtcatcggcgaccttgacacagtgaagcggctgcaggctgggcatggcgagtggacggacgacatggcccctgccctgggccgcgtcgggaaggtggtgaaagtgtttggagacgggaacctgcgtgtagcagtcgctggtcagcggtggaccttcagcccctcctgcctggtggcctaccggcccgaggaggatgccaacctggacgtggccgagcgcgcccgggagaacaaaagctcactgagcgtggccctggacaagcttcgggcccagaagagtgacccagagcacccgggaaggctggtggtggaggtggcgctgggtaacgcagcccgggctctggacctgctgcggaggcgcccagagcaggtggacaccaagaaccaaggcaggaccgctctgcaagtggctgcctacctgggccaggtggagttgatacggctgctgctacaagccagggcgggcgtggacctgccggacgacgagggcaacacggcactgcactacgcggccctggggaaccagcccgaggccaccagggtgctcctgagtgctgggtgccgggcggacgccatcaacagcacccagagcacagcactgcacgtggccgtgcagaggggcttcctggaggtggtgcgggccctgtgtgagcgcggctgtgacgtcaacctgcccgacgcccactcggacacgcccctgcactccgccatctcggcgggcactggagccagcggcattgtcgaggtcctcacggaggtgccaaacatcgatgttaccgccaccaacagccagggtttcaccctgctgcaccatgcctccctcaagggtcacgcgctagctgtgagaaagattctggctcgggcgcggcagctggtggacgccaagaaggaggacggcttcacggcgctgcatctggctgccctcaacaaccaccgcgaggtggcccagatcctcatccgggagggccgctgtgacgtgaacgtgcgcaaccggaagctgcagtccccgctgcatctcgccgtgcaacaggcccacgtggggctggtgccgctactggtggacgctgggtgcagtgtcaacgccgaggacgaggagggggacacagccctgcacgtggcgctgcagcgtcatcagctgctgcccctggtggctgatggggccgggggggacccagggcccttgcagctgctgtccaggctacaggcctcgggcctccccggcagcgcggagctgacggtgggcgcggcggtcgcctgcttcctggcgctggagggcgccgacgtgagctacaccaaccaccgcggtcggagcccgctggacctggccgccgagggtcgcgtgctcaaggcccttcagggctgcgcccagcgcttccgggagcggcaggcgggcgggggccgctgagtgcctggtgtgctccgagctggcgctgctggtgctgttctcgccgtgccagcaccgcaccgtgtgtgaggagtgcgcgcgcaggatgaagaagtgcatcaggtgccaggtggtcgtcagcaagaaactgcgcccagacggctctgaggtggcgagcgccgcccccgcccccggcccgccgcgccagctggtggaggagctgcagagccgctaccggcagatggaggaacgcatcacctgccccatctgcatcgacagccacatccgcctcgtgttccagtgcggccacggcgcatgcgccccctgcggctccgcgctcagcgcctgccccatctgccgccagcccatccgcgaccgcatccagatcttcgtgtgagccgcgccgtccgccgcgcccgagctgccttcgcgtgcccccgccctgtgttttataaaaagaaagattctcgg

SEQ ID NO: 154096 - DNA, 2997 bp, Homo sapiens
  Payload ID: 10282
  Gene Symbol: MIB2
  Gene Name: mindbomb E3 ubiquitin protein ligase 2
  ENST ID: ENST00000506488
  CDS Start-End: 162-1349
tgcccgtctggtttgctgtgttgtgtctccagtggctttagcttccaacaggaaagcctggtagccgagcgaatctgtgacccaggaagtagcaattaaatgcctgggacgctgcctcgaggctggtgtgtgctctgaggtcccgagcagccccgcccaacatggacccagacccccaggcgggcgtgcaggtgggcatgcgggtggtgcgcggcgtggactggaagtggggccagcaggacggcggcgagggcggcgtgggcacggtggtggagcttggccgccacggcagcccctcgacacccgaccgcacagtggtcgtgcagtgggaccagggcacgcgcaccaactaccgcgccggctaccagggcgcgcacgacctgctgctgtacgacaacgcccagatcggcgtccggcaccccaacatcatctgtgactgctgcaagaagcacgggctgcgggggatgcgctggaagtgccgtgtgtgcctggactacgacctctgcacgcagtgctacatgcacaacaagcatgagctcgcccacgccttcgaccgctacgagaccgctcactcgcgccctgtcacactgagtccccgccagggcctcccgaggatcccactaaggggcatcttccagggagcgaaggtggtgcgaggccccgactgggagtggggctcacaggatggaggggaagggaaaccgggccgtgtggtggacatccgtggctgggatgtggagacaggccggagtgtggccagcgtgacgtgggctgatggtaccaccaatgtgtaccgtgtgggccacaagggcaaggtggacctcaagtgtgtgggcgaggcagcgggcggcttctactacaaggaccacctcccaaggctcggcaagccggcggagctgcagcgcagggtgagtgctgacagccagcccttccagcacggggacaaggtcaagtgtctgctggacactgatgtcctgcgggagatgcaggaaggccacggcggctggaaccccaggatggcggagcaccactccttctgggtgggcgacgtggtccgggtcatcggcgaccttgacacagtgaagcggctgcaggctgggcatggcgagtggacggacgacatggcccctgccctgggccgcgtcgggaaggtggtgaaagtgtttggagacgggaacctgcgtgtagcagtcgctggtcagcggtggaccttcagcccctcctgcctggtggcctaccggcccgaggaggatgccaacctggacgtggccgagcgcgcccgggagaacaaaagtgcggcacagctcaggcggccagtgggaggtggggctgcccctggccaccactaacctcagccctgcccccaggctcactgagcgtggccctggacaagcttcgggcccagaagagtgacccagagcacccgggaaggctggtggtggaggtggcgctgggtaacgcagcccgggctctggacctgctgcggaggcgcccagagcaggtggacaccaagaaccaaggcaggaccgctctgcaagtggctgcctacctgggccaggtggagttgatacggctgctgctacaagccagggcgggcgtggacctgccggacgacgagggcaacacggcactgcactacgcggccctggggaaccagcccgaggccaccagggtgctcctgagtgctgggtgccgggcggacgccatcaacagcacccagagcacagcactgcacgtggccgtgcagaggggcttcctggaggtggtgcgggccctgtgtgagcgcggctgtgacgtcaacctgcccgacgcccactcggacacgcccctgcactccgccatctcggcgggcactggagccagcggcattgtcgaggtcctcacggaggtgccaaacatcgatgttaccgccaccaacagccagggtttcaccctgctgcaccatgcctccctcaagggtcacgcgctagctgtgagaaagattctggctcgggcgcggcagctggtggacgccaagaaggaggacggcttcacggcgctgcatctggctgccctcaacaaccaccgcgaggtggcccagatcctcatccgggagggccgctgtgacgtgaacgtgcgcaaccggaagctgcagtccccgctgcatctcgccgtgcaacaggcccacgtggggctggtgccgctactggtggacgctgggtgcagtgtcaacgccgaggacgaggagggggacacagccctgcacgtggcgctgcagcgtcatcagctgctgcccctggtggctgatggggccgggggggacccagggcccttgcagctgctgtccaggctacaggcctcgggcctccccggcagcgcggagctgacggtgggcgcggcggtcgcctgcttcctggcgctggagggcgccgacgtgagctacaccaaccaccgcggtcggagcccgctggacctggccgccgagggtcgcgtgctcaaggcccttcagggctgcgcccagcgcttccgggagcggcaggcgggcgggggcgcggccccgggccccaggcaaacgctcgggacccccaacaccgtgacgaacctgcacgtgggcgccgcgccggggcccgaggccgctgagtgcctggtgtgctccgagctggcgctgctggtgctgttctcgccgtgccagcaccgcaccgtgtgtgaggagtgcgcgcgcaggatgaagaagtgcatcaggtgccaggtggtcgtcagcaagaaactgcgcccagacggctctgaggtggcgagcgccgcccccgcccccggcccgccgcgccagctggtggaggagctgcagagccgctaccggcagatggaggaacgcatcacctgccccatctgcatcgacagccacatccgcctcgtgttccagtgcggccacggcgcatgcgccccctgcggctccgcgctcagcgcctgccccatctgccgccagcccatccgcgaccgcatccagatcttcgtgtgagc

SEQ ID NO: 154097 - DNA, 3034 bp, Homo sapiens
  Payload ID: 10282
  Gene Symbol: MIB2
  Gene Name: mindbomb E3 ubiquitin protein ligase 2
  ENST ID: ENST00000489635
  CDS Start-End: 136-522
tcccgcccttcgggtcccacagtttccagccgccgctctcctcagtgcccggtggcccaggagggcctgggagcccgaagccgtccccgagtcgctcctaggtcactggcgcgatgcgggccgtcctctcggctgatgggttggaagcccagcgaggctagaggccagtcccaaagtttccaggcatcagggctgcagcccaggagcctcaaggcggcccggcgggcgactggacggccggacaggtcccgagcagcccggcccaccatggacccctctgcccacaggtcccgagcagccccgcccaacatggacccagacccccaggcgggcgtgcaggcgtccggcaccccaacatcatctgtgactgctgcaagaagcacgggctgcgggggatgcgctggaagtgccgtgtgtgcctggactacgacctctgcacgcagtgctacatgcacaacaagcatgagctcgcccacgccttcgaccgctacgagaccgctcactcgcgccctgtcacactgagtccccgccagggcctcccgaggatcccactaaggggcatcttccagggagcgaaggtggtgcgaggccccgactgggagtggggctcacaggatggaggggaagggaaaccgggccgtgtggtggacatccgtggctgggatgtggagacaggccggagtgtggccagcgtgacgtgggctgatggtaccaccaatgtgtaccgtgtgggccacaagggcaaggtggacctcaagtgtgtgggcgaggcagcgggcggcttctactacaaggaccacctcccaaggctcggcaagccggcggagctgcagcgcagggtgagtgctgacagccagcccttccagcacggggacaaggtcaagtgtctgctggacactgatgtcctgcgggagatgcaggaaggccacggcggctggaaccccaggatggcggagtttatcggacagacgggcaccgtgcatcgtatcacggaccgcggggacgtgcgcgtgcagttcaaccacgagacgcgctggaccttccaccccggggcgctcaccaagcaccactccttctgggtgggcgacgtggtccgggtcatcggcgaccttgacacagtgaagcggctgcaggctgggcatggcgagtggacggacgacatggcccctgccctgggccgcgtcgggaaggtggtgaaagtgtttggagacgggaacctgcgtgtagcagtcgctggtcagcggtggaccttcagcccctcctgcctggtggcctaccggcccgaggaggatgccaacctggacgtggccgagcgcgcccgggagaacaaaagctcactgagcgtggccctggacaagcttcgggcccagaagagtgacccagagcacccgggaaggctggtggtggaggtggcgctgggtaacgcagcccgggctctggacctgctgcggaggcgcccagagcaggtggacaccaagaaccaaggcaggaccgctctgcaagtggctgcctacctgggccaggtggagttgatacggctgctgctacaagccagggcgggcgtggacctgccggacgacgagggcaacacggcactgcactacgcggccctggggaaccagcccgaggccaccagggtgctcctgagtgctgggtgccgggcggacgccatcaacagcacccagagcacagcactgcacgtggccgtgcagaggggcttcctggaggtggtgcgggccctgtgtgagcgcggctgtgacgtcaacctgcccgacgcccactcggacacgcccctgcactccgccatctcggcgggcactggagccagcggcattgtcgaggtcctcacggaggtgccaaacatcgatgttaccgccaccaacagccagggtttcaccctgctgcaccatgcctccctcaagggtcacgcgctagctgtgagaaagattctggctcgggcgcggcagctggtggacgccaagaaggaggacggcttcacggcgctgcatctggctgccctcaacaaccaccgcgaggtggcccagatcctcatccgggagggccgctgtgacgtgaacgtgcgcaaccggaagctgcagtccccgctgcatctcgccgtgcaacaggcccacgtggggctggtgccgctactggtggacgctgggtgcagtgtcaacgccgaggacgaggagggggacacagccctgcacgtggcgctgcagcgtcatcagctgctgcccctggtggctgatggggccgggggggacccagggcccttgcagctgctgtccaggctacaggcctcgggcctccccggcagcgcggagctgacggtgggcgcggcggtcgcctgcttcctggcgctggagggcgccgacgtgagctacaccaaccaccgcggtcggagcccgctggacctggccgccgagggtcgcgtgctcaaggcccttcagggctgcgcccagcgcttccgggagcggcaggcgggcgggggcgcggccccgggccccaggcaaacgctcgggacccccaacaccgtgacgaacctgcacgtgggcgccgcgccggggcccgaggccgctgagtgcctggtgtgctccgagctggcgctgctggtgctgttctcgccgtgccagcaccgcaccgtgtgtgaggagtgcgcgcgcaggatgaagaagtgcatcaggtgccaggtggtcgtcagcaagaaactgcgcccagacggctctgaggtggcgagcgccgcccccgcccccggcccgccgcgccagctggtggaggagctgcagagccgctaccggcagatggaggaacgcatcacctgccccatctgcatcgacagccacatccgcctcgtgttccagtgcggccacggcgcatgcgccccctgcggctccgcgctcagcgcctgccccatctgccgccagcccatccgcgaccgcatccagatcttcgtgtgagccgcgccgtccgccgcgcccgagctgccttcgcgtgcccccgccctgtgttttataaaaagaaagattctcgg

SEQ ID NO: 154098 - DNA, 3305 bp, Homo sapiens
  Payload ID: 10282
  Gene Symbol: MIB2
  Gene Name: mindbomb E3 ubiquitin protein ligase 2
  Uniprot ID: Q96AX9
  ENST ID: ENST00000505820
  CDS Start-End: 18-3230
gtggcgggggcgtggccatggcgggggcgctccggcgggggcgggccctgggctcccgcccttcgggtcccacagtttccagccgccgctctcctcagtgcccggtggcccaggagggcctgggagcccgaagccgtccccgagtcgctcctaggtcactggcgcgatgcgggccgtcctctcggctgatgggttggaagcccagcgaggctagaggccagtcccaaagtttccaggcatcagggctgcagcccaggagcctcaaggcggcccggcgggcgactggacggccggacaggtcccgagcagcccggcccaccatggacccctctgcccacaggtcccgagcagccccgcccaacatggacccagacccccaggcgggcgtgcaggtgggcatgcgggtggtgcgcggcgtggactggaagtggggccagcaggacggcggcgagggcggcgtgggcacggtggtggagcttggccgccacggcagcccctcgacacccgaccgcacagtggtcgtgcagtgggaccagggcacgcgcaccaactaccgcgccggctaccagggcgcgcacgacctgctgctgtacgacaacgcccagatcggcgtccggcaccccaacatcatctgtgactgctgcaagaagcacgggctgcgggggatgcgctggaagtgccgtgtgtgcctggactacgacctctgcacgcagtgctacatgcacaacaagcatgagctcgcccacgccttcgaccgctacgagaccgctcactcgcgccctgtcacactgagtccccgccagggcctcccgaggatcccactaaggggcatcttccagggagcgaaggtggtgcgaggccccgactgggagtggggctcacaggatggaggggaagggaaaccgggccgtgtggtggacatccgtggctgggatgtggagacaggccggagtgtggccagcgtgacgtgggctgatggtaccaccaatgtgtaccgtgtgggccacaagggcaaggtggacctcaagtgtgtgggcgaggcagcgggcggcttctactacaaggaccacctcccaaggctcggcaagccggcggagctgcagcgcagggtgagtgctgacagccagcccttccagcacggggacaaggtcaagtgtctgctggacactgatgtcctgcgggagatgcaggaaggccacggcggctggaaccccaggatggcggagtttatcggacagacgggcaccgtgcatcgtatcacggaccgcggggacgtgcgcgtgcagttcaaccacgagacgcgctggaccttccaccccggggcgctcaccaagcaccactccttctgggtgggcgacgtggtccgggtcatcggcgaccttgacacagtgaagcggctgcaggctgggcatggcgagtggacggacgacatggcccctgccctgggccgcgtcgggaaggtggtgaaagtgtttggagacgggaacctgcgtgtagcagtcgctggtcagcggtggaccttcagcccctcctgcctggtggcctaccggcccgaggaggatgccaacctggacgtggccgagcgcgcccgggagaacaaaagctcactgagcgtggccctggacaagcttcgggcccagaagagtgacccagagcacccgggaaggctggtggtggaggtggcgctgggtaacgcagcccgggctctggacctgctgcggaggcgcccagagcaggtggacaccaagaaccaaggcaggaccgctctgcaagtggctgcctacctgggccaggtggagttgatacggctgctgctacaagccagggcgggcgtggacctgccggacgacgagggcaacacggcactgcactacgcggccctggggaaccagcccgaggccaccagggtgctcctgagtgctgggtgccgggcggacgccatcaacagcacccagagcacagcactgcacgtggccgtgcagaggggcttcctggaggtggtgcgggccctgtgtgagcgcggctgtgacgtcaacctgcccgacgcccactcggacacgcccctgcactccgccatctcggcgggcactggagccagcggcattgtcgaggtcctcacggaggtgccaaacatcgatgttaccgccaccaacagccagggtttcaccctgctgcaccatgcctccctcaagggtcacgcgctagctgtgagaaagattctggctcgggcgcggcagctggtggacgccaagaaggaggacggcttcacggcgctgcatctggctgccctcaacaaccaccgcgaggtggcccagatcctcatccgggagggccgctgtgacgtgaacgtgcgcaaccggaagctgcagtccccgctgcatctcgccgtgcaacaggcccacgtggggctggtgccgctactggtggacgctgggtgcagtgtcaacgccgaggacgaggagggggacacagccctgcacgtggcgctgcagcgtcatcagctgctgcccctggtggctgatggggccgggggggacccagggcccttgcagctgctgtccaggctacaggcctcgggcctccccggcagcgcggagctgacggtgggcgcggcggtcgcctgcttcctggcgctggagggcgccgacgtgagctacaccaaccaccgcggtcggagcccgctggacctggccgccgagggtcgcgtgctcaaggcccttcagggctgcgcccagcgcttccgggagcggcaggcgggcgggggcgcggccccgggccccaggcaaacgctcgggacccccaacaccgtgacgaacctgcacgtgggcgccgcgccggggcccgaggccgctgagtgcctggtgtgctccgagctggcgctgctggtgctgttctcgccgtgccagcaccgcaccgtgtgtgaggagtgcgcgcgcaggatgaagaagtgcatcaggtgccaggtggtcgtcagcaagaaactgcgcccagacggctctgaggtggcgagcgccgcccccgcccccggcccgccgcgccagctggtggaggagctgcagagccgctaccggcagatggaggaacgcatcacctgccccatctgcatcgacagccacatccgcctcgtgttccagtgcggccacggcgcatgcgccccctgcggctccgcgctcagcgcctgccccatctgccgccagcccatccgcgaccgcatccagatcttcgtgtgagccgcgccgtccgccgcgcccgagctgccttcgcgtgcccccgccctgtgttttataaaaagaaagattctcgga

SEQ ID NO: 154099 - DNA, 3311 bp, Homo sapiens
  Payload ID: 10282
  Gene Symbol: MIB2
  Gene Name: mindbomb E3 ubiquitin protein ligase 2
  ENST ID: ENST00000504599
  CDS Start-End: 328-3237
cgcaattacgggcccggcgctggcggctcctgcgcgctcagaccccagggagcccatccgggcaggcggcggccctgagtgtcgcggccgtgggcccgagtggacctggagccggcgggcagccccgggggcagacaggcgaccgagccgcgggtcgaggtgctaactgtgcatcttggcatctcccctcggccacagggttggaagcccagcgaggctagaggccagtcccaaagtttccaggcatcagggctgcagcccaggagcctcaaggcggcccggcgggcgactggacggccggacaggtcccgagcagcccggcccaccatggacccctctgcccacaggtcccgagcagccccgcccaacatggacccagacccccaggcgggcgtgcaggtgggcatgcgggtggtgcgcggcgtggactggaagtggggccagcaggacggcggcgagggcggcgtgggcacggtggtggagcttggccgccacggcagcccctcgacacccgaccgcacagtggtcgtgcagtgggaccagggcacgcgcaccaactaccgcgccggctaccagggcgcgcacgacctgctgctgtacgacaacgcccagatcggcgtccggcaccccaacatcatctgtgactgctgcaagaagcacgggctgcgggggatgcgctggaagtgccgtgtgtgcctggactacgacctctgcacgcagtgctacatgcacaacaagcatgagctcgcccacgccttcgaccgctacgagaccgctcactcgcgccctgtcacactgagtccccgccagggcctcccgaggatcccactaaggggcatcttccagggagcgaaggtggtgcgaggccccgactgggagtggggctcacaggatggaggggaagggaaaccgggccgtgtggtggacatccgtggctgggatgtggagacaggccggagtgtggccagcgtgacgtgggctgatggtaccaccaatgtgtaccgtgtgggccacaagggcaaggtggacctcaagtgtgtgggcgaggcagcgggcggcttctactacaaggaccacctcccaaggctcggcaagccggcggagctgcagcgcagggtgagtgctgacagccagcccttccagcacggggacaaggtcaagtgtctgctggacactgatgtcctgcgggagatgcaggaaggccacggcggctggaaccccaggatggcggagtttatcggacagacgggcaccgtgcatcgtatcacggaccgcggggacgtgcgcgtgcagttcaaccacgagacgcgctggaccttccaccccggggcgctcaccaagcaccactccttctgggtgggcgacgtggtccgggtcatcggcgaccttgacacagtgaagcggctgcaggctgggcatggcgagtggacggacgacatggcccctgccctgggccgcgtcgggaaggtggtgaaagtgtttggagacgggaacctgcgtgtagcagtcgctggtcagcggtggaccttcagcccctcctgcctggtggcctaccggcccgaggaggatgccaacctggacgtggccgagcgcgcccgggagaacaaaagctcactgagcgtggccctggacaagcttcgggcccagaagagtgacccagagcacccgggaaggctggtggtggaggtggcgctgggtaacgcagcccgggctctggacctgctgcggaggcgcccagagcaggtggacaccaagaaccaaggcaggaccgctctgcaagtggctgcctacctgggccaggtggagttgatacggctgctgctacaagccagggcgggcgtggacctgccggacgacgagggcaacacggcactgcactacgcggccctggggaaccagcccgaggccaccagggtgctcctgagtgctgggtgccgggcggacgccatcaacagcacccagagcacagcactgcacgtggccgtgcagaggggcttcctggaggtggtgcgggccctgtgtgagcgcggctgtgacgtcaacctgcccgacgcccactcggacacgcccctgcactccgccatctcggcgggcactggagccagcggcattgtcgaggtcctcacggaggtgccaaacatcgatgttaccgccaccaacagccagggtttcaccctgctgcaccatgcctccctcaagggtcacgcgctagctgtgagaaagattctggctcgggcgcggcagctggtggacgccaagaaggaggacggcttcacggcgctgcatctggctgccctcaacaaccaccgcgaggtggcccagatcctcatccgggagggccgctgtgacgtgaacgtgcgcaaccggaagctgcagtccccgctgcatctcgccgtgcaacaggcccacgtggggctggtgccgctactggtggacgctgggtgcagtgtcaacgccgaggacgaggagggggacacagccctgcacgtggcgctgcagcgtcatcagctgctgcccctggtggctgatggggccgggggggacccagggcccttgcagctgctgtccaggctacaggcctcgggcctccccggcagcgcggagctgacggtgggcgcggcggtcgcctgcttcctggcgctggagggcgccgacgtgagctacaccaaccaccgcggtcggagcccgctggacctggccgccgagggtcgcgtgctcaaggcccttcagggctgcgcccagcgcttccgggagcggcaggcgggcgggggcgcggccccgggccccaggcaaacgctcgggacccccaacaccgtgacgaacctgcacgtgggcgccgcgccggggcccgaggccgctgagtgcctggtgtgctccgagctggcgctgctggtgctgttctcgccgtgccagcaccgcaccgtgtgtgaggagtgcgcgcgcaggatgaagaagtgcatcaggtgccaggtggtcgtcagcaagaaactgcgcccagacggctctgaggtggcgagcgccgcccccgcccccggcccgccgcgccagctggtggaggagctgcagagccgctaccggcagatggaggaacgcatcacctgccccatctgcatcgacagccacatccgcctcgtgttccagtgcggccacggcgcatgcgccccctgcggctccgcgctcagcgcctgccccatctgccgccagcccatccgcgaccgcatccagatcttcgtgtgagccgcgccgtccgccgcgcccgagctgccttcgcgtgcccccgccctgtgttttataaaaagaaagattctcgg

SEQ ID NO: 154100 - DNA, 576 bp, Homo sapiens
  Payload ID: 10282
  Gene Symbol: MIB2
  Gene Name: mindbomb E3 ubiquitin protein ligase 2
  ENST ID: ENST00000503789
  CDS Start-End: 131-576
tgatggttcggaagtcctcctgccctctgagagcttgcagtttcttgtgaaaaagagaaactaagcagcaatagaacagacccggtgtctgcttgcgtggttaagacggtcccgagcagccccgcccaacatggacccagacccccaggcgggcgtgcaggtgggcatgcgggtggtgcgcggcgtggactggaagtggggccagcaggacggcggcgagggcggcgtgggcacggtggtggagcttggccgccacggcagcccctcgacacccgaccgcacagtggtcgtgcagtgggaccagggcacgcgcaccaactaccgcgccggctaccagggcgcgcacgacctgctgctgtacgacaacgcccagatcggcgtccggcaccccaacatcatctgtgactgctgcaagaagcacgggctgcgggggatgcgctggaagtgccgtgtgtgcctggactacgacctctgcacgcagtgctacatgcacaacaagcatgagctcgcccacgccttcgaccgctacgagaccgctcactcgcgccctgtcacactgagtccccgccagggcct

SEQ ID NO: 154101 - DNA, 889 bp, Homo sapiens
  Payload ID: 10282
  Gene Symbol: MIB2
  Gene Name: mindbomb E3 ubiquitin protein ligase 2
  ENST ID: ENST00000510793
  CDS Start-End: 364-889
acgtctgcgagccgcggccgccagaccccgggcgcacgcaattacgggcccggcgctggcggctcctgcgcgctcagaccccagggagcccatccgggcaggcggcggccctgagtgtcgcggccgtgggcccgagtggacctggagccggcgggcagccccgggggcagacaggcgaccgagccgcgggtcgaggtgctaactgtgcatcttggcatctcccctcggccacagggttggaagcccagcgaggctagaggccagtcccaaagtttccaggcatcagggctgcagcccaggagcctcaaggcggcccggcgggcgactggacggccggacaggtcccgagcagccccgcccaacatggacccagacccccaggcgggcgtgcaggtgggcatgcgggtggtgcgcggcgtggactggaagtggggccagcaggacggcggcgagggcggcgtgggcacggtggtggagcttggccgccacggcagcccctcgacacccgaccgcacagtggtcgtgcagtgggaccagggcacgcgcaccaactaccgcgccggctaccagggcgcgcacgacctgctgctgtacgacaacgcccagatcggcgtccggcaccccaacatcatctgtgactgctgcaagaagcacgggctgcgggggatgcgctggaagtgccgtgtgtgcctggactacgacctctgcacgcagtgctacatgcacaacaagcatgagctcgcccacgccttcgaccgctacgagaccgctcactcgcgccctgtcacactgagtccccgccagggcctcccgaggatcccactaaggggcatcttccagggagcgaaggtggtgcgaggccccgactgggagtggggctcacaggatg

SEQ ID NO: 154102 - DNA, 2562 bp, Homo sapiens
  Payload ID: 10282
  Gene Symbol: MIB2
  Gene Name: mindbomb E3 ubiquitin protein ligase 2
  ENST ID: ENST00000514234
  CDS Start-End: 1-2488
ctgctgcaagaagcacgggctgcgggggatgcgctggaagtgccgtgtgtgcctggactacgacctctgcacgcagtgctacatgcacaacaagcatgagctcgcccacgccttcgaccgctacgagaccgctcactcgcgccctgtcacactgagtccccgccagggcctcccgaggatcccactaaggggcatcttccagggagcgaaggtggtgcgaggccccgactgggagtggggctcacaggatggaggggaagggaaaccgggccgtgtggtggacatccgtggctgggatgtggagacaggccggagtgtggccagcgtgacgtgggctgatggtaccaccaatgtgtaccgtgtgggccacaagggcaaggtggacctcaagtgtgtgggcgaggcagcgggcggcttctactacaaggaccacctcccaaggctcggcaagccggcggagctgcagcgcagggtgagtgctgacagccagcccttccagcacggggacaaggtcaagtgtctgctggacactgatgtcctgcgggagatgcaggaaggccacggcggctggaaccccaggatggcggagtttatcggacagacgggcaccgtgcatcgtatcacggaccgcggggacgtgcgcgtgcagttcaaccacgagacgcgctggaccttccaccccggggcgctcaccaaggccctgggccgcgtcgggaaggtggtgaaagtgtttggagacgggaacctgcgtgtagcagtcgctggtcagcggtggaccttcagcccctcctgcctggtggcctaccggcccgaggaggatgccaacctggacgtggccgagcgcgcccgggagaacaaaagctcactgagcgtggccctggacaagcttcgggcccagaagagtgacccagagcacccgggaaggctggtggtggaggtggcgctgggtaacgcagcccgggctctggacctgctgcggaggcgcccagagcaggtggacaccaagaaccaaggcaggaccgctctgcaagtggctgcctacctgggccaggtggagttgatacggctgctgctacaagccagggcgggcgtggacctgccggacgacgagggcaacacggcactgcactacgcggccctggggaaccagcccgaggccaccagggtgctcctgagtgctgggtgccgggcggacgccatcaacagcacccagagcacagcactgcacgtggccgtgcagaggggcttcctggaggtggtgcgggccctgtgtgagcgcggctgtgacgtcaacctgcccgacgcccactcggacacgcccctgcactccgccatctcggcgggcactggagccagcggcattgtcgaggtcctcacggaggtgccaaacatcgatgttaccgccaccaacagccagggtttcaccctgctgcaccatgcctccctcaagggtcacgcgctagctgtgagaaagattctggctcgggcgcggcagctggtggacgccaagaaggaggacggcttcacggcgctgcatctggctgccctcaacaaccaccgcgaggtggcccagatcctcatccgggagggccgctgtgacgtgaacgtgcgcaaccggaagctgcagtccccgctgcatctcgccgtgcaacaggcccacgtggggctggtgccgctactggtggacgctgggtgcagtgtcaacgccgaggacgaggagggggacacagccctgcacgtggcgctgcagcgtcatcagctgctgcccctggtggctgatggggccgggggggacccagggcccttgcagctgctgtccaggctacaggcctcgggcctccccggcagcgcggagctgacggtgggcgcggcggtcgcctgcttcctggcgctggagggcgccgacgtgagctacaccaaccaccgcggtcggagcccgctggacctggccgccgagggtcgcgtgctcaaggcccttcagggctgcgcccagcgcttccgggagcggcaggcgggcgggggcgcggccccgggccccaggcaaacgctcgggacccccaacaccgtgacgaacctgcacgtgggcgccgcgccggggcccgaggccgctgagtgcctggtgtgctccgagctggcgctgctggtgctgttctcgccgtgccagcaccgcaccgtgtgtgaggagtgcgcgcgcaggatgaagaagtgcatcaggtgccaggtggtcgtcagcaagaaactgcgcccagacggctctgaggtggcgagcgccgcccccgcccccggcccgccgcgccagctggtggaggagctgcagagccgctaccggcagatggaggaacgcatcacctgccccatctgcatcgacagccacatccgcctcgtgttccagtgcggccacggcgcatgcgccccctgcggctccgcgctcagcgcctgccccatctgccgccagcccatccgcgaccgcatccagatcttcgtgtgagccgcgccgtccgccgcgcccgagctgccttcgcgtgcccccgccctgtgttttataaaaagaaagattctcgg

SEQ ID NO: 154103 - DNA, 3116 bp, Homo sapiens
  Payload ID: 10282
  Gene Symbol: MIB2
  Gene Name: mindbomb E3 ubiquitin protein ligase 2
  Uniprot ID: Q96AX9
  ENST ID: ENST00000518681
  CDS Start-End: 24-3041
atccccgtggcgggggcgtggccatggcgggggcgctccggcgggggcgggccctgggctcccgcccttcgggtcccacagtttccagccgccgctctcctcagtgcccggtggcccaggagggcctgggagcccgaagccgtccccgagtcgctcctaggtcactggcgcgatgcgggccgtcctctcggctgatgggttggaagcccagcgaggctagaggccagtcccaaagtttccaggcatcagggctgcagcccaggagcctcaaggcggcccggcgggcgactggacggccggacaggtcccgagcagcccggcccaccatggacccctctgcccacaggtcccgagcagccccgcccaacatggacccagacccccaggcgggcgtgcaggtgggcatgcgggtggtgcgcggcgtggactggaagtggggccagcaggacggcggcgagggcggcgtgggcacggtggtggagcttggccgccacggcagcccctcgacacccgaccgcacagtggtcgtgcagtgggaccagggcacgcgcaccaactaccgcgccggctaccagggcgcgcacgacctgctgctgtacgacaacgcccagatcggcgtccggcaccccaacatcatctgtgactgctgcaagaagcacgggctgcgggggatgcgctggaagtgccgtgtgtgcctggactacgacctctgcacgcagtgctacatgcacaacaagcatgagctcgcccacgccttcgaccgctacgagaccgctcactcgcgccctgtcacactgagtccccgccagggcctcccgaggatcccactaaggggcatcttccagggagcgaaggtggtgcgaggccccgactgggagtggggctcacaggatggcaagccggcggagctgcagcgcagggtgagtgctgacagccagcccttccagcacggggacaaggtcaagtgtctgctggacactgatgtcctgcgggagatgcaggaaggccacggcggctggaaccccaggatggcggagtttatcggacagacgggcaccgtgcatcgtatcacggaccgcggggacgtgcgcgtgcagttcaaccacgagacgcgctggaccttccaccccggggcgctcaccaagcaccactccttctgggtgggcgacgtggtccgggtcatcggcgaccttgacacagtgaagcggctgcaggctgggcatggcgagtggacggacgacatggcccctgccctgggccgcgtcgggaaggtggtgaaagtgtttggagacgggaacctgcgtgtagcagtcgctggtcagcggtggaccttcagcccctcctgcctggtggcctaccggcccgaggaggatgccaacctggacgtggccgagcgcgcccgggagaacaaaagctcactgagcgtggccctggacaagcttcgggcccagaagagtgacccagagcacccgggaaggctggtggtggaggtggcgctgggtaacgcagcccgggctctggacctgctgcggaggcgcccagagcaggtggacaccaagaaccaaggcaggaccgctctgcaagtggctgcctacctgggccaggtggagttgatacggctgctgctacaagccagggcgggcgtggacctgccggacgacgagggcaacacggcactgcactacgcggccctggggaaccagcccgaggccaccagggtgctcctgagtgctgggtgccgggcggacgccatcaacagcacccagagcacagcactgcacgtggccgtgcagaggggcttcctggaggtggtgcgggccctgtgtgagcgcggctgtgacgtcaacctgcccgacgcccactcggacacgcccctgcactccgccatctcggcgggcactggagccagcggcattgtcgaggtcctcacggaggtgccaaacatcgatgttaccgccaccaacagccagggtttcaccctgctgcaccatgcctccctcaagggtcacgcgctagctgtgagaaagattctggctcgggcgcggcagctggtggacgccaagaaggaggacggcttcacggcgctgcatctggctgccctcaacaaccaccgcgaggtggcccagatcctcatccgggagggccgctgtgacgtgaacgtgcgcaaccggaagctgcagtccccgctgcatctcgccgtgcaacaggcccacgtggggctggtgccgctactggtggacgctgggtgcagtgtcaacgccgaggacgaggagggggacacagccctgcacgtggcgctgcagcgtcatcagctgctgcccctggtggctgatggggccgggggggacccagggcccttgcagctgctgtccaggctacaggcctcgggcctccccggcagcgcggagctgacggtgggcgcggcggtcgcctgcttcctggcgctggagggcgccgacgtgagctacaccaaccaccgcggtcggagcccgctggacctggccgccgagggtcgcgtgctcaaggcccttcagggctgcgcccagcgcttccgggagcggcaggcgggcgggggcgcggccccgggccccaggcaaacgctcgggacccccaacaccgtgacgaacctgcacgtgggcgccgcgccggggcccgaggccgctgagtgcctggtgtgctccgagctggcgctgctggtgctgttctcgccgtgccagcaccgcaccgtgtgtgaggagtgcgcgcgcaggatgaagaagtgcatcaggtgccaggtggtcgtcagcaagaaactgcgcccagacggctctgaggtggcgagcgccgcccccgcccccggcccgccgcgccagctggtggaggagctgcagagccgctaccggcagatggaggaacgcatcacctgccccatctgcatcgacagccacatccgcctcgtgttccagtgcggccacggcgcatgcgccccctgcggctccgcgctcagcgcctgccccatctgccgccagcccatccgcgaccgcatccagatcttcgtgtgagccgcgccgtccgccgcgcccgagctgccttcgcgtgcccccgccctgtgttttataaaaagaaagattctcgga

SEQ ID NO: 154104 - DNA, 3321 bp, Homo sapiens
  Payload ID: 10282
  Gene Symbol: MIB2
  Gene Name: mindbomb E3 ubiquitin protein ligase 2
  Uniprot ID: Q96AX9
  ENST ID: ENST00000520777
  CDS Start-End: 46-3246
acttccggtgcttgccctgcccatccccgtggcgggggcgtggccatggcgggggcgctccggcgggggcgggccctgggctcccgcccttcgggtcccacagtttccagccgccgctctcctcagtgcccggtggcccaggagggcctgggagcccgaagccgtccccgagtcgctcctaggtcactggcgcgatgcgggccgtcctctcggctgatgggttggaagcccagcgaggctagaggccagtcccaaagtttccaggcatcagggctgcagcccaggagcctcaaggcggcccggcgggcgactggacggccggacaggtcccgagcagcccggcccaccatggacccctctgcccacaggtcccgagcagccccgcccaacatggacccagacccccaggcgggcgtgcaggtgggcatgcgggtggtgcgcggcgtggactggaagtggggccagcaggacggcggcgagggcggcgtgggcacggtggtggagcttggccgccacggcagcccctcgacacccgaccgcacagtggtcgtgcagtgggaccagggcacgcgcaccaactaccgcgccggctaccagggcgcgcacgacctgctgctgtacgacaacgcccagatcggcgtccggcaccccaacatcatctgtgactgctgcaagaagcacgggctgcgggggatgcgctggaagtgccgtgtgtgcctggactacgacctctgcacgcagtgctacatgcacaacaagcatgagctcgcccacgccttcgaccgctacgagaccgctcactcgcgccctgtcacactgagtccccgccagggcctcccgaggatcccactaaggggcatcttccagggagcgaaggtggtgcgaggccccgactgggagtggggctcacaggatggaggggaagggaaaccgggccgtgtggtggacatccgtggctgggatgtggagacaggccggagtgtggccagcgtgacgtgggctgatggtaccaccaatgtgtaccgtgtgggccacaagggcaaggtggacctcaagtgtgtgggcgaggcagcgggcggcttctactacaaggaccacctcccaaggctcggcaagccggcggagctgcagcgcagggtgagtgctgacagccagcccttccagcacggggacaaggtcaagtgtctgctggacactgatgtcctgcgggagatgcaggaaggccacggcggctggaaccccaggatggcggagacgggcaccgtgcatcgtatcacggaccgcggggacgtgcgcgtgcagttcaaccacgagacgcgctggaccttccaccccggggcgctcaccaagcaccactccttctgggtgggcgacgtggtccgggtcatcggcgaccttgacacagtgaagcggctgcaggctgggcatggcgagtggacggacgacatggcccctgccctgggccgcgtcgggaaggtggtgaaagtgtttggagacgggaacctgcgtgtagcagtcgctggtcagcggtggaccttcagcccctcctgcctggtggcctaccggcccgaggaggatgccaacctggacgtggccgagcgcgcccgggagaacaaaagctcactgagcgtggccctggacaagcttcgggcccagaagagtgacccagagcacccgggaaggctggtggtggaggtggcgctgggtaacgcagcccgggctctggacctgctgcggaggcgcccagagcaggtggacaccaagaaccaaggcaggaccgctctgcaagtggctgcctacctgggccaggtggagttgatacggctgctgctacaagccagggcgggcgtggacctgccggacgacgagggcaacacggcactgcactacgcggccctggggaaccagcccgaggccaccagggtgctcctgagtgctgggtgccgggcggacgccatcaacagcacccagagcacagcactgcacgtggccgtgcagaggggcttcctggaggtggtgcgggccctgtgtgagcgcggctgtgacgtcaacctgcccgacgcccactcggacacgcccctgcactccgccatctcggcgggcactggagccagcggcattgtcgaggtcctcacggaggtgccaaacatcgatgttaccgccaccaacagccagggtttcaccctgctgcaccatgcctccctcaagggtcacgcgctagctgtgagaaagattctggctcgggcgcggcagctggtggacgccaagaaggaggacggcttcacggcgctgcatctggctgccctcaacaaccaccgcgaggtggcccagatcctcatccgggagggccgctgtgacgtgaacgtgcgcaaccggaagctgcagtccccgctgcatctcgccgtgcaacaggcccacgtggggctggtgccgctactggtggacgctgggtgcagtgtcaacgccgaggacgaggagggggacacagccctgcacgtggcgctgcagcgtcatcagctgctgcccctggtggctgatggggccgggggggacccagggcccttgcagctgctgtccaggctacaggcctcgggcctccccggcagcgcggagctgacggtgggcgcggcggtcgcctgcttcctggcgctggagggcgccgacgtgagctacaccaaccaccgcggtcggagcccgctggacctggccgccgagggtcgcgtgctcaaggcccttcagggctgcgcccagcgcttccgggagcggcaggcgggcgggggcgcggccccgggccccaggcaaacgctcgggacccccaacaccgtgacgaacctgcacgtgggcgccgcgccggggcccgaggccgctgagtgcctggtgtgctccgagctggcgctgctggtgctgttctcgccgtgccagcaccgcaccgtgtgtgaggagtgcgcgcgcaggatgaagaagtgcatcaggtgccaggtggtcgtcagcaagaaactgcgcccagacggctctgaggtggcgagcgccgcccccgcccccggcccgccgcgccagctggtggaggagctgcagagccgctaccggcagatggaggaacgcatcacctgccccatctgcatcgacagccacatccgcctcgtgttccagtgcggccacggcgcatgcgccccctgcggctccgcgctcagcgcctgccccatctgccgccagcccatccgcgaccgcatccagatcttcgtgtgagccgcgccgtccgccgcgcccgagctgccttcgcgtgcccccgccctgtgttttataaaaagaaagattctcgga

SEQ ID NO: 154105 - DNA, 568 bp, Homo sapiens
  Payload ID: 10282
  Gene Symbol: MIB2
  Gene Name: mindbomb E3 ubiquitin protein ligase 2
  ENST ID: ENST00000486072
  CDS Start-End: 1-174
gtgcatcgtatcacggaccgcggggacgtgcgcgtgcagttcaaccacgagacgcgctggaccttccaccccggggcgctcaccaagcttcccagggccagccacctcggcttcacacctgcccagagctggcttctgtctgcctggacactcctcccatggctctggggctagggacacccagggctgccttggacacctggggctctcgtccagccagagcctctggcagtgcctggggtcggggtcggggccggggccgagtcaggcctgcctgtctcgtggagctcagcaggttgccctcctgttgcatgagcctgggcagccacacacagctggggggcccctcacgcccctctttgtcgctcagcaccactccttctgggtgggcgacgtggtccgggtcatcggcgaccttgacacagtgaagcggctgcaggctgggcatggcgagtggacggacgacatggcccctgccctgggccgcgtcgggaaggtggtgaaagtgtttggagacgggaacctgcgtgtagcagtcgctggtcagcggtggaccttcagcccctcc

SEQ ID NO: 154106 - DNA, 1058 bp, Homo sapiens
  Payload ID: 10282
  Gene Symbol: MIB2
  Gene Name: mindbomb E3 ubiquitin protein ligase 2
  ENST ID: ENST00000483015
  CDS Start-End: 1-999
ggccgctgtgacgtgaacgtgcgcaaccggaagctgcagtccccgctgcatctcgccgtgcaacaggcccacgtggggctggtgccgctactggtggacgctgggtgcagtgtcaacgccgaggacgaggagggggacacagccctgcacgtggcgctgcagcgtcatcagctgctgcccctggtggctgatggggccgggggggacccagggcccttgcagctgctgtccaggacatggggcgccggctgctggggctgccaggtgccaggagacgcctccctcgggcctgccccggcgcccgccctcaccggcgtctgtcctgccgcccagctacaggcctcgggcctccccggcagcgcggagctgacggtgggcgcggcggtcgcctgcttcctggcgctggagggcgccgacgtgagctacaccaaccaccgcggtcggagcccgctggacctggccgccgagggtcgcgtgctcaaggcccttcagggctgcgcccagcgcttccgggagcggcaggcgggcgggggcgcggccccgggccccaggcaaacgctcgggacccccaacaccgtgacgaacctgcacgtgggcgccgcgccggggcccgaggccgctgagtgcctggtgtgctccgagctggcgctgctggtgctgttctcgccgtgccagcaccgcaccgtgtgtgaggagtgcgcgcgcaggatgaagaagtgcatcaggtgccaggtggtcgtcagcaagaaactgcgcccagacggctctgaggtggcgagcgccgcccccgcccccggcccgccgcgccagctggtggaggagctgcagagccgctaccggcagatggaggaacgcatcacctgccccatctgcatcgacagccacatccgcctcgtgttccagtgcggccacggcgcatgcgccccctgcggctccgcgctcagcgcctgccccatctgccgccagcccatccgcgaccgcatccagatcttcgtgtgagccgcgccgtccgccgcgcccgagctgccttcgcgtgcccccgccctgtgttttataaa

SEQ ID NO: 154107 - DNA, 4587 bp, Homo sapiens
  Payload ID: 10283
  Gene Symbol: MCM10
  Gene Name: minichromosome maintenance 10 replication initiation factor
  ENST ID: ENST00000378694
  CDS Start-End: 76-2643
ccaagattctacattgctcatctgggcatctgagcctccttcgaagtttcctgtcacaactgtcctcttgacagcatggatgaggaggaagacaatctgtctctgctgaccgcactgctggaagaaaatgagtcagccttggattgtaattcagaagaaaataacttcttgacgcgggaaaatggcgagcccgacgcatttgatgagctctttgatgccgacggcgacggtgaatcttatacagaagaggctgatgatggagaaacaggagagacaagagacgaaaaggaaaatctggccactctctttggagatatggaggacttaacagatgaagaagaagttcccgcatcacagtcaactgaaaatagggtcctccctgctcctgcccccaggcgagagaaaacgaatgaagagttgcaagaggaattaaggaatttgcaagagcaaatgaaggccttacaagagcagctaaaagtaacaacaattaaacagacagcaagcccagcccgtctgcaaaaatcccctgagaagtctccccggccacctcttaaggagaggagagttcagagaattcaggagtcaacatgcttttctgcggagcttgatgtccctgcgctaccaagaaccaagagggtggctcgaacaccaaaggcttcacctccagatcccaaaagctcatcttcaaggatgacaagtgcaccctcccaacccctacagacgatttctcggaacaaacctagtgggataactagaggtcaaattgtggggaccccaggaagttctggggaaacgactcaacccatctgtgtggaagccttctctggtctgcggctcaggcggcctcgagtatcctccacagaaatgaacaagaaaatgaccggccgaaaactgatcagactgtctcagatcaaggaaaagatggccagagagaagctggaagaaatagattgggtgacatttggggttatattgaagaaggttacgccacagagtgtgaatagtggaaaaaccttcagcatatggaaactgaatgatcttcgtgacctgacacaatgtgtgtccttgttcttatttggagaagttcacaaagcgctctggaagacggagcaggggactgtcgtagggatcctcaatgccaaccccatgaagcccaaggatggttcagaggaggtgtgtttatctatcgatcatcctcagaaggtcttaattatgggtgaagctcttgacctgggaacctgtaaagccaagaagaagaatggagagccgtgcacgcagactgtgaatttgcgtgactgtgagtactgtcagtaccatgtccaggctcagtacaagaagctcagcgcaaagcgtgcggatctgcagtccaccttctctggaggacgaattccaaagaagtttgcccgcagaggcaccagcctcaaagaacggctgtgccaagatggcttttactacggaggggtttcttctgcctcgtatgcagcttcaattgcagcagctgtggctcctaagaagaagattcaaaccactctgagtaatctggttgttaagggcacaaacttgatcatccaggaaacacggcaaaaactcggaataccccagaagagcctgtcttgctctgaggagttcaaggaactgatggacctgccgacgtgtggagccaggaacttaaaacaacatttagccaaagccacagcttcagggattatggggagcccaaaaccagccatcaagtccatctcggcctcagcactcttgaagcaacagaagcagcggatgttggagatgaggagaaggaaatcagaagaaatacagaagcgatttctgcagagctcaagtgaagttgagagcccagctgtgccatcttcatcaagacagccccctgctcagcctccacggacaggatccgagttccccaggctggagggagccccggccacaatgacgcccaagctggggcgaggtgtcttggaaggagatgatgttctcttttatgatgagtcaccaccaccaagaccaaaactgagtgctttagcagaagccaaaaagttagctgctatcaccaaattaagggcaaaaggccaggttcttacaaaaacaaacccaaacagcattaagaagaaacaaaaggaccctcaggacatcctggaggtgaaggaacgtgtagaaaaaaacaccatgttttcttctcaagctgaggatgaattggagcctgccaggaaaaaaaggagagaacaacttgcctatctggaatctgaggaatttcagaaaatcctaaaagcaaaatcaaaacacacaggcatcctgaaagaggccgaggctgagatgcaggagcgctactttgagccactggtgaaaaaagaacaaatggaagaaaagatgagaaacatcagagaagtgaagtgccgtgtcgtgacatgcaagacgtgcgcctatacccacttcaagctgctggagacctgcgtcagtgagcagcatgaataccactggcatgatggtgtgaagaggtttttcaaatgtccctgtggaaacagaagcatctccttggacagactcccgaacaagcactgcagtaactgtggcctctacaaatgggaacgggacggaatgctaaaggtatgccatttgcgtactaatttttgactccttttagtgacccatgctaataatgtggaaccatctcctattaaaatattttcatttttctaggaaaagactggtccaaagataggaggagaaactctgttaccaagaggagaagaacatgctaaatttctgaacagccttaaataacccgaacttcagacattttcccacagacttcctggcctcctgtgactctggaaagcaaaggattggctgtgtattgtccattgattcctgattgacgccgtcaaaaacaaatgcttgttaagcccataagctttgcctgcttactttctgccattgggttggtttgataccacatttaacattgacatttaagtggaaaaccaagttatcattgtcttttctaagctcagtgtggatgattgcattacttcattcactgaagtttttgcccaaaaattggaaggtaaacagagagctatgtttctgtatcttttggttatagagtgttcacttctttatcataacaaaattctagtgtttatacgaacacccagaggcaaaagaatttggcttaattctcactccaggtaagtagcttaacttctgggcttcagttttctcatctgtaaaatcaggaagattggactaagtgatcctgaaatgtattttttagcactggatttctacaaataataaaactttcccatctagataatgatgatcacatagtcttgatgtacggacattaaaagccagatttcttcattcaattctgttatctctgttttactctttgaaattgatcaagccactgaatcactttgcatttcagtttatatatatagagagaaagaaggtgtctgctcttacattattgtggagccctgtgatagaaatatgtaaaatctcatattattttttttttaatttttttattttttatgacagggtctcactatgtcaccctggctggagtgcagtagtgcgatcgcggcacactgcagccttggcttccctgggctcaagcagtcctcccacctcagtctcccaaatagctaggactacaggcgtgcgtgaccaagcccagctaatttttgcattttttgtagagatggggttttgccatgttgctcaggctggtctcaaactcctgagcactagcaatccacccacctctgtttccaaaaaaaaaaaaaaaatgaaaggtcaacccctatgcaaattaccacagcaaaggtttcattcaggagattcttccatctgggcaacctggttttccaaatatcatttgacctaagtgaatgttgatactagctaaagattgggtaaattggttgaattattgtattgaagcttgagctgtagctaaaagtaatttaggtttcccctaagatgttattatgttagggacataacacttttgggaggttgttgtgggagatggttgatttaggttttcaaaagctagaaataaaatttacatgccttagatttcataaaattctgctctaattgggtggaaggtgctgtatctaacttgtgttcctcctaaggttatgtcctaataactattcttttaggagtatacttctactttatagaaggttgcttttctttttaattttttctaacaaagaaaagaataaagtatttattaataagaaccagaaagcacttgaaactgatgtttttaatggctcatttagggtagatttatttatctcattaacttaaaacagctatgtgtatgaaataggtcacaacagaacttgaacaccaggttggtgtctgagcaatccctttcttatgggaaaaacaatgttcttgtttgaacagagggtatcattgcagtcagtattcacgtgtatattgttatataagttgtataatatgcttgtaaaggctgagggtgagctgtatctggatgcctttttacaatttgattttaacttttaaaataaatttaaaacataa

SEQ ID NO: 154108 - DNA, 4547 bp, Homo sapiens
  Payload ID: 10283
  Gene Symbol: MCM10
  Gene Name: minichromosome maintenance 10 replication initiation factor
  Uniprot ID: Q7L590
  ENST ID: ENST00000378714
  CDS Start-End: 129-2753
ggttggaattttggcgggttcagctgtgaacgaagaaggcgtcccggcatcggccaagattctacattgctcatctgggcatctgagcctccttcgaagtttcctgtcacaactgtcctcttgacagcatggatgaggaggaagacaatctgtctctgctgaccgcactgctggaagaaaatgagtcagccttggattgtaattcagaagaaaataacttcttgacgcgggaaaatggcgagcccgacgcatttgatgagctctttgatgccgacggcgacggtgaatcttatacagaagaggctgatgatggagaaacaggagagacaagagacgaaaaggaaaatctggccactctctttggagatatggaggacttaacagatgaagaagaagttcccgcatcacagtcaactgaaaatagggtcctccctgctcctgcccccaggcgagagaaaacgaatgaagagttgcaagaggaattaaggaatttgcaagagcaaatgaaggccttacaagagcagctaaaagtaacaacaattaaacagacagcaagcccagcccgtctgcaaaaatcccctgagaagtctccccggccacctcttaaggagaggagagttcagagaattcaggagtcaacatgcttttctgcggagcttgatgtccctgcgctaccaagaaccaagagggtggctcgaacaccaaaggcttcacctccagatcccaaaagctcatcttcaaggatgacaagtgcaccctcccaacccctacagacgatttctcggaacaaacctagtgggataactagaggtcaaattgtggggaccccaggaagttctggggaaacgactcaacccatctgtgtggaagccttctctggtctgcggctcaggcggcctcgagtatcctccacagaaatgaacaagaaaatgaccggccgaaaactgatcagactgtctcagatcaaggaaaagatggccagagagaagctggaagaaatagattgggtgacatttggggttatattgaagaaggttacgccacagagtgtgaatagtggaaaaaccttcagcatatggaaactgaatgatcttcgtgacctgacacaatgtgtgtccttgttcttatttggagaagttcacaaagcgctctggaagacggagcaggggactgtcgtagggatcctcaatgccaaccccatgaagcccaaggatggttcagaggaggtgtgtttatctatcgatcatcctcagaaggtcttaattatgggtgaagctcttgacctgggaacctgtaaagccaagaagaagaatggagagccgtgcacgcagactgtgaatttgcgtgactgtgagtactgtcagtaccatgtccaggctcagtacaagaagctcagcgcaaagcgtgcggatctgcagtccaccttctctggaggacgaattccaaagaagtttgcccgcagaggcaccagcctcaaagaacggctgtgccaagatggcttttactacggaggggtttcttctgcctcgtatgcagcttcaattgcagcagctgtggctcctaagaagaagattcaaaccactctgagtaatctggttgttaagggcacaaacttgatcatccaggaaacacggcaaaaactcggaataccccagaagagcctgtcttgctctgaggagttcaaggaactgatggacctgccgacgtgtggagccaggaacttaaaacaacatttagccaaagccacagcttcagggattatggggagcccaaaaccagccatcaagtccatctcggcctcagcactcttgaagcaacagaagcagcggatgttggagatgaggagaaggaaatcagaagaaatacagaagcgatttctgcagagctcaagtgaagttgagagcccagctgtgccatcttcatcaagacagccccctgctcagcctccacggacaggatccgagttccccaggctggagggagccccggccacaatgacgcccaagctggggcgaggtgtcttggaaggagatgatgttctcttttatgatgagtcaccaccaccaagaccaaaactgagtgctttagcagaagccaaaaagttagctgctatcaccaaattaagggcaaaaggccaggttcttacaaaaacaaacccaaacagcattaagaagaaacaaaaggaccctcaggacatcctggaggtgaaggaacgtgtagaaaaaaacaccatgttttcttctcaagctgaggatgaattggagcctgccaggaaaaaaaggagagaacaacttgcctatctggaatctgaggaatttcagaaaatcctaaaagcaaaatcaaaacacacaggcatcctgaaagaggccgaggctgagatgcaggagcgctactttgagccactggtgaaaaaagaacaaatggaagaaaagatgagaaacatcagagaagtgaagtgccgtgtcgtgacatgcaagacgtgcgcctatacccacttcaagctgctggagacctgcgtcagtgagcagcatgaataccactggcatgatggtgtgaagaggtttttcaaatgtccctgtggaaacagaagcatctccttggacagactcccgaacaagcactgcagtaactgtggcctctacaaatgggaacgggacggaatgctaaaggaaaagactggtccaaagataggaggagaaactctgttaccaagaggagaagaacatgctaaatttctgaacagccttaaataacccgaacttcagacattttcccacagacttcctggcctcctgtgactctggaaagcaaaggattggctgtgtattgtccattgattcctgattgacgccgtcaaaaacaaatgcttgttaagcccataagctttgcctgcttactttctgccattgggttggtttgataccacatttaacattgacatttaagtggaaaaccaagttatcattgtcttttctaagctcagtgtggatgattgcattacttcattcactgaagtttttgcccaaaaattggaaggtaaacagagagctatgtttctgtatcttttggttatagagtgttcacttctttatcataacaaaattctagtgtttatacgaacacccagaggcaaaagaatttggcttaattctcactccaggtaagtagcttaacttctgggcttcagttttctcatctgtaaaatcaggaagattggactaagtgatcctgaaatgtattttttagcactggatttctacaaataataaaactttcccatctagataatgatgatcacatagtcttgatgtacggacattaaaagccagatttcttcattcaattctgttatctctgttttactctttgaaattgatcaagccactgaatcactttgcatttcagtttatatatatagagagaaagaaggtgtctgctcttacattattgtggagccctgtgatagaaatatgtaaaatctcatattattttttttttaatttttttattttttatgacagggtctcactatgtcaccctggctggagtgcagtagtgcgatcgcggcacactgcagccttggcttccctgggctcaagcagtcctcccacctcagtctcccaaatagctaggactacaggcgtgcgtgaccaagcccagctaatttttgcattttttgtagagatggggttttgccatgttgctcaggctggtctcaaactcctgagcactagcaatccacccacctctgtttccaaaaaaaaaaaaaaaatgaaaggtcaacccctatgcaaattaccacagcaaaggtttcattcaggagattcttccatctgggcaacctggttttccaaatatcatttgacctaagtgaatgttgatactagctaaagattgggtaaattggttgaattattgtattgaagcttgagctgtagctaaaagtaatttaggtttcccctaagatgttattatgttagggacataacacttttgggaggttgttgtgggagatggttgatttaggttttcaaaagctagaaataaaatttacatgccttagatttcataaaattctgctctaattgggtggaaggtgctgtatctaacttgtgttcctcctaaggttatgtcctaataactattcttttaggagtatacttctactttatagaaggttgcttttctttttaattttttctaacaaagaaaagaataaagtatttattaataagaaccagaaagcacttgaaactgatgtttttaatggctcatttagggtagatttatttatctcattaacttaaaacagctatgtgtatgaaataggtcacaacagaacttgaacaccaggttggtgtctgagcaatccctttcttatgggaaaaacaatgttcttgtttgaacagagggtatcattgcagtcagtattcacgtgtatattgttatataagttgtataatatgcttgtaaaggctgagggtgagctgtatctggatgcctttttacaatttgattttaacttttaaaataaatttaaaacataa

SEQ ID NO: 154109 - DNA, 469 bp, Homo sapiens
  Payload ID: 10283
  Gene Symbol: MCM10
  Gene Name: minichromosome maintenance 10 replication initiation factor
  ENST ID: ENST00000479669
  CDS Start-End: 262-469
gtgaacgaagaaggcgtcccggcatcggaggaggaagacaatctgtctctgctgaccgcactgctggaagaaaatgagtcagccttggattgtaattcagaagaaaataacttcttgacgcgggaaaatggcgagcccgacgcatttgatgagctctttgatgccgacggcgacggtgaatcttatacagaagaggctgatgatggagaaacaggagagacaagagacgaaaaggaaaatctggccactctctttggagatatggaggacttaacagatgaagaagaagttcccgcatcacagtcaactgaaaatagggtcctccctgctcctgcccccaggcgagagaaaacgaatgaagagttgcaagaggaattaaggaatttgcaagagcaaatgaaggccttacaagagcagctaaaagtaacaacaattaaacagacagcaagcccagcccgtctgcaaaaat

SEQ ID NO: 154110 - DNA, 3157 bp, Homo sapiens
  Payload ID: 10283
  Gene Symbol: MCM10
  Gene Name: minichromosome maintenance 10 replication initiation factor
  Uniprot ID: Q7L590
  ENST ID: ENST00000484800
  CDS Start-End: 104-2731
gtgaacgaagaaggcgtcccggcatcggccaagattctacattgctcatctgggcatctgagcctccttcgaagtttcctgtcacaactgtcctcttgacagcatggatgaggaggaagacaatctgtctctgctgaccgcactgctggaagaaaatgagtcagccttggattgtaattcagaagaaaataacttcttgacgcgggaaaatggcgagcccgacgcatttgatgagctctttgatgccgacggcgacggtgaatcttatacagaagaggctgatgatggagaaacaggagagacaagagacgaaaaggaaaatctggccactctctttggagatatggaggacttaacagatgaagaagaagttcccgcatcacagtcaactgaaaatagggtcctccctgctcctgcccccaggcgagagaaaacgaatgaagagttgcaagaggaattaaggaatttgcaagagcaaatgaaggccttacaagagcagctaaaagtaacaacaattaaacagacagcaagcccagcccgtctgcaaaaatcccctgtagagaagtctccccggccacctcttaaggagaggagagttcagagaattcaggagtcaacatgcttttctgcggagcttgatgtccctgcgctaccaagaaccaagagggtggctcgaacaccaaaggcttcacctccagatcccaaaagctcatcttcaaggatgacaagtgcaccctcccaacccctacagacgatttctcggaacaaacctagtgggataactagaggtcaaattgtggggaccccaggaagttctggggaaacgactcaacccatctgtgtggaagccttctctggtctgcggctcaggcggcctcgagtatcctccacagaaatgaacaagaaaatgaccggccgaaaactgatcagactgtctcagatcaaggaaaagatggccagagagaagctggaagaaatagattgggtgacatttggggttatattgaagaaggttacgccacagagtgtgaatagtggaaaaaccttcagcatatggaaactgaatgatcttcgtgacctgacacaatgtgtgtccttgttcttatttggagaagttcacaaagcgctctggaagacggagcaggggactgtcgtagggatcctcaatgccaaccccatgaagcccaaggatggttcagaggaggtgtgtttatctatcgatcatcctcagaaggtcttaattatgggtgaagctcttgacctgggaacctgtaaagccaagaagaagaatggagagccgtgcacgcagactgtgaatttgcgtgactgtgagtactgtcagtaccatgtccaggctcagtacaagaagctcagcgcaaagcgtgcggatctgcagtccaccttctctggaggacgaattccaaagaagtttgcccgcagaggcaccagcctcaaagaacggctgtgccaagatggcttttactacggaggggtttcttctgcctcgtatgcagcttcaattgcagcagctgtggctcctaagaagaagattcaaaccactctgagtaatctggttgttaagggcacaaacttgatcatccaggaaacacggcaaaaactcggaataccccagaagagcctgtcttgctctgaggagttcaaggaactgatggacctgccgacgtgtggagccaggaacttaaaacaacatttagccaaagccacagcttcagggattatggggagcccaaaaccagccatcaagtccatctcggcctcagcactcttgaagcaacagaagcagcggatgttggagatgaggagaaggaaatcagaagaaatacagaagcgatttctgcagagctcaagtgaagttgagagcccagctgtgccatcttcatcaagacagccccctgctcagcctccacggacaggatccgagttccccaggctggagggagccccggccacaatgacgcccaagctggggcgaggtgtcttggaaggagatgatgttctcttttatgatgagtcaccaccaccaagaccaaaactgagtgctttagcagaagccaaaaagttagctgctatcaccaaattaagggcaaaaggccaggttcttacaaaaacaaacccaaacagcattaagaagaaacaaaaggaccctcaggacatcctggaggtgaaggaacgtgtagaaaaaaacaccatgttttcttctcaagctgaggatgaattggagcctgccaggaaaaaaaggagagaacaacttgcctatctggaatctgaggaatttcagaaaatcctaaaagcaaaatcaaaacacacaggcatcctgaaagaggccgaggctgagatgcaggagcgctactttgagccactggtgaaaaaagaacaaatggaagaaaagatgagaaacatcagagaagtgaagtgccgtgtcgtgacatgcaagacgtgcgcctatacccacttcaagctgctggagacctgcgtcagtgagcagcatgaataccactggcatgatggtgtgaagaggtttttcaaatgtccctgtggaaacagaagcatctccttggacagactcccgaacaagcactgcagtaactgtggcctctacaaatgggaacgggacggaatgctaaaggaaaagactggtccaaagataggaggagaaactctgttaccaagaggagaagaacatgctaaatttctgaacagccttaaataacccgaacttcagacattttcccacagacttcctggcctcctgtgactctggaaagcaaaggattggctgtgtattgtccattgattcctgattgacgccgtcaaaaacaaatgcttgttaagcccataagctttgcctgcttactttctgccattgggttggtttgataccacatttaacattgacatttaagtggaaaaccaagttatcattgtcttttctaagctcagtgtggatgattgcattacttcattcactgaagtttttgcccaaaaattggaaggtaaacagagagctatgtttctgtatcttttggttatagagtgttcacttctttatcataacaaaattctagtgtttatacgaacacccagaggcaaaagaatttggcttaattctcactccaggtaagtagcttaacttctg

SEQ ID NO: 154111 - DNA, 3442 bp, Homo sapiens
  Payload ID: 10284
  Gene Symbol: MCM8
  Gene Name: minichromosome maintenance 8 homologous recombination repair factor
  Uniprot ID: Q9UJA3
  ENST ID: ENST00000265187
  CDS Start-End: 153-2627
agggagggagaatccggccggacagatctgcgcgtatcctggagccggcccagttgtgaactaggagagctttgggacctctgtcccaagcaagtaagaactttagccttaggagatgtaaataaagtagtatttgaagaagcacaggagagatgaatggagagtatagaggcagaggatttggacgaggaagatttcaaagctggaaaaggggaagaggtggtgggaacttctcaggaaaatggagagaaagagaacacagacctgatctgagtaaaaccacaggaaaacgtacttctgaacaaaccccacagtttttgctttcaacaaagaccccacagtcaatgcagtcaacattggatcgattcataccatataaaggctggaagctttatttctctgaagtttacagcgatagctctcctttgattgagaagattcaagcatttgaaaaatttttcacaaggcatattgatttgtatgacaaggatgaaatagaaagaaagggaagtattttggtagattttaaagaactgacagaaggtggtgaagtaactaacttgataccagatatagcaactgaactaagagatgcacctgagaaaaccttggcttgcatgggtttggcaatacatcaggtgttaactaaggaccttgaaaggcatgcagctgagttacaagcccaggaaggattgtctaatgatggagaaacaatggtaaatgtgccacatattcatgcaagggtgtacaactatgagcctttgacacagctcaagaatgtcagagcaaattactatggaaaatacattgctctaagagggacagtggttcgtgtcagtaatataaagcctctttgcaccaagatggcttttctttgtgctgcatgtggagaaattcagagctttcctcttccagatggaaaatacagtcttcccacaaagtgtcctgtgcctgtgtgtcgaggcaggtcatttactgctctccgcagctctcctctcacagttacgatggactggcagtcaatcaaaatccaggaattgatgtctgatgatcagagagaagcaggtcggattccacgaacaatagaatgtgagcttgttcatgatcttgtggatagctgtgtcccgggagacacagtgactattactggaattgtcaaagtctcaaatgcggaagaagcaaattctattagtaatagcaaaggacagaaaacaaagagttctgaggatgggtgtaagcatggaatgttgatggagttctcacttaaagacctttatgccatccaagagattcaagctgaagaaaacctgtttaaactcattgtcaactcgctttgccctgtcatttttggtcatgaacttgttaaagcaggtttggcattagcactctttggaggaagccagaaatacgcagatgacaaaaacagaattccaattcggggagacccccacatccttgttgttggagatccaggcctaggaaaaagtcaaatgctacaggcagcgtgcaatgttgccccacgtggcgtgtatgtttgtggtaacaccacgaccacctctggtctgacggtaactctttcaaaagatagttcctctggagattttgctttggaagctggtgccctggtacttggtgatcaaggtatttgtggaatcgatgaatttgataagatggggaatcaacatcaagccttgttggaagccatggagcagcaaagtattagtcttgctaaggctggtgtggtttgtagccttcctgcaagaacttccattattgctgctgcaaatccagttggaggacattacaataaagccaaaacagtttctgagaatttaaaaatggggagtgcactactatccagatttgatttggtctttatcctgttagatactccaaatgagcatcatgatcacttactctctgaacatgtgattgcaataagagctggaaagcagagaaccattagcagtgccacagtagctcgtatgaatagtcaagattcaaatacttccgtacttgaagtagtttctgagaagccattatcagaaagactaaaggtggttcctggagaaacaatagatcccattccccaccagctattgagaaagtacattggctatgctcggcagtatgtgtacccaaggctatccacagaagctgctcgagttcttcaagatttttaccttgagctccggaaacagagccagaggttaaatagctcaccaatcactaccaggcagctggaatctttgattcgtctgacagaggcacgagcaaggttggaattgagagaggaagcaaccaaagaagacgctgaggatatagtggaaattatgaaatatagcatgctaggaacttactctgatgaatttgggaacctagattttgagcgatcccagcatggttctggaatgagcaacaggtcaacagcgaaaagatttatttctgctctcaacaacgttgctgaaagaacttataataatatatttcaatttcatcaacttcggcagattgccaaagaactaaacattcaggttgctgattttgaaaattttattggatcactaaatgaccagggttacctcttgaaaaaaggcccaaaagtttaccagcttcaaactatgtaaaaggacttcaccaagttagggcctcctgggtttattgcagattaaagccatctcagtgaagatatgcgtgcacgcacagacagacagacacacacacacacacacacacacacacacacacacacacacacagtcaaatactgttctctgaaaaatgatgtcccaaaagtattataataggaaaaaagcattaaatataataaactaatttaagaagtgataaagtctccagatgcagtagctcacactgtaatcacagtgactcaggaggctgaggtgagaggattccttgaggccagggttcgagaccaaccttgggcaacatagcaagaccccatttcttaaaaaaaaaaaaaaaaaatttaaacttagctgggtatggtggcacatgcctatagtctcagctacttgtgaggctgaggcaggaggattctttgagcccaggagtttgaggttacagtgagccacaatcacaccaatcactgcactccagcctgggcaataaagtaactcttgactcaaaaaaataaaaaaaattgtagtggtagccatgtgttaattgttaaataaattctccaaagggctaaaagtaaattacttataaattttttatagttgtatttttgacctgccttttatatgtatgaatatttcatagttttgcatatcagatgtaggcatacagacaaatacataaaccaatgaatatattacatattctgtgttccaataaaactttatttatggacactaaaatttgaatttcataaaattttcccatgtcaagaatacaaaatacttgagttttgttttta

SEQ ID NO: 154112 - DNA, 3574 bp, Homo sapiens
  Payload ID: 10284
  Gene Symbol: MCM8
  Gene Name: minichromosome maintenance 8 homologous recombination repair factor
  Uniprot ID: Q9UJA3
  ENST ID: ENST00000378883
  CDS Start-End: 378-2759
ctttgagcggaagttggatcactgaagcgccaaaaaagaatttaggggaagacctgattttcgcttgaggcatttttgcggcgctgtgcgctacagacaccttctggaagctgcggtggggaaactgagtttcccgagccgttgagacagatggggttcagcaccgcgcggggacgacaggaaagctgcggctgaagagaactgcggacttggcaggagtcgcctgaggagctaagatcccggagactcttagccccgtggtgcttctctacgggagggagggagggagaatccggccggacagatctgcgcgtatcctggagccggcccagttgtgaactaggagagctttgggacctctgtcccaagcaagagagatgaatggagagtatagaggcagaggatttggacgaggaagatttcaaagctggaaaaggggaagaggtggtgggaacttctcaggaaaatggagagaaagagaacacagacctgatctgagtaaaaccacaggaaaacgtacttctgaacaaaccccacagtttttgctttcaacaaagaccccacagtcaatgcagtcaacattggatcgattcataccatataaaggctggaagctttatttctctgaagtttacagcgatagctctcctttgattgagaagattcaagcatttgaaaaatttttcacaaggcatattgatttgtatgacaaggatgaaatagaaagaaagggaagtattttggtagattttaaagaactgacagaaggtggtgaagtaactaacttgataccagatatagcaactgaactaagagatgcacctgagaaaaccttggcttgcatgggtttggcaatacatcaggtgttaactaaggaccttgaaaggcatgcagctgagttacaagcccaggaaggattgtctaatgatggagaaacaatggtaaatgtgccacatattcatgcaagggtgtacaactatgagcctttgacacagctcaagaatgtcagagcaaattactatggaaaatacattgctctaagagggacagtggttcgtgtcagtaatataaagcctctttgcaccaagatggcttttctttgtgctgcatgtggagaaattcagagctttcctcttccagatggaaaatacagtcttcccacaaagtgtcctgtgcctgtgtgtcgaggcaggtcatttactgctctccgcagctctcctctcacagttacgatggactggcagtcaatcaaaatccaggaattgatgtctgatgatcagagagaagcaggtcggattccacgaacaatagaatgtgagcttgttcatgatcttgtggatagctgtgtcccgggagacacagtgactattactggaattgtcaaagtctcaaatgcggaagaaggttctcgaaataagaatgacaagtgtatgttccttttgtatattgaagcaaattctattagtaatagcaaaggacagaaaacaaagagttctgaggatgggtgtaagcatggaatgttgatggagttctcacttaaagacctttatgccatccaagagattcaagctgaagaaaacctgtttaaactcattgtcaactcgctttgccctgtcatttttggtcatgaagcagcgtgcaatgttgccccacgtggcgtgtatgtttgtggtaacaccacgaccacctctggtctgacggtaactctttcaaaagatagttcctctggagattttgctttggaagctggtgccctggtacttggtgatcaaggtatttgtggaatcgatgaatttgataagatggggaatcaacatcaagccttgttggaagccatggagcagcaaagtattagtcttgctaaggctggtgtggtttgtagccttcctgcaagaacttccattattgctgctgcaaatccagttggaggacattacaataaagccaaaacagtttctgagaatttaaaaatggggagtgcactactatccagatttgatttggtctttatcctgttagatactccaaatgagcatcatgatcacttactctctgaacatgtgattgcaataagagctggaaagcagagaaccattagcagtgccacagtagctcgtatgaatagtcaagattcaaatacttccgtacttgaagtagtttctgagaagccattatcagaaagactaaaggtggttcctggagaaacaatagatcccattccccaccagctattgagaaagtacattggctatgctcggcagtatgtgtacccaaggctatccacagaagctgctcgagttcttcaagatttttaccttgagctccggaaacagagccagaggttaaatagctcaccaatcactaccaggcagctggaatctttgattcgtctgacagaggcacgagcaaggttggaattgagagaggaagcaaccaaagaagacgctgaggatatagtggaaattatgaaatatagcatgctaggaacttactctgatgaatttgggaacctagattttgagcgatcccagcatggttctggaatgagcaacaggtcaacagcgaaaagatttatttctgctctcaacaacgttgctgaaagaacttataataatatatttcaatttcatcaacttcggcagattgccaaagaactaaacattcaggttgctgattttgaaaattttattggatcactaaatgaccagggttacctcttgaaaaaaggcccaaaagtttaccagcttcaaactatgtaaaaggacttcaccaagttagggcctcctgggtttattgcagattaaagccatctcagtgaagatatgcgtgcacgcacagacagacagacacacacacacacacacacacacacacacacacacacacacacagtcaaatactgttctctgaaaaatgatgtcccaaaagtattataataggaaaaaagcattaaatataataaactaatttaagaagtgataaagtctccagatgcagtagctcacactgtaatcacagtgactcaggaggctgaggtgagaggattccttgaggccagggttcgagaccaaccttgggcaacatagcaagaccccatttcttaaaaaaaaaaaaaaaaaatttaaacttagctgggtatggtggcacatgcctatagtctcagctacttgtgaggctgaggcaggaggattctttgagcccaggagtttgaggttacagtgagccacaatcacaccaatcactgcactccagcctgggcaataaagtaactcttgactcaaaaaaataaaaaaaattgtagtggtagccatgtgttaattgttaaataaattctccaaagggctaaaagtaaattacttataaattttttatagttgtatttttgacctgccttttatatgtatgaatatttcatagttttgcatatcagatgtaggcatacagacaaatacataaaccaatgaatatattacatattctgtgttccaataaaactttatttatggacactaaaatttgaatttcataaaattttcccatgtcaagaatacaaaatacttgagttttgttttta

SEQ ID NO: 154113 - DNA, 3835 bp, Homo sapiens
  Payload ID: 10284
  Gene Symbol: MCM8
  Gene Name: minichromosome maintenance 8 homologous recombination repair factor
  Uniprot ID: Q9UJA3
  ENST ID: ENST00000378886
  CDS Start-End: 378-3020
ctttgagcggaagttggatcactgaagcgccaaaaaagaatttaggggaagacctgattttcgcttgaggcatttttgcggcgctgtgcgctacagacaccttctggaagctgcggtggggaaactgagtttcccgagccgttgagacagatggggttcagcaccgcgcggggacgacaggaaagctgcggctgaagagaactgcggacttggcaggagtcgcctgaggagctaagatcccggagactcttagccccgtggtgcttctctacgggagggagggagggagaatccggccggacagatctgcgcgtatcctggagccggcccagttgtgaactaggagagctttgggacctctgtcccaagcaagagagatgaatggagagtatagaggcagaggatttggacgaggaagatttcaaagctggaaaaggggaagaggtggtgggaacttctcaggaaaatggagagaaagagaacacagacctgatctgagtaaaaccacaggaaaacgtacttctgaacaaaccccacagtttttgctttcaacaaagaccccacagtcaatgcagtcaacattggatcgattcataccatataaaggctggaagctttatttctctgaagtttacagcgatagctctcctttgattgagaagattcaagcatttgaaaaatttttcacaaggcatattgatttgtatgacaaggatgaaatagaaagaaagggaagtattttggtagattttaaagaactgacagaaggtggtgaagtaactaacttgataccagatatagcaactgaactaagagatgcacctgagaaaaccttggcttgcatgggtttggcaatacatcaggtgttaactaaggaccttgaaaggcatgcagctgagttacaagcccaggaaggattgtctaatgatggagaaacaatggtaaatgtgccacatattcatgcaagggtgtacaactatgagcctttgacacagctcaagaatgtcagagcaaattactatggaaaatacattgctctaagagggacagtggttcgtgtcagtaatataaagcctctttgcaccaagatggcttttctttgtgctgcatgtggagaaattcagagctttcctcttccagatggaaaatacagtcttcccacaaagtgtcctgtgcctgtgtgtcgaggcaggtcatttactgctctccgcagctctcctctcacagttacgatggactggcagtcaatcaaaatccaggaattgatgtctgatgatcagagagaagcaggtcggattccacgaacaatagaatgtgagcttgttcatgatcttgtggatagctgtgtcccgggagacacagtgactattactggaattgtcaaagtctcaaatgcggaagaaggttctcgaaataagaatgacaagtgtatgttccttttgtatattgaagcaaattctattagtaatagcaaaggacagaaaacaaagagttctgaggatgggtgtaagcatggaatgttgatggagttctcacttaaagacctttatgccatccaagagattcaagctgaagaaaacctgtttaaactcattgtcaaatggagtcttgctctgtcgcccaggctagagtacagtggtgcgatctcagctcactgcaacctccacctcccaagttcaaacagttctcccacctcagcctgccgagtagctgggactacaggcatgcgccaccagacccagctacttttgcttgttaaagcaggtttggcattagcactctttggaggaagccagaaatacgcagatgacaaaaacagaattccaattcggggagacccccacatccttgttgttggagatccaggcctaggaaaaagtcaaatgctacaggcagcgtgcaatgttgccccacgtggcgtgtatgtttgtggtaacaccacgaccacctctggtctgacggtaactctttcaaaagatagttcctctggagattttgctttggaagctggtgccctggtacttggtgatcaaggtatttgtggaatcgatgaatttgataagatggggaatcaacatcaagccttgttggaagccatggagcagcaaagtattagtcttgctaaggctggtgtggtttgtagccttcctgcaagaacttccattattgctgctgcaaatccagttggaggacattacaataaagccaaaacagtttctgagaatttaaaaatggggagtgcactactatccagatttgatttggtctttatcctgttagatactccaaatgagcatcatgatcacttactctctgaacatgtgattgcaataagagctggaaagcagagaaccattagcagtgccacagtagctcgtatgaatagtcaagattcaaatacttccgtacttgaagtagtttctgagaagccattatcagaaagactaaaggtggttcctggagaaacaatagatcccattccccaccagctattgagaaagtacattggctatgctcggcagtatgtgtacccaaggctatccacagaagctgctcgagttcttcaagatttttaccttgagctccggaaacagagccagaggttaaatagctcaccaatcactaccaggcagctggaatctttgattcgtctgacagaggcacgagcaaggttggaattgagagaggaagcaaccaaagaagacgctgaggatatagtggaaattatgaaatatagcatgctaggaacttactctgatgaatttgggaacctagattttgagcgatcccagcatggttctggaatgagcaacaggtcaacagcgaaaagatttatttctgctctcaacaacgttgctgaaagaacttataataatatatttcaatttcatcaacttcggcagattgccaaagaactaaacattcaggttgctgattttgaaaattttattggatcactaaatgaccagggttacctcttgaaaaaaggcccaaaagtttaccagcttcaaactatgtaaaaggacttcaccaagttagggcctcctgggtttattgcagattaaagccatctcagtgaagatatgcgtgcacgcacagacagacagacacacacacacacacacacacacacacacacacacacacacacagtcaaatactgttctctgaaaaatgatgtcccaaaagtattataataggaaaaaagcattaaatataataaactaatttaagaagtgataaagtctccagatgcagtagctcacactgtaatcacagtgactcaggaggctgaggtgagaggattccttgaggccagggttcgagaccaaccttgggcaacatagcaagaccccatttcttaaaaaaaaaaaaaaaaaatttaaacttagctgggtatggtggcacatgcctatagtctcagctacttgtgaggctgaggcaggaggattctttgagcccaggagtttgaggttacagtgagccacaatcacaccaatcactgcactccagcctgggcaataaagtaactcttgactcaaaaaaataaaaaaaattgtagtggtagccatgtgttaattgttaaataaattctccaaagggctaaaagtaaattacttataaattttttatagttgtatttttgacctgccttttatatgtatgaatatttcatagttttgcatatcagatgtaggcatacagacaaatacataaaccaatgaatatattacatattctgtgttccaataaaactttatttatggacactaaaatttgaatttcataaaattttcccatgtcaagaatacaaaatacttgagttttgttttta

SEQ ID NO: 154114 - DNA, 3769 bp, Homo sapiens
  Payload ID: 10284
  Gene Symbol: MCM8
  Gene Name: minichromosome maintenance 8 homologous recombination repair factor
  Uniprot ID: Q9UJA3
  ENST ID: ENST00000378896
  CDS Start-End: 432-2954
ctttgagcggaagttggatcactgaagcgccaaaaaagaatttaggggaagacctgattttcgcttgaggcatttttgcggcgctgtgcgctacagacaccttctggaagctgcggtggggaaactgagtttcccgagccgttgagacagatggggttcagcaccgcgcggggacgacaggaaagctgcggctgaagagaactgcggacttggcaggagtcgcctgaggagctaagatcccggagactcttagccccgtggtgcttctctacgggagggagggagggagaatccggccggacagatctgcgcgtatcctggagccggcccagttgtgaactaggagagctttgggacctctgtcccaagcaagtaagaactttagccttaggagatgtaaataaagtagtatttgaagaagcacaggagagatgaatggagagtatagaggcagaggatttggacgaggaagatttcaaagctggaaaaggggaagaggtggtgggaacttctcaggaaaatggagagaaagagaacacagacctgatctgagtaaaaccacaggaaaacgtacttctgaacaaaccccacagtttttgctttcaacaaagaccccacagtcaatgcagtcaacattggatcgattcataccatataaaggctggaagctttatttctctgaagtttacagcgatagctctcctttgattgagaagattcaagcatttgaaaaatttttcacaaggcatattgatttgtatgacaaggatgaaatagaaagaaagggaagtattttggtagattttaaagaactgacagaaggtggtgaagtaactaacttgataccagatatagcaactgaactaagagatgcacctgagaaaaccttggcttgcatgggtttggcaatacatcaggtgttaactaaggaccttgaaaggcatgcagctgagttacaagcccaggaaggattgtctaatgatggagaaacaatggtaaatgtgccacatattcatgcaagggtgtacaactatgagcctttgacacagctcaagaatgtcagagcaaattactatggaaaatacattgctctaagagggacagtggttcgtgtcagtaatataaagcctctttgcaccaagatggcttttctttgtgctgcatgtggagaaattcagagctttcctcttccagatggaaaatacagtcttcccacaaagtgtcctgtgcctgtgtgtcgaggcaggtcatttactgctctccgcagctctcctctcacagttacgatggactggcagtcaatcaaaatccaggaattgatgtctgatgatcagagagaagcaggtcggattccacgaacaatagaatgtgagcttgttcatgatcttgtggatagctgtgtcccgggagacacagtgactattactggaattgtcaaagtctcaaatgcggaagaaggttctcgaaataagaatgacaagtgtatgttccttttgtatattgaagcaaattctattagtaatagcaaaggacagaaaacaaagagttctgaggatgggtgtaagcatggaatgttgatggagttctcacttaaagacctttatgccatccaagagattcaagctgaagaaaacctgtttaaactcattgtcaactcgctttgccctgtcatttttggtcatgaacttgttaaagcaggtttggcattagcactctttggaggaagccagaaatacgcagatgacaaaaacagaattccaattcggggagacccccacatccttgttgttggagatccaggcctaggaaaaagtcaaatgctacaggcagcgtgcaatgttgccccacgtggcgtgtatgtttgtggtaacaccacgaccacctctggtctgacggtaactctttcaaaagatagttcctctggagattttgctttggaagctggtgccctggtacttggtgatcaaggtatttgtggaatcgatgaatttgataagatggggaatcaacatcaagccttgttggaagccatggagcagcaaagtattagtcttgctaaggctggtgtggtttgtagccttcctgcaagaacttccattattgctgctgcaaatccagttggaggacattacaataaagccaaaacagtttctgagaatttaaaaatggggagtgcactactatccagatttgatttggtctttatcctgttagatactccaaatgagcatcatgatcacttactctctgaacatgtgattgcaataagagctggaaagcagagaaccattagcagtgccacagtagctcgtatgaatagtcaagattcaaatacttccgtacttgaagtagtttctgagaagccattatcagaaagactaaaggtggttcctggagaaacaatagatcccattccccaccagctattgagaaagtacattggctatgctcggcagtatgtgtacccaaggctatccacagaagctgctcgagttcttcaagatttttaccttgagctccggaaacagagccagaggttaaatagctcaccaatcactaccaggcagctggaatctttgattcgtctgacagaggcacgagcaaggttggaattgagagaggaagcaaccaaagaagacgctgaggatatagtggaaattatgaaatatagcatgctaggaacttactctgatgaatttgggaacctagattttgagcgatcccagcatggttctggaatgagcaacaggtcaacagcgaaaagatttatttctgctctcaacaacgttgctgaaagaacttataataatatatttcaatttcatcaacttcggcagattgccaaagaactaaacattcaggttgctgattttgaaaattttattggatcactaaatgaccagggttacctcttgaaaaaaggcccaaaagtttaccagcttcaaactatgtaaaaggacttcaccaagttagggcctcctgggtttattgcagattaaagccatctcagtgaagatatgcgtgcacgcacagacagacagacacacacacacacacacacacacacacacacacacacacacacagtcaaatactgttctctgaaaaatgatgtcccaaaagtattataataggaaaaaagcattaaatataataaactaatttaagaagtgataaagtctccagatgcagtagctcacactgtaatcacagtgactcaggaggctgaggtgagaggattccttgaggccagggttcgagaccaaccttgggcaacatagcaagaccccatttcttaaaaaaaaaaaaaaaaaatttaaacttagctgggtatggtggcacatgcctatagtctcagctacttgtgaggctgaggcaggaggattctttgagcccaggagtttgaggttacagtgagccacaatcacaccaatcactgcactccagcctgggcaataaagtaactcttgactcaaaaaaataaaaaaaattgtagtggtagccatgtgttaattgttaaataaattctccaaagggctaaaagtaaattacttataaattttttatagttgtatttttgacctgccttttatatgtatgaatatttcatagttttgcatatcagatgtaggcatacagacaaatacataaaccaatgaatatattacatattctgtgttccaataaaactttatttatggacactaaaatttgaatttcataaaattttcccatgtcaagaatacaaaatacttgagttttgttttta

SEQ ID NO: 154115 - DNA, 7486 bp, Homo sapiens
  Payload ID: 10284
  Gene Symbol: MCM8
  Gene Name: minichromosome maintenance 8 homologous recombination repair factor
  Uniprot ID: Q9UJA3
  ENST ID: ENST00000610722
  CDS Start-End: 378-2900
ctttgagcggaagttggatcactgaagcgccaaaaaagaatttaggggaagacctgattttcgcttgaggcatttttgcggcgctgtgcgctacagacaccttctggaagctgcggtggggaaactgagtttcccgagccgttgagacagatggggttcagcaccgcgcggggacgacaggaaagctgcggctgaagagaactgcggacttggcaggagtcgcctgaggagctaagatcccggagactcttagccccgtggtgcttctctacgggagggagggagggagaatccggccggacagatctgcgcgtatcctggagccggcccagttgtgaactaggagagctttgggacctctgtcccaagcaagagagatgaatggagagtatagaggcagaggatttggacgaggaagatttcaaagctggaaaaggggaagaggtggtgggaacttctcaggaaaatggagagaaagagaacacagacctgatctgagtaaaaccacaggaaaacgtacttctgaacaaaccccacagtttttgctttcaacaaagaccccacagtcaatgcagtcaacattggatcgattcataccatataaaggctggaagctttatttctctgaagtttacagcgatagctctcctttgattgagaagattcaagcatttgaaaaatttttcacaaggcatattgatttgtatgacaaggatgaaatagaaagaaagggaagtattttggtagattttaaagaactgacagaaggtggtgaagtaactaacttgataccagatatagcaactgaactaagagatgcacctgagaaaaccttggcttgcatgggtttggcaatacatcaggtgttaactaaggaccttgaaaggcatgcagctgagttacaagcccaggaaggattgtctaatgatggagaaacaatggtaaatgtgccacatattcatgcaagggtgtacaactatgagcctttgacacagctcaagaatgtcagagcaaattactatggaaaatacattgctctaagagggacagtggttcgtgtcagtaatataaagcctctttgcaccaagatggcttttctttgtgctgcatgtggagaaattcagagctttcctcttccagatggaaaatacagtcttcccacaaagtgtcctgtgcctgtgtgtcgaggcaggtcatttactgctctccgcagctctcctctcacagttacgatggactggcagtcaatcaaaatccaggaattgatgtctgatgatcagagagaagcaggtcggattccacgaacaatagaatgtgagcttgttcatgatcttgtggatagctgtgtcccgggagacacagtgactattactggaattgtcaaagtctcaaatgcggaagaaggttctcgaaataagaatgacaagtgtatgttccttttgtatattgaagcaaattctattagtaatagcaaaggacagaaaacaaagagttctgaggatgggtgtaagcatggaatgttgatggagttctcacttaaagacctttatgccatccaagagattcaagctgaagaaaacctgtttaaactcattgtcaactcgctttgccctgtcatttttggtcatgaacttgttaaagcaggtttggcattagcactctttggaggaagccagaaatacgcagatgacaaaaacagaattccaattcggggagacccccacatccttgttgttggagatccaggcctaggaaaaagtcaaatgctacaggcagcgtgcaatgttgccccacgtggcgtgtatgtttgtggtaacaccacgaccacctctggtctgacggtaactctttcaaaagatagttcctctggagattttgctttggaagctggtgccctggtacttggtgatcaaggtatttgtggaatcgatgaatttgataagatggggaatcaacatcaagccttgttggaagccatggagcagcaaagtattagtcttgctaaggctggtgtggtttgtagccttcctgcaagaacttccattattgctgctgcaaatccagttggaggacattacaataaagccaaaacagtttctgagaatttaaaaatggggagtgcactactatccagatttgatttggtctttatcctgttagatactccaaatgagcatcatgatcacttactctctgaacatgtgattgcaataagagctggaaagcagagaaccattagcagtgccacagtagctcgtatgaatagtcaagattcaaatacttccgtacttgaagtagtttctgagaagccattatcagaaagactaaaggtggttcctggagaaacaatagatcccattccccaccagctattgagaaagtacattggctatgctcggcagtatgtgtacccaaggctatccacagaagctgctcgagttcttcaagatttttaccttgagctccggaaacagagccagaggttaaatagctcaccaatcactaccaggcagctggaatctttgattcgtctgacagaggcacgagcaaggttggaattgagagaggaagcaaccaaagaagacgctgaggatatagtggaaattatgaaatatagcatgctaggaacttactctgatgaatttgggaacctagattttgagcgatcccagcatggttctggaatgagcaacaggtcaacagcgaaaagatttatttctgctctcaacaacgttgctgaaagaacttataataatatatttcaatttcatcaacttcggcagattgccaaagaactaaacattcaggttgctgattttgaaaattttattggatcactaaatgaccagggttacctcttgaaaaaaggcccaaaagtttaccagcttcaaactatgtaaaaggacttcaccaagttagggcctcctgggtttattgcagattaaagccatctcagtgaagatatgcgtgcacgcacagacagacagacacacacacacacacacacacacacacacacacacacacacacagtcaaatactgttctctgaaaaatgatgtcccaaaagtattataataggaaaaaagcattaaatataataaactaatttaagaagtgataaagtctccagatgcagtagctcacactgtaatcacagtgactcaggaggctgaggtgagaggattccttgaggccagggttcgagaccaaccttgggcaacatagcaagaccccatttcttaaaaaaaaaaaaaaaaaatttaaacttagctgggtatggtggcacatgcctatagtctcagctacttgtgaggctgaggcaggaggattctttgagcccaggagtttgaggttacagtgagccacaatcacaccaatcactgcactccagcctgggcaataaagtaactcttgactcaaaaaaataaaaaaaattgtagtggtagccatgtgttaattgttaaataaattctccaaagggctaaaagtaaattacttataaattttttatagttgtatttttgacctgccttttatatgtatgaatatttcatagttttgcatatcagatgtaggcatacagacaaatacataaaccaatgaatatattacatattctgtgttccaataaaactttatttatggacactaaaatttgaatttcataaaattttcccatgtcaagaatacaaaatacttgagttttgtttttagctatttaataataggtctcatttattccacaggctgtagtttgtagtcttgcttgaaacaatagaaacagactgattaagcaggagaagttttttgaaagaattttgtttggctcacggaattattagaaggcaggtgaaccaggagggtaagcttccagcagcaatttgtaaaaccatgccttagaattggactaaggaagaagctgctgacactccactgccacacagggcactggaagaaagtgctgctgcctccctgccccacctttgccacttctgcagcaggaataggtagaagaatgcccccacccgcaccggaacagcaacaaaaggattctgcatgagatgcctccctaaattgctgaattcaaaaaagaagttgcatacaaagacatctgattgaaaaagggtatgttatatgcccctttcataggctgctagggagttttcctggttctactttcaggtggtgggatcaataagaccagaatttctcatatgttgtgagaggattcaaatgttacagggttgccagccaaactatcaatcatgtataaatccaacaaacactttgtaacatacaagaactcaggaaatgtgaaccattgttggagaatctactaaaatacggcttcccgcaaacgaagatgaatggaaaatgtaaataaaaagaactggcagtgtatatcagatgtttaactataggaccagaactaagatgtggagactattgccatagaccacaatgtaaatttttaagtgaggaaggaaaaatcaggaatcaaaaggggccaggtgcagtggctcacatctataatcccagagctttgggagttcgaggcaggaggatcacttgaagccagttttgagaccagcctatgcaacacattgagaccctatctctacaaaaaatagattagctgggcacggtggtgcatgcctattgtcctacctactgtggaggctgaagtaggaaatcacttgagcccgagagtttgaggttacagtgagctatgattataccactgcactccagcctgggcaagagagcaagaccttgtctcttaaagaaaaaaaaaaaaaatggagaaagtagatagtagtataaatatagtgaagtctttaaaagctaggagttaaaagatatttaaagcaaataactcaggcatggtggtgtgtgcctgtagtcccagccactaaggaggctgaggcaggagaatcacttgaacccgggaggcagaggttgcagtgagccaagatcgtaccactgcactccagcctgggcaacagagtgagactctttctccaaactaaataagagatatttaaagctgaaaaaaaatctattaatagaatttaaaacatttcacaaaagtcaacacataaataatatcaaccaaaataaagtggtagacagaagagaaaatatactaatttattgttcaaagaggaaaataagtctcaaaggttaaggctattatataaatttatttttaaaaagacataaacctacattttcagaagaagaagttccatgtttccttagattatgtatttagcatccattaatcacagggccaaactaacaacaaaagttgtttagctttcccttacaatccagcttttatgggtgtgcaaacatcacattacagtccctccaaccacaaaccccaacatatagtatttcacttcctgcccaatagtgggtgtccccacacctttcaaccactgtagcaacaaagctctggcctaggcttttcacttgcttctttactgcctgactgactttggtgtttcctcatgtggcctggtgtggcatggcacgccctcttgggagatgaaagtaatcttccataggcaattgtttctgtgtcaccattgctgattaaaacaaatcctaagtacaaatgtcagaacagaaacatgcaaagcaagaaaacattacatcatgaaagtttctttttttttcttttttcttttttttttttttttgagacagagttttgctctttttgctcaggctggagtacagtggcgcgatcttggttcaccgcaacctccgcctcctgggttcaagcgtttctcctgcctcagcctcccaagtagctgggattataggcatgtgccaccatggctaattttgtatttttagtagagacggggtttctccatgttggtgaggctggtttttaactcccgaactcaggtgattgcctgcctcggtctcccaaaaagtgccgggattacaggcgtgagccattgtgcccagccaaaagtttctttttcaagagatggtggtcttgccatgttgtccagtatggacttgaactactcagctcaagcagtcctcccacctcagcctcctgaatagctgagactacaggcatgcaccactacacctggctgcgagatgaaattttaagagatgggggtcttgttctgtcgcccaggctggagtgcagtgacatgatcaagccgtgatctcctgggctcaagcaatcctcctacctcagcctcctgagtagctggaactacaggaatgcaacaccatgcccagctaattttgatttttagtagagatgaggtcttcctttgttgcccaagctggtctcaaactccagggcttcctgagtagctgagactacaggtgtgagccaccatgcccagcctcctctcttttccaatattgtgttaagtaaattgtattggtggtaatcaacttgatcatttcatttttaggatagagatatcaaggtgagggtataactgaacgagaagaggaataaacaccaccctgtgattgatggatctttatagctctcctttgataaagaagggaaatatcgtacttacattagcatgttatagttgctgttgttatacagaagaatattaaacaatattcatatattgtttatgaatgcattgaattcataaacaatggtatggatattgactagccaaagaggtggataaatgtagatacaatgatacggtgatttggtattcagtgtccattctgctctcctagtgtgccttcctataatgcaggggctggaaggtgagaaaataaccacatttcccagactccctttgcaggtagatttccagatgtgaattgggttccactgatcagacacccatgtgtgagatttggaatgcagaactgaggagagagccatcttcctcttgcttgtgttctggtggcatgtgtggttgaggagacatttaatttccctgcagcagaattcttgcagtcagttgttgaggcaagtggcgtggtggatgcaaccctgattcttcacctttctcattattgtggggtagcagcgcctctggcaagccagacagacctgcagtgtttttctgggagttaattctggagacccagtatggaacccactcctagcccttgtgacaatattgcaagcatccagttccctgttttacagtccttttaaatgtggctagctacagtagtttgtgtttcctgcaactaatcactcatacatctgtatctaaagcactccacctgggtcatgtactatacttaaaattataaggcaatattaattcacaaaactacctactcgttttatttaaccctcagaagaactgaaaacaaaagctataccaggcttgctctagagcgtgggcttgggaatggaaaggcagagtgcacctattgaattccatcatcagtttttctataccatggagttacttaccatgtgtatacataacactgattaaaaattttaaaaaaaa

SEQ ID NO: 154116 - DNA, 2442 bp, Homo sapiens
  Payload ID: 10285
  Gene Symbol: MCM9
  Gene Name: minichromosome maintenance 9 homologous recombination repair factor
  Uniprot ID: Q9NXL9
  ENST ID: ENST00000316068
  CDS Start-End: 240-1415
ccggcgtcggtcgagagcgcaggcccggcagagccgcaggcgctaggccgcccgacacagcccgcgcgtccccgcggccggtggcgcctcgagcggccacgtgcacgcgcgcactccgcctcaccagccttcttgcgccggagacgaacccgctgcctggctggagctctctgggcccttcggcctcgggagcaacgcgttcccggcgacttctgacacagccattacctagattcaagatgaatagcgatcaagttacactggttggtcaagtgtttgagtcatatgtttcggaataccataagaatgatattcttctaatcttgaaggaaagggatgaagatgctcattacccagttgtggttaatgccatgactctgtttgagaccaacatggaaatcggggaatatttcaacatgttccccagtgaagtgcttacaatttttgatagtgcactgcgaaggtcagccttgacaattctccagtccctttctcagcctgaggctgtttccatgaaacagaatcttcatgccaggatatcaggtttgcctgtctgtcctgagctggtgagggaacacatacctaaaaccaaggatgtgggacactttttatctgtcactgggacagtgattcgaacaagtctggtgaaggttctggagtttgagcgggattacatgtgtaacaaatgcaagcatgtgtttgtgatcaaggctgactttgagcagtattacaccttttgccggccatcctcgtgtcccagcttggagagctgtgattcctctaaattcacttgcctctcaggcttgtcttcgtctccaaccaggtgtagagattaccaggaaatcaaaattcaggaacaggttcaaaggctatctgttggaagtattccacgatctatgaaggttattctggaagatgacttagtggatagttgcaaatctggtgatgacctcactatttacgggattgtaatgcaacggtggaagccctttcagcaagatgtgcgctgtgaagtggagatagtcctgaaagcaaattacatccaagtaaataatgagcagtcctcagggatcatcatggatgaggaggtccaaaaggaattcgaagatttttgggaatactataagagcgatccctttgcaggaaggaatgtaatattggctagcttgtgccctcaagtgtttggaatgtatctagtaaagcttgctgtggccatggtgctggctggtgggattcaaaggactgatgctacaggaacacgggtcagaggagaatctcatcttttattggttggggatcctggcacagggaaatctcagttcctcaaatatgcagcaaagattacaccaagatctgtgctgaccacaggaattggatctactagtgcaggtattgtatgtgacaatttcaagtaatttaacattacttcagaagttaacacaatggttttttctaatgaaaaactacctataataggataaatttcaagctaatttttgagttaccactaaaaatggaaggaaatatgcaatgttattttggtagctctaagaaaatatcttgcaagctccaccttcactttgcatcttagttttgaacaatcctattcaattttctcattctctagtgattaccttcatacttttatgcaggaaaaagtccgtatcatctggcattttatcaagactcagcaactggaatgttaaactaaagagggggatatttcactttaccaagtagatagatggtatagagcttaaggcattttcatgctcataaatctgataggcaacagtagctcctactgaaatttcttaggtagggaatgtttattaatatttggaaaatatacttccatcattgcaatgtggagcttcattcataagttgtaatgattctttagcaagtacacttaaaagcctttgcaggtagaatgtcaagatttgattataaataaagtgacccagggaatttagaaaaaaattattttaaaaaatatgtttgatgctattttgtatttttacagttttgattgggtaatgtttctgttcttctgaaaacagacccttggcttcacacattttaaaaatgtttgctacttgttaagggagtcagattaacttccattgggctaatgaatgctcaaatttctaatgagaaactaacactttaaaatttatcatacaacagaaaatggccaattaatggtcctgtataagtggaaaactgttaaggaggtctcaggttttgaaatataactcaacagtatattaaccattgacaagaatggatttttggaattgagaagggtagacaaacttcaggatactaggcaagaatatataaagaatatttcccatgcgttttaaatccgtatgacccagtgttctagagttctgtataaaatgataccaacaacaaataaagatgcttcccaagtaa

SEQ ID NO: 154117 - DNA, 5101 bp, Homo sapiens
  Payload ID: 10285
  Gene Symbol: MCM9
  Gene Name: minichromosome maintenance 9 homologous recombination repair factor
  Uniprot ID: Q9NXL9
  ENST ID: ENST00000316316
  CDS Start-End: 288-3719
tccatccggaagagccgccggggcagggaagttgaggcggtgcgcggcccggcgtcggtcgagagcgcaggcccggcagagccgcaggcgctaggccgcccgacacagcccgcgcgtccccgcggccggtggcgcctcgagcggccacgtgcacgcgcgcactccgcctcaccagccttcttgcgccggagacgaacccgctgcctggctggagctctctgggcccttcggcctcgggagcaacgcgttcccggcgacttctgacacagccattacctagattcaagatgaatagcgatcaagttacactggttggtcaagtgtttgagtcatatgtttcggaataccataagaatgatattcttctaatcttgaaggaaagggatgaagatgctcattacccagttgtggttaatgccatgactctgtttgagaccaacatggaaatcggggaatatttcaacatgttccccagtgaagtgcttacaatttttgatagtgcactgcgaaggtcagccttgacaattctccagtccctttctcagcctgaggctgtttccatgaaacagaatcttcatgccaggatatcaggtttgcctgtctgtcctgagctggtgagggaacacatacctaaaaccaaggatgtgggacactttttatctgtcactgggacagtgattcgaacaagtctggtgaaggttctggagtttgagcgggattacatgtgtaacaaatgcaagcatgtgtttgtgatcaaggctgactttgagcagtattacaccttttgccggccatcctcgtgtcccagcttggagagctgtgattcctctaaattcacttgcctctcaggcttgtcttcgtctccaaccaggtgtagagattaccaggaaatcaaaattcaggaacaggttcaaaggctatctgttggaagtattccacgatctatgaaggttattctggaagatgacttagtggatagttgcaaatctggtgatgacctcactatttacgggattgtaatgcaacggtggaagccctttcagcaagatgtgcgctgtgaagtggagatagtcctgaaagcaaattacatccaagtaaataatgagcagtcctcagggatcatcatggatgaggaggtccaaaaggaattcgaagatttttgggaatactataagagcgatccctttgcaggaaggaatgtaatattggctagcttgtgccctcaagtgtttggaatgtatctagtaaagcttgctgtggccatggtgctggctggtgggattcaaaggactgatgctacaggaacacgggtcagaggagaatctcatcttttattggttggggatcctggcacagggaaatctcagttcctcaaatatgcagcaaagattacaccaagatctgtgctgaccacaggaattggatctactagtgcaggtctgacggtaactgctgtaaaagactcaggagaatggaatttggaggctggggcattagttcttgcagatgcgggcctttgctgtattgatgagttcaatagcctcaaagagcatgataggaccagtatccatgaagcaatggagcaacaaaccataagtgttgctaaggctggcctcgtgtgcaagctgaacacaaggaccaccatcctggcagcaacgaaccccaaaggccagtacgacccccaggagtccgtgtctgtgaacattgccctcggcagcccactcttaagtcgatttgacctgatcctggttttgcttgataccaagaatgaagactgggatcgtatcatttcctcctttatcttagaaaataaaggttacccaagcaaatcagagaagctctggagcatggaaaagatgaaaacctatttctgcctcataaggaatctgcagcccacactgtctgatgtgggcaatcaggttcttctccggtactaccagatgcaaaggcagagtgattgccggaacgctgcccggaccaccattcggctgttggaaagcttgatacgattagcagaagctcatgctcgcctgatgtttcgtgatactgtaactctggaagacgctattacggtggtgtcagtcatggagtcctcaatgcagggaggtgcactgctaggaggtgtgaatgccctccacacttcctttcctgaaaaccctggagagcagtaccagagacagtgtgaacttattctggaaaagctagagctgcagagcctcttgagtgaagagcttagaagacttgaaaggttacagaatcagagtgtgcaccaatcccaaccacgggtattggaggtagagactactccaggatccttgagaaatggtccaggggaagaatcaaacttcagaacttcatcacagcaggaaatcaactatagcacacatatcttctctcctggaggcagccccgagggaagcccagttctagatcccccaccgcatctggagcctaatagatcaacaagtaggaaacattcagctcagcacaaaaataacagagatgacagtttagattggtttgatttcatggcaactcatcagagtgaacctaaaaacactgttgttgtgtctcctcatcccaaaacatctggagaaaatatggcttcgaagatctctaacagcacatctcagggtaaggagaagagtgagccaggccaaaggagcaaagtggacattgggttgcttccatcaccaggagagacaggtgttccatggagggcagacaatgtggaaagtaacaagaaaaaaaggctagcactagattctgaagcagcagtctctgctgataaaccagactcagtactgactcatcatgtccccaggaacctgcagaagctgtgcaaagagagggcccagaagttgtgcagaaatagcaccagggtgcctgcacagtgcacagtcccttcccatcctcagtccactcctgtacatagcccagacagaatgctggactcacccaaaagaaagagaccgaaatcccttgcgcaagtggaagagcctgcaattgaaaatgttaagcctccaggttcccctgtggccaaactggcaaaatttactttcaagcagaagtcaaaactgatccactcctttgaagatcacagccatgtgtcacctggtgcaactaaaatagcagttcatagtcctaaaatttcccagcgtagaacaagaagagacgcagccttgccggtgaagcgtccaggaaagttaacatctaccccaggaaaccagatctccagtcagccacagggtgagacaaaggaggtgtcgcagcagccaccagagaaacacggaccaagagagaaggtgatgtgtgcccctgagaagaggattattcagcctgaattagagcttgggaacgagactgggtgtgctcatcttacttgtgagggagacaaaaaggaagaggtttcaggcagtaataaaagcggcaaggttcatgcctgcacattagccagattggcaaacttctgctttactcccccatcggaatccaaatcaaaatcccctcctcctgaaaggaagaaccgaggtgagagaggcccaagctcccctcctacaaccacagctccaatgcgtgtcagtaaaaggaaatcttttcagctccgtgggtccaccgagaaactgattgtttccaaagaatccctcttcactttaccagaactaggtgatgaagcatttgattgtgactgggatgaagagatgagaaaaaagtcatagttgggaaaagctttctggtcaaatctcaccttcttcaactccacagaggaccttcaggatatcaatatggtatttataaatgtatagaacaattggccatattgaggatcactctgaatactggctcccccttaaggctttctaatttcaggttaatcttcatgacttaaaaagttgtataatcagttgaggtcagtgtgataccagcagctgagctgaattaattatgttgtgcttaattttacaaatggagtacttgtattcctgttcctgaagctgtttctgttttttgttttgttttgtttttaagggggagaggttcttccctagattaatttcttctttcattcactcaggaacaaatgtcaagaaggtagcactcataaatctaacaaggcagatgaactcttttctactttttttttttttttttgtattttcacctggaatgggctaagtacagtgaatataatcacttggatgatttgccaaaatcagactatttttctagtattatttttgtattgatttgtgtggatcaggttaaatgtgactaatgcttttctttctttgagaggtatccttacaattccatgatgttcttagagatctggccactggtcaaacagtacctttctgaagtactgaccttctgagttgtcctttctttcttgagccaacattttgtacttcagattcttttttctcttgggggcctaccttcaaccaagtaaaatactgtgattagaagaagagagagtatgagccaggcacagtgactcactcctgtagtcctagctactcggggaggctgaggcaggatgattgcttaagcccaggagttcggggttacagtgagctgtggtcacaccactgtattccagcctgggtgacagagtgagatcctgtctctaaaaataaaataaatgaagaagagagactatgtggtagtctcaatcaaacatcatgtctcatctacccagctggttaatatggaaatgtgattcctactaagttgtgattcacttgtctttaaaaccaaggaaattatatactgtttttggtcagaatagataacctcaagctttgtctttctatgtgcttttaaaatcacttattcctttggattctaataagggttattaggattcagtaattatggactttctcttctgaagtgtgaatttgtaaactgattgtttaattgtcagagggacttttggacatagaatactcaaaactatatgtattttgtttaattttcacttcattcaattcacgcattgaaaacaaatttagaaaatccaatttttcttaagcatttaaacgttctaaaattcactaataaaattttctgaaaaaatttaaactgtgagtacaaa

SEQ ID NO: 154118 - DNA, 752 bp, Homo sapiens
  Payload ID: 10285
  Gene Symbol: MCM9
  Gene Name: minichromosome maintenance 9 homologous recombination repair factor
  ENST ID: ENST00000425154
  CDS Start-End: 284-752
gagcggccacgtgcacgcgcgcactccgcctcaccagccttcttgcgccggagacgaacccgctgcctggctggagctctctgggcccttcggcctcgggagcaacgcgttcccggcgacttctgacacagccactgtttctgcagaacccagtagatttcctacggtaagaaagagaaagaaggaaacaaattcacttccaagtatgaatttctaaggacagtctgttaattattcatgtcagaactggctgtcagtctgattaatgttacctagattcaagatgaatagcgatcaagttacactggttggtcaagtgtttgagtcatatgtttcggaataccataagaatgatattcttctaatcttgaaggaaagggatgaagatgctcattacccagttgtggttaatgccatgactctgtttgagaccaacatggaaatcggggaatatttcaacatgttccccagtgaagtgcttacaatttttgatagtgcactgcgaaggtcagccttgacaattctccagtccctttctcagcctgaggctgtttccatgaaacagaatcttcatgccaggatatcaggtttgcctgtctgtcctgagctggtgagggaacacatacctaaaaccaaggatgtgggacactttttatctgtcactgggacagtgattcgaacaagtctggtgaaggttctggagtttgagcgggattacatgtgtaacaaatgcaagcatgtgtttgtgatca

SEQ ID NO: 154119 - DNA, 549 bp, Homo sapiens
  Payload ID: 10285
  Gene Symbol: MCM9
  Gene Name: minichromosome maintenance 9 homologous recombination repair factor
  ENST ID: ENST00000458674
  CDS Start-End: 1-549
cagcctcgtgtgcaagctgaacacaaggaccaccatcctggcagcaacgaaccccaaaggccagtacgacccccaggagtccgtgtctgtgaacattgccctcggcagcccactcttaagtcgatttgacctgatcctggttttgcttgataccaagaatgaagactgggatcgtatcatttcctcctttatcttagaaaataaagctcatgctcgcctgatgtttcgtgatactgtaactctggaagacgctattacggtggtgtcagtcatggagtcctcaatgcagggaggtgcactgctaggaggtgtgaatgccctccacacttcctttcctgaaaaccctggagagcagtaccagagacagtgtgaacttattctggaaaagctagagctgcagagcctcttgagtgaagagcttagaagacttgaaaggttacagaatcagagtgtgcaccaatcccaaccacgggtattggaggtagagactactccaggatccttgagaaatggtccaggggaagaatcaaacttcagaacttcatcaca

SEQ ID NO: 154120 - DNA, 470 bp, Homo sapiens
  Payload ID: 10285
  Gene Symbol: MCM9
  Gene Name: minichromosome maintenance 9 homologous recombination repair factor
  ENST ID: ENST00000505446
  CDS Start-End: 237-470
gattcccggagacagctgggggatgccagtgcagttaggcactctcctgtcttcttttcgacgcttcgctgtggtcaagaggacaaactgtttctgcagaacccagtagatttcctacggtaagaaagagaaagaaggaaacaaattcacttccaagtatgaatttctaaggacagtctgttaattattcatgtcagaactggctgtcagtctgattaatgttacctagattcaagatgaatagcgatcaagttacactggttggtcaagtgtttgagtcatatgtttcggaataccataagaatgatattcttctaatcttgaaggaaagggatgaagatgctcattacccagttgtggttaatgccatgactctgtttgagaccaacatggaaatcggggaatatttcaacatgttccccagtgaagtgcttacaatttttgatagtgcactgcgaaggtcagccttg

SEQ ID NO: 154121 - DNA, 4822 bp, Homo sapiens
  Payload ID: 10285
  Gene Symbol: MCM9
  Gene Name: minichromosome maintenance 9 homologous recombination repair factor
  Uniprot ID: Q9NXL9
  ENST ID: ENST00000619706
  CDS Start-End: 16-3447
ttacctagattcaagatgaatagcgatcaagttacactggttggtcaagtgtttgagtcatatgtttcggaataccataagaatgatattcttctaatcttgaaggaaagggatgaagatgctcattacccagttgtggttaatgccatgactctgtttgagaccaacatggaaatcggggaatatttcaacatgttccccagtgaagtgcttacaatttttgatagtgcactgcgaaggtcagccttgacaattctccagtccctttctcagcctgaggctgtttccatgaaacagaatcttcatgccaggatatcaggtttgcctgtctgtcctgagctggtgagggaacacatacctaaaaccaaggatgtgggacactttttatctgtcactgggacagtgattcgaacaagtctggtgaaggttctggagtttgagcgggattacatgtgtaacaaatgcaagcatgtgtttgtgatcaaggctgactttgagcagtattacaccttttgccggccatcctcgtgtcccagcttggagagctgtgattcctctaaattcacttgcctctcaggcttgtcttcgtctccaaccaggtgtagagattaccaggaaatcaaaattcaggaacaggttcaaaggctatctgttggaagtattccacgatctatgaaggttattctggaagatgacttagtggatagttgcaaatctggtgatgacctcactatttacgggattgtaatgcaacggtggaagccctttcagcaagatgtgcgctgtgaagtggagatagtcctgaaagcaaattacatccaagtaaataatgagcagtcctcagggatcatcatggatgaggaggtccaaaaggaattcgaagatttttgggaatactataagagcgatccctttgcaggaaggaatgtaatattggctagcttgtgccctcaagtgtttggaatgtatctagtaaagcttgctgtggccatggtgctggctggtgggattcaaaggactgatgctacaggaacacgggtcagaggagaatctcatcttttattggttggggatcctggcacagggaaatctcagttcctcaaatatgcagcaaagattacaccaagatctgtgctgaccacaggaattggatctactagtgcaggtctgacggtaactgctgtaaaagactcaggagaatggaatttggaggctggggcattagttcttgcagatgcgggcctttgctgtattgatgagttcaatagcctcaaagagcatgataggaccagtatccatgaagcaatggagcaacaaaccataagtgttgctaaggctggcctcgtgtgcaagctgaacacaaggaccaccatcctggcagcaacgaaccccaaaggccagtacgacccccaggagtccgtgtctgtgaacattgccctcggcagcccactcttaagtcgatttgacctgatcctggttttgcttgataccaagaatgaagactgggatcgtatcatttcctcctttatcttagaaaataaaggttacccaagcaaatcagagaagctctggagcatggaaaagatgaaaacctatttctgcctcataaggaatctgcagcccacactgtctgatgtgggcaatcaggttcttctccggtactaccagatgcaaaggcagagtgattgccggaacgctgcccggaccaccattcggctgttggaaagcttgatacgattagcagaagctcatgctcgcctgatgtttcgtgatactgtaactctggaagacgctattacggtggtgtcagtcatggagtcctcaatgcagggaggtgcactgctaggaggtgtgaatgccctccacacttcctttcctgaaaaccctggagagcagtaccagagacagtgtgaacttattctggaaaagctagagctgcagagcctcttgagtgaagagcttagaagacttgaaaggttacagaatcagagtgtgcaccaatcccaaccacgggtattggaggtagagactactccaggatccttgagaaatggtccaggggaagaatcaaacttcagaacttcatcacagcaggaaatcaactatagcacacatatcttctctcctggaggcagccccgagggaagcccagttctagatcccccaccgcatctggagcctaatagatcaacaagtaggaaacattcagctcagcacaaaaataacagagatgacagtttagattggtttgatttcatggcaactcatcagagtgaacctaaaaacactgttgttgtgtctcctcatcccaaaacatctggagaaaatatggcttcgaagatctctaacagcacatctcagggtaaggagaagagtgagccaggccaaaggagcaaagtggacattgggttgcttccatcaccaggagagacaggtgttccatggagggcagacaatgtggaaagtaacaagaaaaaaaggctagcactagattctgaagcagcagtctctgctgataaaccagactcagtactgactcatcatgtccccaggaacctgcagaagctgtgcaaagagagggcccagaagttgtgcagaaatagcaccagggtgcctgcacagtgcacagtcccttcccatcctcagtccactcctgtacatagcccagacagaatgctggactcacccaaaagaaagagaccgaaatcccttgcgcaagtggaagagcctgcaattgaaaatgttaagcctccaggttcccctgtggccaaactggcaaaatttactttcaagcagaagtcaaaactgatccactcctttgaagatcacagccatgtgtcacctggtgcaactaaaatagcagttcatagtcctaaaatttcccagcgtagaacaagaagagacgcagccttgccggtgaagcgtccaggaaagttaacatctaccccaggaaaccagatctccagtcagccacagggtgagacaaaggaggtgtcgcagcagccaccagagaaacacggaccaagagagaaggtgatgtgtgcccctgagaagaggattattcagcctgaattagagcttgggaacgagactgggtgtgctcatcttacttgtgagggagacaaaaaggaagaggtttcaggcagtaataaaagcggcaaggttcatgcctgcacattagccagattggcaaacttctgctttactcccccatcggaatccaaatcaaaatcccctcctcctgaaaggaagaaccgaggtgagagaggcccaagctcccctcctacaaccacagctccaatgcgtgtcagtaaaaggaaatcttttcagctccgtgggtccaccgagaaactgattgtttccaaagaatccctcttcactttaccagaactaggtgatgaagcatttgattgtgactgggatgaagagatgagaaaaaagtcatagttgggaaaagctttctggtcaaatctcaccttcttcaactccacagaggaccttcaggatatcaatatggtatttataaatgtatagaacaattggccatattgaggatcactctgaatactggctcccccttaaggctttctaatttcaggttaatcttcatgacttaaaaagttgtataatcagttgaggtcagtgtgataccagcagctgagctgaattaattatgttgtgcttaattttacaaatggagtacttgtattcctgttcctgaagctgtttctgttttttgttttgttttgtttttaagggggagaggttcttccctagattaatttcttctttcattcactcaggaacaaatgtcaagaaggtagcactcataaatctaacaaggcagatgaactcttttctactttttttttttttttttgtattttcacctggaatgggctaagtacagtgaatataatcacttggatgatttgccaaaatcagactatttttctagtattatttttgtattgatttgtgtggatcaggttaaatgtgactaatgcttttctttctttgagaggtatccttacaattccatgatgttcttagagatctggccactggtcaaacagtacctttctgaagtactgaccttctgagttgtcctttctttcttgagccaacattttgtacttcagattcttttttctcttgggggcctaccttcaaccaagtaaaatactgtgattagaagaagagagagtatgagccaggcacagtgactcactcctgtagtcctagctactcggggaggctgaggcaggatgattgcttaagcccaggagttcggggttacagtgagctgtggtcacaccactgtattccagcctgggtgacagagtgagatcctgtctctaaaaataaaataaatgaagaagagagactatgtggtagtctcaatcaaacatcatgtctcatctacccagctggttaatatggaaatgtgattcctactaagttgtgattcacttgtctttaaaaccaaggaaattatatactgtttttggtcagaatagataacctcaagctttgtctttctatgtgcttttaaaatcacttattcctttggattctaataagggttattaggattcagtaattatggactttctcttctgaagtgtgaatttgtaaactgattgtttaattgtcagagggacttttggacatagaatactcaaaactatatgtattttgtttaattttcacttcattcaattcacgcattgaaaacaaatttagaaaatccaatttttcttaagcatttaaacgttctaaaattcactaataaaattttctgaaaaaatttaaactgtga

SEQ ID NO: 154122 - DNA, 4169 bp, Homo sapiens
  Payload ID: 10286
  Gene Symbol: MCMBP
  Gene Name: minichromosome maintenance complex binding protein
  Uniprot ID: Q9BTE3
  ENST ID: ENST00000360003
  CDS Start-End: 171-2099
tgaggcgcgggaggcccgcgccccgcggctcgctgtgcgtgggagggcgcgagcgaacgcgggcgaggagcggccgagccgctgaagaggagctgggcgccggccgcccggccgcgctcggcccgcggatcgcctccgcccggtcttcgccggccccggcccctggcgagatgccgtgtggggaggattggctcagccacccgctgggaatcgtgcagggattcttcgcccaaaatggagttaatcctgactgggagaagaaagtaattgagtattttaaggaaaagctgaaggaaaataatgctcctaagtgggtaccatcactgaacgaagttccccttcattatttgaaacctaatagttttgtgaaatttcgttgcatgattcaggatatgtttgaccctgagttttacatgggagtttatgaaacggttaaccaaaacacaaaagcacatgttcttcattttggaaaatatagagatgtagcagagtgtgggcctcaacaagaacttgatttaaactctccacgaaataccactttggaaagacagactttctattgtgttccggtgcctggggaatctacgtgggtaaaagaagcctatgttaatgcaaaccaagctcgagtcagtccctcaacatcctacactcctagtcgccacaagaggagttatgaagatgatgacgatatggacctacagcccaataagcagaaagaccaacatgcaggtgccagacaagcagggagtgttggtggtcttcaatggtgtggagagccaaaacgtttagaaactgaagcttctactgggcaacagctgaactctctgaacttgtcttctccttttgatttgaattttccattgccaggagagaagggccctgcatgccttgtgaaggtttatgaagattgggattgtttcaaagtaaatgacattcttgagctatatggcatactgtctgtggatcctgtgctgagtatactgaataatgatgaaagggatgcctctgcactgctggatccgatggagtgcacagacacagcagaggagcagagagtacacagtcctcctgcttcattagtgccgagaattcatgtgatcttagcccagaagttgcaacacatcaacccattattgcctgcctgccttaacaaagaggagagcaaaacctgtaagtttgtttcaagtttcatgtccgaattgtctccagtcagagcagaacttcttgggttccttactcatgcccttctgggggatagtttggctgctgaataccttatattacatctcatctccacagtatatacaagaagagatgtccttccactaggaaaatttacagttaacttgagtggttgcccacggaatagtaccttcacagaacacttgtatcgaattattcaacatcttgttccagcatcttttcgtctgcagatgactatagagaacatgaaccatttgaaattcattccccacaaagactacacagccaatcgcttggtcagtgggctcctccagctgcccagcaatacttcccttgtaatcgatgagactctcctggaacaggggcagctggataccccaggtgttcataatgtgacagccctgagcaacctcataacgtggcagaaggtggattatgacttcagctaccatcagatggaattcccctgcaatattaacgttttcattacttcggaggggaggtcactcctcccggcagactgccagattcacttacagccccagctaattccaccaaacatggaggagtacatgaacagccttctctcagcggtgctgccttccgtgctgaacaaattccgcatttatctaactcttttgagattcttggaatatagcatatctgatgaaataaccaaggcagttgaagatgactttgtggaaatgcggaagaacgaccctcagagcatcactgctgatgatcttcaccagctgctcgtggtggctcggtgtctgtctctcagtgctggtcagacaacgctgtcaagagaacgatggctgagagcaaagcagctagagtctttaagaagaacgaggcttcagcagcaaaaatgtgtgaatggaaatgaactttaaagatgtaatacctatgaagagtaatgggcaaactgtagccacataattgtaaaattcagatattcatttataccacattgttttataggtaatttctatcacaaaccagtgacatttcctgaaatcaagcctggtaacacctgatgtttatatgatattcagtaaggacttttaccttactgatttcatggagcttttgaagtttgttttataataattatataaattagtaatgatgtaaaaaaagtatttgatattaaaagtttaatattgataatgttgctgattgtaccatttccttagcttcagctgagtcataggccagactgttgaaatgctgaaatgaagaaggttgttgcagtttcaaagtcagaggaatcgtgcttcggatttcttatgttttctagttctctgtttttccagttcacagtgggttggggtgcattcagtagtccatctttggggaacggaggcgtacttgccattgattcacatgactacatgaaattctgtactgtcatttcccagatgtttggccacagaaactttttcccacttaacatttgttaacagcctgcaaaactaaacttgtacatggcagtggttcccagacttttgtattttatggaccggtagtaatatttccaaaaatctggggtactataaggttgccaatttaccttgccaagtaatccgaataaatcactgtattatcaccatttttttcataaaaggaaaggacaatctatctctgaataagaggagtcctttaaacggaatgaatgtggcttttgggggcaaaagaaaccaagacactacattgtctttattttctcctatcccagtgcatttgagaaccatgcataagggaatgctgtgctacaaagctgtgcccaaatatgaaaacaaaataggaaacttaaaaagcaataccccctttagaaagtttttattttcttaaatgtcattgagttgctttgattctattggatttttggcattttttatgggatcatcagttggttccaagtatgttagatcagctaacatctgctactccagtaacagcctcgtacaactgcaggtaggttttctccagaccaattagttttaatagagcaaactaacaacagactgtagtagcatggttatggcaaccagaatcttcagaaaggttaggacattactttttaagctgtcagtggtatcaaataacttacctagttggaggcagataaaggatcccttacgttttttcctataaggcctaaattgaaattgttaaccaaggaaacagggtcagccttgaaaaatcaaggaattcattgtacctaataactgaagtaaaaataactagttgttcaacttttcctaaactcaaatctatttttataaacaaatgtaaataatgtttatattagagttgaactggttttcatttttataactggtagactagaccttccttaaacttttagaaataaaatgaaggcttcactggatttgtgaggataaaatacattttctttaattgtcctagagcaaagtacattagtcaccatgtgttttttgtgccaatgtaaattgtaatttaccaaagaaaaatacatacattgcttggtcttgcagaaaagttcccttgaaagaacctttccaataaataaaacgtcccaaattagcagtaccttgggctgtttttcatgagtaagaagattcaccatcccatgtgatctgtgtggaaaaagaccatgtcctcttggtggaagacatgagagagctgaactgaagtggaggaggtggtgcaagagggaccttcctgctcaaggcccgcccaggcagcggaatggagtgcagtgcttggctgcagaaaccctttgtccctcacctatatatacacggacagtcaagtttgttgctctaacgtaaggcacagcgttaatcctgtatggccaggaaactgagtagactcctgtgtaaccctgtttggaactttgccttcttaaaatgatttttcaaagatctctttcgaactaatttctgtagagtttaaacgtgtattttatcacctaa

SEQ ID NO: 154123 - DNA, 2465 bp, Homo sapiens
  Payload ID: 10286
  Gene Symbol: MCMBP
  Gene Name: minichromosome maintenance complex binding protein
  Uniprot ID: Q9BTE3
  ENST ID: ENST00000369077
  CDS Start-End: 266-2188
cccgccattgtgcgaagtgaaggctaggggcccgtacgcgcccgcctgactgtcgccagcagctcctcggcggccccaccgcagccgccgctccctgaggcgcgggaggcccgcgccccgcggctcgctgtgcgtgggagggcgcgagcgaacgcgggcgaggagcggccgagccgctgaagaggagctgggcgccggccgcccggccgcgctcggcccgcggatcgcctccgcccggtcttcgccggccccggcccctggcgagatgccgtgtggggaggattggctcagccacccgctgggaatcgtgcagggattcttcgcccaaaatggagttaatcctgactgggagaagaaagtaattgagtattttaaggaaaagctgaaggaaaataatgctcctaagtgggtaccatcactgaacgaagttccccttcattatttgaaacctaatagttttgtgaaatttcgttgcatgattcaggatatgtttgaccctgagttttacatgggagtttatgaaacggttaaccaaaacacaaaagcacatgttcttcattttggaaaatatagagatgtagcagagtgtgggcctcaacaagaacttgatttaaactctccacgaaataccactttggaaagacagactttctattgtgttccggtgcctggggaatctacgtgggtaaaagaagcctatgttaatgcaaaccaagctcgagtcagtccctcaacatcctacactcctagtcgccacaagaggagttatgaagatgatgacgatatggacctacagcccaataagcagaaagaccaacatgcaggtgccagacaagcagggagtgttggtggtcttcaatggtgtggagagccaaaacgtttagaaactgaagcttctactgggcaacagctgaactctctgaacttgtcttctccttttgatttgaattttccattgccaggagagaagggccctgcatgccttgtgaaggtttatgaagattgggattgtttcaaagtaaatgacattcttgagctatatggcatactgtctgtggatcctgtgctgagtatactgaataatgatgaaagggatgcctctgcactgctggatccgatggagtgcacagacacagcagaggagcagagagtacacagtcctcctgcttcattagtgccgagaattcatgtgatcttagcccagaagttgcaacacatcaacccattattgcctgcctgccttaacaaagaggagagcaaaacctttgtttcaagtttcatgtccgaattgtctccagtcagagcagaacttcttgggttccttactcatgcccttctgggggatagtttggctgctgaataccttatattacatctcatctccacagtatatacaagaagagatgtccttccactaggaaaatttacagttaacttgagtggttgcccacggaatagtaccttcacagaacacttgtatcgaattattcaacatcttgttccagcatcttttcgtctgcagatgactatagagaacatgaaccatttgaaattcattccccacaaagactacacagccaatcgcttggtcagtgggctcctccagctgcccagcaatacttcccttgtaatcgatgagactctcctggaacaggggcagctggataccccaggtgttcataatgtgacagccctgagcaacctcataacgtggcagaaggtggattatgacttcagctaccatcagatggaattcccctgcaatattaacgttttcattacttcggaggggaggtcactcctcccggcagactgccagattcacttacagccccagctaattccaccaaacatggaggagtacatgaacagccttctctcagcggtgctgccttccgtgctgaacaaattccgcatttatctaactcttttgagattcttggaatatagcatatctgatgaaataaccaaggcagttgaagatgactttgtggaaatgcggaagaacgaccctcagagcatcactgctgatgatcttcaccagctgctcgtggtggctcggtgtctgtctctcagtgctggtcagacaacgctgtcaagagaacgatggctgagagcaaagcagctagagtctttaagaagaacgaggcttcagcagcaaaaatgtgtgaatggaaatgaactttaaagatgtaatacctatgaagagtaatgggcaaactgtagccacataattgtaaaattcagatattcatttataccacattgttttataggtaatttctatcacaaaccagtgacatttcctgaaatcaagcctggtaacacctgatgtttatatgatattcagtaaggacttttaccttactgatttcatggagcttttgaagtttgttttataataattatataaattagtaatgatgtaaaaaaagtatttgatattaaaagtttaatattgataa

SEQ ID NO: 154124 - DNA, 3622 bp, Homo sapiens
  Payload ID: 10287
  Gene Symbol: MCM2
  Gene Name: minichromosome maintenance complex component 2
  Uniprot ID: P49736
  ENST ID: ENST00000265056
  CDS Start-End: 245-2959
ggcgagcgcacgcgcacagcgccgggccgcacacctccgggctctgggcggagcgcctcgggcgttgtaggcgggaccggaccctctggcccgcccctccgtgtcccttctggtcgccagtggacgccgacgtcatgacgtcgcgttccgtagggctcttcccgggctttggtgggtcacgtgaaccacttttcgcgcgaaacctggttgttgctgtagtggcggagaggatcgtggtactgctatggcggaatcatcggaatccttcaccatggcatccagcccggcccagcgtcggcgaggcaatgatcctctcacctccagccctggccgaagctcccggcgtactgatgccctcacctccagccctggccgtgaccttccaccatttgaggatgagtccgaggggctcctaggcacagaggggcccctggaggaagaagaggatggagaggagctcattggagatggcatggaaagggactaccgcgccatcccagagctggacgcctatgaggccgagggactggctctggatgatgaggacgtagaggagctgacggccagtcagagggaggcagcagagcgggccatgcggcagcgtgaccgggaggctggccggggcctgggccgcatgcgccgtgggctcctgtatgacagcgatgaggaggacgaggagcgccctgcccgcaagcgccgccaggtggagcgggccacggaggacggcgaggaggacgaggagatgatcgagagcatcgagaacctggaggatctcaaaggccactctgtgcgcgagtgggtgagcatggcgggcccccggctggagatccaccaccgcttcaagaacttcctgcgcactcacgtcgacagccacggccacaacgtcttcaaggagcgcatcagcgacatgtgcaaagagaaccgtgagagcctggtggtgaactatgaggacttggcagccagggagcacgtgctggcctacttcctgcctgaggcaccggcggagctgctgcagatctttgatgaggctgccctggaggtggtactggccatgtaccccaagtacgaccgcatcaccaaccacatccatgtccgcatctcccacctgcctctggtggaggagctgcgctcgctgaggcagctgcatctgaaccagctgatccgcaccagtggggtggtgaccagctgcactggcgtcctgccccagctcagcatggtcaagtacaactgcaacaagtgcaatttcgtcctgggtcctttctgccagtcccagaaccaggaggtgaaaccaggctcctgtcctgagtgccagtcggccggcccctttgaggtcaacatggaggagaccatctatcagaactaccagcgtatccgaatccaggagagtccaggcaaagtggcggctggccggctgccccgctccaaggacgccattctcctcgcagatctggtggacagctgcaagccaggagacgagatagagctgactggcatctatcacaacaactatgatggctccctcaacactgccaatggcttccctgtctttgccactgtcatcctagccaaccacgtggccaagaaggacaacaaggttgctgtaggggaactgaccgatgaagatgtgaagatgatcactagcctctccaaggatcagcagatcggagagaagatctttgccagcattgctccttccatctatggtcatgaagacatcaagagaggcctggctctggccctgttcggaggggagcccaaaaacccaggtggcaagcacaaggtacgtggtgatatcaacgtgctcttgtgcggagaccctggcacagcgaagtcgcagtttctcaagtatattgagaaagtgtccagccgagccatcttcaccactggccagggggcgtcggctgtgggcctcacggcgtatgtccagcggcaccctgtcagcagggagtggaccttggaggctggggccctggttctggctgaccgaggagtgtgtctcattgatgaatttgacaagatgaatgaccaggacagaaccagcatccatgaggccatggagcaacagagcatctccatctcgaaggctggcatcgtcacctccctgcaggctcgctgcacggtcattgctgccgccaaccccataggagggcgctacgacccctcgctgactttctctgagaacgtggacctcacagagcccatcatctcacgctttgacatcctgtgtgtggtgagggacaccgtggacccagtccaggacgagatgctggcccgcttcgtggtgggcagccacgtcagacaccaccccagcaacaaggaggaggaggggctggccaatggcagcgctgctgagcccgccatgcccaacacgtatggcgtggagcccctgccccaggaggtcctgaagaagtacatcatctacgccaaggagagggtccacccgaagctcaaccagatggaccaggacaaggtggccaagatgtacagtgacctgaggaaagaatctatggcgacaggcagcatccccattacggtgcggcacatcgagtccatgatccgcatggcggaggcccacgcgcgcatccatctgcgggactatgtgatcgaagacgacgtcaacatggccatccgcgtgatgctggagagcttcatagacacacagaagttcagcgtcatgcgcagcatgcgcaagacttttgcccgctacctttcattccggcgtgacaacaatgagctgttgctcttcatactgaagcagttagtggcagagcaggtgacatatcagcgcaaccgctttggggcccagcaggacactattgaggtccctgagaaggacttggtggataaggctcgtcagatcaacatccacaacctctctgcattttatgacagtgagctcttcaggatgaacaagttcagccacgacctgaaaaggaaaatgatcctgcagcagttctgaggccctatgccatccataaggattccttgggattctggtttggggtggtcagtgccctctgtgctttatggacacaaaaccagagcacttgatgaactcggggtactagggtcagggcttatagcaggatgtctggctgcacctggcatgactgtttgtttctccaagcctgctttgtgcttctcacctttgggtgggatgccttgccagtgtgtcttacttggttgctgaacatcttgccacctccgagtgctttgtctccactcagtaccttggatcagagctgctgagttcaggatgcctgcgtgtggtttaggtgttagccttcttacatggatgtcaggagagctgctgccctcttggcgtgagttgcgtattcaggctgcttttgctgcctttggccagagagctggttgaagatgtttgtaatcgttttcagtctcctgcaggtttctgtgcccctgtggtggaagagggcacgacagtgccagcgcagcgttctgggctcctcagtcgcaggggtgggatgtgagtcatgcggattatccactcgccacagttatcagctgccattgctccctgtctgtttccccactctcttatttgtgcattcggtttggtttctgtagttttaatttttaataaagttgaataaaatataaa

SEQ ID NO: 154125 - DNA, 2510 bp, Homo sapiens
  Payload ID: 10287
  Gene Symbol: MCM2
  Gene Name: minichromosome maintenance complex component 2
  ENST ID: ENST00000477668
  CDS Start-End: 1-274
cctaggcacagaggggcccctggaggaagaagaggatggagaggagctcattggagatggcatggaaagggactaccgcgccatcccagagctggacgcctatgaggccgagggactggctctggatgatgaggacgtagaggagctgacggccagtcagagggaggcagcagagcgggccatgcggcagcgtgaccgggaggctggccggggcctgggccgcatgcgccgtgggctcctgtatggtgtctcttgcctccccagacagcgatgaggaggacgaggagcgccctgcccgcaagcgccgccaggtggagcgggccacggaggacggcgaggaggacgaggagatgatcgagagcatcgagaacctggaggatctcaaaggccactctgtgcgcgagtgggtgagcatggcgggcccccggctggagatccaccaccgcttcaagaacttcctgcgcactcacgtcgacagccacggccacaacgtcttcaaggagcgcatcagcgacatgtgcaaagagaaccgtgagagcctggtggtgaactatgaggacttggcagccagggagcacgtgctggcctacttcctgcctgaggcaccggcggagctgctgcagatctttgatgaggctgccctggaggtggtactggccatgtaccccaagtacgaccgcatcaccaaccacatccatgtccgcatctcccacctgcctctggtggaggagctgcgctcgctgaggcagctgcatctgaaccagctgatccgcaccagtggggtggtgaccagctgcactggcgtcctgccccagctcagcatggtcaagtacaactgcaacaagtgcaatttcgtcctgggtcctttctgccagtcccagaaccaggaggtgaaaccaggctcctgtcctgagtgccagtcggccggcccctttgaggtcaacatggaggagaccatctatcagaactaccagcgtatccgaatccaggagagtccaggcaaagtggcggctggccggctgccccgctccaaggacgccattctcctcgcagatctggtggacagctgcaagccaggagacgagatagagctgactggcatctatcacaacaactatgatggctccctcaacactgccaatggcttccctgtctttgccactgtcatcctagccaaccacgtggccaagaaggacaacaaggttgctgtaggggaactgaccgatgaagatgtgaagatgatcactagcctctccaaggatcagcagatcggagagaagatctttgccagcattgctccttccatctatggtcatgaagacatcaagagaggcctggctctggccctgttcggaggggagcccaaaaacccaggtggcaagcacaaggtacgtggtgatatcaacgtgctcttgtgcggagaccctggcacagcgaagtcgcagtttctcaagtatattgagaaagtgtccagccgagccatcttcaccactggccagggggcgtcggctgtgggcctcacggcgtatgtccagcggcaccctgtcagcagggagtggaccttggaggctggggccctggttctggctgaccgaggagtgtgtctcattgatgaatttgacaagatgaatgaccaggacagaaccagcatccatgaggccatggagcaacagagcatctccatctcgaaggctggcatcgtcacctccctgcaggctcgctgcacggtcattgctgccgccaaccccataggacgagatgctggcccgcttcgtggtgggcagccacgtcagacaccaccccagcaacaaggaggaggaggggctggccaatggcagcgctgctgagcccgccatgcccaacacgtatggcgtggagcccctgccccaggaggtcctgaagaagtacatcatctacgccaaggagagggtccacccgaagctcaaccagatggaccaggacaaggtggccaagatgtacagtgacctgaggaaagaatctatggcgacaggcagcatccccattacggtgcggcacatcgagtccatgatccgcatggcggaggcccacgcgcgcatccatctgcgggactatgtgatcgaagacgacgtcaacatggccatccgcgtgatgctggagagcttcatagacacacagaagttcagcgtcatgcgcagcatgcgcaagacttttgcccgctacctttcattccggcgtgacaacaatgagctgttgctcttcatactgaagcagttagtggcagagcaggtgacatatcagcgcaaccgctttggggcccagcaggacactattgaggtccctgagaaggacttggtggataaggctcgtcagatcaacatccacaacctctctgcattttatgacagtgagctcttcaggatgaacaagttcagccacgacctgaaaaggaaaatgatcctgcagcagttctgaggccctatgccatccataaggattccttgggattctggtttggggtggtcagtgcc

SEQ ID NO: 154126 - DNA, 547 bp, Homo sapiens
  Payload ID: 10287
  Gene Symbol: MCM2
  Gene Name: minichromosome maintenance complex component 2
  ENST ID: ENST00000472731
  CDS Start-End: 238-547
ttgtttggaagccactgactcagattgctcagctgagagcattccaggtgagagaacagcaagggcaaagatctggaggctggaaggggtttggtgtgttggaggacaagagtcacaggtggagagaaagaagggaaggcccctgatggtaaaaaggaagctgtatcatgcctcaccagcttcctaggtttctgacaaccgcaccttctcttgcaggaatcatcggaatccttcaccatggcatccagcccggcccagcgtcggcgaggcaatgatcctctcacctccagccctggccgaagctcccggcgtactgatgccctcacctccagccctggccgtgaccttccaccatttgaggatgagtccgaggggctcctaggcacagaggggcccctggaggaagaagaggatggagaggagctcattggagatggcatggaaagggactaccgcgccatcccagagctggacgcctatgaggccgagggactggctctggatgatgaggacgtagaggagctgacggccagtcagagggaggcag

SEQ ID NO: 154127 - DNA, 693 bp, Homo sapiens
  Payload ID: 10287
  Gene Symbol: MCM2
  Gene Name: minichromosome maintenance complex component 2
  ENST ID: ENST00000480910
  CDS Start-End: 309-693
gtccctttgtcttgtatactgtctgttccacatctgagttccagacctcttgttttggtggctcttctatgccatctctatcacaataccttgcgcactgtgtgtgctgaaataggtctaatgcttaaggggagataatagacagtaaacaggtaaataggcaaatgacataacctcagtggtttttcatggagaaagcacggtgatgtgggtgaccccgatatttgagctggcttctatttgtttggaagccactgactcagattgctcagctgagagcattccaggaatcatcggaatccttcaccatggcatccagcccggcccagcgtcggcgaggcaatgatcctctcacctccagccctggccgaagctcccggcgtactgatgccctcacctccagccctggccgtgaccttccaccatttgaggatgagtccgaggggctcctaggcacagaggggcccctggaggaagaagaggatggagaggagctcattggagatggcatggaaagggactaccgcgccatcccagagctggacgcctatgaggccgagggactggctctggatgatgaggacgtagaggagctgacggccagtcagagggaggcagcagagcgggccatgcggcagcgtgaccgggaggctggccggggcctgggccgcatgcgccgtgggctcctgtatg

SEQ ID NO: 154128 - DNA, 2847 bp, Homo sapiens
  Payload ID: 10287
  Gene Symbol: MCM2
  Gene Name: minichromosome maintenance complex component 2
  ENST ID: ENST00000474964
  CDS Start-End: 58-498
acttttcgcgcgaaacctggttgttgctgtagtggcggagaggatcgtggtactgctatggcggaatcatcggaatccttcaccatggcatccagcccggcccagcgtcggcgaggcaatgatcctctcacctccagccctggccgaagctcccggcgtactgatgccctcacctccagccctggccgtgaccttccaccatttgaggatgagtccgaggggctcctaggcacagaggggcccctggaggaagaagaggatggagaggagctcattggagatggcatggaaagggactaccgcgccatcccagagctggacgcctatgaggccgagggactggctctggatgatgaggacgtagaggagctgacggccagtcagagggaggcagcagagcgggccatgcggcagcgtgaccgggaggctggccggggcctgggccgcatgcgccgtgggctcctgtatggtgtctcttgcctccccagacagcgatgaggaggacgaggagcgccctgcccgcaagcgccgccaggtggagcgggccacggaggacggcgaggaggacgaggagatgatcgagagcatcgagaacctggaggatctcaaaggccactctgtgcgcgagtgggtgagcatggcgggcccccggctggagatccaccaccgcttcaagaacttcctgcgcactcacgtcgacagccacggccacaacgtcttcaaggagcgcatcagcgacatgtgcaaagagaaccgtgagagcctggtggtgaactatgaggacttggcagccagggagcacgtgctggcctacttcctgcctgaggcaccggcggagctgctgcagatctttgatgaggctgccctggaggtggtactggccatgtaccccaagtacgaccgcatcaccaaccacatccatgtccgcatctcccacctgcctctggtggaggagctgcgctcgctgaggcagctgcatctgaaccagctgatccgcaccagtggggtggtgaccagctgcactggcgtcctgccccagctcagcatggtcaagtacaactgcaacaagtgcaatttcgtcctgggtcctttctgccagtcccagaaccaggaggtgaaaccaggctcctgtcctgagtgccagtcggccggcccctttgaggtcaacatggaggagaccatctatcagaactaccagcgtatccgaatccaggagagtccaggcaaagtggcggctggccggctgccccgctccaaggacgccattctcctcgcagatctggtggacagctgcaagccaggagacgagatagagctgactggcatctatcacaacaactatgatggctccctcaacactgccaatggcttccctgtctttgccactgtcatcctagccaaccacgtggccaagaaggacaacaaggttgctgtaggggaactgaccgatgaagatgtgaagatgatcactagcctctccaaggatcagcagatcggagagaagatctttgccagcattgctccttccatctatggtcatgaagacatcaagagaggcctggctctggccctgttcggaggggagcccaaaaacccaggtggcaagcacaaggtacgtggtgatatcaacgtgctcttgtgcggagaccctggcacagcgaagtcgcagtttctcaagtatattgagaaagtgtccagccgagccatcttcaccactggccagggggcgtcggctgtgggcctcacggcgtatgtccagcggcaccctgtcagcagggagtggaccttggaggctggggccctggttctggctgaccgaggagtgtgtctcattgatgaatttgacaagatgaatgaccaggacagaaccagcatccatgaggccatggagcaacagagcatctccatctcgaaggctggcatcgtcacctccctgcaggctcgctgcacggtcattgctgccgccaaccccataggagggcgctacgacccctcgctgactttctctgagaacgtggacctcacagagcccatcatctcacgctttgacatcctgtgtgtggtgagggacaccgtggacccagtccaggacgagatgctggcccgcttcgtggtgggcagccacgtcagacaccaccccagcaacaaggaggaggaggggctggccaatggcagcgctgctgagcccgccatgcccaacacgtatggcgtggagcccctgccccaggaggtcctgaagaagtacatcatctacgccaaggagagggtccacccgaagctcaaccagatggaccaggacaaggtggccaagatgtacagtgacctgaggaaagaatctatggcgacaggcagcatccccattacggtgcggcacatcgagtccatgatccgcatggcggaggcccacgcgcgcatccatctgcgggactatgtgatcgaagacgacgtcaacatggccatccgcgtgatgctggagagcttcatagacacacagaagttcagcgtcatgcgcagcatgcgcaagacttttgcccgctacctttcattccggcgtgacaacaatgagctgttgctcttcatactgaagcagttagtggcagagcaggtgacatatcagcgcaaccgctttggggcccagcaggacactattgaggtccctgagaaggacttggtggataaggctcgtcagatcaacatccacaacctctctgcattttatgacagtgagctcttcaggatgaacaagttcagccacgacctgaaaaggaaaatgatcctgcagcagttctgaggccctatgccatccataaggattccttgggattctggtttggggtggtcagtgcc

SEQ ID NO: 154129 - DNA, 2844 bp, Homo sapiens
  Payload ID: 10287
  Gene Symbol: MCM2
  Gene Name: minichromosome maintenance complex component 2
  ENST ID: ENST00000491422
  CDS Start-End: 1-2510
acagcgatgaggaggacgaggagcgccctgcccgcaagcgccgccaggtggagcgggccacggaggacggcgaggaggacgaggagatgatcgagagcatcgagaacctggaggatctcaaaggccactctgtgcgcgagtgggtgagcatggcgggcccccggctggagatccaccaccgcttcaagaacttcctgcgcactcacgtcgacagccacggccacaacgtcttcaaggagcgcatcagcgacatgtgcaaagagaaccgtgagagcctggtggtgaactatgaggacttggcagccagggagcacgtgctggcctacttcctgcctgaggcaccggcggagctgctgcagatctttgatgaggctgccctggaggtggtactggccatgtaccccaagtacgaccgcatcaccaaccacatccatgtccgcatctcccacctgcctctggtggaggagctgcgctcgctgaggcagctgcatctgaaccagctgatccgcaccagtggggtggtgaccagctgcactggcgtcctgccccagctcagcatggtcaagtacaactgcaacaagtgcaatttcgtcctgggtcctttctgccagtcccagaaccaggaggtgaaaccaggctcctgtcctgagtgccagtcggccggcccctttgaggtcaacatggaggagaccatctatcagaactaccagcgtatccgaatccaggagagtccaggcaaagtggcggctggccggctgccccgctccaaggacgccattctcctcgcagatctggtggacagctgcaagccaggagacgagatagagctgactggcatctatcacaacaactatgatggctccctcaacactgccaatggcttccctgtctttgccactgtcatcctagccaaccacgtggccaagaaggacaacaaggttgctgtaggggaactgaccgatgaagatgtgaagatgatcactagcctctccaaggatcagcagatcggagagaaggaaagctccagaaatgcatccctggcagaggctggtattggtgccattccttcccagctcttggccatcgaacctagtctgcgaagatctggggttcccataggagaggtgggtgtttctcagcgtcaggaagccaggagcttcagttcagccaacacacattggttcctggaagacctcctagggccaagttgtagggatacaatgatctttgccagcattgctccttccatctatggtcatgaagacatcaagagaggcctggctctggccctgttcggaggggagcccaaaaacccaggtggcaagcacaaggtacgtggtgatatcaacgtgctcttgtgcggagaccctggcacagcgaagtcgcagtttctcaagtatattgagaaagtgtccagccgagccatcttcaccactggccagggggcgtcggctgtgggcctcacggcgtatgtccagcggcaccctgtcagcagggagtggaccttggaggctggggccctggttctggctgaccgaggagtgtgtctcattgatgaatttgacaagatgaatgaccaggacagaaccagcatccatgaggccatggagcaacagagcatctccatctcgaaggctggcatcgtcacctccctgcaggctcgctgcacggtcattgctgccgccaaccccataggagggcgctacgacccctcgctgactttctctgagaacgtggacctcacagagcccatcatctcacgctttgacatcctgtgtgtggtgagggacaccgtggacccagtccaggacgagatgctggcccgcttcgtggtgggcagccacgtcagacaccaccccagcaacaaggaggaggaggggctggccaatggcagcgctgctgagcccgccatgcccaacacgtatggcgtggagcccctgccccaggaggtcctgaagaagtacatcatctacgccaaggagagggtccacccgaagctcaaccagatggaccaggacaaggtggccaagatgtacagtgacctgaggaaagaatctatggcgacaggcagcatccccattacggtgcggcacatcgagtccatgatccgcatggcggaggcccacgcgcgcatccatctgcgggactatgtgatcgaagacgacgtcaacatggccatccgcgtgatgctggagagcttcatagacacacagaagttcagcgtcatgcgcagcatgcgcaagacttttgcccgctacctttcattccggcgtgacaacaatgagctgttgctcttcatactgaagcagttagtggcagagcaggtgacatatcagcgcaaccgctttggggcccagcaggacactattgaggtccctgagaaggacttggtggataaggctcgtcagatcaacatccacaacctctctgcattttatgacagtgagctcttcaggatgaacaagttcagccacgacctgaaaaggaaaatgatcctgcagcagttctgaggccctatgccatccataaggattccttgggattctggtttggggtggtcagtgccctctgtgctttatggacacaaaaccagagcacttgatgaactcggggtactagggtcagggcttatagcaggatgtctggctgcacctggcatgactgtttgtttctccaagcctgctttgtgcttctcacctttgggtgggatgccttgccagtgtgtcttacttggttgctgaacatcttgccacctccgagtgctttgtctccactcagtaccttggatcagagctgctgagttcaggatgcctgcgtgtggtttaggtgttagccttcttacat

SEQ ID NO: 154130 - DNA, 3083 bp, Homo sapiens
  Payload ID: 10288
  Gene Symbol: MCM3
  Gene Name: minichromosome maintenance complex component 3
  Uniprot ID: P25205
  ENST ID: ENST00000229854
  CDS Start-End: 78-2504
gaagttttcgcgccggggtggagtcatcctgggaacctccacgcgactttggtggaggtagttctttggcagcgggcatggcgggtaccgtggtgctggacgatgtggagctgcgggaggctcagagagattacctggacttcctggacgacgaggaagaccagggaatttatcagagcaaagttcgggagctgatcagtgacaaccaataccggctgattgtcaatgtgaatgacctgcgcaggaaaaacgagaagagggctaaccggcttctgaacaatgcctttgaggagctggttgccttccagcgggccttaaaggattttgtggcctccattgatgctacctatgccaagcagtatgaggagttctacgtaggactggaaggcagctttggctccaagcacgtctccccgcggactcttacctcctgcttcctcagctgtgtggtctgtgtggagggcattgtcactaaatgttctctagttcgtcccaaagtcgtccgcagtgtccactactgtcctgctactaagaagaccatagagcgacgttattctgatctcaccaccctggtggcctttccctccagctctgtctatcctaccaaggatgaggagaacaatccccttgagacagaatatggcctttctgtctacaaggatcaccagaccatcaccatccaggagatgccggagaaggccccagccggccagctcccccgctctgtggacgtcattctggatgatgacttggtggataaagcgaagcctggtgaccgggttcaggtggtgggaacctaccgttgccttcctggaaagaagggaggctacacctctgggaccttcaggactgtcctgattgcctgtaatgttaagcagatgagcaaggatgctcagccctctttctctgctgaggatatagccaagatcaagaagttcagtaaaacccgatccaaggatatctttgaccagctggccaagtcattggccccaagtatccatgggcatgactatgtcaagaaagcaatcctctgcttgctcttgggaggggtggaacgagacctagaaaatggcagccacatccgtggggacatcaatattcttctaataggagacccatccgttgccaagtctcagcttctgcggtatgtgctttgcactgcaccccgagctatccccaccactggccggggctcctctggagtgggtctgacggctgctgtcaccacagaccaggaaacaggagagcgccgtctggaagcaggggccatggtcctggctgaccgaggcgtggtttgcattgatgaatttgacaaaatgtctgacatggatcgcacagccatccatgaagtgatggagcagggtcgagtgaccattgccaaggctggcatccatgctcggctgaatgcccgctgcagtgttttggcagctgccaaccctgtctacggcaggtatgaccagtataagactccaatggagaacattgggctacaggactcactgctgtcacgatttgacttgctcttcatcatgctggatcagatggatcctgagcaggatcgggagatctcagaccatgtccttcggatgcaccgttacagagcacctggggagcaggatggcgatgctatgcccttgggtagtgctgtggatatcctggccacagatgatcccaactttagccaggaagatcagcaggacacccagatttatgagaagcatgacaaccttctacatgggaccaagaagaaaaaggagaagatggtgagtgcagcattcatgaagaagtacatccatgtggccaaaatcatcaagcctgtcctgacacaggagtcggccacctacattgcagaagagtattcacgcctgcgcagccaggatagcatgagctcagacaccgccaggacatctccagttacagcccgaacactggaaactctgattcgactggccacagcccatgcgaaggcccgcatgagcaagactgtggacctgcaggatgcagaggaagctgtggagttggtccagtatgcttactttaagaaggttctggagaaggagaagaaacgtaagaagcgaagtgaggatgaatcagagacagaagatgaagaggagaaaagccaagaggaccaggagcagaagaggaagagaaggaagactcgccagccagatgccaaagatggggattcatacgacccctatgacttcagtgacacagaggaggaaatgcctcaagtacacactccaaagacggcagactcacaggagaccaaggaatcccagaaagtggagttgagtgaatccaggttgaaggcattcaaggtggccctcttggatgtgttccgggaagctcatgcgcagtcaatcggcatgaatcgcctcacagaatccatcaaccgggacagcgaagagcccttctcttcagttgagatccaggctgctctgagcaagatgcaggatgacaatcaggtcatggtgtctgagggcatcatcttcctcatctgaggaggcctcgtctctgaacttgggttgtgccgagagagtttgttctgtgtttcccaccctctccctgacccaagtctttgcctctactcccttaacagtgttgaattcaactgaaggcgaggaatgttggtgatgaagctgagttcaggactcggtggaccctttgggaatgggtcatgaaagctgccatggggtgaggaaagaggagacagtgggagaggacaatgactattgcatcttcattgcaaaagcactggctcatccgccctacttcccatcccacacaaacccaattgtaaataacatatgacttctgagtacttttgggggcacaactgttttctgtttgctgtttttttgttttgttttttttctccagagcactttggtctagactaggctttgggtggttccaattggtggagagaagctctgaggcacgtcatgcaggtcaagaaagctttctttgcagtagcaccagttaaggtgaatatgtattgtatcacaaaacaaacccaatatccagatgaatatccgagatgttgaataaacttagccatttcgtacacatggtcttaa

SEQ ID NO: 154131 - DNA, 3095 bp, Homo sapiens
  Payload ID: 10288
  Gene Symbol: MCM3
  Gene Name: minichromosome maintenance complex component 3
  ENST ID: ENST00000419835
  CDS Start-End: 65-2521
gaagaagaagaagcttttgattggacagtcgctagtccgacctcagagaactcagccaatcataatgcttatatgctcccaaggtccccgcctcttcctcgaggtaacctttggtggcgggaagagttcggaagttttcgcgccggggtggagtcatcctgggaacctccacgcgactttggtggaggtagttctttggcagcgggcatggcgggtaccgtggtgctggacgatgtggagctgcgggaggctcagagagattacctggacttcctggacgacgaggcttctgaacaatgcctttgaggagctggttgccttccagcgggccttaaaggattttgtggcctccattgatgctacctatgccaagcagtatgaggagttctacgtaggactggaaggcagctttggctccaagcacgtctccccgcggactcttacctcctgcttcctcagctgtgtggtctgtgtggagggcattgtcactaaatgttctctagttcgtcccaaagtcgtccgcagtgtccactactgtcctgctactaagaagaccatagagcgacgttattctgatctcaccaccctggtggcctttccctccagctctgtctatcctaccaaggatgaggagaacaatccccttgagacagaatatggcctttctgtctacaaggatcaccagaccatcaccatccaggagatgccggagaaggccccagccggccagctcccccgctctgtggacgtcattctggatgatgacttggtggataaagcgaagcctggtgaccgggttcaggtggtgggaacctaccgttgccttcctggaaagaagggaggctacacctctgggaccttcaggactgtcctgattgcctgtaatgttaagcagatgagcaaggatgctcagccctctttctctgctgaggatatagccaagatcaagaagttcagtaaaacccgatccaaggatatctttgaccagctggccaagtcattggccccaagtatccatgggcatgactatgtcaagaaagcaatcctctgcttgctcttgggaggggtggaacgagacctagaaaatggcagccacatccgtggggacatcaatattcttctaataggagacccatccgttgccaagtctcagcttctgcggtatgtgctttgcactgcaccccgagctatccccaccactggccggggctcctctggagtgggtctgacggctgctgtcaccacagaccaggaaacaggagagcgccgtctggaagcaggggccatggtcctggctgaccgaggcgtggtttgcattgatgaatttgacaaaatgtctgacatggatcgcacagccatccatgaagtgatggagcagggtcgagtgaccattgccaaggctggcatccatgctcggctgaatgcccgctgcagtgttttggcagctgccaaccctgtctacggcaggtatgaccagtataagactccaatggagaacattgggctacaggactcactgctgtcacgatttgacttgctcttcatcatgctggatcagatggatcctgagcaggatcgggagatctcagaccatgtccttcggatgcaccgttacagagcacctggggagcaggatggcgatgctatgcccttgggtagtgctgtggatatcctggccacagatgatcccaactttagccaggaagatcagcaggacacccagatttatgagaagcatgacaaccttctacatgggaccaagaagaaaaaggagaagatggtgagtgcagcattcatgaagaagtacatccatgtggccaaaatcatcaagcctgtcctgacacaggagtcggccacctacattgcagaagagtattcacgcctgcgcagccaggatagcatgagctcagacaccgccaggacatctccagttacagcccgaacactggaaactctgattcgactggccacagcccatgcgaaggcccgcatgagcaagactgtggacctgcaggatgcagaggaagctgtggagttggtccagtatgcttactttaagaaggttctggagaaggagaagaaacgtaagaagcgaagtgaggatgaatcagagacagaagatgaagaggagaaaagccaagaggaccaggagcagaagaggaagagaaggaagactcgccagccagatgccaaagatggggattcatacgacccctatgacttcagtgacacagaggaggaaatgcctcaagtacacactccaaagacggcagactcacaggagaccaaggaatcccagaaagtggagttgagtgaatccaggttgaaggcattcaaggtggccctcttggatgtgttccgggaagctcatgcgcagtcaatcggcatgaatcgcctcacagaatccatcaaccgggacagcgaagagcccttctcttcagttgagatccaggctgctctgagcaagatgcaggatgacaatcaggtcatggtgtctgagggcatcatcttcctcatctgaggaggcctcgtctctgaacttgggttgtgccgagagagtttgttctgtgtttcccaccctctccctgacccaagtctttgcctctactcccttaacagtgttgaattcaactgaaggcgaggaatgttggtgatgaagctgagttcaggactcggtggaccctttgggaatgggtcatgaaagctgccatggggtgaggaaagaggagacagtgggagaggacaatgactattgcatcttcattgcaaaagcactggctcatccgccctacttcccatcccacacaaacccaattgtaaataacatatgacttctgagtacttttgggggcacaactgttttctgtttgctgtttttttgttttgttttttttctccagagcactttggtctagactaggctttgggtggttccaattggtggagagaagctctgaggcacgtcatgcaggtcaagaaagctttctttgcagtagcaccagttaaggtgaatatgtattgtatcacaaaacaaacccaatatccagatgaatatccgagatgttgaataaacttagccatttcgtacacatggt

SEQ ID NO: 154132 - DNA, 1030 bp, Homo sapiens
  Payload ID: 10288
  Gene Symbol: MCM3
  Gene Name: minichromosome maintenance complex component 3
  ENST ID: ENST00000421471
  CDS Start-End: 1-987
cgttacagagcacctggggagcaggatggcgatgctatgcccttgggtagtgctgtggatatcctggccacagatgatcccaactttagccaggaagatcagcaggacacccagatttatgagaagcatgacaaccttctacatgggaccaagaagaaaaaggagaagatggtgagtgcagcattcatgaagaagtacatccatgtggccaaaatcatcaagcctgtcctgacacaggagtcggccacctacattgcagaagagtattcacgcctgcgcagccaggatagcatgagctcagacaccgccaggacatctccagttacagcccgaacactggaaactctgattcgactggccacagcccatgcgaaggcccgcatgagcaagactgtggacctgcaggatgcagaggaagctgtggagttggtccagtatgcttactttaagaaggttctggagaaggagaagaaacgtaagaagcgaagtgaggatgaatcagagacagaagatgaagaggagaaaagccaagaggaccaggagcagaagaggaagagaaggaagactcgccagccagatgccaaagatggggattcatacgacccctatgacttcagtgacacagaggaggaaatgcctcaagtacacactccaaagacggcagactcacaggagaccaaggaatcccagaaagtggagttgagtgaatccagagacgggatctcaccatgttgcccaggctggtcttggactcctggcctcaagcagtccttctacctgagcctcccaaaaggctgggattacaggcataagccactgtgcttgtttgatctcattctttttaatgactgcagggtttccatggttgaaggcattcaaggtggccctcttggatgtgttccgggaagctcatgcgcagtcaatcggcatgaatcgcctcacagaatccatcaaccgggacagcgaagagcccttctcttcagttgagatccaggctgctctgagcaagatgcaggatgacaatcaggtc

SEQ ID NO: 154133 - DNA, 559 bp, Homo sapiens
  Payload ID: 10288
  Gene Symbol: MCM3
  Gene Name: minichromosome maintenance complex component 3
  ENST ID: ENST00000596983
  CDS Start-End: 73-306
gaagaagaagaagcttttgattggacagtcgctagtccgacctcagagaactcagccaatcataatgcttatatgctcccaaggtccccgcctcttcctcgaggtaacctttggtggcgggaagagttcggaagttttcgcgccggggtggagtcatcctgggaacctccacgcgactttggtggaggtagttctttggcagcgggcatggcgggtaccgtggtgctggacgatgtggagctgcgggaggctcagagagattacctggacttcctggacgacgaggcttctgaacaatgcctttgaggagctggttgccttccagcgggccttaaaggattttgtggcctccattgatgctacctatgccaagcagtatgaggagttctacgtaggactggaaggcagctttggctccaagcacgtctccccgcggactcttacctcctgcttcctcagctgtgtggtctgtgtggagggcattgtcactaaatgttctctagttcgtcccaaagtcgtccgcagtgtccactactgtcctgctactaagaagaccata

SEQ ID NO: 154134 - DNA, 3169 bp, Homo sapiens
  Payload ID: 10288
  Gene Symbol: MCM3
  Gene Name: minichromosome maintenance complex component 3
  Uniprot ID: P25205
  ENST ID: ENST00000596288
  CDS Start-End: 29-2590
agagaactcagccaatcataatgcttatatgctcccaaggtccccgcctcttcctcgaggtaacctttggtggcgggaagagttcggaagttttcgcgccggggtggagtcatcctgggaacctccacgcgactttggtggaggtagttctttggcagcgggcatggcgggtaccgtggtgctggacgatgtggagctgcgggaggctcagagagattacctggacttcctggacgacgaggaagaccagggaatttatcagagcaaagttcgggagctgatcagtgacaaccaataccggctgattgtcaatgtgaatgacctgcgcaggaaaaacgagaagagggctaaccggcttctgaacaatgcctttgaggagctggttgccttccagcgggccttaaaggattttgtggcctccattgatgctacctatgccaagcagtatgaggagttctacgtaggactggaaggcagctttggctccaagcacgtctccccgcggactcttacctcctgcttcctcagctgtgtggtctgtgtggagggcattgtcactaaatgttctctagttcgtcccaaagtcgtccgcagtgtccactactgtcctgctactaagaagaccatagagcgacgttattctgatctcaccaccctggtggcctttccctccagctctgtctatcctaccaaggatgaggagaacaatccccttgagacagaatatggcctttctgtctacaaggatcaccagaccatcaccatccaggagatgccggagaaggccccagccggccagctcccccgctctgtggacgtcattctggatgatgacttggtggataaagcgaagcctggtgaccgggttcaggtggtgggaacctaccgttgccttcctggaaagaagggaggctacacctctgggaccttcaggactgtcctgattgcctgtaatgttaagcagatgagcaaggatgctcagccctctttctctgctgaggatatagccaagatcaagaagttcagtaaaacccgatccaaggatatctttgaccagctggccaagtcattggccccaagtatccatgggcatgactatgtcaagaaagcaatcctctgcttgctcttgggaggggtggaacgagacctagaaaatggcagccacatccgtggggacatcaatattcttctaataggagacccatccgttgccaagtctcagcttctgcggtatgtgctttgcactgcaccccgagctatccccaccactggccggggctcctctggagtgggtctgacggctgctgtcaccacagaccaggaaacaggagagcgccgtctggaagcaggggccatggtcctggctgaccgaggcgtggtttgcattgatgaatttgacaaaatgtctgacatggatcgcacagccatccatgaagtgatggagcagggtcgagtgaccattgccaaggctggcatccatgctcggctgaatgcccgctgcagtgttttggcagctgccaaccctgtctacggcaggtatgaccagtataagactccaatggagaacattgggctacaggactcactgctgtcacgatttgacttgctcttcatcatgctggatcagatggatcctgagcaggatcgggagatctcagaccatgtccttcggatgcaccgttacagagcacctggggagcaggatggcgatgctatgcccttgggtagtgctgtggatatcctggccacagatgatcccaactttagccaggaagatcagcaggacacccagatttatgagaagcatgacaaccttctacatgggaccaagaagaaaaaggagaagatggtgagtgcagcattcatgaagaagtacatccatgtggccaaaatcatcaagcctgtcctgacacaggagtcggccacctacattgcagaagagtattcacgcctgcgcagccaggatagcatgagctcagacaccgccaggacatctccagttacagcccgaacactggaaactctgattcgactggccacagcccatgcgaaggcccgcatgagcaagactgtggacctgcaggatgcagaggaagctgtggagttggtccagtatgcttactttaagaaggttctggagaaggagaagaaacgtaagaagcgaagtgaggatgaatcagagacagaagatgaagaggagaaaagccaagaggaccaggagcagaagaggaagagaaggaagactcgccagccagatgccaaagatggggattcatacgacccctatgacttcagtgacacagaggaggaaatgcctcaagtacacactccaaagacggcagactcacaggagaccaaggaatcccagaaagtggagttgagtgaatccaggttgaaggcattcaaggtggccctcttggatgtgttccgggaagctcatgcgcagtcaatcggcatgaatcgcctcacagaatccatcaaccgggacagcgaagagcccttctcttcagttgagatccaggctgctctgagcaagatgcaggatgacaatcaggtcatggtgtctgagggcatcatcttcctcatctgaggaggcctcgtctctgaacttgggttgtgccgagagagtttgttctgtgtttcccaccctctccctgacccaagtctttgcctctactcccttaacagtgttgaattcaactgaaggcgaggaatgttggtgatgaagctgagttcaggactcggtggaccctttgggaatgggtcatgaaagctgccatggggtgaggaaagaggagacagtgggagaggacaatgactattgcatcttcattgcaaaagcactggctcatccgccctacttcccatcccacacaaacccaattgtaaataacatatgacttctgagtacttttgggggcacaactgttttctgtttgctgtttttttgttttgttttttttctccagagcactttggtctagactaggctttgggtggttccaattggtggagagaagctctgaggcacgtcatgcaggtcaagaaagctttctttgcagtagcaccagttaaggtgaatatgtattgtatcacaaaacaaacccaatatccagatgaatatccgagatgttgaataaacttagccatttcgtacacatggtcttaa

SEQ ID NO: 154135 - DNA, 3208 bp, Homo sapiens
  Payload ID: 10288
  Gene Symbol: MCM3
  Gene Name: minichromosome maintenance complex component 3
  Uniprot ID: P25205
  ENST ID: ENST00000616552
  CDS Start-End: 73-2634
gaagaagaagaagcttttgattggacagtcgctagtccgacctcagagaactcagccaatcataatgcttatatgctcccaaggtccccgcctcttcctcgaggtaacctttggtggcgggaagagttcggaagttttcgcgccggggtggagtcatcctgggaacctccacgcgactttggtggaggtagttctttggcagcgggcatggcgggtaccgtggtgctggacgatgtggagctgcgggaggctcagagagattacctggacttcctggacgacgaggaagaccagggaatttatcagagcaaagttcgggagctgatcagtgacaaccaataccggctgattgtcaatgtgaatgacctgcgcaggaaaaacgagaagagggctaaccggcttctgaacaatgcctttgaggagctggttgccttccagcgggccttaaaggattttgtggcctccattgatgctacctatgccaagcagtatgaggagttctacgtaggactggaaggcagctttggctccaagcacgtctccccgcggactcttacctcctgcttcctcagctgtgtggtctgtgtggagggcattgtcactaaatgttctctagttcgtcccaaagtcgtccgcagtgtccactactgtcctgctactaagaagaccatagagcgacgttattctgatctcaccaccctggtggcctttccctccagctctgtctatcctaccaaggatgaggagaacaatccccttgagacagaatatggcctttctgtctacaaggatcaccagaccatcaccatccaggagatgccggagaaggccccagccggccagctcccccgctctgtggacgtcattctggatgatgacttggtggataaagcgaagcctggtgaccgggttcaggtggtgggaacctaccgttgccttcctggaaagaagggaggctacacctctgggaccttcaggactgtcctgattgcctgtaatgttaagcagatgagcaaggatgctcagccctctttctctgctgaggatatagccaagatcaagaagttcagtaaaacccgatccaaggatatctttgaccagctggccaagtcattggccccaagtatccatgggcatgactatgtcaagaaagcaatcctctgcttgctcttgggaggggtggaacgagacctagaaaatggcagccacatccgtggggacatcaatattcttctaataggagacccatccgttgccaagtctcagcttctgcggtatgtgctttgcactgcaccccgagctatccccaccactggccggggctcctctggagtgggtctgacggctgctgtcaccacagaccaggaaacaggagagcgccgtctggaagcaggggccatggtcctggctgaccgaggcgtggtttgcattgatgaatttgacaaaatgtctgacatggatcgcacagccatccatgaagtgatggagcagggtcgagtgaccattgccaaggctggcatccatgctcggctgaatgcccgctgcagtgttttggcagctgccaaccctgtctacggcaggtatgaccagtataagactccaatggagaacattgggctacaggactcactgctgtcacgatttgacttgctcttcatcatgctggatcagatggatcctgagcaggatcgggagatctcagaccatgtccttcggatgcaccgttacagagcacctggggagcaggatggcgatgctatgcccttgggtagtgctgtggatatcctggccacagatgatcccaactttagccaggaagatcagcaggacacccagatttatgagaagcatgacaaccttctacatgggaccaagaagaaaaaggagaagatggtgagtgcagcattcatgaagaagtacatccatgtggccaaaatcatcaagcctgtcctgacacaggagtcggccacctacattgcagaagagtattcacgcctgcgcagccaggatagcatgagctcagacaccgccaggacatctccagttacagcccgaacactggaaactctgattcgactggccacagcccatgcgaaggcccgcatgagcaagactgtggacctgcaggatgcagaggaagctgtggagttggtccagtatgcttactttaagaaggttctggagaaggagaagaaacgtaagaagcgaagtgaggatgaatcagagacagaagatgaagaggagaaaagccaagaggaccaggagcagaagaggaagagaaggaagactcgccagccagatgccaaagatggggattcatacgacccctatgacttcagtgacacagaggaggaaatgcctcaagtacacactccaaagacggcagactcacaggagaccaaggaatcccagaaagtggagttgagtgaatccaggttgaaggcattcaaggtggccctcttggatgtgttccgggaagctcatgcgcagtcaatcggcatgaatcgcctcacagaatccatcaaccgggacagcgaagagcccttctcttcagttgagatccaggctgctctgagcaagatgcaggatgacaatcaggtcatggtgtctgagggcatcatcttcctcatctgaggaggcctcgtctctgaacttgggttgtgccgagagagtttgttctgtgtttcccaccctctccctgacccaagtctttgcctctactcccttaacagtgttgaattcaactgaaggcgaggaatgttggtgatgaagctgagttcaggactcggtggaccctttgggaatgggtcatgaaagctgccatggggtgaggaaagaggagacagtgggagaggacaatgactattgcatcttcattgcaaaagcactggctcatccgccctacttcccatcccacacaaacccaattgtaaataacatatgacttctgagtacttttgggggcacaactgttttctgtttgctgtttttttgttttgttttttttctccagagcactttggtctagactaggctttgggtggttccaattggtggagagaagctctgaggcacgtcatgcaggtcaagaaagctttctttgcagtagcaccagttaaggtgaatatgtattgtatcacaaaacaaacccaatatccagatgaatatccgagatgttgaataaacttagccatttcgtacacatggt

SEQ ID NO: 154136 - DNA, 6193 bp, Homo sapiens
  Payload ID: 10289
  Gene Symbol: MCM3AP
  Gene Name: minichromosome maintenance complex component 3 associated protein
  Uniprot ID: O60318
  ENST ID: ENST00000291688
  CDS Start-End: 109-6051
cttgttctaaagacgaaggggaactccctagtgctacaggctgtttcaggaagccaattaattttgtacacataatacttaattaccttctaataattggagcagaagatgaacccaactaatcctttcagtgggcagcagcctagtgctttttcggcgtcttctagtaatgtaggaacacttccatctaagccgccatttcgatttggtcaaccttctctttttggacaaaacagtaccttatctgggaagagctcgggattttcacaggtatccagctttccagcgtcttctggagtaagtcattcctcttcagtgcaaacattagggttcacccaaacctcaagtgttggacccttttctggacttgagcacacttccacctttgtggctacctctgggccttcaagttcatctgtgctgggaaacacaggatttagttttaaatcacccaccagtgttggggctttcccaagcacttctgcttttggacaagaagctggagaaatagtgaactctggttttgggaaaacagaattcagctttaaacctctggaaaatgcagtgttcaaaccaatactgggggctgaatctgagccagagaaaacccagagccaaattgcttctgggttttttacattttcccacccaattagtagtgcacctggaggcctggcccctttctcttttcctcaagtaacaagtagttcagctaccacttcaaattttaccttttcaaaacctgttagtagtaataattcattatctgcctttacccctgctttgtcaaaccaaaatgtagaggaagagaagagaggacctaagtcaatatttggaagttctaataatagcttcagtagcttccctgtatcatctgcggttttgggcgaacctttccaggctagcaaagcaggtgtcaggcaggggtgtgaagaagctgtttcccaggtggaaccacttcccagcctaatgaaaggactgaaaaggaaggaggaccaggatcgctccccaaggagacatggccacgagccagcagaagattcggatcctctgtcccggggcgatcatcctccagacaaacgacctgtccgcctgaatcgaccccggggaggtactttatttggtcggacgatacaggatgttttcaaaagcaataaggaagtaggtcgtctgggcaacaaggaggccaaaaaggaaactggctttgttgagtctgcagaaagtgaccacatggctatcccaggagggaatcagtctgtcctggcaccttcccggattccaggtgtgaataaagaggaagaaactgaaagtagagagaagaaagaagattctctaagaggaactccggcgcgtcagagtaacagaagcgagagcacagacagtcttgggggcttgtctccctctgaagtcacagccatccagtgcaagaacatccctgactacctcaacgacaggaccattctggagaaccattttggcaaaattgctaaagtgcagcgcatctttaccaggcgcagcaaaaagcttgcagtggtacatttctttgatcatgcatctgcagccctggctagaaagaaggggaaaagtttgcataaagacatggctatcttttggcacaggaagaaaataagccccaataagaaacccttttccctgaaggagaagaaaccaggtgacggtgaagtcagcccgagcacagaggatgcaccctttcagcactctcctcttggcaaggccgcagggaggactggtgctagcagcctcctgaataaaagctctccagtgaagaagccaagtcttctaaaggcccaccaattcgagggagactcttttgactcagcctccgagggctccgagggcctcgggccatgtgtgctctccctcagtaccctgataggcactgtggctgagacatccaaggagaagtaccgcctgcttgaccagagagacaggatcatgcggcaagctcgggtgaagagaaccgatctggacaaagcgaggacttttgttggcacctgcctggatatgtgtcctgagaaggagaggtacatgcgggagacccgtagccagctgagcgtgttcgaagtggtcccagggactgaccaggtggaccacgcagcagctgtgaaagagtacagtcggtcctcggcggatcaggaggagcccctgccccacgagctgcggcccttgccagtgctcagcaggaccatggactacctggtgacccagatcatggaccagaaggagggcagcctgcgggattggtatgacttcgtgtggaaccgcacgcgtggcatacggaaggatatcacgcagcagcacctctgtgaccccctgacggtgtccctgattgagaagtgcacccggtttcacatccactgtgcccacttcatgtgtgaggagcccatgtcctcctttgatgccaagatcaataatgagaacatgaccaagtgcctgcagagcctgaaggagatgtaccaggacctgagaaacaagggtgtcttctgtgccagcgaagcggagttccagggctacaatgttctgctcagtctcaacaagggagacatcctaagagaagtacaacagttccatcctgctgttagaaactcatctgaggtgaaatttgctgttcaggcttttgctgcattgaacagtaataattttgtgagatttttcaaactggtccagtcagcttcttacctgaacgcttgtcttttacactgttacttcagtcagatccgcaaggatgctctccgggcgctcaactttgcgtacacggtgagcacacagcgatctaccatctttcccctggatggtgtggtgcgcatgctgctgttcagagactgtgaagaggccaccgacttcctcacctgccacggcctcaccgtttccgacggctgtgtggagctgaaccggtctgcattcctggaaccagagggattatccaagaccaggaagtcggtgtttattactaggaagctgacggtgtcagtcggggaaattgtgaacggagggccattgccccccgtccctcgtcatacccctgtgtgcagcttcaactcccagaacaagtacatcggggagagcctggccgcggagctgcccgtcagcacccagagacccggctccgacacagtgggcggagggagaggagaggagtgtggtgtagagccggatgcacccctgtccagtctcccacagtctctaccagcccctgcgccctcaccagtgcctctgcctcctgtcctggcactgaccccgtctgtggcgcccagcctcttccagctgtctgtgcagcctgaaccaccgcctccagagcccgtgcccatgtactctgacgaggacctggcgcaggtggtggacgagctcatccaggaggccctgcagagggactgtgaggaagttggctctgcgggtgctgcctacgcagctgccgccctgggtgtttctaatgctgctatggaggatttgttaacagctgcaaccacgggcattttgaggcacattgcagctgaagaagtgtctaaggaaagagagcgaagggagcaggagaggcagcgggctgaagaggaaaggttgaaacaagagagagagctggtgttaagtgagctgagccagggcctggccgtggagctgatggaacgcgtgatgatggagtttgtgagggaaacctgctcccaggagttgaagaatgcagtagagacagaccagagggtccgtgtggcccgttgctgtgaggatgtctgtgcccacttagtggacttgtttctcgtggaggaaatcttccagactgcaaaggagaccctccaggagcttcagtgcttctgcaagtatctacagcggtggagggaagctgtcacagcccgcaagaaactgaggcgccaaatgcgggctttccctgctgcgccctgctgcgtggacgtgagcgaccggctgagggcgctggcgcccagcgcagagtgccccattgctgaagagaacctggccaggggcctcctggacctgggccatgcagggagattgggcatctcctgcaccaggttaaggcggctcagaaacaagacagctcaccagatgaaggttcagcacttctaccagcagctgctgagtgatgtggcatgggcgtctctggacctgccatccctcgtggctgagcacctccctgggaggcaggagcatgtgttttggaagctggtgctggtgttgccggatgtagaggagcagtccccagagagttgtggcagaattctagcaaattggttaaaagtcaagttcatgggagatgaaggctcagtggatgacacatccagcgatgctggtgggattcagacgctttcgcttttcaactcacttagcagcaaaggggatcagatgatttctgttaacgtgtgtataaaggtggcccatggcgccctcagtgatggtgccattgatgctgtggagacacagaaggacctcctgggagccagtgggctcatgctgctgcttccccccaaaatgaagagtgaggacatggcagaggaggacgtgtactggctgtcggccttgctgcagctcaagcagctcctgcaggctaagcccttccagcctgcgcttcctctggtggttcttgtgcctagcccaggaggggacgccgttgagaaggaagtagaagatggtctgatgctacaggacttggtttcagctaagctgatttcagattacactgttaccgagatccctgataccattaatgatctacaaggttcaactaaggttttgcaagcagtgcagtggctggtttcccactgcccccattcccttgacctctgctgccagactctcattcagtacgtcgaagacgggattggccatgagtttagtggccgctttttccatgacagaagagagaggcgtctgggcggtcttgcttctcaggagcctggcgccatcattgagctgtttaacagtgtgctgcagttcctggcttctgtggtgtcctctgaacagctgtgtgacctgtcctggcctgtcactgagtttgctgaggcagggggcagccggctgcttcctcacctgcactggaatgccccagagcacctggcctggctgaagcaggctgtgctcgggttccagcttccgcagatggaccttccacccctgggggccccctggctccccgtgtgctccatggttgtccagtacgcctcccagatccccagctcacgccagacacagcctgtcctccagtcccaggtggagaacctgctccacagaacctactgtaggtggaagagcaagagtccctccccagtccatggggcaggcccctcggtcatggagatcccatgggatgatcttatcgccttgtgtatcaaccacaagctgagagactggacgcccccccggcttcctgttacatcagaggcgctgagtgaagatggtcagatatgtgtgtatttttttaaaaacgatttgaaaaaatatgatgttcctttgtcgtgggaacaagccaggttgcagacgcagaaggagctacagctgagagagggacgtttggcaataaagccttttcatccttctgcaaacaattttcccataccattgcttcacatgcaccgtaactggaagaggagcacagagtgtgctcaagaggggaggattcccagcacagaggatctgatgcgaggagcttctgctgaggagctcttggcgcagtgtttgtcgagcagtctgctgctggagaaagaagagaacaagaggtttgaagatcagcttcagcaatggttgtctgaagactcaggagcatttacggatttaacttcccttcccctctatcttcctcagactctagtgtctctttctcacactattgaacctgtgatgaaaacatctgtaactactagcccacagagtgacatgatgagggagcaactgcagctgtcagaggcgacaggaacgtgtctaggcgaacgactaaagcacctggaaaggctgatccggagttcaagggaagaggaagttgcctctgagctccatctctctgcgctgctagacatggtggacatttgagcagcctgacctgtggggagggggtctctcccgaagagtttctgtttttactcaaaataatgttattctcagatgcttgatgcactgttggaaatgtgattaatttaatcatgcagataaaccatttaaatgtcagtctccc

SEQ ID NO: 154137 - DNA, 6333 bp, Homo sapiens
  Payload ID: 10289
  Gene Symbol: MCM3AP
  Gene Name: minichromosome maintenance complex component 3 associated protein
  Uniprot ID: O60318
  ENST ID: ENST00000397708
  CDS Start-End: 256-6198
agtgctgagcgaaccggaagtcggtccgcggcgttttctgcccgcggtgcgcagcgctgagtgtcgcggcagcagcctgtgcttgcgcctcaagtctttccgaggggccagtgggcagcgcgggcctcggggtcctggggcgagacgcttgttctaaagacgaaggggaactccctagtgctacaggctgtttcaggaagccaattaattttgtacacataatacttaattaccttctaataattggagcagaagatgaacccaactaatcctttcagtgggcagcagcctagtgctttttcggcgtcttctagtaatgtaggaacacttccatctaagccgccatttcgatttggtcaaccttctctttttggacaaaacagtaccttatctgggaagagctcgggattttcacaggtatccagctttccagcgtcttctggagtaagtcattcctcttcagtgcaaacattagggttcacccaaacctcaagtgttggacccttttctggacttgagcacacttccacctttgtggctacctctgggccttcaagttcatctgtgctgggaaacacaggatttagttttaaatcacccaccagtgttggggctttcccaagcacttctgcttttggacaagaagctggagaaatagtgaactctggttttgggaaaacagaattcagctttaaacctctggaaaatgcagtgttcaaaccaatactgggggctgaatctgagccagagaaaacccagagccaaattgcttctgggttttttacattttcccacccaattagtagtgcacctggaggcctggcccctttctcttttcctcaagtaacaagtagttcagctaccacttcaaattttaccttttcaaaacctgttagtagtaataattcattatctgcctttacccctgctttgtcaaaccaaaatgtagaggaagagaagagaggacctaagtcaatatttggaagttctaataatagcttcagtagcttccctgtatcatctgcggttttgggcgaacctttccaggctagcaaagcaggtgtcaggcaggggtgtgaagaagctgtttcccaggtggaaccacttcccagcctaatgaaaggactgaaaaggaaggaggaccaggatcgctccccaaggagacatggccacgagccagcagaagattcggatcctctgtcccggggcgatcatcctccagacaaacgacctgtccgcctgaatcgaccccggggaggtactttatttggtcggacgatacaggatgttttcaaaagcaataaggaagtaggtcgtctgggcaacaaggaggccaaaaaggaaactggctttgttgagtctgcagaaagtgaccacatggctatcccaggagggaatcagtctgtcctggcaccttcccggattccaggtgtgaataaagaggaagaaactgaaagtagagagaagaaagaagattctctaagaggaactccggcgcgtcagagtaacagaagcgagagcacagacagtcttgggggcttgtctccctctgaagtcacagccatccagtgcaagaacatccctgactacctcaacgacaggaccattctggagaaccattttggcaaaattgctaaagtgcagcgcatctttaccaggcgcagcaaaaagcttgcagtggtacatttctttgatcatgcatctgcagccctggctagaaagaaggggaaaagtttgcataaagacatggctatcttttggcacaggaagaaaataagccccaataagaaacccttttccctgaaggagaagaaaccaggtgacggtgaagtcagcccgagcacagaggatgcaccctttcagcactctcctcttggcaaggccgcagggaggactggtgctagcagcctcctgaataaaagctctccagtgaagaagccaagtcttctaaaggcccaccaattcgagggagactcttttgactcagcctccgagggctccgagggcctcgggccatgtgtgctctccctcagtaccctgataggcactgtggctgagacatccaaggagaagtaccgcctgcttgaccagagagacaggatcatgcggcaagctcgggtgaagagaaccgatctggacaaagcgaggacttttgttggcacctgcctggatatgtgtcctgagaaggagaggtacatgcgggagacccgtagccagctgagcgtgttcgaagtggtcccagggactgaccaggtggaccacgcagcagctgtgaaagagtacagtcggtcctcggcggatcaggaggagcccctgccccacgagctgcggcccttgccagtgctcagcaggaccatggactacctggtgacccagatcatggaccagaaggagggcagcctgcgggattggtatgacttcgtgtggaaccgcacgcgtggcatacggaaggatatcacgcagcagcacctctgtgaccccctgacggtgtccctgattgagaagtgcacccggtttcacatccactgtgcccacttcatgtgtgaggagcccatgtcctcctttgatgccaagatcaataatgagaacatgaccaagtgcctgcagagcctgaaggagatgtaccaggacctgagaaacaagggtgtcttctgtgccagcgaagcggagttccagggctacaatgttctgctcagtctcaacaagggagacatcctaagagaagtacaacagttccatcctgctgttagaaactcatctgaggtgaaatttgctgttcaggcttttgctgcattgaacagtaataattttgtgagatttttcaaactggtccagtcagcttcttacctgaacgcttgtcttttacactgttacttcagtcagatccgcaaggatgctctccgggcgctcaactttgcgtacacggtgagcacacagcgatctaccatctttcccctggatggtgtggtgcgcatgctgctgttcagagactgtgaagaggccaccgacttcctcacctgccacggcctcaccgtttccgacggctgtgtggagctgaaccggtctgcattcctggaaccagagggattatccaagaccaggaagtcggtgtttattactaggaagctgacggtgtcagtcggggaaattgtgaacggagggccattgccccccgtccctcgtcatacccctgtgtgcagcttcaactcccagaacaagtacatcggggagagcctggccgcggagctgcccgtcagcacccagagacccggctccgacacagtgggcggagggagaggagaggagtgtggtgtagagccggatgcacccctgtccagtctcccacagtctctaccagcccctgcgccctcaccagtgcctctgcctcctgtcctggcactgaccccgtctgtggcgcccagcctcttccagctgtctgtgcagcctgaaccaccgcctccagagcccgtgcccatgtactctgacgaggacctggcgcaggtggtggacgagctcatccaggaggccctgcagagggactgtgaggaagttggctctgcgggtgctgcctacgcagctgccgccctgggtgtttctaatgctgctatggaggatttgttaacagctgcaaccacgggcattttgaggcacattgcagctgaagaagtgtctaaggaaagagagcgaagggagcaggagaggcagcgggctgaagaggaaaggttgaaacaagagagagagctggtgttaagtgagctgagccagggcctggccgtggagctgatggaacgcgtgatgatggagtttgtgagggaaacctgctcccaggagttgaagaatgcagtagagacagaccagagggtccgtgtggcccgttgctgtgaggatgtctgtgcccacttagtggacttgtttctcgtggaggaaatcttccagactgcaaaggagaccctccaggagcttcagtgcttctgcaagtatctacagcggtggagggaagctgtcacagcccgcaagaaactgaggcgccaaatgcgggctttccctgctgcgccctgctgcgtggacgtgagcgaccggctgagggcgctggcgcccagcgcagagtgccccattgctgaagagaacctggccaggggcctcctggacctgggccatgcagggagattgggcatctcctgcaccaggttaaggcggctcagaaacaagacagctcaccagatgaaggttcagcacttctaccagcagctgctgagtgatgtggcatgggcgtctctggacctgccatccctcgtggctgagcacctccctgggaggcaggagcatgtgttttggaagctggtgctggtgttgccggatgtagaggagcagtccccagagagttgtggcagaattctagcaaattggttaaaagtcaagttcatgggagatgaaggctcagtggatgacacatccagcgatgctggtgggattcagacgctttcgcttttcaactcacttagcagcaaaggggatcagatgatttctgttaacgtgtgtataaaggtggcccatggcgccctcagtgatggtgccattgatgctgtggagacacagaaggacctcctgggagccagtgggctcatgctgctgcttccccccaaaatgaagagtgaggacatggcagaggaggacgtgtactggctgtcggccttgctgcagctcaagcagctcctgcaggctaagcccttccagcctgcgcttcctctggtggttcttgtgcctagcccaggaggggacgccgttgagaaggaagtagaagatggtctgatgctacaggacttggtttcagctaagctgatttcagattacactgttaccgagatccctgataccattaatgatctacaaggttcaactaaggttttgcaagcagtgcagtggctggtttcccactgcccccattcccttgacctctgctgccagactctcattcagtacgtcgaagacgggattggccatgagtttagtggccgctttttccatgacagaagagagaggcgtctgggcggtcttgcttctcaggagcctggcgccatcattgagctgtttaacagtgtgctgcagttcctggcttctgtggtgtcctctgaacagctgtgtgacctgtcctggcctgtcactgagtttgctgaggcagggggcagccggctgcttcctcacctgcactggaatgccccagagcacctggcctggctgaagcaggctgtgctcgggttccagcttccgcagatggaccttccacccctgggggccccctggctccccgtgtgctccatggttgtccagtacgcctcccagatccccagctcacgccagacacagcctgtcctccagtcccaggtggagaacctgctccacagaacctactgtaggtggaagagcaagagtccctccccagtccatggggcaggcccctcggtcatggagatcccatgggatgatcttatcgccttgtgtatcaaccacaagctgagagactggacgcccccccggcttcctgttacatcagaggcgctgagtgaagatggtcagatatgtgtgtatttttttaaaaacgatttgaaaaaatatgatgttcctttgtcgtgggaacaagccaggttgcagacgcagaaggagctacagctgagagagggacgtttggcaataaagccttttcatccttctgcaaacaattttcccataccattgcttcacatgcaccgtaactggaagaggagcacagagtgtgctcaagaggggaggattcccagcacagaggatctgatgcgaggagcttctgctgaggagctcttggcgcagtgtttgtcgagcagtctgctgctggagaaagaagagaacaagaggtttgaagatcagcttcagcaatggttgtctgaagactcaggagcatttacggatttaacttcccttcccctctatcttcctcagactctagtgtctctttctcacactattgaacctgtgatgaaaacatctgtaactactagcccacagagtgacatgatgagggagcaactgcagctgtcagaggcgacaggaacgtgtctaggcgaacgactaaagcacctggaaaggctgatccggagttcaagggaagaggaagttgcctctgagctccatctctctgcgctgctagacatggtggacatttgagcagcctgacctgtggggagggggtctctcccgaagagtttctgtttttactcaaaataatgttattctcagatgcttgatgcactgttggaaatgtgattaatttaatcatgcagataaaccatttaaatgtca

SEQ ID NO: 154138 - DNA, 876 bp, Homo sapiens
  Payload ID: 10289
  Gene Symbol: MCM3AP
  Gene Name: minichromosome maintenance complex component 3 associated protein
  ENST ID: ENST00000426537
  CDS Start-End: 595-876
ggcagcgcgggcctcggggtcctggggcgagacggtgagcgtgggggctgggccggcgccaggggcgccgtttccttcccccacgcagctccgcgcgcccgggcctccacatcgtcgctaacggagcgttgcggcgccggcgacccctggcgagcccggggcgggacagtggccaggccggcctgggcccagcgcgtggcctccgccgtttcgggctgtgctgggtggaagattaggctccccgggcacgccgtccccgccgagaggcctcagcttcgtggcagcgccctcgtccttccagcccgctcgagggtggccgccagggcgcgatgaaggaatgtgagaaagtgcttagcgctccagccgctccgagggaagccaggtgggaggagatcccgaaacgctaaggttttgacagcgttacagtgaattctccggctgtagagattggaggaagtcgggagaaattcgtctctaagttgtaagcttgttctaaagacgaaggggaactccctagtgctacaggctgtttcaggaagccaattaattttgtacacataatacttaattaccttctaataattggagcagaagatgaacccaactaatcctttcagtgggcagcagcctagtgctttttcggcgtcttctagtaatgtaggaacacttccatctaagccgccatttcgatttggtcaaccttctctttttggacaaaacagtaccttatctgggaagagctcgggattttcacaggtatccagctttccagcgtcttctggagtaagtcattcctcttcagtgcaaacattagggttcacccaaacctcaagtgttggacccttttctggacttgagcacacttccacctttgtg

SEQ ID NO: 154139 - DNA, 4183 bp, Homo sapiens
  Payload ID: 10290
  Gene Symbol: MCM4
  Gene Name: minichromosome maintenance complex component 4
  Uniprot ID: P33991
  ENST ID: ENST00000262105
  CDS Start-End: 210-2801
gtctcgcggtttgggagcgctactcgccaggtggactcggagtccgcgagcgtcgtcggcaagcggccgcctttccacggtaaccgcgcgccggcggggagggcgtggcgcggagccgacgggaacgtccgcgctgcggagcagggcagggaagccgggaggcgggcccggcccgagcttgtccttgtcgcgcaggtactccgagcactatgtcgtccccggcgtcgaccccgagccgccgcggcagccggcgtggaagggccacccccgcccagacgcctcggagtgaggatgccaggtcatctccctctcagagacgtagaggcgaggattccacctccacgggggagttgcagccgatgccaacctcgcctggagtggacctgcagagccctgctgcgcaggacgtgctgttttccagccctccccaaatgcattcttcagctatccctcttgactttgatgttagttcaccactgacatacggcactcccagctctcgggtagagggaaccccaagaagtggtgttaggggcacacctgtgagacagaggcctgacctgggctctgcacagaagggcctgcaagtggatctgcagtctgacggggcagcagcagaagatatagtggcaagtgagcagtctctaggccaaaaacttgtgatctggggaacagatgtaaatgtggcagcatgcaaagaaaactttcagagatttcttcagcgttttattgaccctctggctaaagaagaagaaaatgttggcatagatattactgaacctctatacatgcaacgacttggggagattaatgttattggtgagccatttttaaatgtgaactgtgaacacatcaaatcatttgacaaaaatttgtacagacaactcatctcttacccacaggaagttattccaacttttgacatggctgtcaatgaaatcttctttgaccgttaccctgactcaatcttagaacatcagattcaagtaagaccattcaacgcattgaagactaagaatatgagaaacctgaatccagaagacattgaccagctcatcaccatcagcggcatggtgatcaggacatcccagctgattcccgagatgcaggaggccttcttccagtgccaagtgtgtgcccacacgacccgggtggagatggaccgcggccgcattgcagagcccagtgtgtgcgggcgctgccacaccacccacagcatggcactcatccacaaccgctccctcttctctgacaagcagatgatcaagcttcaggagtctccggaagacatgcctgcagggcagacaccacacacagttatcctgtttgctcacaatgatctcgttgacaaggtccagcctggggacagagtgaatgttacaggcatctatcgagctgtgcctattcgagtcaatccaagagtgagtaatgtgaagtctgtctacaaaacccacattgatgtcattcattatcggaaaacggatgcaaaacgtctgcatggccttgatgaagaagcagaacagaaacttttttcagagaaacgtgtggaattgcttaaggaactttccaggaaaccagacatttatgagaggcttgcttcagccttggctccaagcatttatgaacatgaagatataaagaagggaattttgcttcagctctttggcgggacaaggaaggattttagtcacactggaaggggcaaatttcgggctgagatcaacatcttgctgtgtggcgaccctggtaccagcaagtcccagctgctgcagtacgtgtacaacctcgtccccaggggccagtacacgtctgggaagggctccagtgcagttggcctcactgcgtacgtaatgaaagaccctgagacaaggcagctggtcctgcagacaggtgctcttgtcctgagtgacaacggcatctgctgtatcgatgagttcgacaagatgaatgaaagtacaagatcggtattgcatgaagtcatggaacagcagactctgtccattgcaaaggctgggatcatctgtcagctcaatgcgcgcacctctgtcctggcagcagcaaatcccattgagtctcagtggaatcctaaaaaaacaaccattgaaaacatccagctgcctcatactttattatcaaggtttgatttgatcttcctcttgctggaccctcaggacgaagcctatgacaggcgtctggctcaccacctggtcgcactgtactaccagagcgaggagcaggcagaggaggagctcctggacatggcggtgctaaaggactacattgcctacgcgcacagcaccatcatgccgcggctaagtgaggaagccagccaggctctcatcgaggcttatgtagacatgaggaagattggcagtagccggggaatggtttctgcataccctcgacagctagagtcattaatccgcttagcagaagcccatgctaaagtaagattgtctaacaaagttgaagccattgatgtggaagaggccaaacgcctccatcgggaagctctgaagcagtctgcaactgatccccggactggcatcgtggacatatctattcttactacggggatgagtgccacctctcgtaaacggaaagaagaattagctgaagcattgaaaaagcttattttatctaagggcaaaacaccagctctaaaataccagcaactttttgaagatattcggggacaatctgacatagcaattactaaagatatgtttgaagaagcactgcgtgccctggcagatgatgatttcctgacagtgactgggaagaccgtgcgcttgctctgaagccttgtgagcaaggaaggctccctgcatgtcctgcttgctgcacgccacatgggtgtggtctgcatctcagttggccgccatcagtgtaaatagagcttaaagtcatggtttggctgcataaaaattttctaacttgggttcaatatttgtagtgaagtatctgttttcatttttttcacgttataaataaaaatactatgctggccgggcgcggtggctcacacctgtaatcccagcactttgggaggccaatgtgggtggatcatgaggtcaggagttcaagaccagcctagccaagatggtgaaaccccgtctctagtaaagataacaaaaaattagctgggcttgatggcatgcgcctgtaatcccagctactcgggaggttgaggcaggagaatcgcttaaacccaggcggcagaggttgcagtgagccaagatcgcgccactgcactccagcctcagcaatagagtgagactgtctcaaaaaaaaaaaaaaaaaaaaaacctgccaattttcaaacataccgtagagattattttcaggtgccattttatagtatagcagcagggcttttactctgtgtatgcacagatgcagtctggggcatggtttgtgtgctggactttctcatggccatcatcagtatgcttatggatttgatgacaggcatagcctgggcatatcacctcattggtaaagggctagagcctttcttttttatggcacttctttttttgagatagggtcttactctgtcaccctggctagagtacactggtacaatcacggctcaatgtaggcttaacctcctgggctcaggtgtatgtcactatgcccggctactttttgtattttttggtagagacggcttcgccacgttgcccaggctgcaagcgatatgcctaggctcaagcgatctgcccacctcaacttccggaagtgctgagattacaggtgtgagccactgcacccagcctttgttttattttttattttttgagaggtatgattctttctagagattttttctcatggctactattagatcaggaatgggtgattggagattattagattctaggttaacttctaccactttaccctaatacataaaactttttcctaaataaatgatggaaggaataatacttggttacctggcattatttttcagtaagaaaaaagctttactaaccactacatttatggaaatttgtaggggtaagtattttataggtcataaaaaacaccataatataacgaatctcattttctttaaatgtgaattaaatcctaacagtcatctttataaaatgaccataggctaaaatcttacgtgtaagtactactacaataaataatttctgaaacctttaaa

SEQ ID NO: 154140 - DNA, 547 bp, Homo sapiens
  Payload ID: 10290
  Gene Symbol: MCM4
  Gene Name: minichromosome maintenance complex component 4
  ENST ID: ENST00000524086
  CDS Start-End: 72-317
ctcgccaggtggactcggagtccgcgagcgtcgtcggcaagcggccgcctttccacggtactccgagcactatgtcgtccccggcgtcgaccccgagccgccgcggcagccggcgtggaagggccacccccgcccagacgcctcggagtgaggatgccaggtcatctccctctcagagacgtagaggcgaggattccacctccacgggggagttgcagccgatgccaacctcgcctggagtggacctgcagagccctgctgcgcaggacgtgctgttttccagccctccccaaatgcattcttcagttcaccactgacatacggcactcccagctctcgggtagagggaaccccaagaagtggtgttaggggcacacctgtgagacagaggcctgacctgggctctgcacagaagggcctgcaagtggatctgcagtctgacggggcagcagcagaagatatagtggcaagtgagcagtctctaggccaaaaacttgtgatctggggaacagatgtaaatgtggcagcatgcaaagaaaactttcag

SEQ ID NO: 154141 - DNA, 839 bp, Homo sapiens
  Payload ID: 10290
  Gene Symbol: MCM4
  Gene Name: minichromosome maintenance complex component 4
  ENST ID: ENST00000520637
  CDS Start-End: 4-839
gacatggctgtcaatgaaatcttctttgaccgttaccctgactcaatcttagaacatcagattcaagtaagaccattcaacgcattgaagactaagaatatgagaaacctgaatccagaagacattgaccagctcatcaccatcagcggcatggtgatcaggacatcccagctgattcccgagatgcaggaggccttcttccagtgccaaatcaagcttcaggagtctccggaagacatgcctgcagggcagacaccacacacagttatcctgtttgctcacaatgatctcgttgacaaggtccagcctggggacagagtgaatgttacaggcatctatcgagctgtgcctattcgagtcaatccaagagtgagtaatgtgaagtctgtctacaaaacccacattgatgtcattcattatcggaaaacggatgcaaaacgtctgcatggccttgatgaagaagcagaacagaaacttttttcagagaaacgtgtggaattgcttaaggaactttccaggaaaccagacatttatgagaggcttgcttcagccttggctccaagcatttatgaacatgaagatataaagaagggaattttgcttcagctctttggcgggacaaggaaggattttagtcacactggaaggggcaaatttcgggctgagatcaacatcttgctgtgtggcgaccctggtaccagcaagtcccagctgctgcagtacgtgtacaacctcgtccccaggggccagtacacgtctgggaagggctccagtgcagttggcctcactgcgtacgtaatgaaagaccctgagacaaggcagctggtcctgcagacagg

SEQ ID NO: 154142 - DNA, 734 bp, Homo sapiens
  Payload ID: 10290
  Gene Symbol: MCM4
  Gene Name: minichromosome maintenance complex component 4
  ENST ID: ENST00000519170
  CDS Start-End: 100-734
ctgttttgtgtgacacaagctcggagtgaggatgccaggtcatctccctctcagagacgtagaggcgaggattccacctccacgggggagttgcagccgatgccaacctcgcctggagtggacctgcagagccctgctgcgcaggacgtgctgttttccagccctccccaaatgcattcttcagctatccctcttgactttgatgttagttcaccactgacatacggcactcccagctctcgggtagagggaaccccaagaagtggtgttaggggcacacctgtgagacagaggcctgacctgggctctgcacagaagggcctgcaagtggatctgcagtctgacggggcagcagcagaagatatagtggcaagtgagcagtctctaggccaaaaacttgtgatctggggaacagatgtaaatgtggcagcatgcaaagaaaactttcagagatttcttcagcgttttattgaccctctggctaaagaagaagaaaatgttggcatagatattactgaacctctatacatgcaacgacttggggagattaatgttattggtgagccatttttaaatgtgaactgtgaacacatcaaatcatttgacaaaaatttgtacagacaactcatctcttacccacaggaagttattccaacttttgacatggctgtcaatgaaatcttctttgaccgttaccctgactcaatcttagaacatcagattcaagtaagacc

SEQ ID NO: 154143 - DNA, 4105 bp, Homo sapiens
  Payload ID: 10290
  Gene Symbol: MCM4
  Gene Name: minichromosome maintenance complex component 4
  Uniprot ID: P33991
  ENST ID: ENST00000523944
  CDS Start-End: 132-2723
aggggcggagacgaccttgccgccggcgggaactctgggtctcgcggtttgggagcgctactcgccaggtggactcggagtccgcgagcgtcgtcggcaagcggccgcctttccacggtactccgagcactatgtcgtccccggcgtcgaccccgagccgccgcggcagccggcgtggaagggccacccccgcccagacgcctcggagtgaggatgccaggtcatctccctctcagagacgtagaggcgaggattccacctccacgggggagttgcagccgatgccaacctcgcctggagtggacctgcagagccctgctgcgcaggacgtgctgttttccagccctccccaaatgcattcttcagctatccctcttgactttgatgttagttcaccactgacatacggcactcccagctctcgggtagagggaaccccaagaagtggtgttaggggcacacctgtgagacagaggcctgacctgggctctgcacagaagggcctgcaagtggatctgcagtctgacggggcagcagcagaagatatagtggcaagtgagcagtctctaggccaaaaacttgtgatctggggaacagatgtaaatgtggcagcatgcaaagaaaactttcagagatttcttcagcgttttattgaccctctggctaaagaagaagaaaatgttggcatagatattactgaacctctatacatgcaacgacttggggagattaatgttattggtgagccatttttaaatgtgaactgtgaacacatcaaatcatttgacaaaaatttgtacagacaactcatctcttacccacaggaagttattccaacttttgacatggctgtcaatgaaatcttctttgaccgttaccctgactcaatcttagaacatcagattcaagtaagaccattcaacgcattgaagactaagaatatgagaaacctgaatccagaagacattgaccagctcatcaccatcagcggcatggtgatcaggacatcccagctgattcccgagatgcaggaggccttcttccagtgccaagtgtgtgcccacacgacccgggtggagatggaccgcggccgcattgcagagcccagtgtgtgcgggcgctgccacaccacccacagcatggcactcatccacaaccgctccctcttctctgacaagcagatgatcaagcttcaggagtctccggaagacatgcctgcagggcagacaccacacacagttatcctgtttgctcacaatgatctcgttgacaaggtccagcctggggacagagtgaatgttacaggcatctatcgagctgtgcctattcgagtcaatccaagagtgagtaatgtgaagtctgtctacaaaacccacattgatgtcattcattatcggaaaacggatgcaaaacgtctgcatggccttgatgaagaagcagaacagaaacttttttcagagaaacgtgtggaattgcttaaggaactttccaggaaaccagacatttatgagaggcttgcttcagccttggctccaagcatttatgaacatgaagatataaagaagggaattttgcttcagctctttggcgggacaaggaaggattttagtcacactggaaggggcaaatttcgggctgagatcaacatcttgctgtgtggcgaccctggtaccagcaagtcccagctgctgcagtacgtgtacaacctcgtccccaggggccagtacacgtctgggaagggctccagtgcagttggcctcactgcgtacgtaatgaaagaccctgagacaaggcagctggtcctgcagacaggtgctcttgtcctgagtgacaacggcatctgctgtatcgatgagttcgacaagatgaatgaaagtacaagatcggtattgcatgaagtcatggaacagcagactctgtccattgcaaaggctgggatcatctgtcagctcaatgcgcgcacctctgtcctggcagcagcaaatcccattgagtctcagtggaatcctaaaaaaacaaccattgaaaacatccagctgcctcatactttattatcaaggtttgatttgatcttcctcttgctggaccctcaggacgaagcctatgacaggcgtctggctcaccacctggtcgcactgtactaccagagcgaggagcaggcagaggaggagctcctggacatggcggtgctaaaggactacattgcctacgcgcacagcaccatcatgccgcggctaagtgaggaagccagccaggctctcatcgaggcttatgtagacatgaggaagattggcagtagccggggaatggtttctgcataccctcgacagctagagtcattaatccgcttagcagaagcccatgctaaagtaagattgtctaacaaagttgaagccattgatgtggaagaggccaaacgcctccatcgggaagctctgaagcagtctgcaactgatccccggactggcatcgtggacatatctattcttactacggggatgagtgccacctctcgtaaacggaaagaagaattagctgaagcattgaaaaagcttattttatctaagggcaaaacaccagctctaaaataccagcaactttttgaagatattcggggacaatctgacatagcaattactaaagatatgtttgaagaagcactgcgtgccctggcagatgatgatttcctgacagtgactgggaagaccgtgcgcttgctctgaagccttgtgagcaaggaaggctccctgcatgtcctgcttgctgcacgccacatgggtgtggtctgcatctcagttggccgccatcagtgtaaatagagcttaaagtcatggtttggctgcataaaaattttctaacttgggttcaatatttgtagtgaagtatctgttttcatttttttcacgttataaataaaaatactatgctggccgggcgcggtggctcacacctgtaatcccagcactttgggaggccaatgtgggtggatcatgaggtcaggagttcaagaccagcctagccaagatggtgaaaccccgtctctagtaaagataacaaaaaattagctgggcttgatggcatgcgcctgtaatcccagctactcgggaggttgaggcaggagaatcgcttaaacccaggcggcagaggttgcagtgagccaagatcgcgccactgcactccagcctcagcaatagagtgagactgtctcaaaaaaaaaaaaaaaaaaaaaacctgccaattttcaaacataccgtagagattattttcaggtgccattttatagtatagcagcagggcttttactctgtgtatgcacagatgcagtctggggcatggtttgtgtgctggactttctcatggccatcatcagtatgcttatggatttgatgacaggcatagcctgggcatatcacctcattggtaaagggctagagcctttcttttttatggcacttctttttttgagatagggtcttactctgtcaccctggctagagtacactggtacaatcacggctcaatgtaggcttaacctcctgggctcaggtgtatgtcactatgcccggctactttttgtattttttggtagagacggcttcgccacgttgcccaggctgcaagcgatatgcctaggctcaagcgatctgcccacctcaacttccggaagtgctgagattacaggtgtgagccactgcacccagcctttgttttattttttattttttgagaggtatgattctttctagagattttttctcatggctactattagatcaggaatgggtgattggagattattagattctaggttaacttctaccactttaccctaatacataaaactttttcctaaataaatgatggaaggaataatacttggttacctggcattatttttcagtaagaaaaaagctttactaaccactacatttatggaaatttgtaggggtaagtattttataggtcataaaaaacaccataatataacgaatctcattttctttaaatgtgaattaaatcctaacagtcatctttataaaatgaccataggctaaaatcttacgtgtaagtactactacaataaataatttctgaaacctttaaa

SEQ ID NO: 154144 - DNA, 572 bp, Homo sapiens
  Payload ID: 10290
  Gene Symbol: MCM4
  Gene Name: minichromosome maintenance complex component 4
  ENST ID: ENST00000518221
  CDS Start-End: 151-572
acgcgcggaggcggggctgcggggcgcggcggcaggaactttcccggggacccctgcgggaaggcctggccagtaagcgcgcctctttggcccgaatcaacatggaaacctaaggaaaaacgtctgacctgcggaggtactccgagcactatgtcgtccccggcgtcgaccccgagccgccgcggcagccggcgtggaagggccacccccgcccagacgcctcggagtgaggatgccaggtcatctccctctcagagacgtagaggcgaggattccacctccacgggggagttgcagccgatgccaacctcgcctggagtggacctgcagagccctgctgcgcaggacgtgctgttttccagccctccccaaatgcattcttcagctatccctcttgactttgatgttagttcaccactgacatacggcactcccagctctcgggtagagggaaccccaagaagtggtgttaggggcacacctgtgagacagaggcctgacctgggctctgcacagaagggcctgcaagtggatctgcagtctgacggggcagcagcagaagatatagtggc

SEQ ID NO: 154145 - DNA, 366 bp, Homo sapiens
  Payload ID: 10290
  Gene Symbol: MCM4
  Gene Name: minichromosome maintenance complex component 4
  ENST ID: ENST00000518382
  CDS Start-End: 1-83
ttgaaaacatccagctgcctcatactttattatcaagattggcagtagccggggaatggtttctgcataccctcgacagctagagtcattaatccgcttagcagaagcccatgctaaagtaagattgtctaacaaagttgaagccattgatgtggaagaggccaaacgcctccatcgggaagctctgaagcagtctgcaactgatccccggactggcatcgtggacatatctattcttactacggggatgagtgccacctctcgtaaacggaaagaagaattagctgaagcattgaaaaagcttattttatctaagggcaaaacaccagctctaaaataccagcaactttttgaagatattcgggg

SEQ ID NO: 154146 - DNA, 3534 bp, Homo sapiens
  Payload ID: 10291
  Gene Symbol: MCM5
  Gene Name: minichromosome maintenance complex component 5
  Uniprot ID: P33992
  ENST ID: ENST00000216122
  CDS Start-End: 155-2359
aatcgctggccgcgaggctccggcgaaccaatgggagcgcagcggctgcggcgtccgaacaccgcctcttgtttttcccgcgaaactcggcggctgagcgtggaggttcttgtctcccctggtttgtgaagtgcggaaaaccagaggcgcagtcatgtcgggattcgacgatcctggcattttctacagcgacagcttcgggggcgacgcccaggccgacgaggggcaggcccgcaaatcgcagctgcagaggcgcttcaaggagttcctgcggcagtaccgagtgggcaccgaccgcacgggcttcaccttcaaatacagggatgaactcaagcggcattacaacctgggggagtactggattgaggtggagatggaggatctggccagctttgatgaggacctggccgactacttgtacaagcagccagccgagcacctgcagctgctggaggaagctgccaaggaggtagctgatgaggtgacccggccccggccttctggggaggaggtgctccaggacatccaggtcatgctcaagtcggacgccagcccttccagcattcgtagcctgaagtcggacatgatgtcacacctggtgaagatccctggcatcatcatcgcggcctctgcggtccgtgccaaggccacccgcatctctatccagtgccgcagctgccgcaacaccctcaccaacattgccatgcgccctggcctcgagggctatgccctgcccaggaagtgcaacacagatcaggctgggcgccccaaatgcccattggacccgtacttcatcatgcccgacaaatgcaaatgcgtggacttccagaccctgaagctgcaggagctgcctgatgcagtcccccacggggagatgcccagacacatgcagctctactgcgacaggtacctgtgtgacaaggtcgtccctgggaacagggttaccatcatgggcatctactccatcaagaagtttggcctgactaccagcaggggccgtgacagggtgggcgtgggcatccgaagctcctacatccgtgtcctgggcatccaggtggacacagatggctctggccgcagctttgctggggccgtgagcccccaggaggaggaggagttccgtcgcctggctgccctcccaaatgtctatgaggtcatctccaagagcatcgccccctccatctttgggggcacagacatgaagaaggccattgcctgcctgctctttgggggctcccgaaagaggctccctgatggacttactcgccgaggagacatcaacctgctgatgctaggggaccctgggacagccaagtcccagcttctgaagtttgtggagaagtgttctcccattggggtatacacgtctgggaaaggcagcagcgcagctggactgacagcctcggtgatgagggacccttcgtcccggaatttcatcatggagggcggagccatggtcctggccgatggtggggtcgtctgtattgacgagtttgacaagatgcgagaagatgaccgtgtggcaatccacgaagccatggagcagcagaccatctctatcgccaaggctgggatcaccaccaccctgaactcccgctgctccgtcctggctgctgccaactcagtgttcggccgctgggatgagacgaagggggaggacaacattgacttcatgcccaccatcttgtcgcgcttcgacatgatcttcatcgtcaaggatgagcacaatgaggagagggatgtgatgctggccaagcatgtcatcactctgcacgtgagcgcactgacacagacacaggctgtggagggcgagattgacctggccaagctgaagaagtttattgcctactgccgagtgaagtgtggcccccggctgtcagcagaggctgcagagaaactgaagaaccgctacatcatcatgcggagcggggcccgtcagcacgagagggacagtgaccgccgctccagcatccccatcactgtgcggcagctggaggccattgtgcgcatcgcggaagccctcagcaagatgaagctgcagcccttcgccacagaggcagatgtggaggaggccctgcggctcttccaagtgtccacgttggatgctgccttgtccggtaccctgtcaggggtggagggcttcaccagccaggaggaccaggagatgctgagccgcatcgagaagcagctcaagcgccgctttgccattggctcccaggtgtctgagcacagcatcatcaaggacttcaccaagcagaaatacccggagcacgccatccacaaggtgctgcagctcatgctgcggcgcggcgagatccagcatcgcatgcagcgcaaggttctctaccgcctcaagtgagtcgcgccgcctcactggactcatggactcgcccacgcctcgcccctcctgccgctgcctgccattgacaatgttgctgggacctctgcctccccactgcagccctcgaacttcccaggcaccctcctttctgccccagaggaaggagctgtagtgtcctgctgcctctgggcgcccgcctctagcgcggttctgggaagtgtgcttttggcatccgttaataataaagccacggtgtgttcaggtatctgtgggtttgtgcactcggtgacctgtcacctccatcgtgccctcatggcagggtaagtgtgagggaacagggtctggaggcagactggccagggtttctgacttggatctgccactcagacttctgggtaagtcacgtgacttgagtgctccggtttcttcatctgtttagcggggctcataaagccactcccttgatgctgggaatccagtgagaccagggagtggggaagcgcttctcaaagtgtgtgattttgatccgcctcacctgttccccagtaacttattggggggctgcgagccgtggtgcggcggtcagactgcctggattcatggaccctctccatgccttagtttccttatctgtaagcaggctgatactagaacctgcttcacagggttgtgcttagggtcagtgagcagctgttagtgaggggaatgtagtggccaccaggcaggaactaggactccagccagttctttcctggtgggccacgtgtaactgtgtggccttgggcgagacatttcacttttctgtgcctgagtttatcagtaaactggagatggggggattcctcaccctgagttgtgaggattgaatgacagaaggcactagtgacagtgatgctggaggaaggagtgttgccaagtgcctcggtcactttgcctaatttcagaaagtcactctgagttggtatgttttgtgtttttaaaaaagctaggattcataaaattaaatagaaatcagtgaaataaaatatttgatatttaaaatacatttagaaatacaaagtgtcaagcaaaacgtgaatttggaaatctatggaacattagataaggtatttaaaagtaattgccatgtaaaaatgacacgaacttgaagtaagattatttgatttttctaaaaatacaagaaagcttggtgc

SEQ ID NO: 154147 - DNA, 2402 bp, Homo sapiens
  Payload ID: 10291
  Gene Symbol: MCM5
  Gene Name: minichromosome maintenance complex component 5
  ENST ID: ENST00000382011
  CDS Start-End: 81-2156
ttcccgcgaaactcggcggctgagcgtggaggttcttgtctcccctggtttgtgaagtgcggaaaaccagaggcgcagtcatgtcgggattcgacgatcctggcattttctacagcgacagcttcgggggcgacgcccaggccgacgaggggcaggcccgcaaatcgcagctgcagaggcgcttcaaggagttcctgcggcagtaccgagtgggcaccgaccgcacgggcttcaccttcaaatacagggatgaactcaagcggcattacaacctgggggagtactggattgaggtggagatggaggatctggccagctttgatgaggacctggccgactacttgtacaagcagccagccgagcacctgcagctgtcggacatgatgtcacacctggtgaagatccctggcatcatcatcgcggcctctgcggtccgtgccaaggccacccgcatctctatccagtgccgcagctgccgcaacaccctcaccaacattgccatgcgccctggcctcgagggctatgccctgcccaggaagtgcaacacagatcaggctgggcgccccaaatgcccattggacccgtacttcatcatgcccgacaaatgcaaatgcgtggacttccagaccctgaagctgcaggagctgcctgatgcagtcccccacggggagatgcccagacacatgcagctctactgcgacaggtacctgtgtgacaaggtcgtccctgggaacagggttaccatcatgggcatctactccatcaagaagtttggcctgactaccagcaggggccgtgacagggtgggcgtgggcatccgaagctcctacatccgtgtcctgggcatccaggtggacacagatggctctggccgcagctttgctggggccgtgagcccccaggaggaggaggagttccgtcgcctggctgccctcccaaatgtctatgaggtcatctccaagagcatcgccccctccatctttgggggcacagacatgaagaaggccattgcctgcctgctctttgggggctcccgaaagaggctccctgatggacttactcgccgaggagacatcaacctgctgatgctaggggaccctgggacagccaagtcccagcttctgaagtttgtggagaagtgttctcccattggggtatacacgtctgggaaaggcagcagcgcagctggactgacagcctcggtgatgagggacccttcgtcccggaatttcatcatggagggcggagccatggtcctggccgatggtggggtcgtctgtattgacgagtttgacaagatgcgagaagatgaccgtgtggcaatccacgaagccatggagcagcagaccatctctatcgccaaggctgggatcaccaccaccctgaactcccgctgctccgtcctggctgctgccaactcagtgttcggccgctgggatgagacgaagggggaggacaacattgacttcatgcccaccatcttgtcgcgcttcgacatgatcttcatcgtcaaggatgagcacaatgaggagagggatgtgatgctggccaagcatgtcatcactctgcacgtgagcgcactgacacagacacaggctgtggagggcgagattgacctggccaagctgaagaagtttattgcctactgccgagtgaagtgtggcccccggctgtcagcagaggctgcagagaaactgaagaaccgctacatcatcatgcggagcggggcccgtcagcacgagagggacagtgaccgccgctccagcatccccatcactgtgcggcagctggaggccattgtgcgcatcgcggaagccctcagcaagatgaagctgcagcccttcgccacagaggcagatgtggaggaggccctgcggctcttccaagtgtccacgttggatgctgccttgtccggtaccctgtcaggggtggagggcttcaccagccaggaggaccaggagatgctgagccgcatcgagaagcagctcaagcgccgctttgccattggctcccaggtgtctgagcacagcatcatcaaggacttcaccaagcagaaatacccggagcacgccatccacaaggtgctgcagctcatgctgcggcgcggcgagatccagcatcgcatgcagcgcaaggttctctaccgcctcaagtgagtcgcgccgcctcactggactcatggactcgcccacgcctcgcccctcctgccgctgcctgccattgacaatgttgctgggacctctgcctccccactgcagccctcgaacttcccaggcaccctcctttctgccccagaggaaggagctgtagtgtcctgctgcctctgggcgcccgcctctagcgcggttctgggaagtgtgcttttggcatccgttaataataaagccacggtgtgttcaggt

SEQ ID NO: 154148 - DNA, 739 bp, Homo sapiens
  Payload ID: 10291
  Gene Symbol: MCM5
  Gene Name: minichromosome maintenance complex component 5
  ENST ID: ENST00000416905
  CDS Start-End: 48-739
tcttgtctcccctggtttgtgaagtgcggaaaaccagaggcgcagtcatgtcgggattcgacgatcctggcattttctacagcgacagcttcgggggcgacgcccaggccgacgaggggcaggcccgcaaatcgcagctgcagaggcgcttcaaggagttcctgcggcagtaccgagtgggcaccgaccgcacgggcttcaccttcaaatacagtcttgcaccttcattgattgagcacctgctgcctgccagatactgttctgggtgctgggctgcagcactgaagctggacctggctcctgcttctagggatgaactcaagcggcattacaacctgggggagtactggattgaggtggagatggaggatctggccagctttgatgaggacctggccgactacttgtacaagcagccagccgagcacctgcagctgctggaggaagctgccaaggaggtagctgatgaggtgacccggccccggccttctggggaggaggtgctccaggacatccaggtcatgctcaagtcggacgccagcccttccagcattcgtagcctgaagtcggacatgatgtcacacctggtgaagatccctggcatcatcatcgcggcctctgcggtccgtgccaaggccacccgcatctctatccagtgccgcagctgccgcaacaccctcaccaacattgccatgcgccctggcctcgagggctatgccctgcccaggaagtgcaacac

SEQ ID NO: 154149 - DNA, 551 bp, Homo sapiens
  Payload ID: 10291
  Gene Symbol: MCM5
  Gene Name: minichromosome maintenance complex component 5
  ENST ID: ENST00000444778
  CDS Start-End: 100-551
gcgcagtcatgtcgggattcgacgatcctggcattttctacagcgacagcttcgggggcgacgcccagcccttccagcattcgtagcctgaagtcggacatgatgtcacacctggtgaagatccctggcatcatcatcgcggcctctgcggtccgtgccaaggccacccgcatctctatccagtgccgcagctgccgcaacaccctcaccaacattgccatgcgccctggcctcgagggctatgccctgcccaggaagtgcaacacagatcaggctgggcgccccaaatgcccattggacccgtacttcatcatgcccgacaaatgcaaatgcgtggacttccagaccctgaagctgcaggagctgcctgatgcagtcccccacggggagatgcccagacacatgcagctctactgcgacaggtacctgtgtgacaaggtcgtccctgggaacagggttaccatcatgggcatctactccatcaagaagtttggcctgactaccagcaggggccgtgacagggtgggcgtgggcatccgaagctcctacat

SEQ ID NO: 154150 - DNA, 450 bp, Homo sapiens
  Payload ID: 10291
  Gene Symbol: MCM5
  Gene Name: minichromosome maintenance complex component 5
  ENST ID: ENST00000451351
  CDS Start-End: 84-257
tttttcccgcgaaactcggcggctgagcgtggaggttcttgtctcccctggtttgtgaagtgcggaaaaccagaggcgcagtcatgtcgggattcgacgatcctggcattttctacagcgacagcttcgggggcgacgcccaggccgacgaggggcaggcccgcaaatcgcagctgcagaggcgcttcaaggagttcctgcggcagtaccgagtgggcaccgaccgcacgggcttcaccttcaaatacagcagctgatattgcccacctgtgtgccaggcactgcgctacaaagatgaaaagacgtgcttcttgtcctagagaagctcctaagtcagaggagtgagtcgtgaagaccaacagataacttccacggtggtcatttcctccacagaggaagggatgaactcaagcggcattacaacctgggggagtactggattgaggtgga

SEQ ID NO: 154151 - DNA, 3736 bp, Homo sapiens
  Payload ID: 10292
  Gene Symbol: MCM6
  Gene Name: minichromosome maintenance complex component 6
  Uniprot ID: Q14566
  ENST ID: ENST00000264156
  CDS Start-End: 62-2527
ggaaaaaagcgacttgtggcggtcgagcgtggcgcaggcgaatcctcggcactaagcaaatatggacctcgcggcggcagcggagccgggcgccggcagccagcacctggaggtccgcgacgaggtggccgagaagtgccagaaactgttcctggacttcttggaggagtttcagagcagcgatggagaaattaaatacttgcaattagcagaggaactgattcgtcctgagagaaacacattggttgtgagttttgtggacctggaacaatttaaccagcaactttccaccaccattcaagaggagttctatagagtttacccttacctgtgtcgggccttgaaaacattcgtcaaagaccgtaaagagatccctcttgccaaggatttttatgttgcattccaagacctgcctaccagacacaagattcgagagctcacctcatccagaattggtttgctcactcgcatcagtgggcaggtggtgcggactcacccagttcacccagagcttgtgagcggaacttttctgtgcttggactgtcagacagtgatcagggatgtagaacagcagttcaaatacacacagccaaacatctgccgaaatccagtttgtgccaacaggaggagattcttactggatacaaataaatcaagatttgttgattttcaaaaggttcgtattcaagagacccaagctgagcttcctcgagggagtatcccccgcagtttagaagtaattttaagggctgaagctgtggaatcagctcaagctggtgacaagtgtgactttacagggacactgattgttgtgcctgacgtctccaagcttagcacaccaggagcacgtgcagaaactaattcccgtgtcagtggtgttgatggatatgagacagaaggcattcgaggactccgggcccttggtgttagggacctttcttataggctggtctttcttgcctgctgtgttgcgccaaccaacccaaggtttggggggaaagagctcagagatgaggaacagacagctgagagcattaagaaccaaatgactgtgaaagaatgggagaaagtgtttgagatgagtcaagataaaaatctataccacaatctttgtaccagcctgttccctactatacatggcaatgatgaagtaaaacggggtgtcctgctgatgctctttggtggcgttccaaagacaacaggagaagggacctctcttcgaggggacataaatgtttgcattgttggtgacccaagtacagctaagagccaatttctcaagcacgtggaggagttcagccccagagctgtctacaccagtggtaaagcgtccagtgctgctggcttaacagcagctgttgtgagagatgaagaatctcatgagtttgtcattgaggctggagctttgatgttggctgataatggtgtgtgttgtattgatgaatttgataagatggacgtgcgggatcaagttgctattcatgaagctatggaacagcagaccatatccatcactaaagcaggagtgaaggctactctgaacgcccggacgtccattttggcagcagcaaacccaatcagtggacactatgacagatcaaaatcattgaaacagaatataaatttgtcagctcccatcatgtcccgattcgatctcttctttatccttgtggatgaatgtaatgaggttacagattatgccattgccaggcgcatagtagatttgcattcaagaattgaggaatcaattgatcgtgtctattccctcgatgatatcagaagatatcttctctttgcaagacagtttaaacccaagatttccaaagagtcagaggacttcattgtggagcaatataaacatctccgccagagagatggttctggagtgaccaagtcttcatggaggattacagtgcgacagcttgagagcatgattcgtctctctgaagctatggctcggatgcactgctgtgatgaggtccaacctaaacatgtgaaggaagctttccggttactgaataaatcaatcatccgtgtggaaacacctgatgtcaatctagatcaagaggaagagatccagatggaggtagatgagggtgctggtggcatcaatggtcatgctgacagccctgctcctgtgaacgggatcaatggctacaatgaagacataaatcaagagtctgctcccaaagcctccttaaggctgggcttctctgagtactgccgaatctctaaccttattgtgcttcacctcagaaaggtggaagaagaagaggacgagtcagcattaaagaggagcgagcttgttaactggtacttgaaggaaatcgaatcagagatagactctgaagaagaacttataaataaaaaaagaatcatagagaaagttattcatcgactcacacactatgatcatgttctaattgagctcacccaggctggattgaaaggctccacagagggaagtgagagctatgaagaagatccctacttggtagttaaccctaactacttgctcgaagattgagatagtgaaagtaactgaccagagctgaggaactgtggcacagcacctcgtggcctggagcctggctggagctctgctagggacagaagtgtttctggaagtgatgcttccaggatttgttttcagaaacaagaattgagttgatggtcctatgtgtcacattcatcacaggtttcataccaacacaggcttcagcacttcctttggtgtgtttcctgtcccagtgaagttggaaccaaataatgtgtagtctctataaccaatacctttgttttcatgtgtaagaaaaggcccattacttttaaggtatgtgctgtcctattgagcaaataactttttttcaattgccagctactgcttttattcatcaaaataaaataacttgttctgaagttgtctattggatttctttctactgtaccctgattattacttccatctacttctgaatgtgagactttccctttttgcttaacctggagtgaagaggtagaactgtggtattatggatgaggtttctatgagaaggagtcattagagaactcatatgaaagctagaggccttagagatgactttccaaggttaattccagttgtttttttttttttttaagtttataaaagtttattatacttttttaaaattactctttagtaatttattttacttctgtgtcctaagggtaatttctcaggattgttttcaaattgcttttttaggggaaataggtcatttgctatattacaagcaatccccaaattttatggtcttccaggaaaagttattaccgtttatgatactaacagttcctgagacttagctatgatcagtatgttcatgaggtggagcagttcctgtgttgcagcttttaacaacagatggcattcattaaatcacaaagtatgttaaaggtcacaaaagcaaaataactgtctgaggctaaggcccacgtgggacagtctaatacccatgagtactcaacttgccttgatgtctgagctttccagtgcaatgtgaatttgagcagccagaaatctattagtagaaagcaagacagattaatataggttaaaacaatgatttaaatatgtttctcccaataattatctctttccctggaatcaacttgtatgaaaccttgtcaaaatgtactccacaagtatgtacaattaagtattttaaaaataaatggcaaacattaaaaacaa

SEQ ID NO: 154152 - DNA, 2957 bp, Homo sapiens
  Payload ID: 10293
  Gene Symbol: MCM7
  Gene Name: minichromosome maintenance complex component 7
  Uniprot ID: P33993
  ENST ID: ENST00000303887
  CDS Start-End: 647-2806
agtcccgtcagcttccggtagaagagctcggccacatcccggccgccactgtccccgcggactggcgggtggaaggactcagtgaaggatcctgcgacacaggctggccctgggcgcccctcccgcccggcccctccgccccttcccagccccaagggtctaggatacagtctttgtagatgagcgggtcccccttggaggacagaatgaagaattgggaaatcatggccgttctggagagtagacaagaagacggcgaaagtcgggcctgccccgccctgcggccccggaacaaaagaacgcgtgtgcgctggccctttaagagcgattctcctccgcccgcgccagctcggaccgcgggaaacccggcgcctgcactaccccgcccggagattcccttccgacgcccgcaccgcctccccgtcactcattctaggcccgcacggtgattggcttgcggctagcgggaggtgaagaaggccgccttgtccgattggcccgcacgcagtggcgccggtcacgtggggggcgacgtttcgcgccaatttcggttggccggccacagtccaccgcgcggagattctcagcttccccaggagcaagacctctgagcccgccaagcgcggccgcacggccctcggcagcgatggcactgaaggactacgcgctagagaaggaaaaggttaagaagttcttacaagagttctaccaggatgatgaactcgggaagaagcagttcaagtatgggaaccagttggttcggctggctcatcgggaacaggtggctctgtatgtggacctggacgacgtagccgaggatgaccccgagttggtggactcaatttgtgagaatgccaggcgctacgcgaagctctttgctgatgccgtacaagagctgctgcctcagtacaaggagagggaagtggtaaataaagatgtcctggacgtttacattgagcatcggctaatgatggagcagcggagtcgggaccctgggatggtccgaagcccccagaaccagtaccctgctgaactcatgcgcagatttgagctgtattttcaaggccctagcagcaacaagcctcgtgtgatccgggaagtgcgggctgactctgtggggaagttggtaactgtgcgtggaatcgtcactcgtgtctctgaagtcaaacccaagatggtggtggccacttacacttgtgaccagtgtggggcagagacctaccagccgatccagtctcccactttcatgcctctgatcatgtgcccaagccaggagtgccaaaccaaccgctcaggagggcggctgtatctgcagacacggggctccagattcatcaaattccaggagatgaagatgcaagaacatagtgatcaggtgcctgtgggaaatatccctcgtagtatcacggtgctggtagaaggagagaacacaaggattgcccagcctggagaccacgtcagcgtcactggtattttcttgccaatcctgcgcactgggttccgacaggtggtacagggtttactctcagaaacctacctggaagcccatcggattgtgaagatgaacaagagtgaggatgatgagtctggggctggagagctcaccagggaggagctgaggcaaattgcagaggaggatttctacgaaaagctggcagcttcaatcgccccagaaatatacgggcatgaagatgtgaagaaggcactgctgctcctgctagtcgggggtgtggaccagtctcctcgaggcatgaaaatccggggcaacatcaacatctgtctgatgggggatcctggtgtggccaagtctcagctcctgtcatacattgatcgactggcgcctcgcagccagtacacaacaggccggggctcctcaggagtggggcttacggcagctgtgctgagagactccgtgagtggagaactgaccttagagggtggggccctggtgctggctgaccagggtgtgtgctgcattgatgagttcgacaagatggctgaggccgaccgcacagccatccacgaggtcatggagcagcagaccatctccattgccaaggccggcattctcaccacactcaatgcccgctgctccatcctggctgccgccaaccctgcctacgggcgctacaaccctcgccgcagcctggagcagaacatacagctacctgctgcactgctctcccggtttgacctcctctggctgattcaggaccggcccgaccgagacaatgacctacggttggcccagcacatcacctatgtgcaccagcacagccggcagcccccctcccagtttgaacctctggacatgaagctcatgaggcgttacatagccatgtgccgcgagaagcagcccatggtgccagagtctctggctgactacatcacagcagcatacgtggagatgaggcgagaggcttgggctagtaaggatgccacctatacttctgcccggaccctgctggctatcctgcgcctttccactgctctggcacgtctgagaatggtggatgtggtggagaaagaagatgtgaatgaagccatcaggctaatggagatgtcaaaggactctcttctaggagacaaggggcagacagctaggactcagagaccagcagatgtgatatttgccaccgtccgtgaactggtctcagggggccgaagtgtccggttctctgaggcagagcagcgctgtgtatctcgtggcttcacacccgcccagttccaggcggctctggatgaatatgaggagctcaatgtctggcaggtcaatgcttcccggacacggatcacttttgtctgattccagcctgcttgcaaccctggggtcctcttgttccctgctggcctgccccttgggaaggggcagtgatgcctttgaggggaaggaggagcccctctttctcccatgctgcacttactccttttgctaataaaagtgtttgtagattgtc

SEQ ID NO: 154153 - DNA, 1968 bp, Homo sapiens
  Payload ID: 10293
  Gene Symbol: MCM7
  Gene Name: minichromosome maintenance complex component 7
  Uniprot ID: P33993
  ENST ID: ENST00000343023
  CDS Start-End: 647-1816
agtcccgtcagcttccggtagaagagctcggccacatcccggccgccactgtccccgcggactggcgggtggaaggactcagtgaaggatcctgcgacacaggctggccctgggcgcccctcccgcccggcccctccgccccttcccagccccaagggtctaggatacagtctttgtagatgagcgggtcccccttggaggacagaatgaagaattgggaaatcatggccgttctggagagtagacaagaagacggcgaaagtcgggcctgccccgccctgcggccccggaacaaaagaacgcgtgtgcgctggccctttaagagcgattctcctccgcccgcgccagctcggaccgcgggaaacccggcgcctgcactaccccgcccggagattcccttccgacgcccgcaccgcctccccgtcactcattctaggcccgcacggtgattggcttgcggctagcgggaggtgaagaaggccgccttgtccgattggcccgcacgcagtggcgccggtcacgtggggggcgacgtttcgcgccaatttcggttggccggccacagtccaccgcgcggagattctcagcttccccaggagcaagacctctgagcccgccaagcgcggccgcacggccctcggcagcgatggcactgaaggactacgcgctagagaaggaaaaggttaagaagttcttacaagagttctaccaggatgatgaactcgggaagaagcagttcaagtatgggaaccagttggttcggctggctcatcgggaacaggtggctctgtatgtggacctggacgacgtagccgaggatgaccccgagttggtggactcaatttgtgagaatgccaggcgctacgcgaagctctttgctgatgccgtacaagagctgctgcctcagtacaaggagagggaagtggtaaataaagatgtcctggacgtttacattgagcatcggctaatgatggagcagcggagtcgggaccctgggatggtccgaagcccccagaaccagtaccctgctgaactcatgcgcagatttgagctgtattttcaaggccctagcagcaacaagcctcgtgtgatccgggaagtgcgggctgactctgtggggaagttggtaactgtgcgtggaatcgtcactcgtgtctctgaagtcaaacccaagatggtggtggccacttacacttgtgaccagtgtggggcagagacctaccagccgatccagtctcccactttcatgcctctgatcatgtgcccaagccaggagtgccaaaccaaccgctcaggagggcggctgtatctgcagacacggggctccagattcatcaaattccaggagatgaagatgcaagaacatagtgatcaggtgcctgtgggaaatatccctcgtagtatcacggtgctggtagaaggagagaacacaaggattgcccagcctggagaccacgtcagcgtcactggtattttcttgccaatcctgcgcactgggttccgacaggtggtacagggtttactctcagaaacctacctggaagcccatcggattgtgaagatgaacaagagtgaggatgatgagtctggggctggagagctcaccagggaggagctgaggcaaattgcagatgtgatatttgccaccgtccgtgaactggtctcagggggccgaagtgtccggttctctgaggcagagcagcgctgtgtatctcgtggcttcacacccgcccagttccaggcggctctggatgaatatgaggagctcaatgtctggcaggtcaatgcttcccggacacggatcacttttgtctgattccagcctgcttgcaaccctggggtcctcttgttccctgctggcctgccccttgggaaggggcagtgatgcctttgaggggaaggaggagcccctctttctcccatgctgcacttactccttttgctaataaaagtgtttgtagattgtca

SEQ ID NO: 154154 - DNA, 2975 bp, Homo sapiens
  Payload ID: 10293
  Gene Symbol: MCM7
  Gene Name: minichromosome maintenance complex component 7
  Uniprot ID: P33993
  ENST ID: ENST00000354230
  CDS Start-End: 1141-2772
agtggcgcgaggaggctggagggagtgtcgtgtaaacagtgtccttccgcgcggcggccgcggagagagctgcggcccgggggggcgtgcctgggatccggagcttcgctcgggcccgggaaaggcggcagtgggctgggatcgcggtgtctctgggtgtgatggccaatggctggactggctcccgccctgggcggaggaatcccgagctgtgaagcggctggaatccgggcccatgtgcttctttgtttactaagagcggaagcgatggcgggagcgggggtggggtgcggtggcggggtgcggtggcggaggtcccggtgaaatcaggggctaaggggacccaaagaaggcgggggatcataggggtggaaagaaagctgagaaccttgagaccggagtgtgaggggccaacggggaagggcgctagaattttaaactaaagtagggaccggaattcccctggggagatgttggatggccctgtgcactgccacgggctctttattcttcgctggttagaaacagacttgtgaaaaagagttatgcccactttggggagacttcgaaaaggttaagaagttcttacaagagttctaccaggatgatgaactcgggaagaagcagttcaagtatgggaaccagttggttcggctggctcatcgggaacaggtggctctgtatgtggacctggacgacgtagccgaggatgaccccgagttggtggactcaatttgtgagaatgccaggcgctacgcgaagctctttgctgatgccgtacaagagctgctgcctcagtacaaggagagggaagtggtaaataaagatgtcctggacgtttacattgagcatcggctaatgatggagcagcggagtcgggaccctgggatggtccgaagcccccagaaccagtaccctgctgaactcatgcgcagattgtgagtggtctctgtcgggaaagatgtagggattggttctccaggatcttgtttgtgactgttttctccccttagtgagctgtattttcaaggccctagcagcaacaagcctcgtgtgatccgggaagtgcgggctgactctgtggggaagttggtaactgtgcgtggaatcgtcactcgtgtctctgaagtcaaacccaagatggtggtggccacttacacttgtgaccagtgtggggcagagacctaccagccgatccagtctcccactttcatgcctctgatcatgtgcccaagccaggagtgccaaaccaaccgctcaggagggcggctgtatctgcagacacggggctccagattcatcaaattccaggagatgaagatgcaagaacatagtgatcaggtgcctgtgggaaatatccctcgtagtatcacggtgctggtagaaggagagaacacaaggattgcccagcctggagaccacgtcagcgtcactggtattttcttgccaatcctgcgcactgggttccgacaggtggtacagggtttactctcagaaacctacctggaagcccatcggattgtgaagatgaacaagagtgaggatgatgagtctggggctggagagctcaccagggaggagctgaggcaaattgcagaggaggatttctacgaaaagctggcagcttcaatcgccccagaaatatacgggcatgaagatgtgaagaaggcactgctgctcctgctagtcgggggtgtggaccagtctcctcgaggcatgaaaatccggggcaacatcaacatctgtctgatgggggatcctggtgtggccaagtctcagctcctgtcatacattgatcgactggcgcctcgcagccagtacacaacaggccggggctcctcaggagtggggcttacggcagctgtgctgagagactccgtgagtggagaactgaccttagagggtggggccctggtgctggctgaccagggtgtgtgctgcattgatgagttcgacaagatggctgaggccgaccgcacagccatccacgaggtcatggagcagcagaccatctccattgccaaggccggcattctcaccacactcaatgcccgctgctccatcctggctgccgccaaccctgcctacgggcgctacaaccctcgccgcagcctggagcagaacatacagctacctgctgcactgctctcccggtttgacctcctctggctgattcaggaccggcccgaccgagacaatgacctacggttggcccagcacatcacctatgtgcaccagcacagccggcagcccccctcccagtttgaacctctggacatgaagctcatgaggcgttacatagccatgtgccgcgagaagcagcccatggtgccagagtctctggctgactacatcacagcagcatacgtggagatgaggcgagaggcttgggctagtaaggatgccacctatacttctgcccggaccctgctggctatcctgcgcctttccactgctctggcacgtctgagaatggtggatgtggtggagaaagaagatgtgaatgaagccatcaggctaatggagatgtcaaaggactctcttctaggagacaaggggcagacagctaggactcagagaccagcagatgtgatatttgccaccgtccgtgaactggtctcagggggccgaagtgtccggttctctgaggcagagcagcgctgtgtatctcgtggcttcacacccgcccagttccaggcggctctggatgaatatgaggagctcaatgtctggcaggtcaatgcttcccggacacggatcacttttgtctgattccagcctgcttgcaaccctggggtcctcttgttccctgctggcctgccccttgggaaggggcagtgatgcctttgaggggaaggaggagcccctctttctcccatgctgcacttactccttttgctaataaaagtgtttgtagattgtcatcttctagcctgggcctgacttccattaaaacagggttttgtgcgtttttt

SEQ ID NO: 154155 - DNA, 1497 bp, Homo sapiens
  Payload ID: 10293
  Gene Symbol: MCM7
  Gene Name: minichromosome maintenance complex component 7
  ENST ID: ENST00000425308
  CDS Start-End: 948-1497
taggccccgggggcgggcaggccggggccgctgcgcgccgggattggccgtttgaggccgccctccgagcggaagtggagccgggcggaagtggcgcgaggaggctggagggagtgtcgtgtaaacagtgtccttccgcgcggcggccgcggagagagctgcggcccgggggggcgtgcctgggatccggagcttcgctcgggcccgggaaaggcggcagtgggctgggatcgcggtgtctctgggtgtgatggccaatggctggactggctcccgccctgggcggaggaatcccgagctgtgaagcggctggaatccgggcccatgtgcttctttgtttactaagagcggaagcgatggcgggagcgggggtggggtgcggtggcggggtgcggtggcggaggtcccggtgaaatcaggggctaaggggacccaaagaaggcgggggatcataggggtggaaagaaagctgagaaccttgagaccggagtgtgaggggccaacggggaagggcgctagaattttaaactaaagtagggaccggaattcccctggggagatgttggatggccctgtgcactgccacgggctctttattcttcgctggttagaaacagacttgtgaaaaagagttatgcccactttggggagacttcgaaaaggttaagaagttcttacaagagttctaccaggatgatgaactcgggaagaagcagttcaagtatgggaaccagttggttcggctggctcatcgggaacaggtggctctgtatgtggacctggacgacgtagccgaggatgaccccgagttggtggactcaatttgtgagaatgccaggcgctacgcgaagctctttgctgatgccgtacaagagctgctgcctcagtacaaggagagggaagtggtaaataaagatgtcctggacgtttacattgagcatcggctaatgatggagcagcggagtcgggaccctgggatggtccgaagcccccagaaccagtaccctgctgaactcatgcgcagatttgagctgtattttcaaggccctagcagcaacaagcctcgtgtgatccgggaagtgcgggctgactctgtggggaagttggtaactgtgcgtggaatcgtcactcgtgtctctgaagtcaaacccaagatggtggtggccacttacacttgtgaccagtgtggggcagagacctaccagccgatccagtctcccactttcatgcctctgatcatgtgcccaagccaggagtgccaaaccaaccgctcaggagggcggctgtatctgcagacacggggctccagattcatcaaattccaggagatgaagatgcaagaacatagtgatcaggtgcctgtgggaaatatccctcgtagtatcacggtgctggtagaaggagagaacacaaggattgcccagcctggagaccacgtcagcgtcactggtattttcttgccaatcctgcgcactgggttccgacaggtggtacagg

SEQ ID NO: 154156 - DNA, 648 bp, Homo sapiens
  Payload ID: 10293
  Gene Symbol: MCM7
  Gene Name: minichromosome maintenance complex component 7
  ENST ID: ENST00000491245
  CDS Start-End: 1-251
gggaacaggtggctctgtatgtggacctggacgacgtagccgaggatgaccccgagttggtggactcaatttgtgagaatgccagaccatctccattgccaaggccggcattctcaccacactcaatgcccgctgctccatcctggctgccgccaaccctgcctacgggcgctacaaccctcgccgcagcctggagcagaacatacagctacctgctgcactgctctcccggtttgacctcctctggctgattcaggaccggcccgaccgagacaatgacctacggttggcccagcacatcacctatgtgcaccagcacagccggcagcccccctcccagtttgaacctctggacatgaagctcatgaggcgttacatagccatgtgccgcgagaagcagcccatggtgccagagtctctggctgactacatcacagcagcatacgtggagatgaggcgagaggcttgggctagtaaggatgccacctatacttctgcccggaccctgctggctatcctgcgcctttccactgctctggcacgtctgagaatggtggatgtggtggagaaagaagatgtgaatgaagccatcaggctaatggagatgtcaaaggactctcttctaggagacaaggggcagacagctag

SEQ ID NO: 154157 - DNA, 3084 bp, Homo sapiens
  Payload ID: 10293
  Gene Symbol: MCM7
  Gene Name: minichromosome maintenance complex component 7
  Uniprot ID: P33993
  ENST ID: ENST00000621318
  CDS Start-End: 1250-2881
agtcccgtcagcttccggtagaagagctcggccacatcccggccgccactgtccccgcggactggcgggtggaaggactcagtgaaggatcctgcgacacaggctggccctgggcgcccctcccgcccggcccctccgccccttcccagccccaagggtctaggatacagtctttgtagatgagcgggtcccccttggaggacagaatgaagaattgggaaatcatggccgttctggagagtagacaagaagacggcgaaagtcgggcctgccccgccctgcggccccggaacaaaagaacgcgtgtgcgctggccctttaagagcgattctcctccgcccgcgccagctcggaccgcgggaaacccggcgcctgcactaccccgcccggagattcccttccgacgcccgcaccgcctccccgtcactcattctaggcccgcacggtgattggcttgcggctagcgggaggtgaagaaggccgccttgtccgattggcccgcacgcagtggcgccggtcacgtggggggcgacgtttcgcgccaatttcggttggccggccacagtccaccgcgcggagattctcagcttccccaggagcaagacctctgagcccgccaagcgcggccgcacggccctcggcagcgatggcactgaaggactacgcgctagagaaggaaaaggttaagaagttcttacaagagttctaccaggatgatgaactcgggaagaagcagttcaagtatgggaaccagttggttcggctggctcatcgggaacaggtggctctgtatgtggacctggacgacgtagccgaggatgaccccgagttggtggactcaatttgtgagaatgccaggcgctacgcgaagctctttgctgatgccgtacaagagctgctgcctcagtacaaggagagggaagtggtaaataaagatgtcctggacgtttacattgagcatcggctaatgatggagcagcggagtcgggaccctgggatggtccgaagcccccagaaccagtaccctgctgaactcatgcgcagattgtgagtggtctctgtcgggaaagatgtagggattggttctccaggatcttgtttgtgactgttttctccccttagtgagctgtattttcaaggccctagcagcaacaagcctcgtgtgatccgggaagtgcgggctgactctgtggggaagttggtaactgtgcgtggaatcgtcactcgtgtctctgaagtcaaacccaagatggtggtggccacttacacttgtgaccagtgtggggcagagacctaccagccgatccagtctcccactttcatgcctctgatcatgtgcccaagccaggagtgccaaaccaaccgctcaggagggcggctgtatctgcagacacggggctccagattcatcaaattccaggagatgaagatgcaagaacatagtgatcaggtgcctgtgggaaatatccctcgtagtatcacggtgctggtagaaggagagaacacaaggattgcccagcctggagaccacgtcagcgtcactggtattttcttgccaatcctgcgcactgggttccgacaggtggtacagggtttactctcagaaacctacctggaagcccatcggattgtgaagatgaacaagagtgaggatgatgagtctggggctggagagctcaccagggaggagctgaggcaaattgcagaggaggatttctacgaaaagctggcagcttcaatcgccccagaaatatacgggcatgaagatgtgaagaaggcactgctgctcctgctagtcgggggtgtggaccagtctcctcgaggcatgaaaatccggggcaacatcaacatctgtctgatgggggatcctggtgtggccaagtctcagctcctgtcatacattgatcgactggcgcctcgcagccagtacacaacaggccggggctcctcaggagtggggcttacggcagctgtgctgagagactccgtgagtggagaactgaccttagagggtggggccctggtgctggctgaccagggtgtgtgctgcattgatgagttcgacaagatggctgaggccgaccgcacagccatccacgaggtcatggagcagcagaccatctccattgccaaggccggcattctcaccacactcaatgcccgctgctccatcctggctgccgccaaccctgcctacgggcgctacaaccctcgccgcagcctggagcagaacatacagctacctgctgcactgctctcccggtttgacctcctctggctgattcaggaccggcccgaccgagacaatgacctacggttggcccagcacatcacctatgtgcaccagcacagccggcagcccccctcccagtttgaacctctggacatgaagctcatgaggcgttacatagccatgtgccgcgagaagcagcccatggtgccagagtctctggctgactacatcacagcagcatacgtggagatgaggcgagaggcttgggctagtaaggatgccacctatacttctgcccggaccctgctggctatcctgcgcctttccactgctctggcacgtctgagaatggtggatgtggtggagaaagaagatgtgaatgaagccatcaggctaatggagatgtcaaaggactctcttctaggagacaaggggcagacagctaggactcagagaccagcagatgtgatatttgccaccgtccgtgaactggtctcagggggccgaagtgtccggttctctgaggcagagcagcgctgtgtatctcgtggcttcacacccgcccagttccaggcggctctggatgaatatgaggagctcaatgtctggcaggtcaatgcttcccggacacggatcacttttgtctgattccagcctgcttgcaaccctggggtcctcttgttccctgctggcctgccccttgggaaggggcagtgatgcctttgaggggaaggaggagcccctctttctcccatgctgcacttactccttttgctaataaaagtgtttgtagattgtcatcttctagcctgggcctgacttccattaaaacagggttttgtgcgtttttt

SEQ ID NO: 154158 - DNA, 2043 bp, Homo sapiens
  Payload ID: 10294
  Gene Symbol: MCMDC2
  Gene Name: minichromosome maintenance domain containing 2
  ENST ID: ENST00000313616
  CDS Start-End: 137-2035
cctaatgccctggatcaggccatccaacttgtaggaatatcccaataggttttcacatcctttctatgagtttcgccatctatagcttttatcaacaattgtggtttaatcaattagaaatattaaccaggagaaaatgtcaaatctaaaaatgaaagaggcggccctcatctatcttgacagaagtggaggcctccaaaagtttatagatgattgcaagtactacaatgattcaaaacaaagctatgctgtctatcgattcaaaattttaataaatccctctgatgttgttgaattagatgctgagcttggaaatcacattttacaccaacctttaaaagctgctgaagtctttcaatcagtctgttttattgctgttaagactctctcattaattggacaattgcagactgaaacgcaaattaatatagtgctgaaattaacacatttacctcccctgccaagttatggtcttgatctttgtgagtttccacttgattatacatctcagagattttatatgatgcaaggaattgtgattgcaatgacaactataaccaagtatacacaaggggcaagatttctttgttcagatgaagcatgccctctttcaaaaggatttcagtatataagagtgcatgtgcctggtgctacagaatctgcaacgataagaaatgactttttgtgtaatctatgtgcatcttcacttcaagaagacagaaaatttagagtacttggtgataaacaaatagttgaaataattgccacaaaggcacttcgtgcttttcaaggatattctaacaaccagccatttaggtttcaatcacttacaattttcctaagagatgaatcagtgaataaaatgaatataggaaatgaatataaaattattggaattccaacctgtgtaaaaacctcacaaactgctgtctgtatagaagcaaatagcataactttttgtaattcaaaagttccttcaggaattagtgacaacttcaggtgtctcctctccttaacttccagctcatgctggaagtttacagcaatacttgccaatatctttgcatcacaaattacccctcctgggacttacaatttgctcaagctctgtttgttgatgagtctagtacagacaactgaccgtaacaaggaactggaagattgcctggatattttaattataacaagtgatactctactcatagacaggcttctgaattttagcataaaccttgtcccccgtggtatacgtcatctagtctctactgaaatttttcccactctatccaggaataagtatggaactggagcagttagcattcaggctggcagtgctttgctagctaaaggtggtatctgctttataggagacttggcttcacacaaaaaagataaacttgaacagcttcaaacagttctggagagcagaagcatcacagtgtacatcccaggaaagaagtttggggaggatattgatcaacagatgacttttccagttcagtgcagtttttggtcttttgttgatgtggattcatcttcaaggagaaatgcacagaaaatcaacactctaattggtcagatggattgcagtttgattccagctaaccttgtggaggcatttggtttattgattaactgcaacgagtcatctccctgccacccatttcttcctactgtgcaacacactttgaacaaagccattaatcctgaagggctgttttatgcggcttctagacagttcacaactgaagattttgaaaagctattggcttttgcaaagaatttgaatgtagaattcagcttggaagcagaaagaatgacccatggctattatctagcaagtcgcagaatcagaacaggctctgtatgtggatcaaagctgtcagcatctgcattaaaatatctcgttttcctatctgaagcccatgcacgactgaacttaaggaacaaagtgcttaaagaagatgtgctgattgcagccttactatttgaaacatccctcacattgaaatatggtaatgaattaaattattaatgatcact

SEQ ID NO: 154159 - DNA, 2373 bp, Homo sapiens
  Payload ID: 10294
  Gene Symbol: MCMDC2
  Gene Name: minichromosome maintenance domain containing 2
  Uniprot ID: Q4G0Z9
  ENST ID: ENST00000396592
  CDS Start-End: 172-1944
gggacgtgcgcgcatgcgcgctaggactccgctccgcctacgctgcaggcggagagcaaccgccaagcttggtgggagtcaaggttttcacatcctttctatgagtttcgccatctatagcttttatcaacaattgtggtttaatcaattagaaatattaaccaggagaaaatgtcaaatctaaaaatgaaagaggcggccctcatctatcttgacagaagtggaggcctccaaaagtttatagatgattgcaagtactacaatgattcaaaacaaagctatgctgtctatcgattcaaaattttaataaatccctctgatgttgttgaattagatgctgagcttggaaatcacattttacaccaacctttaaaagctgctgaagtctttcaatcagtctgttttattgctgttaagactctctcattaattggacaattgcagactgaaacgcaaattaatatagtgctgaaattaacacatttacctcccctgccaagttatggtcttgatctttgtgagtttccacttgattatacatctcagagattttatatgatgcaaggaattgtgattgcaatgacaactataaccaagtatacacaaggggcaagatttctttgttcagatgaagcatgccctctttcaaaaggatttcagtatataagagtgcatgtgcctggtgctacagaatctgcaacgataagaaatgactttttgtgtaatctatgtgcatcttcacttcaagaagacagaaaatttagagtacttggtgataaacaaatagttgaaataattgccacaaaggcacttcgtgcttttcaaggatattctaacaaccagccatttaggtttcaatcacttacaattttcctaagagatgaatcagtgaataaaatgaatataggaaatgaatataaaattattggaattccaacctgtgtaaaaacctcacaaactgctgtctgtatagaagcaaatagcataactttttgtaattcaaaagttccttcaggaattagtgacaacttcaggtgtctcctctccttaacttccagctcatgctggaagtttacagcaatacttgccaatatctttgcatcacaaattacccctcctgggacttacaatttgctcaagctctgtttgttgatgagtctagtacagacaactgaccgtaacaaggaactggaagattgcctggatattttaattataacaagtgatactctactcatagacaggcttctgaattttagcataaaccttgtcccccgtggtatacgtcatctagtctctactgaaatttttcccactctatccaggaataagtatggaactggagcagttagcattcaggctggcagtgctttgctagctaaaggtggtatctgctttataggagacttggcttcacacaaaaaagataaacttgaacagcttcaaacagttctggagagcagaagcatcacagtgtacatcccaggaaagaagtttggggaggatattgatcaacagatgacttttccagttcagtgcagtttttggtcttttgttgatgtggattcatcttcaaggagaaatgcacagaaaatcaacactctaattggtcagatggattgcagtttgattccagctaaccttgtggaggcatttggtttattgattaactgcaacgagtcatctccctgccacccatttcttcctactgtgcaacacactttgaacaaagccattaatcctgaagggctgttttatgcggcttctagacagttcacaactgaagattttgaaaagctattggcttttgcaaagaatttgaatgtagaattcagcttggaagcagaaagaatgacccatggctattatctagcaagtcgcagaatcagaacaggctctgtatgtggatcaaagctgtcagcatctgcattaaaatatctgtaggtattcaattcaagattttaaaatcagcattgagtttcaaatgatatgtttaattaaattgctaatttacctatttcacttgtttctctgcttgattgctagttggttggtttgtaaatggccttgttccaaaaggactaaaggcttcacaattccttttgttatatcatgttacatcattttaatctctaataatttttttactaaactgatttttattggatgccatatgagatatgtctgggaaaagtgcactgatttcaaatgcaaatccttgtttttaaaaatgtggctgttgggcgggcacggtggctcacacctgtaatcccagcactttgggagtccgagagggcagattgcctgaggtcaggagttcaagaccagcctgggcaacacagtaaaaccctgtctctaataaaatacagaaaa

SEQ ID NO: 154160 - DNA, 2372 bp, Homo sapiens
  Payload ID: 10294
  Gene Symbol: MCMDC2
  Gene Name: minichromosome maintenance domain containing 2
  ENST ID: ENST00000415737
  CDS Start-End: 94-285
tctaggttttcacatcctttctatgagtttcgccatctatagcttttatcaacaattgtggtttaatcaattagaaatattaaccaggagaaaatgtcaaatctaaaaatgaaagaggcggccctcatctatcttgacagaagtggaggcctccaaaagtttatagatgattgcaagtactacaatggtacgttcagcaaagatgctgagcttggaaatcacattttacaccaacctttaaaagctgctgaagtctttcaatcagtaagtcaaaaaaagaaataattttatgccacatggaatttttggtaactttttttgtttgaaatcacaggtctgttttattgctgttaagactctctcattaattggacaattgcagactgaaacgcaagatttcagtatataagagtgcatgtgcctggtgctacagaatctgcaacgataagaaatgactttttgtgtaatctatgtgcatcttcacttcaagaagacagaaaatttagagtacttggtgataaacaaatagttgaaataattgccacaaaggcacttcgtgcttttcaaggatattctaacaaccagccatttaggtttcaatcacttacaattttcctaagagatgaatcagtgaataaaatgaatataggaaatgaatataaaattattggaattccaacctgtgtaaaaacctcacaaactgctgtctgtatagaagcaaatagcataactttttgtaattcaaaagttccttcaggaattagtgacaacttcaggtgtctcctctccttaacttccagctcatgctggaagtttacagcaatacttgccaatatctttgcatcacaaattacccctcctgggacttacaatttgctcaagctctgtttgttgatgagtctagtacagacaactgaccgtaacaaggaactggaagattgcctggatattttaattataacaagtgatactctactcatagacaggcttctgaattttagcataaaccttgtcccccgtggtatacgtcatctagtctctactgaaatttttcccactctatccaggaataagtatggaactggagcagttagcattcaggctggcagtgctttgctagctaaaggtggtatctgctttataggagacttggcttcacacaaaaaagataaacttgaacagcttcaaacagttctggagagcagaagcatcacagtgtacatcccaggaaagaagtttggggaggatattgatcaacagatgacttttccagttcagtgcagtttttggtcttttgttgatgtggattcatcttcaaggagaaatgcacagaaaatcaacactctaattggtcagatggattgcagtttgattccagctaaccttgtggaggcatttggtttattgattaactgcaacgagtcatctccctgccacccatttcttcctactgtgcaacacactttgaacaaagccattaatcctgaagggctgttttatgcggcttctagacagttcacaactgaagattttgaaaagctattggcttttgcaaagaatttgaatgtagaattcagcttggaagcagaaagaatgacccatggctattatctagcaagtcgcagaatcagaacaggctctgtatgtggatcaaagctgtcagcatctgcattaaaatatctcgttttcctatctgaagcccatgcacgactgaacttaaggaacaaagtgcttaaagaagatgtgctgattgcagccttactatttgaaacatccctcacattgaaatatggggccactgtattttgtgttgctccgaatgcagtatttccatttgaactgtataatgaagaatacttagagcaaagggatctctatctgactcagtgccaacaacagctggaacaatttattgccacatatggacctgggacaactattttctctagtgatgaataagcaatttgaggaatttttgttcattcctacttaagcagtggagaaaaagtgtgactattttgagagtgactttgaagtaatgctttgataatactctgtacaggaatatattacaatactgtttttaaaaatataaaatatagtcccctcaaaactaattgctaatgggataaatactaatccaaacctctaaaaccaacagaattttaaaacttagaacaatgtggacaatttaaagtgataaagttgtcaaggagaatactataaagaaaaacctggttagcccagaataccagtggtgaacagataaaaatgtaaatgttgcaatttgagcagtgtgtaaaatggcaacctttatgtagttcactctactgtcacaagatggcaataactctttacctacaaattactct

SEQ ID NO: 154161 - DNA, 5096 bp, Homo sapiens
  Payload ID: 10294
  Gene Symbol: MCMDC2
  Gene Name: minichromosome maintenance domain containing 2
  Uniprot ID: Q4G0Z9
  ENST ID: ENST00000422365
  CDS Start-End: 172-2217
gggacgtgcgcgcatgcgcgctaggactccgctccgcctacgctgcaggcggagagcaaccgccaagcttggtgggagtcaaggttttcacatcctttctatgagtttcgccatctatagcttttatcaacaattgtggtttaatcaattagaaatattaaccaggagaaaatgtcaaatctaaaaatgaaagaggcggccctcatctatcttgacagaagtggaggcctccaaaagtttatagatgattgcaagtactacaatgattcaaaacaaagctatgctgtctatcgattcaaaattttaataaatccctctgatgttgttgaattagatgctgagcttggaaatcacattttacaccaacctttaaaagctgctgaagtctttcaatcagtctgttttattgctgttaagactctctcattaattggacaattgcagactgaaacgcaaattaatatagtgctgaaattaacacatttacctcccctgccaagttatggtcttgatctttgtgagtttccacttgattatacatctcagagattttatatgatgcaaggaattgtgattgcaatgacaactataaccaagtatacacaaggggcaagatttctttgttcagatgaagcatgccctctttcaaaaggatttcagtatataagagtgcatgtgcctggtgctacagaatctgcaacgataagaaatgactttttgtgtaatctatgtgcatcttcacttcaagaagacagaaaatttagagtacttggtgataaacaaatagttgaaataattgccacaaaggcacttcgtgcttttcaaggatattctaacaaccagccatttaggtttcaatcacttacaattttcctaagagatgaatcagtgaataaaatgaatataggaaatgaatataaaattattggaattccaacctgtgtaaaaacctcacaaactgctgtctgtatagaagcaaatagcataactttttgtaattcaaaagttccttcaggaattagtgacaacttcaggtgtctcctctccttaacttccagctcatgctggaagtttacagcaatacttgccaatatctttgcatcacaaattacccctcctgggacttacaatttgctcaagctctgtttgttgatgagtctagtacagacaactgaccgtaacaaggaactggaagattgcctggatattttaattataacaagtgatactctactcatagacaggcttctgaattttagcataaaccttgtcccccgtggtatacgtcatctagtctctactgaaatttttcccactctatccaggaataagtatggaactggagcagttagcattcaggctggcagtgctttgctagctaaaggtggtatctgctttataggagacttggcttcacacaaaaaagataaacttgaacagcttcaaacagttctggagagcagaagcatcacagtgtacatcccaggaaagaagtttggggaggatattgatcaacagatgacttttccagttcagtgcagtttttggtcttttgttgatgtggattcatcttcaaggagaaatgcacagaaaatcaacactctaattggtcagatggattgcagtttgattccagctaaccttgtggaggcatttggtttattgattaactgcaacgagtcatctccctgccacccatttcttcctactgtgcaacacactttgaacaaagccattaatcctgaagggctgttttatgcggcttctagacagttcacaactgaagattttgaaaagctattggcttttgcaaagaatttgaatgtagaattcagcttggaagcagaaagaatgacccatggctattatctagcaagtcgcagaatcagaacaggctctgtatgtggatcaaagctgtcagcatctgcattaaaatatctcgttttcctatctgaagcccatgcacgactgaacttaaggaacaaagtgcttaaagaagatgtgctgattgcagccttactatttgaaacatccctcacattgaaatatggggccactgtattttgtgttgctccgaatgcagtatttccatttgaactgtataatgaagaatacttagagcaaagggatctctatctgactcagtgccaacaacagctggaacaatttattgccacatatggacctgggacaactattttctctagtgatgaataagcaatttgaggaatttttgttcattcctacttaagcagtggagaaaaagtgtgactattttgagagtgactttgaagtaatgctttgataatactctgtacaggaatatattacaatactgtttttaaaaatataaaatatagtcccctcaaaactaattgctaatgggataaatactaatccaaacctctaaaaccaacagaattttaaaacttagaacaatgtggacaatttaaagtgataaagttgtcaaggagaatactataaagaaaaacctggttagcccagaataccagtggtgaacagataaaaatgtaaatgttgcaatttgagcagtgtgtaaaatggcaacctttatgtagttcactctactgtcacaagatggcaataactctttacctacaaattactctaaaacatttttcttccacttgtgaacttgctaaactgatgagtaaatactttatataacccgaagcttcaaatgtaaggccttttcatactttattactggcctgtccattacatactactgttttagaagccctaaatatggaatcgggaaaagccttggaagttttccatacgtatacgctaggttaaatgaaaaaaatactttacacggaaacaaggagccaataacttataaattggctctctaaccctaactggttacaagaaaggctccaaaaggcaaagaaaccaacttgcaaatctagtcctcatttttggagggaagatatctgctctgaaaagataggggcaccatgagaaaacaaatccatcttgtaaaatttataaatcctttttagttcagtttccataactttaataaaagatcagttctattcacagaaaagcaaaatgtcattaccaaattgccactttattaaccaagatgttaccatgcatcaattctttcaaaactggtcccttaacagagatgcttaactgtacagctggacctctcccactctccacaggacccggaggaagttgttcactattactgaatacctactagtagcagggagtaaacagtattagttttcagaagccaaaggtagtgtttttgttttttgtttttttgagatggggtctcgctctgtcatgcaggctggagtgcagtggtgttatcttggcactgcaacctccacctcccgggttcaagtgattctcctgctgggattacaggtgcactccaccatgactggctaatttttgtatttttagtagagacagggtttcaccatgttggccaggctggtcttgaactcccgacctcaggtgatctgcctgcctcagtctcccaaagtgctaagacaacaggtatgagccaacacgactggcgactgtagttttcaacaaaatacttacatattacagttctataatgttaagacgtttattttgtgcttctcaaatactacatttcaaacatgtctggctctctatggggggaaggcaaaacacattcctattttataaaactaggatccttttacaattggaaagtttaaaaacttttttttttggagacaggggctgtcaccgtttggagggttgtggcgccacctcagctccctgcagccttgaccttgcaagtaattctcccaccttaggcctccgagtagctgggactacagggacatgctaccaccctgggataacttctgcattttttgtagagatggaattttgccatgtttcccaggctggtctcaagtcatcctcccatctcagtacctcagcttcccagtgttgggattacaggagtgagccaccatgcatggcacaaagatggcttttatttacttatctatatttatatatacatatttatatgtagctgtcacccaagctgtagtgtactgatgcaatcatagctcactgccaccttaatctccccagctcaaaaaacccaacctcagtctcaaagatggttacttcaccacaaaaaaattaaaatgtttaagtttctcattaaagagtagaagtgtacattcagaaacaattatgggaggtaattcattaatattaaatatgccaacggtattttaaaggttattggagaattagaagggggtggggtgcaggacgaaaaattaatgggtgcaatgtacaccattcaggtaatggctgcacaaaaagctcagactccaaactacttcatatacctatgcaacagaactgcacttataccccccaaatctatactgagggaagtgactaagatgttgctatacaggttttataccatttatcatataaaaattataaccttggtaaaaggaatttataagctagtactcaacaggagaaaagatttagctctaaaccttcacccagatataaattcagctttagaattcttgccaatttagtcctagacagactggtctgctcagtcatttctcttaacatagcatattgcttagttattacatgtactagtattaggatgacttttttgttcacaaagatgaaagcaaactgaataaaaaaggtgaaacctttatctgtaagggggaatttgattgctatttggtattaaagagttttaagattcaaccacctggtacaacagcaggctctgaaggggaagccagacagggaacctagaggtacaagcaatgtctccccagctgtcagcctcaatgagaatcaccacccataaataagctaattattgacaagattataatctttcgaatatgttcaaaacaggtctgactagtgactatgagaatggagctatttagagttgatttaaaagaaaacactttattgttcagcaattaaaagttagccaaatatgtatttttctccataatttattgtgatgttatcaacatcaagtaaaatgctcattttcatca

SEQ ID NO: 154162 - DNA, 2245 bp, Homo sapiens
  Payload ID: 10294
  Gene Symbol: MCMDC2
  Gene Name: minichromosome maintenance domain containing 2
  ENST ID: ENST00000428734
  CDS Start-End: 150-278
aggactccgctccgcctacgctgcaggcggagagcaaccgccaagcttggtgggagtcaaggttttcacatcctttctatgagtttcgccatctatagcttttatcaacaattgtggtttaatcaattagaaatattaaccaggagaaaatgtcaaatctaaaaatgaaagaggcggccctcatctatcttgacagaagtggaggcctccaaaagtttatagatgattgcaagtactacaatggtacgttcagcaaaggtctgttttattgctgttaagactctctcattaattggacaattgcagactgaaacgcaaattaatatagtgctgaaattaacacatttacctcccctgccaagttatggtcttgatctttgtgagtttccacttgattatacatctcagagattttatatgatgcaaggaattgtgattgcaatgacaactataaccaagtatacacaaggggcaagatttctttgttcagatgaagcatgccctctttcaaaaggatttcagtatataagagtgcatgtgcctggtgctacagaatctgcaacgataagaaatgactttttgtgtaatctatgtgcatcttcacttcaagaagacagaaaatttagagtacttggtgataaacaaatagttgaaataattgccacaaaggcacttcgtgcttttcaaggatattctaacaaccagccatttaggtttcaatcacttacaattttcctaagagatgaatcagtgaataaaatgaatataggaaatgaatataaaattattggaattccaacctgtgtaaaaacctcacaaactgctgtctgtatagaagcaaatagcataactttttgtaattcaaaagttccttcaggaattagtgacaacttcaggtgtctcctctccttaacttccagctcatgctggaagtttacagcaatacttgccaatatctttgcatcacaaattacccctcctgggacttacaatttgctcaagctctgtttgttgatgagtctagtacagacaactgaccgtaacaaggaactggaagattgcctggatattttaattataacaagtgatactctactcatagacaggcttctgaattttagcataaaccttgtcccccgtggtatacgtcatctagtctctactgaaatttttcccactctatccaggaataagtatggaactggagcagttagcattcaggctggcagtgctttgctagctaaaggtggtatctgctttataggagacttggcttcacacaaaaaagataaacttgaacagcttcaaacagttctggagagcagaagcatcacagtgtacatcccaggaaagaagtttggggaggatattgatcaacagatgacttttccagttcagtgcagtttttggtcttttgttgatgtggattcatcttcaaggagaaatgcacagaaaatcaacactctaattggtcagatggattgcagtttgattccagctaaccttgtggaggcatttggtttattgattaactgcaacgagtcatctccctgccacccatttcttcctactgtgcaacacactttgaacaaagccattaatcctgaagggctgttttatgcggcttctagacagttcacaactgaagattttgaaaagctattggcttttgcaaagaatttgaatgtagaattcagcttggaagcagaaagaatgacccatggctattatctagcaagtcgcagaatcagaacaggctctgtatgtggatcaaagctgtcagcatctgcattaaaatatctcgttttcctatctgaagcccatgcacgactgaacttaaggaacaaagtgcttaaagaagatgtgctgattgcagccttactatttgaaacatccctcacattgaaatatggggccactgtattttgtgttgctccgaatgcagtatttccatttgaactgtataatgaagaatacttagagcaaagggatctctatctgactcagtgccaacaacagctggaacaatttattgccacatatggacctgggacaactattttctctagtgatgaataagcaatttgaggaatttttgttcattcctacttaagcagtggagaaaaagtgtgactattttgagagtgactttgaagtaatgctttgataatactctgtacaggaatatattacaatactgtttttaaaaatataaaatatagtcccctcaaaactaattgctaat

SEQ ID NO: 154163 - DNA, 1831 bp, Homo sapiens
  Payload ID: 10294
  Gene Symbol: MCMDC2
  Gene Name: minichromosome maintenance domain containing 2
  ENST ID: ENST00000492775
  CDS Start-End: 131-1237
gctgcaggcggagagcaaccgccaagcttggtgggagtcaaggttttcacatcctttctatgagtttcgccatctatagcttttatcaacaattgtggtttaatcaattagaaatattaaccaggagaaaatgtcaaatctaaaaatgaaagaggcggccctcatctatcttgacagaagtggaggcctccaaaagtttatagatgattgcaagtactacaatgattcaaaacaaagctatgctgtctatcgattcaaaattttaataaatccctctgatgttgttgaattagatgctgagcttggaaatcacattttacaccaacctttaaaagctgctgaagtctttcaatcagtctgttttattgctgttaagactctctcattaattggacaattgcagactgaaacgcaaattaatatagtgctgaaattaacacatttacctcccctgccaagttatggtcttgatctttgtgagtttccacttgattatacatctcagagattttatatgatgcaaggaattgtgattgcaatgacaactataaccaagtatacacaaggggcaagatttctttgttcagatgaagcatgccctctttcaaaaggatttcagtatataagagtgcatgtgcctggtgctacagaatctgcaacgataagaaatgactttttgtgtaatctatgtgcatcttcacttcaagaagacagaaaatttagagtacttggtgataaacaaatagttgaaataattgccacaaaggcacttcgtgcttttcaaggatattctaacaaccagccatttaggtttcaatcacttacaattttcctaagagatgaatcagtgaataaaatgaatataggaaatgaatataaaattattggaattccaacctgtgtaaaaacctcacaaactgctgtctgtatagaagcaaatagcataactttttgtaattcaaaagttccttcaggaattagtgacaacttcaggtgtctcctctccttaacttccagctcatgctggaagtttacagcaatacttgccaatatctttgcatcacaaattacccctcctgggacttacaatttgctcaagctctgtttgttgatgagtctagtacagacaactgaccgtaacaaggaactggaagattgcctggatattttaattataacaagtgatactctactcatagacaggtatatatgtgacatgaatttttacaaatattaattggtcacagatttgcatacatcctttccatgagcattattacaagaagaatatttagaatttttctgagccagtataagtatttaaatcaatctttatcaataaaattcaaaacctttgaaagataaattgataagtgataagttgaattactccaattttcaacctatttccccactcagacctttgtaaataaatacatccttcccagccttcctttccccctattccctagctctgtattctctttctgtactttgttttgaatagtcttccccctaaggaacaaactaaccattttcttatttttcttcaatattccatcaataatattgactcactgcatccagataaggctgtcagaagtgccataattactatctggggggaacatcatcctaactttggagtaagcctctatttagcattttgtggctccccactagcaagtaccctttccttaaaacttgcttaaatattcacaaagttagaaataagctccctatttagtatcttgtatgcaaatccaaagcaaaaaataaatttacaaaatgaatttaaaatagaaaaaaataaaattgaaattaacaataa

SEQ ID NO: 154164 - DNA, 590 bp, Homo sapiens
  Payload ID: 10295
  Gene Symbol: MINOS1-NBL1
  Gene Name: MINOS1-NBL1 readthrough
  ENST ID: ENST00000602450
  CDS Start-End: 1-140
ggaagtgggaccggtgtctggcggatgcggtcgtgaagatagagatggggtttcaccatgttgcccaggctggtcttgaactcagggtccaaacgatccacctaccttggcctcccaacgtgccaggattacaggcatgagccaccacacctggtccatcttgataatttcatactctggcttggcaaagactgaagggaagccatggtgaatgcacagcaacttctggctctggaggccacgggcatgatgcttcgggtcctggtgggggctgtcctccctgccatgctactggctgccccaccacccatcaacaagctggcactgttcccagataagagtgcctggtgcgaagccaagaacatcacccagatcgtgggccacagcggctgtgaggccaagtccatccagaacagggcgtgcctaggacagtgcttcagctacagcgtccccaacaccttcccacagtccacagagtccctggttcactgtgactcctgcatgccagcccagtccatgtgggagattgtgacgctggagtgcccgggccacgaggaggtgcccagggtggacaagctggtggagaagat

SEQ ID NO: 154165 - DNA, 820 bp, Homo sapiens
  Payload ID: 10295
  Gene Symbol: MINOS1-NBL1
  Gene Name: MINOS1-NBL1 readthrough
  ENST ID: ENST00000602293
  CDS Start-End: 83-295
aggaagtgggaccggtgtctggcggatgcggtcgtgaagatagaatcctggtaattgatgtccacccgagaaatccctgcagatgttccagcctctgtctagtccagatagccacaggaagggtactggttttggattaggaattgttttctcacttaccttctttaaaagaagaatgtggccattagccttcggttctggcatgggattaggaatggcttattccaactgtcagcatgatttccaggctccatatcttctacatggaaaatatgtcaaagagcaggagcagtgacttcacctgagaacatcccagcgggaggacaagagaaatcatgtttattcctcaggaatactgaagtgccctggaaattccccaatggcttctcatcccatttggagaaaaagtcaaagtcgatacagtggactgtaggactctacaagacctggccttcttgggctctggaggccacgggcatgatgcttcgggtcctggtgggggctgtcctccctgccatgctactggctgccccaccacccatcaacaagctggcactgttcccagataagagtgcctggtgcgaagccaagaacatcacccagatcgtgggccacagcggctgtgaggccaagtccatccagaacagggcgtgcctaggacagtgcttcagctacagcgtccccaacaccttcccacagtccacagagtccctggttcactgtgactcctgcatgccagcccagtccatgtgggagattgtgacgctggagtgcccgggccacgaggaggtgcccagggtggacaagctggtggagaaga

SEQ ID NO: 154166 - DNA, 1623 bp, Homo sapiens
  Payload ID: 10295
  Gene Symbol: MINOS1-NBL1
  Gene Name: MINOS1-NBL1 readthrough
  ENST ID: ENST00000602662
  CDS Start-End: 151-696
gcgagactttcaggggtcggagcgcgggggccggccgagaggaaagctggaggcgcgggtggggaacatgtctgagtcggagctcggcaggaagtgggaccggtgtctggcggatgcggtcgtgaagatagggctctggaggccacgggcatgatgcttcgggtcctggtgggggctgtcctccctgccatgctactggctgccccaccacccatcaacaagctggcactgttcccagataagagtgcctggtgcgaagccaagaacatcacccagatcgtgggccacagcggctgtgaggccaagtccatccagaacagggcgtgcctaggacagtgcttcagctacagcgtccccaacaccttcccacagtccacagagtccctggttcactgtgactcctgcatgccagcccagtccatgtgggagattgtgacgctggagtgcccgggccacgaggaggtgcccagggtggacaagctggtggagaagatcctgcactgtagctgccaggcctgcggcaaggagcctagtcacgaggggctgagcgtctatgtgcagggcgaggacgggccgggatcccagcccggcacccaccctcacccccatccccacccccatcctggcgggcagacccctgagcccgaggacccccctggggccccccacacagaggaagagggggctgaggactgaggcccccccaactcttcctcccctctcatccccctgtggaatgttgggtctcactctctggggaagtcaggggagaagctgaagcccccctttggcactggatggacttggcttcagactcggacttgaatgctgcccggttgccatggagatctgaaggggcggggttagagccaagctgcacaatttaatatattcaagagtggggggaggaagcagaggtcttcagggctctttttttggggggggtggtctcttcctgtctggcttctagagatgtgcctgtgggagggggaggaagttggctgagccattgagtgctgggggaggccatccaagatggcatgaatcgggctaaggtccctgggggtgcagatggtactgctgaggtcccgggcttagtgtgagcatcttgccagcctcaggcttgagggagggctgggctagaaagaccactggcagaaacaggaggctccggcccacaggtttccccaaggcctctcaccccacttcccatctccagggaagcgtcgccccagtggcactgaagtggccctccctcagcggaggggtttgggagtcaggcctgggcaggaccctgctgactcgtggcgcgggagctgggagccaggctctccgggcctttctctggcttccttggcttgcctggtgggggaaggggaggaggggaagaaggaaagggaagagtcttccaaggccagaaggagggggacaaccccccaagaccatccctgaagacgagcatccccctcctctccctgttagaaatgttagtgccccgcactgtgccccaagttctaggccccccagaaagctgccagagccggccgccttctcccctctcccagggatgctctttgtaaatatcggatgggtgtgggagtgaggggttacctccctcgcccc

SEQ ID NO: 154167 - DNA, 999 bp, Homo sapiens
  Payload ID: 10295
  Gene Symbol: MINOS1-NBL1
  Gene Name: MINOS1-NBL1 readthrough
  ENST ID: ENST00000602384
  CDS Start-End: 1-216
aggaagtgggaccggtgtctggcggatgcggtcgtgaagataggtactggttttggattaggaattgttttctcacttaccttctttaaaagaagaatgtggccattagccttcggttctggcatgggattaggaatggcttattccaactgtcagcatgatttccaggctccatatcttctacatggaaaatatgtcaaagagcaggagcagtgacttcacctgagaacatcccagcgggaggacaagagaaatcatgtttattcctcaggaatactgaagtgccctggaaattccccaatggcttctcatcccatttggagaaaaagtcaaagtcgatacagtggactgtaggactctacaagacctggccttcttgataaggaaaccaaggcccaggtgtgaaacaactagcacagagtcagagggcgatgcaggaacaatgtaaaccctgagcctcccctgatgagtccgaatggctcctcccagctccatacctggagcgagagtgcagaggtttggacccccgttgaggccagactgacaggattagaggaaacagctgggctgagtccgtgccctgcaggagggagctcacattcccggactctgggagagagcagctccccacagctcagtcacattccagggctctggaggccacgggcatgatgcttcgggtcctggtgggggctgtcctccctgccatgctactggctgccccaccacccatcaacaagctggcactgttcccagataagagtgcctggtgcgaagccaagaacatcacccagatcgtgggccacagcggctgtgaggccaagtccatccagaacagggcgtgcctaggacagtgcttcagctacagcgtccccaacaccttcccacagtccacagagtccctggttcactgtgactcctgcatgccagcccagtccatgtgggagattgtgacgctggagtgcccgggccacgaggaggtgcccagggtggacaagc

SEQ ID NO: 154168 - DNA, 7185 bp, Homo sapiens
  Payload ID: 10296
  Gene Symbol: MIPOL1
  Gene Name: mirror-image polydactyly 1
  Uniprot ID: Q8TD10
  ENST ID: ENST00000327441
  CDS Start-End: 467-1795
cgccccgctcctccgccggatcgtctgtgggtgagtctcgagccaggaggctctgagccagtggcgattggctgacgcggtggctgcgcactcggcctgagaaactcggcaagcgcgcagtgtcgactccccggtctatgccaggcgcatctcagagtttggcttagagattaaagctccttctatcttgtgatgccaccatcgcaaggttctcaaggttgttgtgggagaagagaaggctaaaggagctcatagaatgcctttaatgctaatccaaaagtaaatgagaaacttagaaaaagattgccaattccaaatcaacatatttagagaaaattggaaaaggagaagcttactacagctttatttgaggactttttaaagaacgctgggttctatctgtgagctgcaaatcttggagcaaaaaccagagacattgccagagcaaacaagaacagaaatacaaatggagaactggtcaaaagacataacccacagttatcttgaacaagaaactacggggataaataaaagtacgcagccagatgagcaactgactatgaattctgagaaaagtatgcatcggaaatccactgaattagttaatgaaataacatgtgagaacacagaatggccagggcagagatcaacgaattttcagatcatcagttcttatccagatgatgagtctgtttactgcactactgaaaaatacaacgttatggaacatagacataatgatatgcattatgaatgtatgactccttgtcaagttacttcagactcagataaagagaagacaatagcatttcttctaaaagaattggatattctcagaacaagcaataaaaagcttcagcagaaattggctaaagaagataaagaacagagaaaactaaagtttaagctggaactccaagagaaagaaacagaagctaaaattgctgaaaagacagcagctctggttgaagaagtgtattttgcgcagaaggaacgtgatgaagctgttatgtctagactgcaattagccattgaggagagagatgaagcaattgcacgagccaagcatatggaaatgtctctaaaagtgctagaaaatattaaccctgaagaaaatgacatgacattacaggaattactgaacagaataaacaatgcagacacagggatagctattcagaagaatggagctataattgtggatagaatctacaagaccaaggaatgtaaaatgagaataactgcagaagaaatgagtgcactaatagaagaacgggatgctgccttgtctaagtgcaaacggttagagcaggagcttcatcatgtgaaagagcagaaccagacttcagcaaacaacatgagacatctgactgctgaaaacaatcaagaacgtgctctgaaggcaaagttgttatctatgcaacaagccagagaaactgcagttcaacagtacaaaaaactggaagaggaaatccagacccttcgagtttactacagtttacacaaatctttatctcaagaagaaaatctgaaggatcagtttaactatacccttagtacatatgaagaagctttaaaaaacagagagaacattgtttccatcactcaacaacaaaatgaggaactggctactcaactgcaacaagctctgacagagcgagcaaatatggaattacaacttcaacatgccagagaggcctcccaagtggccaatgaaaaagttcaaaagttggaaaggctggtggatgtactgaggaagaaggttggaaccgggaccatgaggacagtgatctgattgaaaaaaaacgacagtctggggaagcgatcacatctggtgaccaggctgcttcattcaacactgtgtaaacaccaaagccttaacttagcaaacagttgttagaagtgggacactccaaccacattccaagctgagataaaatcaaatcacaaatgtttaaccactttgctgctgacttgagttatttatccaaatatattaactatagacttttaccaatgggtagctataaggttacagcttattttgtaactattttatatctcaatatctttaatataaatctttttactgagagatcattatagaaacatgttaaagttggttaggatcatatcttcacatatggccctttctgaatcaaagtgcggcaaagtaaatattgtctaagctttaatccactgtgttaggtcaaaacttcaaatacatgcatttttcaatatagggtatatttcttaactgatgagagaggcttagacatgagtgtgtagtcttccttcaatgcgtgtatgtaatctttgttagtataaaagatattaaatataggtgccaagaattaaatgtataatttgtttaataagagatggatatattaaaattacattcatcaaggcatgatttttgtttcactacaaataatgcaaactgttttcaataaaaagaggagactgttaatgtgtacttataaattcacattgtcagtattttttaatattgggtctgaataattatctgaattctacttaagctataagtctctgtcatttttgcttgaaaattagcatgcctctgtcttaaaagagaccatcaaacctattaagtattcttattgtttatctttttttaattgccatttgatttttattgtggaggaggaggatctaatatataatattcaatacaattgtaatgtagaaatataagaatttagaaaaaagtaaacttgccatttggttaaggttacctgctttttattttattccagaaataagatagttacagcatagcagtcatatgaagttatgaatagaactgagatttttatgtaattagttataggcaaaatactttcatatttttagattagacagacgaaagaccaagaggaaatgactgtgcctggaacaggatgaaatagacaagtagagatttaattagcaaaaattttgtagggaagtaaaattttttctaagtctatacgtttttaattcatctttaagattgagctaaattatctaccattgcctatttacaggataagtacattcaggacaatttattgtaccattctttcatataccatagcagattatccatttcaatttttttttactccacaggaaaatgtaagctactttgtcatagatcacaaaagaatcataatgctaacaaactctatttcttccttattaaatctgtatccattaaagtaacttttttaactatgagaattagaaaataagggacaacaggggttaaaaataaactgatttaatttgctctatagtcctaaagagaattatatcctctcatagaccaatgactctataatagagaaatatgtaatgatttggtcatgcatggagtcttgtctctgggctctatttgaaacgtgtaacagctccctatgtgaagaaacattatctttaaagtcatctgggaggtgcaggtaagtaaagagaaacaatttttgtcacaaagtagtccattcctgatctcacttaaaataaatcacaagtaaatttgaattttcggtttaatgttgaaagcagatgaacttttcttgagttattttgtcttttagaatacacaaaatatagtataaagacatttcacaatttccaaacaaatctttctacgcttaaatgatcaaattagaaaaaccaattcctataattaatatgcagaacttttatagaatatgatattataaagttaaatttgcaaaataattctaacatccactattgttcagtataggtaatctcccaaaaatatcacatcctcttgaaaatgaattgtctacaaaatttcaaatgcaaagtattacagccaaatattatcttaattaatttcttacacttaaaagtgtccatcaacagtgtgtcagatggtctttatatattttttctgtatgaaggaatagccttgcctactgaagataggttctctatgtattcaacaataatgcaactttagaagtattccacactgctgagaaatgttgctttgagtttgctttacacatcatcaactctaaatcctatagtaacatgagaattcacttcttcttgtaaaaataagtaatttacaggaaaggcaaaatgctaatactaacatttgtagcacttgatgatttacaaagtccttttacatctgttttttcatttgatcctatcgacaatcataataataataaattatatatataacccatataataacgatggtgatgataattttagtattactgtcattataattattattatattcattctacagatgaggaaacagactcagtaagccttggaatttgccaaggactggctaggacctagaactaagatcttataaccacactccatgcaactatgagtctctaaatctctctgtaagaaaaaaatttcaaagtaaagattttactcttgcaatttctgttgtgatagtaccatctctttcacatactacatacaaattccctaataatcaaaagattgtacacatttttttcaatgaagtacaataatgtgaactgcatgtgtaaacagcatcacattattaccacctctctatggtattatagtggcagtatgctttgcctcagccttcactaattaggaatattgtgacaattcattgctaataaaacataacatgagtctctttgtactgtttttaatttggcctgatgctaaaacctatcagcttagttttttaacatggtagtctaaacttcaaggcttgctctatctcctagagcaatttagagctaaaaccagtaataagcaaagttattggttataagcaaggtataagcagttaaagcaaagttattaattattaatatatgagaatttaaaattttataaataagttagaaattattaatgtattttaaatatggagtaaaatattttgctaatttttttcaatgataaagttgatcctttgtatatttccttattcaaataaattcagtcatcttcttatcaggttgcttatttatataatttgtttattttattaaaaatctagaatattaaagatttatacttttaatattgaatatagtttcgtagaaaaacattttatatgtactattcttaaagatcacaattatttttaaactttctattttcaaatacttgtgattaataaggcattctatgatgaaatagccatggcttatatatttttgtcttttcacatatgatgtgtttggaacccaaattttttactgattttattgtgttgttggtaactagtatttacagctaacctatctattcatattttacatatatatatatatatatacatgcacacacaccgatacatttaccttttaaaaaaatgatttataagtgaactgttaggctccagtgatttcagtgttttgttcatgttttattggaaatgcacgtggtttcttaggcttttaaacaaatacatggaatggttgaaagatttattttgctcgtgcttagctaaatatgtcatctctagaaaagatgtggtttgttttggcactgttttaaaaactcaaatattttaaacatttgttaagttggagcttgcacatttaaaccagcagcatacgttccagaagagcatctcaagttaccaaattttttgtaatccttttactagaaaaatcttttttgaagagtttttcttgtgcttgcttcggcagcatatatactgaaattagaaaaagaaaacttttcttttttattatatattttagtgtaagttaagttaaacttctaaaagttgaattatttaatgtaggacttcataaatagtatttgacaatgataaatgtgtatttttgagaatcattaaaatgtatacaatgatattcctttgcagaagtcttaatatgcataatttttaatctaattgtcttctaaatatagttttggtgtatgctggtattttagaagccaccaatttctggactatctgattattaacaaagatgtattttaatgcacaaactcaaatgtttaaaatatatatttactttgtactcaaataaaatcccctattgcaaatcctatacatatttcaatgcaattcttatacatcgatcttaatcaaatttataaatgtacaatcctgaagacagtgtactagatatgcactataaaatatattgcagtaaggaaacagattaagttcactgtcaaactgtctgacttccttaacaaatttaataaagataaatgtcaatatgaacaaatttgttaggtaccttaggaatctttcaaaactatttagatataaaataaaattatagtaataaaatattgaagagaaatatcatttttagtgaatatggttagaaagaacataagaagtgagatcaaattattttaattaaaaaaataggccaggtgcgatggctcacgcctgtaatcccagcattttgggaggccgaggcgggcggatcacaaggtcaggagattgagaccatcctggctaacacggtgaaaccccgtctctactaaaaaaagtacaaaaaagaagttagccgggcgtggtggcgggcgcctgtagtcccagctacttgggaggctgaggcaggagaatggcgtgaacccggaaggcagagcttgcagtgagccgagatcacgccattgcactccagcctgggtgacagagtgagactgtctcaaataataataataataataataataataataataataataatagactgactcaaatctaccataaagcacctctactcattttggaatatgtacgtggaattttgcttcaatagctgaaatctaaaaacactctttctgttgcatttgattattcaatcatgataaggtaaatgtaaacagactgtgtagcactctatcacctggagtgaacttagaatttacagcttagagtacatgactaaaagaggaatggagtggaagtgggcagtaggtgtctttggggcaaaaattctataaactggtgttatctaaactatcacattactttgttaaattattgtttcatcacgtatgacctttgtgatttgtcacacattttacttctacatatgcacataattgtaatttttttaactttaaaaagtcaattatgtttaagaaaatttttaaaataagaatgaacgtatgtgatatttactgtga

SEQ ID NO: 154169 - DNA, 6258 bp, Homo sapiens
  Payload ID: 10296
  Gene Symbol: MIPOL1
  Gene Name: mirror-image polydactyly 1
  Uniprot ID: Q8TD10
  ENST ID: ENST00000396294
  CDS Start-End: 643-1971
ccctgcggcgcgccgccgccccgtaggccccacgcgccgccccgctcctccgccggatcgtctgtgggtgagtctcgagccaggaggctctgagccagtggcgattggctgacgcggtggctgcgcactcggcctgagaaactcggcaagcgcgcagtgtcgactccccggtctatgccaggcgcatctcaggaacgaggtctcactatattgcccagactggtctcgaactcctgggctcaaacagtccccctgcgttggcctcccaaagtgatggaattacaggtgtgaatcactgcatctgactatggcaaggatctctgtcactgagagtttggcttagagattaaagctccttctatcttgtgatgccaccatcgcaaggttctcaaggttgttgtgggagaagagaaggctaaaggagctcatagaatgcctttaatgctaatccaaaagtaaatgagaaacttagaaaaagattgccaattccaaatcaacatatttagagaaaattggaaaaggagaagcttactacagctttatttgaggactttttaaagaacgctgggttctatctgtgagctgcaaatcttggagcaaaaaccagagacattgccagagcaaacaagaacagaaatacaaatggagaactggtcaaaagacataacccacagttatcttgaacaagaaactacggggataaataaaagtacgcagccagatgagcaactgactatgaattctgagaaaagtatgcatcggaaatccactgaattagttaatgaaataacatgtgagaacacagaatggccagggcagagatcaacgaattttcagatcatcagttcttatccagatgatgagtctgtttactgcactactgaaaaatacaacgttatggaacatagacataatgatatgcattatgaatgtatgactccttgtcaagttacttcagactcagataaagagaagacaatagcatttcttctaaaagaattggatattctcagaacaagcaataaaaagcttcagcagaaattggctaaagaagataaagaacagagaaaactaaagtttaagctggaactccaagagaaagaaacagaagctaaaattgctgaaaagacagcagctctggttgaagaagtgtattttgcgcagaaggaacgtgatgaagctgttatgtctagactgcaattagccattgaggagagagatgaagcaattgcacgagccaagcatatggaaatgtctctaaaagtgctagaaaatattaaccctgaagaaaatgacatgacattacaggaattactgaacagaataaacaatgcagacacagggatagctattcagaagaatggagctataattgtggatagaatctacaagaccaaggaatgtaaaatgagaataactgcagaagaaatgagtgcactaatagaagaacgggatgctgccttgtctaagtgcaaacggttagagcaggagcttcatcatgtgaaagagcagaaccagacttcagcaaacaacatgagacatctgactgctgaaaacaatcaagaacgtgctctgaaggcaaagttgttatctatgcaacaagccagagaaactgcagttcaacagtacaaaaaactggaagaggaaatccagacccttcgagtttactacagtttacacaaatctttatctcaagaagaaaatctgaaggatcagtttaactatacccttagtacatatgaagaagctttaaaaaacagagagaacattgtttccatcactcaacaacaaaatgaggaactggctactcaactgcaacaagctctgacagagcgagcaaatatggaattacaacttcaacatgccagagaggcctcccaagtggccaatgaaaaagttcaaaagttggaaaggctggtggatgtactgaggaagaaggttggaaccgggaccatgaggacagtgatctgattgaaaaaaaacgacagtctggggaagcgatcacatctggtgaccaggctgcttcattcaacactgtgtaaacaccaaagccttaacttagcaaacagttgttagaagtgggacactccaaccacattccaagctgagataaaatcaaatcacaaatgtttaaccactttgctgctgacttgagttatttatccaaatatattaactatagacttttaccaatgggtagctataaggttacagcttattttgtaactattttatatctcaatatctttaatataaatctttttactgagagatcattatagaaacatgttaaagttggttaggatcatatcttcacatatggccctttctgaatcaaagtgcggcaaagtaaatattgtctaagctttaatccactgtgttaggtcaaaacttcaaatacatgcatttttcaatatagggtatatttcttaactgatgagagaggcttagacatgagtgtgtagtcttccttcaatgcgtgtatgtaatctttgttagtataaaagatattaaatataggtgccaagaattaaatgtataatttgtttaataagagatggatatattaaaattacattcatcaaggcatgatttttgtttcactacaaataatgcaaactgttttcaataaaaagaggagactgttaatgtgtacttataaattcacattgtcagtattttttaatattgggtctgaataattatctgaattctacttaagctataagtctctgtcatttttgcttgaaaattagcatgcctctgtcttaaaagagaccatcaaacctattaagtattcttattgtttatctttttttaattgccatttgatttttattgtggaggaggaggatctaatatataatattcaatacaattgtaatgtagaaatataagaatttagaaaaaagtaaacttgccatttggttaaggttacctgctttttattttattccagaaataagatagttacagcatagcagtcatatgaagttatgaatagaactgagatttttatgtaattagttataggcaaaatactttcatatttttagattagacagacgaaagaccaagaggaaatgactgtgcctggaacaggatgaaatagacaagtagagatttaattagcaaaaattttgtagggaagtaaaattttttctaagtctatacgtttttaattcatctttaagattgagctaaattatctaccattgcctatttacaggataagtacattcaggacaatttattgtaccattctttcatataccatagcagattatccatttcaatttttttttactccacaggaaaatgtaagctactttgtcatagatcacaaaagaatcataatgctaacaaactctatttcttccttattaaatctgtatccattaaagtaacttttttaactatgagaattagaaaataagggacaacaggggttaaaaataaactgatttaatttgctctatagtcctaaagagaattatatcctctcatagaccaatgactctataatagagaaatatgtaatgatttggtcatgcatggagtcttgtctctgggctctatttgaaacgtgtaacagctccctatgtgaagaaacattatctttaaagtcatctgggaggtgcaggtaagtaaagagaaacaatttttgtcacaaagtagtccattcctgatctcacttaaaataaatcacaagtaaatttgaattttcggtttaatgttgaaagcagatgaacttttcttgagttattttgtcttttagaatacacaaaatatagtataaagacatttcacaatttccaaacaaatctttctacgcttaaatgatcaaattagaaaaaccaattcctataattaatatgcagaacttttatagaatatgatattataaagttaaatttgcaaaataattctaacatccactattgttcagtataggtaatctcccaaaaatatcacatcctcttgaaaatgaattgtctacaaaatttcaaatgcaaagtattacagccaaatattatcttaattaatttcttacacttaaaagtgtccatcaacagtgtgtcagatggtctttatatattttttctgtatgaaggaatagccttgcctactgaagataggttctctatgtattcaacaataatgcaactttagaagtattccacactgctgagaaatgttgctttgagtttgctttacacatcatcaactctaaatcctatagtaacatgagaattcacttcttcttgtaaaaataagtaatttacaggaaaggcaaaatgctaatactaacatttgtagcacttgatgatttacaaagtccttttacatctgttttttcatttgatcctatcgacaatcataataataataaattatatatataacccatataataacgatggtgatgataattttagtattactgtcattataattattattatattcattctacagatgaggaaacagactcagtaagccttggaatttgccaaggactggctaggacctagaactaagatcttataaccacactccatgcaactatgagtctctaaatctctctgtaagaaaaaaatttcaaagtaaagattttactcttgcaatttctgttgtgatagtaccatctctttcacatactacatacaaattccctaataatcaaaagattgtacacatttttttcaatgaagtacaataatgtgaactgcatgtgtaaacagcatcacattattaccacctctctatggtattatagtggcagtatgctttgcctcagccttcactaattaggaatattgtgacaattcattgctaataaaacataacatgagtctctttgtactgtttttaatttggcctgatgctaaaacctatcagcttagttttttaacatggtagtctaaacttcaaggcttgctctatctcctagagcaatttagagctaaaaccagtaataagcaaagttattggttataagcaaggtataagcagttaaagcaaagttattaattattaatatatgagaatttaaaattttataaataagttagaaattattaatgtattttaaatatggagtaaaatattttgctaatttttttcaatgataaagttgatcctttgtatatttccttattcaaataaattcagtcatcttcttatcaggttgcttatttatataatttgtttattttattaaaaatctagaatattaaagatttatacttttaatattgaatatagtttcgtagaaaaacattttatatgtactattcttaaagatcacaattatttttaaactttctattttcaaatacttgtgattaataaggcattctatgatgaaatagccatggcttatatatttttgtcttttcacatatgatgtgtttggaacccaaattttttactgattttattgtgttgttggtaactagtatttacagctaacctatctattcatattttacatatatatatatatatatacatgcacacacaccgatacatttaccttttaaaaaaatgatttataagtgaactgttaggctccagtgatttcagtgttttgttcatgttttattggaaatgcacgtggtttcttaggcttttaaacaaatacatggaatggttgaaagatttattttgctcgtgcttagctaaatatgtcatctctagaaaagatgtggtttgttttggcactgttttaaaaactcaaatattttaaacatttgttaagttggagcttgcacatttaaaccagcagcatacgttccagaagagcatctcaagttaccaaattttttgtaatccttttactagaaaaatcttttttgaagagtttttcttgtgcttgcttcggcagcatatatactgaaattagaaaaagaaaacttttcttttttattatatattttagtgtaagttaagttaaacttctaaaagttgaattatttaatgtaggacttcataaatagtatttgacaatgataaatgtgtatttttgagaatcattaaaatgtatacaatgatattcctttgcagaagtcttaatatgcataatttttaatctaattgtcttctaaatatagttttggtgtatgctggtattttagaagccaccaatttctggactatctgattattaacaaagatgtattttaatgcacaaactcaaatgtttaaaatatatatttactttgtactcaaataaaatcccctattgcaaatcct

SEQ ID NO: 154170 - DNA, 2389 bp, Homo sapiens
  Payload ID: 10296
  Gene Symbol: MIPOL1
  Gene Name: mirror-image polydactyly 1
  ENST ID: ENST00000539062
  CDS Start-End: 462-1697
gtggcgattggctgacgcggtggctgcgcactcggcctgagaaactcggcaagcgcgcagtgtcgactccccggtctatgccaggcgcatctcagctaatccaaaagtaaatgagaaacttagaaaaagattgccaattccaaatcaacatatttagagaaaattggaaaaggagaagcttactacagctttatttgaggactttttaaagaacgctgggttctatctgtgagctgcaaatcttggagcaaaaaccagagacattgccagagcaaacaagaacagaaatacaaatggagaactggtcaaaagtttgctacttcgcatatccctacttgaccttttttggagcaaatgcctttgtgaagtcttcctagagtcttccagacataacccacagttatcttgaacaagaaactacggggataaataaaagtacgcagccagatgagcaactgactatgaattctgagaaaagtatgcatcggaaatccactgaattagttaatgaaataacatgtgagaacacagaatggccagggcagagatcaacgaattttcagatcatcagttcttatccagatgatgagtctgtttactgcactactgaaaaatacaacgttatggaacatagacataatgatatgcattatgaatgtatgactccttgtcaagttacttcagactcagataaagagaagacaatagcatttcttctaaaagaattggatattctcagaacaagcaataaaaagcttcagcagaaattggctaaagaagataaagaacagagaaaactaaagtttaagctggaactccaagagaaagaaacagaagctaaaattgctgaaaagacagcagctctggttgaagaagtgtattttgcgcagaaggaacgtgatgaagctgttatgtctagactgcaattagccattgaggagagagatgaagcaattgcacgagccaagcatatggaaatgtctctaaaagtgctagaaaatattaaccctgaagaaaatgacatgacattacaggaattactgaacagaataaacaatgcagacacagggatagctattcagaagaatggagctataattgtggatagaatctacaagaccaaggaatgtaaaatgagaataactgcagaagaaatgagtgcactaatagaagaacgggatgctgccttgtctaagtgcaaacggttagagcaggagcttcatcatgtgaaagagcagaaccagacttcagcaaacaacatgagacatctgactgctgaaaacaatcaagaacgtgctctgaaggcaaagttgttatctatgcaacaagccagagaaactgcagttcaacagtacaaaaaactggaagaggaaatccagacccttcgagtttactacagtttacacaaatctttatctcaagaagaaaatctgaaggatcagtttaactatacccttagtacatatgaagaagctttaaaaaacagagagaacattgtttccatcactcaacaacaaaatgaggaactggctactcaactgcaacaagctctgacagagcgagcaaatatggaattacaacttcaacatgccagagaggcctcccaagtggccaatgaaaaagttcaaaagttggaaaggctggtggatgtactgaggaagaaggttggaaccgggaccatgaggacagtgatctgattgaaaaaaaacgacagtctggggaagcgatcacatctggtgaccaggctgcttcattcaacactgtgtaaacaccaaagccttaacttagcaaacagttgttagaagtgggacactccaaccacattccaagctgagataaaatcaaatcacaaatgtttaaccactttgctgctgacttgagttatttatccaaatatattaactatagacttttaccaatgggtagctataaggttacagcttattttgtaactattttatatctcaatatctttaatataaatctttttactgagagatcattatagaaacatgttaaagttggttaggatcatatcttcacatatggccctttctgaatcaaagtgcggcaaagtaaatattgtctaagctttaatccactgtgttaggtcaaaacttcaaatacatgcatttttcaatatagggtatatttcttaactgatgagagaggcttagacatgagtgtgtagtcttccttcaatgcgtgtatgtaatctttgttagtataaaagatattaaatataggtgccaagaattaaatgtataatttgtttaataagagatggatatattaaaattacattcatcaaggcatgatttttgtttcactacaaataatgcaaactgttttcaataaaaagaggagactgttaatgtgtacttataaa

SEQ ID NO: 154171 - DNA, 2073 bp, Homo sapiens
  Payload ID: 10296
  Gene Symbol: MIPOL1
  Gene Name: mirror-image polydactyly 1
  ENST ID: ENST00000545536
  CDS Start-End: 419-1693
ggaacgaggtctcactatattgcccagactggtctcgaactcctgggctcaaacagtccccctgcgttggcctcccaaagtgatggaattacaggtgtgaatcactgcatctgactatggcaaggatctctgtcactgagctaatccaaaagtaaatgagaaacttagaaaaagattgccaattccaaatcaacatatttagagaaaattggaaaaggagaagcttactacagctttatttgaggactttttaaagaacgctgggttctatctgtgagctgcaaatcttggagcaaaaaccagagacattgccagagcaaacaagaacagaaatacaaatggagaactggtcaaaagttatcttgaacaagaaactacggggataaataaaagtacgcagccagatgagcaactgactatgaattctgagaaaagtatgcatcggaaatccactgaattagttaatgaaataacatgtgagaacacagaatggccagggcagagatcaacgaattttcagatcatcagttcttatccagatgatgagtctgtttactgcactactgaaaaatacaacgttatggaacatagacataatgatatgcattatgaatgtatgactccttgtcaagttacttcagactcagataaagagaagacaatagcatttcttctaaaagaattggatattctcagaacaagcaataaaaagcttcagcagaaattggctaaagaagataaagaacagagaaaactaaagtttaagctggaactccaagagaaagaaacagaagctaaaattgctgaaaagacagcagctctggttgaagaagtgtattttgcgcagaaggaacgtgatgaagctgttatgtctagactgcaattagccattgaggagagagatgaagcaattgcacgagccaagcatatggaaatgtctctaaaagtgctagaaaatattaaccctgaagaaaatgacatgacattacaggaattactgaacagaataaacaatgcagacacagggatagctattcagaagaatggagctataattgtggatagaatctacaagaccaaggaatgtaaaatgagaataactgcagaagaaatgagtgcactaatagaagaacgggatgctgccttgtctaagtgcaaacggttagagcaggagcttcatcatgtgaaagagcagaaccagacttcagcaaacaacatgagacatctgactgctgaaaacaatcaagaacgtgctctgaaggcaaagttgttatctatgcaacaagccagagaaactgcagttcaacagtacaaaaaactggaagaggaaatccagacccttcgagtttactacagtttacacaaatctttatctcaagaagaaaatctgaaggatcagtttaactatacccttagtacatatgaagaagctttaaaaaacagagagaacattgtttccatcactcaacaacaaaatgaggaactggctactcaactgcaacaagctctgacagagcgagcaaatatggaattacaacttcaacatgccagagaggcctcccaagtggccaatgaaaaagttcaaaaatctcaaatacaaatctatttcattccaaataaaaaagatgaaagagaaaaattcctaatggataaaagaagaaagattgttgcacattcaaaacagaattcttgatagatacaaaatcatccaataaacttcagctagttttcagcattatatgcagttgatttgtccattcctcagtggaacttccaaatcatctaaaccagctttgtatgacactaagaataccctcattccttcagtgtctagctctgtgctgtgtttatttgcagaggaccctcatgcatggatccatataaatgaggcaaactgtgaagcagactagactgtgccgcttaccgtaaagtctttgagagaggaagattgtgtatatgaaaactgctaggcatgatatttacttataaggaagatttctatgtgtataacatcaagcaagatttttggttgaggttttatgctttcagtaaagaaaataaaagaagaaaacc

SEQ ID NO: 154172 - DNA, 5954 bp, Homo sapiens
  Payload ID: 10296
  Gene Symbol: MIPOL1
  Gene Name: mirror-image polydactyly 1
  Uniprot ID: Q8TD10
  ENST ID: ENST00000537471
  CDS Start-End: 339-1667
ggaacgaggtctcactatattgcccagactggtctcgaactcctgggctcaaacagtccccctgcgttggcctcccaaagtgatggaattacaggtgtgaatcactgcatctgactatggcaaggatctctgtcactgagctaatccaaaagtaaatgagaaacttagaaaaagattgccaattccaaatcaacatatttagagaaaattggaaaaggagaagcttactacagctttatttgaggactttttaaagaacgctgggttctatctgtgagctgcaaatcttggagcaaaaaccagagacattgccagagcaaacaagaacagaaatacaaatggagaactggtcaaaagacataacccacagttatcttgaacaagaaactacggggataaataaaagtacgcagccagatgagcaactgactatgaattctgagaaaagtatgcatcggaaatccactgaattagttaatgaaataacatgtgagaacacagaatggccagggcagagatcaacgaattttcagatcatcagttcttatccagatgatgagtctgtttactgcactactgaaaaatacaacgttatggaacatagacataatgatatgcattatgaatgtatgactccttgtcaagttacttcagactcagataaagagaagacaatagcatttcttctaaaagaattggatattctcagaacaagcaataaaaagcttcagcagaaattggctaaagaagataaagaacagagaaaactaaagtttaagctggaactccaagagaaagaaacagaagctaaaattgctgaaaagacagcagctctggttgaagaagtgtattttgcgcagaaggaacgtgatgaagctgttatgtctagactgcaattagccattgaggagagagatgaagcaattgcacgagccaagcatatggaaatgtctctaaaagtgctagaaaatattaaccctgaagaaaatgacatgacattacaggaattactgaacagaataaacaatgcagacacagggatagctattcagaagaatggagctataattgtggatagaatctacaagaccaaggaatgtaaaatgagaataactgcagaagaaatgagtgcactaatagaagaacgggatgctgccttgtctaagtgcaaacggttagagcaggagcttcatcatgtgaaagagcagaaccagacttcagcaaacaacatgagacatctgactgctgaaaacaatcaagaacgtgctctgaaggcaaagttgttatctatgcaacaagccagagaaactgcagttcaacagtacaaaaaactggaagaggaaatccagacccttcgagtttactacagtttacacaaatctttatctcaagaagaaaatctgaaggatcagtttaactatacccttagtacatatgaagaagctttaaaaaacagagagaacattgtttccatcactcaacaacaaaatgaggaactggctactcaactgcaacaagctctgacagagcgagcaaatatggaattacaacttcaacatgccagagaggcctcccaagtggccaatgaaaaagttcaaaagttggaaaggctggtggatgtactgaggaagaaggttggaaccgggaccatgaggacagtgatctgattgaaaaaaaacgacagtctggggaagcgatcacatctggtgaccaggctgcttcattcaacactgtgtaaacaccaaagccttaacttagcaaacagttgttagaagtgggacactccaaccacattccaagctgagataaaatcaaatcacaaatgtttaaccactttgctgctgacttgagttatttatccaaatatattaactatagacttttaccaatgggtagctataaggttacagcttattttgtaactattttatatctcaatatctttaatataaatctttttactgagagatcattatagaaacatgttaaagttggttaggatcatatcttcacatatggccctttctgaatcaaagtgcggcaaagtaaatattgtctaagctttaatccactgtgttaggtcaaaacttcaaatacatgcatttttcaatatagggtatatttcttaactgatgagagaggcttagacatgagtgtgtagtcttccttcaatgcgtgtatgtaatctttgttagtataaaagatattaaatataggtgccaagaattaaatgtataatttgtttaataagagatggatatattaaaattacattcatcaaggcatgatttttgtttcactacaaataatgcaaactgttttcaataaaaagaggagactgttaatgtgtacttataaattcacattgtcagtattttttaatattgggtctgaataattatctgaattctacttaagctataagtctctgtcatttttgcttgaaaattagcatgcctctgtcttaaaagagaccatcaaacctattaagtattcttattgtttatctttttttaattgccatttgatttttattgtggaggaggaggatctaatatataatattcaatacaattgtaatgtagaaatataagaatttagaaaaaagtaaacttgccatttggttaaggttacctgctttttattttattccagaaataagatagttacagcatagcagtcatatgaagttatgaatagaactgagatttttatgtaattagttataggcaaaatactttcatatttttagattagacagacgaaagaccaagaggaaatgactgtgcctggaacaggatgaaatagacaagtagagatttaattagcaaaaattttgtagggaagtaaaattttttctaagtctatacgtttttaattcatctttaagattgagctaaattatctaccattgcctatttacaggataagtacattcaggacaatttattgtaccattctttcatataccatagcagattatccatttcaatttttttttactccacaggaaaatgtaagctactttgtcatagatcacaaaagaatcataatgctaacaaactctatttcttccttattaaatctgtatccattaaagtaacttttttaactatgagaattagaaaataagggacaacaggggttaaaaataaactgatttaatttgctctatagtcctaaagagaattatatcctctcatagaccaatgactctataatagagaaatatgtaatgatttggtcatgcatggagtcttgtctctgggctctatttgaaacgtgtaacagctccctatgtgaagaaacattatctttaaagtcatctgggaggtgcaggtaagtaaagagaaacaatttttgtcacaaagtagtccattcctgatctcacttaaaataaatcacaagtaaatttgaattttcggtttaatgttgaaagcagatgaacttttcttgagttattttgtcttttagaatacacaaaatatagtataaagacatttcacaatttccaaacaaatctttctacgcttaaatgatcaaattagaaaaaccaattcctataattaatatgcagaacttttatagaatatgatattataaagttaaatttgcaaaataattctaacatccactattgttcagtataggtaatctcccaaaaatatcacatcctcttgaaaatgaattgtctacaaaatttcaaatgcaaagtattacagccaaatattatcttaattaatttcttacacttaaaagtgtccatcaacagtgtgtcagatggtctttatatattttttctgtatgaaggaatagccttgcctactgaagataggttctctatgtattcaacaataatgcaactttagaagtattccacactgctgagaaatgttgctttgagtttgctttacacatcatcaactctaaatcctatagtaacatgagaattcacttcttcttgtaaaaataagtaatttacaggaaaggcaaaatgctaatactaacatttgtagcacttgatgatttacaaagtccttttacatctgttttttcatttgatcctatcgacaatcataataataataaattatatatataacccatataataacgatggtgatgataattttagtattactgtcattataattattattatattcattctacagatgaggaaacagactcagtaagccttggaatttgccaaggactggctaggacctagaactaagatcttataaccacactccatgcaactatgagtctctaaatctctctgtaagaaaaaaatttcaaagtaaagattttactcttgcaatttctgttgtgatagtaccatctctttcacatactacatacaaattccctaataatcaaaagattgtacacatttttttcaatgaagtacaataatgtgaactgcatgtgtaaacagcatcacattattaccacctctctatggtattatagtggcagtatgctttgcctcagccttcactaattaggaatattgtgacaattcattgctaataaaacataacatgagtctctttgtactgtttttaatttggcctgatgctaaaacctatcagcttagttttttaacatggtagtctaaacttcaaggcttgctctatctcctagagcaatttagagctaaaaccagtaataagcaaagttattggttataagcaaggtataagcagttaaagcaaagttattaattattaatatatgagaatttaaaattttataaataagttagaaattattaatgtattttaaatatggagtaaaatattttgctaatttttttcaatgataaagttgatcctttgtatatttccttattcaaataaattcagtcatcttcttatcaggttgcttatttatataatttgtttattttattaaaaatctagaatattaaagatttatacttttaatattgaatatagtttcgtagaaaaacattttatatgtactattcttaaagatcacaattatttttaaactttctattttcaaatacttgtgattaataaggcattctatgatgaaatagccatggcttatatatttttgtcttttcacatatgatgtgtttggaacccaaattttttactgattttattgtgttgttggtaactagtatttacagctaacctatctattcatattttacatatatatatatatatatacatgcacacacaccgatacatttaccttttaaaaaaatgatttataagtgaactgttaggctccagtgatttcagtgttttgttcatgttttattggaaatgcacgtggtttcttaggcttttaaacaaatacatggaatggttgaaagatttattttgctcgtgcttagctaaatatgtcatctctagaaaagatgtggtttgttttggcactgttttaaaaactcaaatattttaaacatttgttaagttggagcttgcacatttaaaccagcagcatacgttccagaagagcatctcaagttaccaaattttttgtaatccttttactagaaaaatcttttttgaagagtttttcttgtgcttgcttcggcagcatatatactgaaattagaaaaagaaaacttttcttttttattatatattttagtgtaagttaagttaaacttctaaaagttgaattatttaatgtaggacttcataaatagtatttgacaatgataaatgtgtatttttgagaatcattaaaatgtatacaatgatattcctttgcagaagtcttaatatgcataatttttaatctaattgtcttctaaatatagttttggtgtatgctggtattttagaagccaccaatttctggactatctgattattaacaaagatgtattttaatgcacaaactcaaatgtttaaaatatatatttactttgtactcaaataaaatcccctattgcaaatcct

SEQ ID NO: 154173 - DNA, 2282 bp, Homo sapiens
  Payload ID: 10296
  Gene Symbol: MIPOL1
  Gene Name: mirror-image polydactyly 1
  ENST ID: ENST00000556451
  CDS Start-End: 622-1896
ggtggctgcgcactcggcctgagaaactcggcaagcgcgcagtgtcgactccccggtctatgccaggcgcatctcagataccagcattgccaccggtgggtagaacactaagtgggctcttggagtccctgattccagaacttgactcttggatgacatttctggacctgctctgggccagagaggagaccacttcccttaagggaacgaggtctcactatattgcccagactggtctcgaactcctgggctcaaacagtccccctgcgttggcctcccaaagtgatggaattacaggtgtgaatcactgcatctgactatggcaaggatctctgtcactgagctaatccaaaagtaaatgagaaacttagaaaaagattgccaattccaaatcaacatatttagagaaaattggaaaaggagaagcttactacagctttatttgaggactttttaaagaacgctgggttctatctgtgagctgcaaatcttggagcaaaaaccagagacattgccagagcaaacaagaacagaaatacaaatggagaactggtcaaaagttatcttgaacaagaaactacggggataaataaaagtacgcagccagatgagcaactgactatgaattctgagaaaagtatgcatcggaaatccactgaattagttaatgaaataacatgtgagaacacagaatggccagggcagagatcaacgaattttcagatcatcagttcttatccagatgatgagtctgtttactgcactactgaaaaatacaacgttatggaacatagacataatgatatgcattatgaatgtatgactccttgtcaagttacttcagactcagataaagagaagacaatagcatttcttctaaaagaattggatattctcagaacaagcaataaaaagcttcagcagaaattggctaaagaagataaagaacagagaaaactaaagtttaagctggaactccaagagaaagaaacagaagctaaaattgctgaaaagacagcagctctggttgaagaagtgtattttgcgcagaaggaacgtgatgaagctgttatgtctagactgcaattagccattgaggagagagatgaagcaattgcacgagccaagcatatggaaatgtctctaaaagtgctagaaaatattaaccctgaagaaaatgacatgacattacaggaattactgaacagaataaacaatgcagacacagggatagctattcagaagaatggagctataattgtggatagaatctacaagaccaaggaatgtaaaatgagaataactgcagaagaaatgagtgcactaatagaagaacgggatgctgccttgtctaagtgcaaacggttagagcaggagcttcatcatgtgaaagagcagaaccagacttcagcaaacaacatgagacatctgactgctgaaaacaatcaagaacgtgctctgaaggcaaagttgttatctatgcaacaagccagagaaactgcagttcaacagtacaaaaaactggaagaggaaatccagacccttcgagtttactacagtttacacaaatctttatctcaagaagaaaatctgaaggatcagtttaactatacccttagtacatatgaagaagctttaaaaaacagagagaacattgtttccatcactcaacaacaaaatgaggaactggctactcaactgcaacaagctctgacagagcgagcaaatatggaattacaacttcaacatgccagagaggcctcccaagtggccaatgaaaaagttcaaaaatctcaaatacaaatctatttcattccaaataaaaaagatgaaagagaaaaattcctaatggataaaagaagaaagattgttgcacattcaaaacagaattcttgatagatacaaaatcatccaataaacttcagctagttttcagcattatatgcagttgatttgtccattcctcagtggaacttccaaatcatctaaaccagctttgtatgacactaagaataccctcattccttcagtgtctagctctgtgctgtgtttatttgcagaggaccctcatgcatggatccatataaatgaggcaaactgtgaagcagactagactgtgccgcttaccgtaaagtctttgagagaggaagattgtgtatatgaaaactgctaggcatgatatttacttataaggaagatttctatgtgtataacatcaagcaagatttttggttgaggttttatgctttcagtaaagaaaataaaagaagaaaaccaattaa

SEQ ID NO: 154174 - DNA, 775 bp, Homo sapiens
  Payload ID: 10296
  Gene Symbol: MIPOL1
  Gene Name: mirror-image polydactyly 1
  ENST ID: ENST00000556753
  CDS Start-End: 391-775
atgccaggcgcatctcaggtaaacggttgggcagggaggtttgggcgacggagaatgatagtggtgggcacagatcagccctggagttttcggccgcagacttttccttggagaaggagaaggggccccgcggaatctgtacttagtgaatgctgaccccgcgtggccgggagtgatggggctctctcgaagctaatccaaaagtaaatgagaaacttagaaaaagattgccaattccaaatcaacatatttagagaaaattggaaaaggagaagcttactacagctttatttgaggactttttaaagaacgctgggttctatctgtgagctgcaaatcttggagcaaaaaccagagacattgccagagcaaacaagaacagaaatacaaatggagaactggtcaaaagacataacccacagttatcttgaacaagaaactacggggataaataaaagtacgcagccagatgagcaactgactatgaattctgagaaaagtatgcatcggaaatccactgaattagttaatgaaataacatgtgagaacacagaatggccagggcagagatcaacgaattttcagatcatcagttcttatccagatgatgagtctgtttactgcactactgaaaaatacaacgttatggaacatagacataatgatatgcattatgaatgtatgactccttgtcaagttacttcagactcagataaagagaagacaatagcatttcttctaaaagaattggatattctcagaacaagcaataaaa

SEQ ID NO: 154175 - DNA, 732 bp, Homo sapiens
  Payload ID: 10296
  Gene Symbol: MIPOL1
  Gene Name: mirror-image polydactyly 1
  ENST ID: ENST00000556615
  CDS Start-End: 421-732
ccctgcggcgcgccgccgccccgtaggccccacgcgccgccccgctcctccgccggatcgtctgtgggtgagtctcgagccaggaggctctgagccagtggcgattggctgacgcggtggctgcgcactcggcctgagaaactcggcaagcgcgcagtgtcgactccccggtctatgccaggcgcatctcagctaatccaaaagtaaatgagaaacttagaaaaagattgccaattccaaatcaacatatttagagaaaattggaaaaggagaagcttactacagctttatttgaggactttttaaagaacgctgggttctatctgtgagtttatttatctagagttggctttattttagctgcaaatcttggagcaaaaaccagagacattgccagagcaaacaagaacagaaatacaaatggagaactggtcaaaagacataacccacagttatcttgaacaagaaactacggggataaataaaagtacgcagccagatgagcaactgactatgaattctgagaaaagtatgcatcggaaatccactgaattagttaatgaaataacatgtgagaacacagaatggccagggcagagatcaacgaattttcagatcatcagttcttatccagatgatgagtctgtttactgcactactgaaaaatacaacgttatggaacatagacataatgatatgcattatgaatgtatgactccttgtcaagttact

SEQ ID NO: 154176 - DNA, 7434 bp, Homo sapiens
  Payload ID: 10296
  Gene Symbol: MIPOL1
  Gene Name: mirror-image polydactyly 1
  ENST ID: ENST00000555870
  CDS Start-End: 435-977
gcactcggcctgagaaactcggcaagcgcgcagtgtcgactccccggtctatgccaggcgcatctcagctaatccaaaagtaaatgagaaacttagaaaaagattgccaattccaaatcaacatatttagagaaaattggaaaaggagaagcttactacagctttatttgaggactttttaaagaacgctgggttctatctgtgagctgcaaatcttggagcaaaaaccagagacattgccagagcaaacaagaacagaaatacaaatggagaactggtcaaaagtttgctacttcgcatatccctacttgaccttttttggagcaaatgcctttgtgaagtcttcctagagtcttccagacataacccacagttatcttgaacaagaaactacggggataaataaaagtacgcagccagatgagcaactgactatgaattctgagaaaagtatgcatcggaaatccactgaattagttaatgaaataacatgtgagaacacagaatggccagggcagagatcaacgaattttcagatcatcagttcttatccagatgatgagtctgtttactgcactactgaaaaatacaacgttatggaacatagacataatgatatgcattatgaatgtatgactccttgtcaagttacttcagactcagataaagagaagacaatagcatttcttctaaaagaattggatattctcagaacaagcaataaaaagcttcagcagaaattggctaaagaagataaagaacagagaaaactaaagtttaagctggaactccaagagaaagaaacagaagctaaaattgctgaaaagacagcaggcaaagttgttatctatgcaacaagccagagaaactgcagttcaacagtacaaaaaactggaagaggaaatccagacccttcgagtttactacagtttacacaaatctttatctcaagaagaaaatctgaaggatcagtttaactatacccttagtacatatgaagaagctttaaaaaacagagagaacattgtttccatcactcaacaacaaaatgaggaactggctactcaactgcaacaagctctgacagagcgagcaaatatggaattacaacttcaacatgccagagaggcctcccaagtggccaatgaaaaagttcaaaaatctcatcaactatcatcatcatttcatttaaaaaaacaatttttatacaccaagaagtagaaataatatcatctcagataatgttttaaattaaataactttactgaatggccaagataaccaaataggaacagctctagtctgcagctcccagtgttgatcgacacagaagatgggtgatttctgtatttccacctgagatacctggttcatctcgttgggactggttggacagtgcatgcagcccaccgagggtgagccaaagcagggcagggtgtcacctcacctgggaagcacaaggtgtcgggggatttctttttcctagccaagggaagccgtgacagactgtacctggaaaatcggtacactcccacccaaatactgtgcttttcccacagtcttaccaacctgcagaccaggagattctctctcatgcctggcttggtgggtcccacgcccatggagcatggctcactgctagcatggcagtctgagatccacctgtgaggctgcagcctggcagggggaggggcgtctgccattgctgaggcttgaaggtaaacagagtggctgggcagctcaaactgggtggagcccaccgcagctcagcaaggcctactgcctctatggactccatctctgagggcaggacatagctgaacaaaaggcagcagacaacttctgcagacttaaacgtccctgtctgacagctctgaagagggaagtggttatctcagcatggcatttgagctctgagaagggacagactgcctcctcaagtgggtccctgacacccctgtagtctaactgggagacacctcccagtaggggccgacagacacctcatacaagcgagtgcccctctaggacgaagcttccagaggaaggatcaggcagcaatatttgctcttctgcaatatgtgcagttctacagcctctgctggtgatacccaggcaaacagggtttgggtggacctccagcaaactccaacagacctgcagctgagggaccagagtgttagaataaaaactaacaaacagaaaggaatagcatcaacatcagcaaaaagcacatccacaccaaaacctcatctgtaggtcaccaacatcaaagaccaaaggtagataaaaccatgaagatgggaagaaaccagagcagaaaatctgaaaattctaaaaaccagagcacctcttctgtgccaaaggctcacagctcctcaccagcaatggaacaaagctagatgcagaatgactttgatgagttggcagaagtaggcttcagaaggtcggtaataacaaaattctctgagctaaaggagcatgttcaaacccattacaaggaagctaaaaaccttgaaaaaaggttacatgaatggctaactagaataaacagtgtagagaagaccttaaatgacctgatggagatgaaaaccatggcaggagaacttcatgatgcatgcacaagcttcaataggcgatgcaatcaagtgcaagaaaggatatcagtgattgaagatcaaattaatgaaataaagtgagaaggcaagattagagaaaagtaaaaagaaacaaacaaagcctccaagaaatatgggattacgtgaaaagaccaaatcttgattggtgtacctgaaagtgacggggagaatgaaaccaagttggagaacactcttcaggatattatccaggagaaattcccccacctagcaaggcaggccaacattcaaattcaggaaatatacagaacatcacaaagatactccttgagaagagcaaacccatgaaacataattgtcaaattcaccaaggttgaaatgaaggaaaaaatgttaagggtagccaggaaggtcgggttacccagaaagggaagctgactaacagtggatttctcggcagaaaccctacaagccagaagagagtaggggccaatattcaacattcttaaagaaaagaattttcaacccagaatttcatatccagccaaactaagctccataagtgaaggagaaataaaatcctttacagacaagcaaatgttgagagattttgtcaccaccaggcctgccttacaagagctcctgaaggaagcactaaacatggaaaggaacaattggaacaagccactgcaaaaaacatgccaaattgtaaagaccatcgatgctaggaaaaaactgcatcaatttacgggcaaaataaccagctaacatcataacgacaggttcaaattcactcataacaatattaaccttaaatggaaatgggctaaatgccccaattaaaagacacagactggcaaattggataaagagtcaagacccatcagtgtgctgtattcagaagacccatcttacatgcagaggcacaaataggcttaaaatatagggatggaggaagatctaccaagcaaatggaaaacaaaaaaagcagggtttgcagtcctagtctctgataaaacagactttaaaccaacaaagatcaaaagagacaaagaaggccattacataatggtaaagggatcacttcaacaagaagagctaactatcctaaatatatatgcacccaatacaggagcacccagattcataaaacaagtccatggagacctacaaagagacttagactcccacacagtgataatgggagactttaacaccccactgtcaatattagacagatcaacgagagaggaggttaacaaagatatccaggacttgaactcagctcggcaccaagcagacctaatagacatctacagaactctccaccccaaatcaacagaatatactttcttctcagcaccacatcacacttattctaaaactgaccacataattggaagtaaagcactcctcagcaaatgtaaaagaatagaaatcacaaaaaactgtctctcagaccacagtgcaatcaaattagaactcaggattaagaaactcactcaaaactgaacaactacgtggaaactgaacaatcagctcctgaatgactactgggtaaataacgaaatgaaggcagaaataaagatgttctttgaaaccaatgagaacaaagacacaacataccagaatctctgggacacaattaaagcagtgttaagagggaaatttatagcactaaatgcccacaagagaaagcaagaaagatctaaaattgacaccctaccatcacaattaaaagaactgagaagcaagagcaaacaaattcaaaagctagcacaaggtaagaaataactaagatcagagcagaactgaagaagatggagacgcaaaaaacccttcaaaaaatcaatgaatccaggagctggttttttgaaaagatcaacaaaattgatagactgctagccagactaataaagaagagagagaagaatcaaatagacacaataaaaaatgacaaaggggatatcaccaccaatcccacagaaatacaaactaccatcagataatactataaacacctctacacaaataaactagaaaatctagaagaaatggataaattcctggacacatacaccctcccaagactaacccaggaggaagttgatcctctaaatagaccaataacaggctctgaaattgaggcaataattaatagcctaccaccaaaaaaagtccagaaccagacagattcacagctgaattctaccaaaggtacaaagaggagctggtaccatcccttctgaaactattccagtcaatagaaaaaggaggaatcctccctaactcatttcatgaggccagcatcatcctaataccaaagcctgtcagagacacaacaacaaaaaagataattttagaccaatatccctggtgaacatcgctgtgaaaatcctcaataaaatactggcaacccaaatccagcagcacatcaaaaagcttatccaccatgatcaagtcagcttcatccctgggatgcaagcctggttcaacatatgcacatcaataaacgtaatccatcacataaaaagaaccaatgacaaaaaccacatgattatctcattagatgcagaaaaggcctttgacaaaattcaacagcctttatgctaaaaactttatgcaataaactggatattgatggaacatatctcaaagtaataagagctatttatgacaaacccacagccaatatcatactgaatgggcaaaaactggaagcattccctttgaagactggcacaagacaaggatgttctctctcaccactcctattcaacatagtattggaagttctggccaggaatcaggcaagagaaagaaataaagggtattcaattaagaaaagaggaagtcaaattgtccctgtttgcatatgacatgattgtatatttagaaaaccccattgtctcagcccaaaacctctttaagatgataagcaacttcagcaaagtctcaggatataaaatcaatgtgcaaaaatcacaggcattcctatacaccaaaaacagacaaacagccaaatcatgagggaattcccattcacaattgctacaaagagaataaaatacctgtgaatccaacttacaagggatgtgaaggaccccttcaaagagagctacaaaccactgctcaatgaaataaatgaggacacagacaaatagaagtacattccatgctcacggataggaataatcaatatcgtgaaaatggccatactgcctaaggtaatttatagattcagtgccattcccatcaagctaccaataactttcttcacagaattggaaaaaactactttaaagttcatatggaaccaaaaaagagcccatagccaagacaatcctaagcaaaaacaacaaagctggagacatcatgctacctgacttcaaacaatagtgctaggctactataaccaaaacagcatggtactggtaccaaaacagaggtatagatcaatggaacagaacagagccctcagaaataacaccgcacatctacaaccatctgatctttgacaaacctgacaaaaacaagcaatggggaaaggattccctatttaataaatggtgctgggaaaactggctagccatatgaagaaaactaaaactggattcccttacaccttatacaaaaattaattcaagatgaattaaaaacttaaatgtaagacctaaaaccataaaaactctagaagaaaacctaggcaataccattcaggacgtaggcgtgggcaaagacttcatgactaaaacaccaaaagcaatggcaacaaaaaccaaaattgacaaatgggatctaattaaactaaagagcttctgcacagcaaaagaaactatcatcagagtgaacaggcaacctacagaatgggagaaaatttttgcaatctacccatctgacaatgggctaatatccagaatgtacataatttattggaacttaaacaattacaagaaaaaaacaaacatccccatcaaaaagtgggccaaggatatgaatagacccttctcaaaagaagatatttatgcagtcaacagacatatgaaaaaatgctcatcatcactggtcatcagagaaatgcaaatcagagccacaatgagataaccatctcatgccagttagaatggcgatcattaaaaagtcaataaacaacagaagctggagaggatgtggagaaataggaacgcttttacactgctggtgggagtgtaaattagttcaatcatggtggaagacagtgtgacgattcctcaaggatctagaactagaaataccatttgacccagccatcccattactggatatatacccaaagcattataaatcattttatgataaagatacatgcacacatatgcttattgcggcactattcacaataggaaacacttggaaccacccaagtgcccatcaatgatagactggattaagaaaatgtggcacatatacaccatggaatactatgcagccataaaaaagaatgagttcatgtactttgcagggagatcagtgaagctggaaaccatcattctcagctaactatcacaaggacagaaaaccaaacaccacatgctttcatttgtaggtgtgaatcaaactatgagaacacttggacacagggtagggaacatcacacaccgggacctctcagggactgggggtctgggagagggatagcattaagataaatacctaatgtaaatgacgagttgatgggtgcagcaaaccaatatggcacatgtatacctatgtagcaaacctgcacattgtgcacatgtaccctagaacctaaagtataataaaaattaataaataaagtaactttaactctgaaaaa

SEQ ID NO: 154177 - DNA, 2505 bp, Homo sapiens
  Payload ID: 10297
  Gene Symbol: MIS12
  Gene Name: MIS12 kinetochore complex component
  Uniprot ID: Q9H081
  ENST ID: ENST00000381165
  CDS Start-End: 554-1171
ctcgccgagatgacctgggcacctctgcgttgaatcggcaaatactgatcaagccgcatttattctgctctcaggaactctaagtctagcagagaagatgaggcggtagaagttcatcaatggcttggctggaggacaagcaaattgaggacattggcaacggagtgatcaaaatgatagatcatgaggcctaaaatgaataaggaaagaagagaagtggcagaggctgagaacagaaagagagggtggaggggctgtaaatcttgaagattagggtataatatgagtatatgggtaagaattggaagaattgtgtaggaggcagtagtcaaaaagtagaagcagtttggaagagtagttacaaatatcaagagccaggtggctaaaaggtggagctataggtcattgaagctcaagaaactgagtctctagggcattggttaagtcatctgtctagacttcaaagttgtctaggatgataattcagaagactgatctgtgccaaagtcacaggtttttcacgactgaaaacaacatagcaaaataagccaagatgtctgtggatccaatgacctacgaggcccagttctttggcttcacgccacaaacgtgcatgcttcggatctacattgcatttcaagactacctatttgaagtgatgcaggccgttgaacaggttattctgaagaagctggatggcatcccagactgtgacattagcccagtgcagattcgcaaatgcacagagaagtttctttgcttcatgaaaggacattttgataacctttttagcaaaatggagcaactgtttttgcagctgattttacgtattccctcaaacatcttgcttcctgaagataaatgtaaggagacaccttatagtgaggaagattttcagcatctccagaaagaaattgaacagttacaggagaagtacaagactgaattatgtactaagcaggcccttcttgcagaattagaagagcaaaaaattgttcaggccaaactcaaacagacgttgactttctttgatgagcttcataatgttggcagagatcatgggactagtgattttagggagagtttagtatccctggttcagaactccagaaaactacagaacattagagacaatgtggaaaaggaatcgaaacgactgaaaatatcttaattgctcagtagtcaaaaggaggagcctgtcaaaaagtagaatcataaggactgttcaaaccataaggactgttcaaatcataccagtgactgttcaaaccaaccatactttttattagatttgctttgtcaactctttcttgtattctgtgttttcctcttttttggtccactttgctgaggtatgaagtgtactactttgaactaggctgaagcatctgagtcttctaataagtgggaagggatccaacaaagaagccatgaccagttaaagatatttgcagagttacaccttggtcataagtcctttgtgaccttgattattttggcttactctttggatgagaccagacaagaaaaggattaaacgggtggctcctttaatattattattattgtttttgagacaaggtccctttctgtcacccaggttagagtagatttcagtggcacaatcttggctcactgcaacctctgtgtcctgggctcaagtgatcctcctgcctcagcctcccaagtagctaggaccacaggtgcgtgtcaccatgcttggctaatttttttgcagaaacgaggcctcactatattgtccaggctgagtggctcttttattaaccagtcattacactgcggaacagccaacatagagtacttgctctcgtcctgtgaattttctttcatgagggagtcaatatgtagtggaaagaagcatgtagcaaaaaagacaaccttgatctttaataaaaaagaagttggtttatttccaaaataaatcccctgacaaaaaacctggtgatgttaagcaattgactgtcttagagtccagcagaagaccttagacaaaaaaagcagaacccactggagtagaaaaggaagcatgtagcatatactcagtagtgaaatttaattttactgactgttaggtatctatgccaatttgttttcatacttcagttggttttggaatctgccttatacctaatatttatttattcacactcataagcatcaaatatttaatgccctcagtgggaaatttgtgtttaaactcaatggaatctaatatttctttatgtcgttagtccctgtaaaatgttaggtcacccaaggaaaggggagaaatagcaatggttgttcctaaggtattgcttgccctccatgtcttcctaaagagcagaacttggagtttctcctttatgtagagaagaagtaacttagggtgtatttgcaatgaaatattcatagatattgaaagcttgtgtttacatgaaatatgtttattatcaagaagtcctttttccaattctgtacattaaatatatgtgttttaaaggg

SEQ ID NO: 154178 - DNA, 945 bp, Homo sapiens
  Payload ID: 10297
  Gene Symbol: MIS12
  Gene Name: MIS12 kinetochore complex component
  ENST ID: ENST00000576570
  CDS Start-End: 873-945
ctctcttctccaccagccaacgtccgggaaaaacgagtaagtacaggttccttctgccaatccccgccggccacagctaactttcccgcccggcccctttctgtcataattgaggtgtccacaaccagccaatcaggaacgcgagagtatcccgcgtttgctttcgctcgccgaggcgcgtatcagtcggaattttggggagccaaccgcgccgtctgtccctggcaagccagcggcggtttaaaggaggtggcgggaagcctgtgtgtgcttcaaatcgtcaccctcatggtcgctccgagtctcgctctgttgcccaggctggggtgcagtggcacaatctcggctcaccgcaaccttcgcctctcgggttccagtgattctcctgcctcagcctcccgagtagctgggattgcaagtatccaccatcacgcctggatggcttggctggaggacaagcaaattgaggacattggcaacggagtgatcaaaatgatagatcatgaggcctaaaatgaataaggaaagaagagaagtggcagaggctgagaacagaaagagagggtggaggggctgtaaatcttgaagattagggtataatatgagtatatgggtaagaattggaagaattgtgtaggaggcagtagtcaaaaagtagaagcagtttggaagagtagttacaaatatcaagagccaggtggctaaaaggtggagctataggtcattgaagctcaagaaactgagtctctagggcattggttaagtcatctgtctagacttcaaagttgtctaggatgataattcagaagactgatctgtgccaaagtcacaggtttttcacgactgaaaacaacatagcaaaataagccaagatgtctgtggatccaatgacctacgaggcccagttctttggcttcacgccacaaacgtgcatgcttcggatct

SEQ ID NO: 154179 - DNA, 2204 bp, Homo sapiens
  Payload ID: 10297
  Gene Symbol: MIS12
  Gene Name: MIS12 kinetochore complex component
  Uniprot ID: Q9H081
  ENST ID: ENST00000573759
  CDS Start-End: 330-947
accagccaacgtccgggaaaaacgagtaagtacaggttccttctgccaatccccgccggccacagctaactttcccgcccggcccctttctgtcataattgaggtgtccacaaccagccaatcaggaacgcgagagtatcccgcgtttgctttcgctcgccgaggcgcgtatcagtcggaattttggggagccaaccgcgccgtctgtccctggcaagccagcggcggtttaaaggaggtggcgggaagcctgtgtgtgcttcaaatcgtcaccctcatggtcgctccggtttttcacgactgaaaacaacatagcaaaataagccaagatgtctgtggatccaatgacctacgaggcccagttctttggcttcacgccacaaacgtgcatgcttcggatctacattgcatttcaagactacctatttgaagtgatgcaggccgttgaacaggttattctgaagaagctggatggcatcccagactgtgacattagcccagtgcagattcgcaaatgcacagagaagtttctttgcttcatgaaaggacattttgataacctttttagcaaaatggagcaactgtttttgcagctgattttacgtattccctcaaacatcttgcttcctgaagataaatgtaaggagacaccttatagtgaggaagattttcagcatctccagaaagaaattgaacagttacaggagaagtacaagactgaattatgtactaagcaggcccttcttgcagaattagaagagcaaaaaattgttcaggccaaactcaaacagacgttgactttctttgatgagcttcataatgttggcagagatcatgggactagtgattttagggagagtttagtatccctggttcagaactccagaaaactacagaacattagagacaatgtggaaaaggaatcgaaacgactgaaaatatcttaattgctcagtagtcaaaaggaggagcctgtcaaaaagtagaatcataaggactgttcaaaccataaggactgttcaaatcataccagtgactgttcaaaccaaccatactttttattagatttgctttgtcaactctttcttgtattctgtgttttcctcttttttggtccactttgctgaggtatgaagtgtactactttgaactaggctgaagcatctgagtcttctaataagtgggaagggatccaacaaagaagccatgaccagttaaagatatttgcagagttacaccttggtcataagtcctttgtgaccttgattattttggcttactctttggatgagaccagacaagaaaaggattaaacgggtggctcctttaatattattattattgtttttgagacaaggtccctttctgtcacccaggttagagtagatttcagtggcacaatcttggctcactgcaacctctgtgtcctgggctcaagtgatcctcctgcctcagcctcccaagtagctaggaccacaggtgcgtgtcaccatgcttggctaatttttttgcagaaacgaggcctcactatattgtccaggctgagtggctcttttattaaccagtcattacactgcggaacagccaacatagagtacttgctctcgtcctgtgaattttctttcatgagggagtcaatatgtagtggaaagaagcatgtagcaaaaaagacaaccttgatctttaataaaaaagaagttggtttatttccaaaataaatcccctgacaaaaaacctggtgatgttaagcaattgactgtcttagagtccagcagaagaccttagacaaaaaaagcagaacccactggagtagaaaaggaagcatgtagcatatactcagtagtgaaatttaattttactgactgttaggtatctatgccaatttgttttcatacttcagttggttttggaatctgccttatacctaatatttatttattcacactcataagcatcaaatatttaatgccctcagtgggaaatttgtgtttaaactcaatggaatctaatatttctttatgtcgttagtccctgtaaaatgttaggtcacccaaggaaaggggagaaatagcaatggttgttcctaaggtattgcttgccctccatgtcttcctaaagagcagaacttggagtttctcctttatgtagagaagaagtaacttagggtgtatttgcaatgaaatattcatagatattgaaagctt

SEQ ID NO: 154180 - DNA, 551 bp, Homo sapiens
  Payload ID: 10297
  Gene Symbol: MIS12
  Gene Name: MIS12 kinetochore complex component
  ENST ID: ENST00000576988
  CDS Start-End: 177-551
aacgccaagcaaccgcaatccgtagagacctaaggaacgcacatccgccaatcacgagttgcgtcgccaccgcccccccccagcgccccatctccccaccctctcttctccaccagccaacgtccgggaaaaacgagtttttcacgactgaaaacaacatagcaaaataagccaagatgtctgtggatccaatgacctacgaggcccagttctttggcttcacgccacaaacgtgcatgcttcggatctacattgcatttcaagactacctatttgaagtgatgcaggccgttgaacaggttattctgaagaagctggatggcatcccagactgtgacattagcccagtgcagattcgcaaatgcacagagaagtttctttgcttcatgaaaggacattttgataacctttttagcaaaatggagcaactgtttttgcagctgattttacgtattccctcaaacatcttgcttcctgaagataaatgtaaggagacaccttatagtgaggaagattttcagcatctccagaaagaaattgaacagttacag

SEQ ID NO: 154181 - DNA, 2691 bp, Homo sapiens
  Payload ID: 10297
  Gene Symbol: MIS12
  Gene Name: MIS12 kinetochore complex component
  Uniprot ID: Q9H081
  ENST ID: ENST00000611091
  CDS Start-End: 746-1363
atctccccaccctctcttctccaccagccaacgtccgggaaaaacgagtaagtacaggttccttctgccaatccccgccggccacagctaactttcccgcccggcccctttctgtcataattgaggtgtccacaaccagccaatcaggaacgcgagagtatcccgcgtttgctttcgctcgccgaggcgcgtatcagtcggaattttggggagccaaccgcgccgtctgtccctggcaagccagcggcggtttaaaggaggtggcgggaagcctgtgtgtgcttcaaatcgtcaccctcatggtcgctccgatggcttggctggaggacaagcaaattgaggacattggcaacggagtgatcaaaatgatagatcatgaggcctaaaatgaataaggaaagaagagaagtggcagaggctgagaacagaaagagagggtggaggggctgtaaatcttgaagattagggtataatatgagtatatgggtaagaattggaagaattgtgtaggaggcagtagtcaaaaagtagaagcagtttggaagagtagttacaaatatcaagagccaggtggctaaaaggtggagctataggtcattgaagctcaagaaactgagtctctagggcattggttaagtcatctgtctagacttcaaagttgtctaggatgataattcagaagactgatctgtgccaaagtcacaggtttttcacgactgaaaacaacatagcaaaataagccaagatgtctgtggatccaatgacctacgaggcccagttctttggcttcacgccacaaacgtgcatgcttcggatctacattgcatttcaagactacctatttgaagtgatgcaggccgttgaacaggttattctgaagaagctggatggcatcccagactgtgacattagcccagtgcagattcgcaaatgcacagagaagtttctttgcttcatgaaaggacattttgataacctttttagcaaaatggagcaactgtttttgcagctgattttacgtattccctcaaacatcttgcttcctgaagataaatgtaaggagacaccttatagtgaggaagattttcagcatctccagaaagaaattgaacagttacaggagaagtacaagactgaattatgtactaagcaggcccttcttgcagaattagaagagcaaaaaattgttcaggccaaactcaaacagacgttgactttctttgatgagcttcataatgttggcagagatcatgggactagtgattttagggagagtttagtatccctggttcagaactccagaaaactacagaacattagagacaatgtggaaaaggaatcgaaacgactgaaaatatcttaattgctcagtagtcaaaaggaggagcctgtcaaaaagtagaatcataaggactgttcaaaccataaggactgttcaaatcataccagtgactgttcaaaccaaccatactttttattagatttgctttgtcaactctttcttgtattctgtgttttcctcttttttggtccactttgctgaggtatgaagtgtactactttgaactaggctgaagcatctgagtcttctaataagtgggaagggatccaacaaagaagccatgaccagttaaagatatttgcagagttacaccttggtcataagtcctttgtgaccttgattattttggcttactctttggatgagaccagacaagaaaaggattaaacgggtggctcctttaatattattattattgtttttgagacaaggtccctttctgtcacccaggttagagtagatttcagtggcacaatcttggctcactgcaacctctgtgtcctgggctcaagtgatcctcctgcctcagcctcccaagtagctaggaccacaggtgcgtgtcaccatgcttggctaatttttttgcagaaacgaggcctcactatattgtccaggctgagtggctcttttattaaccagtcattacactgcggaacagccaacatagagtacttgctctcgtcctgtgaattttctttcatgagggagtcaatatgtagtggaaagaagcatgtagcaaaaaagacaaccttgatctttaataaaaaagaagttggtttatttccaaaataaatcccctgacaaaaaacctggtgatgttaagcaattgactgtcttagagtccagcagaagaccttagacaaaaaaagcagaacccactggagtagaaaaggaagcatgtagcatatactcagtagtgaaatttaattttactgactgttaggtatctatgccaatttgttttcatacttcagttggttttggaatctgccttatacctaatatttatttattcacactcataagcatcaaatatttaatgccctcagtgggaaatttgtgtttaaactcaatggaatctaatatttctttatgtcgttagtccctgtaaaatgttaggtcacccaaggaaaggggagaaatagcaatggttgttcctaaggtattgcttgccctccatgtcttcctaaagagcagaacttggagtttctcctttatgtagagaagaagtaacttagggtgtatttgcaatgaaatattcatagatattgaaagcttgtgtttacatgaaatatgtttattatcaagaagtcctttttccaattctgtacattaaatatatgtgtttt

SEQ ID NO: 154182 - DNA, 4777 bp, Homo sapiens
  Payload ID: 10298
  Gene Symbol: MIS18BP1
  Gene Name: MIS18 binding protein 1
  Uniprot ID: Q6P0N0
  ENST ID: ENST00000310806
  CDS Start-End: 460-3858
caactagaggagctcgccccctgcctgtgacagcttagggtcgcctactttttgtggacacactgccgtccacggagtgcagaggccgcctgcagttttcttgcgtccctgtgagacgcacggtggcgcaattcccgagcgtgccaatcccgggctggctggagggcgggctcttcaaatttgaattgcggaagtgttttgtgtgttagagaacgtcgcggaggaggtaagcgtcgcttggcgcctggccgccgcgggcaggatacaccgtgggcctgaggcgcgagcccggcggcgtgcggccctctctccgcgcggagccgagccggaactgcggcagtctctccctgccaggctcttcatccaaggtttctgtggatcccttctgaagttctatctgaaaattgcgcttaagtgaattttctgttagaagaacttggttgctactttcttgtcaagatgattgcaacacctttgaaacattcaagaatttacttacctccagaggcatcttctcaaaggagaaatctacccatggatgcaatcttttttgacagcattccttcaggcacacttactcctgtaaaagatttggtgaaatatcagaactcctccttaaaattgaatgaccataaaaagaatcagttcctaaaaatgacaacttttaacaataaaaatatatttcaatcaactatgctaacagaggctactacctctaacagttctcttgatatcagtgctataaagcccaacaaggatggattaaaaaataaagcaaactatgaatcaccaggaaaaatatttctaagaatgaaagaaaaagtactgcgtgacaagcaagaacagccatcaagaaacagtagtttgttggaaccacagaaaagtggaaataatgaaaccttcactcctaacagagttgaaaaaaaaaaattgcagcatacctacctatgtgaagaaaaggaaaacaacaaatcattccagtcagatgacagttcactaagagcctcagtccaaggagttcctctagaatcatcaaataatgatattttcctcccggtcaaacaaaagattcagtgccagcaggaaaagaaagcaccactgcacaatttaacttacgaacttccaactctgaaccaagaacaggaaaattttttggctgtagaagcccgaaacaagacattaactagagctcagttggctaaacaaatttttcactcaaaggagagtatagttgcaaccactaaatccaaaaaggacacgtttgttttagaaagcgttgattctgctgatgaacaatttcaaaatactaatgctgagactctcagtactaattgtattcctattaaaaatggcagcctgttaatggtttctgatagtgagaggacaacagaagggacttcgcaacagaaagttaaggaaggaaatggaaaaacagtgcctggagagacaggtcttccaggttccatgaaagatacatgtaaaattgtacttgcaacaccaagacttcatataacaatacctcggaggtcaaaaagaaatatttcaaagctttctcctccaagaatatttcaaactgttacaaatggacttaaaaaaaatcaggtagttcagctacaggaatggatgattaaaagcatcaataataatactgctatatgtgtagaaggaaaattgatagacgtcactaacatatattggcacagtaatgtaattatagagcggattgagcacaacaaacttaggactatatcaggcaacgtttatatattaaaaggcatgatagaccaaatttccatgaaagaagcaggatatccaaattatctcataaggaaatttatgtttggatttccagaaaattggaaagagcacattgataattttctggaacaattaagggctggtgaaaagaacagggaaaagaccaaacaaaaacagaaaactggaagatctgtccgtgacataaggaaatcaatgaaaaatgatgcacgagaaaaccaaacagatactgctcaaagagccaccaccacttacgattttgattgtgataatttggaactgaagagtaataagcacagtgagtcaccaggagctacagaattaaacatgtgccacagtaattgccaaaataaaccaacattaaggttcccagatgaccaagtaaataatactattcaaaatggaggaggagatgacttatctaatcaggaattaattggaaaaaaagaatataaaatgtcttcaaagaaactaaaaattggtgaaagaacaaatgaaaggataataaaaagtcagaagcaagagacaactgaagaattggatgtatccattgatattctaacctcaagggaacagtttttctcagatgaagaaagaaaatacatggccatcaatcagaagaaagcttatattttagtaacaccacttaaatctagaaaagtgatagagcaaagatgcatgaggtataatctgtccgctggcaccatcaaagcagtaacagattttgtaataccagagtgtcaaaaaaaaagtcccatcagcaagtccatggggactttagaaaatacatttgaaggtcataaaagtaaaaacaaggaagattgcgatgaacgtgacttacttactgtcaaccggaaaataaaaatatctaaccttgaaaaggaacaaatgctcacctctgactttaagaaaaataccagactattaccaaaattgaagaaaatagaaaatcaggtagctatgtcattttataagcatcagtcctcaccagatttgtcaagtgaagaaagtgaaacagaaaaggaaattaaaaggaaagctgaagttaagaaaaccaaagcaggaaacaccaaagaagcagtggttcacctgagaaagagcacaagaaacacaagtaatattccagtgattttggaacctgaaactgaagaaagtgaaaatgaattttatatcaaacaaaagaaagctagaccttccgtcaaagaaactcttcagaagtctggtgttaggaaagagtttccaattactgaggcagtaggatctgataagacaaataggcatcccttagaatgcttacctggtttaattcaggataaggaatggaatgagaaggagttacagaaacttcattgtgcttttgcatctcttccaaagcacaaacctggtttctggtcagaggtagctgcggctgtaggttctcgatctcctgaagaatgccagaggaaatacatggaaaatcccagaggaaaaggatcccagaaacatgtcactaagaagaagccagccaattccaaaggccaaaatggcaagagaggtgatgctgatcagaaacaaactattaagataactgccaaagtgggaactcttaaaaggaagcaacagatgagggaatttctggaacagttgccaaaagatgaccatgatgattttttcagtacaacacctttacagcatcaaagaatactgttgccaagtttccaggacagtgaagatgatgatgatattctgccaaatatggacaaaaatccaacaactccatcatcagttatctttccattggtaaaaactcctcaatgtcagcatgtcagtcctggcatgctaggttctataaataggaatgactgtgataaatatgtttttcgtatgcaaaaatatcataaaagtaatggtggtattgtctggggcaacatcaagaaaaaattagttgaaactgatttctcaactccaacaccaagaaggaaaaccccatttaacacagacttaggagaaaactctggtattggaaaacttttcactaatgctgtggaatctttagatgaagaagagaaagattattatttttcgaactctgattctgcatagtaaaatgagaaaatatgattcctgggatttttaccataaagcagacagtgtttgtattttcaactggagtacatgtattttctttgtaaagtagcttcctatgaaaatgtggacttttttgaaggtttcatatgtttgtgttcaaagtaaaatatcctcattgctgcagcttactaaaaatgtaaagaaaattgtttttgctcgtgtagatatctgtaaatttgtttttgcatattaaaatatatatagataattttttaataagcatccaagtctgtttactttaagaaaaccatttcccaaacagatttttttttatttcaagaaaattttgctaccatttaagtaagagaaggtgagaaggatgacagaggttgtattggtagctattgaattcatgaaaacttttaagttagcatttgttagcagttattatccaagccagagtaggatttgttaccagttgttatccaaacctaatgtttaaattacacattgttgaaattaaattacacattgttgacatgcttctctcctgattgtttttattttaaacttgtgataggcatatctatgaaacctttgtaaatttagtttattgctttaccattattttactaggtaaaattagagaacagattttgttctctaatttttaagccttatttacatatgcagaaacagcttaaatattttgactagattagacaaacagttaatagatccaccattaggaatcaatatattatgtcataataaacatcctttttctttcactgaaatttcttttagaaataaacttatttttgcttgttatgttttgaaacttgacataggatattttccctctggctacacattcacctacccttgttctctatttagattattcaaataaagttagtttgcttttatagta

SEQ ID NO: 154183 - DNA, 808 bp, Homo sapiens
  Payload ID: 10298
  Gene Symbol: MIS18BP1
  Gene Name: MIS18 binding protein 1
  ENST ID: ENST00000451174
  CDS Start-End: 343-808
ggtaagcgtcgcttggcgcctggccgccgcgggcaggatacaccgtgggcctgaggcgcgagcccggcggcgtgcggccctctctccgcgcggagccgagccggaactgcggcagtctctccctgccaggctcttcatccaaggggcagggacattaggaaacagaaagctctgttttggttcttggagcctttcaacgtgaccacaattatctgactttaaatgaagacagttctgcatgtccattacaggtttctgtggatcccttctgaagttctatctgaaaattgcgcttaagtgaattttctgttagaagaacttggttgctactttcttgtcaagatgattgcaacacctttgaaacattcaagaatttacttacctccagaggcatcttctcaaaggagaaatctacccatggatgcaatcttttttgacagcattccttcaggcacacttactcctgtaaaagatttggtgaaatatcagaactcctccttaaaattgaatgaccataaaaagaatcagttcctaaaaatgacaacttttaacaataaaaatatatttcaatcaactatgctaacagaggctactacctctaacagttctcttgatatcagtgctataaagcccaacaaggatggattaaaaaataaagcaaactatgaatcaccaggaaaaatatttctaagaatgaaagaaaaagtactgcgtgacaagcaagaacagccatcaagaaacagtagtttgttggaaccacagaaaagtggaaataatgaaaccttcactcctaacagagttgaaaaaa

SEQ ID NO: 154184 - DNA, 2131 bp, Homo sapiens
  Payload ID: 10298
  Gene Symbol: MIS18BP1
  Gene Name: MIS18 binding protein 1
  ENST ID: ENST00000454990
  CDS Start-End: 256-1746
gttagagaacgtcgcggaggaggtaagcgtcgcttggcgcctggccgccgcgggcaggatacaccgtgggcctgaggcgcgagcccggcggcgtgcggccctctctccgcgcggagccgagccggaactgcggcagtctctccctgccaggctcttcatccaaggtttctgtggatcccttctgaagttctatctgaaaattgcgcttaagtgaattttctgttagaagaacttggttgctactttcttgtcaagatgattgcaacacctttgaaacattcaagaatttacttacctccagaggcatcttctcaaaggagaaatctacccatggatgcaatcttttttgacagcattccttcaggcacacttactcctgtaaaagatttggtgaaatatcagaactcctccttaaaattgaatgaccataaaaagaatcagttcctaaaaatgacaacttttaacaataaaaatatatttcaatcaactatgctaacagaggctactacctctaacagttctcttgatatcagtgctataaagcccaacaaggatggattaaaaaataaagcaaactatgaatcaccaggaaaaatatttctaagaatgaaagaaaaagtactgcgtgacaagcaagaacagccatcaagaaacagtagtttgttggaaccacagaaaagtggaaataatgaaaccttcactcctaacagagttgaaaaaaaaaaattgcagcatacctacctatgtgaagaaaaggaaaacaacaaatcattccagtcagatgacagttcactaagagcctcagtccaaggagttcctctagaatcatcaaataatgatattttcctcccggtcaaacaaaagattcagtgccagcaggaaaagaaagcaccactgcacaatttaacttacgaacttccaactctgaaccaagaacaggaaaattttttggctgtagaagcccgaaacaagacattaactagagctcagttggctaaacaaatttttcactcaaaggagagtatagttgcaaccactaaatccaaaaaggacacgtttgttttagaaagcgttgattctgctgatgaacaatttcaaaatactaatgctgagactctcagtactaattgtattcctattaaaaatggcagcctgttaatggtttctgatagtgagaggacaacagaagggacttcgcaacagaaagttaaggaaggaaatggaaaaacagtgcctggagagacaggtcttccaggttccatgaaagatacatgtaaaattgtacttgcaacaccaagacttcatataacaatacctcggaggtcaaaaagaaatatttcaaagctttctcctccaagaatatttcaaactgttacaaatggacttaaaaaaaatcaggtagttcagctacaggaatggatgattaaaagcatcaataataatactgctatatgtgtagaaggaaaattgatagacgtcactaacatatattggcacagtaatgtaattatagagcggattgagcacaacaaacttaggactatatcaggcaacgtttatatattaaaaggcatgatagaccaaatttccatgaaagaagcaggatatccaaattatctcataaggaaatttatgtttggatttccagaaaattggaaagagcacattgataattttctggaacaattaagagatggggtttcgtcatgttggccagactggtctcgaactcctggctacaagtgatccgcctgtctcagcctcccaaagtgttgggattacaggcatgagccactgtgcctggcctgagggctggtgaaaagaacagggaaaagaccaaacaaaaacagaaaactggaagatctgtccgtgacataaggaaatcaatgaaaaatgatgcacgagaaaaccaaacagatactgctcaaagagccaccaccacttacgattttgattgtgataatttggaactgaagagtaataagcacagtgagtcaccaggagctacagaattaaacatgtgccacagtaattgccaaaataaaccaacattaaggttcccagatgaccaagtaaataatactattcaaaatggaggaggagatgacttatctaatcaggaattaattgg

SEQ ID NO: 154185 - DNA, 898 bp, Homo sapiens
  Payload ID: 10298
  Gene Symbol: MIS18BP1
  Gene Name: MIS18 binding protein 1
  ENST ID: ENST00000453142
  CDS Start-End: 1-588
gctgtagaagcccgaaacaagacattaactagagctcagttggctaaacaaatttttcactcaaaggagagtatagttgcaaccactaaatccaaaaaggacacgtttgttttagaaagcgttgattctgctgatgaacaatttcaaaatactaatgctgagactctcagtactaattgtattcctattaaaaatggcagcctgttaatggtttctgatagtgagaggacaacagaagggacttcgcaacagaaagttaaggaaggaaatggaaaaacagtgcctggagagacaggtcttccaggttccatgaaagatacatgtaaaattgtacttgcaacaccaagacttcatataacaatacctcggaggtcaaaaagaaatatttcaaagctttctcctccaagaatatttcaaactgttacaaatggacttaaaaaaaatcaggtagttcagctacaggaatggatgattaaaagcatcaataataatactgctatatgtgtagaaggaaaattgatgatatccaaattatctcataaggaaatttatgtttggatttccagaaaattggaaagagcacattgataattttctggaacaattaagagatggggtttcgtcatgttggccagactggtctcgaactcctggctacaagtgatccgcctgtctcagcctcccaaagtgttgggattacaggcatgagccactgtgcctggcctgagggctggtgaaaagaacagggaaaagaccaaacaaaaacagaaaactggaagatctgtccgtgacataaggaaatcaatgaaaaatgatgcacgagaaaaccaaacagatactgctcaaagagccaccaccacttacgattttgattgtgataatttggaactgaagagta

SEQ ID NO: 154186 - DNA, 585 bp, Homo sapiens
  Payload ID: 10298
  Gene Symbol: MIS18BP1
  Gene Name: MIS18 binding protein 1
  ENST ID: ENST00000554093
  CDS Start-End: 1-235
tgaagaaagtgaaaatgaattttatatcaaacaaaagaaagctagaccttccgtcaaagaaactcttcagaagtctggtgttaggaaagagtttccaattactgaggcagtaggatctgataagacaaataggcatcccttagaatgcttacctggtttaattcaggataaggaatggaatgagaaggagttacagaaacttcattgcacaaacctggtttctggtcagaggtagctgcggctgtaggttctcgatctcctgaagaatgccagaggaaatacatggaaaatcccagaggaaaaggatcccagaaacatgtcactaagaagaagccagccaattccaaaggccaaaatggcaagagaggtgatgctgatcagaaacaaactattaagataactgccaaagtgggaactcttaaaaggaagcaacagatgagggaatttctggaacagttgccaaaagatgaccatgatgattttttcagtacaacacctttacagcatcaaagaatactgttgccaagtttccaggacagtgaagatgatgatgatattctgccaaatatggacaaaaatccaaca

SEQ ID NO: 154187 - DNA, 1950 bp, Homo sapiens
  Payload ID: 10298
  Gene Symbol: MIS18BP1
  Gene Name: MIS18 binding protein 1
  ENST ID: ENST00000627697
  CDS Start-End: 460-1950
caactagaggagctcgccccctgcctgtgacagcttagggtcgcctactttttgtggacacactgccgtccacggagtgcagaggccgcctgcagttttcttgcgtccctgtgagacgcacggtggcgcaattcccgagcgtgccaatcccgggctggctggagggcgggctcttcaaatttgaattgcggaagtgttttgtgtgttagagaacgtcgcggaggaggtaagcgtcgcttggcgcctggccgccgcgggcaggatacaccgtgggcctgaggcgcgagcccggcggcgtgcggccctctctccgcgcggagccgagccggaactgcggcagtctctccctgccaggctcttcatccaaggtttctgtggatcccttctgaagttctatctgaaaattgcgcttaagtgaattttctgttagaagaacttggttgctactttcttgtcaagatgattgcaacacctttgaaacattcaagaatttacttacctccagaggcatcttctcaaaggagaaatctacccatggatgcaatcttttttgacagcattccttcaggcacacttactcctgtaaaagatttggtgaaatatcagaactcctccttaaaattgaatgaccataaaaagaatcagttcctaaaaatgacaacttttaacaataaaaatatatttcaatcaactatgctaacagaggctactacctctaacagttctcttgatatcagtgctataaagcccaacaaggatggattaaaaaataaagcaaactatgaatcaccaggaaaaatatttctaagaatgaaagaaaaagtactgcgtgacaagcaagaacagccatcaagaaacagtagtttgttggaaccacagaaaagtggaaataatgaaaccttcactcctaacagagttgaaaaaaaaaaattgcagcatacctacctatgtgaagaaaaggaaaacaacaaatcattccagtcagatgacagttcactaagagcctcagtccaaggagttcctctagaatcatcaaataatgatattttcctcccggtcaaacaaaagattcagtgccagcaggaaaagaaagcaccactgcacaatttaacttacgaacttccaactctgaaccaagaacaggaaaattttttggctgtagaagcccgaaacaagacattaactagagctcagttggctaaacaaatttttcactcaaaggagagtatagttgcaaccactaaatccaaaaaggacacgtttgttttagaaagcgttgattctgctgatgaacaatttcaaaatactaatgctgagactctcagtactaattgtattcctattaaaaatggcagcctgttaatggtttctgatagtgagaggacaacagaagggacttcgcaacagaaagttaaggaaggaaatggaaaaacagtgcctggagagacaggtcttccaggttccatgaaagatacatgtaaaattgtacttgcaacaccaagacttcatataacaatacctcggaggtcaaaaagaaatatttcaaagctttctcctccaagaatatttcaaactgttacaaatggacttaaaaaaaatcaggtagttcagctacaggaatggatgattaaaagcatcaataataatactgctatatgtgtagaaggaaaattgatagacgtcactaacatatattggcacagtaatgtaattatagagcggattgagcacaacaaacttaggactatatcaggcaacgtttatatattaaaaggcatgatagaccaaatttccatgaaagaagcaggatatccaaattatctcataaggaaatttatgtttggatttccagaaaattggaaagagcacattgataattttctggaacaattaagagatggggtttcgtcatgttggccagactggtctcgaactcctggctacaagtga

SEQ ID NO: 154188 - DNA, 1575 bp, Homo sapiens
  Payload ID: 10299
  Gene Symbol: MIS18A
  Gene Name: MIS18 kinetochore protein A
  Uniprot ID: Q9NYP9
  ENST ID: ENST00000290130
  CDS Start-End: 56-757
agcagcggcggttttttttcccatggcgctctggggcgcgggcgatttgtaggtaatggcaggcgttcggtcactgaggtgtagcagaggatgcgctggcggctgtgagtgcggcgacaagggcaaatgcagcgactcctcgctgttgggcaagagactctccgaagactcgagccgccaccagctgttgcagaagtgggcgagcatgtggagctccatgagcgaagacgcgtcggtggccgacatggagagggcgcagctggaggaggaggcggcggctgcggaggagaggccgctggtgttcctgtgctccggctgccggcggccgctgggcgactcgctgagctgggtggccagccaggaggacaccaactgcatcctgcttcgctgtgtttcctgtaatgtttctgtggataaggaacagaagctatccaaacgtgaaaaggaaaatggttgcgtccttgagactttgtgctgcgcggggtgctcactcaatcttggctacgtgtacagatgcacgcccaagaatcttgattacaagagagacttgttttgcctcagtgttgaagccattgaaagttatgttttagggtcctctgaaaagcaaattgtgtcagaagataaagagctttttaatcttgaaagcagagttgaaatagaaaagtctctaacacagatggaagatgtcttgaaagcattacaaatgaagctgtgggaggccgaatccaaattgtcctttgccacttgtaaaagctgaactctagtctgtgtcctccattctgcccccgcccttcctccccttatttgttaaatgaagcaacatagtgagacgtcgtctctacaaaaaaaaaaagaaaaaaaaaattagccaggcatgcgaaacgctgaggtgggaggatcagatgagcttgggaggttgaggctgcagtgagccttggtcatgccactactgtgttctagtctgggcaacagagtgagaccttctctcaaaaaaaaaacccaaaattgtagaattacttctatagctatattttatgataaagaagtgattgtttctcaaaatcgcattttaaagacgttttatggtacttgttggaattgggacttaggagttttgattttgataagaaactgggataattttctgaactttttttcctctgtatcacatttatttactatttttaaaaactttgacatttaacacttgggacaacatttattataaatgataagaaaaatcttagaggtttgtctacccacagtgtcatggaatcttctctgaaaactaatccataaagttccctggagaaattggtcagaatgatctgtcagaaccatttgaaaacttgctcaagagcagttgcttatatatagtaggattttactttttcctgcttatgtactactatatgcttaaaaaacctggaggaatacttaccaaagaggagtaaccatctctgagggtgggattctgggggaatttttgtttttttctgttttctataatgtgaaacttttgtagtatgtatttttctaattgaagagaataaagattaaaacaaagtgctttaa

SEQ ID NO: 154189 - DNA, 2431 bp, Homo sapiens
  Payload ID: 10300
  Gene Symbol: MSTO1
  Gene Name: misato 1, mitochondrial distribution and morphology regulator
  Uniprot ID: Q9BUK6
  ENST ID: ENST00000245564
  CDS Start-End: 25-1737
ggcggccccgtggagcagcgcagtatggcgggcggggcccgggaggtgctcacactgcagttgggacattttgccggtttcgtgggcgcgcactggtggaaccagcaggatgctgcgctgggccgagcgaccgattccaaggagcccccgggagagctgtgccccgacgtcctgtatcgtacgggccggacgctgcacggccaggagacctacacgccgcgactcatcctcatggatctgaagggtagtttgagctccctaaaagaggaaggtggactctacagggacaaacagttggatgctgcaatagcatggcaggggaagctcaccacacacaaagaggaactctatcccaagaacccttatctccaagactttctgagtgcagagggagtgctgagtagtgatggtgtctggagggtcaaatccattcccaatggcaaaggttcctcaccactccccaccgctacaactccaaaaccacttatccctacagaggccagcatcagggtctggtcagacttcctcagagtccatctccatccccggagcatctgtatgattcagaagtacaaccacgatggggaagcaggtcggctggaggcttttggccaaggggaaagtgtcctaaaggaacccaagtaccaggaagagctggaggacaggctgcatttctacgtggaggaatgtgactacttgcagggcttccagatcctgtgtgacctgcacgatggcttctctggggtaggcgcgaaggcggcagagctgctacaagatgaatattcagggcggggaataataacctggggcctgctacctggtccctaccatcgtggggaggcccagagaaacatctatcgtctattaaacacagcttttggtctcgtgcacctgactgctcacagctctcttgtctgccccttgtccttgggtgggagcctgggcctgcgacccgagccacctgtcagcttcccttacctgcattatgatgccactctgcccttccactgcagtgccatcctggctacagccctggacacagtcactgttccttatcgcctgtgttcctctccagtttccatggttcatctggctgacatgctgagcttctgtgggaaaaaggtggtgacagcaggagcaatcatccctttccccttggctccaggccagtcccttcctgattccctgatgcagtttggaggagccaccccatggaccccactgtctgcatgtggggagccttctggaacacgttgctttgcccagtcagtggtgctgaggggtatagacagagcatgccacacaagccagctcaccccagggacacctccaccctctgcccttcatgcatgtaccactggggaagaaatcttggctcagtatttacaacagcagcagcctggagtcatgagttcttcccatctgctgctgactccctgcagggtggctcctccttacccccacctcttctcaagctgcagtccaccgggtatggttctggatggttcccccaagggagcagcagtggagagcatcccagtgtttggggcactgtgttcctcttcgtccctgcaccagaccctggaagccttggccagagacctcaccaaactcgacttgcggcgctgggccagcttcatggatgctggagtggagcacgatgacgtagcagagctgctgcaggagctacaaagcctggcccagtgctaccagggtggtgacagcctcgtggactaaagttcccagtgtgggagaaaggagctagtttgcaataaaaacagctggatgcaggagcccagtgtcttcatgcagaggagctcaatgtcgcgggactagctacaccaacatatgcactttttacatttagaaacactgtgattagaccacagaacaataaatatgtgccatcagaccaaaaaaaagtagagaaaggagctgaactccactctcgatgctacttacagaggacatctgtaaagtcttcataaaagaccttgaatgatgcctaggatggcagagcccctgggtcctactccatcctccagcctttgtccttgtcctggcctcctgctctccagatctgtaaactgggctcaaggactgtacaagcagagtacaactacccgcctccccggtgccagggcgcctgttgggtttggtcctgtgtagatgattcccagagtctcattcatccagctcctcttcagacagaaggtccccatggtcagacagctggtctgcattgctggtactggttgcatcatcctcatcctcagagctggcttcacaggcagtgtggaagagctgcatgagttctcgaaaatggtgggaaacctaagaaaggaggagggctgtattcactgatccttagtaacatgttaacatttatgaagcactatatattgatttgcaaaatcttttgtttattcca

SEQ ID NO: 154190 - DNA, 2245 bp, Homo sapiens
  Payload ID: 10300
  Gene Symbol: MSTO1
  Gene Name: misato 1, mitochondrial distribution and morphology regulator
  Uniprot ID: Q9BUK6
  ENST ID: ENST00000368341
  CDS Start-End: 9-1583
agcgcagtatggcgggcggggcccgggaggtgctcacactgcagttgggacattttgccggtttcgtgggcgcgcactggtggaaccagcaggatgctgcgctgggccgagcgaccgattccaaggagcccccgggagagctgtgccccgacgtcctgtatcgtacgggccggacgctgcacggccaggagacctacacgccgcgactcatcctcatggatctgaagggtagtttgagctccctaaaagaggaaggtggactctacagggacaaacagttggatgctgcaatagcatggcaggggaagctcaccacacacaaaggttcctcaccactccccaccgctacaactccaaaaccacttatccctacagaggccagcatcagggtctggtcagacttcctcagagtccatctccatccccggagcatctgtatgattcagaagtacaaccacgatggggaagcaggtcggctggaggcttttggccaaggggaaagtgtcctaaaggaacccaagtaccaggaagagctggaggacaggctgcatttctacgtggaggaatgtgactacttgcagggcttccagatcctgtgtgacctgcacgatggcttctctggggtaggcgcgaaggcggcagagctgctacaagatgaatattcagggcggggaataataacctggggcctgctacctggtccctaccatcgtggggaggcccagagaaacatctatcgtctattaaacacagcttttggtctcgtgcacctgactgctcacagctctcttgtctgccccttgtccttgggtgggagcctgggcctgcgacccgagccacctgtcagcttcccttacctgcattatgatgccactctgcccttccactgcagtgccatcctggctacagccctggacacagtcactgttccttatcgcctgtgttcctctccagtttccatggttcatctggctgacatgctgagcttctgtgggaaaaaggtggtgacagcaggagcaatcatccctttccccttggctccaggccagtcccttcctgattccctgatgcagtttggaggagccaccccatggaccccactgtctgcatgtggggagccttctggaacacgttgctttgcccagtcagtggtgctgaggggtatagacagagcatgccacacaagccagctcaccccagggacacctccaccctctgcccttcatgcatgtaccactggggaagaaatcttggctcagtatttacaacagcagcagcctggagtcatgagttcttcccatctgctgctgactccctgcagggtggctcctccttacccccacctcttctcaagctgcagtccaccggcagtggagagcatcccagtgtttggggcactgtgttcctcttcgtccctgcaccagaccctggaagccttggccagagacctcaccaaactcgacttgcggcgctgggccagcttcatggatgctggagtggagcacgatgacgtagcagagctgctgcaggagctacaaagcctggcccagtgctaccagggtggtgacagcctcgtggactaaagttcccagtgtgggagaaaggagctagtttgcaataaaaacagctggatgcaggagcccagtgtcttcatgcagaggagctcaatgtcgcgggactagctacaccaacatatgcactttttacatttagaaacactgtgattagaccacagaacaataaatatgtgccatcagaccaaaaaaaagtagagaaaggagctgaactccactctcgatgctacttacagaggacatctgtaaagtcttcataaaagaccttgaatgatgcctaggatggcagagcccctgggtcctactccatcctccagcctttgtccttgtcctggcctcctgctctccagatctgtaaactgggctcaaggactgtacaagcagagtacaactacccgcctccccggtgccagggcgcctgttgggtttggtcctgtgtagatgattcccagagtctcattcatccagctcctcttcagacagaaggtccccatggtcagacagctggtctgcattgctggtactggttgcatcatcctcatcctcagagctggcttcacaggcagtgtggaagagctgcatgagttctcgaaaatggtgggaaacctaagaaaggaggagggctgtattcactgatccttagtaacatgttaacatttatgaagcactat

SEQ ID NO: 154191 - DNA, 2346 bp, Homo sapiens
  Payload ID: 10300
  Gene Symbol: MSTO1
  Gene Name: misato 1, mitochondrial distribution and morphology regulator
  Uniprot ID: Q9BUK6
  ENST ID: ENST00000490743
  CDS Start-End: 32-331
gaggcgcggcggccccgtggagcagcgcagtatggcgggcggggcccgggaggtgctcacactgcagttgggacattttgccggtttcgtgggcgcgcactggtggaaccagcaggatgctgcgctgggccgagcgaccgattccaaggagcccccgggagagctgtgccccgacgtcctgtatcgtacgggccggacgctgcacggccaggagacctacacgccgcgactcatcctcatggatctgaagggtagtttgagctccctaaaagaggaaggtggactctacagggacaaacagttggatgctgcaatagcatgggagtgctgagtagtgatggtgtctggagggtcaaatccattcccaatggcaaaggttcctcaccactccccaccgctacaactccaaaaccacttatccctacagaggccagcatcagggtctggtcagacttcctcagagtccatctccatccccggagcatctgtatgattcagaagtacaaccacgatggggaagcaggtcggctggaggcttttggccaaggggaaagtgtcctaaaggaacccaagtaccaggaagagctggaggacaggctgcatttctacgtggaggaatgtgactacttgcagggcttccagatcctgtgtgacctgcacgatggcttctctggggtaggcgcgaaggcggcagagctgctacaagatgaatattcagggcggggaataataacctggggcctgctacctggtccctaccatcgtggggaggcccagagaaacatctatcgtctattaaacacagcttttggtctcgtgcacctgactgctcacagctctcttgtctgccccttgtccttgggtgggagcctgggcctgcgacccgagccacctgtcagcttcccttacctgcattatgatgccactctgcccttccactgcagtgccatcctggctacagccctggacacagtcactgttccttatcgcctgtgttcctctccagtttccatggttcatctggctgacatgctgagcttctgtgggaaaaaggtggtgacagcaggagcaatcatccctttccccttggctccaggccagtcccttcctgattccctgatgcagtttggaggagccaccccatggaccccactgtctgcatgtggggagccttctggaacacgttgctttgcccagtcagtggtgctgaggggtatagacagagcatgccacacaagccagctcaccccagggacacctccaccctctgcccttcatgcatgtaccactggggaagaaatcttggctcagtatttacaacagcagcagcctggagtcatgagttcttcccatctgctgctgactccctgcagggtggctcctccttacccccacctcttctcaagctgcagtccaccgggtatggttctggatggttcccccaagggagcagcagtggagagcatcccagtgtttggggcactgtgttcctcttcgtccctgcaccagaccctggaagccttggccagagacctcaccaaactcgacttgcggcgctgggccagcttcatggatgctggagtggagcacgatgacgtagcagagctgctgcaggagctacaaagcctggcccagtgctaccagggtggtgacagcctcgtggactaaagttcccagtgtgggagaaaggagctagtttgcaataaaaacagctggatgcaggagcccagtgtcttcatgcagaggagctcaatgtcgcgggactagctacaccaacatatgcactttttacatttagaaacactgtgattagaccacagaacaataaatatgtgccatcagaccaaaaaaaagtagagaaaggagctgaactccactctcgatgctacttacagaggacatctgtaaagtcttcataaaagaccttgaatgatgcctaggatggcagagcccctgggtcctactccatcctccagcctttgtccttgtcctggcctcctgctctccagatctgtaaactgggctcaaggactgtacaagcagagtacaactacccgcctccccggtgccagggcgcctgttgggtttggtcctgtgtagatgattcccagagtctcattcatccagctcctcttcagacagaaggtccccatggtcagacagctggtctgcattgctggtactggttgcatcatcctcatcctcagagctggcttcacaggcagtgtggaagagctgcatgagttctcgaaaatggtgggaaacctaagaaaggaggagggctgtattcactgatccttagtaacatgttaacatttatgaagcactatatattgatttgcaaaa

SEQ ID NO: 154192 - DNA, 514 bp, Homo sapiens
  Payload ID: 10300
  Gene Symbol: MSTO1
  Gene Name: misato 1, mitochondrial distribution and morphology regulator
  ENST ID: ENST00000462250
  CDS Start-End: 1-236
catgccacacaagccagctcaccccagggacacctccaccctctgcccttcatgcatgtaccactggggaagaaatcttggctcagtatttacaacagcagcagcctggagtcatgagttcttcccatctgctgctgactccctgcagggtggctcctccttacccccacctcttctcaagctgcagtccaccgggtatggttctggatggttcccccaagggagcaggtatgtaggaggtgaagaaaactgagatttcaagtatgggagagtttttactatctccattcctggattaaaagtgctgaaaaagtccacagttaaacattcctttattcaccctatggctcccaagaaaagcattcttcctctggagtactggtgtactaaggggacaatacaccaaatttgttgagtttacaatcaagtctactaaggttggacttccttatcagtttggcagagtcccagggcagaataatcatccatctacaggtctctgtttcctctccct

SEQ ID NO: 154193 - DNA, 4863 bp, Homo sapiens
  Payload ID: 10301
  Gene Symbol: MINK1
  Gene Name: misshapen-like kinase 1
  Uniprot ID: Q8N4C8
  ENST ID: ENST00000347992
  CDS Start-End: 185-4096
ggagatagcgcctgtcagtcggtgggtcggtcctcgcgccggccctccccctccccggtctccgggggaggcgcggtggagtccgcccccggggttctccgatgggggagaagcggcgacggcggcagtggagtaaccgagccggagcgtgagcggccccggtgccccgttccccacggaggccatgggcgacccagcccccgcccgcagcctggacgacatcgacctgtccgccctgcgggaccctgctgggatctttgagcttgtggaggtggtcggcaatggaacctacggacaggtgtacaagggtcggcatgtcaagacggggcagctggctgccatcaaggtcatggatgtcacggaggacgaggaggaagagatcaaacaggagatcaacatgctgaaaaagtactctcaccaccgcaacatcgccacctactacggagccttcatcaagaagagccccccgggaaacgatgaccagctctggctggtgatggagttctgtggtgctggttcagtgactgacctggtaaagaacacaaaaggcaacgccctgaaggaggactgtatcgcctatatctgcagggagatcctcaggggtctggcccatctccatgcccacaaggtgatccatcgagacatcaaggggcagaatgtgctgctgacagagaatgctgaggtcaagctagtggattttggggtgagtgctcagctggaccgcaccgtgggcagacggaacactttcattgggactccctactggatggctccagaggtcatcgcctgtgatgagaaccctgatgccacctatgattacaggagtgatatttggtctctaggaatcacagccatcgagatggcagagggagccccccctctgtgtgacatgcaccccatgcgagccctcttcctcattcctcggaaccctccgcccaggctcaagtccaagaagtggtctaagaagttcattgacttcattgacacatgtctcatcaagacttacctgagccgcccacccacggagcagctactgaagtttcccttcatccgggaccagcccacggagcggcaggtccgcatccagcttaaggaccacattgaccgatcccggaagaagcggggtgagaaagaggagacagaatatgagtacagcggcagcgaggaggaagatgacagccatggagaggaaggagagccaagctccatcatgaacgtgcctggagagtcgactctacgccgggagtttctccggctccagcaggaaaataagagcaactcagaggctttaaaacagcagcagcagctgcagcagcagcagcagcgagaccccgaggcacacatcaaacacctgctgcaccagcggcagcggcgcatagaggagcagaaggaggagcggcgccgcgtggaggagcaacagcggcgggagcgggagcagcggaagctgcaggagaaggagcagcagcggcggctggaggacatgcaggctctgcggcgggaggaggagcggcggcaggcggagcgcgagcaggaatacaagcggaagcagctggaggagcagcggcagtcagaacgtctccagaggcagctgcagcaggagcatgcctacctcaagtccctgcagcagcagcaacagcagcagcagcttcagaaacagcagcagcagcagctcctgcctggggacaggaagcccctgtaccattatggtcggggcatgaatcccgctgacaaaccagcctgggcccgagaggtagaagagagaacaaggatgaacaagcagcagaactctcccttggccaagagcaagccaggcagcacggggcctgagccccccatcccccaggcctccccagggcccccaggacccctttcccagactcctcctatgcagaggccggtggagccccaggagggaccgcacaagagcctggtggcacaccgggtcccactgaagccatatgcagcacctgtaccccgatcccagtccctgcaggaccagcccacccgaaacctggctgccttcccagcctcccatgaccccgaccctgccatccccgcacccactgccacgcccagtgcccgaggagctgtcatccgccagaattcagaccccacctctgaaggacctggccccagcccgaatcccccagcctgggtccgcccagataacgaggccccacccaaggtgcctcagaggacctcatctatcgccactgcccttaacaccagtggggccggagggtcccggccagcccaggcagtccgtgccagtaaccccgacctcaggaggagcgaccctggctgggaacgctcggacagcgtccttccagcctctcacgggcacctcccccaggctggctcactggagcggaaccgcgtgggagtctcctccaaaccggacagctcccctgtgctctcccctgggaataaagccaagcccgacgaccaccgctcacggccaggccggcccgcaagctataagcgagcaattggtgaggactttgtgttgctgaaagagcggactctggacgaggcccctcggcctcccaagaaggccatggactactcgtcgtccagcgaggaggtggaaagcagtgaggacgacgaggaggaaggcgaaggcgggccagcagaggggagcagagatacccctgggggccgcagcgatggggatacagacagcgtcagcaccatggtggtccacgacgtcgaggagatcaccgggacccagcccccatacgggggcggcaccatggtggtccagcgcacccctgaagaggagcggaacctgctgcatgctgacagcaatgggtacacaaacctgcctgacgtggtccagcccagccactcacccaccgagaacagcaaaggccaaagcccaccctcgaaggatgggagtggtgactaccagtctcgtgggctggtaaaggcccctggcaagagctcgttcacgatgtttgtggatctagggatctaccagcctggaggcagtggggacagcatccccatcacagccctagtgggtggagagggcactcggctcgaccagctgcagtacgacgtgaggaagggttctgtggtcaacgtgaatcccaccaacacccgggcccacagtgagacccctgagatccggaagtacaagaagcgattcaactccgagatcctctgtgcagccctttggggggtcaacctgctggtgggcacggagaacgggctgatgttgctggaccgaagtgggcagggcaaggtgtatggactcattgggcggcgacgcttccagcagatggatgtgctggaggggctcaacctgctcatcaccatctcagggaaaaggaacaaactgcgggtgtattacctgtcctggctccggaacaagattctgcacaatgacccagaagtggagaagaagcagggctggaccaccgtgggggacatggagggctgcgggcactaccgtgttgtgaaatacgagcggattaagttcctggtcatcgccctcaagagctccgtggaggtgtatgcctgggcccccaaaccctaccacaaattcatggccttcaagtcctttgccgacctcccccaccgccctctgctggtcgacctgacagtagaggaggggcagcggctcaaggtcatctatggctccagtgctggcttccatgctgtggatgtcgactcggggaacagctatgacatctacatccctgtgcacatccagagccagatcacgccccatgccatcatcttcctccccaacaccgacggcatggagatgctgctgtgctacgaggacgagggtgtctacgtcaacacgtacgggcgcatcattaaggatgtggtgctgcagtggggggagatgcctacttctgtggcctacatctgctccaaccagataatgggctggggtgagaaagccattgagatccgctctgtggagacgggccacctcgacggggtcttcatgcacaaacgagctcagaggctcaagttcctgtgtgagcggaatgacaaggtgttttttgcctcagtccgctctgggggcagcagccaagtttacttcatgactctgaaccgtaactgcatcatgaactggtgacggggccctgggctggggctgtcccacactggacccagctctccccctgcagccaggcttcccgggccgcccctctttcccctccctgggcttttgcttttactggtttgatttcactggagcctgctgggaacgtgacctctgacccctgatgctttcgtgatcacgtgaccatcctcttccccaacatgtcctcttcccaaaactgtgcctgtccccagcttctggggagggacacagcttccccttcccaggaattgagtgggcctagcccctccccccttttctccatttgagaggagagtgcttggggcttgaaccccttaccccactgctgctgactgggcagggccctggacccctttatttgcacgtcaggggagccggctccccccttgaatgtaccagaccctggggggggtcactgggccctagatttttggggggtcaccagccactccaggggcagggaccatttcttcattttctgaaagcactttaatgattccccttcccccaaactccagggaatggaggggggaccccgccagccaaaacattccccccattcccgacccccctctcctcttctagcccatgcccttccccggtggagggagggagcagggagccctcactctccacgccccttgcttgcatctgtatatagtgtgagcagcaagtaacccttctccctccccccccacccctcctcaatgtagtggccttggatatcctgtttgttaataaagacaattcaaccagct

SEQ ID NO: 154194 - DNA, 4961 bp, Homo sapiens
  Payload ID: 10301
  Gene Symbol: MINK1
  Gene Name: misshapen-like kinase 1
  Uniprot ID: Q8N4C8
  ENST ID: ENST00000355280
  CDS Start-End: 197-4195
ggctggctccggggagatagcgcctgtcagtcggtgggtcggtcctcgcgccggccctccccctccccggtctccgggggaggcgcggtggagtccgcccccggggttctccgatgggggagaagcggcgacggcggcagtggagtaaccgagccggagcgtgagcggccccggtgccccgttccccacggaggccatgggcgacccagcccccgcccgcagcctggacgacatcgacctgtccgccctgcgggaccctgctgggatctttgagcttgtggaggtggtcggcaatggaacctacggacaggtgtacaagggtcggcatgtcaagacggggcagctggctgccatcaaggtcatggatgtcacggaggacgaggaggaagagatcaaacaggagatcaacatgctgaaaaagtactctcaccaccgcaacatcgccacctactacggagccttcatcaagaagagccccccgggaaacgatgaccagctctggctggtgatggagttctgtggtgctggttcagtgactgacctggtaaagaacacaaaaggcaacgccctgaaggaggactgtatcgcctatatctgcagggagatcctcaggggtctggcccatctccatgcccacaaggtgatccatcgagacatcaaggggcagaatgtgctgctgacagagaatgctgaggtcaagctagtggattttggggtgagtgctcagctggaccgcaccgtgggcagacggaacactttcattgggactccctactggatggctccagaggtcatcgcctgtgatgagaaccctgatgccacctatgattacaggagtgatatttggtctctaggaatcacagccatcgagatggcagagggagccccccctctgtgtgacatgcaccccatgcgagccctcttcctcattcctcggaaccctccgcccaggctcaagtccaagaagtggtctaagaagttcattgacttcattgacacatgtctcatcaagacttacctgagccgcccacccacggagcagctactgaagtttcccttcatccgggaccagcccacggagcggcaggtccgcatccagcttaaggaccacattgaccgatcccggaagaagcggggtgagaaagaggagacagaatatgagtacagcggcagcgaggaggaagatgacagccatggagaggaaggagagccaagctccatcatgaacgtgcctggagagtcgactctacgccgggagtttctccggctccagcaggaaaataagagcaactcagaggctttaaaacagcagcagcagctgcagcagcagcagcagcgagaccccgaggcacacatcaaacacctgctgcaccagcggcagcggcgcatagaggagcagaaggaggagcggcgccgcgtggaggagcaacagcggcgggagcgggagcagcggaagctgcaggagaaggagcagcagcggcggctggaggacatgcaggctctgcggcgggaggaggagcggcggcaggcggagcgcgagcaggaatacaagcggaagcagctggaggagcagcggcagtcagaacgtctccagaggcagctgcagcaggagcatgcctacctcaagtccctgcagcagcagcaacagcagcagcagcttcagaaacagcagcagcagcagctcctgcctggggacaggaagcccctgtaccattatggtcggggcatgaatcccgctgacaaaccagcctgggcccgagaggtagaagagagaacaaggatgaacaagcagcagaactctcccttggccaagagcaagccaggcagcacggggcctgagccccccatcccccaggcctccccagggcccccaggacccctttcccagactcctcctatgcagaggccggtggagccccaggagggaccgcacaagagcctggtggcacaccgggtcccactgaagccatatgcagcacctgtaccccgatcccagtccctgcaggaccagcccacccgaaacctggctgccttcccagcctcccatgaccccgaccctgccatccccgcacccactgccacgcccagtgcccgaggagctgtcatccgccagaattcagaccccacctctgaaggacctggccccagcccgaatcccccagcctgggtccgcccagataacgaggccccacccaaggtgcctcagaggacctcatctatcgccactgcccttaacaccagtggggccggagggtcccggccagcccaggcagtccgtgccagacctcgcagcaactccgcctggcaaatctatctgcaaaggcgggcagagcggggcaccccaaagcctccagggccccctgctcagccccctggcccgcccaacgcctctagtaaccccgacctcaggaggagcgaccctggctgggaacgctcggacagcgtccttccagcctctcacgggcacctcccccaggctggctcactggagcggaaccgcgtgggagtctcctccaaaccggacagctcccctgtgctctcccctgggaataaagccaagcccgacgaccaccgctcacggccaggccggcccgcagactttgtgttgctgaaagagcggactctggacgaggcccctcggcctcccaagaaggccatggactactcgtcgtccagcgaggaggtggaaagcagtgaggacgacgaggaggaaggcgaaggcgggccagcagaggggagcagagatacccctgggggccgcagcgatggggatacagacagcgtcagcaccatggtggtccacgacgtcgaggagatcaccgggacccagcccccatacgggggcggcaccatggtggtccagcgcacccctgaagaggagcggaacctgctgcatgctgacagcaatgggtacacaaacctgcctgacgtggtccagcccagccactcacccaccgagaacagcaaaggccaaagcccaccctcgaaggatgggagtggtgactaccagtctcgtgggctggtaaaggcccctggcaagagctcgttcacgatgtttgtggatctagggatctaccagcctggaggcagtggggacagcatccccatcacagccctagtgggtggagagggcactcggctcgaccagctgcagtacgacgtgaggaagggttctgtggtcaacgtgaatcccaccaacacccgggcccacagtgagacccctgagatccggaagtacaagaagcgattcaactccgagatcctctgtgcagccctttggggggtcaacctgctggtgggcacggagaacgggctgatgttgctggaccgaagtgggcagggcaaggtgtatggactcattgggcggcgacgcttccagcagatggatgtgctggaggggctcaacctgctcatcaccatctcagggaaaaggaacaaactgcgggtgtattacctgtcctggctccggaacaagattctgcacaatgacccagaagtggagaagaagcagggctggaccaccgtgggggacatggagggctgcgggcactaccgtgttgtgaaatacgagcggattaagttcctggtcatcgccctcaagagctccgtggaggtgtatgcctgggcccccaaaccctaccacaaattcatggccttcaagtcctttgccgacctcccccaccgccctctgctggtcgacctgacagtagaggaggggcagcggctcaaggtcatctatggctccagtgctggcttccatgctgtggatgtcgactcggggaacagctatgacatctacatccctgtgcacatccagagccagatcacgccccatgccatcatcttcctccccaacaccgacggcatggagatgctgctgtgctacgaggacgagggtgtctacgtcaacacgtacgggcgcatcattaaggatgtggtgctgcagtggggggagatgcctacttctgtggcctacatctgctccaaccagataatgggctggggtgagaaagccattgagatccgctctgtggagacgggccacctcgacggggtcttcatgcacaaacgagctcagaggctcaagttcctgtgtgagcggaatgacaaggtgttttttgcctcagtccgctctgggggcagcagccaagtttacttcatgactctgaaccgtaactgcatcatgaactggtgacggggccctgggctggggctgtcccacactggacccagctctccccctgcagccaggcttcccgggccgcccctctttcccctccctgggcttttgcttttactggtttgatttcactggagcctgctgggaacgtgacctctgacccctgatgctttcgtgatcacgtgaccatcctcttccccaacatgtcctcttcccaaaactgtgcctgtccccagcttctggggagggacacagcttccccttcccaggaattgagtgggcctagcccctccccccttttctccatttgagaggagagtgcttggggcttgaaccccttaccccactgctgctgactgggcagggccctggacccctttatttgcacgtcaggggagccggctccccccttgaatgtaccagaccctggggggggtcactgggccctagatttttggggggtcaccagccactccaggggcagggaccatttcttcattttctgaaagcactttaatgattccccttcccccaaactccagggaatggaggggggaccccgccagccaaaacattccccccattcccgacccccctctcctcttctagcccatgcccttccccggtggagggagggagcagggagccctcactctccacgccccttgcttgcatctgtatatagtgtgagcagcaagtaacccttctccctccccccccacccctcctcaatgtagtggccttggatatcctgtttgttaataaagacaattcaaccagc

SEQ ID NO: 154195 - DNA, 3939 bp, Homo sapiens
  Payload ID: 10301
  Gene Symbol: MINK1
  Gene Name: misshapen-like kinase 1
  Uniprot ID: Q8N4C8
  ENST ID: ENST00000453408
  CDS Start-End: 1-3939
atgggcgacccagcccccgcccgcagcctggacgacatcgacctgtccgccctgcgggaccctgctgggatctttgagcttgtggaggtggtcggcaatggaacctacggacaggtgtacaagggtcggcatgtcaagacggggcagctggctgccatcaaggtcatggatgtcacggaggacgaggaggaagagatcaaacaggagatcaacatgctgaaaaagtactctcaccaccgcaacatcgccacctactacggagccttcatcaagaagagccccccgggaaacgatgaccagctctggctggtgatggagttctgtggtgctggttcagtgactgacctggtaaagaacacaaaaggcaacgccctgaaggaggactgtatcgcctatatctgcagggagatcctcaggggtctggcccatctccatgcccacaaggtgatccatcgagacatcaaggggcagaatgtgctgctgacagagaatgctgaggtcaagctagtggattttggggtgagtgctcagctggaccgcaccgtgggcagacggaacactttcattgggactccctactggatggctccagaggtcatcgcctgtgatgagaaccctgatgccacctatgattacaggagtgatatttggtctctaggaatcacagccatcgagatggcagagggagccccccctctgtgtgacatgcaccccatgcgagccctcttcctcattcctcggaaccctccgcccaggctcaagtccaagaagtggtctaagaagttcattgacttcattgacacatgtctcatcaagacttacctgagccgcccacccacggagcagctactgaagtttcccttcatccgggaccagcccacggagcggcaggtccgcatccagcttaaggaccacattgaccgatcccggaagaagcggggtgagaaagaggagacagaatatgagtacagcggcagcgaggaggaagatgacagccatggagaggaaggagagccaagctccatcatgaacgtgcctggagagtcgactctacgccgggagtttctccggctccagcaggaaaataagagcaactcagaggctttaaaacagcagcagcagctgcagcagcagcagcagcgagaccccgaggcacacatcaaacacctgctgcaccagcggcagcggcgcatagaggagcagaaggaggagcggcgccgcgtggaggagcaacagcggcgggagcgggagcagcggaagctgcaggagaaggagcagcagcggcggctggaggacatgcaggctctgcggcgggaggaggagcggcggcaggcggagcgcgagcaggaatacaagcggaagcagctggaggagcagcggcagtcagaacgtctccagaggcagctgcagcaggagcatgcctacctcaagtccctgcagcagcagcaacagcagcagcagcttcagaaacagcagcagcagcagctcctgcctggggacaggaagcccctgtaccattatggtcggggcatgaatcccgctgacaaaccagcctgggcccgagaggtagaagagagaacaaggatgaacaagcagcagaactctcccttggccaagagcaagccaggcagcacggggcctgagccccccatcccccaggcctccccagggcccccaggacccctttcccagactcctcctatgcagaggccggtggagccccaggagggaccgcacaagtccctgcaggaccagcccacccgaaacctggctgccttcccagcctcccatgaccccgaccctgccatccccgcacccactgccacgcccagtgcccgaggagctgtcatccgccagaattcagaccccacctctgaaggacctggccccagcccgaatcccccagcctgggtccgcccagataacgaggccccacccaaggtgcctcagaggacctcatctatcgccactgcccttaacaccagtggggccggagggtcccggccagcccaggcagtccgtgccagacctcgcagcaactccgcctggcaaatctatctgcaaaggcgggcagagcggggcaccccaaagcctccagggccccctgctcagccccctggcccgcccaacgcctctagtaaccccgacctcaggaggagcgaccctggctgggaacgctcggacagcgtccttccagcctctcacgggcacctcccccaggctggctcactggagcggaaccgcgtgggagtctcctccaaaccggacagctcccctgtgctctcccctgggaataaagccaagcccgacgaccaccgctcacggccaggccggcccgcagactttgtgttgctgaaagagcggactctggacgaggcccctcggcctcccaagaaggccatggactactcgtcgtccagcgaggaggtggaaagcagtgaggacgacgaggaggaaggcgaaggcgggccagcagaggggagcagagatacccctgggggccgcagcgatggggatacagacagcgtcagcaccatggtggtccacgacgtcgaggagatcaccgggacccagcccccatacgggggcggcaccatggtggtccagcgcacccctgaagaggagcggaacctgctgcatgctgacagcaatgggtacacaaacctgcctgacgtggtccagcccagccactcacccaccgagaacagcaaaggccaaagcccaccctcgaaggatgggagtggtgactaccagtctcgtgggctggtaaaggcccctggcaagagctcgttcacgatgtttgtggatctagggatctaccagcctggaggcagtggggacagcatccccatcacagccctagtgggtggagagggcactcggctcgaccagctgcagtacgacgtgaggaagggttctgtggtcaacgtgaatcccaccaacacccgggcccacagtgagacccctgagatccggaagtacaagaagcgattcaactccgagatcctctgtgcagccctttggggggtcaacctgctggtgggcacggagaacgggctgatgttgctggaccgaagtgggcagggcaaggtgtatggactcattgggcggcgacgcttccagcagatggatgtgctggaggggctcaacctgctcatcaccatctcagggaaaaggaacaaactgcgggtgtattacctgtcctggctccggaacaagattctgcacaatgacccagaagtggagaagaagcagggctggaccaccgtgggggacatggagggctgcgggcactaccgtgttgtgaaatacgagcggattaagttcctggtcatcgccctcaagagctccgtggaggtgtatgcctgggcccccaaaccctaccacaaattcatggccttcaagtcctttgccgacctcccccaccgccctctgctggtcgacctgacagtagaggaggggcagcggctcaaggtcatctatggctccagtgctggcttccatgctgtggatgtcgactcggggaacagctatgacatctacatccctgtgcacatccagagccagatcacgccccatgccatcatcttcctccccaacaccgacggcatggagatgctgctgtgctacgaggacgagggtgtctacgtcaacacgtacgggcgcatcattaaggatgtggtgctgcagtggggggagatgcctacttctgtggcctacatctgctccaaccagataatgggctggggtgagaaagccattgagatccgctctgtggagacgggccacctcgacggggtcttcatgcacaaacgagctcagaggctcaagttcctgtgtgagcggaatgacaaggtgttttttgcctcagtccgctctgggggcagcagccaagtttacttcatgactctgaaccgtaactgcatcatgaactggtga

SEQ ID NO: 154196 - DNA, 770 bp, Homo sapiens
  Payload ID: 10301
  Gene Symbol: MINK1
  Gene Name: misshapen-like kinase 1
  ENST ID: ENST00000576037
  CDS Start-End: 1-486
ctcccccaccgccctctgctggtcgacctgacagtagaggaggggcagcggctcaaggtcatctatggctccagtgctggcttccatgctgtggatgtcgactcggggaacagctatgacatctacatccctgtgcacatccagagccagatcacgccccatgccatcatcttcctccccaacaccgacggcatggagatgctgctgtgctacgaggacgagggtgtctacgtcaacacgtacgggcgcatcattaaggatgtggtgctgcagtggggggagatgcctacttctgtggcctacatctgctccaaccagataatgggctggggtgagaaagccattgagatccgctctgtggagacgggccacctcgacggggtcttcatgcacaaacgagctcagaggctcaagttcctgtgtgagcggaatgacaaggtgggaggctccttccctctgaaagccctgctgtcccggctgccatgaccctaggcccctgggcagagttctggggagaggatggtggtggtggcttcctgaaagcgggcccctctgggagctcagagggcagtcagccactaccactgccctgcgctcccttcagattccgaggacttcccagctggcccccagggggcgagtggtgcaccctctcccctaacatcccagcctgcctttcctccgggtgaggggcactgtgagtctcctcctgcagtctctgtgtctccctcaactcttctgccaccccttcttcccttctttccctctcc

SEQ ID NO: 154197 - DNA, 675 bp, Homo sapiens
  Payload ID: 10301
  Gene Symbol: MINK1
  Gene Name: misshapen-like kinase 1
  ENST ID: ENST00000577021
  CDS Start-End: 1-161
tcgacctgtccgccctgcgggaccctgctgggatctttgagcttgtggaggtggtcggcaatggaacctacggacaggtgtacaagggtcggcatgtcaagacggggcagctggctgccatcaaggtcatggatgtcacggagctcctcccatctgcttaggacgaggaggaagagatcaaacaggagatcaacatgctgaaaaagtactctcaccaccgcaacatcgccacctactacggagccttcatcaagaagagccccccgggaaacgatgaccagctctggctggtgatggagttctgtggtgctggttcagtgactgacctggtaaagaacacaaaaggcaacgccctgaaggaggactgtatcgcctatatctgcagggagatcctcaggggtctggcccatctccatgcccacaaggtgatccatcgagacatcaaggggcagaatgtgctgctgacagagaatgctgaggtcaagctagtggattttggggtgagtgctcagctggaccgcaccgtgggcagacggaacactttcattgggactccctactggatggctccagaggtcatcgcctgtgatgagaaccctgatgccacctatgattacaggagtgatatttggtctctaggaatcacagccatcgagatggcagagggagcccccc

SEQ ID NO: 154198 - DNA, 4569 bp, Homo sapiens
  Payload ID: 10301
  Gene Symbol: MINK1
  Gene Name: misshapen-like kinase 1
  ENST ID: ENST00000571207
  CDS Start-End: 1-1145
tcaggggtctggcccatctccatgcccacaaggtgatccatcgagacatcaaggggcagaatgtgctgctgacagagaatgctgaggtcaagctagtggattttggggtgagtgctcagctggaccgcaccgtgggcagacggaacactttcattgggactccctactggatggctccagaggtcatcgcctgtgatgagaaccctgatgccacctatgattacaggagtgatatttggtctctaggaatcacagccatcgagatggcagagggagccccccctctgtgtgacatgcaccccatgcgagccctcttcctcattcctcggaaccctccgcccaggctcaagtccaagaagtggtctaagaagttcattgacttcattgacacatgtctcatcaagacttacctgagccgcccacccacggagcagctactgaagtttcccttcatccgggaccagcccacggagcggcaggtccgcatccagcttaaggaccacattgaccgatcccggaagaagcggggtgagaaagaggagacagaatatgagtacagcggcagcgaggaggaagatgacagccatggagaggaaggagagccaagctccatcatgaacgtgcctggagagtcgactctacgccgggagtttctccggctccagcaggaaaataagagcaactcagaggctttaaaacagcagcagcagctgcagcagcagcagcagcgagaccccgaggcacacatcaaacacctgctgcaccagcggcagcggcgcatagaggagcagaaggaggagcggcgccgcgtggaggagcaacagcggcgggagcgggagcagcggaagctgcaggagaaggagcagcagcggcggctggaggacatgcaggctctgcggcgggaggaggagcggcggcaggcggagcgcgagcaggaatatattcgtcacaggctagaggaggagcagcgacagctcgagatccttcagcaacagctgctccaggaacaggccctgctgctggtaacgggtccctcagcgtcctctgggaagatgcttttcagagcttctttgctggaacgggatgggaacacttcaagggaagggattcacccaggacatcaagggaatacatctcctctctaggcagttggagaaaagagagggcatgcctgctctaactcccagggccacaccctgctgagccctctctccctacccttgggcccaggaatacaagcggaagcagctggaggagcagcggcagtcagaacgtctccagaggcagctgcagcaggagcatgcctacctcaagtccctgcagcagcagcaacagcagcagcagcttcagaaacagcagcagcagcagctcctgcctggggacaggaagcccctgtaccattatggtcggggcatgaatcccgctgacaaaccagcctgggcccgagaggtagaagagagaacaaggatgaacaagcagcagaactctcccttggccaagagcaagccaggcagcacggggcctgagccccccatcccccaggcctccccagggcccccaggacccctttcccagactcctcctatgcagaggccggtggagccccaggagggaccgcacaagagcctggtggcacaccgggtcccactgaagccatatgcagcacctgtaccccgatcccagtccctgcaggaccagcccacccgaaacctggctgccttcccagcctcccatgaccccgaccctgccatccccgcacccactgccacgcccagtgcccgaggagctgtcatccgccagaattcagaccccacctctgaaggacctggccccagcccgaatcccccagcctgggtccgcccagataacgaggccccacccaaggtgcctcagaggacctcatctatcgccactgcccttaacaccagtggggccggagggtcccggccagcccaggcagtccgtgccagtaaccccgacctcaggaggagcgaccctggctgggaacgctcggacagcgtccttccagcctctcacgggcacctcccccaggctggctcactggagcggaaccgcgtgggagtctcctccaaaccggacagctcccctgtgctctcccctgggaataaagccaagcccgacgaccaccgctcacggccaggccggcccgcaagctataagcgagcaattggtgaggactttgtgttgctgaaagagcggactctggacgaggcccctcggcctcccaagaaggccatggactactcgtcgtccagcgaggaggtggaaagcagtgaggacgacgaggaggaaggcgaaggcgggccagcagaggggagcagagatacccctgggggccgcagcgatggggatacagacagcgtcagcaccatggtggtccacgacgtcgaggagatcaccgggacccagcccccatacgggggcggcaccatggtggtccagcgcacccctgaagaggagcggaacctgctgcatgctgacagcaatgggtacacaaacctgcctgacgtggtccagcccagccactcacccaccgagaacagcaaaggccaaagcccaccctcgaaggatgggagtggtgactaccagtctcgtgggctggtaaaggcccctggcaagagctcgttcacgatgtttgtggatctagggatctaccagcctggaggcagtggggacagcatccccatcacagccctagtgggtggagagggcactcggctcgaccagctgcagtacgacgtgaggaagggttctgtggtcaacgtgaatcccaccaacacccgggcccacagtgagacccctgagatccggaagtacaagaagcgattcaactccgagatcctctgtgcagccctttggggggtcaacctgctggtgggcacggagaacgggctgatgttgctggaccgaagtgggcagggcaaggtgtatggactcattgggcggcgacgcttccagcagatggatgtgctggaggggctcaacctgctcatcaccatctcagggaaaaggaacaaactgcgggtgtattacctgtcctggctccggaacaagattctgcacaatgacccagaagtggagaagaagcagggctggaccaccgtgggggacatggagggctgcgggcactaccgtgttgtgaaatacgagcggattaagttcctggtcatcgccctcaagagctccgtggaggtgtatgcctgggcccccaaaccctaccacaaattcatggccttcaagtcctttgccgacctcccccaccgccctctgctggtcgacctgacagtagaggaggggcagcggctcaaggtcatctatggctccagtgctggcttccatgctgtggatgtcgactcggggaacagctatgacatctacatccctgtgcacatccagagccagatcacgccccatgccatcatcttcctccccaacaccgacggcatggagatgctgctgtgctacgaggacgagggtgtctacgtcaacacgtacgggcgcatcattaaggatgtggtgctgcagtggggggagatgcctacttctgtggcctacatctgctccaaccagataatgggctggggtgagaaagccattgagatccgctctgtggagacgggccacctcgacggggtcttcatgcacaaacgagctcagaggctcaagttcctgtgtgagcggaatgacaaggtgttttttgcctcagtccgctctgggggcagcagccaagtttacttcatgactctgaaccgtaactgcatcatgaactggtgacggggccctgggctggggctgtcccacactggacccagctctccccctgcagccaggcttcccgggccgcccctctttcccctccctgggcttttgcttttactggtttgatttcactggagcctgctgggaacgtgacctctgacccctgatgctttcgtgatcacgtgaccatcctcttccccaacatgtcctcttcccaaaactgtgcctgtccccagcttctggggagggacacagcttccccttcccaggaattgagtgggcctagcccctccccccttttctccatttgagaggagagtgcttggggcttgaaccccttaccccactgctgctgactgggcagggccctggacccctttatttgcacgtcaggggagccggctccccccttgaatgtaccagaccctggggggggtcactgggccctagatttttggggggtcaccagccactccaggggcagggaccatttcttcattttctgaaagcactttaatgattccccttcccccaaactccagggaatggaggggggaccccgccagccaaaacattccccccattcccgacccccctctcctcttctagcccatgcccttccccggtggagggagggagcagggagccctcactctccacgccccttgcttgcatctgtatatagtgtgagcagcaagtaacccttctccctccccccccacccctcctcaatgtagtggccttggatatcctgtttgttaataaagacaattcaaccagctcccacca

SEQ ID NO: 154199 - DNA, 4941 bp, Homo sapiens
  Payload ID: 10301
  Gene Symbol: MINK1
  Gene Name: misshapen-like kinase 1
  ENST ID: ENST00000574453
  CDS Start-End: 172-507
gtcagtcggtgggtcggtcctcgcgccggccctccccctccccggtctccgggggaggcgcggtggagtccgcccccggggttctccgatgggggagaagcggcgacggcggcagtggagtaaccgagccggagcgtgagcggccccggtgccccgttccccacggaggccatgggcgacccagcccccgcccgcagcctggacgacatcgacctgtccgccctgcgggctttatggttccagttcttctaccattctggaagctccctagaatctcctggaatgcttaatggacctttccagcaccgaaattcaagaattatgactcatcggtcagcagaaaagaccctgctgggatctttgagcttgtggaggtggtcggcaatggaacctacggacaggtgtacaagggtcggcatgtcaagacggggcagctggctgccatcaaggtcatggatgtcacggaggacgaggaggaagagatcaaacaggagatcaacatgctgaaaaagtactctcaccaccgcaacatcgccacctactacggagccttcatcaagaagagccccccgggaaacgatgaccagctctggctggtgatggagttctgtggtgctggttcagtgactgacctggtaaagaacacaaaaggcaacgccctgaaggaggactgtatcgcctatatctgcagggagatcctcaggggtctggcccatctccatgcccacaaggtgatccatcgagacatcaaggggcagaatgtgctgctgacagagaatgctgaggtcaagctagtggattttggggtgagtgctcagctggaccgcaccgtgggcagacggaacactttcattgggactccctactggatggctccagaggtcatcgcctgtgatgagaaccctgatgccacctatgattacaggagtgatatttggtctctaggaatcacagccatcgagatggcagagggagccccccctctgtgtgacatgcaccccatgcgagccctcttcctcattcctcggaaccctccgcccaggctcaagtccaagaagtggtctaagaagttcattgacttcattgacacatgtctcatcaagacttacctgagccgcccacccacggagcagctactgaagtttcccttcatccgggaccagcccacggagcggcaggtccgcatccagcttaaggaccacattgaccgatcccggaagaagcggggtgagaaagaggagacagaatatgagtacagcggcagcgaggaggaagatgacagccatggagaggaaggagagccaagctccatcatgaacgtgcctggagagtcgactctacgccgggagtttctccggctccagcaggaaaataagagcaactcagaggctttaaaacagcagcagcagctgcagcagcagcagcagcgagaccccgaggcacacatcaaacacctgctgcaccagcggcagcggcgcatagaggagcagaaggaggagcggcgccgcgtggaggagcaacagcggcgggagcgggagcagcggaagctgcaggagaaggagcagcagcggcggctggaggacatgcaggctctgcggcgggaggaggagcggcggcaggcggagcgcgagcaggaatacaagcggaagcagctggaggagcagcggcagtcagaacgtctccagaggcagctgcagcaggagcatgcctacctcaagtccctgcagcagcagcaacagcagcagcagcttcagaaacagcagcagcagcagctcctgcctggggacaggaagcccctgtaccattatggtcggggcatgaatcccgctgacaaaccagcctgggcccgagaggtagaagagagaacaaggatgaacaagcagcagaactctcccttggccaagagcaagccaggcagcacggggcctgagccccccatcccccaggcctccccagggcccccaggacccctttcccagactcctcctatgcagaggccggtggagccccaggagggaccgcacaagagcctggtggcacaccgggtcccactgaagccatatgcagcacctgtaccccgatcccagtccctgcaggaccagcccacccgaaacctggctgccttcccagcctcccatgaccccgaccctgccatccccgcacccactgccacgcccagtgcccgaggagctgtcatccgccagaattcagaccccacctctgaaggacctggccccagcccgaatcccccagcctgggtccgcccagataacgaggccccacccaaggtgcctcagaggacctcatctatcgccactgcccttaacaccagtggggccggagggtcccggccagcccaggcagtccgtgccagtaaccccgacctcaggaggagcgaccctggctgggaacgctcggacagcgtccttccagcctctcacgggcacctcccccaggctggctcactggagcggaaccgcgtgggagtctcctccaaaccggacagctcccctgtgctctcccctgggaataaagccaagcccgacgaccaccgctcacggccaggccggcccgcagactttgtgttgctgaaagagcggactctggacgaggcccctcggcctcccaagaaggccatggactactcgtcgtccagcgaggaggtggaaagcagtgaggacgacgaggaggaaggcgaaggcgggccagcagaggggagcagagatacccctgggggccgcagcgatggggatacagacagcgtcagcaccatggtggtccacgacgtcgaggagatcaccgggacccagcccccatacgggggcggcaccatggtggtccagcgcacccctgaagaggagcggaacctgctgcatgctgacagcaatgggtacacaaacctgcctgacgtggtccagcccagccactcacccaccgagaacagcaaaggccaaagcccaccctcgaaggatgggagtggtgactaccagtctcgtgggctggtaaaggcccctggcaagagctcgttcacgatgtttgtggatctagggatctaccagcctggaggcagtggggacagcatccccatcacagccctagtgggtggagagggcactcggctcgaccagctgcagtacgacgtgaggaagggttctgtggtcaacgtgaatcccaccaacacccgggcccacagtgagacccctgagatccggaagtacaagaagcgattcaactccgagatcctctgtgcagccctttggggggtcaacctgctggtgggcacggagaacgggctgatgttgctggaccgaagtgggcagggcaaggtgtatggactcattgggcggcgacgcttccagcagatggatgtgctggaggggctcaacctgctcatcaccatctcagggaaaaggaacaaactgcgggtgtattacctgtcctggctccggaacaagattctgcacaatgacccagaagtggagaagaagcagggctggaccaccgtgggggacatggagggctgcgggcactaccgtgttgtgaaatacgagcggattaagttcctggtcatcgccctcaagagctccgtggaggtgtatgcctgggcccccaaaccctaccacaaattcatggccttcaagtcctttgccgacctcccccaccgccctctgctggtcgacctgacagtagaggaggggcagcggctcaaggtcatctatggctccagtgctggcttccatgctgtggatgtcgactcggggaacagctatgacatctacatccctgtgcacatccagagccagatcacgccccatgccatcatcttcctccccaacaccgacggcatggagatgctgctgtgctacgaggacgagggtgtctacgtcaacacgtacgggcgcatcattaaggatgtggtgctgcagtggggggagatgcctacttctgtggcctacatctgctccaaccagataatgggctggggtgagaaagccattgagatccgctctgtggagacgggccacctcgacggggtcttcatgcacaaacgagctcagaggctcaagttcctgtgtgagcggaatgacaaggtgttttttgcctcagtccgctctgggggcagcagccaagtttacttcatgactctgaaccgtaactgcatcatgaactggtgacggggccctgggctggggctgtcccacactggacccagctctccccctgcagccaggcttcccgggccgcccctctttcccctccctgggcttttgcttttactggtttgatttcactggagcctgctgggaacgtgacctctgacccctgatgctttcgtgatcacgtgaccatcctcttccccaacatgtcctcttcccaaaactgtgcctgtccccagcttctggggagggacacagcttccccttcccaggaattgagtgggcctagcccctccccccttttctccatttgagaggagagtgcttggggcttgaaccccttaccccactgctgctgactgggcagggccctggacccctttatttgcacgtcaggggagccggctccccccttgaatgtaccagaccctggggggggtcactgggccctagatttttggggggtcaccagccactccaggggcagggaccatttcttcattttctgaaagcactttaatgattccccttcccccaaactccagggaatggaggggggaccccgccagccaaaacattccccccattcccgacccccctctcctcttctagcccatgcccttccccggtggagggagggagcagggagccctcactctccacgccccttgcttgcatctgtatatagtgtgagcagcaagtaacccttctccctccccccccacccctcctcaatgtagtggccttggatatcctgtttgttaataaagacaattcaaccagc

SEQ ID NO: 154200 - DNA, 3453 bp, Homo sapiens
  Payload ID: 10302
  Gene Symbol: MIOS
  Gene Name: missing oocyte, meiosis regulator, homolog (Drosophila)
  Uniprot ID: Q9NXC5
  ENST ID: ENST00000340080
  CDS Start-End: 422-3049
gctgggaaactccccttccaaggccgaggcgccgctgcgcgtcctccaggcgtggtggtggggtcgtgggtcccagcccagtggtccaggtcacgggccgcacggccgcggccgccatcttgcccgcgtccgggctcctgcggcgggcggggcggtgtcccggccggaagcggctgtgcggcggccgcgctgccacctcagggaaatttggatatgtgcagtgcatctcctcgaagatgctgatggtggaaatttcttgaaaccgctctcgtaatttgccacgtgctgttgcaaatattctggtgaatgaacacagaatcagcatggctttcctttgctgagaaatcactgatgggaagtgagacttgttaaacttgaaagtgaatggacctgagtggaccctttgatcacatcagtaaacatgagcggtaccaaacctgatattttatgggcaccacaccatgttgatagatttgttgtgtgtgactcagaactaagtctttatcatgtggaatctactgtgaattcagaactcaaagctggatctttacgtttatctgaagactctgcagctacattactgtcaataaattcagatacaccctatatgaaatgtgttgcctggtatcttaattatgatcctgaatgtctgctggcagttggacaagcaaatggtcgagttgtacttacaagccttggtcaagatcataactcaaagttcaaagatttgataggaaaagagtttgttccaaaacatgcacgacaatgtaatacccttgcctggaatccactggatagtaactggctagctgctggtttagataagcacagagctgacttttcagtgctaatatgggatatctgcagcaaatatactcctgatatagttcccatggaaaaagtgaaactttcagcaggtgaaactgaaacaacattattagtaacaaaaccactttatgagttaggacagaatgatgcttgtctgtctctttgttggcttccacgagaccagaaacttctccttgctggtatgcatcgtaacctagctatatttgatcttcggaatacaagccaaaagatgttcgtaaatacaaaagctgttcagggtgtgacggtagacccatatttccacgatcgtgttgcttccttctatgaaggtcaggttgcaatatgggatcttagaaaatttgagaagccagttttgacattgactgagcaaccaaaacccttaacaaaagtagcatggtgtcccactaggactggtctacttgccactttaacaagggatagtaatattattagattgtatgatatgcagcatacacccactcccattggggatgaaactgaacccacaataattgaaagaagtgtgcaaccttgtgacaattacattgcttcctttgcgtggcatccaacaagtcaaaatcgaatgatagttgtaactcccaaccgaacaatgtcagacttcactgtttttgaaaggatatctcttgcctggagcccaattacatctttaatgtgggcttgtggtcgtcatttatatgaatgtacggaagaagaaaatgataattctttagaaaaagatatagcaacgaagatgcgtcttcgggctttatcaaggtatggacttgatacagagcaggtgtggaggaaccacattttagctggaaatgaagatccacagctcaagtcactctggtatactctgcactttatgaagcaatacacagaagatatggatcagaaatctccaggcaacaaaggatcattggtttatgcaggaattaaatcaattgtaaagtcatcgttgggaatggtggaaagcagcagacataattggagtgggttggataagcaaagtgatattcaaaatttaaatgaagagagaatcttagctttacagctttgtgggtggataaagaaaggaacggatgtagacgtggggccatttttgaactcccttgtacaagaaggggaatgggaaagagctgctgctgtggcattgttcaacttggatattcgccgagcaatccaaatcctgaatgaaggggcatcttctgaaaaaggagatctgaatctcaatgtggtagcaatggctttatcgggttatacggatgagaagaactccctttggagagaaatgtgtagcacactgcgattacagctaaataacccgtatttgtgtgtcatgtttgcatttctgacaagtgaaacaggatcttacgatggagttttgtatgaaaacaaagttgcagtacgtgacagagtggcatttgcttgtaaattccttagtgatactcagttaaatagatacatcgaaaagttgaccaatgaaatgaaagaggctggaaatttggaaggaattttgcttacaggccttactaaagatggagtggacttaatggagagttatgttgatagaactggagatgttcaaacagcaagttactgtatgttacagggttcacctttagatgttcttaaagatgaaagggttcagtactggattgagaattatagaaatttattagatgcctggaggttttggcataaacgagctgaatttgatattcacaggagtaagttggatcccagttccaagcctttagcacaagtttttgtgagttgcaatttctgtggcaagtcaatctcctacagctgttcagctgtgcctcatcagggcagaggttttagtcagtatggtgtgagtggctcaccaacgaaatctaaagtcacaagttgtcctggctgtcgaaaaccacttcctcgatgtgcgctttgtctcattaatatgggaacaccagtttctagctgtcctggaggaaccaaatcagatgaaaaagtggacttgagcaaggacaaaaaattagcccaatttaacaactggtttacatggtgtcataattgcaggcacggtggacatgctggacatatgcttagttggttcagggaccatgcagagtgccctgtgtcggcatgcacgtgtaaatgtatgcagttggatacaacagggaatctggtacctgcagagactgtccagccataaaatgttaccaccttaagagaacccttcaagtgtggagctttctagtaggtgtccttcatagctcagaaacatacctcagaacaagccattcatgacttacctgtaatgggaaaataaatcattctatcagatcagcagttttgatgtttgagtgattttgatatgcttcacagagacaaatgctgccaaaataaacatcgaagtatagacatgagttctgttcagcaggttgaaaagtctgatttagaaaaactttctaagttttggttgaaattatgaacactctagaagcagaatttctggaagagccaagaacagactttgagcctatatcttcaaagctgaaactggatatctttcaataaaatatgtgcacttttaaaataaaatgactaattctgtga

SEQ ID NO: 154201 - DNA, 3095 bp, Homo sapiens
  Payload ID: 10302
  Gene Symbol: MIOS
  Gene Name: missing oocyte, meiosis regulator, homolog (Drosophila)
  Uniprot ID: Q9NXC5
  ENST ID: ENST00000405785
  CDS Start-End: 337-2964
gggaaactccccttccaaggccgaggcgccgctgcgcgtcctccaggcgtggtggtggggtcgtgggtcccagcccagtggtccaggtcacgggccgcacggccgcggccgccatcttgcccgcgtccgggctcctgcggcgggcggggcggtgtcccggccggaagcggctgtgcggcggccgcgctgccacctcagtgctgttgcaaatattctggtgaatgaacacagaatcagcatggctttcctttgctgagaaatcactgatgggaagtgagacttgttaaacttgaaagtgaatggacctgagtggaccctttgatcacatcagtaaacatgagcggtaccaaacctgatattttatgggcaccacaccatgttgatagatttgttgtgtgtgactcagaactaagtctttatcatgtggaatctactgtgaattcagaactcaaagctggatctttacgtttatctgaagactctgcagctacattactgtcaataaattcagatacaccctatatgaaatgtgttgcctggtatcttaattatgatcctgaatgtctgctggcagttggacaagcaaatggtcgagttgtacttacaagccttggtcaagatcataactcaaagttcaaagatttgataggaaaagagtttgttccaaaacatgcacgacaatgtaatacccttgcctggaatccactggatagtaactggctagctgctggtttagataagcacagagctgacttttcagtgctaatatgggatatctgcagcaaatatactcctgatatagttcccatggaaaaagtgaaactttcagcaggtgaaactgaaacaacattattagtaacaaaaccactttatgagttaggacagaatgatgcttgtctgtctctttgttggcttccacgagaccagaaacttctccttgctggtatgcatcgtaacctagctatatttgatcttcggaatacaagccaaaagatgttcgtaaatacaaaagctgttcagggtgtgacggtagacccatatttccacgatcgtgttgcttccttctatgaaggtcaggttgcaatatgggatcttagaaaatttgagaagccagttttgacattgactgagcaaccaaaacccttaacaaaagtagcatggtgtcccactaggactggtctacttgccactttaacaagggatagtaatattattagattgtatgatatgcagcatacacccactcccattggggatgaaactgaacccacaataattgaaagaagtgtgcaaccttgtgacaattacattgcttcctttgcgtggcatccaacaagtcaaaatcgaatgatagttgtaactcccaaccgaacaatgtcagacttcactgtttttgaaaggatatctcttgcctggagcccaattacatctttaatgtgggcttgtggtcgtcatttatatgaatgtacggaagaagaaaatgataattctttagaaaaagatatagcaacgaagatgcgtcttcgggctttatcaaggtatggacttgatacagagcaggtgtggaggaaccacattttagctggaaatgaagatccacagctcaagtcactctggtatactctgcactttatgaagcaatacacagaagatatggatcagaaatctccaggcaacaaaggatcattggtttatgcaggaattaaatcaattgtaaagtcatcgttgggaatggtggaaagcagcagacataattggagtgggttggataagcaaagtgatattcaaaatttaaatgaagagagaatcttagctttacagctttgtgggtggataaagaaaggaacggatgtagacgtggggccatttttgaactcccttgtacaagaaggggaatgggaaagagctgctgctgtggcattgttcaacttggatattcgccgagcaatccaaatcctgaatgaaggggcatcttctgaaaaaggagatctgaatctcaatgtggtagcaatggctttatcgggttatacggatgagaagaactccctttggagagaaatgtgtagcacactgcgattacagctaaataacccgtatttgtgtgtcatgtttgcatttctgacaagtgaaacaggatcttacgatggagttttgtatgaaaacaaagttgcagtacgtgacagagtggcatttgcttgtaaattccttagtgatactcagttaaatagatacatcgaaaagttgaccaatgaaatgaaagaggctggaaatttggaaggaattttgcttacaggccttactaaagatggagtggacttaatggagagttatgttgatagaactggagatgttcaaacagcaagttactgtatgttacagggttcacctttagatgttcttaaagatgaaagggttcagtactggattgagaattatagaaatttattagatgcctggaggttttggcataaacgagctgaatttgatattcacaggagtaagttggatcccagttccaagcctttagcacaagtttttgtgagttgcaatttctgtggcaagtcaatctcctacagctgttcagctgtgcctcatcagggcagaggttttagtcagtatggtgtgagtggctcaccaacgaaatctaaagtcacaagttgtcctggctgtcgaaaaccacttcctcgatgtgcgctttgtctcattaatatgggaacaccagtttctagctgtcctggaggaaccaaatcagatgaaaaagtggacttgagcaaggacaaaaaattagcccaatttaacaactggtttacatggtgtcataattgcaggcacggtggacatgctggacatatgcttagttggttcagggaccatgcagagtgccctgtgtcggcatgcacgtgtaaatgtatgcagttggatacaacagggaatctggtacctgcagagactgtccagccataaaatgttaccaccttaagagaacccttcaagtgtggagctttctagtaggtgtccttcatagctcagaaacatacctcagaacaagccattcatgacttacctgtaatgggaaaataaatcattctatcaga

SEQ ID NO: 154202 - DNA, 844 bp, Homo sapiens
  Payload ID: 10302
  Gene Symbol: MIOS
  Gene Name: missing oocyte, meiosis regulator, homolog (Drosophila)
  ENST ID: ENST00000433056
  CDS Start-End: 653-844
cggccgcgctgccacctcaggtcagtgagcgcgacccggttcgcgtctcgactctcgggagcgccgcggccgcagcgaggggccggagatagcctagttgaaaggcccgggcgtctcggcggggagcgcgttccgcgctgtagggtaatcgcgccgggcggccggccgcctggccgggcctcagcgggagccaccgggggctgcgggcggccgtgggacctgcggagacctcctcggggcgcagggaacacgctacagccttcgccgcggcgggcttgtggggagcggcgtcccagcctttcccgggaggctcagccaggtgcctggagcgggagagtcggactcagattcctgctttacctagaatagcaacgtgccctgttcccgttgtaccctcttaaatactatacttcttaaacggcctgtctcccgggaaatttggatatgtgcagtgcatctcctcgaagatgctgatggtggaaatttcttgaaaccgctctcgtaatttgccacgtgctgttgcaaatattctggtgaatgaacacagaatcagcatggctttcctttgctgagaaatcactgatgggaagtgagacttgttaaacttgaaagtgaatggacctgagtggaccctttgatcacatcagtaaacatgagcggtaccaaacctgatattttatgggcaccacaccatgttgatagatttgttgtgtgtgactcagaactaagtctttatcatgtggaatctactgtgaattcagaactcaaagctggatctttacgtttatctgaagactctgcagctacattactgtcaataaattcagatacaccctatatgaaa

SEQ ID NO: 154203 - DNA, 1075 bp, Homo sapiens
  Payload ID: 10302
  Gene Symbol: MIOS
  Gene Name: missing oocyte, meiosis regulator, homolog (Drosophila)
  ENST ID: ENST00000456533
  CDS Start-End: 538-1075
atcttgcccgcgtccgggctcctgcggcgggcggggcggtgtcccggccggaagcggctgtgcggcggccgcgctgccacctcaggtcagtgagcgcgacccggttcgcgtctcgactctcgggagcgccgcggccgcagcgaggggccggagatagcctagttgaaaggcccgggcgtctcggcggggagcgcgttccgcgctgtagggtaatcgcgccgggcggccggccgcctggccgggcctcagcgggagccaccgggggctgcgggcggccgtgggacctgcggagacctcctcggggcgcagggaacacgctacagccttcgccgcggcgggcttgtggggagcggcgtcccagcctttcccgggaggctcagccaggtgcctggagcgggagagtcggactcagattcctgctttacctagaatagcaacgtgccctgttcccgttgtaccctcttaaatactatacttcttaaacggcctgtctcccgtgaatggacctgagtggaccctttgatcacatcagtaaacatgagcggtaccaaacctgatattttatgggcaccacaccatgttgatagatttgttgtgtgtgactcagaactaagtctttatcatgtggaatctactgtgaattcagaactcaaagctggatctttacgtttatctgaagactctgcagctacattactgtcaataaattcagatacaccctatatgaaatgtgttgcctggtatcttaattatgatcctgaatgtctgctggcagttggacaagcaaatggtcgagttgtacttacaagccttggtcaagatcataactcaaagttcaaagatttgataggaaaagagtttgttccaaaacatgcacgacaatgtaatacccttgcctggaatccactggatagtaactggctagctgctggtttagataagcacagagctgacttttcagtgctaatatgggatatctgcagcaaatatactcctgatatagttcccatggaaaaagtgaaactttcagcaggtgaaactgaaacaacattattagtaacaaaaccactttatg

SEQ ID NO: 154204 - DNA, 602 bp, Homo sapiens
  Payload ID: 10302
  Gene Symbol: MIOS
  Gene Name: missing oocyte, meiosis regulator, homolog (Drosophila)
  ENST ID: ENST00000433635
  CDS Start-End: 153-602
gtcacgggccgcacggccgcggccgccatcttgcccgcgtccgggctcctgcggcgggcggggcggtgtcccggccggaagcggctgtgcggcggccgcgctgccacctcagtgaatggacctgagtggaccctttgatcacatcagtaaacatgagcggtaccaaacctgatattttatgggcaccacaccatgttgatagatttgttgtgtgtgactcagaactaagtctttatcatgtggaatctactgtgaattcagaactcaaagctggatctttacgtttatctgaagactctgcagctacattactgtcaataaattcagatacaccctatatgaaatgtgttgcctggtatcttaattatgatcctgaatgtctgctggcagttggacaagcaaatggtcgagttgtacttacaagccttggtcaagatcataactcaaagttcaaagatttgataggaaaagagtttgttccaaaacatgcacgacaatgtaatacccttgcctggaatccactggatagtaactggctagctgctggtttagataagcacagagctgacttttcagtgctaatatgggatatctgcagcaaa

SEQ ID NO: 154205 - DNA, 536 bp, Homo sapiens
  Payload ID: 10302
  Gene Symbol: MIOS
  Gene Name: missing oocyte, meiosis regulator, homolog (Drosophila)
  ENST ID: ENST00000445169
  CDS Start-End: 345-536
cggtgagctctgttctcttctcatatgagtaatgaaaattaagaggatgaatgaaacctcacacatgttgtggactttgctgaataggttagcaaatgactgcaggccttttgtatattttaagggaaatttggatatgtgcagtgcatctcctcgaagatgctgatggtggaaatttcttgaaaccgctctcgtaatttgccacgtgctgttgcaaatattctggtgaatgaacacagaatcagcatggctttcctttgctgagaaatcactgatgggaagtgagacttgttaaacttgaaagtgaatggacctgagtggaccctttgatcacatcagtaaacatgagcggtaccaaacctgatattttatgggcaccacaccatgttgatagatttgttgtgtgtgactcagaactaagtctttatcatgtggaatctactgtgaattcagaactcaaagctggatctttacgtttatctgaagactctgcagctacattactgtcaataaattcagatacaccctatatgaaa

SEQ ID NO: 154206 - DNA, 939 bp, Homo sapiens
  Payload ID: 10303
  Gene Symbol: MITD1
  Gene Name: MIT, microtubule interacting and transport, domain containing 1
  Uniprot ID: Q8WV92
  ENST ID: ENST00000289359
  CDS Start-End: 78-827
acatgaccacttcccggaagcgcagcagacccgctcaacttcatcctgggttgaggcggaggagaacttccagaattatggcgaagtccgggctgaggcaggacccgcagagcacagctgcagccactgtgctaaagcgggcagtagaactagattcggagtcgcggtatccgcaggctctggtgtgttaccaagaggggattgatctgctcctgcaggttctgaaaggtaccaaagataatactaagagatgtaatctcagagaaaaaatttccaaatacatggacagagcggaaaacataaagaagtacttggaccaagaaaaagaagatggaaaatatcacaagcaaattaaaatagaagagaatgcaacaggtttcagttatgagtcactttttcgcgaataccttaatgagacagttacagaagtttggatagaagatccttatattagacatactcatcagctgtataactttcttcgattttgtgagatgcttattaagagaccatgtaaagtaaaaactattcaccttctcacctctctggatgaaggcattgagcaagtgcagcaaagtagaggcctgcaagaaatagaagagtcactcaggagtcacggagtgctgttggaagttcaatactcttcttcaatacatgaccgagaaattaggttcaacaatggatggatgattaagattggaaggggacttgattattttaagaaaccacagagtcgtttttcccttggatattgtgattttgatttaagaccatgtcatgaaacaacagtagacatttttcataagaagcatacaaaaaatatatgatgggtggtagcctaatttgtattatgtctactttaagtgaatattggattttttttaaaagatcacttttataatgtatgaatttaacaataaacttttatatttctactaa

SEQ ID NO: 154207 - DNA, 662 bp, Homo sapiens
  Payload ID: 10303
  Gene Symbol: MITD1
  Gene Name: MIT, microtubule interacting and transport, domain containing 1
  ENST ID: ENST00000409107
  CDS Start-End: 70-662
acttcccggaagcgcagcagacccgctcaacttcatcctgggttgaggcggaggagaacttccagaattatggcgaagtccgggctgaggcaggacccgcagagcacagctgcagccactgtgctaaagcgggcagtagaactagattcggagtcgcggtatccgcaggctctggtgtgttaccaagaggggattgatctgctcctgcaggttctgaaaggtaccaaagataatactaagagatgtaatctcagagaaaaaatttccaaatacatggacagagcggaaaacataaagaagtacttggaccaagaaaaagaagatggaaaatatcacaagcaaattaaaatagaagagaatgcaacaggtttcagttatgagtcactttttcgcgaataccttaatgagacagttacagaagtttggatagaagatccttatattagacatactcatcagggcattgagcaagtgcagcaaagtagaggcctgcaagaaatagaagagtcactcaggagtcacggagtgctgttggaagttcaatactcttcttcaatacatgaccgagaaattaggttcaacaatggatggatgattaagattggaaggggacttgattattttaagaaaccacagagtcgtttttcccttggatattgtga

SEQ ID NO: 154208 - DNA, 999 bp, Homo sapiens
  Payload ID: 10303
  Gene Symbol: MITD1
  Gene Name: MIT, microtubule interacting and transport, domain containing 1
  ENST ID: ENST00000438121
  CDS Start-End: 55-216
agcagacccgctcaacttcatcctgggttgaggcggaggagaacttccagaattatggcgaagtccgggctgaggcaggacccgcagagcacagctgcagccactgtgctaaagcgggcagtagaactagattcggagtcgcggtatccgcaggctctggtgtgttaccaagaggggattgatctgctcctgcaggttctgaaaggtgagcaatgagccaaggcggggaggacctgaggaaaaggagctggttcctgctgtgtctggggtgaagtgaaagagttaaaaatgatttttccacaccacgaagaagcagttaaatacagaaggtaccaaagataatactaagagatgtaatctcagagaaaaaatttccaaatacatggacagagcggaaaacataaagaagtacttggaccaagaaaaagaaggtaaagaggttgttttagaaaatgcatccataaacaactgtgactgtccattcacccaatgtttctggctcctgccctttggagctctgtgtggtctggaccagttgtccctgggagcttacaggatttaatctgtatttccactcccatacaggagttgttcttaattttttgtttgtttgtttgttttggcttttgtttttagttgggggtgggaatatcagacacccctttgaacatctcatgaaagctatacttactggagaatgttccatgccatttttaaggggttcacaaatccctatgaagcttatgtgtggaccctatgttaagaaatactacagggaatactgaatgtaaattgtgtattttatttatatttccctttatgaaatgaccaaaatcatgaaagaagctaaagaaactcctgggatttctctcagattttgttgtgaatcaaaacacctcaggagttaagcattcctaatgattagaggtcaggtaggtattgttccctattattagttccctactcctaagcatccagtttacaaatgtctgtaaatgg

SEQ ID NO: 154209 - DNA, 971 bp, Homo sapiens
  Payload ID: 10303
  Gene Symbol: MITD1
  Gene Name: MIT, microtubule interacting and transport, domain containing 1
  ENST ID: ENST00000422537
  CDS Start-End: 1-696
ctaaagcgggcagtagaactagattcggagtcgcggtatccgcaggctctggtgtgttaccaagaggggattgatctgctcctgcaggttctgaaaggtaccaaagataatactaagagatgtaatctcagagaaaaaatttccaaatacatggacagagcggaaaacataaagaagtacttggaccaagaaaaagaagatggaaaatatcacaagcaaattaaaatagaagagaatgcaacaggtttcagttatgagtcactttttcgcgaataccttaatgagacagttacagaagtttggatagaagatccttatattagacatactcatcagctgtataactttcttcgattttgtgagatgcttattaagagaccatgtaaagtaaaaactattcaccttctcacctctctggatgaaggcattgagcaagtgcagcaaagtagaggcctgcaagaaatagaagagtcactcaggagtcacggagtgctgttggaagttcaatactcttcttcaatacatgaccgagaaattaggttcaacaatggatggatgattaagattggaaggggacttgattattttaagaaaccacagagtcgtttttcccttggatattgtgattttgatttaagaccatgtcatgaaacaacagtagacatttttcataagaagcatacaaaaaatatatgatggattcaggttacattcctgccaaggattttgatgcctaccaattacaacagagggagaattctgccaaaagaatagaattggtttgccttctagattcatatggtcatggatccagtcttccacagccagattttgatagacatcattggaaattgactgtaaaatgagcccattttttactgtttttttaaagccagctgctgggacctggcagttacaaagtaactggaagcaattcttcattgaaaatgggatcagcatgcttttaaaaa

SEQ ID NO: 154210 - DNA, 7439 bp, Homo sapiens
  Payload ID: 10304
  Gene Symbol: MARC1
  Gene Name: mitochondrial amidoxime reducing component 1
  Uniprot ID: Q5VT66
  ENST ID: ENST00000366910
  CDS Start-End: 187-1200
agctgagccaccacctcccactccccgcgccgccccccagaaggacgcactgctctgattggcccggaagggttcaggagctgcccagcctttgggctcggggccaaaggccgcaccttcccccagcggccccgggcgaccagcgcgctccggccttgccgccgccacctcgcggagaagccagccatgggcgccgccggctcctccgcgctggcgcgctttgtcctcctcgcgcaatcccggcccgggtggctcggggttgccgcgctgggcctgaccgcggtggcgctgggggctgtcgcctggcgccgcgcatggcccacgcggcgccggcggctgctgcagcaggtgggcacagtggcgcagctctggatctaccctgtgaaatcctgcaagggggtgccggtgagcgaggcggagtgcacggccatggggctgcgcagcggcaacctgcgggacaggttttggcttgtgatcaaccaggagggaaacatggttactgctcgccaggaacctcgcctggtcctgatttccctgacctgcgatggtgacaccctgactctcagtgcagcctacacaaaggacctactactgcctatcaaaacgcccaccacaaatgcagtgcacaagtgcagagtgcacggcctggagatagagggcagggactgtggcgaggccaccgcccagtggataaccagcttcctgaagtcacagccctaccgcctggtgcacttcgagcctcacatgcgaccgagacgtcctcatcaaatagcagacttgttccgacccaaggaccagattgcttactcagacaccagcccattcttgatcctttctgaggcgtcgctggcggatctcaactccaggctagagaagaaagttaaagcaaccaacttcaggcccaatattgtaatttcaggatgcgatgtctatgcagaggattcttgggatgagcttcttattggtgacgtggaactgaaaagggtgatggcttgttccagatgcattttaaccacagtggacccagacaccggtgtcatgagcaggaaggaaccgctggaaacactgaagagttatcgccagtgtgacccttcagaacgaaagttatatggaaaatcaccactctttgggcagtattttgtgctggaaaacccagggaccatcaaagtgggagaccctgtgtacctgctgggccagtaatgggaaccgtatgtcctggaatattagatgccttttaaaaatgttctcaaaaatgacaacacttgaagcatggtgtttcagaactgagacctctacattttctttaaatttgtgattttcacatttttcgtcttttggacttctggtgtctcaatgcttcaatgtcccagtgcaaaaagtaaagaaatatagtctcaataacttagtaggacttcagtaagtcacttaaatgacaagacaggattctgaaaactccccgtttaactgattatggaatagttctttctcctgcttctccgtttatctaccaagagcgcagacttgcatcctgtcactaccactcgttagagaaagagaagaagagaaagaggaagagtgggtgggctggaagaatatcctagaatgtgttattgcccctgttcatgaggtacgcaatgaaaattaaattgcaccccaaatatggctggaatgccacttcccttttcttctcaagccccgggctagcttttgaaatggcataaagactgaggtgaccttcaggaagcactgcagatattaattttccatagatctggatctggccctgctgcttctcagacagcattggatttcctaaaggtgctcaggaggatggttgtgtagtcatggaggacccctggatccttgccattcccctcagctaatgacggagtgctccttctccagttccgggtgaaaaagttctgaattctgtggaggagaagaaaagtgattcagtgatttcagatagactactgaaaacctttaaagggggaaaaggaaagcatatgtcagttgtttaaaacccaatatctattttttaactgattgtataactctaagatctgatgaagtatattttttattgccattttgtcctttgattatattgggaagttgactaaacttgaaaaatgtttttaaaactgtgaataaatggaagctactttgactagtttcagatcttactaacttcttggcacaaagttagactgtgaaagctgactgaggctgggcacaggggctcatgcctgtaattccagcactttgggaggccaaggtgggagaatggcttgagcccaggagtttgagaccagcccagaaaatataatgggatcctgtcgctacaaaatgtttttaaaatgcactcggtgtggtggtgtgtgcctgcagtcctggctatggctactcgggaggatgaggtagaaggattggttgagcccaggagcgggagattgaggctgcagtgagttatgattgcaccactacactccagcctgagtgatagagtgagaccctatctctaaaaaagaaacaggaaaaaaaaagaaagctgactgaggtgaatgggcaaagccagtaattctgacacctgaccacagctgggtcttctgcataatggacctcctcacccacagcctcccaggcaagcacccatgtttgaaggactatcaagtcaacatgctttttaccaaaagctgcacatttttcactttgattttataaaagaggtcagtaatcgctgaaatctagctgagccctgaagtaaagttctgagcaaagaggtgcatgtgcttgttttatggttggtgaattattacagtttgttttctgcatgcttggcatgaggtgaataattacatcaattttccagagaacctgggccatcaccttccccaacaagtccagttgatgttgaaactacagatagattgagacaaagcgaagtgttcagcaagtagcattactaatgggaccgggggacccgtgggagagtgagtgtacacaggatttaggaaaccatgtgaatatgggctctctgggaatagccaataggtagggagcaatcagaaacccaaggtttggtggctcttcctaggtatttataattagtggcaagtgaaagccttagtcctgaatttctaaccacttgtaagaactaacagccacttctctgtgccccgtccgggcagtaaccatcattctccatggacaggctctcggggtagctagctctgcagggcagcacccacgtggaagggagcacccagaaaccctcctcactgggcagacctgtccttctgtgcctcacagtgtgaggaagattcctgtttgaagagagaagttccagtgacctctagaatctcagagtagttgccaagctttctgtcagtgagatttaaaggccatttacttgtgtttattttatatttaatgagttggttaatgccagagacaaagctgatatcccatttattttggatactgagcatttgcacactattccacttgaaatatagaatcaggaatgtaggccatcccagactttcagatcttacaacagcaaatgacagatgtttgagatcaggccaaaatatccaccctcggtgggcatctcctctgtgtggcaacttatgctgcagccacagtggggagtcacaaactcagagctggaggtcttgaaaaggacaatgtgggccaggctccggaggggctgcctaaaggcttgcttttgtgactctcctgcagaaaatgttagaaacttccaaccgaaagacgagggcagcaacttatacacacgaaggcagaaagaaattggggaaggggaggctgttggaattcaggccgttgtcctatagggagaaatactcctcctctccttctccctttactgataacggggcatggtgaggagatgagcttgtgagggtctgccagtttggtaagagtgcatggggaggttgggtaaattagactagccaaatgggacttcgggaaaccatttatgaggctgtcaccaacagtgatggcaggctgaaattccaggcaagtgctcccagcattccaagagtgtatcaaattaaagcaacccatgatggtggagaacagatacattaaagttccttgaaaatgacagagtggctctcagaccagaccttgattgtgggtataatcggagtgttgctaccacaccctaacactgcatttcccgtgttttattggtccatggaattctgaaagtttgcctttcgggatgcttctaaaaacaattccatggaccagtaagtttggaaagtcctgcgtgcctcacttctcttcaaaggcaaaaggctctggagaggccttcatgaagacatctgtgtttaatgctgcccttcccaaaggtctgtttttgactgtcttttgagaaatgatcctctgatctctaggcagaatgccagtgagccaaggaatcccagttagcaggaggggtgcactcatgggaagactgaagaagttaaaagttcccgccaagtgaaggagacctatcttgggacacttccccttgtcctctcccttgcccctcttgctggagtaaaaggatggaactgggacttgataggttaaaggaggtgtggagaagtgtcttagaccagctctcctgttgtgggccttagggagaagcactctctttcttcgggatcattttccaaacatgcatttttggatggatagggtggatcagggtgagggaagggaaaccaaactctctctaaccttgcccttacagcaatacctgtgatgtaagttacaaaaccacctgtgatgaaagtgctccaggatgcttcatgcaccagggaggggtgccctgtttctcttctgctagcttctcctttcttttttttttttcttcttttttttgagacagtgtctcactctgttgccaggctggagtgcagtggtgagatctcagctcactgcagcctctgcctcccaggttcaagcaattcttctgcctcagcctcccgagtagctggtgtgtctggagttggttccttctggtgggttcttggtctcgctgacttcaagaatgaagccacagaccttcgcagtgagtgttacagctcttaaaggtggcacggacccaaagtgagcagtagcaagatttattgtggagagcgaaagaacaaagcttcggaaggggacccaaatgggctgctgctgctggctggggtggccaccttttattcccttatttgtccctgcccatgtcctgctgattgctccattttacagagtgctgattggtccattttacagagtgctgattggtgcatttacaatcctttagctagacacagagtgccgattggtgagtttttacagtgctgattggtgcatttacaatcctttagctagacacagaacactgactggtgcatttataatcctctagctagaaagaaaagttctccaagtccccactagacccaggaagtccagctggcttcacctctcactgggactacaggtgcacaccaccacacccagctaatttttgtatttttagtagagacggggtttcaccatgttgttcaggatggtctcgaactcttgatctcgtgatctgcccgcctcggcctcccaaagtgctgggattacagttgtgagccaccacgcccggccctagcttttcctttctgttgcaagtcctctcaactagtgttgccttccaccctacaaagcagaattacctcagaagtcctatggccctgactctatctatgtctgcacaaagcactactgtgctttgctgtctgcaagaacagagattgtttgcttcaaccactttctctgaatggatgaatgagttatgatgatatctaaagttacccaatttcaagcaagaggaagaatctggctcggtaccacagatgttcttggaattgggatagtaaaaaagtccctgaggcatcccttggtctgctctgaccacactctcttcacaggaagaggcttgggccacagctctgactataactctgctcttcctccaaacacagctgaggaattgggtggtggggcacctgctcccatgctctgtggcctggctcagagagaagagttgccttaattacattattattcttcctggacaggctgtaggttgtgtaaagtaacaaaaaggactgagaagtgacttcccattcagcctcttccaaggccatttttgataggcaggtcaaattcactcacatttggttatttgttggccagtctagtgcattcacccttgctggtcctcagtcatgctcctttacctttacagagcatcctagactgctcttcctcttaccttccttgtgaaacccacaacccctagtccctccccttccctggcatttgttatgccctctaccaatccctgacctggtattggtcagtctccaatcctggtggatccctgtgggaactaagttaagtctaacttttgtctccctctttagaatttactgggagtactgtaaataaactattgttgttataattatttctgattaacatttttacacctaacaaagtctcagagagattgaatttactgggttgaagggaggagcaccttccacatgacctgcccagcaattaaagccgcttgttagtccgaggcccaggacggccgaggacagctggagagctcttcgttgcaggcagctctggttaacatcaaccgggaaagctctttgtaaacacatgaataattgatcgtccagcgctcacatagctaccgcggatctgagcccgtatgactcatttgcgagccattcctgtcgtctggatgccataacattggaggaatgatgatcgtttcttggaggttcttctgtggccagagttgccaagaccaaggctgtaatggtttgttatgatgacctttgttattccattaggctcaattgctttaaaaaatgatgtgtgcatactttaggaacgtttttaccctttatgttgacctgacatcatagtttatattataaaatgtattaatgacagaagagtgttttcatgtcccaaggacaaattttaacaaccataatctgccctcagtcatcataaatataaatgtattggtcaaacagatctcgttaatgtggccaagataaatgcaagtctatattttaaggcagtcgaagtcctagagaatatatctggagcttttgtggggctaagagatcttgtatatatgctatcaaaaggctgagaaaattaacatgttcccccctctgattttgcattggacagatataaatgtcttggggatgtcaagtaagattgttcacatagtttctggacaccattaatgcctgatggggtgaatcttagttcttaaagctatattctgctcattatgctcacagggcttttgaaaagagaacaaaataaagatttcaagtcttagc

SEQ ID NO: 154211 - DNA, 1760 bp, Homo sapiens
  Payload ID: 10304
  Gene Symbol: MARC1
  Gene Name: mitochondrial amidoxime reducing component 1
  ENST ID: ENST00000407981
  CDS Start-End: 1-790
gttttggcttgtgatcaaccaggagggaaacatggttactgctcgccaggaacctcgcctggtcctgatttccctgacctgcgatggtgacaccctgactctcagtgcagcctacacaaaggacctactactgcctatcaaaacgcccaccacaaatgcagtgcacaagtgcagagtgcacggcctggagatagagggcagggactgtggcgaggccaccgcccagtggataaccagcttcctgaagtcacagccctaccgcctggtgcacttcgagcctcacatgcgaccgagacgtcctcatcaaatagcagacttgttccgacccaaggaccagattgcttactcagacaccagcccattcttgatcctttctgaggcgtcgctggcggatctcaactccaggctagagaagaaagttaaagcaaccaacttcaggcccaatattgtaatttcaggatgcgatgtctatgcagaggtaacactatgcccctttggatctttccttggatttgacttcttttttaaggattcttgggatgagcttcttattggtgacgtggaactgaaaagggtgatggcttgttccagatgcattttaaccacagtggacccagacaccggtgtcatgagcaggaaggaaccgctggaaacactgaagagttatcgccagtgtgacccttcagaacgaaagttatatggaaaatcaccactctttgggcagtattttgtgctggaaaacccagggaccatcaaagtgggagaccctgtgtacctgctgggccagtaatgggaaccgtatgtcctggaatattagatgccttttaaaaatgttctcaaaaatgacaacacttgaagcatggtgtttcagaactgagacctctacattttctttaaatttgtgattttcacatttttcgtcttttggacttctggtgtctcaatgcttcaatgtcccagtgcaaaaagtaaagaaatatagtctcaataacttagtaggacttcagtaagtcacttaaatgacaagacaggattctgaaaactccccgtttaactgattatggaatagttctttctcctgcttctccgtttatctaccaagagcgcagacttgcatcctgtcactaccactcgttagagaaagagaagaagagaaagaggaagagtgggtgggctggaagaatatcctagaatgtgttattgcccctgttcatgaggtacgcaatgaaaattaaattgcaccccaaatatggctggaatgccacttcccttttcttctcaagccccgggctagcttttgaaatggcataaagactgaggtgaccttcaggaagcactgcagatattaattttccatagatctggatctggccctgctgcttctcagacagcattggatttcctaaaggtgctcaggaggatggttgtgtagtcatggaggacccctggatccttgccattcccctcagctaatgacggagtgctccttctccagttccgggtgaaaaagttctgaattctgtggaggagaagaaaagtgattcagtgatttcagatagactactgaaaacctttaaagggggaaaaggaaagcatatgtcagttgtttaaaacccaatatctattttttaactgattgtataactctaagatctgatgaagtatattttttattgccattttgtcctttgattatattgggaagttgactaaacttgaaaaatgtttttaaaactgtgaataaatggaagctactttga

SEQ ID NO: 154212 - DNA, 444 bp, Homo sapiens
  Payload ID: 10304
  Gene Symbol: MARC1
  Gene Name: mitochondrial amidoxime reducing component 1
  ENST ID: ENST00000443880
  CDS Start-End: 1-360
cgaccgagacgtcctcatcaaatagcagacttgttccgacccaaggaccagattgcttactcagacaccagcccattcttgatcctttctgaggcgtcgctggcggatctcaactccaggctagagaagaaagttaaagcaaccaacttcaggcccaatattgtaatttcaggatgcgatgtctatgcagaggattcttgggatgagcttcttattggtgacgtggaactgaaaagggtgatggcttgttccagatgcattttaaccacagtggacccagacaccggtgtcatgagcaggaaggaaccgctggaaacactgaagagggaaagtgacgtacacactgatccccatggttgaaggaatggctggagtctgccgttgttgcttccatgacattttgcccctaatggaaagaatatagcacagttactgcatgggtac

SEQ ID NO: 154213 - DNA, 443 bp, Homo sapiens
  Payload ID: 10304
  Gene Symbol: MARC1
  Gene Name: mitochondrial amidoxime reducing component 1
  ENST ID: ENST00000463976
  CDS Start-End: 1-299
tgcgaccgagacgtcctcatcaaatagcagacttgttccgacccaaggaccagattgcttactcagacaccagcccattcttgatcctttctgaggcgtcgctggcggatctcaactccaggctagagaagaaagttaaagcaaccaacttcaggcccaatattgtaatttcaggatgcgatgtctatgcagaggtaacactatgcccctttggatctttccttggatttgacttcttttttaagatttattcagcacttaataagtgcagacttctgtgtggaggatacaaatgttgatgggtcagagactgtcatcaaggaggcagttcagtatctaaggcttctaaggagaattctgagttgacagggaaaaatggaatcaaagcaattgagttttaaccttttatcctcagaggagccaattatattcttcacttttgc

SEQ ID NO: 154214 - DNA, 1335 bp, Homo sapiens
  Payload ID: 10305
  Gene Symbol: MARC2
  Gene Name: mitochondrial amidoxime reducing component 2
  Uniprot ID: Q969Z3
  ENST ID: ENST00000359316
  CDS Start-End: 264-1037
cgtcgctcccacggcgcccagggtacccccgccgctgtctgcctgtcttcctccattaccgcgcaggcttggtcaccgcattaaggcattcccgctctccgcggaactgctctgccgtctcggcggtgaaagtgtgagagggtccgtagttgggtcaactttgactcctctcgcctgcccggatccttaagggcctcctcgtcctcccggtctccggtcgctgccgggtctgtgcgccggtccgcgcccgccctcgctctgccatgggcgcttccagctcctccgcgctggcccgcctcggcctcccagcccggccctggcccaggtggctcggggtcgccgcgctaggactggccgccgtggccctggggactgtcgcctggcgccgcgcatggcccaggcggcgccggcggctgcagcaggtgggcaccgtggcgaagctctggatctacccggtgaaatcctgcaaaggggtgccggtgagcgaggctgagtgcacggccatggggctgcgcagcggcaacctgcgggacaggttttggctggtgattaaggaagatggacacatggtcactgcccgacaggagcctcgcctcgtgctcatctccatcatttatgagaataactgcctgatcttcagggctccagacatggaccagctggttttgcctagcaagcagccttcctcaaacaaactccacaactgcaggatatttggccttgacattaaaggcagagactgtggcaatgaggcagctaagtggttcaccaacttcttgaaaactgaagcgtatagattggttcaatttgagacaaacatgaagggaagaacatcaagaaaacttctccccactcttgatcagaatttccaggtggcctacccagactactgcccgctcctgatcatgacagatgcctccctggtagatttgaataccaggatggagaagaaaatgaaaatggagaatttcaggccaaatattgtggtgaccggctgtgatgcttttgaggaggcttcagcaaccaggagggattgactgagatcttaacaacagcagcaacgatacatcagcaaatccttattatccagccttcaactatctttaccctggaaaacaatctcgatttttgacttttcaaagttgtgtatgctccaggttaatgcaaggaaagtattagaggggggaatatgaaagtatatatataaattttaggtactgaaggctttaaaaataattaagatcatcaaaaatgctattttgaatgttatcatggctattacacttttacttcctgactttaatattgatgaataaagcaagtttaatgaatcaa

SEQ ID NO: 154215 - DNA, 2134 bp, Homo sapiens
  Payload ID: 10305
  Gene Symbol: MARC2
  Gene Name: mitochondrial amidoxime reducing component 2
  Uniprot ID: Q969Z3
  ENST ID: ENST00000366913
  CDS Start-End: 199-1206
ggcttggtcaccgcattaaggcattcccgctctccgcggaactgctctgccgtctcggcggtgaaagtgtgagagggtccgtagttgggtcaactttgactcctctcgcctgcccggatccttaagggcctcctcgtcctcccggtctccggtcgctgccgggtctgtgcgccggtccgcgcccgccctcgctctgccatgggcgcttccagctcctccgcgctggcccgcctcggcctcccagcccggccctggcccaggtggctcggggtcgccgcgctaggactggccgccgtggccctggggactgtcgcctggcgccgcgcatggcccaggcggcgccggcggctgcagcaggtgggcaccgtggcgaagctctggatctacccggtgaaatcctgcaaaggggtgccggtgagcgaggctgagtgcacggccatggggctgcgcagcggcaacctgcgggacaggttttggctggtgattaaggaagatggacacatggtcactgcccgacaggagcctcgcctcgtgctcatctccatcatttatgagaataactgcctgatcttcagggctccagacatggaccagctggttttgcctagcaagcagccttcctcaaacaaactccacaactgcaggatatttggccttgacattaaaggcagagactgtggcaatgaggcagctaagtggttcaccaacttcttgaaaactgaagcgtatagattggttcaatttgagacaaacatgaagggaagaacatcaagaaaacttctccccactcttgatcagaatttccaggtggcctacccagactactgcccgctcctgatcatgacagatgcctccctggtagatttgaataccaggatggagaagaaaatgaaaatggagaatttcaggccaaatattgtggtgaccggctgtgatgcttttgaggaggatacctgggatgaactcctaattggtagtgtagaagtgaaaaaggtaatggcatgccccaggtgtattttgacaacggtggacccagacactggagtcatagacaggaaacagccactggacaccctgaagagctaccgcctgtgtgatccttctgagagggaattgtacaagttgtctccactttttgggatctattattcagtggaaaaaattggaagcctgagagttggtgaccctgtgtatcggatggtgtagtgatgagtgatggatccactagggtgatatggcttcagcaaccaggagggattgactgagatcttaacaacagcagcaacgatacatcagcaaatccttattatccagccttcaactatctttaccctggaaaacaatctcgatttttgacttttcaaagttgtgtatgctccaggttaatgcaaggaaagtattagaggggggaatatgaaagtatatatataaattttaggtactgaaggctttaaaaataattaagatcatcaaaaatgctattttgaatgttatcatggctattacacttttacttcctgactttaatattgatgaataaagcaagtttaatgaatcaactaaaaagctgcaaaaatgtttttaaaatgtgtgccttttattacctatcagtctatgttttgggagaaatgggaagcaacagatcactgtgtcctgatgtgcaggacgcatgttaccacactcacaaatgcctaatattggtctttatgtggccattgagtcctgttgactttccactcatgtgctttttactctagcattatggaatctgggctgtacttgagtatggaaattctcttatagacttagttttagtactctattacacctttactaagccacataaaagtaatctgtttgtgtgtaactgccagatataccacctggaattccaagtaagataaggaagaggatgacatttaaaagagaatggaattttgagagtaggaatgcaaggaagacagcatgaacatatttttttcagtgcaaataattttttcgtaacaaagaaacgaacaactttggtatgatcttaagcaaaaatactcactgaaatagtatgtggatgaattcacctacttacaattttatggtttctttgtaaataataaatgtgaatctcaatcctgcttta

SEQ ID NO: 154216 - DNA, 585 bp, Homo sapiens
  Payload ID: 10305
  Gene Symbol: MARC2
  Gene Name: mitochondrial amidoxime reducing component 2
  ENST ID: ENST00000425560
  CDS Start-End: 1-519
ggacacatggtcactgcccgacaggagcctcgcctcgtgctcatctccatcatttatgagaataactgcctgatcttcagggctccagacatggaccagctggttttgcctagcaagcagccttcctcaaacaaactccacaactgcaggatatttggccttgacattaaaggcagagactgtggcaatgaggcagctaagtggttcaccaacttcttgaaaactgaagcgtatagattggttcaatttgagacaaacatgaagggaagaacatcaagaaaacttctccccactcttgatcagaatttccaggtggcctacccagactactgcccgctcctgatcatgacagatgcctccctggtagatttgaataccaggatggagaagaaaatgaaaatggagaatttcaggccaaatattgtggtgaccggctgtgatgcttttgaggaggatacctgggatgaactcctaattggtagtgtagaagtgaaaaaggtaatggcatgccccaggtaaggagcctagctagaccccaggactgtggtgtggcccattcattggttcctaagcatcacctaaccc

SEQ ID NO: 154217 - DNA, 758 bp, Homo sapiens
  Payload ID: 10305
  Gene Symbol: MARC2
  Gene Name: mitochondrial amidoxime reducing component 2
  ENST ID: ENST00000469583
  CDS Start-End: 308-592
gaccaccccagaggccgccccattagctcgcttgctttgggcggcgtcgctcccacggcgcccagggtacccccgccgctgtctgcctgtcttcctccattaccgcgcaggcttggtcaccgcattaaggcattcccgctctccgcggaactgctctgccgtctcggcggtgaaagtgtgagagggtccgtagttgggtcaactttgactcctctcgcctgcccggatccttaagggcctcctcgtcctcccggtctccggtcgctgccgggtctgtgcgccggtccgcgcccgccctcgctctgccatgggcgcttccagctcctccgcgctggcccgcctcggcctcccagcccggccctggcccaggtggctcggggtcgccgcgctaggactggccgccgtggccctggggactgtcgcctggcgccgcgcatggcccaggcggcgccggcggctgcagcaggtgggcaccgtggcgaagctctggatctacccggtgaaatcctgcaaaggggtgccggtgagcgaggctgagtgcacggccatggggctgcgcagcggcaacctgcgggacagaatgtgtgcatgaagaggaaaggctgtttgggaggtttcctgatgtaggacccccgcatgccgcggttttggctggtgattaaggaagatggacacatggtcactgcccgacaggagcctcgcctcgtgctcatctccatcatttatgagaataactgcctgatcttcagggctccaga

SEQ ID NO: 154218 - DNA, 11714 bp, Homo sapiens
  Payload ID: 10306
  Gene Symbol: MAVS
  Gene Name: mitochondrial antiviral signaling protein
  Uniprot ID: Q7Z434
  ENST ID: ENST00000428216
  CDS Start-End: 129-1751
gcgggaagggtcctgggccccgggcggcggtcgccaggtctcagggccgggggtacccgagtctcgtttcctctcagtccatccacccttcatggggccagagccctctctccagaatctgagcagcaatgccgtttgctgaagacaagacctataagtatatctgccgcaatttcagcaatttttgcaatgtggatgttgtagagattctgccttacctgccctgcctcacagcaagagaccaggatcgactgcgggccacctgcacactctcagggaaccgggacaccctctggcatctcttcaatacccttcagcggcggcccggctgggtggagtacttcattgcggcactgaggggctgtgagctagttgatctcgcggacgaagtggcctctgtctaccagagctaccagcctcggacctcggaccgtcccccagacccactggagccaccgtcacttcctgctgagaggccagggccccccacacctgctgcggcccacagcatcccctacaacagctgcagagagaaggagccaagttaccccatgcctgtccaggagacccaggcgccagagtccccaggagagaattcagagcaagccctgcagacgctcagccccagagccatcccaaggaatccagatggtggccccctggagtcctcctctgacctggcagccctcagccctctgacctccagcgggcatcaggagcaggacacagaactgggcagtacccacacagcaggtgcgacctccagcctcacaccatcccgtgggcctgtgtctccatctgtctccttccagcccctggcccgttccacccccagggcaagccgcttgcctggacccacagggtcagttgtatctactggcacctccttctcctcctcatcccctggcttggcctctgcaggggctgcagagggtaaacagggtgcagagagtgaccaggccgagcctatcatctgctccagtggggcagaggcacctgccaactctctgccctccaaagtgcctaccaccttgatgcctgtgaacacagtggccctgaaagtgcctgccaacccagcatctgtcagcacagtgccctccaagttgccaactagctcaaagccccctggtgcagtgccttctaatgcgctcaccaatccagcaccatccaaattgcccatcaactcaacccgtgctggcatggtgccatccaaagtgcctactagcatggtgctcaccaaggtgtctgccagcacagtccccactgacgggagcagcagaaatgaggagaccccagcagctccaacacccgccggcgccactggaggcagctcagcctggctagacagcagctctgagaataggggccttgggtcggagctgagtaagcctggcgtgctggcatcccaggtagacagcccgttctcgggctgcttcgaggatcttgccatcagtgccagcacctccttgggcatggggccctgccatggcccagaggagaatgagtataagtccgagggcacctttgggatccacgtggctgagaaccccagcatccagctcctggagggcaaccctgggccacctgcggacccggatggcggccccaggccacaagccgaccggaagttccaggagagggaggtgccatgccacaggccctcacctggggctctgtggctccaggtggctgtgacaggggtgctggtagtcacactcctggtggtgctgtaccggcggcgtctgcactagtgaagccctgggctcttcccaccacccatctgttccgttcctgcagtacacctggcccctctccgaagccccttgtccctttcttggggattgtggaggctgggtcagaggggagttaagggactgcaggcctggcagcaggacatgccttggctgaaccaagtcctgagagcagcatctctgtccccacggtgccttgtgtgggtccccgtccttggctttctgggtcctgggctgcccccagtgctccagaccttccccactggcaatccaggttatcatccatgtcctccagaggagcttcctcctccaggcctcagccctgttggcccaggtggagcaggagggaccactggaacatgtggtgcttgggaatgcctctcctgttgcattggtccctgaaggcctcagggcaggtatgtggtgtgtgggcgactccacaagacctgcctcccatcctggcagcccagcctgagaccgttgcattgaggcaggcaggagcggcagggtggctgctctccaggagcccaactgccttgagttcctgccccactgggccccctcccctgctgggcaatcctgggaaggtctggaggttcctgtggacctcagggaagccaggggcagctgtcaggcctgaggaagacctgtggagctcctctccagcctcctctttccctcccctctggtctccattctcttcagctccctacatgggctggggaggagacacctggtgggcagagctcaggcagaggtttggatttcagctccctcacttccggggctgtgtggctttggcagatgtcagacttctggtcttgcttctccacgtggacagtgagtatctggctcattcttcactgggttcttctgagattgaacctacaggtgtttgccaagtgcctggcccagagcaagtggccactgcttctcccatctctctcctgcccaacctggtagagctgagggcatgagaggcagagtgcacagtggtcaagggtgcagctctgcagcacaggcagcctaggcctgcgtcccaacctgcctctcaccagctctgtgaccttgggcaagggatttatctgtctgtcccttagttttctcacctgtaaaaggaggataagtatatatatatatttcccagtgttgtgaagattaaaggagtttatcgatgtaggtcttaggatgagtcctggcatttaccaagggttggatatatgttattatcactattaagtgttgagggtccaggcatgctgggcaacagggaccccatctctacaaaaaagtttaaaaaattagccaggcgtggtggtgcacctgtcgtcttagctacttgggaggctgaggtgggaggatcacttgagcccagaagcttgaagctgcagtgagctaggatcgtgccactgcactccaacctgggtgagagagcgagaccctgtctcaagaaaaagaaaaatgcagagaaacaggagtcttggctactcctttagaggcagactcagaccctcctgcctcacagctttatctttgtatttgccccttactttatcttgtgccttgagaaattgctggggagagaggtatgtccactgggcagctgtacaggatggaggatatagggcgtttccactcccagcagccaggttccctcaccccaagctcacccactgttggggagattatctacaataacaccagaaacacattggggtggattgggggtatccttatgggttcttttcagggaaccattgctggacaaggcacaggagccacctccatttctgagctctgcaagggacaagaactagagccatcaggggctgggctcactgtggccccaccccaagccgtcagcctccagggatctacaccctgccttggctgctacagctttttcactccactgccctaggggagttcagcaacctaatgatctctatctctgaacatctcttcatcccatgctccaagtccagcaacctgcaccctggaaccaggagtggaccctacccgagctgtctgtattaatccccatcccccaccaccaatcttaaaaagccctctgtccccctaccctaaaccccagttaggtacccatgctgggcaggtcagttaacaatttatgcacaggtactagttttattgtattaccgttccagggtagctttgaaaaaagtatctcaaaaaggcaacatgggccgagcgcagtggctcacgcctgtaatcccagcactttgggaggccaaggtgggcagatcgcctgaggtctggagttcaagaccagcctggccaacagggtgaaaccccgtctctacaaaaataagaaaattagccaggtgtagtggcagacgtctgtaatcccagctattcaggaggctgaggcacgagaattccatgaacccaggatgcggaggttgcagtgagccgagattgtgccactgcgctccagcctgggcgacagagtggtattctgtttcaaaaaaaaaaaaaaaggcagtatgtagccccgaagactgttgcccaagtggtagaatgttagcacactaccagcctaggtaaaaaatacaaaaagtaactgggcatggcggcgcccatctatagtcccagctacatgggaggctgaggtgggaagataagtcacttgagcccgccaggaggcggaggttgtagtgagctgagatcgcaccactgcactccagcctgggtgaccgagtgatactctgtctcaaagaaaaaaaattataattttagcacagtaaccagccatgatgggagataccctgggtaaggcatgtagaaagggttgagggaccttcccagtcccctagccccgcctcccatcctcccatctttttcttttttcttttttttagagaatcacccagcctggagcgaagtggtgcaatcataactcactgtatccttaaactcccgggcttaagcgatcctcctgcctcagccttctgagtaactaggacttcaggtacctgtcaccatgcctggctaattaaatttttttttcttttttttttttgagatggagtcttgctctgtcacccaggctggagtgcagtggcgcgatctcagctcactgcgacctccacctcctgggttcaggccattctcccgcctcagcctccagagtagctgggactacaggcgcctgccaccacgcctggctaatttttttgcacttttagtagagacggggtttcactgtgttagccaggatggtctcgatctcctgaccttgtgatccgcccgcctcggcctcccaaagtgctgggattacaggcgtgagccaccgcgcccagccaaattaaattttttatagagatgaggtcatgctgttatgttgcccaggttggcctcatgagatcttgccttagcctcccaaagtgctgggattacagatgtgagacactgcacccaaaccccaccacttttttttttcctttttctttttttgagacagtcttactccgttgcccaggctggagtgtagtggcatgatctcagctcactgcaacctccgcctcccgggttcaagcaattctcctgcctcagcctcccgagtagctgggattacagaggcctgccaccacacccgactaattttcgtatttttagtagagacggggtttctccatgttggccaggctgttcttgaactcctgacctcaagtgctccacctgcgttggcttcccaaagtgctgggatacaggagtgagccactgcgcctggctgatcccagcacttttcaaatgatgccgctcaaagccgtgacttggcctactttgaacagcaaacttgttgctgctgttgtcaacctgaaggcctctcaaatgccagcttcaagcagggtgtgaattggccagtgtcagatctcaggagtcctgtgttgagagtgtggctttcagctgcggggagctgcacttggtggggaaagccaggcaggtcaccctcacagccagataatgtggaggtcagaacccaaggaagggagtgagacctccactcccagtgggggacctggccacccatccttggggacctgagaaagcgtacttcaccttggggtgaaggctgggtggggccagagggaccagtgccctcctcagtgcttaggggcagagccacctgcagcaatggtatctgcatattagcccctctccaccttctttctcccgctgaatcatttccctcaaagcccaagagctgtcactgcttctttctccctgggaagaatgcgtggactctgcctggtgatagactgaagccagaacagtgccacaccctcgccttaattccttgctaggtgttctcagatttatgagacttcttagtcaaatatgagggaggttggatgtggtggcttgtgcctgtaatcccagcattttgggaagccgaggtgggaggatcccttgaagccaggagtttgagacaagcctgggcaacaaagcaagaccctatctctaaaaaaaaaaaaaaaaaaaaaaaaaaaaaaaaaaaaaaaaaatctaggagatgctctttaccctgcctggcctcaaactattaatagcttcctttgagcaacattatttattatgaactttcaaacacaaaaaagtagagagagtagaataacaaatccccatgagcccatcacccaacttcagtaattatcaattcatggccatcttgttcacccctgcctgcttccctgcttcccctcattctgcagaggttcttttcttttgagacagagtgttgctctgttgcccaggctggagtgcagtggtgcaacttcggctcactgcaacctccgcctcccaggttcaagtgattctcctgcttcagcctctcaagtagctgggattacagatgcccgccaccacacctggctaattttcgtatttttgttagagatggggtttcaccatgttggccaggctggtctcgaactcctgacctcaagtgatccgcccgccttggcctcccaaaatgctgggattacaggtgtgaaccacggtgcctggccactgtacaggttatttatagaagttggagagtgaagggttgagaaagccaaggggcagatgcgggtctggaggattttgtgcctaaggccctctctttgctcccagacagcatgaagtaacaatgaggcatccacctcttggttttgtggcctctgtggatgacgtctctcaccttgaaccagttcagagttggagtagcgcaggatcctgtcttcagaggaggggccgaagcgggttcctctgttgtcaagctctttggaggtgcctggctgctactactgtcccagagaggtgatgatgaatgatgggtgtgtccagtggcagtttgccccactgaggcaggggcttccactaggccctgacagagcccttccagcaggcagaaatccctgtgctaggcaagattcaaactccgtagcatgtctcctgctcccatctcttaggaatggagtccttcaggccttgagtcccacattttccatgatgctccattaagcagctgatagcacccccacctccagggaaagtgagttcagagtccttggtctaatgcatctgtgttgaaattgaggccttcccctgtgttcacctttctgctctttttcttttagcccaaggctatgaaggcctcattcggtgctgggcatggtcactcctagcattcctcactctgttgctaacagcaacagcaataataataagggttacaacttactccataccttactgtctgccaggcattaagctaagtgctttacatatattaagtcatttaatcctcataatgaccctatgaaagagataccatctcaacccaattgacagctggtttgcaagattaggagggatgaaggacccaggggacaatgcgagggaaaactctgaccccggggccccaggctggatgttctttatgcctgtgaaccacagcttatcacatgtctggagttagggaccccacttaaagtgagattttggctggaggtggtggatcatacctataatcccagcactttgggagaccaaggcagaaggactgcttgaggccaggagttcaaaaccagtgtaggtaacagctagaccctatctctacaaaaaatttaaaaattagctgggtgtggtggtatgtgcctcaagttccagctactcaggaggctgaggtgggaggatcacttgagcacaggagtttgaagttacagtgagctatgatggcaccactgcacttcagcctaggcaacagagggagaccctgtctttaaagtacatagaggtttttcacaccaacacatctctgcccagtgtgccaacatctgccacctgctataatagtactataacactcaatatgtaattaatgtagtctcagggatgttatgacaatatgattacaactatcacgtgtgtgcccagccaggctcaatgccccaggctgggcgaggtggggcaggggacacagcctaaaatgccaggcctcaggaagccatttggtttagcagacattgtttattaaaggagttacctatgccagatcgaaggcctaagatgattaagacactatgagtgccttcaagtggttggggacgttcatgattgtggtacagacaaataggctttcacatcattcttttatgtaatcatacaacagatatttgcacctacatgtgcagagcactgtgataggcctcagtgacacagaataatacggcaaagaccccacccgatgagccccctcccaccacccaccagtacagtagggggtggtttaatggagtgttcctggaatatgaagtgggggcaggcattaggggtggcaaagggacaagtgtttatctgatcagttatgtactgtttataataagtaaatcagcagagggggaataatacttagaacctatagagagtaaatctgacaagatgaaatgctgatgaaaatatggaggaaatgaaactctcatgggttttgcagggaatctaagtcagtgctgtgttgtgaatgtaggtgtaccctttgaattcatatgttgaatcctaacccccaaagcaatggcattaagaggtggggcctttggggctgggtatggtggctcatgactgtaatcccagcactttgggatgctggcagggggcagatcacttgaagccaggagtctgagatcagcctggccaacatggtgaaaccccatctgtactaaaaatacaaaaattagccaggtgtgatggcgtacatctgtaatttcagccactcgggaggctgagacaggagaatagcttgaacccagtaggtggagatttcagtgagccgagatcgtgccactgcactccagcctgggtgacagagcgagactccatctcaaaaaaataataaagatgtggggcctgtgggaggtggttaggtcatgagggtggagatcatgaatggggttagcaccttataaaacaggcttgagggagcccttctgtcccttctaccatgtgtggatgcagtgagaaggcaccgtatctctgaagcagagagcccgccctggacactggatctgctggcaccttgatcttggacttcccagcctctagaactgtgagaaataattttttgttgtttacaaattacccaggctaaggtgtttcattgtaacctgaatggaccaagctggtgtgaccctgttggaaaactggcagtatctaccaaaagccgaacatacgtataaactgatccagcagttccactcctgggtatgtacaccacagaaagctatgtccaccgagacattggcaagaatgtttctaaccacacgctgactgtagccccaaacctgaaacaacccaaatgtccatccaccaacccaaatgtccatccacagttgaagctacagtgaagtcacagggtcgaatactactgcacagcaacgaatatgaatgaaaatatcgctatgcacagcaacatggataaatttcacagacatgaggtcaagcaaaagaggtcagagtcctcatcatcaagagagaattcattgtatgattctcttcctacaaaaagtacagaaataagcaaaactgatccatggtgttagaagccaggggaacagttaacaggggagggatactggggaggggcatcctggagtgctggtctacctcatctgggtgttgatttcacgagtattgtcagtttgtttccagactccctgttggagatgtggaaataaaaaccacctaaacaagagcagagaggccatttggtcaaagtttgcaaaggagtcagccatgattgcttgtatttggcaggggtcaaaggcaggcagggactgtgaaatgttatagtggaaaaaaagggaaggctctgggtgtgctgtgattggagattgttggcatggggacagagcggactaactggaggggcatctttggttggttgggggggtatatttggctttctctggttggtctggagttggaagagggggtgtggtggctggggattgggaagaagctggcagccactaagttcagactgttctgggtccgattgctgctgaggctgtggtttggcttccttggcttcccaggctggtcatgggtttctggccagagtctattgtcatatgtggcctggccattgtccagttgtatgttcagtctcttggaaggaagggtattgactctgagaggggccaccatcgctggaatgggggacacacagtacttcctccagctgcctacacccccctagggtcagtggcgcctgcctgtgagggtgagcccaatggctagagggctctgctccaagtcattgcttactacacccacaaacattcttcgttctttaaggcctaacttaaagcccagatcctacaggaaaccttgattagacccctctctttattaagcttcctaagatcaaaccctgcttttgtgtaaatgctgacctccttgcctacattttaaaaacctagagctgggcatgatggccccagcctgtaatcccagtgattcaggagactgaggtgggaggattgctagaagccaggagttcgagaccagcctgggtaacatagctagaccacatctcttaaaataaaatagttaatttagccaggcatgatgatatatgcctgtagtcccaactacttggaaggctgaggtgtgaggatctttgagcccgggaggtcgaggctacagtaagctatgatctcaccactgtactccagcctgggtgacagagcgagacccagactcaaaaaataaaaataaaaaccctgaatatcttccttctacttcttcagtgctgtttttatttaaaaaaaaaaaaaaccagccaaaaccacaactttttactgaagtgtaatgtaaatgctgtaaaaggcagtgaaaggcacaagggaggtggaggggtaggaagggtggaagtggcgggaggaagtggcagggcaggcaaaatgaagggaagccctgggttcttgtcctgcatccgcagccagctcccactttcctcaccctccaggacctgtaaactgtgaggctggaccagttatgtcaaatctgtcctcccccagagctcagtccctctgcccttgggtgtccttggcacaaggcaggctaggctgcaccagcttcctccatctccgtcctgcctcccccatccccaggtgccattcccacaccatctgaatcactgatttcctcgcaatcagacgctatcttccagttaatcacttcgcttgtatttaacataagaaagaaaaaccctttcattatcacatacagctggaaatcggcttcttgcaggaggcgtatccaaaggaattggagaagagataaactggtaattggtgaaagaattactttaattttttttcctacttgctgtcatgatgatgtccttagaattgtgagcccgtggacacttctgtacaataaatctgctattattac

SEQ ID NO: 154219 - DNA, 11596 bp, Homo sapiens
  Payload ID: 10306
  Gene Symbol: MAVS
  Gene Name: mitochondrial antiviral signaling protein
  Uniprot ID: Q7Z434
  ENST ID: ENST00000416600
  CDS Start-End: 421-1620
acatggccaatggccgcgcgctctgcccgccccgcctcctcgctgcgggaagggtcctgggccccgggcggcggtcgccaggtctcagggccgggggtacccgagtctcgtttcctctcagtccatccacccttcatggggccagagccctctctccagaatctgagcagcaatgccgtttgctgaagacaagacctataagtatatctgccgcaatttcagcaatttttgcaatgtggatgttgtagagattctgccttacctgccctgcctcacagcaagagaccagggacctcggaccgtcccccagacccactggagccaccgtcacttcctgctgagaggccagggccccccacacctgctgcggcccacagcatcccctacaacagctgcagagagaaggagccaagttaccccatgcctgtccaggagacccaggcgccagagtccccaggagagaattcagagcaagccctgcagacgctcagccccagagccatcccaaggaatccagatggtggccccctggagtcctcctctgacctggcagccctcagccctctgacctccagcgggcatcaggagcaggacacagaactgggcagtacccacacagcaggtgcgacctccagcctcacaccatcccgtgggcctgtgtctccatctgtctccttccagcccctggcccgttccacccccagggcaagccgcttgcctggacccacagggtcagttgtatctactggcacctccttctcctcctcatcccctggcttggcctctgcaggggctgcagagggtaaacagggtgcagagagtgaccaggccgagcctatcatctgctccagtggggcagaggcacctgccaactctctgccctccaaagtgcctaccaccttgatgcctgtgaacacagtggccctgaaagtgcctgccaacccagcatctgtcagcacagtgccctccaagttgccaactagctcaaagccccctggtgcagtgccttctaatgcgctcaccaatccagcaccatccaaattgcccatcaactcaacccgtgctggcatggtgccatccaaagtgcctactagcatggtgctcaccaaggtgtctgccagcacagtccccactgacgggagcagcagaaatgaggagaccccagcagctccaacacccgccggcgccactggaggcagctcagcctggctagacagcagctctgagaataggggccttgggtcggagctgagtaagcctggcgtgctggcatcccaggtagacagcccgttctcgggctgcttcgaggatcttgccatcagtgccagcacctccttgggcatggggccctgccatggcccagaggagaatgagtataagtccgagggcacctttgggatccacgtggctgagaaccccagcatccagctcctggagggcaaccctgggccacctgcggacccggatggcggccccaggccacaagccgaccggaagttccaggagagggaggtgccatgccacaggccctcacctggggctctgtggctccaggtggctgtgacaggggtgctggtagtcacactcctggtggtgctgtaccggcggcgtctgcactagtgaagccctgggctcttcccaccacccatctgttccgttcctgcagtacacctggcccctctccgaagccccttgtccctttcttggggattgtggaggctgggtcagaggggagttaagggactgcaggcctggcagcaggacatgccttggctgaaccaagtcctgagagcagcatctctgtccccacggtgccttgtgtgggtccccgtccttggctttctgggtcctgggctgcccccagtgctccagaccttccccactggcaatccaggttatcatccatgtcctccagaggagcttcctcctccaggcctcagccctgttggcccaggtggagcaggagggaccactggaacatgtggtgcttgggaatgcctctcctgttgcattggtccctgaaggcctcagggcaggtatgtggtgtgtgggcgactccacaagacctgcctcccatcctggcagcccagcctgagaccgttgcattgaggcaggcaggagcggcagggtggctgctctccaggagcccaactgccttgagttcctgccccactgggccccctcccctgctgggcaatcctgggaaggtctggaggttcctgtggacctcagggaagccaggggcagctgtcaggcctgaggaagacctgtggagctcctctccagcctcctctttccctcccctctggtctccattctcttcagctccctacatgggctggggaggagacacctggtgggcagagctcaggcagaggtttggatttcagctccctcacttccggggctgtgtggctttggcagatgtcagacttctggtcttgcttctccacgtggacagtgagtatctggctcattcttcactgggttcttctgagattgaacctacaggtgtttgccaagtgcctggcccagagcaagtggccactgcttctcccatctctctcctgcccaacctggtagagctgagggcatgagaggcagagtgcacagtggtcaagggtgcagctctgcagcacaggcagcctaggcctgcgtcccaacctgcctctcaccagctctgtgaccttgggcaagggatttatctgtctgtcccttagttttctcacctgtaaaaggaggataagtatatatatatatttcccagtgttgtgaagattaaaggagtttatcgatgtaggtcttaggatgagtcctggcatttaccaagggttggatatatgttattatcactattaagtgttgagggtccaggcatgctgggcaacagggaccccatctctacaaaaaagtttaaaaaattagccaggcgtggtggtgcacctgtcgtcttagctacttgggaggctgaggtgggaggatcacttgagcccagaagcttgaagctgcagtgagctaggatcgtgccactgcactccaacctgggtgagagagcgagaccctgtctcaagaaaaagaaaaatgcagagaaacaggagtcttggctactcctttagaggcagactcagaccctcctgcctcacagctttatctttgtatttgccccttactttatcttgtgccttgagaaattgctggggagagaggtatgtccactgggcagctgtacaggatggaggatatagggcgtttccactcccagcagccaggttccctcaccccaagctcacccactgttggggagattatctacaataacaccagaaacacattggggtggattgggggtatccttatgggttcttttcagggaaccattgctggacaaggcacaggagccacctccatttctgagctctgcaagggacaagaactagagccatcaggggctgggctcactgtggccccaccccaagccgtcagcctccagggatctacaccctgccttggctgctacagctttttcactccactgccctaggggagttcagcaacctaatgatctctatctctgaacatctcttcatcccatgctccaagtccagcaacctgcaccctggaaccaggagtggaccctacccgagctgtctgtattaatccccatcccccaccaccaatcttaaaaagccctctgtccccctaccctaaaccccagttaggtacccatgctgggcaggtcagttaacaatttatgcacaggtactagttttattgtattaccgttccagggtagctttgaaaaaagtatctcaaaaaggcaacatgggccgagcgcagtggctcacgcctgtaatcccagcactttgggaggccaaggtgggcagatcgcctgaggtctggagttcaagaccagcctggccaacagggtgaaaccccgtctctacaaaaataagaaaattagccaggtgtagtggcagacgtctgtaatcccagctattcaggaggctgaggcacgagaattccatgaacccaggatgcggaggttgcagtgagccgagattgtgccactgcgctccagcctgggcgacagagtggtattctgtttcaaaaaaaaaaaaaaaggcagtatgtagccccgaagactgttgcccaagtggtagaatgttagcacactaccagcctaggtaaaaaatacaaaaagtaactgggcatggcggcgcccatctatagtcccagctacatgggaggctgaggtgggaagataagtcacttgagcccgccaggaggcggaggttgtagtgagctgagatcgcaccactgcactccagcctgggtgaccgagtgatactctgtctcaaagaaaaaaaattataattttagcacagtaaccagccatgatgggagataccctgggtaaggcatgtagaaagggttgagggaccttcccagtcccctagccccgcctcccatcctcccatctttttcttttttcttttttttagagaatcacccagcctggagcgaagtggtgcaatcataactcactgtatccttaaactcccgggcttaagcgatcctcctgcctcagccttctgagtaactaggacttcaggtacctgtcaccatgcctggctaattaaatttttttttcttttttttttttgagatggagtcttgctctgtcacccaggctggagtgcagtggcgcgatctcagctcactgcgacctccacctcctgggttcaggccattctcccgcctcagcctccagagtagctgggactacaggcgcctgccaccacgcctggctaatttttttgcacttttagtagagacggggtttcactgtgttagccaggatggtctcgatctcctgaccttgtgatccgcccgcctcggcctcccaaagtgctgggattacaggcgtgagccaccgcgcccagccaaattaaattttttatagagatgaggtcatgctgttatgttgcccaggttggcctcatgagatcttgccttagcctcccaaagtgctgggattacagatgtgagacactgcacccaaaccccaccacttttttttttcctttttctttttttgagacagtcttactccgttgcccaggctggagtgtagtggcatgatctcagctcactgcaacctccgcctcccgggttcaagcaattctcctgcctcagcctcccgagtagctgggattacagaggcctgccaccacacccgactaattttcgtatttttagtagagacggggtttctccatgttggccaggctgttcttgaactcctgacctcaagtgctccacctgcgttggcttcccaaagtgctgggatacaggagtgagccactgcgcctggctgatcccagcacttttcaaatgatgccgctcaaagccgtgacttggcctactttgaacagcaaacttgttgctgctgttgtcaacctgaaggcctctcaaatgccagcttcaagcagggtgtgaattggccagtgtcagatctcaggagtcctgtgttgagagtgtggctttcagctgcggggagctgcacttggtggggaaagccaggcaggtcaccctcacagccagataatgtggaggtcagaacccaaggaagggagtgagacctccactcccagtgggggacctggccacccatccttggggacctgagaaagcgtacttcaccttggggtgaaggctgggtggggccagagggaccagtgccctcctcagtgcttaggggcagagccacctgcagcaatggtatctgcatattagcccctctccaccttctttctcccgctgaatcatttccctcaaagcccaagagctgtcactgcttctttctccctgggaagaatgcgtggactctgcctggtgatagactgaagccagaacagtgccacaccctcgccttaattccttgctaggtgttctcagatttatgagacttcttagtcaaatatgagggaggttggatgtggtggcttgtgcctgtaatcccagcattttgggaagccgaggtgggaggatcccttgaagccaggagtttgagacaagcctgggcaacaaagcaagaccctatctctaaaaaaaaaaaaaaaaaaaaaaaaaaaaaaaaaaaaaaaaaatctaggagatgctctttaccctgcctggcctcaaactattaatagcttcctttgagcaacattatttattatgaactttcaaacacaaaaaagtagagagagtagaataacaaatccccatgagcccatcacccaacttcagtaattatcaattcatggccatcttgttcacccctgcctgcttccctgcttcccctcattctgcagaggttcttttcttttgagacagagtgttgctctgttgcccaggctggagtgcagtggtgcaacttcggctcactgcaacctccgcctcccaggttcaagtgattctcctgcttcagcctctcaagtagctgggattacagatgcccgccaccacacctggctaattttcgtatttttgttagagatggggtttcaccatgttggccaggctggtctcgaactcctgacctcaagtgatccgcccgccttggcctcccaaaatgctgggattacaggtgtgaaccacggtgcctggccactgtacaggttatttatagaagttggagagtgaagggttgagaaagccaaggggcagatgcgggtctggaggattttgtgcctaaggccctctctttgctcccagacagcatgaagtaacaatgaggcatccacctcttggttttgtggcctctgtggatgacgtctctcaccttgaaccagttcagagttggagtagcgcaggatcctgtcttcagaggaggggccgaagcgggttcctctgttgtcaagctctttggaggtgcctggctgctactactgtcccagagaggtgatgatgaatgatgggtgtgtccagtggcagtttgccccactgaggcaggggcttccactaggccctgacagagcccttccagcaggcagaaatccctgtgctaggcaagattcaaactccgtagcatgtctcctgctcccatctcttaggaatggagtccttcaggccttgagtcccacattttccatgatgctccattaagcagctgatagcacccccacctccagggaaagtgagttcagagtccttggtctaatgcatctgtgttgaaattgaggccttcccctgtgttcacctttctgctctttttcttttagcccaaggctatgaaggcctcattcggtgctgggcatggtcactcctagcattcctcactctgttgctaacagcaacagcaataataataagggttacaacttactccataccttactgtctgccaggcattaagctaagtgctttacatatattaagtcatttaatcctcataatgaccctatgaaagagataccatctcaacccaattgacagctggtttgcaagattaggagggatgaaggacccaggggacaatgcgagggaaaactctgaccccggggccccaggctggatgttctttatgcctgtgaaccacagcttatcacatgtctggagttagggaccccacttaaagtgagattttggctggaggtggtggatcatacctataatcccagcactttgggagaccaaggcagaaggactgcttgaggccaggagttcaaaaccagtgtaggtaacagctagaccctatctctacaaaaaatttaaaaattagctgggtgtggtggtatgtgcctcaagttccagctactcaggaggctgaggtgggaggatcacttgagcacaggagtttgaagttacagtgagctatgatggcaccactgcacttcagcctaggcaacagagggagaccctgtctttaaagtacatagaggtttttcacaccaacacatctctgcccagtgtgccaacatctgccacctgctataatagtactataacactcaatatgtaattaatgtagtctcagggatgttatgacaatatgattacaactatcacgtgtgtgcccagccaggctcaatgccccaggctgggcgaggtggggcaggggacacagcctaaaatgccaggcctcaggaagccatttggtttagcagacattgtttattaaaggagttacctatgccagatcgaaggcctaagatgattaagacactatgagtgccttcaagtggttggggacgttcatgattgtggtacagacaaataggctttcacatcattcttttatgtaatcatacaacagatatttgcacctacatgtgcagagcactgtgataggcctcagtgacacagaataatacggcaaagaccccacccgatgagccccctcccaccacccaccagtacagtagggggtggtttaatggagtgttcctggaatatgaagtgggggcaggcattaggggtggcaaagggacaagtgtttatctgatcagttatgtactgtttataataagtaaatcagcagagggggaataatacttagaacctatagagagtaaatctgacaagatgaaatgctgatgaaaatatggaggaaatgaaactctcatgggttttgcagggaatctaagtcagtgctgtgttgtgaatgtaggtgtaccctttgaattcatatgttgaatcctaacccccaaagcaatggcattaagaggtggggcctttggggctgggtatggtggctcatgactgtaatcccagcactttgggatgctggcagggggcagatcacttgaagccaggagtctgagatcagcctggccaacatggtgaaaccccatctgtactaaaaatacaaaaattagccaggtgtgatggcgtacatctgtaatttcagccactcgggaggctgagacaggagaatagcttgaacccagtaggtggagatttcagtgagccgagatcgtgccactgcactccagcctgggtgacagagcgagactccatctcaaaaaaataataaagatgtggggcctgtgggaggtggttaggtcatgagggtggagatcatgaatggggttagcaccttataaaacaggcttgagggagcccttctgtcccttctaccatgtgtggatgcagtgagaaggcaccgtatctctgaagcagagagcccgccctggacactggatctgctggcaccttgatcttggacttcccagcctctagaactgtgagaaataattttttgttgtttacaaattacccaggctaaggtgtttcattgtaacctgaatggaccaagctggtgtgaccctgttggaaaactggcagtatctaccaaaagccgaacatacgtataaactgatccagcagttccactcctgggtatgtacaccacagaaagctatgtccaccgagacattggcaagaatgtttctaaccacacgctgactgtagccccaaacctgaaacaacccaaatgtccatccaccaacccaaatgtccatccacagttgaagctacagtgaagtcacagggtcgaatactactgcacagcaacgaatatgaatgaaaatatcgctatgcacagcaacatggataaatttcacagacatgaggtcaagcaaaagaggtcagagtcctcatcatcaagagagaattcattgtatgattctcttcctacaaaaagtacagaaataagcaaaactgatccatggtgttagaagccaggggaacagttaacaggggagggatactggggaggggcatcctggagtgctggtctacctcatctgggtgttgatttcacgagtattgtcagtttgtttccagactccctgttggagatgtggaaataaaaaccacctaaacaagagcagagaggccatttggtcaaagtttgcaaaggagtcagccatgattgcttgtatttggcaggggtcaaaggcaggcagggactgtgaaatgttatagtggaaaaaaagggaaggctctgggtgtgctgtgattggagattgttggcatggggacagagcggactaactggaggggcatctttggttggttgggggggtatatttggctttctctggttggtctggagttggaagagggggtgtggtggctggggattgggaagaagctggcagccactaagttcagactgttctgggtccgattgctgctgaggctgtggtttggcttccttggcttcccaggctggtcatgggtttctggccagagtctattgtcatatgtggcctggccattgtccagttgtatgttcagtctcttggaaggaagggtattgactctgagaggggccaccatcgctggaatgggggacacacagtacttcctccagctgcctacacccccctagggtcagtggcgcctgcctgtgagggtgagcccaatggctagagggctctgctccaagtcattgcttactacacccacaaacattcttcgttctttaaggcctaacttaaagcccagatcctacaggaaaccttgattagacccctctctttattaagcttcctaagatcaaaccctgcttttgtgtaaatgctgacctccttgcctacattttaaaaacctagagctgggcatgatggccccagcctgtaatcccagtgattcaggagactgaggtgggaggattgctagaagccaggagttcgagaccagcctgggtaacatagctagaccacatctcttaaaataaaatagttaatttagccaggcatgatgatatatgcctgtagtcccaactacttggaaggctgaggtgtgaggatctttgagcccgggaggtcgaggctacagtaagctatgatctcaccactgtactccagcctgggtgacagagcgagacccagactcaaaaaataaaaataaaaaccctgaatatcttccttctacttcttcagtgctgtttttatttaaaaaaaaaaaaaaccagccaaaaccacaactttttactgaagtgtaatgtaaatgctgtaaaaggcagtgaaaggcacaagggaggtggaggggtaggaagggtggaagtggcgggaggaagtggcagggcaggcaaaatgaagggaagccctgggttcttgtcctgcatccgcagccagctcccactttcctcaccctccaggacctgtaaactgtgaggctggaccagttatgtcaaatctgtcctcccccagagctcagtccctctgcccttgggtgtccttggcacaaggcaggctaggctgcaccagcttcctccatctccgtcctgcctcccccatccccaggtgccattcccacaccatctgaatcactgatttcctcgcaatcagacgctatcttccagttaatcacttcgcttgtatttaacataagaaagaaaaaccctttcattatcacatacagctggaaatcggcttcttgcaggaggcgtatccaaaggaattggagaagagataaactggtaattggtgaaagaattactttaattttttttcctacttgctgtcatgatgatgtccttagaattgtgagcccgtggacacttctgtacaataaatctgctattattacttctagaactaca

SEQ ID NO: 154220 - DNA, 3044 bp, Homo sapiens
  Payload ID: 10307
  Gene Symbol: MALSU1
  Gene Name: mitochondrial assembly of ribosomal large subunit 1
  Uniprot ID: Q96EH3
  ENST ID: ENST00000466681
  CDS Start-End: 154-858
agctcttccgggtcactgcagtcttcacgggctccagactccgcccatggtccgtccttcaggccttgactccgcccacgcatcgacgtagaatttcccggccgggctccatgaagtaccacccacccgcgacgccgacgcaaggctgctgctatggggccgggcggccgtgtggcgcggctgctcgccccactaatgtggcgcagggcggtttcctcggtggcggggtccgcggttggagccgagcccgggcttcggctgctggccgtgcagcggcttcccgtaggagcagcgttctgccgggcttgccagaccccaaactttgtccgcggcctgcacagcgagcctgggctggaggagcgggcggaggggacggtcaacgagggacgcccagaatcggacgcggcagatcatactggtcccaagtttgacatcgatatgatggtttcacttctgaggcaagaaaatgcaagagacatttgtgtgatccaggttcctccagaaatgagatatacagattactttgtgattgttagtggaacttctacccgacacttacatgccatggccttctacgttgtgaaaatgtacaaacacctgaaatgtaaacgtgaccctcatgttaagatagaagggaaggacactgatgactggctgtgcgtggattttggcagcatggtgattcatttgatgcttccagaaaccagagaaatctatgaattagagaaattatggaccctacgttcttatgatgaccagttagctcagatagcacctgagacagtacctgaagacttcattcttggaatagaagatgatacttcatctgtgactccagtggagttaaaatgtgaataaaatattttatgcactgcgttagtcatttcagatttggattgagtcacttattggaaaatacagctcctaaagtccgtctccttggttaggctgctcttaggacaaggcttgtgtacctcatgggcactcctgctaactggcatgcagagactgtcgataagtgagctatacctgcaaccaaaaatcagtacattctacccaaaacttatgacacgctgcctttatcctggaaatgtcatcagaatttcctggagttagcactggctcctgtgcttgacttctctgctcagatttttattaatttaatttagcttaaatgtaaatcttaaccctgtttgtttaatggaatggcaaaaattttaaaaaataatataaaacatagcccactggtcttatttttatactttgaggtgataatattcttctaggaggacttctgtaacccttccagaatactccagtaacacaagaaagtaaacaaagtgtttgttaggaaaaactctgaacgctctagttcttagttcatatgcaagagtattatcaaggttcacattaagtaccatggctggacatggtataacagaaatctgcgtagagtttgaaaaaaaattcagaacattcccattcaattgaaaaccaaaaataaaacatactacacaacaagctgcacctaaatgatgaaaaaatttattctgcgtcaaggtatctggaaaatgaagctgcatttggggcacattatacatgaggaatgatccatatatggtgagtacaaaactcaattatagaattatttcttagctagtaccagatactccaaattacaaatgcttaagtaaaagtaaaatatgatttgccatactaaaaggctagaagtgaaatatgacagaatttaaaccagcagatataaatgcagcacctatgtgtatatttttaaaaaatcaaatattggggaaaaaaatcaaatactgagaaaagctctggccttaaacacatcttacctgaaatccaaccagaaagccagtccatgattttagcaattttaattcattgtatgaaaaaaaaatcatgaatgctaggagaatccagtgacaaaaagggcacttttttggttaaaactacaaaagaaacttgttttcagagaacattaaggaaaacactttaaatcattttcaaaatgtctaattgatcttcagaaaaacatctagtctgtatagaaattcatcttgaaataagaatgaggcagtgattttttttttaaagggttatatatatgtcctttagatcagtgtaacatgactgtgatcatcttacaaacaaaactcaaaaaatcaattcagagagcagcgtggccttggagaccacccacacccaacacaattgtacgtactgggctttgctgtcaaggagtgagcaaatgagttcgttatcaaaggtcatatgttttcacagtcattcaaattatatcccaaaaacttttcttgtattctctatcttttgacttttttttcaaagaactgattgcacagtatacagaaatcctgttatactttactacttaaggtggagtctaattttttttttttaatttatcagtgcttaaaaatcttcaaaatagcttagtgaggctcatgacagtgctggccccatggaaatgtagccttttgttgcgtttaaacactgtcacaccatctatgactgtcccattggtctgaagtgtagtggcaaactaagcatcctataagacaagctaaagcttgctttttgccagtcagttgaaagtcttgcatctcttcactgatgcactttctttaggtattgatagtcagaagcacaaagcatttattatgcattcaatcatgtagctaaacaaaaaactgaagtctcctgaagccatttaaaccagccgttccaaaatctcctgcgaccactttgttagtaccgtcaaaaactttcccaactataaatgaaagaataaatggtagtgctgctctccagatactaggcactgctccgtatttttgaacatttgatttaactaataactgtgtcaaaagcctcaaaaaaccctgaaattaattttccagctttactgtcaccagccagaagtaaaaatcttaatttgcctgttagctgattgctgttaaattttaaatttattttttaaaaaacggttggacttctatcat

SEQ ID NO: 154221 - DNA, 2874 bp, Homo sapiens
  Payload ID: 10308
  Gene Symbol: MCU
  Gene Name: mitochondrial calcium uniporter
  Uniprot ID: Q8NE86
  ENST ID: ENST00000357157
  CDS Start-End: 10-1002
agttgagagatggcggccgccgcaggtagatcgctcctgctgctcctctcctctcggggcggcggcggcgggggcgccggcggctgcggggcgctgactgccggctgcttccctgggctgggcgtcagccgccaccggcagcagcagcaccaccggacggtacaccagaggatcgcttcctggcagaatttgggagctgtttattgcagcactgttgtgccctctgatgatgttacagtggtttatcaaaatgggttacctgtgatatctgtgaggctaccatcccggcgtgaacgctgtcagttcacactcaagcctatctctgactctgttggtgtatttttacgacaactgcaagaagaggatcggggaattgacagagttgctatctattcaccagatggtgttcgcgttgctgcttcaacaggaatagacctcctcctccttgatgactttaagctggtcattaatgacttaacataccacgtacgaccaccaaaaagagtagagatggggttttgccatgttggccagaatggttttgaactcctgacctcaagttatctacctgcctcagcctcccaaagtgccgagattatagccgtacgaattgagattagcagaaaagctgagaagaggaccactttggtgctatggggtggccttgcctacatggccacacagtttggcattttggcccggcttacctggtgggaatattcctgggacatcatggagccagtaacatacttcatcacttatggaagtgccatggcaatgtatgcatattttgtaatgacacgccaggaatatgtttatccagaagccagagacagacaatacttactatttttccataaaggagccaaaaagtcacgttttgacctagagaaatacaatcaactcaaggatgcaattgctcaggcagaaatggaccttaagagactgagagacccattacaagtacatctgcctctccgacaaattggtgaaaaagattgatctgcaaaaagcctctgaatcctggcagaaggaacacctgtttgcctttttaattaaagcattgcaggtggaagctgggagccatgtggggggtagagcgtttttacctttaattataaaacaaaaacagaaaggatctgagggaagaagggaatgttaaaacctgaggatcaggcattgtggaatataagctcaaagggcttagtgaatattgtcttaaccaagtatctcagtttctggatgaaaatgatgcagttatatagttgagagattcataaagagaaaacaatgctgggggtgttcgtttcttgcatcttctttgcagagtcagcaaaagagtaacacaccagcaccccactcgactctatttgtttttaatttaactgtccctatttttgacataggagtaaataaatatactagaaaagcaaattctcatgatatgctaaaatatcattagcatttattttaaattggacccagtctctgcagagttaccaggaatctttccttccagcatccctttactgaccacctacctgtacctcttggttacactcattttttccatttgataattggaaccaacttataactgtttaataattgacactttagattatctcttaataccttcttaaatgtctatatatcccagtgctctggatcagtgtctaaaaatcactggcaacactgcatgaggttgttggttttgttttgttttattaattagtctttcacaggaggaataattgccctcctttatatacttatctattgataatcccctctccctccagaacacaaatcagagggaaagggggtgttcagctgtactaccaaatcaggaagatgtaaggtttacaaattggctaagaatcatggctctgtagccatttcaaccagaataattttattgctaatctgctttgtgtgacagcattccaggccagccagatgggactgccttgtctggaggctttgttcatctcgaaggacacacacttccacactgtttgtgagccctcccacctccacaacttcagttgtaaatcaagtgtgtggatctcaaagggtgcaatttatctttatataggaatacatttctagggcttccttcaagcccactctcttcaccctattttttcttatcttaaattgagagaaagagaattaatcttatactttgtcaaaacattttctaccatatttccagatgacatctgcgcttgaagagtcaaaggaatctgtgtctaatatcctgtttttaactgctgtaggggcaggatggaaaggatgatgggggctgccacaccactgattggccttttctttcacgtgattcatccttcctcattgtggcaaggagtttctttctctttttcttcctcctttgggatcattgtgtatgaaaagaaaaactttaaatgacaaacccagactccaggtgccttgcaaaggttgaaggccagccaggattgctgctgctgctgctactcctgccaacacccctttcattggcatgacggaatgaaaggatgcatgtctccacttcctgaccctccgcccacttccttctccctccaccacccccagtcgtcagctccttccctcatttatttttgttaagttgtgtgaattatttttaacccatttatcctgtttgtgcatagggtttttaagaagaaacagcacagtgcaacgagcaaatctttttggggtgtgtgggaagcaagggagggaggacatggagaaaagttctttaaacaaatagcaaactattgaacatgtgtaaaatcctgtatcatttatgaaatatgtataaaaagcaatgtaccttctggaacaataaatacttattcaatttttgaa

SEQ ID NO: 154222 - DNA, 2949 bp, Homo sapiens
  Payload ID: 10308
  Gene Symbol: MCU
  Gene Name: mitochondrial calcium uniporter
  Uniprot ID: Q8NE86
  ENST ID: ENST00000373053
  CDS Start-End: 22-1077
ggcgccgtttccagttgagagatggcggccgccgcaggtagatcgctcctgctgctcctctcctctcggggcggcggcggcgggggcgccggcggctgcggggcgctgactgccggctgcttccctgggctgggcgtcagccgccaccggcagcagcagcaccaccggacggtacaccagaggatcgcttcctggcagaatttgggagctgtttattgcagcactgttgtgccctctgatgatgttacagtggtttatcaaaatgggttacctgtgatatctgtgaggctaccatcccggcgtgaacgctgtcagttcacactcaagcctatctctgactctgttggtgtatttttacgacaactgcaagaagaggatcggggaattgacagagttgctatctattcaccagatggtgttcgcgttgctgcttcaacaggaatagacctcctcctccttgatgactttaagctggtcattaatgacttaacataccacgtacgaccaccaaaaagagacctcttaagtcatgaaaatgcagcaacgctgaatgatgtaaagacattggtccagcaactatacaccacactgtgcattgagcagcaccagttaaacaaggaaagggagcttattgaaagactagaggatctcaaagagcagctggctcccctggaaaaggtacgaattgagattagcagaaaagctgagaagaggaccactttggtgctatggggtggccttgcctacatggccacacagtttggcattttggcccggcttacctggtgggaatattcctgggacatcatggagccagtaacatacttcatcacttatggaagtgccatggcaatgtatgcatattttgtaatgacacgccaggaatatgtttatccagaagccagagacagacaatacttactatttttccataaaggagccaaaaagtcacgttttgacctagagaaatacaatcaactcaaggatgcaattgctcaggcagaaatggaccttaagagactgagagacccattacaagtacatctgcctctccgacaaattggtgaaaaagattgatctgcaaaaagcctctgaatcctggcagaaggaacacctgtttgcctttttaattaaagcattgcaggtggaagctgggagccatgtggggggtagagcgtttttacctttaattataaaacaaaaacagaaaggatctgagggaagaagggaatgttaaaacctgaggatcaggcattgtggaatataagctcaaagggcttagtgaatattgtcttaaccaagtatctcagtttctggatgaaaatgatgcagttatatagttgagagattcataaagagaaaacaatgctgggggtgttcgtttcttgcatcttctttgcagagtcagcaaaagagtaacacaccagcaccccactcgactctatttgtttttaatttaactgtccctatttttgacataggagtaaataaatatactagaaaagcaaattctcatgatatgctaaaatatcattagcatttattttaaattggacccagtctctgcagagttaccaggaatctttccttccagcatccctttactgaccacctacctgtacctcttggttacactcattttttccatttgataattggaaccaacttataactgtttaataattgacactttagattatctcttaataccttcttaaatgtctatatatcccagtgctctggatcagtgtctaaaaatcactggcaacactgcatgaggttgttggttttgttttgttttattaattagtctttcacaggaggaataattgccctcctttatatacttatctattgataatcccctctccctccagaacacaaatcagagggaaagggggtgttcagctgtactaccaaatcaggaagatgtaaggtttacaaattggctaagaatcatggctctgtagccatttcaaccagaataattttattgctaatctgctttgtgtgacagcattccaggccagccagatgggactgccttgtctggaggctttgttcatctcgaaggacacacacttccacactgtttgtgagccctcccacctccacaacttcagttgtaaatcaagtgtgtggatctcaaagggtgcaatttatctttatataggaatacatttctagggcttccttcaagcccactctcttcaccctattttttcttatcttaaattgagagaaagagaattaatcttatactttgtcaaaacattttctaccatatttccagatgacatctgcgcttgaagagtcaaaggaatctgtgtctaatatcctgtttttaactgctgtaggggcaggatggaaaggatgatgggggctgccacaccactgattggccttttctttcacgtgattcatccttcctcattgtggcaaggagtttctttctctttttcttcctcctttgggatcattgtgtatgaaaagaaaaactttaaatgacaaacccagactccaggtgccttgcaaaggttgaaggccagccaggattgctgctgctgctgctactcctgccaacacccctttcattggcatgacggaatgaaaggatgcatgtctccacttcctgaccctccgcccacttccttctccctccaccacccccagtcgtcagctccttccctcatttatttttgttaagttgtgtgaattatttttaacccatttatcctgtttgtgcatagggtttttaagaagaaacagcacagtgcaacgagcaaatctttttggggtgtgtgggaagcaagggagggaggacatggagaaaagttctttaaacaaatagcaaactattgaacatgtgtaaaatcctgtatcatttatgaaatatgtataaaaagcaatgtaccttctggaacaataaatacttattcaatttttgaa

SEQ ID NO: 154223 - DNA, 3224 bp, Homo sapiens
  Payload ID: 10308
  Gene Symbol: MCU
  Gene Name: mitochondrial calcium uniporter
  Uniprot ID: Q8NE86
  ENST ID: ENST00000536019
  CDS Start-End: 446-1354
cttcgttcttaacagccctgccccaaggctccctgaacggagccagatggaagttgtcccctttccctcctcctccgggcgggttggggagttctgagttgccgcggccgccttgtgtgtgccaggagagtggcagtgccatgctgctgggagctgccccggagagcagcccaggaccccggcggggccgcccctcgtcctctctcgtccccgaggggtcgggcaggaaggaaaatcaaactttattcccctctgtgacttcctctgtgtgtgtgcatggggaaccggctccctcgagatggatgctgcattgcttcaggaggcaagcttcatcctcttgggtccttaaaggtgcttttgggggtcctttcgagggctactgtataagcgtgttcacgcgtgcctgaagcgggaagggtggtcagcaggcacaggagaagcgaatatggtacaccagaggatcgcttcctggcagaatttgggagctgtttattgcagcactgttgtgccctctgatgatgttacagtggtttatcaaaatgggttacctgtgatatctgtgaggctaccatcccggcgtgaacgctgtcagttcacactcaagcctatctctgactctgttggtgtatttttacgacaactgcaagaagaggatcggggaattgacagagttgctatctattcaccagatggtgttcgcgttgctgcttcaacaggaatagacctcctcctccttgatgactttaagctggtcattaatgacttaacataccacgtacgaccaccaaaaagagacctcttaagtcatgaaaatgcagcaacgctgaatgatgtaaagacattggtccagcaactatacaccacactgtgcattgagcagcaccagttaaacaaggaaagggagcttattgaaagactagaggatctcaaagagcagctggctcccctggaaaaggtacgaattgagattagcagaaaagctgagaagaggaccactttggtgctatggggtggccttgcctacatggccacacagtttggcattttggcccggcttacctggtgggaatattcctgggacatcatggagccagtaacatacttcatcacttatggaagtgccatggcaatgtatgcatattttgtaatgacacgccaggaatatgtttatccagaagccagagacagacaatacttactatttttccataaaggagccaaaaagtcacgttttgacctagagaaatacaatcaactcaaggatgcaattgctcaggcagaaatggaccttaagagactgagagacccattacaagtacatctgcctctccgacaaattggtgaaaaagattgatctgcaaaaagcctctgaatcctggcagaaggaacacctgtttgcctttttaattaaagcattgcaggtggaagctgggagccatgtggggggtagagcgtttttacctttaattataaaacaaaaacagaaaggatctgagggaagaagggaatgttaaaacctgaggatcaggcattgtggaatataagctcaaagggcttagtgaatattgtcttaaccaagtatctcagtttctggatgaaaatgatgcagttatatagttgagagattcataaagagaaaacaatgctgggggtgttcgtttcttgcatcttctttgcagagtcagcaaaagagtaacacaccagcaccccactcgactctatttgtttttaatttaactgtccctatttttgacataggagtaaataaatatactagaaaagcaaattctcatgatatgctaaaatatcattagcatttattttaaattggacccagtctctgcagagttaccaggaatctttccttccagcatccctttactgaccacctacctgtacctcttggttacactcattttttccatttgataattggaaccaacttataactgtttaataattgacactttagattatctcttaataccttcttaaatgtctatatatcccagtgctctggatcagtgtctaaaaatcactggcaacactgcatgaggttgttggttttgttttgttttattaattagtctttcacaggaggaataattgccctcctttatatacttatctattgataatcccctctccctccagaacacaaatcagagggaaagggggtgttcagctgtactaccaaatcaggaagatgtaaggtttacaaattggctaagaatcatggctctgtagccatttcaaccagaataattttattgctaatctgctttgtgtgacagcattccaggccagccagatgggactgccttgtctggaggctttgttcatctcgaaggacacacacttccacactgtttgtgagccctcccacctccacaacttcagttgtaaatcaagtgtgtggatctcaaagggtgcaatttatctttatataggaatacatttctagggcttccttcaagcccactctcttcaccctattttttcttatcttaaattgagagaaagagaattaatcttatactttgtcaaaacattttctaccatatttccagatgacatctgcgcttgaagagtcaaaggaatctgtgtctaatatcctgtttttaactgctgtaggggcaggatggaaaggatgatgggggctgccacaccactgattggccttttctttcacgtgattcatccttcctcattgtggcaaggagtttctttctctttttcttcctcctttgggatcattgtgtatgaaaagaaaaactttaaatgacaaacccagactccaggtgccttgcaaaggttgaaggccagccaggattgctgctgctgctgctactcctgccaacacccctttcattggcatgacggaatgaaaggatgcatgtctccacttcctgaccctccgcccacttccttctccctccaccacccccagtcgtcagctccttccctcatttatttttgttaagttgtgtgaattatttttaacccatttatcctgtttgtgcatagggtttttaagaagaaacagcacagtgcaacgagcaaatctttttggggtgtgtgggaagcaagggagggaggacatggagaaaagttctttaaacaaatagcaaactattgaacatgtgtaaaatcctgtatcatttatgaaatatgtataaaaagcaatgtaccttctggaacaataaatacttattcaatttttg

SEQ ID NO: 154224 - DNA, 1074 bp, Homo sapiens
  Payload ID: 10308
  Gene Symbol: MCU
  Gene Name: mitochondrial calcium uniporter
  ENST ID: ENST00000604679
  CDS Start-End: 10-315
agttgagagatggcggccgccgcaggtagatcgctcctgctgctcctctcctctcggggcggcggcggcgggggcgccggcggctgcggggcgctgactgccggctgcttccctgggctgggcgtcagccgccaccggcagcagcagcaccaccggacgggagtggaggaagaggtgaagatgtggaaagcccagagagttggagagttgagagaaggaagaaagcagttaaggtctttcactaccattcctacagtgattggcaagataccgtttctacctcactctccatgtaccatgccagtgacatcttagctgctagagtgtggagctggcctgtgggagtcaagtattggtgatgtgacctgttcacgcaggggaaacttgaacattcgcaggtacaccagaggatcgcttcctggcagaatttgggagctgtttattgcagcactgttgtgccctctgatgatgttacagtggtttatcaaaatgggttacctgtgatatctgtgaggctaccatcccggcgtgaacgctgtcagttcacactcaagcctatctctgactctgttggtgtatttttacgacaactgcaagaagaggatcggggaattgacagagttgctatctattcaccagatggtgttcgcgttgctgcttcaacaggaatagacctcctcctccttgatgactttaagctggtcattaatgacttaacataccacgtacgaccaccaaaaagagacctcttaagtcatgaaaatgcagcaacgctgaatgatgtaaagacattggtccagcaactatacaccacactgtgcattgagcagcaccagttaaacaaggaaagggagcttattgaaagactagaggatctcaaagagcagctggctcccctggaaaaggtacgaattgagattagcagaaaagctgagaagaggaccactttggtgctatggggtggccttgcctacatggccacacagtttggcattttggcccggcttacctggtgggaatattcctgggacatcatggagccagtaacatacttcatcacttatggaagtgcca

SEQ ID NO: 154225 - DNA, 3224 bp, Homo sapiens; identical to SEQ ID NO: 154223
  Payload ID: 10308
  Gene Symbol: MCU
  Gene Name: mitochondrial calcium uniporter
  ENST ID: ENST00000605597
  CDS Start-End: 141-407

SEQ ID NO: 154226 - DNA, 473 bp, Homo sapiens
  Payload ID: 10308
  Gene Symbol: MCU
  Gene Name: mitochondrial calcium uniporter
  ENST ID: ENST00000603649
  CDS Start-End: 10-285
agttgagagatggcggccgccgcaggtagatcgctcctgctgctcctctcctctcggggcggcggcggcgggggcgccggcggctgcggggcgctgactgccggctgcttccctgggctgggcgtcagccgccaccggcagcagcagcaccaccggacggtctttcactaccattcctacagtgattggcaagataccgtttctacctcactctccatgtaccatgccagtgacatcttagctgctagagtgtggagctggcctgtgggagtcaagtattggtgatgtgacctgttcacgcaggggaaacttgaacattcgcagatggttctgttatatcccccagagaccaagggttggccctttatgcttattaggaaagaaggattatgaccaacacttgcatcctgggtacaccagaggatcgcttcctggcagaatttgggagctgtttattgcagcactgttgtgcc

SEQ ID NO: 154227 - DNA, 894 bp, Homo sapiens
  Payload ID: 10308
  Gene Symbol: MCU
  Gene Name: mitochondrial calcium uniporter
  ENST ID: ENST00000604372
  CDS Start-End: 10-174
agttgagagatggcggccgccgcaggtagatcgctcctgctgctcctctcctctcggggcggcggcggcgggggcgccggcggctgcggggcgctgactgccggctgcttccctgggctgggcgtcagccgccaccggcagcagcagcaccaccggacggtattggtgatgtgacctgttcacgcaggggaaacttgaacattcgcagagagggtctcaccccgtcacccaggctgaagtgcggtggcatgatcttggctcactgcagcctcaaactcctgggctcaagcaatccttctttctcagcatcctgaatagctagtactacaggtacaccagaggatcgcttcctggcagaatttgggagctgtttattgcagcactgttgtgccctctgatgatgttacagtggtttatcaaaatgggttacctgtgatatctgtgaggctaccatcccggcgtgaacgctgtcagttcacactcaagcctatctctgactctgttggtgtatttttacgacaactgcaagaagaggatcggggaattgacagagttgctatctattcaccagatggtgttcgcgttgctgcttcaacaggaatagacctcctcctccttgatgactttaagctggtcattaatgacttaacataccacgtacgaccaccaaaaagagacctcttaagtcatgaaaatgcagcaacgctgaatgatgtaaagacattggtccagcaactatacaccacactgtgcattgagcagcaccagttaaacaaggaaagggagcttattgaaagactagaggatctcaaagagcagctggctcccctggaaaaggtacgaattgagattagcagaaaagctgagaagaggaccactttggtgctatggggt

SEQ ID NO: 154228 - DNA, 556 bp, Homo sapiens
  Payload ID: 10308
  Gene Symbol: MCU
  Gene Name: mitochondrial calcium uniporter
  ENST ID: ENST00000604152
  CDS Start-End: 56-556
tttgtacttcctgagagaaggcagagaagaagaatgttttattacatagatgaacatgtcttgtacaagatacagagcagcatctgccacaaaacagtacaccagaggatcgcttcctggcagaatttgggagctgtttattgcagcactgttgtgccctctgatggtgaatgttacagtggtttatcaaaatgggttacctgtgatatctgtgaggctaccatcccggcgtgaacgctgtcagttcacactcaagcctatctctgactctgttggtgtatttttacgacaactgcaagaagaggatcggggaattgacagagttgctatctattcaccagatggtgttcgcgttgctgcttcaacaggaatagacctcctcctccttgatgactttaagctggtcattaatgacttaacataccacgtacgaccaccaaaaagagacctcttaagtcatgaaaatgcagcaacgctgaatgatgtaaagacattggtccagcaactatacaccacactgtgcattgagcagcaccagttaaacaaggaaagggag

SEQ ID NO: 154229 - DNA, 5471 bp, Homo sapiens
  Payload ID: 10309
  Gene Symbol: MCUR1
  Gene Name: mitochondrial calcium uniporter regulator 1
  Uniprot ID: Q96AQ8
  ENST ID: ENST00000379170
  CDS Start-End: 140-1219
gcgcgcccggcaggaaagggcggtcctgcgctgtggcccacgctcgctcccgctgtcggactctgggcctggaccgcgcgtggccggcgccaaaagcgagaggcatgagcgcgcgcccgggccagtgaactgctcggggatggactgcggctcggtcggcggccagaggacccagcgcctgcccggccgccagcggcttctcttcttgcccgtgggcctcagcggaagaccgggcggcagcgaaacctcagcacgccgctgcctctctgcgctctccgacggtctgggggcgctgcgccctcgcgccccggcggcccgcggcggcgtgtcacgtgcctcaccgctgctcctcctcctgctagtgccctccccgcgcttggccgccgcagccccgcgccggcagctcggggactgggagcgctcgcgcctcgggtatgccgcacccccggccgggcgcagcagcgcgtggaggtgctcaccgggcgtcgccgctgccgccggcgcccttccccagtaccacggcccggcgcctgcactcgtttcctgcaggagagagctaagcttgtctgctggatccctgcagctggagcgcaaaaggagagatttcacctcttctgggagcaggaaactctacttcgacactcatgccttagtgtgcttactggaagacaatgggtttgctactcaacaagcagaaatcattgtgtctgcattggtcaagatcctggaggccaacatggacatcgtctacaaagatatggtcaccaagatgcagcaggaaatcacttttcagcaagtaatgtctcagattgcgaatgtgaaaaaggatatgattattttggagaagagtgaattttcagccctcagagcagaaaatgagaaaataaaactcgaactacatcagttaaaacaacaagtaatggatgaagtgatcaaagtccgaacagataccaaattagacttcaacctagaaaagagcagagtaaaagaattgtattcattgaacgaaaagaagctgctggaattgagaacagaaatagtggcattgcatgcccagcaagatcgggcccttacccagacagacaggaagatcgaaactgaggttgctggcctcaaaaccatgcttgagtcacacaagcttgataatattaaatatttagcagggtctatatttacgtgcctaacagtagctctgggattttatcgcctgtggatctaataaagtgtctatttaaagtgatttctactgttttgccttaagaataccagattgttggctgggtgcggtggctcacacctgtaattccagcactttgggaggctgaggcaggtggattacctgaggtcaggagttcgagaccagcctggccaacacggtgaaaccccgtctctactaaaaaattaaaacattaggcgggcgtggtggcgggcgcctgtagtcccagctactcgggaggctaaggtgtgaacctgggaggcggagcttgtagtgagccgagatcacgtcactgcactccagcctgggcaacagagcgagactccgtctcaaaaaaaaaaaaaaaaccggaataccagattgttgtccttttgttttcttgttacacatttgagcccagattttgacttaatgtgtattatttatttttatgaaaattgtggacacataaccaagataaagaagtcaggtattccatagccattccttatctcctttctgcttagttgactttctagctgagtggtgcacagtgcatggaagattccacttagccggaccaggaagcttggtctcatctgtggtgcacaccaacagcaaacattgatgtaattctctacaacttaatctttggcacatagaggatttgggggtctccatgttcagggcacaatggctttaataagtgctggaaaatcactgaagctaaaccaagagcaccagatcctctttacctaaataaccagtctttaacatgagctagtccctgtaccatagtattgtttcagctgtagttggttgtcatgttaataagacagctgcacgtctaccttcttttcttttgatttccattgtcttggtaagttattgttagggttatttttaatgtgccttccagccagaaaaatcagctgtctaaagaagcattgcaattgtaatggggactcttacctcttagaatgcaagattttccctcctccctccctcttctccatctctttccctcatgatttgagaactgtaataatcctccactggtggcattacctacctagaaaacctgctgattcttagcatggaactttgcttcagtttgcaggacaaagtctgcttccttccggtcttcatttactttttatacaagggatgcagtcagctctccatgtataagatacctagatgatggatacatatttcataaatgaaatttatgtcattaatgaatatccccttgcccacaaccagctcaggctttcaaaattcgagaatggtcatgccacacagcattctaatctagatggattaattctgttgttcaaaacattctcatacctgcctttatattgaaaacaaattctagatacaactggggttattctggaaaagcacattctcaccttttttttttttttgagacggagtctcgcactgtcgcagggctggagtgcattgtcgtgatctctgctcactgcaacctctgcctcctgggttcaagcgattctcctgcctcagtctcctgagtagctgggattacaggtgcccaccaccacgcccagctaatttttgtatttttagtagagatgaggtttcaccatgttggccaggctggtctctaactcctgacctcgtgattcacccgccttggtctcccaaagtagtgggattacaggcgtgagccgctgcgcctggcccattctcatcttattcaaattactggcacatgggcaagagagacaatgacatggatagaagcttttctgcctttctctgcacacacatacagtgaaggaaccacaggcagattttttgatcagtttggtgaatacattgctcgttgtcactgttccaaccacattggtaaaaaaaatagttaccttttgtcctttggatgtcatgtctaaactttggaaaatataagtcattgcccttttagagaatgtttgtgtagtccaaagattgtgagctccatatagtatgaaaatcaagtacttttgcatgagcaatagcagtttcaaagtgaaatattataatttaatctttttcaagtagatcaaaaattcttaactgattaataaaatattttatcaatatatcatccccctttcagagagaagtccccagaagagacagcacacttagcaattgccctcattattaaaggcctaggtgagtggcataaagggccatatgcgattatgtttcaaggtaaacattacctaaccttgtgtgggttaaaaacagtgaagtgtccttgtatcctgataaaatttttttttaaataacatggtgggttgacatttttgcatctgctataagttttctcacatgtcgttcttcctggtgagagcgggctgcatcattctggcacttaatttgggtgttcgattttgctatagagttctttgcagtacagcatagcctcttcttggccttgggaacagtgaactcttcttttgatggtgtggattgcatgcatatctggagagaggagggctcaggactgtgttcactttatttggtcagatgtattttatttgaaaaccatttgagcccaaaatacaagtgtacccttcccacttctggctcaagcacccgtgagccgactagacgtaatattaaaacttactgatgctgggtgcggtggctcatgcctataatcccagcactttgggaggccaaggcaggcagatcacctgaggtcaggagttggagaccagactggccaacatgacgaaatgctctcgctactaaaaatagaaaaattagccaggcgtggtggcacacccctgtaatcctagctactcgggaggctgagacaggaaaattgcatgaacctgggaggcagaggttgcagtgagcagagattacaccactgcaacgagactcgggcccagacgagatctgcctgggcgacacagtgagactctgtctcaaaataaataaataagtaaatagaacctcctgagctaccctggcttataaggattcagattactttaggaaattaggcattagcactaggaggggggaagatggctggcaaaacttctagctagcaacctatgtctagcacatgggtaactaaccatagcgagatcctgaacacatatcctctaggtgcaggtggagggaacgatgtccaatacctgaagcagaatctcacatggacggaacgtctgtatttccctctcctgcacgaatcactcatcattcttggagggcttctctgcattcctccttttcttctctcccctcccctgccttttgtcttttctaaagagtctgaactccgatttccatgctctcctgctacattaataagcaaaacctgcttgtgtgtacggttctttactggaaacatgactttttgtttctgtattggttttactgtcatccagttttctagtttaatatctagcaaaactaaatctgaatgtactcgctttttccgttaagtatgccaagcacctcggttgaaaggcttgactcaaaccagaagtcttgctggaattcgtctctgaacacttgaaaaacagaaaccctgagccgcaacaaacatgcctctgtgtgtcgggattgcctttgtctctgcttccatgtggcttttccttttgtagctatgcttagtgacataatcttccctcttctagccttctcctttcaagcctgtctgttaattaaccatgtcagtattggcaagcatttatcttcccccaccctaacatgcaatcttctaagaattttgcaaaattctaaacaaatatagagatggtatatagaattcatatctagaaaactttgattttaatgtgagcttatcaaatttgttctggcttttttggcactaaggcaaaaacatgttaaccagaaataatttattcttcatgtatgtaaaatatttgagaatgtttagccttttattagaattttatttggaaaatatttatctttctacacattttacacttatgttcctttgcttataacccaatttcttaacttttttgttacttaagcaaatatcaattatgttttattatctaataaagtgtaagattcttactatctaaaatatttaattctgtgtgactaatatacttttctgatcattcaaattgaatatgaaaagctagaataactgtattgcaactgttaattccagccaattgtataatgataacactggtgaatttctaagtaaatctaatacttgaaaatttgggtatacatagaaaataaattttaatataatgta

SEQ ID NO: 154230 - DNA, 622 bp, Homo sapiens
  Payload ID: 10309
  Gene Symbol: MCUR1
  Gene Name: mitochondrial calcium uniporter regulator 1
  ENST ID: ENST00000607303
  CDS Start-End: 1-373
aaaggatatgattattttggagaagagtgaattttcagccctcagagcagaaaatgagaaaataaaactcgaactacatcagttaaaacaacaagtaatggatgaagtgatcaaagtccgaacagataccaaattagacttcaacctagaaaagagcagagtaaaagaattgtattcattgaacgaaaagaagctgctggaattgagaacagaaatagtggcattgcatgcccagcaagatcgggcccttacccagacagacaggaagatcgaaactgaggttgctggcctcaaaaccatgcttgagtcacacaagcttgataatattaaatatttagcagagagaagtccccagaagagacagcacacttagcaattgccctcattattaaaggcctagtatgccaagcacctcggttgaaaggcttgactcaaaccagaagtcttgctggaattcgtctctgaacacttgaaaaacagaaaccctgagccgcaacaaacatgcctctgtgtgtcgggattgcctttgtctctgcttccatgtggcttttccttttgtagctatgcttagtgacataatcttccctcttctagccttctcctttcaagcctgtctgttaat

SEQ ID NO: 154231 - DNA, 1826 bp, Homo sapiens
  Payload ID: 10309
  Gene Symbol: MCUR1
  Gene Name: mitochondrial calcium uniporter regulator 1
  Uniprot ID: Q96AQ8
  ENST ID: ENST00000488770
  CDS Start-End: 140-913
gcgcgcccggcaggaaagggcggtcctgcgctgtggcccacgctcgctcccgctgtcggactctgggcctggaccgcgcgtggccggcgccaaaagcgagaggcatgagcgcgcgcccgggccagtgaactgctcggggatggactgcggctcggtcggcggccagaggacccagcgcctgcccggccgccagcggcttctcttcttgcccgtgggcctcagcggaagaccgggcggcagcgaaacctcagcacgccgctgcctctctgcgctctccgacggtctgggggcgctgcgccctcgcgccccggcggcccgcggcggcgtgtcacgtgcctcaccgctgctcctcctcctgctagtgccctccccgcgcttggccgccgcagccccgcgccggcagctcggggactgggagcgctcgcgcctcgggtatgccgcacccccggccgggcgcagcagcgcgtggaggtgctcaccgggcgtcgccgctgccgccggcgcccttccccagtaccacggcccggcgcctgcactcgtttcctgcaggagagagctaagcttgtctgctggatccctgcagctggagcgcaaaaggagagatttcacctcttctgggagcaggaaactctacttcgacactcatgccttagtgtgcttactggaagacaatgaatctcactctttcatccaggctggagtgcagtggcacagtcttggcctactgcaacccccacctcccggtttcaagcgatcctcccacctcatcctcctgagtagctgggattacaggcatgcaccaccacacctggataatttttctgtatttttactagagacggggtttcaccatgttggccaggctggtctcaaactgctgacctcaagtgatccacccaccttggcctcctaaagtgctgggattacaggcgtgaaccactgtgtccagttgccaaacctaattatgtttaaacatgaactctttttttaattaaaattttttaaaattttatttacattaaaatggagatgggatcactatgttgcccatgctggttctgaactcctgggctcaaagatcctcccgccttggtctcccagagtgttaggattacaggcgtgagccaccacacccagccagtgaactcttcttaataaaactttaaaatttggcaaaagtttagtttgagtttttaaaaactaggaagacagacgagaaaaaagaaaacagagtcagagctaaacaatgttaacattttgggtttgctactcaacaagcagaaatcattgtgtctgcattggtcaagatcctggaggccaacatggacatcgtctacaaagatatggtcaccaagatgcagcaggaaatcacttttcagcaagtaatgtctcagattgcgaatgtgaaaaaggatatgattattttggagaagagtgaattttcagccctcagagcagaaaatgagaaaataaaactcgaactacatcagttaaaacaacaagtaatggatgaagtgatcaaagtccgaacagataccaaattagacttcaacctagaaaagagcagagtaaaagaattgtattcattgaacgaaaagaagctgctggaattgagaacagaaatagtggcattgcatgcccagcaagatcgggcccttacccagacagacaggaagatcgaaactgaggttgctggcctcaaaaccatgcttgagtcacacaagcttgataatattaaatatttagcagggtctatatttacgtgcctaacagtagctctgggattttatcgcctgtggatctaataaagtgtctatttaaagtga

SEQ ID NO: 154232 - DNA, 2383 bp, Homo sapiens
  Payload ID: 10310
  Gene Symbol: MICU1
  Gene Name: mitochondrial calcium uptake 1
  Uniprot ID: Q9BPX6
  ENST ID: ENST00000361114
  CDS Start-End: 98-1528
ggagggggtggaggtttgtctccgctgtttcatctctatggctgtcagaggtgggcggctttgaccgagaggctgctggagctcgtgtttggacgcgatgtttcgtctgaactcactttctgctttggcagaactggctgtgggttctcgatggtaccatggaggatcacagcccatccagatccggcgaagactaatgatggtggctttcctgggagcatctgcagtaactgcaagtactggtcttttgtggaagagggcccatgcagaatctccaccatgtgtagacaacctaaaaagtgacatcggtgataaagggaagaataaagatgaaggggatgtttgtaaccatgagaaaaagactgcagatcttgcccctcacccagaagagaaaaagaagaaacgttctggattcagagacagaaaagtgatggaatatgagaataggattcgagcctactccacgccagacaaaatcttccgatattttgccaccttgaaagtcatcagtgagcctggtgaagcagaagtgtttatgacaccagaagattttgtgcgatccataacacccaatgaaaaacaaccagaacacttgggtctggatcaatatataataaaacgctttgatggaaagaaaatttcccaggaacgagaaaaatttgctgatgaaggcagtatattttacacccttggagaatgtgggctcatatccttttcagactacattttcctcacaactgttctttccactcctcagagaaattttgaaattgccttcaagatgtttgatttgaatggagatggagaagtagatatggaagaatttgaacaggttcagagcatcattcgctcccaaaccagtatgggtatgcgccacagagatcgtccaactactggcaacaccctcaagtctggcttgtgttcagccctcacaacctacttttttggagctgatctgaagggaaagctgacaatcaaaaacttcctcgaatttcagcgtaaactgcagcatgatgttctgaagcttgagtttgaacgccatgaccctgtggatgggagaattactgagaggcagtttggtggcatgctacttgcctacagtggggtgcagtccaagaagctgaccgccatgcagaggcagctcaagaagcacttcaaagaaggaaagggtctgacatttcaggaggtggagaacttctttactttcctaaagaacattaatgatgtggacactgcattgagtttttaccatatggctggagcatctcttgataaagtgaccatgcagcaggtggccaggacagtggctaaagtggagctctcagaccacgtgtgtgatgtggtgtttgcactctttgactgtgatggcaatggcgaactgagcaataaggaatttgtttccatcatgaagcaacggctgatgagaggcctggaaaagcccaaagacatgggtttcactcgcctcatgcaggccatgtggaaatgtgcacaggaaactgcctgggacttcgctttacccaaacagtaaccccacactgcaagaggggacccctccacccccagtaccctggaccccctccgcagagtctcggcagagccctttgtgctgctgcttctggaagtagtcccccttcctcccgggatgacctcaggactctgtcggtttcccctctttacccttccccgtccccgtgttctgctgggctctgattctgcccaatgagtatccccataggttctcaaaaacatgaacaagtctgtaaagctcagacatttgtcagcctcaacagcaccacccattcaagcatcctgtggataaagaattcagggaaccatccacacacctgccaaccctgggaagcatccagttctcaaatcgtttttgctatggatttatactaacaagaacattccttgacttccctcctgctggtgttttaaagccacaagtagggaagatatctggcaggcagaaagaagtctgtgatgataaacaatgatgaggatgacctaggcaccctacgctagtgtgagaagcctgcgccccaggaaggatctgtgttagtccctgggatggctccaaggcctgctctaggaaggcagcatgctcagtgggaacacagcaagattcagaatttaaagtagttgcttcatggctctgtgcactcccttttcttcctcgcagcctccctaagatgactccagtgtgaccctgtgcttagtgagcaatagtgattgagctcatgttccctgcaagtgccatttcctctccaggatgggcctctaaagctgaggcctggctcagagcctgtttgccctctgtcttaaacaattgtaaatatcacttaaattataaccatttgcaataaacatccccaaagtt

SEQ ID NO: 154233 - DNA, 2488 bp, Homo sapiens
  Payload ID: 10310
  Gene Symbol: MICU1
  Gene Name: mitochondrial calcium uptake 1
  ENST ID: ENST00000398761
  CDS Start-End: 184-1620
gttccttttcctctgtgcccctcccacacgcctgtctccacgatcccgacaggcccagcggctaggagagtcacgtgagagtgggcggagggggtggaggtttgtctccgctgtttcatctctatggctgtcagaggtgggcggctttgaccgagaggctgctggagctcgtgtttggacgcgatgtttcgtctgaactcactttctgctttggcagaactggctgtgggttctcgatggtaccatggaggatcacagcccatccagatccggcgaagactaatgatggtggctttcctgggagcatctgcagtaactgcaagtactggtcttttgtggaagagggcccatgcagaatctccaccatgtgtagacaacctaaaaagtgacatcggtgataaagggaagaataaagatgaaggggatgtttgtaaccatgagaaaaagactgcagatcttgcccctcacccagaagagaaaaagaagaaacgttctggattcagagacagaaaagtgatggaatatgagaataggattcgagcctactccacgccagacaaaatcttccgatattttgccaccttgaaagtcatcagtgagcctggtgaagcagaagtgtttatgacaccagaagattttgtgcgatccataacacccaatgaaaaacaaccagaacacttgggtctggatcaatatataataaaacgctttgatggaaaggtgaagaaaatttcccaggaacgagaaaaatttgctgatgaaggcagtatattttacacccttggagaatgtgggctcatatccttttcagactacattttcctcacaactgttctttccactcctcagagaaattttgaaattgccttcaagatgtttgatttgaatggagatggagaagtagatatggaagaatttgaacaggttcagagcatcattcgctcccaaaccagtatgggtatgcgccacagagatcgtccaactactggcaacaccctcaagtctggcttgtgttcagccctcacaacctacttttttggagctgatctgaagggaaagctgacaatcaaaaacttcctcgaatttcagcgtaaactgcagcatgatgttctgaagcttgagtttgaacgccatgaccctgtggatgggagaattactgagaggcagtttggtggcatgctacttgcctacagtggggtgcagtccaagaagctgaccgccatgcagaggcagctcaagaagcacttcaaagaaggaaagggtctgacatttcaggaggtggagaacttctttactttcctaaagaacattaatgatgtggacactgcattgagtttttaccatatggctggagcatctcttgataaagtgaccatgcagcaggtggccaggacagtggctaaagtggagctctcagaccacgtgtgtgatgtggtgtttgcactctttgactgtgatggcaatggcgaactgagcaataaggaatttgtttccatcatgaagcaacggctgatgagaggcctggaaaagcccaaagacatgggtttcactcgcctcatgcaggccatgtggaaatgtgcacaggaaactgcctgggacttcgctttacccaaacagtaaccccacactgcaagaggggacccctccacccccagtaccctggaccccctccgcagagtctcggcagagccctttgtgctgctgcttctggaagtagtcccccttcctcccgggatgacctcaggactctgtcggtttcccctctttacccttccccgtccccgtgttctgctgggctctgattctgcccaatgagtatccccataggttctcaaaaacatgaacaagtctgtaaagctcagacatttgtcagcctcaacagcaccacccattcaagcatcctgtggataaagaattcagggaaccatccacacacctgccaaccctgggaagcatccagttctcaaatcgtttttgctatggatttatactaacaagaacattccttgacttccctcctgctggtgttttaaagccacaagtagggaagatatctggcaggcagaaagaagtctgtgatgataaacaatgatgaggatgacctaggcaccctacgctagtgtgagaagcctgcgccccaggaaggatctgtgttagtccctgggatggctccaaggcctgctctaggaaggcagcatgctcagtgggaacacagcaagattcagaatttaaagtagttgcttcatggctctgtgcactcccttttcttcctcgcagcctccctaagatgactccagtgtgaccctgtgcttagtgagcaatagtgattgagctcatgttccctgcaagtgccatttcctctccaggatgggcctctaaagctgaggcctggctcagagcctgtttgccctctgtcttaaacaattgtaaatatcacttaaattataaccatttgcaataaacatccccaaagttccctgtctccttt

SEQ ID NO: 154234 - DNA, 1224 bp, Homo sapiens
  Payload ID: 10310
  Gene Symbol: MICU1
  Gene Name: mitochondrial calcium uptake 1
  Uniprot ID: Q9BPX6
  ENST ID: ENST00000398763
  CDS Start-End: 304-1140
aagactttattattttgcttttctgagctaatcaatgactttaatttggaaaagcaactaaatatttggagaaaaccatgaaaagaatatatacttacagacgggccaaggagatcttcaaggacactcctaaagaaaatttcccaggaacgagaaaaatttgctgatgaaggcagtatattttacacccttggagaatgtgggctcatatccttttcagactacattttcctcacaactgttctttccaataagtaataccatattgaagcaacagaacgttaatattactaagctaagaagatggtgtctctgaaagcaaagctaaatcatttaaggcaaagcatgttgaaacaaaaagctcctcagagaaattttgaaattgccttcaagatgtttgatttgaatggagatggagaagtagatatggaagaatttgaacaggttcagagcatcattcgctcccaaaccagtatgggtatgcgccacagagatcgtccaactactggcaacaccctcaagtctggcttgtgttcagccctcacaacctacttttttggagctgatctgaagggaaagctgacaatcaaaaacttcctcgaatttcagcgtaaactgcagcatgatgttctgaagcttgagtttgaacgccatgaccctgtggatgggagaattactgagaggcagtttggtggcatgctacttgcctacagtggggtgcagtccaagaagctgaccgccatgcagaggcagctcaagaagcacttcaaagaaggaaagggtctgacatttcaggaggtggagaacttctttactttcctaaagaacattaatgatgtggacactgcattgagtttttaccatatggctggagcatctcttgataaagtgaccatgcagcaggtggccaggacagtggctaaagtggagctctcagaccacgtgtgtgatgtggtgtttgcactctttgactgtgatggcaatggcgaactgagcaataaggaatttgtttccatcatgaagcaacggctgatgagaggcctggaaaagcccaaagacatgggtttcactcgcctcatgcaggccatgtggaaatgtgcacaggaaactgcctgggacttcgctttacccaaacagtaaccccacactgcaagaggggacccctccacccccagtaccctggaccccctccgcagagtctcggcagagccctttgtgctgctg

SEQ ID NO: 154235 - DNA, 1212 bp, Homo sapiens
  Payload ID: 10310
  Gene Symbol: MICU1
  Gene Name: mitochondrial calcium uptake 1
  Uniprot ID: Q9BPX6
  ENST ID: ENST00000418483
  CDS Start-End: 95-931
caaatgggacacctagaaagactttattattttgcttttctgagctaatcaatgactttaatttggaaaagcaactaaatatttggagaaaaccatgaaaagaatatatacttacagacgggccaaggagatcttcaaggacactcctaaagctcctcagagaaattttgaaattgccttcaagatgtttgatttgaatggagatggagaagtagatatggaagaatttgaacaggttcagagcatcattcgctcccaaaccagtatgggtatgcgccacagagatcgtccaactactggcaacaccctcaagtctggcttgtgttcagccctcacaacctacttttttggagctgatctgaagggaaagctgacaatcaaaaacttcctcgaatttcagcgtaaactgcagcatgatgttctgaagcttgagtttgaacgccatgaccctgtggatgggagaattactgagaggcagtttggtggcatgctacttgcctacagtggggtgcagtccaagaagctgaccgccatgcagaggcagctcaagaagcacttcaaagaaggaaagggtctgacatttcaggaggtggagaacttctttactttcctaaagaacattaatgatgtggacactgcattgagtttttaccatatggctggagcatctcttgataaagtgaccatgcagcaggtggccaggacagtggctaaagtggagctctcagaccacgtgtgtgatgtggtgtttgcactctttgactgtgatggcaatggcgaactgagcaataaggaatttgtttccatcatgaagcaacggctgatgagaggcctggaaaagcccaaagacatgggtttcactcgcctcatgcaggccatgtggaaatgtgcacaggaaactgcctgggacttcgctttacccaaacagtaaccccacactgcaagaggggacccctccacccccagtaccctggaccccctccgcagagtctcggcagagccctttgtgctgctgcttctggaagtagtcccccttcctcccgggatgacctcaggactctgtcggtttcccctctttacccttccccgtccccgtgttctgctgggctctgattctgcccaatgagtatccccataggttctcaaaaacatgaacaagtctgtaaagctcagacatttgtcagcctcaacagcaccacccattcaagcatc

SEQ ID NO: 154236 - DNA, 1933 bp, Homo sapiens
  Payload ID: 10310
  Gene Symbol: MICU1
  Gene Name: mitochondrial calcium uptake 1
  ENST ID: ENST00000476605
  CDS Start-End: 1-739
caatgaaaaacaaccagaacacttgggtctggatcaatatataataaaacgctttgatggaaagaaaatttcccaggaacgagaaaaatttgctgatgaaggcagtatattttacacccttggagaatgtgggctcatatccttttcagactacattttcctcacaactgttctttccactcctcagagaaattttgaaattgccttcaagatgtttgatttgaatggagatggagaagtagatatggaagaatttgaacaggttcagagcatcattcgctcccaaaccagtatgggtatgcgccacagagatcgtccaactactggcaacaccctcaagtctggcttgtgttcagccctcacaacctacttttttggagctgatctgaagggaaagctgacaatcaaaaacttcctcgaatttcagcgtaaactgcagcatgatgttctgaagcttgagtttgaacgccatgaccctgtggatgggagaattactgagaggcagtttggtggcatgctacttgcctacagtggggtgcagtccaagaagctgaccgccatgcagaggcagctcaagaagcacttcaaagaaggaaagggtctgacatttcaggaggtggagaacttctttactttcctaaagaacattaatgatgtggacactgcattgagtttttaccatatggctggagcatctcttgataaaggaaagggcaccatcttcatggggagaagatgagtacttgaaatatcaagacaattgcagaaggctgtgccctgagagaatggaagaactgggaaagagaaaaggaagtcagaagcttaagtgaccatgcagcaggtggccaggacagtggctaaagtggagctctcagaccacgtgtgtgatgtggtgtttgcactctttgactgtgatggcaatggcgaactgagcaataaggaatttgtttccatcatgaagcaacggctgatgagaggcctggaaaagcccaaagacatgggtttcactcgcctcatgcaggccatgtggaaatgtgcacaggaaactgcctgggacttcgctttacccaaacagtaaccccacactgcaagaggggacccctccacccccagtaccctggaccccctccgcagagtctcggcagagccctttgtgctgctgcttctggaagtagtcccccttcctcccgggatgacctcaggactctgtcggtttcccctctttacccttccccgtccccgtgttctgctgggctctgattctgcccaatgagtatccccataggttctcaaaaacatgaacaagtctgtaaagctcagacatttgtcagcctcaacagcaccacccattcaagcatcctgtggataaagaattcagggaaccatccacacacctgccaaccctgggaagcatccagttctcaaatcgtttttgctatggatttatactaacaagaacattccttgacttccctcctgctggtgttttaaagccacaagtagggaagatatctggcaggcagaaagaagtctgtgatgataaacaatgatgaggatgacctaggcaccctacgctagtgtgagaagcctgcgccccaggaaggatctgtgttagtccctgggatggctccaaggcctgctctaggaaggcagcatgctcagtgggaacacagcaagattcagaatttaaagtagttgcttcatggctctgtgcactcccttttcttcctcgcagcctccctaagatgactccagtgtgaccctgtgcttagtgagcaatagtgattgagctcatgttccctgcaagtgccatttcctctccaggatgggcctctaaagctgaggcctggctcagagcctgtttgccctctgtcttaaacaattgtaaatatcacttaaattataaccatttgcaataaacatccccaaagtt

SEQ ID NO: 154237 - DNA, 774 bp, Homo sapiens
  Payload ID: 10310
  Gene Symbol: MICU1
  Gene Name: mitochondrial calcium uptake 1
  ENST ID: ENST00000603011
  CDS Start-End: 138-774
tttcatctctatggctgtcagaggtgggcggctttgaccgagaggctgctggagctcgtgtttggacgcaactggctgtgggttctcgatggtaccatggaggatcacagcccatccagatccggcgaagactaatgatggtggctttcctgggagcatctgcagtaactgcaagtactggtcttttgtggaagagggcccatgcagaatctccaccatgtgtagacaacctaaaaagtgacatcggtgataaagggaagaataaagatgaaggggatgtttgtaaccatgagaaaaagactgcagatcttgcccctcacccagaagagaaaaagaagaaacgttctggattcagagacagaaaagtgatggaatatgagaataggattcgagcctactccacgccagacaaaatcttccgatattttgccaccttgaaagtcatcagtgagcctggtgaagcagaagtgtttatgacaccagaagattttgtgcgatccataacacccaatgaaaaacaaccagaacacttgggtctggatcaatatataataaaacgctttgatggaaagaaaatttcccaggaacgagaaaaatttgctgatgaaggcagtatattttacacccttggagaatgtgggctcatatccttttcagactacattttcctcacaactgttctttccactcctcagagaaattttgaaattgccttcaagatgtttgatttgaatggagatggagaagtagatatggaagaatttgaacaggcaa

SEQ ID NO: 154238 - DNA, 1268 bp, Homo sapiens
  Payload ID: 10310
  Gene Symbol: MICU1
  Gene Name: mitochondrial calcium uptake 1
  ENST ID: ENST00000604238
  CDS Start-End: 104-1268
gtgggcggagggggtggaggtttgtctccgctgtttcatctctatggctgtcagaggtgggcggctttgaccgagaggctgctggagctcgtgtttggacgcgatgtttcgtctgaactcactttctgctttggcagaactggctgtgggttctcgatggtaccatggaggatcacagcccatccagatccggcgaagactaatgatggtggctttcctgggagcatctgcagtaactgcaagtactggtcttttgtggaagagggcccatgcagaatctccaccatgtgtagacaacctaaaaagtgacatcggtgataaagggaagaataaagatgaaggggatgtttgtaaccatgagaaaaagactgcagatcttgcccctcacccagaagagaaaaagaagaaacgttctggattcagagacagaaaagtgatggaatatgagaataggattcgagcctactccacgccagacaaaatcttccgatattttgccaccttgaaagtcatcagtgagcctggtgaagcagaagtgtttatgacaccagaagattttgtgcgatccataacacccaatgaaaaacaaccagaacacttgggtctggatcaatatataataaaacgctttgatggaaaggccagattctccaaaaagaaaatattacacagggtcagaaagaaaagtaaagggtcaattttacagaggaggaagaaagcacttcagaaagaagaaagaaccaggcatggttctacaaagcacaatgaacaggaagtcagaaggacaatcatggagtggctggaaaaggctggagtgcagtggcaccatctcagctcactgcaacctccgactccctggttcaagcgattcttctgcctcagcctcttaagtagctgggattacaggcacacaccaccatgcccagctaatttttttatttttagtagagacagggtttcaccatgttggccaggatggtctcgatatcctgacctcatgatccgcccgccttggcttcgcaaagtgctgggattacagaaaatttcccaggaacgagaaaaatttgctgatgaaggcagtatattttacacccttggagaatgtgggctcatatccttttcagactacattttcctcacaactgttctttccactcctcagagaaattttgaaattgccttcaagatgtttgatttgaatggagatggagaagtagatatggaagaatttgaacaggttcagagcatcattcgctcccaaaccagta

SEQ ID NO: 154239 - DNA, 579 bp, Homo sapiens
  Payload ID: 10310
  Gene Symbol: MICU1
  Gene Name: mitochondrial calcium uptake 1
  ENST ID: ENST00000489666
  CDS Start-End: 117-579
agtaaaatggcttaaggggaaacaaatgggacacctagaaagactttattattttgcttttctgagctaatcaatgactttaatttggaaaagcaactaaatatttggagaaaaccatgaaaagaatatatacttacagacgggccaaggagatcttcaaggacactcctaaagctcctcagagaaattttgaaattgccttcaagatgtttgatttgaatggagatggagaagtagatatggaagaatttgaacaggttcagagcatcattcgctcccaaaccagtatgggtatgcgccacagagatcgtccaactactggcaacaccctcaagtctggcttgtgttcagccctcacaacctacttttttggagctgatctgaagggaaagctgacaatcaaaaacttcctcgaatttcagcgtaaactgcagcatgatgttctgaagcttgagtttgaacgccatgaccctgtggatgggagaattactgagaggcagtttggtggcatgctacttgcctacagtggggtgcagtccaagaagctgaccgccatgcagaggcagctcaagaagcact

SEQ ID NO: 154240 - DNA, 2215 bp, Homo sapiens
  Payload ID: 10310
  Gene Symbol: MICU1
  Gene Name: mitochondrial calcium uptake 1
  ENST ID: ENST00000635239
  CDS Start-End: 124-1566
gctaggagagtcacgtgagagtgggcggagggggtggaggtttgtctccgctgtttcatctctatggctgtcagaggtgggcggctttgaccgagaggctgctggagctcgtgtttggacgcgatgtttcgtctgaactcactttctgctttggcagaactggctgtgggttctcgatggtaccatggaggatcacagcccatccagatccggcgaagactaatgatggtggctttcctgggagcatctgcagtaactgcaagtactggtcttttgtggaagagggcccatgcagaatctccaccatgtgtagacaacctaaaaagtgacatcggtgataaagggaagaataaagatgaaggggatgtttgtaaccatgagaaaaagactgcagatcttgcccctcacccagaagagaaaaagaagaaacgttctggattcagagacagaaaagtgatggaatatgagaataggattcgagcctactccacgccagacaaaatcttccgatattttgccaccttgaaagtcatcagtgagcctggtgaagcagaagtgtttatgacaccagaagattttgtgcgatccataacacccaatgaaaaacaaccagaacacttgggtctggatcaatatataataaaacgctttgatggaaaggatttctggcagaaaatttcccaggaacgagaaaaatttgctgatgaaggcagtatattttacacccttggagaatgtgggctcatatccttttcagactacattttcctcacaactgttctttccactcctcagagaaattttgaaattgccttcaagatgtttgatttgaatggagatggagaagtagatatggaagaatttgaacaggttcagagcatcattcgctcccaaaccagtatgggtatgcgccacagagatcgtccaactactggcaacaccctcaagtctggcttgtgttcagccctcacaacctacttttttggagctgatctgaagggaaagctgacaatcaaaaacttcctcgaatttcagcgtaaactgcagcatgatgttctgaagcttgagtttgaacgccatgaccctgtggatgggagaattactgagaggcagtttggtggcatgctacttgcctacagtggggtgcagtccaagaagctgaccgccatgcagaggcagctcaagaagcacttcaaagaaggaaagggtctgacatttcaggaggtggagaacttctttactttcctaaagaacattaatgatgtggacactgcattgagtttttaccatatggctggagcatctcttgataaagtgaccatgcagcaggtggccaggacagtggctaaagtggagctctcagaccacgtgtgtgatgtggtgtttgcactctttgactgtgatggcaatggcgaactgagcaataaggaatttgtttccatcatgaagcaacggctgatgagaggcctggaaaagcccaaagacatgggtttcactcgcctcatgcaggccatgtggaaatgtgcacaggaaactgcctgggacttcgctttacccaaacagtaaccccacactgcaagaggggacccctccacccccagtaccctggaccccctccgcagagtctcggcagagccctttgtgctgctgcttctggaagtagtcccccttcctcccgggatgacctcaggactctgtcggtttcccctctttacccttccccgtccccgtgttctgctgggctctgattctgcccaatgagtatccccataggttctcaaaaacatgaacaagtctgtaaagctcagacatttgtcagcctcaacagcaccacccattcaagcatcctgtggataaagaattcagggaaccatccacacacctgccaaccctgggaagcatccagttctcaaatcgtttttgctatggatttatactaacaagaacattccttgacttccctcctgctggtgttttaaagccacaagtagggaagatatctggcaggcagaaagaagtctgtgatgataaacaatgatgaggatgacctaggcaccctacgctagtgtgagaagcctgcgccccaggaaggatctgtgttagtccctgggatggctccaaggcctgctctaggaaggcagcatgctcagtgggaacacagcaagattcagaatttaaagtagttgcttcatggctctgtgcactcccttttctt

SEQ ID NO: 154241 - DNA, 1920 bp, Homo sapiens
  Payload ID: 10311
  Gene Symbol: MICU2
  Gene Name: mitochondrial calcium uptake 2
  Uniprot ID: Q8IYU8
  ENST ID: ENST00000382374
  CDS Start-End: 67-1371
gagagttcccaagcggtaggcggcggcgccgggagagaagcgccgcctagctgcgcttccgcaaagatggcggcggctgcgggtagctgcgcgcgggtggcggcctggggcggaaaactgcgacgggggctcgctgtcagccgacaggctgtgcggagtcccggccccttggcagcggcagtggccggcgcggccctggcaggagcaggagcggcctggcaccacagccgcgtcagtgttgcggcgcgggatggcagttttacagtctccgcacagaaaaatgttgaacatggaataatatatattgggaaaccgtctcttcgtaagcagcgcttcatgcagttttcttcactcgaacatgaaggagaatattatatgacaccacgagacttcctcttctcagtgatgtttgagcaaatggaacgtaaaacttcagtcaagaagctgacaaaaaaggacatcgaggatacactgtcagggatccaaacagctggctgtggatcaacttttttcagagaccttggcgataaagggctaatttcatataccgagtatcttttcttgcttacaatcctcactaaaccccattctggatttcatgttgcttttaaaatgctggatacagatggtaatgagatgattgaaaaaagggaattttttaagctgcagaagatcataagtaaacaagatgacttgatgacagtgaaaactaatgaaactggatatcaggaagcaatagtgaaagaacctgaaattaacacaactcttcagatgcgtttctttggaaaaagaggacaaagaaaacttcattataaagaatttcgaagatttatggaaaatttacaaacagagattcaagaaatggaattccttcagttttctaaaggtttgagtttcatgagaaaagaagactttgcagagtggctactttttttcactaacactgaaaataaagatatttattggaaaaatgtgagagagaagttgtcagcaggagagagcattagtttggatgaattcaagtcattttgccattttacaacccacttggaagactttgctattgccatgcagatgttcagtttagctcatcgtcctgtcagactagcggagtttaagagagctgtgaaagtagcaacaggacaagaactctcaaacaatattttggacactgtctttaagatctttgatttggatggtgatgaatgtcttagtcatgaagagtttcttggggtgttaaaaaacagaatgcatcgaggtttatgggtaccacaacatcagagtatacaagaatactggaagtgtgtgaagaaagaaagcattaaaggagtaaaagaagtctggaaacaagctggaaaaggtcttttttaataaaagatataatagtatggcaattatattgttccaaatgtcaaaatttgtgattttttagaagtacttgctatttatcttcttaagtcttcattgatattctgtgtgaaataagcatgtcttgtacttgctttctgattcataattttattaaagaacttagtagaaagaaaagtaagtataaaaatagatattggattctgtcagaaggcctagatttgaaataatgttttgtacttcggtaagatggaaaacttagtgattcactgatttcttagacactctaatatgatatgctttctggaaggataaaacaaatacatatgggaaaaagtacttgagaccaaggccagcatcaattccagacatcttcatgttcctaataggctaaatgaagttaaaaacttatttcagatttttctcatctgtaccttatatctcataaatttattgcatattttatgtcagtagcttagctgtttattgtctttaaaataacatgtaaacttcaatgttctatctggaagcagaataaaatatttacataga

SEQ ID NO: 154242 - DNA, 742 bp, Homo sapiens
  Payload ID: 10311
  Gene Symbol: MICU2
  Gene Name: mitochondrial calcium uptake 2
  ENST ID: ENST00000468222
  CDS Start-End: 34-742
agagaagcgccgcctagctgcgcttccgcaaagatggcggcggctgcgggtagctgcgcgcgggtggcggcctggggcggaaaactgcgacgggggctcgctgtcagccgacaggctgtgcggagtcccggccccttggcagcggcagtggccggcgcggccctggcaggagcaggagcggcctggcaccacagccgcgtcagtgttgcggcgcgggatggcagttttacagtctccgcacagaaaaatgttgaacatggaataatatatattgggaaaccgtctcttcgtaagcagcgcttcatgcagttttcttcactcgaacatgaaggagaatattatatgacaccacgagacttcctcttctcagtgatgtttgagcaaatggaacgtaaaacttcagtcaagaagctgacaaaaaaggacatcgaggatacactgtcagggatccaaacagctggctgtggatcaacttttttcagagaccttggcgataaagggctaatttcatataccgagtatcttttcttgcttacaatcctcactaaaccccattctggatttcatgttgcttttaaaatgctggatacagatggtaatgagatgattgaaaaaagggaattttttaagattgatacaattgattctgaaaggcagctgcagaagatcataagtaaacaagatgacttgatgacagtgaaaactaatgaaactggatatcaggaagcaatagtgaaagaac

SEQ ID NO: 154243 - DNA, 3992 bp, Homo sapiens
  Payload ID: 10312
  Gene Symbol: MICU3
  Gene Name: mitochondrial calcium uptake family, member 3
  Uniprot ID: Q86XE3
  ENST ID: ENST00000318063
  CDS Start-End: 43-1635
gttctctgccccctcccagctctggtgtgggcggcctccgctatggctgcgctgcgaaggctcttgtggccgccaccccgggtgtctcctccactctgcgctcaccagcccctccttgggccgtgggggcggcctgcggtgaccaccctgggccttcctggccggcccttctcctcccgagaggatgaggagagggctgtggcggaggcggcatggaggcggcggcggcgctggggggagctgagcgtggcggcggcggccggcggggggctggtcggcctggtatgctaccagctgtacggggaccccagggccggctcgccggcgaccgggcgaccctcaaagagcgcggccacggagcccgaggacccgccccgcggccgggggatgctgcccatcccagtggcggctgccaaggagacggttgctattggcagaacagacattgaagacttagacctttatgccacatctcgggagaggcgatttcgtttatttgcttctatagaatgtgaagggcagttattcatgactccgtatgattttattttggctgttacaacagatgagcccaaagttgccaaaacttggaagtcactttccaaacaggaattaaatcaaatgctcgcagaaacaccaccagtttggaaaggctcatcgaagctatttcgaaatcttaaagaaaaaggtgtgatttcttacacagaatatctttttcttttatgtattttaacaaagccacatgcagggttcagaatagctttcaacatgtttgacactgatggcaatgagatggtggataaaaaagagtttttggtgcttcaagagatattcaggaaaaaaaatgaaaagagagaaattaaaggagatgaagaaaagcgtgcaatgctgcgtcttcaactttatggataccattctcctactaatagtgtacttaaaacagatgctgaggaacttgtctccagaagctattgggatacactgagacgtaacacaagccaagcactgttttcagacctcgcagagcgtgctgatgacatcacaagtttagtaacagatactacacttcttgtacacttttttggaaagaaaggaaaagctgagctcaactttgaagatttttatagattcatggataatctccaaacagaagttctagaaatagaattcctttcctactcaaatggaatgaataccatcagtgaagaagattttgctcatattcttttacgatatacaaatgtggaaaatacatcagtatttttagaaaatgtgcgttacagtatacctgaagaaaagggcatcacatttgatgaattcaggtcatttttccagtttttaaacaacctagaagactttgcaatagccctgaatatgtataactttgcaagtcgttctatagggcaagatgaatttaaacgtgccgtctatgtagctactggactcaaattttcaccacatttagtgaacactgtcttcaagatttttgatgttgacaaagatgatcaattaagttataaagaatttattggaattatgaaagacagactccatagaggattccggggttataaaacagtccagaagtaccccactttcaaatcctgcctgaagaaagaacttcacagcagataaatactcctaaaacaaagtttaaaggattactatctgtgtgacaaataacaagaagcaacattttgagaatggaagcaggtctgaggtcagaagaagtagagaatgaaggaaaaggtgaatgctatgaaattgatattttttctggaactgaattcttaaacataaaacagataaaatgcatcttgttactacaaatgttatatatataaaatcaagttgagctttgccttgatttgctgaactctctgcactttttcattcccttcagaagtatatagatacttccggtgactacatatgaatgtactttcaatattatttttttatttattcattagaaattttcctcatttcaaaataatttatgactcatggaatgttgatcgcctaaaaatgaacatcgcattttctttgattttggactgtgaacttattttcagagatgaatattgcttgagatttataatacccttagaattaaattcctgttatttgcccagtttttaattacactgagataattttgaaaagaaatagaaattaagctactatataaaacaattgtttacgtgtacttttaacttttaaaagtacttaattaacatatgttgtttgacttgtataaagtttttaaaaattgttgtttatttgccaaagtcaacagaatgtctgttattgttttatgtatacggtaaagaaatttaaagtgtagaattttcctcccccaaaaagtcatgtgttgatagtagaagcagtggtagttgttgtaacagtaatcattgtcattgtcattatcttcttaaacatgaagctgctcctgatcataggtggtacacgttaataacactagtaaaaataacgtcttacactctgtaacttactgcatattgttaatgtatgtctagcatcaaatgagtattgtaaaagactaatataaaatggtttataagactgatgtatatattaagtagaagctaatatttttgtttcttgcaaaaggaccacttgaaaagtgatgctaaacagccagtaataataatttaaatataatttattatttcaaaagaatatgtcttaaaagggaaaataaaaactttctgttgaatcacaacaaaattagatttgtacatagagaaacaatttgataatacttaatagaaatctgttcaattaaaaatgcttagtttatacaaagatactacacaaaaatagaacaattagtctgaattaacgtatttacatattgcatatggaagataagttcatttatcttcctttctaagacatatttaatgtaggttacatacactccaactattactttgcttttgcatatgaaactagaaaacactgactttgtttttataagttattaaatgtgaaattgatctgcatcagcttatttataaaagtaatgttatttccaagaaaatgttactcttagcattgattttgtatgttagactttttacattgtttatctaatattatttatgacagtaattttaaaatatattattcataagttcaaggatcccatatagtataagaatataatttcacttgctttgaaagttgatttaattgactgactaaatgaaaatgcctacccactcatataacatacctcaggtctattttaccttacactgaatgttcttaatatgatttggtacctaaagtaattgaaaaaaatgcagtttcctttaatccttgactataagttatactatgttgcgtacatggcaaatcctgcaaatatagattaaaaattaaattagcccattgaaatcctttataattctgtcattttcccaaggaagaatagcattgtacatatgcaatctttattttattctttattgcttatcagagtgagtggatgaaaacatttgtaaggctgcaacataatattaaaatgtgaataaataaatgttctgataaaatagaaaagaaagtaaattacagtgatttccatcatattatcactcttgaattttatcatctataaaatgagagataaaaatatctcactgaattgttacttatatcaatttaaaatttgctagtggtttgaaaataataatgtactgactacatgtatgctgttattgtcagtgtttccttctataaactgttctttggaaaaattaagttatacataaaattcatattaaactttttacagaaagcatacatgataaacagtttatggtacttctcagaatcatttcataataagcaatttatttagcttaagttccaacttactgttcttattataaattgcaaagcaacctgtcttacattcttacattatcttaaaataaatatttctgcccttgaatcaagaaaca

SEQ ID NO: 154244 - DNA, 1130 bp, Homo sapiens
  Payload ID: 10312
  Gene Symbol: MICU3
  Gene Name: mitochondrial calcium uptake family, member 3
  ENST ID: ENST00000519044
  CDS Start-End: 1-1127
catctcgggagaggcgatttcgtttatttgcttctatagaatgtgaagggcagttattcatgactccgtatgattttattttggctgttacaacagatgagcccaaagttgccaaaacttggaagtcactttccaaacaggaattaaatcaaatgctcgcagaaacaccaccagtttggaaaggctcatcgaagctatttcgaaatcttaaagaaaaaggtgtgatttcttacacagaatatctttttcttttatgtattttaacaaagccacatgcagggttcagaatagctttcaacatgtttgacactgatggcaatgagatggtggataaaaaagagtttttggtgcttcaagagatattcaggaaaaaaaatgaaaagagagaaattaaaggagatgaagaaaagcgtgcaatgctggtacttaaaacagatgctgaggaacttgtctccagaagctattgggatacactgagacgtaacacaagccaagcactgttttcagacctcgcagagcgtgctgatgacatcacaagtttagtaacagatactacacttcttgtacacttttttggaaagaaaggaaaagctgagctcaactttgaagatttttatagattcatggataatctccaaacagaagttctagaaatagaattcctttcctactcaaatggaatgaataccatcagtgaagaagattttgctcatattcttttacgatatacaaatgtggaaaatacatcagtatttttagaaaatgtgcgttacagtatacctgaagaaaagggcatcacatttgatgaattcaggtcatttttccagtttttaaacaacctagaagactttgcaatagccctgaatatgtataactttgcaagtcgttctatagggcaagatgaatttaaacgtgccgtctatgtagctactggactcaaattttcaccacatttagtgaacactgtcttcaagatttttgatgttgacaaagatgatcaattaagttataaagaatttattggaattatgaaagacagactccatagaggattccggggttataaaacagtccagaagtaccccactttcaaatcctgcctgaagaaagaacttcacagcagataaata

SEQ ID NO: 154245 - DNA, 439 bp, Homo sapiens
  Payload ID: 10312
  Gene Symbol: MICU3
  Gene Name: mitochondrial calcium uptake family, member 3
  ENST ID: ENST00000517398
  CDS Start-End: 1-301
attcatgactccgtatgattttattttggctgttacaacagatgagcccaaagttgccaaaacttggaagtcactttccaaacaggaattaaatcaaatgctcgcagaaacaccaccagtttggaaaggctcatcgaagctatttcgaaatcttaaagaaaaaggtgtgatttcttacacagaatatctttttcttttatgtattttaacaagtaagtatacttattgcttttatttctggatgcagctttattttttaaacgaatcttggaaagcagatcttaggttctcttactcttgaaaatcaatatccatgctgttctgcaaaattcatgtttaatgctacagaaaaatgctaagcatagcactgtaaagagtcaaaaacataaatgctacagcttatggtatagtaataaatgctcataaattataaatttaa

SEQ ID NO: 154246 - DNA, 2006 bp, Homo sapiens
  Payload ID: 10313
  Gene Symbol: MTCH1
  Gene Name: mitochondrial carrier 1
  Uniprot ID: Q9NZJ7
  ENST ID: ENST00000373616
  CDS Start-End: 126-1244
cccgccgcaccacgctcccgagctcccccgcggcctggagtggtgcgccccggccccgccccctgacgccggtgagggggcgtggccccgtcacgtgacggggagtgacctcgccgccgggcgccatgggagcttcggacccggaagtggcgccctgggctcgcggcggtgccgcggggatggcgggagccggagctggagccggagctcgcggcggagcggcggcgggggtcgaggctcgagctcgcgatccaccgcccgcgcaccgcgcacatcctcgccaccctcggcctgcggctcagccctcggcccgcaggatggatggcgggtcagggggcctggggtctggggacaacgccccgaccactgaggctcttttcgtggcactgggcgcgggcgtgacggcgctcagccatcccctgctctacgtgaagctgctcatccaggtgggtcatgagccgatgccccccacccttgggaccaatgtgctggggaggaaggtcctctatctgccgagcttcttcacctacgccaagtacatcgtgcaagtggatggtaagatagggctgttccgaggcctgagtccccggctgatgtccaacgccctctctactgtgactcggggtagcatgaagaaggttttccctccagatgagattgagcaggtttccaacaaggatgatatgaagacttccctgaagaaagttgtgaaggagacctcctacgagatgatgatgcagtgtgtgtcccgcatgttggcccaccccctgcatgtcatctcaatgcgctgcatggtccagtttgtgggacgggaggccaagtacagtggtgtgctgagctccattgggaagattttcaaagaggaagggctgctgggattcttcgttggattaatccctcacctcctgggcgatgtggttttcttgtggggctgtaacctgctggcccacttcatcaatgcctacctggtggatgacagcttcagccaggccctggccatccggagctataccaagttcgtgatggggattgcagtgagcatgctgacctaccccttcctgctagttggcgacctcatggctgtgaacaactgcgggctgcaagctgggctccccccttactccccagtgttcaaatcctggattcactgctggaagtacctgagtgtgcagggccagctcttccgaggctccagcctgcttttccgccgggtgtcatcaggatcatgctttgccctggagtaacctgaatcatctaaaaaacacggtctcaacctggccaccgtgggtgaggcctgaccaccttgggacacctgcaagacgactccaacccaacaacaaccagatgtgctccagcccagccgggcttcagttccatatttgccatgtgtctgtccagatgtggggttgagcgggggtggggctgcacccagtggattgggtcacccggcagacctagggaaggtgaggcgaggtggggagttggcagaatccccatacctcgcagatttgctgagtctgtcttgtgcagagggccagagaatggcttatgggggcccaggttggatggggaaaggctaatggggtcagaccccaccccgtctacccctccagtcagcccagcgcccatcctgcagctcagctgggagcatcattctcctgctttgtacatagggtgtggtcccctggcacgtggccaccatcatgtctaggcctatgctaggaggcaaatggccaggctctgcctgtgtttttctcaacactacttttctgatatgagggcagcacctgcctctgaatgggaaatcatgcaactactcagaatgtgtcctcctcatctaatgctcatctgtttaatggtgatgcctcgcgtacaggatctggttacctgtgcagttgtgaatacccagaggttgggcagatcagtgtctctagtcctacccagttttaaagttcatggtaagatttgacctcatctcccgcaaataaatgtattggtgatttgga

SEQ ID NO: 154247 - DNA, 2057 bp, Homo sapiens
  Payload ID: 10313
  Gene Symbol: MTCH1
  Gene Name: mitochondrial carrier 1
  Uniprot ID: Q9NZJ7
  ENST ID: ENST00000373627
  CDS Start-End: 126-1295
cccgccgcaccacgctcccgagctcccccgcggcctggagtggtgcgccccggccccgccccctgacgccggtgagggggcgtggccccgtcacgtgacggggagtgacctcgccgccgggcgccatgggagcttcggacccggaagtggcgccctgggctcgcggcggtgccgcggggatggcgggagccggagctggagccggagctcgcggcggagcggcggcgggggtcgaggctcgagctcgcgatccaccgcccgcgcaccgcgcacatcctcgccaccctcggcctgcggctcagccctcggcccgcaggatggatggcgggtcagggggcctggggtctggggacaacgccccgaccactgaggctcttttcgtggcactgggcgcgggcgtgacggcgctcagccatcccctgctctacgtgaagctgctcatccaggtgggtcatgagccgatgccccccacccttgggaccaatgtgctggggaggaaggtcctctatctgccgagcttcttcacctacgccaagtacatcgtgcaagtggatggtaagatagggctgttccgaggcctgagtccccggctgatgtccaacgccctctctactgtgactcggggtagcatgaagaaggttttccctccagatgagattgagcaggtttccaacaaggatgatatgaagacttccctgaagaaagttgtgaaggagacctcctacgagatgatgatgcagtgtgtgtcccgcatgttggcccaccccctgcatgtcatctcaatgcgctgcatggtccagtttgtgggacgggaggccaagtacagtggtgtgctgagctccattgggaagattttcaaagaggaagggctgctgggattcttcgttggattaatccctcacctcctgggcgatgtggttttcttgtggggctgtaacctgctggcccacttcatcaatgcctacctggtggatgacagcgtgagtgacaccccaggggggctgggaaacgaccagaatccaggttcccagttcagccaggccctggccatccggagctataccaagttcgtgatggggattgcagtgagcatgctgacctaccccttcctgctagttggcgacctcatggctgtgaacaactgcgggctgcaagctgggctccccccttactccccagtgttcaaatcctggattcactgctggaagtacctgagtgtgcagggccagctcttccgaggctccagcctgcttttccgccgggtgtcatcaggatcatgctttgccctggagtaacctgaatcatctaaaaaacacggtctcaacctggccaccgtgggtgaggcctgaccaccttgggacacctgcaagacgactccaacccaacaacaaccagatgtgctccagcccagccgggcttcagttccatatttgccatgtgtctgtccagatgtggggttgagcgggggtggggctgcacccagtggattgggtcacccggcagacctagggaaggtgaggcgaggtggggagttggcagaatccccatacctcgcagatttgctgagtctgtcttgtgcagagggccagagaatggcttatgggggcccaggttggatggggaaaggctaatggggtcagaccccaccccgtctacccctccagtcagcccagcgcccatcctgcagctcagctgggagcatcattctcctgctttgtacatagggtgtggtcccctggcacgtggccaccatcatgtctaggcctatgctaggaggcaaatggccaggctctgcctgtgtttttctcaacactacttttctgatatgagggcagcacctgcctctgaatgggaaatcatgcaactactcagaatgtgtcctcctcatctaatgctcatctgtttaatggtgatgcctcgcgtacaggatctggttacctgtgcagttgtgaatacccagaggttgggcagatcagtgtctctagtcctacccagttttaaagttcatggtaagatttgacctcatctcccgcaaataaatgtattggtgatttgga

SEQ ID NO: 154248 - DNA, 602 bp, Homo sapiens
  Payload ID: 10313
  Gene Symbol: MTCH1
  Gene Name: mitochondrial carrier 1
  ENST ID: ENST00000418541
  CDS Start-End: 1-602
atgcagtgtgtgtcccgcatgttggcccaccccctgcatgtcatctcaatgcgctgcatggtccagtttgtgggacgggaggccaagtacagctgtcctgcggggccaccatcccaggaagctcagctgccatggtgcctcattttggggtcattaatgggaaattggcccattcccctagactgattatgagtggtgtgctgagctccattgggaagattttcaaagaggaagggctgctgggattcttcgttggattaatccctcacctcctgggcgatgtggttttcttgtggggctgtaacctgctggcccacttcatcaatgcctacctggtggatgacagcttcagccaggccctggccatccggagctataccaagttcgtgatggggattgcagtgagcatgctgacctaccccttcctgctagttggcgacctcatggctgtgaacaactgcgggctgcaagctgggctccccccttactccccagtgttcaaatcctggattcactgctggaagtacctgagtgtgcagggccagctcttccgaggctccagcctgcttttccgccgggtgtcatcaggatcatgctttgcc

SEQ ID NO: 154249 - DNA, 1572 bp, Homo sapiens
  Payload ID: 10313
  Gene Symbol: MTCH1
  Gene Name: mitochondrial carrier 1
  ENST ID: ENST00000460219
  CDS Start-End: 1-1185
gcggggatggcgggagccggagctggagccggagctcgcggcggagcggcggcgggggtcgaggctcgagctcgcgatccaccgcccgcgcaccgcgcacatcctcgccaccctcggcctgcggctcagccctcggcccgcaggatggatggcgggtcagggggcctggggtctggggacaacgccccgaccactgaggctcttttcgtggcactgggcgcgggcgtgacggcgctcagccatcccctgctctacgtgaagctgctcatccaggtgggtcatgagccgatgccccccacccttgggaccaatgtgctggggaggaaggtcctctatctgccgagcttcttcacctacgccaagtacatcgtgcaagtggatggtaagatagggctgttccgaggcctgagtccccggctgatgtccaacgccctctctactgtgactcggggtagcatgaagaaggttttccctccagatgagattgagcaggtttccaacaaggatgatatgaagacttccctgaagaaagttgtgaaggagacctcctacgagatgatgatgcagtgtgtgtcccgcatgttggcccaccccctgcatgtcatctcaatgcgctgcatggtccagtttgtgggacgggaggccaagtacagtggtgtgctgagctccattgggaagattttcaaagaggaagggctgctgggattcttcgttggattaatccctcacctcctgggcgatgtggttttcttgtggggctgtaacctgctggcccacttcatcaatgcctacctggtggatgacagcttcagccaggccctggccatccggagctataccaagttcgtgatggggattgcagtgagcatgctgacctaccccttcctgctagttggcgacctcatggctgtgaacaactgcgggctgcaagctgggctccccccttactccccagtgttcaaatcctggattcactgctggaagtacctgagtgtgcaggtgagcaagcactggacggcggaggcctttcctgttctttgctacatccttcagctgaaatggttttgtggatgcttcattgcatgcaaagataagtggtttcatggaattcaatattgtgaggagatacttggtatctataaggcatttaagttttcatcttacataatttcagaaaggatttgaggtggctaagtgtgggtttattttaagattatacatcagacaagaccttttcttctttgagtcttaaagactcttaggataaggataagagaactctggcccaggtggcaggtggtaaagcccaagaactgcttctccttcaagtaacatgggctgaaaattcgaggtctgtaaccagttgagctgagttcctgggttgttagggcggctggcattggaaaccgactcctccctcctgcaggacattcctgggcccaggagagcctgtgggtggggctgggccacgtggggaactggcagcagtaccaaccttgggttctcgtgttctgtaccgaagctacctctccgtagctggagctcttgggcccagcagtcaggggtccaggc

SEQ ID NO: 154250 - DNA, 1732 bp, Homo sapiens
  Payload ID: 10313
  Gene Symbol: MTCH1
  Gene Name: mitochondrial carrier 1
  ENST ID: ENST00000538808
  CDS Start-End: 45-1136
atcctcgccaccctcggcctgcggctcagccctcggcccgcaggatggatggcgggtcagggggcctggggtctggggacaacgccccgaccactgaggctcttttcgtggcactgggcgcgggcgtgacggcgctcagccatcccctgctctacgtgaagctgctcatccaggtgggtcatgagccgatgccccccacccttgggaccaatgtgctggggaggaaggtcctctatctgccgagcttcttcacctacgccaagtacatcgtgcaagtggatggtaagatagggctgttccgaggcctgagtccccggctgatgtccaacgccctctctactgtgactcggggtagcatgaagaaggttttccctccagatgagattgagcaggtttccaacaaggatgatatgaagacttccctgaagaaagttgtgaaggagacctcctacgagatgatgatgcagtgtgtgtcccgcatgttggcccaccccctgcatgtcatctcaatgcgctgcatggtccagtttgtgggacgggaggccaagtacagtggtgtgctgagctccattgggaagattttcaaagaggaagggctgctgggattcttcgttggattaatccctcacctcctgggcgatgtggttttcttgtggggctgtaacctgctggcccacttcatcaatgcctacctggtggatgacagcttcagccaggccctggccatccggagctataccaagttcgtgatggggattgcagtgagcatgctgacctaccccttcctgctagttggcgacctcatggctgtgaacaactgcgggctgcaagctgggctccccccttactccccagtgttcaaatcctggattcactgctggaagtacctgagtgtgcagggccagctcttccgaggctccagctgcttttccgccgggtgtcatcaggatcatgctttgccctggagtaacctgaatcatctaaaaaacacggtctcaacctggccaccgtgggtgaggcctgaccaccttgggacacctgcaagacgactccaacccaacaacaaccagatgtgctccagcccagccgggcttcagttccatatttgccatgtgtctgtccagatgtggggttgagcgggggtggggctgcacccagtggattgggtcacccggcagacctagggaaggtgaggcgaggtggggagttggcagaatccccatacctcgcagatttgctgagtctgtcttgtgcagagggccagagaatggcttatgggggcccaggttggatggggaaaggctaatggggtcagaccccaccccgtctacccctccagtcagcccagcgcccatcctgcagctcagctgggagcatcattctcctgctttgtacatagggtgtggtcccctggcacgtggccaccatcatgtctaggcctatgctaggaggcaaatggccaggctctgcctgtgtttttctcaacactacttttctgatatgagggcagcacctgcctctgaatgggaaatcatgcaactactcagaatgtgtcctcctcatctaatgctcatctgtttaatggtgatgcctcgcgtacaggatctggttacctgtgcagttgtgaatacccagaggttgggcagatcagtgtctctagtcctacccagttttaaagttcatggtaagatttgacctcatctcccgcaaataaatgtattggtgatttgga

SEQ ID NO: 154251 - DNA, 2587 bp, Homo sapiens
  Payload ID: 10314
  Gene Symbol: MTCH2
  Gene Name: mitochondrial carrier 2
  Uniprot ID: Q9Y6C9
  ENST ID: ENST00000302503
  CDS Start-End: 159-1070
ggggcggggactgggcggagaggcgcgtgctgctgcgtgcgtgcgcgcgcgccgcgggcgggccagtgaaaccggcggccctggcacgtgacctaggaccggctcaccgggtcgcttggtggctccgtctgtctgtccgtccgcccgcgggtgccatcatggcggacgcggccagtcaggtgctcctgggctccggtctcaccatcctgtcccagccgctcatgtacgtgaaagtgctcatccaggtgggatatgagcctcttcctccaacaataggacgaaatatttttgggcggcaagtgtgtcagcttcctggtctctttagttatgctcagcacattgccagtatcgatgggaggcgcgggttgttcacaggcttaactccaagactgtgttcgggagtccttggaactgtggtccatggtaaagttttacagcattaccaggagagtgacaagggtgaggagttaggacctggaaatgtacagaaagaagtctcatcttcctttgaccacgttatcaaggagacaactcgagagatgatcgctcgttctgctgctaccctcatcacacatcccttccatgtgatcactctgagatctatggtacagttcattggcagagaatccaagtactgtggactttgtgattccataataaccatctatcgggaagagggcattctaggatttttcgcgggtcttgttcctcgccttctaggtgacatcctttctttgtggctgtgtaactcactggcctacctcgtcaatacctatgcactggacagtggggtttctaccatgaatgaaatgaagagttattctcaagctgtcacaggattttttgcgagtatgttgacctatccctttgtgcttgtctccaatcttatggctgtcaacaactgtggtcttgctggtggatgccctccttactccccaatatatacgtcttggatagactgttggtgcatgctacaaaaagaggggaatatgagccgaggaaatagcttatttttccggaaggtcccctttgggaagacttattgttgtgacctgaaaatgttaatttgaagatgtggggcagggacagtgacatttctgtagtcccagatgcacagaattatgggagagaatgttgatttctatacagtgtggcgcgcttttttaataatcatttaatcttgggaaaattcaggtgtttggtgtctgccttttttgttcttttttccagcacaacataacttaccactgatactccccctttagttattctgaattaggatatttttgctccaaattcttattttacttaaccagaagggaaaaaaagttgtattttcctgaagctacaggcactttgtcatgtgatttttgagtctcaatttaaggctttgtaaaatgaagagtagaattccaagaaaaatgagaaataattttgtaaaacttaacaaaatcactaaattaaactatatgggaggttatgaattactttttcttgggtagaccctaaaatgtcagtagcatgcaccagaatctgactcccattatgcttctaagcacatttcattgaccttgtctctcatacttcaagaaaaggacagtacattgctacattaccctagaaagtctgtgtgaggatctgccccttcagtctgttattgcaaagtaataaaatgtcacctacagggagcctctgagcctactctagttcaagaggctacctgaaaaaaaataaataagataaagggtcagcaacaacaaagaaaaagacaattacagaaaataagcaagatttggaaaggaagtataatggcacttttttcctcaaaggaagttcttgttttcacataaaatatgaaaagcagatcctgcaggagtaacccccttctttaagagccaagtatttgccagtgcttaaattacaccatacagttctaattatatataatcttttgttcttcagttttttgttttgtttcctttttgttattgttgccgaaggtgagtagttttgcatttctgatgacagccttggaaagtatatttgtaactccatgtctggtaatgccaacccaagtcgacatgggtcttaggacactgaccacctcacatgccataccctcagttaagcatgttaacatttataggaggaaaaaaatcactttgggagaaaataaaattcaactcaagcataaagcttctgtttactcaggccttctaaaaagcaggttaaaatgctctaaaatgagaaagcctgtggtttcacttatttatataactcactgggacattgccaaatgagtaagcacttaattcgctgcttctgagacttctctgtcaaaacagccccactgataatattagacagaacgagaatgcaggggtctcttccctcccctggggtttaggaagctcatgaggagctcggcttaaaatgtctttgatgtctcttcctttgtctcaaaaagtaatgtcaattttatatactatttcaatattactatctgcatttgttttaatataaaaatgtttgctgcctacctttttctcccaaaaaatctttaagtaaagatgatctgggaaaatgt

SEQ ID NO: 154252 - DNA, 930 bp, Homo sapiens
  Payload ID: 10314
  Gene Symbol: MTCH2
  Gene Name: mitochondrial carrier 2
  ENST ID: ENST00000530428
  CDS Start-End: 143-930
ggagaggcgcgtgctgctgcgtgcgtgcgcgcgcgccgcgggcgggccagtgaaaccggcggccctggcacgtgacctaggaccggctcaccgggtcgcttggtggctccgtctgtctgtccgtccgcccgcgggtgccatcatggcggacgcggccagtcaggtgctcctgggctccggtctcaccatcctgtcccagccgctcatgtacgtgaaagtgctcatccaggtgggatatgagcctcttcctccaacaataggacgaaatatttttgggcggcaagtgtgtcagcttcctggtctctttagttatgctcagcacattgccagtatcgatgggaggcgcgggttgttcacaggcttaactccaagactgtgttcgggagtccttggaactgtggtccatggtaaagttttacaggagttaggacctggaaatgtacagaaagaagtctcatcttcctttgaccacgttatcaaggagacaactcgagagatgatcgctcgttctgctgctaccctcatcacacatcccttccatgtgatcactctgagatctatggtacagttcattggcagagaatccaagtactgtggactttgtgattccataataaccatctatcgggaagagggcattctaggatttttcgcgggtcttgttcctcgccttctaggtgacatcctttctttgtggctgtgtaactcactggcctacctcgtcaatacctatgcactggacagtggggtttctaccatgaatgaaatgaagagttattctcaagctgtcacaggattttttgcgagtatgttgacctatccctttgtgcttgtctccaatcttatggctgtcaacaactgtggtcttgctggtggatgccctccttactccccaatatatacgtcttggatagactgttggtgcatgct

SEQ ID NO: 154253 - DNA, 955 bp, Homo sapiens
  Payload ID: 10315
  Gene Symbol: MCCD1
  Gene Name: mitochondrial coiled-coil domain 1
  Uniprot ID: P59942
  ENST ID: ENST00000376191
  CDS Start-End: 299-658
aaacactagatcaaaaaaaaaaaatcacagacctgtggtaggctgggcaccagtgctctaaagcaagttctgcctaaactggcagggacatttttcacatcaggaacaggagttgttcctggactctgtctggggccaggctgggagagacgtggggcagagtggggcaggggcaggggcagggctgggggctggggcctgggcagggccaggcactcaagtgaggccaagtcctggagcgaaccagttcctggtggccgttggacagctcacacagctccctgccaggtcacccgccatggtcctccctctgccctggctctctcggtaccatttccttcgcctccttctgccctcctggtccttggcaccccagggctcccatgggtgctgctcccaaaaccccaaagcaagcatggaagagcagaccagctccagaggaaatgggaagatgacgtcccctcccaggggccctgggacccaccgcacagctgagctggcccgagctgaagagttgttggagcagcagctggagctgtaccaggccctccttgaagggcaggagggagcctgggaggcccaagccctggtgctcaagatccagaagctgaaggaacagatgaggaggcaccaagagagccttggaggaggcgcctaagtttcccccagtgcccacagcaccctccggcgctgaaaatacacgcaccacccaccaggagccttgggatcataaacaccccagcgtcttcccaggccagagaaagtggaagagaccacaaagcgcaggcaattggcaggcagtgggggagccagggctctgcagtcttagtcccattcccctttgatctcacagcaggcagggcacccaggccttataggaattcaccctggaccatgccctaaaataacctcaccccaaatacaataaagggacgaagcacttatagataccaca

SEQ ID NO: 154254 - DNA, 955 bp, Homo sapiens
  Payload ID: 10315
  Gene Symbol: MCCD1
  Gene Name: mitochondrial coiled-coil domain 1
  Uniprot ID: P59942
  ENST ID: ENST00000383512
  CDS Start-End: 299-658
aaacactagatcaaaaaaaaaaaatcacagacctgtggtaggctgggcaccagtgctctaaagcaagttctgcctaaactggcagggacatttttcacatcaggaacaggagttgttcctggactctgtctggggccaggctgggagagacgtggggcagagtggggcaggggcaggggcagggctgggggctggggcctgggcagggccaggcactcaagtgaggccaagtcctggagcgaaccagttcctggtggccgttggacagctcacacagctcccggccaggtcacccgccatggtcctccctctgccctggctctctcggtaccatttccttcgcctccttctgccctcctggtccttggcaccccagggctcccatgggtgctgctcccaaaaccccaaagcaagcatggaagagcagaccaactccagaggaaatgggaagatgacgtcccctcccaggggccctgggacccaccgcacagctgagctggcccgagctgaagagttgttggagcagcagctggagctgtaccaggccctccttgaagggcaggagggagcctgggaggcccaagccctggtgctcaagatccagaagctgaaggaacagatgaggaggcaccaagagagccttggaggaggtgcctaagtttcccccagtgcccacagcaccctccggcactgaaaatacacgcaccacccaccaggagccttgggatcataaacaccccagcgtcttcccaggccagagaaagtggaagagaccacaaaccgcaggcaattggcaggcagtgggggagccagggctctgcagtcttagtcccattcccctttgatctcacagcaggcagggcacccaggccttataggaattcaccctggaccatgccctaaaataacctcaccccaaatacaataaagggacgaagcacttatagataccaca

SEQ ID NO: 154255 - DNA, 955 bp, Homo sapiens
  Payload ID: 10315
  Gene Symbol: MCCD1
  Gene Name: mitochondrial coiled-coil domain 1
  Uniprot ID: P59942
  ENST ID: ENST00000421209
  CDS Start-End: 299-658
aaacactagatcaaaaaaaaaaaatcacagacctgtggtaggctgggcaccagtgctctaaagcaagttctgcctgaactggcagggacatttttcacatcaggaacaggagttgttcctggactctgtctggggccaggctgggagagacgtggggcagagtggggcaggggcaggggcagggctgggggctggggcctgggcagggccaggcactcaagtgaggccaagtcctggagcgaaccagttcctggtggccgttggacagctcacacagctcccggccaggtcacccgccatggtcctccctctgccctggctctctcggtaccatttccttcgcctccttctgccctcctggtccttggcaccccagggctcccatgggtgctgctcccaaaaccccaaagcaagcatggaagagcagaccaactccagaggaaatgggaagatgacgtcccctcccaggggccctgggacccaccgcacagctgagctggcccgagctgaagagttgttggagcagcagctggagctgtaccaggccctccttgaagggcaggagggagcctgggaggcccaagccctggtgctcaagatccagaagctgaaggaacagatgaggaggcaccaagagagccttggaggaggtgcctaagtttcccccagtgcccacagcaccctccggcactgaaaatacacgcaccacccaccaggagccttgggatcataaacaccccagcgtcttcccaggccagagaaagtggaagagaccacaaaccgcaggcaattggcaggcagtgggggagccagggctctgcagtcttagtcccattcccctttgatctcacagcaggcagggcacccaggccttataggaattcaccctggaccatgccctaaaataacctcaccccaaatacaataaagggacgaagcacttatagataccaca

SEQ ID NO: 154256 - DNA, 955 bp, Homo sapiens; identical to SEQ ID NO: 154254
  Payload ID: 10315
  Gene Symbol: MCCD1
  Gene Name: mitochondrial coiled-coil domain 1
  Uniprot ID: P59942
  ENST ID: ENST00000452195
  CDS Start-End: 299-658

SEQ ID NO: 154257 - DNA, 955 bp, Homo sapiens; identical to SEQ ID NO: 154253
  Payload ID: 10315
  Gene Symbol: MCCD1
  Gene Name: mitochondrial coiled-coil domain 1
  Uniprot ID: P59942
  ENST ID: ENST00000424816
  CDS Start-End: 299-658

SEQ ID NO: 154258 - DNA, 955 bp, Homo sapiens; identical to SEQ ID NO: 154254
  Payload ID: 10315
  Gene Symbol: MCCD1
  Gene Name: mitochondrial coiled-coil domain 1
  Uniprot ID: P59942
  ENST ID: ENST00000443405
  CDS Start-End: 299-658

SEQ ID NO: 154259 - DNA, 955 bp, Homo sapiens
  Payload ID: 10315
  Gene Symbol: MCCD1
  Gene Name: mitochondrial coiled-coil domain 1
  Uniprot ID: P59942
  ENST ID: ENST00000422733
  CDS Start-End: 299-658
aaacactagatcaaaaaaaaaaaatcacagacctgtggtaggctgggcaccagtgctctaaagcaagttctgcctaaactggcagggacatttttcacatcaggaacaggagttgttcctggactctgtctggggccaggctgggagagacgtggggcagagtggggcaggggcaggggcagggctgggggctggggcctgggcagggccaggcactcaagtgaggccaagtcctggagcgaaccagttcctggtggccgttggacagctcacacagctccctgccaggtcacccgccatggtcctccctctgccctggctctctcggtaccatttccttcgcctccttctgccctcctggtccttggcaccccagggctcccatgggtgctgctcccaaaaccccaaagcaagcatggaagagcagaccagctccagaggaaatgggaagatgacgtcccctcccaggggccctgggacccaccgcacagctgagctggcccgagctgaagagttgttggagcagcagctggagctgtaccaggccctccttgaagggcaggagggggcctgggaggcccaagccctggtgctcaagatccagaagctgaaggaacagatgaggaggcaccaagagagccttggaggaggcgcctaagtttcccccagtgcccacagcaccctccggcgctgaaaatacacgcaccacccaccaggagccttgggatcataaacaccccagcgtcttcccaggccagagaaagtggaagagaccacaaagcgcaggcaattggcaggcagtgggggagccagggctctgcagtcttagtcccattcccctttgatctcacagcaggcagggcacccaggccttataggaattcaccctggaccatgccctaaaataacctcaccccaaatacaataaagggacgaagcacttatagataccaca

SEQ ID NO: 154260 - DNA, 955 bp, Homo sapiens
  Payload ID: 10315
  Gene Symbol: MCCD1
  Gene Name: mitochondrial coiled-coil domain 1
  Uniprot ID: P59942
  ENST ID: ENST00000430073
  CDS Start-End: 299-658
aaacactagatcaaaaaaaaaaaatcacagacctgtggtaggctgggcaccagtgctctaaagcaagttctgcctaaactggcagggacatttttcacatcaggaacaggagttgttcctggactctgtctggggccaggctgggagagacgtggggcagagtggggcaggggcaggggcagggctgggggctggggcctgggcagggccaggcactcaagtgaggccaagtcctggagcgaaccagttcctggtggccgttggacagctcacacagctcccggccaggtcacccgcgatggtcctccctctgccctggctctctcggtaccatttccttcgcctccttctgccctcctggtccttggcaccccagggctcccatgggtgctgctcccaaaaccccaaagcaagcatggaaaagcagaccaactccagaggaaatgggaagatgacgtcccctcccaggggccctgggacccaccgcacagctgagctggcccgagctgaagagttgttggagcagcagctggagctgtaccaggccctccttgaagggcaggagggagcctgggaggcccaagccctggtgctcaagatccagaagctgaaggaacagatgaggaggcaccaagagagccttggaggaggtgcctaagtttcccccagtgcccacagcaccctccggcactgaaaatacacgcaccacccaccaggagccttgggatcataaacaccccagcgtcttcccaggccagagaaagtggaagagaccacaaaccgcaggcaattggcaggcagtgggggagccagggctctgcagtcttagtcccattcccctttgatctcacagcaggcagggcacccaggccttataggaattcaccctggaccatgccctaaaataacctcaccccaaatacaataaagggacgaagcacttatagataccaca

SEQ ID NO: 154261 - DNA, 2438 bp, Homo sapiens
  Payload ID: 10316
  Gene Symbol: MUL1
  Gene Name: mitochondrial E3 ubiquitin protein ligase 1
  Uniprot ID: Q969V5
  ENST ID: ENST00000264198
  CDS Start-End: 138-1196
atcgctgggcgactgatttcgagtttccggtcaggttaggccgggggggtgcggtcctggtcggaaggaggtggagagtcgggggtcaccaggcctatccttggcgccacagtcggccaccggggctcgccgccgtcatggagagcggagggcggccctcgctgtgccagttcatcctcctgggcaccacctctgtggtcaccgccgccctgtactccgtgtaccggcagaaggcccgggtctcccaagagctcaagggagctaaaaaagttcatttgggtgaagatttaaagagtattctttcagaagctccaggaaaatgcgtgccttatgctgttatagaaggagctgtgcggtctgttaaagaaacgcttaacagccagtttgtggaaaactgcaagggggtaattcagcggctgacacttcaggagcacaagatggtgtggaatcgaaccacccacctttggaatgattgctcaaagatcattcatcagaggaccaacacagtgccctttgacctggtgccccacgaggatggcgtggatgtggctgtgcgagtgctgaagcccctggactcagtggatctgggtctagagactgtgtatgagaagttccacccctcgattcagtccttcaccgatgtcatcggccactacatcagcggtgagcggcccaaaggcatccaagagaccgaggagatgctgaaggtgggggccaccctcacaggggttggcgaactggtcctggacaacaactctgtccgcctgcagccgcccaaacaaggcatgcagtactatctaagcagccaggacttcgacagcctgctgcagaggcaggagtcgagcgtcaggctctggaaggtgctggcgctggtttttggctttgccacatgtgccaccctcttcttcattctccggaagcagtatctgcagcggcaggagcgcctgcgcctcaagcagatgcaggaggagttccaggagcatgaggcccagctgctgagccgagccaagcctgaggacagggagagtctgaagagcgcctgtgtagtgtgtctgagcagcttcaagtcctgcgtctttctggagtgtgggcacgtttgttcctgcaccgagtgctaccgcgccttgccagagcccaagaagtgccctatctgcagacaggcgatcacccgggtgatacccctgtacaacagctaatagtttggaagccgcacagcttgacctggaagcacccctgcccccttttcagggatttttatctcgaggcctttggaggagcagtggtgggggtagctgtcacctccaggtatgattgagggaggaattgggtagaaactctccagacccatgcctccaatggcaggatgctgcctttcccacctgagaggggaccctgtccatgtgcagcctcatcagagcctcaccctgggaggatgccgtggcgtctcctcccaggagccagatcagtgcgagtgtgactgaaaatgcctcatcacttaagcaccaaagccagtgatcagcagctcttctgttcctgtgtcttctgtttttttctggtgaatcgttgcttgctgtggacttggtggaggactcagaggggaggaaaggctgggccccgagtacaacggatgccttgggtgctgcctccgaagagactctgccgcagcttttcttctttttcctcatgccccgggaaacagtctttcttcagaattgtcaggctgggcaggtcaacttgtgttcctttcccctcacctgcttgcctccttaacgcctgcacgtgtgtgtagaggacaaaagaaagtgaagtcagcacatccgcttctgcccagatggtcggggccccgggcaacagattgaagagagatcatgtgaagggcagttggtcaggcaggcctcctggtttcgccactggccctgatttgaactcctgccacttgggagagctcggggtggtccctggttttccctcctggagaatgaggcgcagaggcctcgcctcctgaaggacgcagtgtggatgccactggcctagtgtcctggcctcacagcttccttgcaaggctgtcacaaggaaaagcagccggctggcaccctgagcatatgccctcttggggctccctcatccagcccgtcgcagctttgacatcttggtgtactcatgtcgcttctccttgtgttaccccctcccagtattaccatttgcccctcacctgcccttggtgagccttttagtgcaagacagatggggctgttttcccccacctctgagtagttggaggtcacatacacagctctttttttattgcccttttctgcctctgaatgttcatctctcgtcctcctttgtgcaggcgaggaaggggtgccctcaggggccgacactagtatgatgcagtgtccagtgtgaacagcagaaattaaacatgttgcaaccaa

SEQ ID NO: 154262 - DNA, 5625 bp, Homo sapiens
  Payload ID: 10317
  Gene Symbol: MIEF1
  Gene Name: mitochondrial elongation factor 1
  Uniprot ID: Q9NQG6
  ENST ID: ENST00000325301
  CDS Start-End: 425-1816
gaaggggccatgttgatgggtgacccggggagaggtacccggccagaggcgagtcctgcggagtggtagcgcgcacggcctgcggtgtgacacccagcccctgccagtcccccatggccccgtggagccgagaggcggtgctgagtctctatcgggctctgttgcgccagggccgacagcttcgctacactgatcgagacttctactttgcctccatccgccgtgaattccgaaaaaatcagaagctagaggacgctgaggcccgggagaggcagctggagaagggcctggtctttctcaacggcaaattggggaggatcatttaggatcctccaagggaaagaggacaaaggtgccttctgtagacactcctgctctcttccatccccatcttacagatgtattaagaagcctcagatgagcaatggcaggcgctggtgagcgcaaaggcaagaaggatgacaatggcattggcacggccattgactttgtgctctccaatgcccggctggtgctgggggtgggtggagcggccatgctgggcatcgccacgctggcagttaagcggatgtacgatcgggcgatcagtgcccctaccagccccacccgcctgagccattcggggaaaaggagctgggaagaacccaactggatgggctccccacgactgctgaacagggacatgaagacgggcctgagccggtccttgcagacccttcccacagactcctccaccttcgacacagatacattctgcccgccccggcccaagccagtggccaggaagggccaggtagacttgaagaagtcacgactccgcatgtccctgcaggagaaacttcttacttactaccggaaccgggcagccatccctgctggagagcaggctcgggccaagcaagctgctgtggacatatgtgccgagctccggagcttcctgcgggccaagttgcctgacatgccgcttcgggacatgtacttgagtggcagcctctacgatgacctgcaggtggtgacagctgaccacatccaactcattgtgccccttgtgctggagcagaacctgtggtcatgtattcctggtgaagacaccatcatgaatgtccctggcttcttcctggtgcgtcgtgagaatccagagtactttcctcgtgggagcagttactgggaccgctgtgtagtagggggctacctctctccaaagacagtcgcagatacatttgagaaggtagtggctggctccatcaattggccagccatagggtccctcttggactatgtgatccgcccggccccacccccagaagccctcacactggaggtgcagtatgagcgtgacaaacatctcttcattgacttcctgccatcagtgaccctcggtgacacagtcttggtggccaaaccacaccggctagcccagtatgacaacctgtggcggctgagcctgcgtcccgcggagacggcacgcctgcgggctctggaccaggctgactcgggctgccgatctctgtgcctcaagatcctcaaggccatatgcaagtccaccccggctctgggccacctcactgccagccagctaaccaatgtcatcctccacttggcccaggaggaggctgactggtctccggatatgctggccgaccgtttcctgcaggccttgaggggacttatcagctacttagaggctggagtcctgcccagtgccctaaaccccaaggtgaacttatttgcagagctcacccctgaagaaatagacgaattaggatacactctgtattgctcattgtctgagccagaggtgctgctgcagacgtagggcaggtgaaggccaaagcgggtgttggtggtcaggccctggattctccgttagatacacttggctacctagttggtgcctcacagggttcctgctgcctggtgtcttgctgatcatcaccctggtcacttcatgctgattagaatgacatctctttcgtctcctattttgttacccaactcttcctatttttgttaccaatcactgtgctctctgccgccccctggctccaggctaatttttctggaatgaattgagaaggtggcgtgctggcctgagctgatggaccacttggtgttttgcgttttggcccatgtttgctgcctctatctggtctgccttgcccgtttgcctgttcctattcagtgtcttttctattttttcctctctcgttcatgccttctgttttgctcttgtccctggagcatatctgcctaattaagatgttgccttttagttgaatgccactgaagagctgtgatagcatgtttcaaagctgaactctacagagcgagtgctgagacagtatttagggtttctgggagtgaggctggtagaagagttggcctttgaccacggttcctggagtagaagtccatcctccccccaacctcctgacccattcataaatgctgagaatgtctctcatgggaacactgttaatgacccacacaggataagctgaatgcaaagttatttgcaggttgaatttcttggtggctattagcagaagtgcagagtagggaaccagagctggttaagggcctagtgaagggtttgtgtgcccagtgtctgctcgtcatctgtggctgcaggggtcagacagacaaggatggggactgccagggcaccacttcatcatgaatgctggttttcacaccttttccttattttattgccaatcaggacaaggccttgaaggaacgcagccttagacatcaggtgaggatgatggaggtagacagtcgactgaatgtcagctggaaaatccagtcactagttggggtttggtggccatgttttctacccagacaggccctgcttttctaggatgtggccttagagcaagaacagacccaacagccagcccttcatcctccagcgtctgccataggaatgtgagaggggtgtttgctgagcgctccgggcacggccagagggcaagtgagcatgcacggacctcttccccctgtcctgtttctcacccagcacctggggagatcggtgctaccaaggaagagagcacacagataagacagaggggaggaggtgggcatttcctacattcctccttgtttgccgctgctgagattgcagtatttattgcaatgtaaatgtatcctgaaggtggggaggaatgtttaatctaccatgtccgtgtgtcatcttggtttgtgtttttccctgtttgtagcaagactctgatgataattctgtttctcatctgcccattcagtattttgttttccttccgtcaagttgtcttattttttcaatgactacctctccatcattgaggttctggtgaagctctctgcagctgtctcattccttcccaacgatagtaacaggaaatgactctttagcatcgatacctcaacatcaatttagggtagagattcctgcccctcttttgtcacagattaggaaattgagaactagggttaaccttgactatatttagaggtctttttgcctcttttccccttaacaaggatttcttatggtggtttcagtttcatttgcataaaggtattgagagggaacaaaaaacataaagctgagaatcttgagagagctcatctaccctgtctgttggtcagactcaaatgagagttaaaaaaaaaaaaaaaaatctgtatgcctgagtaccatcctggatgaatctagaaggtatggggtagagcttgacagggttcctgtgtacccactgggtatccgttagaggtaagggagaggagaggattgatagagtgttgcaaaagtatagattattcattgagataaaggatttggtttccctgccatgagtattaaaaaaatttaagttttcccaagcttgcatctctgaccaaatttcacataaaacattggaaggaggctgggtgcggtggctcatgcttgtaatcccagcactgggaagctaaggcgggtggatcacttgaggtcaggagttcgagaccagcctggccaacatggtgaaaccccgtctccacgaaaaagataaaaataagctgggcgtggtggcaggcgcctataatcccagctactcgggaggctgaggcaggagaataacttaaacccgggaggcggaggttacagtgagctgagatcgtgccactgcactccagcctgggtgacagagtgagaccctatttcaaaaaaataaaaattggaagaagagcttaaaaaagataagattttaaagagtcccaagttatttaagttgagtgtaattgtcatttaaggaaggcaaatgagtttatcatccttcttaaagagcatctcttttaactgttggacaaaaccataactttgtcattttacaaggaagaacctcttaagaagtcctcagaaccagaagcaatgtgaactctcagcgctggtcctggtgggtttgctgaccatgactgggcaagccgttctttttgctgccatcttcctcatcataaagtgtggaacataggcaattgctttgagattcttggatagaagaggacaacattctgcacctgcccccttttttaaatctttggggaaagatgagtaactttccccactactctgccttcctgttcagtaactcttacttttgcctgaagtaacagcatcttctacttctccatctagagatttttgtgtgtgtgccatcaaggttagcaaactttatacgtagcctaacacttaaaaaatgcactcattatcttaaacctaataaattccagagtttattttggttctcctctgttgcccttcctaaaaaatgagctgaagatgacagtatttttctttacatgcttggttatgacttttaaagttttatttaaataaatgttgaagctcaagtttaaagaagcgttgcagaggcccacggtctcctgggtcccggccacctgtccatattccacatttgctgactgtgctccctgcactccactcaagttgagagttcaaatagtcttgaaggggaatcagcttcaggatggaaggacccaggagaggccccgaggtgggagggttctgtaaatacagactactgcgagtgtccagagctctctgccatgatacttccttgggactgacttggctgagaacgtgttctgtcagaggatttgttagaactctgcccttttgtctgaaactcaaggccaaggagaatgataggagacttaggacagagctgacccttgcaccaggctgggaggctgcagcccttttagatgccacttactgtaagtggccagaataccagagaggtgggttccatggtcaaatgcacagtaggtgtttacctttacatttggatcaccttgtagtctttaaattcttggtccctgaggccaagtccacaacttgccttctagtcacttgcctgcccgcagtggtggtggatgtgttagctggtagatttggaatcagtcaccagtctttctgtactgtcttggttagctctatataagtaggggcagcttagccctgaggcccagagacctgctgtcctttttctccttgagggaggaaataaaactgcggaatacaatgtccttccatagcatgggaagaagaaaataaacatctcctttccaaca

SEQ ID NO: 154263 - DNA, 2269 bp, Homo sapiens
  Payload ID: 10317
  Gene Symbol: MIEF1
  Gene Name: mitochondrial elongation factor 1
  ENST ID: ENST00000402881
  CDS Start-End: 498-1934
ctccatctcaaaacaaacaaacaaacaaacaaacaaacaccctgcaatatcaatccaagagatcctggaatgcctcttgccctgtgaaacctggcagagccctgaggtttgggtcagtgccccctgccgtgggtctctggcctacaaaggcaccatggtgtgacacccagcccctgccagtcccccatggccccgtggagccgagaggcggtgctgagtctctatcgggctctgttgcgccagggccgacagcttcgctacactgatcgagacttctactttgcctccatccgccgtgaattccgaaaaaatcagaagctagaggacgctgaggcccgggagaggcagctggagaagggcctggtctttctcaacggcaaattggggaggatcatttaggatcctccaagggaaagaggacaaaggtgccttctgtagacactcctgctctcttccatccccatcttacagatgtattaagaagcctcagatgagcaatggcaggcgctggtgagcgcaaaggcaagaaggatgacaatggcattggcacggccattgactttgtgctctccaatgcccggctggtgctgggggtgggtggagcggccatgctgggcatcgccacgctggcagttaagcggatgtacgatcgggcgatcagtgcccctaccagccccacccgcctgagccattcggggaaaaggagctgggaagaacccaactggatgggctccccacgactgctgaacagggacatgaagacgggcctgagccggtccttgcagacccttcccacagactcctccaccttcgacacagatacattctgcccgccccggcccaagccagtggccaggaagggccaggtagacttgaagaagtcacgactccgcatgtccctgcaggagaaacttcttacttactaccggaaccgggcagccatccctgctggagagcaggctcgggccaagcaagctgctgtggacatatgtgccgagctccggagcttcctgcgggccaagttgcctgacatgccgcttcgggacatgtacttgagtggcagcctctacgatgacctgcaggtggtgacagctgaccacatccaactcattgtgccccttgtgctggagcagaacctgtggtcatgtattcctggtgaagacaccatcatgaatgtccctggcttcttcctggtgcgtcgtgagaatccagagtactttcctcgtgggagcagttactgggaccgctgtgtagtagggggctacctctctccaaagacagtcgcagatacatttgagaaggtagtggctggctccatcaattggccagccatagggtccctcttggactatgtgatccgcccggccccacccccagaagccctcacactggaggtgcagtatgagcgtgacaaacatctcttcattgacttcctgccatcagtgaccctcggtgacacagtcttggtggccaaaccacaccggctagcccagtatgacaacctgtggcggctgagcctgcgtcccgcggagacggcacgcctgcgggctctggaccaggctgactcgggctgccgatctctgtgcctcaagatcctcaaggccatatgcaagtccaccccggctctgggccacctcactgccagccagctaaccaatgtcatcctccacttggcccaggaggaggctgactggtctccggatatgctggccgaccgtttcctgcaggccttgaggggacttatcagctacttagaggctggagtcctgcccagtgccctaaaccccaaggacaaggccttgaaggaacgcagccttagacatcaggtgaggatgatggaggtagacagtcgactgaatgtcagctggaaaatccagtcactagttggggtttggtggccatgttttctacccagacaggccctgcttttctaggatgtggccttagagcaagaacagacccaacagccagcccttcatcctccagcgtctgccataggaatgtgagaggggtgtttgctgagcgctccgggcacggccagagggcaagtgagcatgcacggacctcttccccctgtcctgtttctcacccagcacctggggagatcggtgctaccaaggaagagagcacacagataagacagaggggaggaggtgggcatttcctacattcctccttgtttgccgctgctgagattgcagtatttattgcaatgtaaatgtatcctgaaggtggggaggaatgtttaatctaccatgtccgtgtgtca

SEQ ID NO: 154264 - DNA, 3797 bp, Homo sapiens
  Payload ID: 10317
  Gene Symbol: MIEF1
  Gene Name: mitochondrial elongation factor 1
  Uniprot ID: Q9NQG6
  ENST ID: ENST00000404569
  CDS Start-End: 551-1942
ccggggagaggtacccggccagaggcgagtcctgcggagtggtagcgcgcacggcctgcggtgtgacacccagcccctgccagtcccccatggccccgtggagccgagaggcggtgctgagtctctatcgggctctgttgcgccagggccgacagcttcgctacactgatcgagacttctactttgcctccatccgccgtgaattccgaaaaaatcagaagctagaggacgctgaggcccgggagaggcagctggagaagggcctggtctttctcaacggcaaattggggaggatcatttaggatcctccaagggaaagaggacaaaggtgccttctgtagacactcctgctctcttccatccccatcttacagatgtattaagaagcctcaggcccagggttctaactccacaggaatgggcttatctggggactgctgctgctgcagtcaggaagactccactgtagtcgggagcagcactggcctgagcactgcactggaggccagcctcttcgctgtggtgcccaagtacttctttcagatgagcaatggcaggcgctggtgagcgcaaaggcaagaaggatgacaatggcattggcacggccattgactttgtgctctccaatgcccggctggtgctgggggtgggtggagcggccatgctgggcatcgccacgctggcagttaagcggatgtacgatcgggcgatcagtgcccctaccagccccacccgcctgagccattcggggaaaaggagctgggaagaacccaactggatgggctccccacgactgctgaacagggacatgaagacgggcctgagccggtccttgcagacccttcccacagactcctccaccttcgacacagatacattctgcccgccccggcccaagccagtggccaggaagggccaggtagacttgaagaagtcacgactccgcatgtccctgcaggagaaacttcttacttactaccggaaccgggcagccatccctgctggagagcaggctcgggccaagcaagctgctgtggacatatgtgccgagctccggagcttcctgcgggccaagttgcctgacatgccgcttcgggacatgtacttgagtggcagcctctacgatgacctgcaggtggtgacagctgaccacatccaactcattgtgccccttgtgctggagcagaacctgtggtcatgtattcctggtgaagacaccatcatgaatgtccctggcttcttcctggtgcgtcgtgagaatccagagtactttcctcgtgggagcagttactgggaccgctgtgtagtagggggctacctctctccaaagacagtcgcagatacatttgagaaggtagtggctggctccatcaattggccagccatagggtccctcttggactatgtgatccgcccggccccacccccagaagccctcacactggaggtgcagtatgagcgtgacaaacatctcttcattgacttcctgccatcagtgaccctcggtgacacagtcttggtggccaaaccacaccggctagcccagtatgacaacctgtggcggctgagcctgcgtcccgcggagacggcacgcctgcgggctctggaccaggctgactcgggctgccgatctctgtgcctcaagatcctcaaggccatatgcaagtccaccccggctctgggccacctcactgccagccagctaaccaatgtcatcctccacttggcccaggaggaggctgactggtctccggatatgctggccgaccgtttcctgcaggccttgaggggacttatcagctacttagaggctggagtcctgcccagtgccctaaaccccaaggtgaacttatttgcagagctcacccctgaagaaatagacgaattaggatacactctgtattgctcattgtctgagccagaggtgctgctgcagacgtagggcaggtgaaggccaaagcgggtgttggtggtcaggccctggattctccgttagatacacttggctacctagttggtgcctcacagggttcctgctgcctggtgtcttgctgatcatcaccctggtcacttcatgctgattagaatgacatctctttcgtctcctattttgttacccaactcttcctatttttgttaccaatcactgtgctctctgccgccccctggctccaggctaatttttctggaatgaattgagaaggtggcgtgctggcctgagctgatggaccacttggtgttttgcgttttggcccatgtttgctgcctctatctggtctgccttgcccgtttgcctgttcctattcagtgtcttttctattttttcctctctcgttcatgccttctgttttgctcttgtccctggagcatatctgcctaattaagatgttgccttttagttgaatgccactgaagagctgtgatagcatgtttcaaagctgaactctacagagcgagtgctgagacagtatttagggtttctgggagtgaggctggtagaagagttggcctttgaccacggttcctggagtagaagtccatcctccccccaacctcctgacccattcataaatgctgagaatgtctctcatgggaacactgttaatgacccacacaggataagctgaatgcaaagttatttgcaggttgaatttcttggtggctattagcagaagtgcagagtagggaaccagagctggttaagggcctagtgaagggtttgtgtgcccagtgtctgctcgtcatctgtggctgcaggggtcagacagacaaggatggggactgccagggcaccacttcatcatgaatgctggttttcacaccttttccttattttattgccaatcaggacaaggccttgaaggaacgcagccttagacatcaggtgaggatgatggaggtagacagtcgactgaatgtcagctggaaaatccagtcactagttggggtttggtggccatgttttctacccagacaggccctgcttttctaggatgtggccttagagcaagaacagacccaacagccagcccttcatcctccagcgtctgccataggaatgtgagaggggtgtttgctgagcgctccgggcacggccagagggcaagtgagcatgcacggacctcttccccctgtcctgtttctcacccagcacctggggagatcggtgctaccaaggaagagagcacacagataagacagaggggaggaggtgggcatttcctacattcctccttgtttgccgctgctgagattgcagtatttattgcaatgtaaatgtatcctgaaggtggggaggaatgtttaatctaccatgtccgtgtgtcatcttggtttgtgtttttccctgtttgtagcaagactctgatgataattctgtttctcatctgcccattcagtattttgttttccttccgtcaagttgtcttattttttcaatgactacctctccatcattgaggttctggtgaagctctctgcagctgtctcattccttcccaacgatagtaacaggaaatgactctttagcatcgatacctcaacatcaatttagggtagagattcctgcccctcttttgtcacagattaggaaattgagaactagggttaaccttgactatatttagaggtctttttgcctcttttccccttaacaaggatttcttatggtggtttcagtttcatttgcataaaggtattgagagggaacaaaaaacataaagctgagaatcttgagagagctcatctaccctgtctgttggtcagactcaaatgagagttaaaaaaaaaaaaaaaaa

SEQ ID NO: 154265 - DNA, 744 bp, Homo sapiens
  Payload ID: 10317
  Gene Symbol: MIEF1
  Gene Name: mitochondrial elongation factor 1
  ENST ID: ENST00000434364
  CDS Start-End: 617-744
ccagaggcgagtcctgcggagtggtagcgcgcacggcctgcggtgtgacacccagcccctgccagtcccccatggccccgtggagccgagaggcggtgctgagtctctatcgggctctgttgcgccagggccgacagcttcgctacactgatcgagacttctactttgcctccatccgccgtgaattccgaaaaaatcagaagctagaggacgctgaggcccgggagaggcagctggagaagggcctggtctttctcaacggcaaattggggaggatcatttaggatcctccaagggaaagaggacaaaggtgccttctgtagacactcctgctctcttccatccccatcttacagatgtattaagaagcctcaggacacgggatattatagaggagagtggcagcatgctgagtggtattccgatctgaatcacactgtcatcctttatccggctcaggcccagggttctaactccacaggaatgggcttatctggggactgctgctgctgcagtcaggaagactccactgtagtcgggagcagcactggcctgagcactgcactggaggccagcctcttcgctgtggtgcccaagtacttctttcagatgagcaatggcaggcgctggtgagcgcaaaggcaagaaggatgacaatggcattggcacggccattgactttgtgctctccaatgcccggctggtgctgggggtgggtggagcggccatgctgggcatcgccac

SEQ ID NO: 154266 - DNA, 3838 bp, Homo sapiens
  Payload ID: 10317
  Gene Symbol: MIEF1
  Gene Name: mitochondrial elongation factor 1
  Uniprot ID: Q9NQG6
  ENST ID: ENST00000433117
  CDS Start-End: 476-922
gctcccttcagccccttcgcagctccgtgcgcaaggtcgtgtcccggaagtgaaggggccatgttgatgggtgacccggggagaggtacccggccagaggcgagtcctgcggagtggtagcgcgcacggcctgcggtgtgacacccagcccctgccagtcccccatggccccgtggagccgagaggcggtgctgagtctctatcgggctctgttgcgccagggccgacagcttcgctacactgatcgagacttctactttgcctccatccgccgtgaattccgaaaaaatcagaagctagaggacgctgaggcccgggagaggcagctggagaagggcctggtctttctcaacggcaaattggggaggatcatttaggatcctccaagggaaagaggacaaaggtgccttctgtagacactcctgctctcttccatccccatcttacagatgtattaagaagcctcagatgagcaatggcaggcgctggtgagcgcaaaggcaagaaggatgacaatggcattggcacggccattgactttgtgctctccaatgcccggctggtgctgggggtgggtggagcggccatgctgggcatcgccacgctggcagttaagcggatgtacgatcgggcgatcagtgcccctaccagccccacccgcctgagccattcggggaaaaggagctgggaagaacccaactggatgggctccccacgactgctgaacagggacatgaagacgggcctgagccggtccttgcagacccttcccacagactcctccaccttcgacacaggagaaacttcttacttactaccggaaccgggcagccatccctgctggagagcaggctcgggccaagcaagctgctgtggacatatgtgccgagctccggagcttcctgcgggccaagttgcctgacatgccgcttcgggacatgtacttgagtggcagcctctacgatgacctgcaggtggtgacagctgaccacatccaactcattgtgccccttgtgctggagcagaacctgtggtcatgtattcctggtgaagacaccatcatgaatgtccctggcttcttcctggtgcgtcgtgagaatccagagtactttcctcgtgggagcagttactgggaccgctgtgtagtagggggctacctctctccaaagacagtcgcagatacatttgagaaggtagtggctggctccatcaattggccagccatagggtccctcttggactatgtgatccgcccggccccacccccagaagccctcacactggaggtgcagtatgagcgtgacaaacatctcttcattgacttcctgccatcagtgaccctcggtgacacagtcttggtggccaaaccacaccggctagcccagtatgacaacctgtggcggctgagcctgcgtcccgcggagacggcacgcctgcgggctctggaccaggctgactcgggctgccgatctctgtgcctcaagatcctcaaggccatatgcaagtccaccccggctctgggccacctcactgccagccagctaaccaatgtcatcctccacttggcccaggaggaggctgactggtctccggatatgctggccgaccgtttcctgcaggccttgaggggacttatcagctacttagaggctggagtcctgcccagtgccctaaaccccaaggtgaacttatttgcagagctcacccctgaagaaatagacgaattaggatacactctgtattgctcattgtctgagccagaggtgctgctgcagacgtagggcaggtgaaggccaaagcgggtgttggtggtcaggccctggattctccgttagatacacttggctacctagttggtgcctcacagggttcctgctgcctggtgtcttgctgatcatcaccctggtcacttcatgctgattagaatgacatctctttcgtctcctattttgttacccaactcttcctatttttgttaccaatcactgtgctctctgccgccccctggctccaggctaatttttctggaatgaattgagaaggtggcgtgctggcctgagctgatggaccacttggtgttttgcgttttggcccatgtttgctgcctctatctggtctgccttgcccgtttgcctgttcctattcagtgtcttttctattttttcctctctcgttcatgccttctgttttgctcttgtccctggagcatatctgcctaattaagatgttgccttttagttgaatgccactgaagagctgtgatagcatgtttcaaagctgaactctacagagcgagtgctgagacagtatttagggtttctgggagtgaggctggtagaagagttggcctttgaccacggttcctggagtagaagtccatcctccccccaacctcctgacccattcataaatgctgagaatgtctctcatgggaacactgttaatgacccacacaggataagctgaatgcaaagttatttgcaggttgaatttcttggtggctattagcagaagtgcagagtagggaaccagagctggttaagggcctagtgaagggtttgtgtgcccagtgtctgctcgtcatctgtggctgcaggggtcagacagacaaggatggggactgccagggcaccacttcatcatgaatgctggttttcacaccttttccttattttattgccaatcaggacaaggccttgaaggaacgcagccttagacatcaggtgaggatgatggaggtagacagtcgactgaatgtcagctggaaaatccagtcactagttggggtttggtggccatgttttctacccagacaggccctgcttttctaggatgtggccttagagcaagaacagacccaacagccagcccttcatcctccagcgtctgccataggaatgtgagaggggtgtttgctgagcgctccgggcacggccagagggcaagtgagcatgcacggacctcttccccctgtcctgtttctcacccagcacctggggagatcggtgctaccaaggaagagagcacacagataagacagaggggaggaggtgggcatttcctacattcctccttgtttgccgctgctgagattgcagtatttattgcaatgtaaatgtatcctgaaggtggggaggaatgtttaatctaccatgtccgtgtgtcatcttggtttgtgtttttccctgtttgtagcaagactctgatgataattctgtttctcatctgcccattcagtattttgttttccttccgtcaagttgtcttattttttcaatgactacctctccatcattgaggttctggtgaagctctctgcagctgtctcattccttcccaacgatagtaacaggaaatgactctttagcatcgatacctcaacatcaatttagggtagagattcctgcccctcttttgtcacagattaggaaattgagaactagggttaaccttgactatatttagaggtctttttgcctcttttccccttaacaaggatttcttatggtggtttcagtttcatttgcataaaggtattgagagggaacaaaaaacataaagctgagaatcttgagagagctcatctaccctgtctgttggtcagactcaaatgagagttaaaaaaaaaaaaaaaaatctgtatgcctgagtaccatcctggatgaatctagaaggtatggggtagagcttgacagggttcctgtgtacccactgggtatccgttagaggtaagggagaggagaggattgatagagtgttgcaaaagtatagattattcattgagataaaggatttggtttccctgccatgagtattaaaaaaatttaagttttcccaa

SEQ ID NO: 154267 - DNA, 1379 bp, Homo sapiens
  Payload ID: 10317
  Gene Symbol: MIEF1
  Gene Name: mitochondrial elongation factor 1
  Uniprot ID: Q9NQG6
  ENST ID: ENST00000428069
  CDS Start-End: 531-977
agaggcgagtcctgcggagtggtagcgcgcacggcctgcggtgtgacacccagcccctgccagtcccccatggccccgtggagccgagaggcggtgctgagtctctatcgggctctgttgcgccagggccgacagcttcgctacactgatcgagacttctactttgcctccatccgccgtgaattccgaaaaaatcagaagctagaggacgctgaggcccgggagaggcagctggagaagggcctggtctttctcaacggcaaattggggaggatcatttaggatcctccaagggaaagaggacaaaggtgccttctgtagacactcctgctctcttccatccccatcttacagatgtattaagaagcctcaggcccagggttctaactccacaggaatgggcttatctggggactgctgctgctgcagtcaggaagactccactgtagtcgggagcagcactggcctgagcactgcactggaggccagcctcttcgctgtggtgcccaagtacttctttcagatgagcaatggcaggcgctggtgagcgcaaaggcaagaaggatgacaatggcattggcacggccattgactttgtgctctccaatgcccggctggtgctgggggtgggtggagcggccatgctgggcatcgccacgctggcagttaagcggatgtacgatcgggcgatcagtgcccctaccagccccacccgcctgagccattcggggaaaaggagctgggaagaacccaactggatgggctccccacgactgctgaacagggacatgaagacgggcctgagccggtccttgcagacccttcccacagactcctccaccttcgacacaggagaaacttcttacttactaccggaaccgggcagccatccctgctggagagcaggctcgggccaagcaagctgctgtggacatatgtgccgagctccggagcttcctgcgggccaagttgcctgacatgccgcttcgggacatgtacttgagtggcagcctctacgatgacctgcaggtggtgacagctgaccacatccaactcattgtgccccttgtgctggagcagaacctgtggtcatgtattcctggtgaagacaccatcatgaatgtccctggcttcttcctggtgcgtcgtgagaatccagagtactttcctcgtgggagcagttactgggaccgctgtgtagtagggggctacctctctccaaagacagtcgcagatacatttgagaaggtagtggctggctccatcaattggccagccatagggtccctcttggactatgtgatccgcccggccccacccccagaagccctcacactggaggtgcagtatgagcgtgacaaacatctcttcattgactt

SEQ ID NO: 154268 - DNA, 3364 bp, Homo sapiens
  Payload ID: 10318
  Gene Symbol: MIEF2
  Gene Name: mitochondrial elongation factor 2
  Uniprot ID: Q96C03
  ENST ID: ENST00000323019
  CDS Start-End: 212-1576
gtattttggcacctgtgcgctggactcgagcgctccgattggagttagggcctgcttgtctgcgtgctgcgaagtccgcggctgcccccggggccctagtcgttgggttccagggtccttcacgttccattcccaggctggtctgagctccggggccgtggtcccgctgcctcctccggtcgtcgtgcggaagctgcgacgcaggcagaccatggcagagttctcccagaaacgggggaagcggcgtagcgacgaagggctgggcagcatggtggacttcctcctggccaatgcccgcctggtgctgggcgtgggcggggctgctgtgctgggcattgccaccctggccgtgaagcggttcattgacagggccactagcccgcgggatgaggatgacaccaaggcagacagctggaaggaactgagcctgctcaaggccacaccacacctgcagccccggcctccacctgctgcccttagccagccagtgttgcccttggccccctcgtcgtctgccccagaagggcctgcagaaactgatcctgaggtgacaccacagctcagctccccagcaccgctgtgtctgacactgcaggagaggctgctggccttcgagcgggaccgtgtgaccatcccagcagcccaggtggctttggccaaacagctggctggcgacatcgccctggagctgcaggcctactttcggagcaagttcccggaactgccctttggggcattcgtgcctggggggccgctctacgacgggctgcaggcgggggctgcggaccatgtgcgtctcctggtgccactggtgctggagccgggcctgtggagcctggtgccgggcgtggacactgtggcgagggaccctcgctgctgggccgtgcgcaggacgcagcttgagttctgcccccgtgggagcagcccctgggaccgcttcctggtcgggggctacctctcctcccgcgtcctgctggagctactccgcaaggcgctggctgcttctgtcaactggccggccattggcagccttctcgggtgcctgatccggcccagcatggcctcggaggagctgctgctcgaggtgcagcacgaacgcctggagctcactgtggctgtgcttgtggcagtccctggggtcgatgctgacgaccgcctcctcttggcctggcccctggaggggctggcggggaacctctggctgcaggacctgtatccagtggaggctgctaggctgcgagccctggacgaccatgacgctgggactcgccggcggctgctgctgctgctgtgtgctgtctgccgtggttgctcggctctggggcagctaggccggggtcacctgacccaggtggtcctgcgtctgggggaggacaacgtggattggacggaggaggccttgggtgagcgcttcctgcaagccctggagctgctcatcggcagcctggagcaggccagcctgccctgccacttcaaccccagcgtgaacctcttcagcagcttgcgtgaggaggagattgacgacattggctatgcgctatacagtggcctacaggagcccgaggggctgctctaggtgggtggaaacgggtggttgccatgttttctaatgctggggagctgcacccacctcccttccagggatttgaatagtggtttttctctagctttttgccagaacaaaggagggtacattacttaaacccagggcatcaggatgtgcttgggctatggtggccataaaccctgagcccagagagcttgggtcactgtcacctgagtgcagctgggctgcctcaggcagcttggagtgccagccattcctgcaagcaccgtttcagctcttggggccaaccccaggacctttggctctgtccatcaccagcaaccaatccaccaacagaatgtggtttctgccatcctgggcagaagctgaaggccagcttcacatttctgctgagagaaggtgacttaacgccttttccggccctagctccaggcgttttgaggcgtctggtgcctgatggtaggtatggtgtgtttgttctgtcccccaggggctggagtcacctggtgcccctgaaggacagatttttggctgttaaaggatggcattttcctgctgtcttctgtgcgtttagttttcttgctgagcgggagctcagtatgacttgccacccacctgatacctcagggcaaggccctttttccctccagccaggtgagtgttttcttcaggcagctgagggtcctgggggagctgaggctctgtgctgcacccccagcccacagctggggcatctcactggagctgttccaggccccactggagagcagaggacctgatcccccactagagaggtccggtgtgcacagccggcctcccagtgtgccaaaatgaactgctctcagctgatggctgtattctgactttgaagcctgttaagaggtagcaagggggctagaggagggagattccacctcccctcccaagtgaccctcctcctgcctctggtatccttccttttgaaacgaagctcagcttcgaagatgtgaacaagaataaaaggaaaaaattctaatgtatatataactcaggctggataagggagtcttggtgctttcatacgcagctgttgagggttttctgtaagtcctgtggcttgtcctggcactttggcaagagtgcttgaggtcaattggaggtggtagagtttactttaaaaagtagcatcttggccgggtgtggtggctcgcatctgtaatcccagcacatcgggaggccgaggcgggcggatcacgaggtcaagagatcgagaccatcctgaccaacatgatgaaaccccaactctactaaaaagacaaaaattagctgggcgtggtggcacgcacctatagtcccagctactcgggaggccgaggcaggagaattgcttgaacccgggaggtagaggttgcaatgagctgaaattgcaccactgcactccagactggcgacagagcaagactctgtctcaaaaaaataaataaataagcatcttggccccgcgctgtggctcacgcctataatcccagcactttgggaagccgaggccggtagatcacctgaggttgggaattcaagaccaggctgaccaacgtggagaaactccatctctggtaaaaattcaaaaaaattagctgggcatggtggcacatgcctgtaatcccagctacttgggaggctgaggcaggagaattgcttgaacccgggaggcggaggttgtggtgagctgagatcgtgccagtgcactccagcctaggcaacaagagtgaaactctgtctcaaaataaaataaaataaaataataatagtaataataaa

SEQ ID NO: 154269 - DNA, 718 bp, Homo sapiens
  Payload ID: 10318
  Gene Symbol: MIEF2
  Gene Name: mitochondrial elongation factor 2
  ENST ID: ENST00000395703
  CDS Start-End: 142-633
gaagtccgcggctgcccccggggccctagtcgttgggttccagggtccttcacgttccattcccaggctggtctgagctccggggccgtggtcccgctgcctcctccggtcgtcgtgcggaagctgcgacgcaggcagaccatggcagagttctcccagaaacgggggaagcggcgtagcgacgaagggctgggcagcatggtggacttcctcctggccaatgcccgcctggtgctgggcgtgggcggggctgctgtgctgggcattgccaccctggccgtgaagcggttcattgacagggccactagcccgcgggatgaggatgacaccaaggcagacagctggaaggaactgagcctgctcaaggccacaccacacctgcagccccggcctccacctgctgcccttagccagccagtgttgcccttggccccctcgtcgtctgccccaggtgagtggcactccttcccctcttttggtgtcacattcaagagacgcagcccaggctttgccctgactgactgtgtgaccctgcgcgagtccctgcttctctctcggttgtgggctcctcagatatttaatgggggtggtgtttctttgccctgttcctggagcaaggtggtagcgttgtgatggtggggagctttagatggggaaactgaggtccagaggggcgtgacatacctacctactctgcatgaagctgttgtcgccaggg

SEQ ID NO: 154270 - DNA, 2879 bp, Homo sapiens
  Payload ID: 10318
  Gene Symbol: MIEF2
  Gene Name: mitochondrial elongation factor 2
  Uniprot ID: Q96C03
  ENST ID: ENST00000395704
  CDS Start-End: 149-766
gtgctgcgaagtccgcggctgcccccggggccctagtcgttgggttccagggtccttcacgttccattcccaggctggtctgagctccggggccgtggtcccgctgcctcctccggtcgtcgtgcggaagctgcgacgcaggcagaccatggcagagttctcccagaaacgggggaagcggcgtagcgacgaagggctgggcagcatggtggacttcctcctggccaatgcccgcctggtgctgggcgtgggcggggctgctgtgctgggcattgccaccctggccgtgaagcggttcattgacagggccactagcccgcgggatgaggatgacaccaaggcagacagctggaaggaactgagcctgctcaaggccacaccacacctgcagccccggcctccacctgctgcccttagccagccagtgttgcccttggccccctcgtcgtctgccccaggagaggctgctggccttcgagcgggaccgtgtgaccatcccagcagcccaggtggctttggccaaacagctggctggcgacatcgccctggagctgcaggcctactttcggagcaagttcccggaactgccctttggggcattcgtgcctggggggccgctctacgacgggctgcaggcgggggctgcggaccatgtgcgtctcctggtgccactggtgctggagccgggcctgtggagcctggtgccgggcgtggacactgtggcgagggaccctcgctgctgggccgtgcgcaggacgcagcttgagttctgcccccgtgggagcagcccctgggaccgcttcctggtcgggggctacctctcctcccgcgtcctgctggagctactccgcaaggcgctggctgcttctgtcaactggccggccattggcagccttctcgggtgcctgatccggcccagcatggcctcggaggagctgctgctcgaggtgcagcacgaacgcctggagctcactgtggctgtgcttgtggcagtccctggggtcgatgctgacgaccgcctcctcttggcctggcccctggaggggctggcggggaacctctggctgcaggacctgtatccagtggaggctgctaggctgcgagccctggacgaccatgacgctgggactcgccggcggctgctgctgctgctgtgtgctgtctgccgtggttgctcggctctggggcagctaggccggggtcacctgacccaggtggtcctgcgtctgggggaggacaacgtggattggacggaggaggccttgggtgagcgcttcctgcaagccctggagctgctcatcggcagcctggagcaggccagcctgccctgccacttcaaccccagcgtgaacctcttcagcagcttgcgtgaggaggagattgacgacattggctatgcgctatacagtggcctacaggagcccgaggggctgctctaggtgggtggaaacgggtggttgccatgttttctaatgctggggagctgcacccacctcccttccagggatttgaatagtggtttttctctagctttttgccagaacaaaggagggtacattacttaaacccagggcatcaggatgtgcttgggctatggtggccataaaccctgagcccagagagcttgggtcactgtcacctgagtgcagctgggctgcctcaggcagcttggagtgccagccattcctgcaagcaccgtttcagctcttggggccaaccccaggacctttggctctgtccatcaccagcaaccaatccaccaacagaatgtggtttctgccatcctgggcagaagctgaaggccagcttcacatttctgctgagagaaggtgacttaacgccttttccggccctagctccaggcgttttgaggcgtctggtgcctgatggtaggtatggtgtgtttgttctgtcccccaggggctggagtcacctggtgcccctgaaggacagatttttggctgttaaaggatggcattttcctgctgtcttctgtgcgtttagttttcttgctgagcgggagctcagtatgacttgccacccacctgatacctcagggcaaggccctttttccctccagccaggtgagtgttttcttcaggcagctgagggtcctgggggagctgaggctctgtgctgcacccccagcccacagctggggcatctcactggagctgttccaggccccactggagagcagaggacctgatcccccactagagaggtccggtgtgcacagccggcctcccagtgtgccaaaatgaactgctctcagctgatggctgtattctgactttgaagcctgttaagaggtagcaagggggctagaggagggagattccacctcccctcccaagtgaccctcctcctgcctctggtatccttccttttgaaacgaagctcagcttcgaagatgtgaacaagaataaaaggaaaaaattctaatgtatatataactcaggctggataagggagtcttggtgctttcatacgcagctgttgagggttttctgtaagtcctgtggcttgtcctggcactttggcaagagtgcttgaggtcaattggaggtggtagagtttactttaaaaagtagcatcttggccgggtgtggtggctcgcatctgtaatcccagcacatcgggaggccgaggcgggcggatcacgaggtcaagagatcgagaccatcctgaccaacatgatgaaaccccaactctactaaaaagacaaaaattagctgggcgtggtggcacgcacctatagtcccagctactcgggaggccgaggcaggagaattgcttgaacccgggaggtagaggttgcaatgagctgaaattgcaccactgcactccagactggcgacagagcaagactctgtctc

SEQ ID NO: 154271 - DNA, 2441 bp, Homo sapiens
  Payload ID: 10318
  Gene Symbol: MIEF2
  Gene Name: mitochondrial elongation factor 2
  Uniprot ID: Q96C03
  ENST ID: ENST00000395706
  CDS Start-End: 27-1424
ctgaggcctgcgcgaccccgccagagatggggctgagtcccaatttagacaggcagaccatggcagagttctcccagaaacgggggaagcggcgtagcgacgaagggctgggcagcatggtggacttcctcctggccaatgcccgcctggtgctgggcgtgggcggggctgctgtgctgggcattgccaccctggccgtgaagcggttcattgacagggccactagcccgcgggatgaggatgacaccaaggcagacagctggaaggaactgagcctgctcaaggccacaccacacctgcagccccggcctccacctgctgcccttagccagccagtgttgcccttggccccctcgtcgtctgccccagaagggcctgcagaaactgatcctgaggtgacaccacagctcagctccccagcaccgctgtgtctgacactgcaggagaggctgctggccttcgagcgggaccgtgtgaccatcccagcagcccaggtggctttggccaaacagctggctggcgacatcgccctggagctgcaggcctactttcggagcaagttcccggaactgccctttggggcattcgtgcctggggggccgctctacgacgggctgcaggcgggggctgcggaccatgtgcgtctcctggtgccactggtgctggagccgggcctgtggagcctggtgccgggcgtggacactgtggcgagggaccctcgctgctgggccgtgcgcaggacgcagcttgagttctgcccccgtgggagcagcccctgggaccgcttcctggtcgggggctacctctcctcccgcgtcctgctggagctactccgcaaggcgctggctgcttctgtcaactggccggccattggcagccttctcgggtgcctgatccggcccagcatggcctcggaggagctgctgctcgaggtgcagcacgaacgcctggagctcactgtggctgtgcttgtggcagtccctggggtcgatgctgacgaccgcctcctcttggcctggcccctggaggggctggcggggaacctctggctgcaggacctgtatccagtggaggctgctaggctgcgagccctggacgaccatgacgctgggactcgccggcggctgctgctgctgctgtgtgctgtctgccgtggttgctcggctctggggcagctaggccggggtcacctgacccaggtggtcctgcgtctgggggaggacaacgtggattggacggaggaggccttgggtgagcgcttcctgcaagccctggagctgctcatcggcagcctggagcaggccagcctgccctgccacttcaaccccagcgtgaacctcttcagcagcttgcgtgaggaggagattgacgacattggctatgcgctatacagtggcctacaggagcccgaggggctgctctaggtgggtggaaacgggtggttgccatgttttctaatgctggggagctgcacccacctcccttccagggatttgaatagtggtttttctctagctttttgccagaacaaaggagggtacattacttaaacccagggcatcaggatgtgcttgggctatggtggccataaaccctgagcccagagagcttgggtcactgtcacctgagtgcagctgggctgcctcaggcagcttggagtgccagccattcctgcaagcaccgtttcagctcttggggccaaccccaggacctttggctctgtccatcaccagcaaccaatccaccaacagaatgtggtttctgccatcctgggcagaagctgaaggccagcttcacatttctgctgagagaaggtgacttaacgccttttccggccctagctccaggcgttttgaggcgtctggtgcctgatggtaggtatggtgtgtttgttctgtcccccaggggctggagtcacctggtgcccctgaaggacagatttttggctgttaaaggatggcattttcctgctgtcttctgtgcgtttagttttcttgctgagcgggagctcagtatgacttgccacccacctgatacctcagggcaaggccctttttccctccagccaggtgagtgttttcttcaggcagctgagggtcctgggggagctgaggctctgtgctgcacccccagcccacagctggggcatctcactggagctgttccaggccccactggagagcagaggacctgatcccccactagagaggtccggtgtgcacagccggcctcccagtgtgccaaaatgaactgctctcagctgatggctgtattctgactttgaagcctgttaagaggtagcaagggggctagaggagggagattccacctcccctcccaagtgaccctcctcctgcctctggtatccttccttttgaaacgaagctcagcttcgaagatgtgaacaagaataaaaggaaaaaattctaatgtatatataa

SEQ ID NO: 154272 - DNA, 589 bp, Homo sapiens
  Payload ID: 10318
  Gene Symbol: MIEF2
  Gene Name: mitochondrial elongation factor 2
  ENST ID: ENST00000578174
  CDS Start-End: 149-502
gtgctgcgaagtccgcggctgcccccggggccctagtcgttgggttccagggtccttcacgttccattcccaggctggtctgagctccggggccgtggtcccgctgcctcctccggtcgtcgtgcggaagctgcgacgcaggcagaccatggcagagttctcccagaaacgggggaagcggcgtagcgacgaagggctgggcagcatggtggacttcctcctggccaatgcccgcctggtgctgggcgtgggcggggctgctgtgctgggcattgccaccctggccgtgaagcggttcattgacagggccactagcccgcgggatgaggatgacaccaaggcagacagctggaaggaactgagcctgctcaaggccacaccacacctgcagccccggcctccacctgctgcccttagccagccagtgttgcccttggccccctcgtcgtctgccccaggtggtagcgttgtgatggtggggagctttagatggggaaactgaggtccagaggggcgtgacatacctacctactctgcatgaagctgttgtcgccagggtgttggactctggggcaatgagaactcgtca

SEQ ID NO: 154273 - DNA, 540 bp, Homo sapiens
  Payload ID: 10318
  Gene Symbol: MIEF2
  Gene Name: mitochondrial elongation factor 2
  ENST ID: ENST00000578621
  CDS Start-End: 101-466
agggtccttcacgttccattcccaggctggtctgagctccggggccgtggtcccgctgcctcctccggtcgtcgtgcggaagctgcgacgcaggcagaccatggcagagttctcccagaaacgggggaagcggcgtagcgacgaagggctgggcagcatggtggacttcctcctggccaatgcccgcctggtgctgggcgtgggcggggctgctgtgctgggcattgccaccctggccgtgaagcggttcattgacagggccactagcccgcgggatgaggatgacaccaaggcagacagctggaaggaactgagcctgctcaaggccacaccacacctgcagccccggcctccacctgctgcccttagccagccagtgttgcccttggccccctcgtcgtctgccccaggctgttccgacatgttccccgccccttcactctgcagaagggcctgcagaaactgatcctgaggtgacaccacagctcagctccccagcaccgctgtgtctgacactgcaggagaggctgctggccttcg

SEQ ID NO: 154274 - DNA, 563 bp, Homo sapiens
  Payload ID: 10318
  Gene Symbol: MIEF2
  Gene Name: mitochondrial elongation factor 2
  ENST ID: ENST00000579341
  CDS Start-End: 85-563
cattcccaggctggtctgagctccggggccgtggtcccgctgcctcctccggtcgtcgtgcggaagctgcgacgcaggcagaccatggcagagttctcccagaaacgggggaagcggcgtagcgacgaagggctgggcagcatggtggacttcctcctggccaatgcccgcctggtgctgggcgtgggcggggctgctgtgctgggcattgccaccctggccgtgaagcggttcattgacagggccactagcccgcgggatgaggatgacaccaaggcagacagctggaaggaactgagcctgctcaaggccacaccacacctgcagccccggcctccacctgctgcccttagccagccagtgttgcccttggccccctcgtcgtctgccccagggcctgcagaaactgatcctgaggtgacaccacagctcagctccccagcaccgctgtgtctgacactgcaggagaggctgctggccttcgagcgggaccgtgtgaccatcccagcagcccaggtggctttggccaaacagctggctggcgacatcgccctggagctgca

SEQ ID NO: 154275 - DNA, 2186 bp, Homo sapiens
  Payload ID: 10319
  Gene Symbol: MFF
  Gene Name: mitochondrial fission factor
  Uniprot ID: Q9GZY8
  ENST ID: ENST00000353339
  CDS Start-End: 442-1470
gctacggctcccagaaggggccagcccgcgcctttcgcgcttctgccctggccctctgcgggccgctccgccggtgctgtccctgggcgcctccgtgctctcagccaaccacctctgagagcgcccactcgagcgccccgggagccagagggcgggggtcctcgccgggaccctcctgtgggcccagggggacaaaagtggctctcaatccagcacatgcacattgaagcaagttaaaggatttaatatgaagcacagaagcagatagtgccaaatagcaagcagtagttgttacacatttctggaaaagcagtgtccgtgttgttatgtacacctccaaaaaaagttcaaatgtgtaggggaattgttgtgtaaagtaaactgaactgcagggtagcagtattttaatagctattatagacctgtatttactgtatttaaatgagtaaaggaacaagcagtgacacatcactaggaagggtgagcagggcagcatttccttctcccactgctgctgagatggcagaaattagtcgaattcagtacgaaatggaatatactgaaggcattagtcagcgaatgagggtcccagaaaagttaaaagtagcaccgccaaacgctgacctggaacaaggattccaagaaggagttccaaatgctagtgtgataatgcaagttccggagaggattgttgtagcaggaaataatgaagatgtttcattttcaagaccagcagatcttgaccttattcagtcaactccctttaaacccctggcactgaaaacaccacctcgtgtacttacgctgagtgaaagaccactagattttctggatttagaaagacctcctacaacccctcaaaatgaagaaatccgagcagttggcagactaaaaagagagcggtctatgagtgaaaatgctgttcgccaaaatggacagctggtcagaaatgattctctgtggcacagatcagattctgccccaagaaataaaatttcaaggttccaggcaccgatttctgcaccggagtacactgtgacaccatcgccacaacaggctcgggtctgtcctccccatatgttacctgaagatggagctaatctttcctctgctcgtggcattttgtcgcttatccagtcttctactcgtagggcataccagcagatcttggatgtgctggatgaaaatcgcagacctgtgttgcgtggtgggtctgctgccgccacttctaatcctcatcatgacaacgtcaggtatggcatttcaaatatagatacaaccattgaaggaacgtcagatgacctgactgttgtagatgcagcttcactaagacgacagataatcaaactaaatagacgtctacaacttctggaagaggagaacaaagaacgtgctaaaagagaaatggtcatgtattcaattactgtagctttctggctgcttaatagctggctctggtttcgccgctagaggtaacatcagccctcaaaaatactgtctcaacagctggaaatataaaagatttgcaaacttctttgtttctgtctctgcattgtatgccattttatagtccacaccctgaaaatgtatttcttccagaaagtctggaggaaggacctatatttgtagaagtaaaggtatattctgtcactcagctgtattcacgtctgagcagttctgcagtaacacctgcttaaaattctccctttgcatgttttgtaaataggctccagttttgttttttaaaaggaatttattttttgcctcatcagtccacccaactgattctgaatgggagagagtctgtagagaattgattcagaaaagtgtctgtgaaagaaaaacaattattttgtcctgtttctcaaacagtgttaagcagttttgttaatagacatttttgcatcgacacttcaacattaacactttcaaagtcatggtctggtgccagatttaagaaactcgaaccacctaatatttcataaccttcttcattaggtacttgtacagattaatttctaacattgcagcagtttcatatgtgtgcaatatgtgcattctttcattttagttttgcacttggttttctataaagtacgtttttactcagttcatgcgtgaacaatttaaaaaacgacagaataaggtacaaatgtagtgtatttaataaactgtcaaccaaagaa

SEQ ID NO: 154276 - DNA, 1716 bp, Homo sapiens
  Payload ID: 10319
  Gene Symbol: MFF
  Gene Name: mitochondrial fission factor
  Uniprot ID: Q9GZY8
  ENST ID: ENST00000349901
  CDS Start-End: 305-1021
cgcttctgccctggccctctgcgggccgctccgccggtgctgtccctgggcgcctccgtgctctcagccaaccacctctgagagcgcccactcgagcgccccgggagccagagggcgggggtcctcgccgggaccctcctgtgggcccagggggacaaaagtggctctcaatccagcacatgcacattgaagcaagttaaaggatttaatatgaagcacagaagcagatagtgccaaatagcaagcagtagttgttacacatttggtgagcagggcagcatttccttctcccactgctgctgagatggcagaaattagtcgaattcagtacgaaatggaatatactgaaggcattagtcagcgaatgagggtcccagaaaagttaaaagtagcaccgccaaacgctgacctggaacaaggattccaagaaggagttccaaatgctagtgtgataatgcaagttccggagaggattgttgtagcaggaaataatgaagatgtttcattttcaagaccagcagatcttgaccttattcagtcaactccctttaaacccctggcactgaaaacaccacctcgtgtacttacgctgagtgaaagaccactagattttctggatttagaaagacctcctacaacccctcaaaatgaagaaatccgagcagttggcagactaaaaagagagcggtctatgagtgaaaatgctgttcgccaaaatggacagctggtcagaaatgattctctacctgtgttgcgtggtgggtctgctgccgccacttctaatcctcatcatgacaacgtcaggtatggcatttcaaatatagatacaaccattgaaggaacgtcagatgacctgactgttgtagatgcagcttcactaagacgacagataatcaaactaaatagacgtctacaacttctggaagaggagaacaaagaacgtgctaaaagagaaatggtcatgtattcaattactgtagctttctggctgcttaatagctggctctggtttcgccgctagaggtaacatcagccctcaaaaatactgtctcaacagctggaaatataaaagatttgcaaacttctttgtttctgtctctgcattgtatgccattttatagtccacaccctgaaaatgtatttcttccagaaagtctggaggaaggacctatatttgtagaagtaaaggtatattctgtcactcagctgtattcacgtctgagcagttctgcagtaacacctgcttaaaattctccctttgcatgttttgtaaataggctccagttttgttttttaaaaggaatttattttttgcctcatcagtccacccaactgattctgaatgggagagagtctgtagagaattgattcagaaaagtgtctgtgaaagaaaaacaattattttgtcctgtttctcaaacagtgttaagcagttttgttaatagacatttttgcatcgacacttcaacattaacactttcaaagtcatggtctggtgccagatttaagaaactcgaaccacctaatatttcataaccttcttcattaggtacttgtacagattaatttctaacattgcagcagtttcatatgtgtgcaatatgtgcattctttcattttagttttgcacttggttttctataaagtacgtttttactcagttcatgcgtgaacaatttaaaaaacgacagaataaggtacaaatgtagtgtattt

SEQ ID NO: 154277 - DNA, 2004 bp, Homo sapiens
  Payload ID: 10319
  Gene Symbol: MFF
  Gene Name: mitochondrial fission factor
  Uniprot ID: Q9GZY8
  ENST ID: ENST00000304593
  CDS Start-End: 412-1287
gtggagccgttccagtgcgtgggccacgcgtccgcccttttccgcgtcacatgaccacgaacactcttccgctacggctcccagaaggggccagcccgcgcctttcgcgcttctgccctggccctctgcgggccgctccgccggtgctgtccctgggcgcctccgtgctctcagccaaccacctctgagagcgcccactcgagcgccccgggagccagagggcgggggtcctcgccgggaccctcctgtgggcccagggggacaaaagtggctctcaatccagcacatgcacattgaagcaagttaaaggatttaatatgaagcacagaagcagatagtgccaaatagcaagcagtagttgttacacatttggtgagcagggcagcatttccttctcccactgctgctgagatggcagaaattagtcgaattcagtacgaaatggaatatactgaaggcattagtcagcgaatgagggtcccagaaaagttaaaagtagcaccgccaaacgctgacctggaacaaggattccaagaaggagttccaaatgctagtgtgataatgcaagttccggagaggattgttgtagcaggaaataatgaagatgtttcattttcaagaccagcagatcttgaccttattcagtcaactccctttaaacccctggcactgaaaacaccacctcgtgtacttacgctgagtgaaagaccactagattttctggatttagaaagacctcctacaacccctcaaaatgaagaaatccgagcagttggcagactaaaaagagagcggtctatgagtgaaaatgctgttcgccaaaatggacagctggtcagaaatgattctcttgtgacaccatcgccacaacaggctcgggtctgtcctccccatatgttacctgaagatggagctaatctttcctctgctcgtggcattttgtcgcttatccagtcttctactcgtagggcataccagcagatcttggatgtgctggatgaaaatcgcagacctgtgttgcgtggtgggtctgctgccgccacttctaatcctcatcatgacaacgtcaggtatggcatttcaaatatagatacaaccattgaaggaacgtcagatgacctgactgttgtagatgcagcttcactaagacgacagataatcaaactaaatagacgtctacaacttctggaagaggagaacaaagaacgtgctaaaagagaaatggtcatgtattcaattactgtagctttctggctgcttaatagctggctctggtttcgccgctagaggtaacatcagccctcaaaaatactgtctcaacagctggaaatataaaagatttgcaaacttctttgtttctgtctctgcattgtatgccattttatagtccacaccctgaaaatgtatttcttccagaaagtctggaggaaggacctatatttgtagaagtaaaggtatattctgtcactcagctgtattcacgtctgagcagttctgcagtaacacctgcttaaaattctccctttgcatgttttgtaaataggctccagttttgttttttaaaaggaatttattttttgcctcatcagtccacccaactgattctgaatgggagagagtctgtagagaattgattcagaaaagtgtctgtgaaagaaaaacaattattttgtcctgtttctcaaacagtgttaagcagttttgttaatagacatttttgcatcgacacttcaacattaacactttcaaagtcatggtctggtgccagatttaagaaactcgaaccacctaatatttcataaccttcttcattaggtacttgtacagattaatttctaacattgcagcagtttcatatgtgtgcaatatgtgcattctttcattttagttttgcacttggttttctataaagtacgtttttactcagttcatgcgtgaacaatttaaaaaacgacagaataaggtacaaatgtagtgtatttaataaactgtcaaccaaagaag

SEQ ID NO: 154278 - DNA, 1760 bp, Homo sapiens
  Payload ID: 10319
  Gene Symbol: MFF
  Gene Name: mitochondrial fission factor
  Uniprot ID: Q9GZY8
  ENST ID: ENST00000337110
  CDS Start-End: 313-1044
gcctttcgcgcttctgccctggccctctgcgggccgctccgccggtgctgtccctgggcgcctccgtgctctcagccaaccacctctgagagcgcccactcgagcgccccgggagccagagggcgggggtcctcgccgggaccctcctgtgggcccagggggacaaaagtggctctcaatccagcacatgcacattgaagcaagttaaaggatttaatatgaagcacagaagcagatagtgccaaatagcaagcagtagttgttacacatttggtgagcagggcagcatttccttctcccactgctgctgagatggcagaaattagtcgaattcagtacgaaatggaatatactgaaggcattagtcagcgaatgagggtcccagaaaagttaaaagtagcaccgccaaacgctgacctggaacaaggattccaagaaggagttccaaatgctagtgtgataatgcaagttccggagaggattgttgtagcaggaaataatgaagatgtttcattttcaagaccagcagatcttgaccttattcagtcaactccctttaaacccctggcactgaaaacaccacctcgtgtacttacgctgagtgaaagaccactagattttctggatttagaaagacctcctacaacccctcaaaatgaagaaatccgagcagttggcagactaaaaagagagcggtctatgagtgaaaatgctgttcgccaaaatggacagctggtcagaaatgattctctgtggcacagatcagattctgccccaagaaataaaatttcaaggttccaggcaccgatttctgcaccggagtacacgtatggcatttcaaatatagatacaaccattgaaggaacgtcagatgacctgactgttgtagatgcagcttcactaagacgacagataatcaaactaaatagacgtctacaacttctggaagaggagaacaaagaacgtgctaaaagagaaatggtcatgtattcaattactgtagctttctggctgcttaatagctggctctggtttcgccgctagaggtaacatcagccctcaaaaatactgtctcaacagctggaaatataaaagatttgcaaacttctttgtttctgtctctgcattgtatgccattttatagtccacaccctgaaaatgtatttcttccagaaagtctggaggaaggacctatatttgtagaagtaaaggtatattctgtcactcagctgtattcacgtctgagcagttctgcagtaacacctgcttaaaattctccctttgcatgttttgtaaataggctccagttttgttttttaaaaggaatttattttttgcctcatcagtccacccaactgattctgaatgggagagagtctgtagagaattgattcagaaaagtgtctgtgaaagaaaaacaattattttgtcctgtttctcaaacagtgttaagcagttttgttaatagacatttttgcatcgacacttcaacattaacactttcaaagtcatggtctggtgccagatttaagaaactcgaaccacctaatatttcataaccttcttcattaggtacttgtacagattaatttctaacattgcagcagtttcatatgtgtgcaatatgtgcattctttcattttagttttgcacttggttttctataaagtacgtttttactcagttcatgcgtgaacaatttaaaaaacgacagaataaggtacaaatgtagtgtatttaataaactgtcaaccaaagaa

SEQ ID NO: 154279 - DNA, 1085 bp, Homo sapiens
  Payload ID: 10319
  Gene Symbol: MFF
  Gene Name: mitochondrial fission factor
  Uniprot ID: Q9GZY8
  ENST ID: ENST00000354503
  CDS Start-End: 331-987
cagaaggggccagcccgcgcctttcgcgcttctgccctggccctctgcgggccgctccgccggtgctgtccctgggcgcctccgtgctctcagccaaccacctctgagagcgcccactcgagcgccccgggagccagagggcgggggtcctcgccgggaccctcctgtgggcccagggggacaaaagtggctctcaatccagcacatgcacattgaagcaagttaaaggatttaatatgaagcacagaagcagatagtgccaaatagcaagcagtagttgttacacatttggtgagcagggcagcatttccttctcccactgctgctgagatggcagaaattagtcgaattcagtacgaaatggaatatactgaaggcattagtcagcgaatgagggtcccagaaaagttaaaagtagcaccgccaaacgctgacctggaacaaggattccaagaaggagttccaaatgctagtgtgataatgcaagttccggagaggattgttgtagcaggaaataatgaagatgtttcattttcaagaccagcagatcttgaccttattcagtcaactccctttaaacccctggcactgaaaacaccacctcgtgtacttacgctgagtgaaagaccactagattttctggatttagaaagacctcctacaacccctcaaaatgaagaaatccgagcagttggcagactaaaaagagagcggtctatgagtgaaaatgctgttcgccaaaatggacagctggtcagaaatgattctctgtatggcatttcaaatatagatacaaccattgaaggaacgtcagatgacctgactgttgtagatgcagcttcactaagacgacagataatcaaactaaatagacgtctacaacttctggaagaggagaacaaagaacgtgctaaaagagaaatggtcatgtattcaattactgtagctttctggctgcttaatagctggctctggtttcgccgctagaggtaacatcagccctcaaaaatactgtctcaacagctggaaatataaaagatttgcaaacttctttgtttctgtctctgcattgtatgccattttat

SEQ ID NO: 154280 - DNA, 1710 bp, Homo sapiens
  Payload ID: 10319
  Gene Symbol: MFF
  Gene Name: mitochondrial fission factor
  ENST ID: ENST00000392059
  CDS Start-End: 326-991
ggacaaaagtggctctcaatccagcacatgcacattgaagcaagttaaaggatttaatatgaagcacagaagcagatagtgccaaatagcaagcagtagttgttacacatttctggaaaagcagtgtccgtgttgttatgtacacctccaaaaaaagttcaaatgtgtaggggaattgttgtgtaaagtaaactgaactgcagggtagcagtattttaatagctattatagacctgtatttactgtatttaaatgagtaaaggaacaagcagtgacacatcactaggaaggattccaagaaggagttccaaatgctagtgtgataatgcaagttccggagaggattgttgtagcaggaaataatgaagatgtttcattttcaagaccagcagatcttgaccttattcagtcaactccctttaaacccctggcactgaaaacaccacctcgtgtacttacgctgagtgaaagaccactagattttctggatttagaaagacctcctacaacccctcaaaatgaagaaatccgagcagttggcagactaaaaagagagcggtctatgagtgaaaatgctgttcgccaaaatggacagctggtcagaaatgattctcttgtgacaccatcgccacaacaggctcgggtctgtcctccccatatgttacctgaagatggagctaatctttcctctgctcgtggcattttgtcgcttatccagtcttctactcgtagggcataccagcagatcttggatgtgctggatgaaaatcgcaggtatggcatttcaaatatagatacaaccattgaaggaacgtcagatgacctgactgttgtagatgcagcttcactaagacgacagataatcaaactaaatagacgtctacaacttctggaagaggagaacaaagaacgtgctaaaagagaaatggtcatgtattcaattactgtagctttctggctgcttaatagctggctctggtttcgccgctagaggtaacatcagccctcaaaaatactgtctcaacagctggaaatataaaagatttgcaaacttctttgtttctgtctctgcattgtatgccattttatagtccacaccctgaaaatgtatttcttccagaaagtctggaggaaggacctatatttgtagaagtaaaggtatattctgtcactcagctgtattcacgtctgagcagttctgcagtaacacctgcttaaaattctccctttgcatgttttgtaaataggctccagttttgttttttaaaaggaatttattttttgcctcatcagtccacccaactgattctgaatgggagagagtctgtagagaattgattcagaaaagtgtctgtgaaagaaaaacaattattttgtcctgtttctcaaacagtgttaagcagttttgttaatagacatttttgcatcgacacttcaacattaacactttcaaagtcatggtctggtgccagatttaagaaactcgaaccacctaatatttcataaccttcttcattaggtacttgtacagattaatttctaacattgcagcagtttcatatgtgtgcaatatgtgcattctttcattttagttttgcacttggttttctataaagtacgtttttactcagttcatgcgtgaacaatttaaaaaacgacagaataaggtacaaatgtagtgtatttaataaactgtcaaccaaagaagta

SEQ ID NO: 154281 - DNA, 1247 bp, Homo sapiens
  Payload ID: 10319
  Gene Symbol: MFF
  Gene Name: mitochondrial fission factor
  Uniprot ID: Q9GZY8
  ENST ID: ENST00000409616
  CDS Start-End: 497-1213
gcccgcgcctttcgcgcttctgccctggccctctgcgggccgctccgccggtgctgtccctgggcgcctccgtgctctcagccaaccacctctgagagcgcccactcgagcgccccgggagccagagggcgggggtcctcgccgggaccctcctgtgggcccagggggacaaaagtggctctcaatccagcacatgcacattgaagcaagttaaaggatttaatatgaagcacagaagcagatagtgccaaatagcaagcagtagttgttacacatttctggaaaagcagtgtccgtgttgttatgtacacctccaaaaaaagttcaaatgtgtaggggaattgttgtgtaaagtaaactgaactgcagggtagcagtattttaatagctattatagacctgtatttactgtatttaaatgagtaaaggaacaagcagtgacacatcactaggaagggtgagcagggcagcatttccttctcccactgctgctgagatggcagaaattagtcgaattcagtacgaaatggaatatactgaaggcattagtcagcgaatgagggtcccagaaaagttaaaagtagcaccgccaaacgctgacctggaacaaggattccaagaaggagttccaaatgctagtgtgataatgcaagttccggagaggattgttgtagcaggaaataatgaagatgtttcattttcaagaccagcagatcttgaccttattcagtcaactccctttaaacccctggcactgaaaacaccacctcgtgtacttacgctgagtgaaagaccactagattttctggatttagaaagacctcctacaacccctcaaaatgaagaaatccgagcagttggcagactaaaaagagagcggtctatgagtgaaaatgctgttcgccaaaatggacagctggtcagaaatgattctctacctgtgttgcgtggtgggtctgctgccgccacttctaatcctcatcatgacaacgtcaggtatggcatttcaaatatagatacaaccattgaaggaacgtcagatgacctgactgttgtagatgcagcttcactaagacgacagataatcaaactaaatagacgtctacaacttctggaagaggagaacaaagaacgtgctaaaagagaaatggtcatgtattcaattactgtagctttctggctgcttaatagctggctctggtttcgccgctagaggtaacatcagccctcaaaaatactgtctcaac

SEQ ID NO: 154282 - DNA, 1548 bp, Homo sapiens
  Payload ID: 10319
  Gene Symbol: MFF
  Gene Name: mitochondrial fission factor
  Uniprot ID: Q9GZY8
  ENST ID: ENST00000409565
  CDS Start-End: 210-866
ccagcccgcgcctttcgcgcttctgccctggccctctgcgggccgctccgccggtgctgtccctgggcgcctccgtgctctcagccaaccacctctgagagcgcccactcgagcgccccgggagccagagggcgggggtcctcgccgggaccctcctgtgggcccagggggtgagcagggcagcatttccttctcccactgctgctgagatggcagaaattagtcgaattcagtacgaaatggaatatactgaaggcattagtcagcgaatgagggtcccagaaaagttaaaagtagcaccgccaaacgctgacctggaacaaggattccaagaaggagttccaaatgctagtgtgataatgcaagttccggagaggattgttgtagcaggaaataatgaagatgtttcattttcaagaccagcagatcttgaccttattcagtcaactccctttaaacccctggcactgaaaacaccacctcgtgtacttacgctgagtgaaagaccactagattttctggatttagaaagacctcctacaacccctcaaaatgaagaaatccgagcagttggcagactaaaaagagagcggtctatgagtgaaaatgctgttcgccaaaatggacagctggtcagaaatgattctctgtatggcatttcaaatatagatacaaccattgaaggaacgtcagatgacctgactgttgtagatgcagcttcactaagacgacagataatcaaactaaatagacgtctacaacttctggaagaggagaacaaagaacgtgctaaaagagaaatggtcatgtattcaattactgtagctttctggctgcttaatagctggctctggtttcgccgctagaggtaacatcagccctcaaaaatactgtctcaacagctggaaatataaaagatttgcaaacttctttgtttctgtctctgcattgtatgccattttatagtccacaccctgaaaatgtatttcttccagaaagtctggaggaaggacctatatttgtagaagtaaaggtatattctgtcactcagctgtattcacgtctgagcagttctgcagtaacacctgcttaaaattctccctttgcatgttttgtaaataggctccagttttgttttttaaaaggaatttattttttgcctcatcagtccacccaactgattctgaatgggagagagtctgtagagaattgattcagaaaagtgtctgtgaaagaaaaacaattattttgtcctgtttctcaaacagtgttaagcagttttgttaatagacatttttgcatcgacacttcaacattaacactttcaaagtcatggtctggtgccagatttaagaaactcgaaccacctaatatttcataaccttcttcattaggtacttgtacagattaatttctaacattgcagcagtttcatatgtgtgcaatatgtgcattctttcattttagttttgcacttggttttctataaagtacgtttttactcagttcatgcgtgaacaatttaaaaaacgacagaataaggtacaa

SEQ ID NO: 154283 - DNA, 581 bp, Homo sapiens
  Payload ID: 10319
  Gene Symbol: MFF
  Gene Name: mitochondrial fission factor
  ENST ID: ENST00000423098
  CDS Start-End: 484-581
gtctgcgcatcgcttaccgtggagccgttccagtgcgtgggccacgcgtccgcccttttccgcgtcacatgaccacgaacactcttccgctacggctcccagaaggggccagcccgcgcctttcgcgcttctgccctggccctctgcgggccgctccgccggtgctgtccctgggcgcctccgtgctctcagccaaccacctctgagagcgcccactcgagcgccccgggagccagagggcgggggtcctcgccgggaccctcctgtgggcccagggggacaaaagtggctctcaatccagcacatgcacattgaagcaagttaaaggatttaatatgaagcacagaagcagatagtgccaaatagcaagcagtagttgttacacatttctggaaaagcagtgtccgtgttgttatgtacacctccaaaaaaagttcaaatgtggtgagcagggcagcatttccttctcccactgctgctgagatggcagaaattagtcgaattcagtacgaaatggaatatactgaaggcattagtcagcgaatgagggtcccagaaaagttaaaagtagcaccgccaaa

SEQ ID NO: 154284 - DNA, 566 bp, Homo sapiens
  Payload ID: 10319
  Gene Symbol: MFF
  Gene Name: mitochondrial fission factor
  ENST ID: ENST00000443428
  CDS Start-End: 353-566
ttcccgacccgcgacctgccgcccgagctggctgccaggcctatcgccgccgccgagaccctccggccaacagggacccgcggtggccccggcccccccgggacaaaagtggctctcaatccagcacatgcacattgaagcaagttaaaggatttaatatgaagcacagaagcagatagtgccaaatagcaagcagtagttgttacacatttctggaaaagcagtgtccgtgttgttatgtacacctccaaaaaaagttcaaatgtgtaggggaattgttgtgtaaagtaaactgaactgcagggtagcagtattttaatagctattatagacctgtatttactgtatttaaatgagtaaaggaacaagcagtgacacatcactaggaagggtgagcagggcagcatttccttctcccactgctgctgagatggcagaaattagtcgaattcagtacgaaatggaatatactgaaggcattagtcagcgaatgagggtcccagaaaagttaaaagtagcaccgccaaacgctgacctggaacaaggattccaagaaggagttccaa

SEQ ID NO: 154285 - DNA, 720 bp, Homo sapiens
  Payload ID: 10319
  Gene Symbol: MFF
  Gene Name: mitochondrial fission factor
  ENST ID: ENST00000418961
  CDS Start-End: 541-720
ccgcgacctgccgcccgagctggctgccaggcctatcgccgccgccgagaccctccggccaacagggacccgcggtggccccggcccccccggtagtgtctccctgacccgagtcccgtccccgggcctcttgccttcaaccctggtctttcctcctccccgggaccttgagtccccgaggagagcgagggagaggagcgtcttctgcagggacaaaagtggctctcaatccagcacatgcacattgaagcaagttaaaggatttaatatgaagcacagaagcagatagtgccaaatagcaagcagtagttgttacacatttctggaaaagcagtgtccgtgttgttatgtacacctccaaaaaaagttcaaatgtgtaggggaattgttgtgtaaagtaaactgaactgcagggtagcagtattttaatagctattatagacctgtatttactgtatttaaatgagtaaaggaacaagcagtgacacatcactaggaagggtgagcagggcagcatttccttctcccactgctgctgagatggcagaaattagtcgaattcagtacgaaatggaatatactgaaggcattagtcagcgaatgagggtcccagaaaagttaaaagtagcaccgccaaacgctgacctggaacaaggattccaagaaggagttccaaatgctagtgtgataatgcaagttccggagaggattgttgtagca

SEQ ID NO: 154286 - DNA, 527 bp, Homo sapiens
  Payload ID: 10319
  Gene Symbol: MFF
  Gene Name: mitochondrial fission factor
  ENST ID: ENST00000436237
  CDS Start-End: 426-527
actcgagcgccccgggagccagagggcgggggtcctcgccgggaccctcctgtgggcccagggggacaaaagtggctctcaatccagcacatgcacattgaagcaagttaaaggatttaatatgaagcacagaagcagatagtgccaaatagcaagcagtagttgttacacatttgtgagtaaaaatggtcccttttggcttactttcttagtctttaaatcgtctgcatgccaaatccttaaagatctatgtccccagagattttttgataaagaataaaagatctggaaaagcagtgtccgtgttgttatgtacacctccaaaaaaagttcaaatgtgtaggggaattgttgtgtaaagtaaactgaactgcagggtagcagtattttaatagctattatagacctgtatttactgtatttaaatgagtaaaggaacaagcagtgacacatcactaggaagggtgagcagggcagcatttccttctcccactgctgctgagatggcagaaattagtcgaattcag

SEQ ID NO: 154287 - DNA, 729 bp, Homo sapiens
  Payload ID: 10319
  Gene Symbol: MFF
  Gene Name: mitochondrial fission factor
  ENST ID: ENST00000456345
  CDS Start-End: 1-465
atccgagcagttggcagactaaaaagagagcggtctatgagtgaaaatgctgttcgccaaaatggacagctggtcagaaatgattctcttgtgacaccatcgccacaacaggctcgggtctgtcctccccatatgttacctgaagatggagctaatctttcctctgctcgtggcattttgtcgcttatccagtcttctactcgtagggcataccagcagatcttggatgtgctggatgaaaatcgcaggtatggcatttcaaatatagatacaaccattgaaggaacgtcagatgacctgactgttgtagatgcagcttcactaagacgacagataatcaaactaaatagacgtctacaacttctggaagaggagaacaaagaacgtgctaaaagagaaatggtcatgtattcaattactgtagctttctggctgcttaatagctggctctggtttcgccgctagaggtaacatcagccctcaaaaatactgtctcaacagctggaaatataaaagatttgcaaacttctttgtttctgtctctgcattgtatgccattttatagtccacaccctgaaaatgtatttcttccagaaagtctggaggaaggacctatatttgtagaagtaaaggtatattctgtcactcagctgtattcacgtctgagcagttctgcagtaacacctgcttaaaattctccctttgcatgttttgtaaataggctccagt

SEQ ID NO: 154288 - DNA, 736 bp, Homo sapiens
  Payload ID: 10319
  Gene Symbol: MFF
  Gene Name: mitochondrial fission factor
  ENST ID: ENST00000452930
  CDS Start-End: 323-736
agcccgcgcctttcgcgcttctgccctggccctctgcgggccgctccgccggtgctgtccctgggcgcctccgtgctctcagccaaccacctctgagagcgcccactcgagcgccccgggagccagagggcgggggtcctcgccgggaccctcctgtgggcccaggggtgagtgttgacgtcttcccgacccgcgacctgccgcccgagctggctgccaggcctatcgccgccgccgagaccctccggccaacagggacccgcggtggccccggcccccccgggtgagcagggcagcatttccttctcccactgctgctgagatggcagaaattagtcgaattcagtacgaaatggaatatactgaaggcattagtcagcgaatgagggtcccagaaaagttaaaagtagcaccgccaaacgctgacctggaacaaggattccaagaaggagttccaaatgctagtgtgataatgcaagttccggagaggattgttgtagcaggaaataatgaagatgtttcattttcaagaccagcagatcttgaccttattcagtcaactccctttaaacccctggcactgaaaacaccacctcgtgtacttacgctgagtgaaagaccactagattttctggatttagaaagacctcctacaacccctcaaaatgaagaaatccgagcagttggcagactaaaaagagagcggtctatgagtgaaaatgctgttcgccaaaat

SEQ ID NO: 154289 - DNA, 560 bp, Homo sapiens
  Payload ID: 10319
  Gene Symbol: MFF
  Gene Name: mitochondrial fission factor
  ENST ID: ENST00000530359
  CDS Start-End: 384-560
agaaggggccagcccgcgcctttcgcgcttctgccctggccctctgcgggccgctccgccggtgctgtccctgggcgcctccgtgctctcagccaaccacctctgagagcgcccactcgagcgccccgggagccagagggcgggggtcctcgccgggaccctcctgtgggcccaggggaaataatgaagatgtttcattttcaagaccagcagatcttgaccttattcagtcaactccctttaaacccctggcactgaaaacaccacctcgtgtacttacgctgagtgaaagaccactagattttctggatttagaaagacctcctacaacccctcaaaatgaagaaatccgagcagttggcagactaaaaagagagcggtctatgagtgaaaatgctgttcgccaaaatggacagctggtcagaaatgattctctgtggcacagatcagattctgccccaagaaataaaatttcaaggttccaggcaccgatttctgcaccggagtacactgtgacaccatcgccacaacaggctcgggtctgtcctccccatatgtta

SEQ ID NO: 154290 - DNA, 584 bp, Homo sapiens
  Payload ID: 10319
  Gene Symbol: MFF
  Gene Name: mitochondrial fission factor
  ENST ID: ENST00000531278
  CDS Start-End: 378-584
ggccagcccgcgcctttcgcgcttctgccctggccctctgcgggccgctccgccggtgctgtccctgggcgcctccgtgctctcagccaaccacctctgagagcgcccactcgagcgccccgggagccagagggcgggggtcctcgccgggaccctcctgtgggcccaggggaaataatgaagatgtttcattttcaagaccagcagatcttgaccttattcagtcaactccctttaaacccctggcactgaaaacaccacctcgtgtacttacgctgagtgaaagaccactagattttctggatttagaaagacctcctacaacccctcaaaatgaagaaatccgagcagttggcagactaaaaagagagcggtctatgagtgaaaatgctgttcgccaaaatggacagctggtcagaaatgattctcttgtgacaccatcgccacaacaggctcgggtctgtcctccccatatgttacctgaagatggagctaatctttcctctgctcgtggcattttgtcgcttatccagtcttctactcgtagggcataccagcagatcttggatgtgctggatgaaaat

SEQ ID NO: 154291 - DNA, 576 bp, Homo sapiens
  Payload ID: 10319
  Gene Symbol: MFF
  Gene Name: mitochondrial fission factor
  ENST ID: ENST00000534203
  CDS Start-End: 364-576
tttcgcgcttctgccctggccctctgcgggccgctccgccggtgctgtccctgggcgcctccgtgctctcagccaaccacctctgagagcgcccactcgagcgccccgggagccagagggcgggggtcctcgccgggaccctcctgtgggcccaggggaaataatgaagatgtttcattttcaagaccagcagatcttgaccttattcagtcaactccctttaaacccctggcactgaaaacaccacctcgtgtacttacgctgagtgaaagaccactagattttctggatttagaaagacctcctacaacccctcaaaatgaagaaatccgagcagttggcagactaaaaagagagcggtctatgagtgaaaatgctgttcgccaaaatggacagctggtcagaaatgattctctgtggcacagatcagattctgccccaagaaataaaatttcaaggttccaggcaccgatttctgcaccggagtacacgtatggcatttcaaatatagatacaaccattgaaggaacgtcagatgacctgactgttgtagatgcagcttcactaagacgacag

SEQ ID NO: 154292 - DNA, 647 bp, Homo sapiens
  Payload ID: 10319
  Gene Symbol: MFF
  Gene Name: mitochondrial fission factor
  ENST ID: ENST00000524634
  CDS Start-End: 364-633
tttcgcgcttctgccctggccctctgcgggccgctccgccggtgctgtccctgggcgcctccgtgctctcagccaaccacctctgagagcgcccactcgagcgccccgggagccagagggcgggggtcctcgccgggaccctcctgtgggcccaggggaaataatgaagatgtttcattttcaagaccagcagatcttgaccttattcagtcaactccctttaaacccctggcactgaaaacaccacctcgtgtacttacgctgagtgaaagaccactagattttctggatttagaaagacctcctacaacccctcaaaatgaagaaatccgagcagttggcagactaaaaagagagcggtctatgagtgaaaatgctgttcgccaaaatggacagctggtcagaaatgattctctgtatggcatttcaaatatagatacaaccattgaaggaacgtcagatgacctgactgttgtagatgcagcttcactaagacgacagataatcaaactaaatagacgtctacaacttctggaagaggagaacaaagaacgtgctaaaagagaaatggtcatgtattcaattactgtagctttctggctgcttaatagctggctctggtttcgccgctagaggtaacatcagcc

SEQ ID NO: 154293 - DNA, 558 bp, Homo sapiens
  Payload ID: 10319
  Gene Symbol: MFF
  Gene Name: mitochondrial fission factor
  ENST ID: ENST00000525195
  CDS Start-End: 402-558
tttcgcgcttctgccctggccctctgcgggccgctccgccggtgctgtccctgggcgcctccgtgctctcagccaaccacctctgagagcgcccactcgagcgccccgggagccagagggcgggggtcctcgccgggaccctcctgtgggcccagggggacaaaagtggctctcaatccagcacatgcacattgaagcaagttaaaggatttaatatgaagcacagaagcagatagtgccaaatagcaagcagtagttgttacacatttctggaaaagcagtgtccgtgttgttatgtacacctccaaaaaaagttcaaatgtgtaggggaattgttgtgtaaagtaaactgaactgcaggggtgagcagggcagcatttccttctcccactgctgctgagatggcagaaattagtcgaattcagtacgaaatggaatatactgaaggcattagtcagcgaatgagggtcccagaaaagttaaaagtagcaccgccaaacgctgacctggaacaaggattccaagaaggagttccaaatgctagtgtgataatgcaag

SEQ ID NO: 154294 - DNA, 1370 bp, Homo sapiens
  Payload ID: 10320
  Gene Symbol: MTFP1
  Gene Name: mitochondrial fission process 1
  Uniprot ID: Q9UDX5
  ENST ID: ENST00000266263
  CDS Start-End: 351-851
gaataaagagatgctggataagcccgaggtcacaagctttgcagtgtagcatcccccaacttgatcccctgtctctttggctccaaaacctacactcagtcctgggagcgattagcgccaacagctcagagaaaacgtgacgaaaaccagtctgtaaaacccgagcctgggagaggggcttcggtgcgcggggggaatttgcagacgctccctgctggcggagatttcctgacctgtccttcggcgcgggactttcggcgggtcccggccgggcagacccaagtgccggcggcggagactgcagtggagccagtaccggctgtagtggccggggccgtggcgggagagtcatgtcagagccgcagccgcggggcgcagagcgcgatctctaccgggacacgtgggtgcgatacctgggctatgccaatgaggtgggcgaggctttccgctctcttgtgccagcggcggtggtgtggctgagctatggcgtggccagctcctacgtgctggcggatgccattgacaaaggcaagaaggctggagaggtgcccagccctgaagcaggccgcagcgccagggtgactgtggctgtggtggacacctttgtatggcaggctctagcctctgtggccattccgggcttcaccatcaaccgcgtgtgtgctgcctctctctatgtcctgggcactgccacccgctggcccctggctgtccgcaagtggaccaccaccgcgcttgggctgttgaccatccccatcattatccaccccattgacaggtcggtggatttcctcctggactccagcctgcgcaagctctacccaacagtggggaagcccagctcctcctgatcatactctggtacctggcctgtgcatcggcctcctgcttcatgtcaacctcctactcctgccagggaatgtggacacctggctccctggtgtccaaagaccctggcacctgggtgggtttgagctggacagaagcttagagacaaaggcttcaagaagcagtggctgcagggagtcacagaagggcaggacctgaacgctgtctgcttccctggaatccaagatgctgagtggaagtggaccctgggtgggcccggccctgtctttttcaggaaaattacatcctcccatggaggatgagagactgaggctcagggagggcaaggaataggcccaagatcacttggcaagctgggcacccaggacccccaggtgcttgacagagtcaccccatggtggtatggctgaacaaggagcggcagacaactcagggagaaactcaggagtgcagtaccagggacacctcaggacagattctctggccaggcccttccctgacccaataaatcctgaagaggt

SEQ ID NO: 154295 - DNA, 891 bp, Homo sapiens
  Payload ID: 10320
  Gene Symbol: MTFP1
  Gene Name: mitochondrial fission process 1
  Uniprot ID: Q9UDX5
  ENST ID: ENST00000355143
  CDS Start-End: 105-512
cgggactttcggcgggtcccggccgggcagacccaagtgccggcggcggagactgcagtggagccagtaccggctgtagtggccggggccgtggcgggagagtcatgtcagagccgcagccgcggggcgcagagcgcgatctctaccgggacacgtgggtgcgatacctgggctatgccaatgaggtgggcgaggctttccgctctcttgtgccagcggcggtggtgtggctgagctatggcgtggccagctcctacgtgctggcggatgccattgacaaaggcaagaaggctggagaggtcggtggatttcctcctggactccagcctgcgcaagctctacccaacagtggggaagcccagctcctcctgatcatactctggtacctggcctgtgcatcggcctcctgcttcatgtcaacctcctactcctgccagggaatgtggacacctggctccctggtgtccaaagaccctggcacctgggtgggtttgagctggacagaagcttagagacaaaggcttcaagaagcagtggctgcagggagtcacagaagggcaggacctgaacgctgtctgcttccctggaatccaagatgctgagtggaagtggaccctgggtgggcccggccctgtctttttcaggaaaattacatcctcccatggaggatgagagactgaggctcagggagggcaaggaataggcccaagatcacttggcaagctgggcacccaggacccccaggtgcttgacagagtcaccccatggtggtatggctgaacaaggagcggcagacaactcagggagaaactcaggagtgcagtaccagggacacctcaggacagattctctggccaggcccttccctgacccaataaatcctgaagaggt

SEQ ID NO: 154296 - DNA, 912 bp, Homo sapiens
  Payload ID: 10320
  Gene Symbol: MTFP1
  Gene Name: mitochondrial fission process 1
  ENST ID: ENST00000407550
  CDS Start-End: 64-495
ggcggcggagactgcagtggagccagtaccggctgtagtggccggggccgtggcgggagagtcatgtcagagccgcagccgcggggcgcagagcgcgatctctaccgggacacgtgggtgcgatacctgggctatgccaatgaggtgggcgaggctttccgctctcttgtgccagcggcggtggtgtggctgagctatggcgtggccagctcctacgtgctggcggatgccattgacaaaggcaagaaggctggagaggctctagcctctgtggccattccgggcttcaccatcaaccgcgtgtgtgctgcctctctctatgtcctgggcactgccacccgctggcccctggctgtccgcaagtggaccaccaccgcgcttgggctgttgaccatccccatcattatccaccccattgacaggtcggtggatttcctcctggactccagcctgcgcaagctctacccaacagtggggaagcccagctcctcctgatcatactctggtacctggcctgtgcatcggcctcctgcttcatgtcaacctcctactcctgccagggaatgtggacacctggctccctggtgtccaaagaccctggcacctgggtgggtttgagctggacagaagcttagagacaaaggcttcaagaagcagtggctgcagggagtcacagaagggcaggacctgaacgctgtctgcttccctggaatccaagatgctgagtggaagtggaccctgggtgggcccggccctgtctttttcaggaaaattacatcctcccatggaggatgagagactgaggctcagggagggcaaggaataggcccaagatcacttggcaagctgggcacccaggacccccaggtgcttgacagagtcaccccatggtggtatggctgaacaaggagc

SEQ ID NO: 154297 - DNA, 759 bp, Homo sapiens
  Payload ID: 10320
  Gene Symbol: MTFP1
  Gene Name: mitochondrial fission process 1
  ENST ID: ENST00000412752
  CDS Start-End: 101-325
actttcggcgggtcccggccgggcagacccaagtgccggcggcggagactgcagtggagccagtaccggctgtagtggccggggccgtggcgggagagtcatgtcagagccgcagccgcggggcgcagagcgcgatctctaccgggacacgtgggtgcgatacctgggctatgccaatgaggtgggcgaggctttccgctctcttgtgccagcggcggtggtgtggctgagctatggcgtggccagctcctacgtgctggcggatgccattgacaaaggcaagaaggctggagaggattttctgcctctgccccagctggattaagtgtctctgcgcccaccaggtgcccagccctgaagcaggccgcagcgccagggtgactgtggctgtggtggacacctttgtatggcaggctctagcctctgtggccattccgggcttcaccatcaaccgcgtgtgtgctgcctctctctatgtcctgggcactgccacccgctggcccctggctgtccgcaagtggaccaccaccgcgcttgggctgttgaccatccccatcattatccaccccattgacaggtcggtggatttcctcctggactccagcctgcgcaagctctacccaacagtggggaagcccagctcctcctgatcatactctggtacctggcctgtgcatcggcctcctgcttcatgtcaacctcctactcctgccagggaatgtggacacctggctccctggtgtccaaagaccctggcac

SEQ ID NO: 154298 - DNA, 482 bp, Homo sapiens
  Payload ID: 10320
  Gene Symbol: MTFP1
  Gene Name: mitochondrial fission process 1
  ENST ID: ENST00000629597
  CDS Start-End: 258-482
actcagtcctgggagcgattagcgccaacagctcagagaaaacgtgacgaaaaccagtctgtaaaacccgagcctgggagaggggcttcggtgcgcggggggaatttgcagacgctccctgctggcggagatttcctgacctgtccttcggcgcgggactttcggcgggtcccggccgggcagacccaagtgccggcggcggagactgcagtggagccagtaccggctgtagtggccggggccgtggcgggagagtcatgtcagagccgcagccgcggggcgcagagcgcgatctctaccgggacacgtgggtgcgatacctgggctatgccaatgaggtgggcgaggctttccgctctcttgtgccagcggcggtggtgtggctgagctatggcgtggccagctcctacgtgctggcggatgccattgacaaaggcaagaaggctggagaggattttctgcctctgccccagctggattaa

SEQ ID NO: 154299 - DNA, 2640 bp, Homo sapiens
  Payload ID: 10321
  Gene Symbol: MTFR1
  Gene Name: mitochondrial fission regulator 1
  Uniprot ID: Q15390
  ENST ID: ENST00000262146
  CDS Start-End: 127-1128
agaagcctgaggagccggagagggtgctggctgccgcgcggccgagtgtgttttatggaccatgtgctgctatgtatgcctgaagaagtacttgaaatgcaaatttggggagactttgccatataaatgcttggctggattaagcgcctaattaggatggtttttcaacaagttggagtaagcatgcaatcggtactttggtctaggaagccatatggttcgtctcgaagtatcgtaaggaaaattggtactaatttgtctctgattcagtgtccaagagttcagtttcagattaacagccatgcaacagaatggagtcccagccacccaggagaggatgcagtggcgtcttttgctgatgttggatgggtagccaaagaagaaggagagtgttcagcaagactaaggacagaggtcagatcaaggccaccccttcaggatgaccttcttttctttgagaaggccccaagcagacagatttccttaccagacttgtctcaagaagagcctcagctgaagaccccagcgctggcaaatgaggaagcactgcagaagatttgcgctctcgaaaatgaacttgctgctctcagagctcagattgccaaaattgtgacccagcaggagcagcaaaatctcactgcaggtgacttagattctaccacatttggtaccataccaccacaccctccacctcccccaccgcccctgcctccccctgcactggggctccaccaaagtacatctgctgttgatctgattaaagaacgaagagagaaaagagccaatgctggaaagactttggttaagaacaatccaaagaaacctgaaatgccaaatatgctagagatccttaaagagatgaacagtgtaaaacttcggtcagtgaagaggtcagagcaagatgtgaagcccaagccagtggatgctactgaccctgctgccctcatagcagaggctctgaaaaagaaatttgcttatcggtatcgaagtgatagccaagatgaagttgaaaaaggaattccaaagtctgaatcagaggccacctcagagagagtgttgtttgggccacacatgttgaagccaacaggaaaaatgaaggctttaattgaaaatgtatcagactcctaatagacaatgagctgcgaaaagactcctggttcccctgttgatttgtgagggccaagtttgctagtagaaatcgacactgtttagtaaatacctctttagtattcagtggtcttcttttcaggctaattagtggattaagcaataatgaaagcactaagtttggttttgcttttgtgagatggtcagctttggtgctctccacaacatgtgtgttctgacatgtttctaatatgtggccagggcgttcagatttccagttttgaaaacaattgtatagatttcacaacacaaaaaggacatttgtggatgttactgcacattttaaattcttaacactaatttatctgtataagtgttttatatgcatatttttggacataaacagtttatgtaaaattagtaatgaatgatggcaacgagggcactgttatcttcgtttgttttcaatgatcatttagcattcaatgatggaacagctggtataacataagttgttggcatgaaatatttgagattggaaacttcttgccttgaacagaacttatatcttagattctctctcacattttcttggagctggggtttgaataggaaccagatgatgttcactgctgaaattccataatgcttcccattgaagggaagttgagaaccaggaaagctgctttcacgtcattgccatccagtactgacagggaagaaagatgtagttttccagtagtgatgaatcaaattattgaattaaatttcttcttaagaagtaaaaactcagaatgtaccatcttgtttcctttcagtttattaaatggcatcataaagatgactttgctaagttaatagagttaaaaatttttttaatataagccaaaatattaactttaatgaaacattgacttggcaaatgaatttcctataaattatcattggtcagaatgctgttttgtttaataatattacgcaacataaaccataggtgttattagaagtggagaactgcctttttcatctggggcttttaaggacttgctataaatgattattttttaaatgctttataaatcttcatggtttttctatttctgatacactcagctatagttaataccagagtatcctaccaggagtaatatttggaatatttaaatctagtaaaagaagaaagttgtacttcctggctgggagtattaggagatgggagtagagattcacttttaagttcttgaaaatatatgcattctcctaaatattaacaaaaatgatttggggaaatgacatggcttgattgttctgtttaaatttgtactgtggcttatgttacacatgttcatgttcacctctcattcacctgttttatatggtttaaaattctctttaacaaaattcagaaaattcacctgaaacgtattttgacctaaaagaaacatatttttgtatcagtattgaattttggacagtgcccccatataaggaagttactgttttaaaataaagcaaactaactgttttattttc

SEQ ID NO: 154300 - DNA, 2500 bp, Homo sapiens
  Payload ID: 10321
  Gene Symbol: MTFR1
  Gene Name: mitochondrial fission regulator 1
  Uniprot ID: Q15390
  ENST ID: ENST00000458689
  CDS Start-End: 81-983
tgtgttttatggaccatgtgctgctatgtatgcctgaagaagtacttgaaatgcaaatttggggagactttgccatataaatgcttggctggattaagcgcctaattaggatggtttttcaacaagttggagtaagcatgcaatcgattaacagccatgcaacagaatggagtcccagccacccaggagaggatgcagtggcgtcttttgctgatgttggatgggtagccaaagaagaaggagagtgttcagcaagactaaggacagaggtcagatcaaggccaccccttcaggatgaccttcttttctttgagaaggccccaagcagacagatttccttaccagacttgtctcaagaagagcctcagctgaagaccccagcgctggcaaatgaggaagcactgcagaagatttgcgctctcgaaaatgaacttgctgctctcagagctcagattgccaaaattgtgacccagcaggagcagcaaaatctcactgcaggtgacttagattctaccacatttggtaccataccaccacaccctccacctcccccaccgcccctgcctccccctgcactggggctccaccaaagtacatctgctgttgatctgattaaagaacgaagagagaaaagagccaatgctggaaagactttggttaagaacaatccaaagaaacctgaaatgccaaatatgctagagatccttaaagagatgaacagtgtaaaacttcggtcagtgaagaggtcagagcaagatgtgaagcccaagccagtggatgctactgaccctgctgccctcatagcagaggctctgaaaaagaaatttgcttatcggtatcgaagtgatagccaagatgaagttgaaaaaggaattccaaagtctgaatcagaggccacctcagagagagtgttgtttgggccacacatgttgaagccaacaggaaaaatgaaggctttaattgaaaatgtatcagactcctaatagacaatgagctgcgaaaagactcctggttcccctgttgatttgtgagggccaagtttgctagtagaaatcgacactgtttagtaaatacctctttagtattcagtggtcttcttttcaggctaattagtggattaagcaataatgaaagcactaagtttggttttgcttttgtgagatggtcagctttggtgctctccacaacatgtgtgttctgacatgtttctaatatgtggccagggcgttcagatttccagttttgaaaacaattgtatagatttcacaacacaaaaaggacatttgtggatgttactgcacattttaaattcttaacactaatttatctgtataagtgttttatatgcatatttttggacataaacagtttatgtaaaattagtaatgaatgatggcaacgagggcactgttatcttcgtttgttttcaatgatcatttagcattcaatgatggaacagctggtataacataagttgttggcatgaaatatttgagattggaaacttcttgccttgaacagaacttatatcttagattctctctcacattttcttggagctggggtttgaataggaaccagatgatgttcactgctgaaattccataatgcttcccattgaagggaagttgagaaccaggaaagctgctttcacgtcattgccatccagtactgacagggaagaaagatgtagttttccagtagtgatgaatcaaattattgaattaaatttcttcttaagaagtaaaaactcagaatgtaccatcttgtttcctttcagtttattaaatggcatcataaagatgactttgctaagttaatagagttaaaaatttttttaatataagccaaaatattaactttaatgaaacattgacttggcaaatgaatttcctataaattatcattggtcagaatgctgttttgtttaataatattacgcaacataaaccataggtgttattagaagtggagaactgcctttttcatctggggcttttaaggacttgctataaatgattattttttaaatgctttataaatcttcatggtttttctatttctgatacactcagctatagttaataccagagtatcctaccaggagtaatatttggaatatttaaatctagtaaaagaagaaagttgtacttcctggctgggagtattaggagatgggagtagagattcacttttaagttcttgaaaatatatgcattctcctaaatattaacaaaaatgatttggggaaatgacatggcttgattgttctgtttaaatttgtactgtggcttatgttacacatgttcatgttcacctctcattcacctgttttatatggtttaaaattctctttaacaaaattcagaaaattcacctgaaacgtattttgacctaaaagaaacatatttttgtatcagtattgaattttggacagtgcccccatataaggaagttactgttttaaaataaagcaaactaactgttttattttccttgg

SEQ ID NO: 154301 - DNA, 798 bp, Homo sapiens
  Payload ID: 10321
  Gene Symbol: MTFR1
  Gene Name: mitochondrial fission regulator 1
  ENST ID: ENST00000521247
  CDS Start-End: 1-435
ccacaccctccacctcccccaccgcccctgcctccccctgcactggggctccaccaaagtacatctgctgttgatctgattaaagaacgaagagagaaaagagccaatgctggaaagactttggttaagaacaatccaaagaaacctgaaatgccaaatatgctagagatccttaaagagatgaacagtgtaaaacttcggtcagtgaagaggtcagagcaagatgtgaagcccaagccagtggatgctactgaccctgctgccctcatagcagaggctctgaaaaagaaatttgcttatcggtatcgaagtgatagccaagatgaagttgaaaaaggaattccaaagtctgaatcagaggccacctcagagagagtgttgtcccttccagctggctttattcagccccacgtgtccaagcattgtctgggatagccttgtattggaaaacctggcccattctgtaaataaaggctccactagaaaagactcgttaaagtcagaacctgctggacaagaaggcctatggcaaatcctactgaagataaatttataagccttaagagaataaggactatgacaaaaacaatccaaaccacaataattcatggtaggaaatattgtggcatctacataataaaatggttgaggtccttcttttgttaattttgaggcctataattgctccttaactggtcaggtatcttagatatcagctggctcacaggagaatgtatcttcataatataaacccaaacgttgcttataataaactgtacatataaaaaatcttaaaag

SEQ ID NO: 154302 - DNA, 576 bp, Homo sapiens
  Payload ID: 10321
  Gene Symbol: MTFR1
  Gene Name: mitochondrial fission regulator 1
  ENST ID: ENST00000523222
  CDS Start-End: 132-302
aagctagaagcctgaggagccggagagggtgctggctgccgcgcggccgagtgtgttttatggaccatgtgctgctatgtatgcctgaagaagtacttgaaatgcaaatttggggagactttgccatataaatgcttggctggattaagcgcctaattaggatggtttttcaacaagttggagtaagcatgcaatcggtactttggtctaggaagccatatggttcgtctcgaagtatcgtaaggaaaattggtactaatttgtctctgattcagtgtccaagagttcagtttcagctgtagtaggacaggaccttgctgggaaccttcaattaacagccatgcaacagaatggagtcccagccacccaggagaggatgcagtggcgtcttttgctgatgttggatgggtagccaaagaagaaggagagtgttcagcaagactaaggacagaggtcagatcaaggccaccccttcaggatgaccttcttttctttgagaaggccccaagcagacagatttccttaccagacttgtctcaagaagagcctcagctgaagaccccagcgctggcaaat

SEQ ID NO: 154303 - DNA, 2393 bp, Homo sapiens
  Payload ID: 10321
  Gene Symbol: MTFR1
  Gene Name: mitochondrial fission regulator 1
  ENST ID: ENST00000518800
  CDS Start-End: 1-875
ggatggtttttcaacaagttggagtaagcatgcaatcgattaacagccatgcaacagaatggagtcccagccacccaggagaggatgcagtggcgtcttttgctgatgttggatgggtagccaaagaagaaggagagtgttcagcaagactaaggacagaggtcagatcaaggccaccccttcaggatgaccttcttttctttgagaaggccccaagcagacagatttccttaccagacttgtctcaagaagagcctcagctgaagaccccagcgctggcaaatgaggaagcactgcagaagatttgcgctctcgaaaatgaacttgctgctctcagagctcagattgccaaaattgtgacccagcaggagcagcaaaatctcactgcaggtgacttagattctaccacatttggtaccataccaccacaccctccacctcccccaccgcccctgcctccccctgcactggggctccaccaaagtacatctgctgttgatctgattaaagaacgaagagagaaaagagccaatgctggaaagactttggttaagaacaatccaaagaaacctgaaatgccaaatatgctagagatccttaaagagatgaacagtgtaaaacttcggtcagtgaagaggtcagagcaagatgtgaagcccaagccagtggatgctactgaccctgctgccctcatagcagaggctctgaaaaagaaatttgcttatcggtatcgaagtgatagccaagatgaagttgaaaaaggaattccaaagtctgaatcagaggccacctcagagagagtgttgtttgggccacacatgttgaagccaacaggaaaaatgaaggctttaattgaaaatgtatcagactcctaatagacaatgagctgcgaaaagactcctggttcccctgttgatttgtgagggccaagtttgctagtagaaatcgacactgtttagtaaatacctctttagtattcagtggtcttcttttcaggctaattagtggattaagcaataatgaaagcactaagtttggttttgcttttgtgagatggtcagctttggtgctctccacaacatgtgtgttctgacatgtttctaatatgtggccagggcgttcagatttccagttttgaaaacaattgtatagatttcacaacacaaaaaggacatttgtggatgttactgcacattttaaattcttaacactaatttatctgtataagtgttttatatgcatatttttggacataaacagtttatgtaaaattagtaatgaatgatggcaacgagggcactgttatcttcgtttgttttcaatgatcatttagcattcaatgatggaacagctggtataacataagttgttggcatgaaatatttgagattggaaacttcttgccttgaacagaacttatatcttagattctctctcacattttcttggagctggggtttgaataggaaccagatgatgttcactgctgaaattccataatgcttcccattgaagggaagttgagaaccaggaaagctgctttcacgtcattgccatccagtactgacagggaagaaagatgtagttttccagtagtgatgaatcaaattattgaattaaatttcttcttaagaagtaaaaactcagaatgtaccatcttgtttcctttcagtttattaaatggcatcataaagatgactttgctaagttaatagagttaaaaatttttttaatataagccaaaatattaactttaatgaaacattgacttggcaaatgaatttcctataaattatcattggtcagaatgctgttttgtttaataatattacgcaacataaaccataggtgttattagaagtggagaactgcctttttcatctggggcttttaaggacttgctataaatgattattttttaaatgctttataaatcttcatggtttttctatttctgatacactcagctatagttaataccagagtatcctaccaggagtaatatttggaatatttaaatctagtaaaagaagaaagttgtacttcctggctgggagtattaggagatgggagtagagattcacttttaagttcttgaaaatatatgcattctcctaaatattaacaaaaatgatttggggaaatgacatggcttgattgttctgtttaaatttgtactgtggcttatgttacacatgttcatgttcacctctcattcacctgttttatatggtttaaaattctctttaacaaaattcagaaaattcacctgaaacgtattttgacctaaaagaaacatatttttgtatcagtattgaattttggacagtgcccccatataaggaagttactgttttaaaataaagcaaactaactgttttattttccttgga

SEQ ID NO: 154304 - DNA, 679 bp, Homo sapiens
  Payload ID: 10321
  Gene Symbol: MTFR1
  Gene Name: mitochondrial fission regulator 1
  ENST ID: ENST00000527155
  CDS Start-End: 1-556
tccacctcccccaccgcccctgcctccccctgcactggggctccaccaaagtacatctgctgttgatctgattaaagaacgaagagagaaaagagccaatgctggaaagactttggttaagaacaatccaaagaaacctgaaatgccaaatatgctagagatccttaaagagatgaacagtgtaaaacttcggtcagtgaagaggtcagagcaagatgtgaagcccaagccagtggatgctactgaccctgctgccctcatagcagaggctctgaaaaagaaatttgcttatcggtatcgaagtgatagccaagatgaagttgaaaaaggaattccaaagtctgaatcagaggccacctcagagagagtgttgaaaagactcgttaaagtcagaacctgctggacaagaaggcctatggcaaatcctactgaagataaatttataagccttaagagaataaggactatgacaaaaacaatccaaaccacaataattcatggtaggaaatattgtggcatctacataataaaatggttgaggtccttcttttgttaattttgaggcctataattgctccttaactggtcaggtatcttagatatcagctggctcacaggagaatgtatcttcataatataaacccaaacgttgcttataataaactgtacatataaaaaa

SEQ ID NO: 154305 - DNA, 2053 bp, Homo sapiens
  Payload ID: 10322
  Gene Symbol: MTFR1L
  Gene Name: mitochondrial fission regulator 1-like
  Uniprot ID: Q9H019
  ENST ID: ENST00000374300
  CDS Start-End: 263-1141
cagttatctagttcctctcgcgaggactccgagggacaggcagggtgctgcggagcgcacaggaaaggacctgaccctgtcgcagggaaggaaggtgatgcttaagctgagctctgaggaatgatgaagaatgagctcggcgaagggggtgctggtgtttgatgcagggctcagagatggcctgatatgaaggagtcacgcctcccgcctcccggagctgcccagtggctgccttgtccttcaagtgcaggagctggttcaaatgtcaggaatggaagccactgtgaccatcccaatctggcaaaacaagccacatggggctgctcgaagtgtagtaagaagaattgggaccaacctacccttgaagccgtgtgcccgggcgtcctttgagaccctgcccaacatctctgacctgtgtttgagagatgtgcccccagtccctaccctggctgacatcgcctggattgctgcggatgaagaggagacatatgcccgggtcaggagtgatacgcgccccctgaggcacacctggaaacccagccctctgattgtcatgcagcgcaatgcctctgttcccaacctgcgtgggtccgaggagaggcttctggccctgaagaagccagctctgccagccctaagccgcactactgagctgcaggacgagctgagccacttgcgcagccagattgcaaagatagtggcagctgatgcagcttcggcttcattaacgccagatttcttatctccaggaagttcaaatgtctcttctcccttaccttgttttggatcctcattccactctacaacttcctttgtcattagtgacatcaccgaggagacagaggtggaggtccctgagcttccatcagtccccctgctttgttctgccagccctgaatgttgcaaaccagaacacaaagctgcctgcagttcgtctgaagaggatgactgcgtctctttgtccaaggccagcagctttgcagacatgatgggtatcctgaaggactttcaccgaatgaaacagagtcaagatctgaaccggagtttattgaaggaggaagaccctgctgtgcttatctctgaggtcctaaggaggaagtttgctctaaaggaagaagatatcagtagaaaaggaaattgacaaccctcagctctgcaaactcagtctcatgctcctggaataccttcaatagctgccttcctcaccgcagatgtttctgcctcttaaggatagatcttctgcaacagtcttgctgacaagctagagcttggactgaaagagaagagctggattatatatttcccagacttcaaaccctagcagaagctaaggcttgtgatttgacctgagacatttgtttcaggtaatcgtgtagaatgaagtatcttagtttaaagggtaagagagaagttgtttctggtttttccttgcccctgtgtgaaaataggtcctaaatgactgacttcactgcattagaccctatagctggtctcacaagacactttgtgcccagctgtcactcactcagcagcttccttgcagcagagcagggctgaggggaaggggctatgaatgtttgtatacatgttcacagggcacggaaaatcttatgctgctccgtcataaacctacaccaatgcccagcaatcaccctcctcacttccttgtctagatgtagaggtcaggctgctgaaccagccaacacatgggctactgctgggaagcctgggctgttttttttcttaaacacattttatattactgaacaaccaaatctaccctccacggccctgaggccttatcagttccactgattaaaaactttctcttccacggactttaagcccggtaggaaagagagaggaggagggggaaagagcaaaccatctttcttccaggcccttgactgctcctttgggctgggccaaggtttgtatgtaccacaccatgcatgactcagatgccctcaggtccctttctctatggtatgtatactgcttgtgtttgggttgaagcactacctgacattaaaggaaggacttggagagagaa

SEQ ID NO: 154306 - DNA, 2099 bp, Homo sapiens
  Payload ID: 10322
  Gene Symbol: MTFR1L
  Gene Name: mitochondrial fission regulator 1-like
  Uniprot ID: Q9H019
  ENST ID: ENST00000374301
  CDS Start-End: 309-1187
gagtccccgaagggtagttgctcgtcggagttccccagcaaacagtgaccaagccagacctcaggcttctagtttcggcttcgctgcttgacgggccgggctgccccgccgcgcattctgagacctggccgcggctcggaggcttccgcgcactcgggtccgggtcctgtgggtccaagggccgctgggcaggcggcgagcacttggccgaccttggcccagatggcctgatatgaaggagtcacgcctcccgcctcccggagctgcccagtggctgccttgtccttcaagtgcaggagctggttcaaatgtcaggaatggaagccactgtgaccatcccaatctggcaaaacaagccacatggggctgctcgaagtgtagtaagaagaattgggaccaacctacccttgaagccgtgtgcccgggcgtcctttgagaccctgcccaacatctctgacctgtgtttgagagatgtgcccccagtccctaccctggctgacatcgcctggattgctgcggatgaagaggagacatatgcccgggtcaggagtgatacgcgccccctgaggcacacctggaaacccagccctctgattgtcatgcagcgcaatgcctctgttcccaacctgcgtgggtccgaggagaggcttctggccctgaagaagccagctctgccagccctaagccgcactactgagctgcaggacgagctgagccacttgcgcagccagattgcaaagatagtggcagctgatgcagcttcggcttcattaacgccagatttcttatctccaggaagttcaaatgtctcttctcccttaccttgttttggatcctcattccactctacaacttcctttgtcattagtgacatcaccgaggagacagaggtggaggtccctgagcttccatcagtccccctgctttgttctgccagccctgaatgttgcaaaccagaacacaaagctgcctgcagttcgtctgaagaggatgactgcgtctctttgtccaaggccagcagctttgcagacatgatgggtatcctgaaggactttcaccgaatgaaacagagtcaagatctgaaccggagtttattgaaggaggaagaccctgctgtgcttatctctgaggtcctaaggaggaagtttgctctaaaggaagaagatatcagtagaaaaggaaattgacaaccctcagctctgcaaactcagtctcatgctcctggaataccttcaatagctgccttcctcaccgcagatgtttctgcctcttaaggatagatcttctgcaacagtcttgctgacaagctagagcttggactgaaagagaagagctggattatatatttcccagacttcaaaccctagcagaagctaaggcttgtgatttgacctgagacatttgtttcaggtaatcgtgtagaatgaagtatcttagtttaaagggtaagagagaagttgtttctggtttttccttgcccctgtgtgaaaataggtcctaaatgactgacttcactgcattagaccctatagctggtctcacaagacactttgtgcccagctgtcactcactcagcagcttccttgcagcagagcagggctgaggggaaggggctatgaatgtttgtatacatgttcacagggcacggaaaatcttatgctgctccgtcataaacctacaccaatgcccagcaatcaccctcctcacttccttgtctagatgtagaggtcaggctgctgaaccagccaacacatgggctactgctgggaagcctgggctgttttttttcttaaacacattttatattactgaacaaccaaatctaccctccacggccctgaggccttatcagttccactgattaaaaactttctcttccacggactttaagcccggtaggaaagagagaggaggagggggaaagagcaaaccatctttcttccaggcccttgactgctcctttgggctgggccaaggtttgtatgtaccacaccatgcatgactcagatgccctcaggtccctttctctatggtatgtatactgcttgtgtttgggttgaagcactacctgacattaaaggaaggacttggagagagaa

SEQ ID NO: 154307 - DNA, 2004 bp, Homo sapiens
  Payload ID: 10322
  Gene Symbol: MTFR1L
  Gene Name: mitochondrial fission regulator 1-like
  Uniprot ID: Q9H019
  ENST ID: ENST00000374303
  CDS Start-End: 211-1089
gtgcgcagctgcggaggatcgcttccggggggcgggtcagcggaagtgagggcggttgaggctgggcggcccaaggtggaaggaggggccgtgaggtgagagagtccgggagcccgagcttgagatggcctgatatgaaggagtcacgcctcccgcctcccggagctgcccagtggctgccttgtccttcaagtgcaggagctggttcaaatgtcaggaatggaagccactgtgaccatcccaatctggcaaaacaagccacatggggctgctcgaagtgtagtaagaagaattgggaccaacctacccttgaagccgtgtgcccgggcgtcctttgagaccctgcccaacatctctgacctgtgtttgagagatgtgcccccagtccctaccctggctgacatcgcctggattgctgcggatgaagaggagacatatgcccgggtcaggagtgatacgcgccccctgaggcacacctggaaacccagccctctgattgtcatgcagcgcaatgcctctgttcccaacctgcgtgggtccgaggagaggcttctggccctgaagaagccagctctgccagccctaagccgcactactgagctgcaggacgagctgagccacttgcgcagccagattgcaaagatagtggcagctgatgcagcttcggcttcattaacgccagatttcttatctccaggaagttcaaatgtctcttctcccttaccttgttttggatcctcattccactctacaacttcctttgtcattagtgacatcaccgaggagacagaggtggaggtccctgagcttccatcagtccccctgctttgttctgccagccctgaatgttgcaaaccagaacacaaagctgcctgcagttcgtctgaagaggatgactgcgtctctttgtccaaggccagcagctttgcagacatgatgggtatcctgaaggactttcaccgaatgaaacagagtcaagatctgaaccggagtttattgaaggaggaagaccctgctgtgcttatctctgaggtcctaaggaggaagtttgctctaaaggaagaagatatcagtagaaaaggaaattgacaaccctcagctctgcaaactcagtctcatgctcctggaataccttcaatagctgccttcctcaccgcagatgtttctgcctcttaaggatagatcttctgcaacagtcttgctgacaagctagagcttggactgaaagagaagagctggattatatatttcccagacttcaaaccctagcagaagctaaggcttgtgatttgacctgagacatttgtttcaggtaatcgtgtagaatgaagtatcttagtttaaagggtaagagagaagttgtttctggtttttccttgcccctgtgtgaaaataggtcctaaatgactgacttcactgcattagaccctatagctggtctcacaagacactttgtgcccagctgtcactcactcagcagcttccttgcagcagagcagggctgaggggaaggggctatgaatgtttgtatacatgttcacagggcacggaaaatcttatgctgctccgtcataaacctacaccaatgcccagcaatcaccctcctcacttccttgtctagatgtagaggtcaggctgctgaaccagccaacacatgggctactgctgggaagcctgggctgttttttttcttaaacacattttatattactgaacaaccaaatctaccctccacggccctgaggccttatcagttccactgattaaaaactttctcttccacggactttaagcccggtaggaaagagagaggaggagggggaaagagcaaaccatctttcttccaggcccttgactgctcctttgggctgggccaaggtttgtatgtaccacaccatgcatgactcagatgccctcaggtccctttctctatggtatgtatactgcttgtgtttgggttgaagcactacctgacattaaaggaaggacttggagagagaatgc

SEQ ID NO: 154308 - DNA, 1868 bp, Homo sapiens
  Payload ID: 10322
  Gene Symbol: MTFR1L
  Gene Name: mitochondrial fission regulator 1-like
  Uniprot ID: Q9H019
  ENST ID: ENST00000374307
  CDS Start-End: 114-956
gagagagtccgggagcccgagcttgagatggcctgatatgaaggagtcacgcctcccgcctcccggagctgcccagtggctgccttgtccttcaagtgcaggagctggttcaaatgtcaggaatggaagccactgtgaccatcccaatctggcaaaacaagccacatggggctgctcgaagtgtagtaagaagaattgggaccaacctacccttgaagccgtgtgcccgggcgtcctttgagaccctgcccaacatctctgacctgtgtttgagagatgtgcccccagtccctaccctggctgacatcgcctggattgctgcggatgaagaggagacatatgcccgggtcaggagtgatacgcgccccctgaggcacacctggaaacccagccctctgattgtcatgcagcgcaatgcctctgttcccaacctgcgtgggtccgaggagaggcttctggccctgaagaagccagctctgccagccctaagccgcactactgagctgcaggacgagctgagccacttgcgcagccagattgcaaagatagtggcagctgatgcaggaagttcaaatgtctcttctcccttaccttgttttggatcctcattccactctacaacttcctttgtcattagtgacatcaccgaggagacagaggtggaggtccctgagcttccatcagtccccctgctttgttctgccagccctgaatgttgcaaaccagaacacaaagctgcctgcagttcgtctgaagaggatgactgcgtctctttgtccaaggccagcagctttgcagacatgatgggtatcctgaaggactttcaccgaatgaaacagagtcaagatctgaaccggagtttattgaaggaggaagaccctgctgtgcttatctctgaggtcctaaggaggaagtttgctctaaaggaagaagatatcagtagaaaaggaaattgacaaccctcagctctgcaaactcagtctcatgctcctggaataccttcaatagctgccttcctcaccgcagatgtttctgcctcttaaggatagatcttctgcaacagtcttgctgacaagctagagcttggactgaaagagaagagctggattatatatttcccagacttcaaaccctagcagaagctaaggcttgtgatttgacctgagacatttgtttcaggtaatcgtgtagaatgaagtatcttagtttaaagggtaagagagaagttgtttctggtttttccttgcccctgtgtgaaaataggtcctaaatgactgacttcactgcattagaccctatagctggtctcacaagacactttgtgcccagctgtcactcactcagcagcttccttgcagcagagcagggctgaggggaaggggctatgaatgtttgtatacatgttcacagggcacggaaaatcttatgctgctccgtcataaacctacaccaatgcccagcaatcaccctcctcacttccttgtctagatgtagaggtcaggctgctgaaccagccaacacatgggctactgctgggaagcctgggctgttttttttcttaaacacattttatattactgaacaaccaaatctaccctccacggccctgaggccttatcagttccactgattaaaaactttctcttccacggactttaagcccggtaggaaagagagaggaggagggggaaagagcaaaccatctttcttccaggcccttgactgctcctttgggctgggccaaggtttgtatgtaccacaccatgcatgactcagatgccctcaggtccctttctctatggtatgtatactgcttgtgtttgggttgaagcactacctgacattaaaggaaggacttggagagagaa

SEQ ID NO: 154309 - DNA, 756 bp, Homo sapiens
  Payload ID: 10322
  Gene Symbol: MTFR1L
  Gene Name: mitochondrial fission regulator 1-like
  ENST ID: ENST00000424294
  CDS Start-End: 300-756
tggaagagctgtggggcataaaccacactgcagagctgaactggccttttggaccttttatcagtcattggcttgggaggtgaaggaaattcccaggtagggagctccgttcttcctgcaaggggatctgagtgggacaccaaatcagcatctacacccaggacagacagccagcgtggacttgcatgatccgccatcgcacaggagggaaagatggcctgatatgaaggagtcacgcctcccgcctcccggagctgcccagtggctgccttgtccttcaagtgcaggagctggttcaaatgtcaggaatggaagccactgtgaccatcccaatctggcaaaacaagccacatggggctgctcgaagtgtagtaagaagaattgggaccaacctacccttgaagccgtgtgcccgggcgtcctttgagaccctgcccaacatctctgacctgtgtttgagagatgtgcccccagtccctaccctggctgacatcgcctggattgctgcggatgaagaggagacatatgcccgggtcaggagtgatacgcgccccctgaggcacacctggaaacccagccctctgattgtcatgcagcgcaatgcctctgttcccaacctgcgtgggtccgaggagaggcttctggccctgaagaagccagctctgccagccctaagccgcactactgagctgcaggacgagctgagccacttgcgcagccagattgcaaagatagtggcagctgatgcagcttcgg

SEQ ID NO: 154310 - DNA, 815 bp, Homo sapiens
  Payload ID: 10322
  Gene Symbol: MTFR1L
  Gene Name: mitochondrial fission regulator 1-like
  ENST ID: ENST00000526158
  CDS Start-End: 304-815
gactcgccctggcgggtccccgcggggagagggtccgcgcgggtctccggccactgctgcgcgcggcaaagtttcactgagcgcggcggcctccgtgggggcccccgggaccaggggtgctgagcagggccctgcgctggaggagctcccgttctcctgaggggacgcctgtcagcagacagcaactgcagcctccggagggctgcggggcgcagagatggcctgatatgaaggagtcacgcctcccgcctcccggagctgcccagtggctgccttgtccttcaagtgcaggagctggttcaaatgtcaggaatggaagccactgtgaccatcccaatctggcaaaacaagccacatggggctgctcgaagtgtagtaagaagaattgggaccaacctacccttgaagccgtgtgcccgggcgtcctttgagaccctgcccaacatctctgacctgtgtttgagagatgtgcccccagtccctaccctggctgacatcgcctggattgctgcggatgaagaggagacatatgcccgggtcaggagtgatacgcgccccctgaggcacacctggaaacccagccctctgattgtcatgcagcgcaatgcctctgttcccaacctgcgtgggtccgaggagaggcttctggccctgaagaagccagctctgccagccctaagccgcactactgagctgcaggacgagctgagccacttgcgcagccagattgcaaagatagtggcagctgatgcagcttcggcttcattaacgccagatttcttatctccaggaagttcaaatgtctcttctccctt

SEQ ID NO: 154311 - DNA, 763 bp, Homo sapiens
  Payload ID: 10322
  Gene Symbol: MTFR1L
  Gene Name: mitochondrial fission regulator 1-like
  ENST ID: ENST00000530599
  CDS Start-End: 247-405
gtttagttcagcgcgttgaagcgctcactgtgtcctaggcagacaccgtgctgtgcgcggggatcacagttatctagttcctctcgcgaggactccgagggacaggcagggtgctgcggagcgcacaggaaaggacctgaccctgtcgcagggaaggaagatggcctgatatgaaggagtcacgcctcccgcctcccggagctgcccagtggctgccttgtccttcaagtgcaggagctggttcaaatgtcaggaatggaagccactgtgaggcctggaattggagcaaggccaccgtttcactccctccccctaagaagaaccaactatgatcctggggcacttcaggagtcagtaccatcccaatctggcaaaacaagccacatggggctgctcgaagtgtagtaagaagaattgggaccaacctacccttgaagccgtgtgcccgggcgtcctttgagaccctgcccaacatctctgacctgtgtttgagagatgtgcccccagtccctaccctggctgacatcgcctggattgctgcggatgaagaggagacatatgcccgggtcaggagtgatacgcgccccctgaggcacacctggaaacccagccctctgattgtcatgcagcgcaatgcctctgttcccaacctgcgtgggtccgaggagaggcttctggccctgaagaagccagctctgccagccctaagccgcactactgagctgcaggacgagctgagccacttgcgcagccagattgcaaa

SEQ ID NO: 154312 - DNA, 733 bp, Homo sapiens
  Payload ID: 10322
  Gene Symbol: MTFR1L
  Gene Name: mitochondrial fission regulator 1-like
  ENST ID: ENST00000526894
  CDS Start-End: 138-686
aggtggaaggaggggccgtgaggtgagagagtccgggagcccgagcttgagatggcctgatatgaaggagtcacgcctcccgcctcccggagctgcccagtggctgccttgtccttcaagtgcaggagctggttcaaatgtcaggaatggaagccactgtgaccatcccaatctggcaaaacaagccacatggggctgctcgaagtgtagtaagaagaattgggaccaacctacccttgaagccgtgtgcccgggcgtcctttgagaccctgcccaacatctctgacctgtgtttgagagatgtgcccccagtccctaccctggctgacatcgcctggattgctgcggatgaagaggagacatatgcccgggtcaggagtgatacgcgccccctgaggcacacctggaaacccagccctctgattgtcatgcagcgcaatgcctctgttcccaacctgcgtgggtccgaggagaggcttctggccctgaagaagccagctctgccagccctaagccgcactactgagctgcaggacgagctgagccacttgcgcagccagattgcaaagatagtggcagctgatgcagccctgaatgttgcaaaccagaacacaaagctgcctgcagttcgtctgaagaggatgactgcgtctctttgtccaaggccagcagctttgcagacatgatgggtatcctgaaggactttcaccgaatgaaacagagtcaagatctg

SEQ ID NO: 154313 - DNA, 838 bp, Homo sapiens
  Payload ID: 10322
  Gene Symbol: MTFR1L
  Gene Name: mitochondrial fission regulator 1-like
  ENST ID: ENST00000472643
  CDS Start-End: 358-838
ggtcagcggaagtgagggcggttgaggctgggcggcccaaggtggaaggaggggccgtgaggtgagagagtccgggagcccgagcttgagaccatcccaatctggcaaaacaagccacatggggctgctcgaagtgtagtaagaagaattgggaccaacctacccttgaagccgtgtgcccgggcgtcctttgagaccctgcccaacatctctgacctgtgtttgagagatgtgcccccagtccctaccctggctgacatcgcctggattgctgcggatgaagaggagacatatgcccgggtcaggagtgatacgcgccccctgaggcacacctggaaacccagccctctgattgtcatgcagcgcaatgcctctgttcccaacctgcgtgggtccgaggagaggcttctggccctgaagaagccagctctgccagccctaagccgcactactgagctgcaggacgagctgagccacttgcgcagccagattgcaaagatagtggcagctgatgcagcttcggcttcattaacgccagatttcttatctccaggaagttcaaatgtctcttctcccttaccttgttttggatcctcattccactctacaacttcctttgtcattagtgacatcaccgaggagacagaggtggaggtccctgagcttccatcagtccccctgctttgttctgccagccctgaatgttgcaaaccagaacacaaagctgcctgcagttcgtctgaagaggatgactgcgtctctttgtccaaggccagcagctttgcagacatgatgggtatcctgaaggactttcaccgaatgaaacagagtcaagatc

SEQ ID NO: 154314 - DNA, 555 bp, Homo sapiens
  Payload ID: 10322
  Gene Symbol: MTFR1L
  Gene Name: mitochondrial fission regulator 1-like
  ENST ID: ENST00000529116
  CDS Start-End: 211-555
tccggggggcgggtcagcggaagtgagggcggttgaggctgggcggcccaaggtggaaggaggggccgtgaggtgagagagtccgggagcccgagcttgagagggaaatctggtgctcctccagatggcctgatatgaaggagtcacgcctcccgcctcccggagctgcccagtggctgccttgtccttcaagtgcaggagctggttcaaatgtcaggaatggaagccactgtgaccatcccaatctggcaaaacaagccacatggggctgctcgaagtgtagtaagaagaattgggaccaacctacccttgaagccgtgtgcccgggcgtcctttgagaccctgcccaacatctctgacctgtgtttgagagatgtgcccccagtccctaccctggctgacatcgcctggattgctgcggatgaagaggagacatatgcccgggtcaggagtgatacgcgccccctgaggcacacctggaaacccagccctctgattgtcatgcagcgcaatgcctctgttcccaacctgcgtgggtccgaggagaggcttctg

SEQ ID NO: 154315 - DNA, 575 bp, Homo sapiens
  Payload ID: 10322
  Gene Symbol: MTFR1L
  Gene Name: mitochondrial fission regulator 1-like
  ENST ID: ENST00000525713
  CDS Start-End: 244-575
gagtccccgaagggtagttgctcgtcggagttccccagcaaacagtgaccaagccagacctcaggcttctagtttcggcttcgctgcttgacgggccgggctgccccgccgcgcattctgagacctggccgcggctcggaggcttccgcgcactcggatggcctgatatgaaggagtcacgcctcccgcctcccggagctgcccagtggctgccttgtccttcaagtgcaggagctggttcaaatgtcaggaatggaagccactgtgaccatcccaatctggcaaaacaagccacatggggctgctcgaagtgtagtaagaagaattgggaccaacctacccttgaagccgtgtgcccgggcgtcctttgagaccctgcccaacatctctgacctgtgtttgagagatgtgcccccagtccctaccctggctgacatcgcctggattgctgcggatgaagaggagacatatgcccgggtcaggagtgatacgcgccccctgaggcacacctggaaacccagccctctgattgtcatgcagcgcaatgcctctgttcccaacctgcgtgggtccga

SEQ ID NO: 154316 - DNA, 562 bp, Homo sapiens
  Payload ID: 10322
  Gene Symbol: MTFR1L
  Gene Name: mitochondrial fission regulator 1-like
  ENST ID: ENST00000528624
  CDS Start-End: 249-407
aaactgagtccccgaagggtagttgctcgtcggagttccccagcaaacagtgaccaagccagacctcaggcttctagtttcggcttcgctgcttgacgggccgggctgccccgccgcgcattctgagacctggccgcggctcggaggcttccgcgcactcggatggcctgatatgaaggagtcacgcctcccgcctcccggagctgcccagtggctgccttgtccttcaagtgcaggagctggttcaaatgtcaggaatggaagccactgtgaggcctggaattggagcaaggccaccgtttcactccctccccctaagaagaaccaactatgatcctggggcacttcaggagtcagtaccatcccaatctggcaaaacaagccacatggggctgctcgaagtgtagtaagaagaattgggaccaacctacccttgaagccgtgtgcccgggcgtcctttgagaccctgcccaacatctctgacctgtgtttgagagatgtgcccccagtccctaccctggctgacatcgcctggattgctgcggatgaagaggagacatat

SEQ ID NO: 154317 - DNA, 3262 bp, Homo sapiens
  Payload ID: 10322
  Gene Symbol: MTFR1L
  Gene Name: mitochondrial fission regulator 1-like
  Uniprot ID: Q9H019
  ENST ID: ENST00000466284
  CDS Start-End: 1583-2200
gtgaatgacacctcgtctcccaagggtagaagaggggaccctccacaggaggtctccagaaagagctgctttgtcagtctagtctatctcccattcagagcctgtccagggctccccagtgacccggacctcatgacttgccccctacttttgtagctttatcatgctctgctcctctttccatgtccttcaccttcttgtgctggacctgtgctcttgctgttttgtcttcatttcctactccctcgcaacttactacagggcactagggccagagctctgacctcatctggccacctgcctaatgctactcagcctttgctagaagtatgtattcatgtcctatcactctgctggacagcgagttccttgagagcatgactgtgtcttactccttccatagcccctacggtgcccagcacaaggcctggcacaagtgggtactgttggtgtttgatgaacaagtgaatgaacgagcacactgattgcatctgctcaccatgcaaggactgctgtgaagagcagtcagatgtcacctcacccatctgtgtcatgttttaacagttcattaagcactcaaccccatttcactcattgacccttaaggtagcctccagtggcagcttttcctgtctcctttttccagatggaaaaaccaacattcagaaaagttaaataacttgcctgtagctacaaagccagaaggtggctgagccaggataaacttttttggctctttttctctgtagctcatgagactgagattggcatgagctggtgttcgttctcctattttctctgatctctccctttgcaagggcccagcagtgcttttacatctcatcttcaagaatgaatcctgggcttggatagtacttataatttggctagatgagctttgtagctaccaaggattctatttgcatctttagaagttttgcctcaagaaacctgagagcccaggaaggctcttgggttggccaagctcactaggcaaatcttttttttttttttttttttttgagacggagtctcgctctgtcacccaggttggagtgcagtggcgtgatctcggctcactgcaagctctgcctcctgggttcacgccattctcctgcctcagcctcccaagtagctggtactacaggtgcccgccaccacacctggctaattttttgtatttttagtagagacagggcttcactgtgttagccaggatggtctcgctctcctgacctcgtgatccgcccacctcggcctcccaaagtgctgggattacagatgtgagccactgcgcctggccgcagatctttaacagaacctttaagagtctggacttagagctaagtgttgggtgagggcagcctcttgggctggttttctcccctgtgaagtcatggctctgcagggcctggttttttggggcttgtgtggtgaccattaaatccccactgtggggggttgtttcacaagagggaaatctggtgctcctccagatggcctgatatgaaggagtcacgcctcccgcctcccggagctgcccagtggctgccttgtccttcaagtgcaggagctggttcaaatgtcaggaatggaagccactgtgaccatcccaatctggcaaaacaagccacatggggctgctcgaagtgtagtaagaagaattgggaccaacctacccttgaagccgtgtgcccgggcgtcctttgagaccctgcccaacatctctgacctgtgtttgagagatgtgcccccagtccctaccctggctgacatcgcctggattgctgcggatgaagaggagacatatgcccgggtcaggagtgatacgcgccccctgaggcacacctggaaacccagccctctgattgtcatgcagcgcaatgcctctgttcccaacctgcgtgggtccgaggagaggcttctggccctgaagaagccagctctgccagccctaagccgcactactgagctgcaggacgagctgagccacttgcgcagccagattgcaaagatagtggcagctgatgcagtgacatcaccgaggagacagaggtggaggtccctgagcttccatcagtccccctgctttgttctgccagccctgaatgttgcaaaccagaacacaaagctgcctgcagttcgtctgaagaggatgactgcgtctctttgtccaaggccagcagctttgcagacatgatgggtatcctgaaggactttcaccgaatgaaacagagtcaagatctgaaccggagtttattgaaggaggaagaccctgctgtgcttatctctgaggtcctaaggaggaagtttgctctaaaggaagaagatatcagtagaaaaggaaattgacaaccctcagctctgcaaactcagtctcatgctcctggaataccttcaatagctgccttcctcaccgcagatgtttctgcctcttaaggatagatcttctgcaacagtcttgctgacaagctagagcttggactgaaagagaagagctggattatatatttcccagacttcaaaccctagcagaagctaaggcttgtgatttgacctgagacatttgtttcaggtaatcgtgtagaatgaagtatcttagtttaaagggtaagagagaagttgtttctggtttttccttgcccctgtgtgaaaataggtcctaaatgactgacttcactgcattagaccctatagctggtctcacaagacactttgtgcccagctgtcactcactcagcagcttccttgcagcagagcagggctgaggggaaggggctatgaatgtttgtatacatgttcacagggcacggaaaatcttatgctgctccgtcataaacctacaccaatgcccagcaatcaccctcctcacttccttgtctagatgtagaggtcaggctgctgaaccagccaacacatgggctactgctgggaagcctgggctgttttttttcttaaacacattttatattactgaacaaccaaatctaccctccacggccctgaggccttatcagttccactgattaaaaactttctcttccacggactttaagcccggtaggaaagagagaggaggagggggaaagagcaaaccatctttcttccaggcccttgactgctcctttgggctgggccaaggtttgtatgtaccacaccatgcatgactcagatgccctcaggtccctttctctatggtatgtatactgcttgtgtttgggttgaagcactacctgacattaaaggaaggacttggagagag

SEQ ID NO: 154318 - DNA, 722 bp, Homo sapiens
  Payload ID: 10322
  Gene Symbol: MTFR1L
  Gene Name: mitochondrial fission regulator 1-like
  ENST ID: ENST00000533762
  CDS Start-End: 682-722
gcttccggggggcgggtcagcggaagtgagggcggttgaggctgggcggcccaaggtggaaggaggggccgtgaggtgagagagtccgggagcccgagcttgagatggcctgatatgaaggagtcacgcctcccgcctcccggagctgcccagtggctgccttgtccttcaagtgcaggagctggttcaaatgtcaggaatggaagccactgtggcctggaattggagcaaggccaccgtttcactccctccccctaagaagaaccaactatgatcctggggcacttcaggagtcagtgtatgtctgcctttctgtacagaggacgggaaggaaagcctggataatctctacactcagctacttcctctccccttccctgaccctcccaacattgactgccttagcagcagcagaccatcccaatctggcaaaacaagccacatggggctgctcgaagtgtagtaagaagaattgggaccaacctacccttgaagccgtgtgcccgggcgtcctttgagaccctgcccaacatctctgacctgtgtttgagagatgtgcccccagtccctaccctggctgacatcgcctggattgctgcggatgaagaggagacatatgcccgggtcaggagtgatacgcgccccctgaggcacacctggaaacccagccctctgattgtcatgcagcgcaatgcctctgttcccaacctgcgtgggtccga

SEQ ID NO: 154319 - DNA, 1217 bp, Homo sapiens
  Payload ID: 10322
  Gene Symbol: MTFR1L
  Gene Name: mitochondrial fission regulator 1-like
  ENST ID: ENST00000524618
  CDS Start-End: 445-1032
aggaggggccgtgaggtgagagagtccgggagcccgagcttgagatggcctgatatgaaggagtcacgcctcccgcctcccggagctgcccagtggctgccttgtccttcaagtgcaggagctggttcaaatgtcaggaatggaagccactgtgctgtctccgtctctttgctccagaccatcccaatctggcaaaacaagccacatggggctgctcgaagtgtagtaagaagaattgggaccaacctacccttgaagccgtgtgcccgggcgtcctttgagaccctgcccaacatctctgacctgtgtttgagagatgtgcccccagtccctaccctggctgacatcgcctggattgctgcggatgaagaggagacatatgcccgggtcaggagtgatacgcgccccctgaggcacacctggaaacccagccctctgattgtcatgcagcgcaatgcctctgttcccaacctgcgtgggtccgaggagaggcttctggccctgaagaagccagctctgccagccctaagccgcactactgagctgcaggacgagctgagccacttgcgcagccagattgcaaagatagtggcagctgatgcagcttcggcttcattaacgccagatttcttatctccaggaagttcaaatgtctcttctcccttaccttgttttggatcctcattccactctacaacttcctttgtcattagtgacatcaccgaggagacagaggtggaggtccctgagcttccatcagtccccctgctttgttctgccagccctgaatgttgcaaaccagaacacaaagctgcctgcagttcgtctgaagaggatgactgcgtctctttgtccaaggccagcagctttgcagacatgatgggtatcctgaaggactttcaccgaatgaaacagagtcaagatctgaaccggagtttattgaaggaggaagaccctgctgtgcttatctctgaggtcctaaggaggaagtttgctctaaaggaagaagatatcagtagaaaaggaaattgacaaccctcagctctgcaaactcagtctcatgctcctggaataccttcaatagctgccttcctcaccgcagatgtttctgcctcttaaggatagatcttctgcaacagtcttgctgacaagctagagcttggactgaaagagaagagctggattatatatttcccagacttcaaaccctagcagaa

SEQ ID NO: 154320 - DNA, 1873 bp, Homo sapiens
  Payload ID: 10322
  Gene Symbol: MTFR1L
  Gene Name: mitochondrial fission regulator 1-like
  Uniprot ID: Q9H019
  ENST ID: ENST00000474295
  CDS Start-End: 188-805
tccggggggcgggtcagcggaagtgagggcggttgaggctgggcggcccaaggtggaaggaggggccgtgaggtgagagagtccgggagcccgagcttgagatggcctgatatgaaggagtcacgcctcccgcctcccggagctgcccagtggctgccttgtccttcaagtgcaggagctggttcaaatgtcaggaatggaagccactgtgaccatcccaatctggcaaaacaagccacatggggctgctcgaagtgtagtaagaagaattgggaccaacctacccttgaagccgtgtgcccgggcgtcctttgagaccctgcccaacatctctgacctgtgtttgagagatgtgcccccagtccctaccctggctgacatcgcctggattgctgcggatgaagaggagacatatgcccgggtcaggagtgatacgcgccccctgaggcacacctggaaacccagccctctgattgtcatgcagcgcaatgcctctgttcccaacctgcgtgggtccgaggagaggcttctggccctgaagaagccagctctgccagccctaagccgcactactgagctgcaggacgagctgagccacttgcgcagccagattgcaaagatagtggcagctgatgcagtgacatcaccgaggagacagaggtggaggtccctgagcttccatcagtccccctgctttgttctgccagccctgaatgttgcaaaccagaacacaaagctgcctgcagttcgtctgaagaggatgactgcgtctctttgtccaaggccagcagctttgcagacatgatgggtatcctgaaggactttcaccgaatgaaacagagtcaagatctgaaccggagtttattgaaggaggaagaccctgctgtgcttatctctgaggtcctaaggaggaagtttgctctaaaggaagaagatatcagtagaaaaggaaattgacaaccctcagctctgcaaactcagtctcatgctcctggaataccttcaatagctgccttcctcaccgcagatgtttctgcctcttaaggatagatcttctgcaacagtcttgctgacaagctagagcttggactgaaagagaagagctggattatatatttcccagacttcaaaccctagcagaagctaaggcttgtgatttgacctgagacatttgtttcaggtaatcgtgtagaatgaagtatcttagtttaaagggtaagagagaagttgtttctggtttttccttgcccctgtgtgaaaataggtcctaaatgactgacttcactgcattagaccctatagctggtctcacaagacactttgtgcccagctgtcactcactcagcagcttccttgcagcagagcagggctgaggggaaggggctatgaatgtttgtatacatgttcacagggcacggaaaatcttatgctgctccgtcataaacctacaccaatgcccagcaatcaccctcctcacttccttgtctagatgtagaggtcaggctgctgaaccagccaacacatgggctactgctgggaagcctgggctgttttttttcttaaacacattttatattactgaacaaccaaatctaccctccacggccctgaggccttatcagttccactgattaaaaactttctcttccacggactttaagcccggtaggaaagagagaggaggagggggaaagagcaaaccatctttcttccaggcccttgactgctcctttgggctgggccaaggtttgtatgtaccacaccatgcatgactcagatgccctcaggtccctttctctatggtatgtatactgcttgtgtttgggttgaagcactacctgacattaaaggaaggacttggagagagaatgca

SEQ ID NO: 154321 - DNA, 793 bp, Homo sapiens
  Payload ID: 10322
  Gene Symbol: MTFR1L
  Gene Name: mitochondrial fission regulator 1-like
  ENST ID: ENST00000478284
  CDS Start-End: 136-357
gtggaaggaggggccgtgaggtgagagagtccgggagcccgagcttgagatggcctgatatgaaggagtcacgcctcccgcctcccggagctgcccagtggctgccttgtccttcaagtgcaggagctggttcaaatgtcaggaatggaagccactgtgaggacgggaaggaaagcctggataatctctacactcagctacttcctctccccttccctgaccctcccaacattgactgccttagcagcagcagaccatcccaatctggcaaaacaagccacatggggctgctcgaagtgtagtaagaagaattgggaccaacctacccttgaagccgtgtgcccgggcgtcctttgagaccctgcccaacatctctgacctgtgtttgagagatgtgcccccagtccctaccctggctgacatcgcctggattgctgcggatgaagaggagacatatgcccgggtcaggagtgatacgcgccccctgaggcacacctggaaacccagccctctgattgtcatgcagcgcaatgcctctgttcccaacctgcgtgggtccgaggagaggcttctggccctgaagaagccagctctgccagccctaagccgcactactgagctgcaggacgagctgagccacttgcgcagccagattgcaaagatagtggcagctgatgcagcttcggcttcattaacgccagatttcttatctccaggaagttcaaatgtctcttctcccttaccttgttttggatcctcattccactctacaacttcctttgtcattagtgac

SEQ ID NO: 154322 - DNA, 1201 bp, Homo sapiens
  Payload ID: 10322
  Gene Symbol: MTFR1L
  Gene Name: mitochondrial fission regulator 1-like
  ENST ID: ENST00000464008
  CDS Start-End: 515-673
aaacagtgaccaagccagacctcaggcttctagtttcggcttcgctgcttgacgggccgggctgccccgccgcgcattctgagacctggccgcggctcggaggcttccgcgcactcgggtccgggtcctgtgggtccaagggccgctgggcaggcggcgagcacttggccgaccttggcccaggtcgggtcgtctgccgcgggggaggggcgactcgccctggcgggtccccgcggggagagggtccgcgcgggtctccggccactgctgcgcgcggcaaagtttcactgagcgcggcggcctccgtgggggcccccgggaccaggggtgctgagcagggccctgcgctggaggagctcccgttctcctgaggggacgcctgtcagcagacagcaactgcagcctccggagggctgcggggcgcagagatggcctgatatgaaggagtcacgcctcccgcctcccggagctgcccagtggctgccttgtccttcaagtgcaggagctggttcaaatgtcaggaatggaagccactgtgaggcctggaattggagcaaggccaccgtttcactccctccccctaagaagaaccaactatgatcctggggcacttcaggagtcagtaccatcccaatctggcaaaacaagccacatggggctgctcgaagtgtagtaagaagaattgggaccaacctacccttgaagccgtgtgcccgggcgtcctttgagaccctgcccaacatctctgacctgtgtttgagagatgtgcccccagtccctaccctggctgacatcgcctggattgctgcggatgaagaggagacatatgcccgggtcaggagtgatacgcgccccctgaggcacacctggaaacccagccctctgattgtcatgcagcgcaatgcctctgttcccaacctgcgtgggtccgaggagaggcttctggccctgaagaagccagctctgccagccctaagccgcactactgagctgcaggacgagctgagccacttgcgcagccagattgcaaagatagtggcagctgatgcagcttcggcttcattaacgccagatttcttatctccaggaagttcaaatgtctcttctcccttaccttgttttggatcctcattccactctacaacttcctttgtcattagtgacatcaccgaggagacagaggtggaggtccctgagcttc

SEQ ID NO: 154323 - DNA, 541 bp, Homo sapiens
  Payload ID: 10322
  Gene Symbol: MTFR1L
  Gene Name: mitochondrial fission regulator 1-like
  ENST ID: ENST00000488327
  CDS Start-End: 382-541
gggtcagcggaagtgagggcggttgaggctgggcggcccaaggtggaaggaggggccgtgaggtgagagagtccgggagcccgagcttgagctgtctccgtctctttgctccagaccatcccaatctggcaaaacaagccacatggggctgctcgaagtgtagtaagaagaattgggaccaacctacccttgaagccgtgtgcccgggcgtcctttgagaccctgcccaacatctctgacctgtgtttgagagatgtgcccccagtccctaccctggctgacatcgcctggattgctgcggatgaagaggagacatatgcccgggtcaggagtgatacgcgccccctgaggcacacctggaaacccagccctctgattgtcatgcagcgcaatgcctctgttcccaacctgcgtgggtccgaggagaggcttctggccctgaagaagccagctctgccagccctaagccgcactactgagctgcaggacgagctgagccacttgcgcagccagattgcaaagatagtggcagctgatgcag

SEQ ID NO: 154324 - DNA, 1586 bp, Homo sapiens
  Payload ID: 10323
  Gene Symbol: MTFR2
  Gene Name: mitochondrial fission regulator 2
  Uniprot ID: Q6P444
  ENST ID: ENST00000367784
  CDS Start-End: 84-218
agtagcagtccggtcctagggactagcaggcaccaagaaactgataatgttcctttgaattggcttctgtatttgcttcatcaatgtctctcatactgaatatcttaagagagatgctggaatattttggcgttcctgtagaacagttagaagtaacttcagcatatttgtcatcactctggaagaaacagacaggaagaaatttaagatccacatgagagaggattgagcaccgcctttgagaaggttttgctgatttgggaaaataaagactatggatcaactaggagtattgttcgtattattgggaaaatgcttccactggaaccttgtcgaagacctaattttgagttgatcccgctcttgaactctgtagactctgataattgtggatctatggttccatcttttgctgatattttgtatgtggcaaatgatgaagaagccagttatctcagatttcgaaatagtatatggaaaaatgaagaagagaaagtggaaatttttcatcctttgcgactagttcgggatccactgtcacctgctgtaagacagaaagaaactgtgaaaaatgacctgcctgtaaatgaagctgcaattagaaaaatagctgcccttgaaaatgagctgacttttcttcgctctcagattgcagcaattgtggaaatgcaggaactgaaaaatagtacaaattctagttcctttggcttgagtgacgagcgcattagtttgggtcagctgtcatcatcgcgggctgcccatctgagtgtggacccagatcagcttccaggttcagtgctttctcctcctcctcctccaccacttcctcctcagttttcatctctccagccaccgtgttttcctcccgtacaaccaggatctaataatatttgtgactcagataatccagcaactgaaatgagcaaacagaacccggctgctaataagaccaattatagtcatcattcaaaaagccagagaaataaagatattccaaacatgttggacgttctaaaggatatgaataaggttaagcttcgtgcaattgagcggtcacctggcggtagacccattcataagaggaaaagacagaattcacattgggatccagtttctttaatatctcatgcacttaaacagaaatttgcatttcaagaagatgattcttttgagaaagagaatagatcttgggaatcttccccattttctagtccagaaacttcaaggtttggacatcacatttcacagtcagaaggacagcgaactaaagaagaaatggtcaacacaaaagctgttgaccaaggtatcagcaacacaagccttctaaactcaaggatttaaactcaacttaaggttgagctttaaacttccaaaacttcttcctggatgataaattattcttagaaactgatttggactgttaaaggctaaaagtagatgtatttaaagactcttcttgacacattttgcctacacttgctatgtaaatatgtatgcctgtcatttttgtttcctttgttcctttttacgtttatactctgttcttctgtacatagagcttaaaataaacattctttttgaacttg

SEQ ID NO: 154325 - DNA, 1793 bp, Homo sapiens
  Payload ID: 10323
  Gene Symbol: MTFR2
  Gene Name: mitochondrial fission regulator 2
  Uniprot ID: Q6P444
  ENST ID: ENST00000420702
  CDS Start-End: 391-1548
agcagtcctgtcatgcggaagtagcagtccggtcctagggactagcaggtgggttggttgggcgcaggaggacgggggcgcgcttcccataacattaccctggctgagcgtgaggctccagggctgggcaccgggttgacctcttattcctcgctgagggcatcgttaccgcctgtggctgcaagccgaggcgcgcgggtggaaactgggtcgaggtctgggtagacgtctgagcgatctgcacaaggagtggcgcagtctggaatttgattgaggattcctaacgccctccgcttgatgttctggtgattcccgggggctcggcttcggaggaaggcaccaagaaactgataatgttcctttgaattggcttctgtatttgcttcatcaatgtctctcatactgaatatcttaagagagatgctggaatattttggcgttcctgtagaacaggttttgctgatttgggaaaataaagactatggatcaactaggagtattgttcgtattattgggaaaatgcttccactggaaccttgtcgaagacctaattttgagttgatcccgctcttgaactctgtagactctgataattgtggatctatggttccatcttttgctgatattttgtatgtggcaaatgatgaagaagccagttatctcagatttcgaaatagtatatggaaaaatgaagaagagaaagtggaaatttttcatcctttgcgactagttcgggatccactgtcacctgctgtaagacagaaagaaactgtgaaaaatgacctgcctgtaaatgaagctgcaattagaaaaatagctgcccttgaaaatgagctgacttttcttcgctctcagattgcagcaattgtggaaatgcaggaactgaaaaatagtacaaattctagttcctttggcttgagtgacgagcgcattagtttgggtcagctgtcatcatcgcgggctgcccatctgagtgtggacccagatcagcttccaggttcagtgctttctcctcctcctcctccaccacttcctcctcagttttcatctctccagccaccgtgttttcctcccgtacaaccaggatctaataatatttgtgactcagataatccagcaactgaaatgagcaaacagaacccggctgctaataagaccaattatagtcatcattcaaaaagccagagaaataaagatattccaaacatgttggacgttctaaaggatatgaataaggttaagcttcgtgcaattgagcggtcacctggcggtagacccattcataagaggaaaagacagaattcacattgggatccagtttctttaatatctcatgcacttaaacagaaatttgcatttcaagaagatgattcttttgagaaagagaatagatcttgggaatcttccccattttctagtccagaaacttcaaggtttggacatcacatttcacagtcagaaggacagcgaactaaagaagaaatggtcaacacaaaagctgttgaccaaggtatcagcaacacaagccttctaaactcaaggatttaaactcaacttaaggttgagctttaaacttccaaaacttcttcctggatgataaattattcttagaaactgatttggactgttaaaggctaaaagtagatgtatttaaagactcttcttgacacattttgcctacacttgctatgtaaatatgtatgcctgtcatttttgtttcctttgttcctttttacgtttatactctgttcttctgtacatagagcttaaaataaacattctttttgaacttg

SEQ ID NO: 154326 - DNA, 1524 bp, Homo sapiens
  Payload ID: 10323
  Gene Symbol: MTFR2
  Gene Name: mitochondrial fission regulator 2
  Uniprot ID: Q6P444
  ENST ID: ENST00000451457
  CDS Start-End: 116-1273
gggatgcggaagtagcagtcctgtcatgcggaagtagcagtccggtcctagggactagcaggcaccaagaaactgataatgttcctttgaattggcttctgtatttgcttcatcaatgtctctcatactgaatatcttaagagagatgctggaatattttggcgttcctgtagaacaggttttgctgatttgggaaaataaagactatggatcaactaggagtattgttcgtattattgggaaaatgcttccactggaaccttgtcgaagacctaattttgagttgatcccgctcttgaactctgtagactctgataattgtggatctatggttccatcttttgctgatattttgtatgtggcaaatgatgaagaagccagttatctcagatttcgaaatagtatatggaaaaatgaagaagagaaagtggaaatttttcatcctttgcgactagttcgggatccactgtcacctgctgtaagacagaaagaaactgtgaaaaatgacctgcctgtaaatgaagctgcaattagaaaaatagctgcccttgaaaatgagctgacttttcttcgctctcagattgcagcaattgtggaaatgcaggaactgaaaaatagtacaaattctagttcctttggcttgagtgacgagcgcattagtttgggtcagctgtcatcatcgcgggctgcccatctgagtgtggacccagatcagcttccaggttcagtgctttctcctcctcctcctccaccacttcctcctcagttttcatctctccagccaccgtgttttcctcccgtacaaccaggatctaataatatttgtgactcagataatccagcaactgaaatgagcaaacagaacccggctgctaataagaccaattatagtcatcattcaaaaagccagagaaataaagatattccaaacatgttggacgttctaaaggatatgaataaggttaagcttcgtgcaattgagcggtcacctggcggtagacccattcataagaggaaaagacagaattcacattgggatccagtttctttaatatctcatgcacttaaacagaaatttgcatttcaagaagatgattcttttgagaaagagaatagatcttgggaatcttccccattttctagtccagaaacttcaaggtttggacatcacatttcacagtcagaaggacagcgaactaaagaagaaatggtcaacacaaaagctgttgaccaaggtatcagcaacacaagccttctaaactcaaggatttaaactcaacttaaggttgagctttaaacttccaaaacttcttcctggatgataaattattcttagaaactgatttggactgttaaaggctaaaagtagatgtatttaaagactcttcttgacacattttgcctacacttgctatgtaaatatgtatgcctgtcatttttgtttcctttgttcctttttacgtttatactctgttcttctgtacatagagcttaaaataaacattctttttgaacttgcttgtg

SEQ ID NO: 154327 - DNA, 833 bp, Homo sapiens
  Payload ID: 10323
  Gene Symbol: MTFR2
  Gene Name: mitochondrial fission regulator 2
  ENST ID: ENST00000418509
  CDS Start-End: 98-833
gaagtagcagtccggtcctagggactagcaggttttgctgatttgggaaaataaagactatggatcaactaggagtattgttcgtattattgggaaaatgcttccactggaaccttgtcgaagacctaattttgagttgatcccgctcttgaactctgtagactctgataattgtggatctatggttccatcttttgctgatattttgtatgtggcaaatgatgaagaagccagttatctcagatttcgaaatagtatatggaaaaatgaagaagagaaagtggaaatttttcatcctttgcgactagttcgggatccactgtcacctgctgtaagacagaaagaaactgtgaaaaatgacctgcctgtaaatgaagctgcaattagaaaaatagctgcccttgaaaatgagctgacttttcttcgctctcagattgcagcaattgtggaaatgcaggaactgaaaaatagtacaaattctagttcctttggcttgagtgacgagcgcattagtttgggtcagctgtcatcatcgcgggctgcccatctgagtgtggacccagatcagcttccaggttcagtgctttctcctcctcctcctccaccacttcctcctcagttttcatctctccagccaccgtgttttcctcccgtacaaccaggatctaataatatttgtgactcagataatccagcaactgaaatgagcaaacagaacccggctgctaataagaccaattatagtcatcattcaaaaagccagagaaataaagatattccaaacatgttggacgttctaaaggatatgaataaggttaagcttcgtgcaattg

SEQ ID NO: 154328 - DNA, 437 bp, Homo sapiens
  Payload ID: 10323
  Gene Symbol: MTFR2
  Gene Name: mitochondrial fission regulator 2
  ENST ID: ENST00000532958
  CDS Start-End: 1-346
aagccagagaaataaagatattccaaacatgttggacgttctaaaggatatgaataaggttaagcttcgtgcaattgagcggtcacctggcggtagacccattcataagaggaaaagacagaattcacattgggatccagtttctttaatatctcatgcacttaaacagaaatttgcatttcaagaagatgattcttttgagaaagagaatagatcttgggaatcttccccattttctagtccagaaacttcaagggtaagctacactaatgtaaaattaatttttcagtttttctcagatgtgttgtttatgttacagctttgtgttcaagttctcttgaagtaattgtgcagaatgggctatataattgtttattgatgctgctaatgtttctggggtttttttgttgttaattttatatgctcattttcacttt

SEQ ID NO: 154329 - DNA, 1781 bp, Homo sapiens
  Payload ID: 10324
  Gene Symbol: MGME1
  Gene Name: mitochondrial genome maintenance exonuclease 1
  ENST ID: ENST00000377704
  CDS Start-End: 87-845
gttaagcgaagtgtggtggcttccaaggaatacaaacataaaggccttcgaccgttgcaaatagactaaagtgaaaacaaatctgaatgaagatgaagttatttcagaccatttgcaggcagctcaggagttcaaagttttctgtggaatcagctgcccttgtggctttctctacttcctcttactcatgtggccggaagaaaaaagtgaacccatatgaagaagtggaccaagaaaaatactctaatttagttcagtctgtcttgtcatccagaggcgtcgcccagaccccgggatcggtggaggaagatgctttgctctgtggacccgtgagcaagcataagctgccaaaccaaggtgaggacagacgagtgccacaaaactggtttcctatcttcaatccagagagaagtgataaaccaaatgcaagtgatccttcagttcctttgaaaatccccttgcaaaggaatgtgataccaagtgtgacccgagtccttcagcagaccatgacaaaacaacaggttttcttgttggagaggtggaaacagcggatgattctggaactgggagaagatggctttaaagaatacacttcaagttcaatgtggcttaattgtggtggcctacaaagatggatcacctgcccacccacatttcatggatgcagagctctgttcccagtactggaccaagtggcttcttcgactagaagaatatacggaaaagaaaaagaaccagaatattcagaaaccagaatattcagaatagggagcaagttgctatttgggaacattcagcaccttctcacagtttgggaacatatattgctgtttactccagtgtaaaaatgaggtgccactggatctgagtgctacacgaacacaagtagaagtattaatttgttgaaatgtgttgttaccaaaaagactgaaaagccccaaagtctagatataaagacctagacttcggcacgcgaaatcccagctatgctacctcttatttacctgaaaggaggacacgcaggatgggcagtcatgctggtgactcttgtactcccttgagggacattgggggggggggggcgtggtcccaggcaggatgcccagtctttgagctgagattggaaggcagtgaggctgagggtgccaagatttccccagggttcacccagaggggaaggggctacatgcccccagctgtgtgcagggaggacacatcagcccactaccgctgccaacaccaatgcctaaaacttgtttcatacattggggttttctatatatttcagctgggaaaagcttacatttaaccttttgaaaaaataaatacgtgattagcctcaactaaacattgctgactataaagacagtatattcaccatgtcgctggcaatatgtcattgcgtaacaccaaataaccccccagaagtagccagaggccagtttgaacatcacaattctaagtgttttagtaactatttctggcgtgagtcaacagatcatgtagatagagtcaattattgtttgtggagtttttcagctataggggaggggaactattaaaatccatttgtttctattcaataggtaataaaaattagttgtccctgggtttgggaaacttaaatgcccattacagccctggggaagggttttctgtcttatggagtgagtcttagcatttaagttatacagttgctgccttaaaatagtagcctgctacaatgacttctttgggtagccattttcataagaaataaaatacaagatatgagtaatgaa

SEQ ID NO: 154330 - DNA, 1936 bp, Homo sapiens
  Payload ID: 10324
  Gene Symbol: MGME1
  Gene Name: mitochondrial genome maintenance exonuclease 1
  ENST ID: ENST00000377709
  CDS Start-End: 129-923
ggatgaaagtacgggtcgcgagaggttgttcgcgccttgagagttaagcgaagtgtggtggcttccaaggaatacaaacataaaggccttcgaccgttgcaaatagactaaagtgaaaacaaatctgaatgaagatgaagttatttcagaccatttgcaggcagctcaggagttcaaagttttctgtggaatcagctgcccttgtggctttctctacttcctcttactcatgtggccggaagaaaaaagtgaacccatatgaagaagtggaccaagaaaaatactctaatttagttcagtctgtcttgtcatccagaggcgtcgcccagaccccgggatcggtggaggaagatgctttgctctgtggacccgtgagcaagcataagctgccaaaccaagacgtctttttacaagggaaacggttccacgaagccttggaaagcatactttcaccccaggaaaccttaaaagagagagatgaaaatctcctcaagtctggttacattgaaagtgtccagcatattctgaaagatgtcagtggagtgcgagctcttgaaagtgctgttcaacatgaaaccttaaactatataggtctgctggactgtgtggctgagtatcagggcaagctctgtgtgattgattggaagacatcagagaaaccaaagccttttattcaaagtacatttgacaacccactgcaagttgtggcatacatgggtgccatgaaccatgataccaactacagctttcaggttcaatgtggcttaattgtggtggcctacaaagatggatcacctgcccacccacatttcatggatgcagagctctgttcccagtactggaccaagtggcttcttcgactagaagaatatacggaaaagaaaaagaaccagaatattcagaaaccagaatattcagaatagggagcaagttgctatttgggaacattcagcaccttctcacagtttgggaacatatattgctgtttactccagtgtaaaaatgaggtgccactggatctgagtgctacacgaacacaagtagaagtattaatttgttgaaatgtgttgttaccaaaaagactgaaaagccccaaagtctagatataaagacctagacttcggcacgcgaaatcccagctatgctacctcttatttacctgaaaggaggacacgcaggatgggcagtcatgctggtgactcttgtactcccttgagggacattgggggggggggggcgtggtcccaggcaggatgcccagtctttgagctgagattggaaggcagtgaggctgagggtgccaagatttccccagggttcacccagaggggaaggggctacatgcccccagctgtgtgcagggaggacacatcagcccactaccgctgccaacaccaatgcctaaaacttgtttcatacattggggttttctatatatttcagctgggaaaagcttacatttaaccttttgaaaaaataaatacgtgattagcctcaactaaacattgctgactataaagacagtatattcaccatgtcgctggcaatatgtcattgcgtaacaccaaataaccccccagaagtagccagaggccagtttgaacatcacaattctaagtgttttagtaactatttctggcgtgagtcaacagatcatgtagatagagtcaattattgtttgtggagtttttcagctataggggaggggaactattaaaatccatttgtttctattcaataggtaataaaaattagttgtccctgggtttgggaaacttaaatgcccattacagccctggggaagggttttctgtcttatggagtgagtcttagcatttaagttatacagttgctgccttaaaatagtagcctgctacaatgacttctttgggtagccattttcataagaaataaaatacaagatatgagtaatgaa

SEQ ID NO: 154331 - DNA, 2336 bp, Homo sapiens
  Payload ID: 10324
  Gene Symbol: MGME1
  Gene Name: mitochondrial genome maintenance exonuclease 1
  Uniprot ID: Q9BQP7
  ENST ID: ENST00000377710
  CDS Start-End: 289-1323
ggagacgccggcccttccgctcggagaggtactccctgcctctaactggtggcgcgttggcggaggccgacgaaagcctcgggtggggcgtgagcgccgcggggcattctggacctgctttgccttaggctgtgcctaattcgaaaccaaagcgcgggacggatgaaagtacgggtcgcgagaggttgttcgcgccttgagagttaagcgaagtgtggtggcttccaaggaatacaaacataaaggccttcgaccgttgcaaatagactaaagtgaaaacaaatctgaatgaagatgaagttatttcagaccatttgcaggcagctcaggagttcaaagttttctgtggaatcagctgcccttgtggctttctctacttcctcttactcatgtggccggaagaaaaaagtgaacccatatgaagaagtggaccaagaaaaatactctaatttagttcagtctgtcttgtcatccagaggcgtcgcccagaccccgggatcggtggaggaagatgctttgctctgtggacccgtgagcaagcataagctgccaaaccaaggtgaggacagacgagtgccacaaaactggtttcctatcttcaatccagagagaagtgataaaccaaatgcaagtgatccttcagttcctttgaaaatccccttgcaaaggaatgtgataccaagtgtgacccgagtccttcagcagaccatgacaaaacaacaggttttcttgttggagaggtggaaacagcggatgattctggaactgggagaagatggctttaaagaatacacttcaaacgtctttttacaagggaaacggttccacgaagccttggaaagcatactttcaccccaggaaaccttaaaagagagagatgaaaatctcctcaagtctggttacattgaaagtgtccagcatattctgaaagatgtcagtggagtgcgagctcttgaaagtgctgttcaacatgaaaccttaaactatataggtctgctggactgtgtggctgagtatcagggcaagctctgtgtgattgattggaagacatcagagaaaccaaagccttttattcaaagtacatttgacaacccactgcaagttgtggcatacatgggtgccatgaaccatgataccaactacagctttcaggttcaatgtggcttaattgtggtggcctacaaagatggatcacctgcccacccacatttcatggatgcagagctctgttcccagtactggaccaagtggcttcttcgactagaagaatatacggaaaagaaaaagaaccagaatattcagaaaccagaatattcagaatagggagcaagttgctatttgggaacattcagcaccttctcacagtttgggaacatatattgctgtttactccagtgtaaaaatgaggtgccactggatctgagtgctacacgaacacaagtagaagtattaatttgttgaaatgtgttgttaccaaaaagactgaaaagccccaaagtctagatataaagacctagacttcggcacgcgaaatcccagctatgctacctcttatttacctgaaaggaggacacgcaggatgggcagtcatgctggtgactcttgtactcccttgagggacattgggggggggggggcgtggtcccaggcaggatgcccagtctttgagctgagattggaaggcagtgaggctgagggtgccaagatttccccagggttcacccagaggggaaggggctacatgcccccagctgtgtgcagggaggacacatcagcccactaccgctgccaacaccaatgcctaaaacttgtttcatacattggggttttctatatatttcagctgggaaaagcttacatttaaccttttgaaaaaataaatacgtgattagcctcaactaaacattgctgactataaagacagtatattcaccatgtcgctggcaatatgtcattgcgtaacaccaaataaccccccagaagtagccagaggccagtttgaacatcacaattctaagtgttttagtaactatttctggcgtgagtcaacagatcatgtagatagagtcaattattgtttgtggagtttttcagctataggggaggggaactattaaaatccatttgtttctattcaataggtaataaaaattagttgtccctgggtttgggaaacttaaatgcccattacagccctggggaagggttttctgtcttatggagtgagtcttagcatttaagttatacagttgctgccttaaaatagtagcctgctacaatgacttctttgggtagccattttcataagaaataaaatacaagatatgagtaatgaa

SEQ ID NO: 154332 - DNA, 589 bp, Homo sapiens
  Payload ID: 10325
  Gene Symbol:
  Gene Name: Mitochondrial import inner membrane translocase subunit Tim10 B  [Source:UniProtKB/Swiss-Prot
  Acc:Q9Y5J6]
  ENST ID: ENST00000464330
  CDS Start-End: 33-248
ggaagtggcgtacggcatgcgccggtggcgtgatggagcggcagcagcagcagcaacagcaactgcgaaacgaggcctgtctgcacagctgtgctgggaagctgatccattccaaccaccgcctcatggccgcttacgtgcagctcatgcctgccctggtacagcgccgcatcgcagactacgaggctgcctcggctgtgccaggcgttgctgctgaacagcctggggtctctccatcaggcagctagccatacccaaccccaggaaggaaggccttggatggaccctcagattgaaggacccggtggaccttggggtctcagcttgactatgaagttcccagggaaaaggccttccaaaagagcagcaccggcttttcacctgagacttccttcctggatagccaggtgatgactgctctgaagatggagagatacctgaagaagatccacttcctctatctcaatgtggctcccagccggtactttaggccttacagcctgatggtggtgccacccgacaaggtgaatcccgagcactacatcttctctccctttgggatcttgcatgtacatcctgtggaaggtag

SEQ ID NO: 154333 - DNA, 595 bp, Homo sapiens
  Payload ID: 10325
  Gene Symbol:
  Gene Name: Mitochondrial import inner membrane translocase subunit Tim10 B  [Source:UniProtKB/Swiss-Prot
  Acc:Q9Y5J6]
  Uniprot ID: Q9Y5J6
  ENST ID: ENST00000472836
  CDS Start-End: 17-328
atgcgccggtggcgtgatggagcggcagcagcagcagcaacagcaactgcgaaacctgcgtgacttcctgttggtctacaatcggatgacagaactctgcttccagcgctgtgtgcccagcttgcaccaccgagctctggacgctgaggaggaggcctgtctgcacagctgtgctgggaagctgatccattccaaccaccgcctcatggccgcttacgtgcagctcatgcctgccctggtacagcgccgcatcgcagactacgaggctgcctcggctgtgccaggcgttgctgctgaacagcctggggtctctccatcaggcagctagccatacccaaccccaggaaggaaggccttggatggaccctcagattgaaggacccggtggaccttggggcgatcgccagctcgagtgcagattccttgctgtgaccgaggttcagagtgagctctgtcggtgtgtcagtttgcctcttcaggtgaggccccgcatctggcatcctggaactggcagttggagcctgagctatgggcaaggtcacttcgacagcagttgaatgcccagctcctcatggtcccggaggagaggagggta

SEQ ID NO: 154334 - DNA, 3712 bp, Homo sapiens
  Payload ID: 10326
  Gene Symbol: MINOS1
  Gene Name: mitochondrial inner membrane organizing system 1
  Uniprot ID: Q5TGZ0
  ENST ID: ENST00000322753
  CDS Start-End: 57-293
aggggtcggagcgcgggggccggccgagaggaaagctggaggcgcgggtggggaacatgtctgagtcggagctcggcaggaagtgggaccggtgtctggcggatgcggtcgtgaagataggtactggttttggattaggaattgttttctcacttaccttctttaaaagaagaatgtggccattagccttcggttctggcatgggattaggaatggcttattccaactgtcagcatgatttccaggctccatatcttctacatggaaaatatgtcaaagagcaggagcagtgacttcacctgagaacatcccagcgggaggacaagagaaatcatgtttattcctcaggaatactgaagtgccctggagtaagctgccattcttctgtaacaatgttatcagtaatgctttaaactccagcacctggttatgcatttgaaaccaagtctgtttcttgttttgtattttctctctggaagttgtaaggaggtggtcttaaataaattaaacaaaaagaggaagtccattgcatggcctttgtttcttcacctttggtctctgagcatgaggaggactgtgtgtgaactgccagcagctgtagccacctgctcacagcctctctgagaaccccctgaaaccagttgttgggtatccttcccatttgccccctcaggcgtagttttcagaactgcttccacctcgtaatcagaagttgaagattgctgctgcgtggcctgatggagatgactgatgtcttaaggcgcctttccttctgtggcacctcttcgtgtgttctcacctggggacctggcagggcacatctccgctgtgcctactgcaaggcggtcccactgctgctgtattagcaggggaagaatcctggctgtgtggatggcccactccattgaagtcaagtcctgcagcttcatagagcttgagacagtccaagcttcagctctggagggcggaggaaagctcatggcatacccacctggccggaggagcccgattggggttaattttatcttcacgtagcagctgaagtttgaggacaaaagggccacttctgatgcccctctgagtttgttcctgtggtttcacttgaaccagggatgctagatgcaaaagtcatattttagcaatttcttcagacgatatacagaaccccagcgctcagccgttcttatttctttttccttatcgtagaattaagatagggagagcccgatcccacttgcccctgtatcctgtaaatgttgatttatcatctactgtaagcgaggcactgttgtaagcagcagagataaatggataaatagacacaggcttctgccttcaaggagcttagagtctgatggaaagacagacgtgcaaacacaactctgaaagaagtgttttaatggagaagagaggtgtaggcaaagtacactgagaacaaaggagaaggagcaactatgtctccctaggatggccccacaggcgacggaatgcctgcgctgggacccgaagttgactgggaatcccagacagaaggagggtagcctctgtgtttgctcaggatcatgtaatgcatattatagctgggaaatcgcaagtagttcagcatagccagggtgtgtaggggcaggggaaaggcatggagggggaggctgggcaatagggtacaactcatgtctgactccagttctggaacattgattagaccttagttcttgcaagtgctatagtgagtacattcagggtagcaaataccctccctcagcctccccactcccttttccagaaaggtctgctaggctctgccctgcaaactgtccaggctcctctgccctctgggcttgttttcctctttattgctacttggctgtttttcacttggtcctcttcattctatgattaaggcaacccatataattgaaagaaaaataatgtgcagcctgtttcatcccttccacttgttttcttactatttatttatttatttctgagatggaattttgctcttgttgcccaggctggagtgcaatggtggcgatctcggcctgctgcaacctccgcttcctgggttcaagcgcttctcctgcctcagcctcccgagtagctgggattacaggcatgcgccatcacacctggctaattttgtatttttagtagagacggtgtttctccttggtcatgctggtctccaactcccgacctcaggtgatcctcccgcctcggcctcccaaagtgctgggattacaggcgtgagccaccgcacccagcctcctatttgctttaaaagtaatttcctggccggatgcggtggctcacacctgtaatcccagcactttgggaggccaaggcaggtggatcatgaggtcaagagatcaagaccatcctggccaacattgtaaaaccctgtctctactaaaaatataaaaatcagctgggcatggtggcgcacacctgtagtcccagctactcaggaggttgaggcaggagaatcatttgaacccgggaggcagaggttgcggtgagctgagatcgcgccactgcactccagcccggcgacagagcgagaatctgtctcaaaaaaaaaaaaaaaaaaaaagcattttccttccccaatttttctgtcattttcccatcctcattcaggcagagagaagaataacatgcccccttccaaaaaagacaaaacacaaggtagccacaaattccctagacacattagaaaaatagggagtggagaggggcattggaatgaaagttctctatctcattagctgttaggctttaggcatttatttggatggatccctttggcaccttggaagcaccactgaagtgctctgagaaaggggtcagctgtctgagggaatagttctggatagaggccacaggaagcactggccagttgctttagttctagatagctttgtattcccgccttgttgcccttagcggaggctggcccaaagcacacttgatcttgtccccactccctgcccccatctcagatcaaccttcagaaagtcccggcttgttggcaaaggcacacattctgtgttactcttaagtttcattagaaattcaagtcctctggggccctgttcccttgtgggcttgtgcaactgactttgtttcttgtctgcctttctggaaccaaatccaaggaaattcatgggtttggggagacagcgatgggaacccagcagggcacaggatgctaggataaagctgtggcgccccaaaagtggcctgctctgccaacatacataaatacatacagtctgagcttgacactgtataatttggcccagaacaatatgtattttgagctcatttaggtgaatgactttggcattccatgtacccactaggggaagctttatcaggctgcatttgccttatgcagaagtatgcctttgttctgagaaatggcctcagaacacactgttgagctgtctcctttagtgagtgtcatcctctcatccatttcaaaagattgcagatgccgtcttgaagtcctgcttgtaagaaatgcaggggttgggaatggaggagatgacgatgtagttttgcttttagttttcccaaacctgtttacattttttaaaaatgtaaccaacccataattgcattttacttgtcgtggttcgatctgattgtattgtcgaaggactatttttgaacctgtccaaataaactctgcaaagtatttccacaa

SEQ ID NO: 154335 - DNA, 3678 bp, Homo sapiens
  Payload ID: 10326
  Gene Symbol: MINOS1
  Gene Name: mitochondrial inner membrane organizing system 1
  ENST ID: ENST00000617872
  CDS Start-End: 70-258
tcgcgagactttcaggggtcggagcgcgggggccggccgagaggaaagctggaggcgcgggtggggaacatgtctgagtcggagctcggcaggaagtgggaccggtgtctggcggatgcggtcgtgaagataggaagaatgtggccattagccttcggttctggcatgggattaggaatggcttattccaactgtcagcatgatttccaggctccatatcttctacatggaaaatatgtcaaagagcaggagcagtgacttcacctgagaacatcccagcgggaggacaagagaaatcatgtttattcctcaggaatactgaagtgccctggagtaagctgccattcttctgtaacaatgttatcagtaatgctttaaactccagcacctggttatgcatttgaaaccaagtctgtttcttgttttgtattttctctctggaagttgtaaggaggtggtcttaaataaattaaacaaaaagaggaagtccattgcatggcctttgtttcttcacctttggtctctgagcatgaggaggactgtgtgtgaactgccagcagctgtagccacctgctcacagcctctctgagaaccccctgaaaccagttgttgggtatccttcccatttgccccctcaggcgtagttttcagaactgcttccacctcgtaatcagaagttgaagattgctgctgcgtggcctgatggagatgactgatgtcttaaggcgcctttccttctgtggcacctcttcgtgtgttctcacctggggacctggcagggcacatctccgctgtgcctactgcaaggcggtcccactgctgctgtattagcaggggaagaatcctggctgtgtggatggcccactccattgaagtcaagtcctgcagcttcatagagcttgagacagtccaagcttcagctctggagggcggaggaaagctcatggcatacccacctggccggaggagcccgattggggttaattttatcttcacgtagcagctgaagtttgaggacaaaagggccacttctgatgcccctctgagtttgttcctgtggtttcacttgaaccagggatgctagatgcaaaagtcatattttagcaatttcttcagacgatatacagaaccccagcgctcagccgttcttatttctttttccttatcgtagaattaagatagggagagcccgatcccacttgcccctgtatcctgtaaatgttgatttatcatctactgtaagcgaggcactgttgtaagcagcagagataaatggataaatagacacaggcttctgccttcaaggagcttagagtctgatggaaagacagacgtgcaaacacaactctgaaagaagtgttttaatggagaagagaggtgtaggcaaagtacactgagaacaaaggagaaggagcaactatgtctccctaggatggccccacaggcgacggaatgcctgcgctgggacccgaagttgactgggaatcccagacagaaggagggtagcctctgtgtttgctcaggatcatgtaatgcatattatagctgggaaatcgcaagtagttcagcatagccagggtgtgtaggggcaggggaaaggcatggagggggaggctgggcaatagggtacaactcatgtctgactccagttctggaacattgattagaccttagttcttgcaagtgctatagtgagtacattcagggtagcaaataccctccctcagcctccccactcccttttccagaaaggtctgctaggctctgccctgcaaactgtccaggctcctctgccctctgggcttgttttcctctttattgctacttggctgtttttcacttggtcctcttcattctatgattaaggcaacccatataattgaaagaaaaataatgtgcagcctgtttcatcccttccacttgttttcttactatttatttatttatttctgagatggaattttgctcttgttgcccaggctggagtgcaatggtggcgatctcggcctgctgcaacctccgcttcctgggttcaagcgcttctcctgcctcagcctcccgagtagctgggattacaggcatgcgccatcacacctggctaattttgtatttttagtagagacggtgtttctccttggtcatgctggtctccaactcccgacctcaggtgatcctcccgcctcggcctcccaaagtgctgggattacaggcgtgagccaccgcacccagcctcctatttgctttaaaagtaatttcctggccggatgcggtggctcacacctgtaatcccagcactttgggaggccaaggcaggtggatcatgaggtcaagagatcaagaccatcctggccaacattgtaaaaccctgtctctactaaaaatataaaaatcagctgggcatggtggcgcacacctgtagtcccagctactcaggaggttgaggcaggagaatcatttgaacccgggaggcagaggttgcggtgagctgagatcgcgccactgcactccagcccggcgacagagcgagaatctgtctcaaaaaaaaaaaaaaaaaaaaagcattttccttccccaatttttctgtcattttcccatcctcattcaggcagagagaagaataacatgcccccttccaaaaaagacaaaacacaaggtagccacaaattccctagacacattagaaaaatagggagtggagaggggcattggaatgaaagttctctatctcattagctgttaggctttaggcatttatttggatggatccctttggcaccttggaagcaccactgaagtgctctgagaaaggggtcagctgtctgagggaatagttctggatagaggccacaggaagcactggccagttgctttagttctagatagctttgtattcccgccttgttgcccttagcggaggctggcccaaagcacacttgatcttgtccccactccctgcccccatctcagatcaaccttcagaaagtcccggcttgttggcaaaggcacacattctgtgttactcttaagtttcattagaaattcaagtcctctggggccctgttcccttgtgggcttgtgcaactgactttgtttcttgtctgcctttctggaaccaaatccaaggaaattcatgggtttggggagacagcgatgggaacccagcagggcacaggatgctaggataaagctgtggcgccccaaaagtggcctgctctgccaacatacataaatacatacagtctgagcttgacactgtataatttggcccagaacaatatgtattttgagctcatttaggtgaatgactttggcattccatgtacccactaggggaagctttatcaggctgcatttgccttatgcagaagtatgcctttgttctgagaaatggcctcagaacacactgttgagctgtctcctttagtgagtgtcatcctctcatccatttcaaaagattgcagatgccgtcttgaagtcctgcttgtaagaaatgcaggggttgggaatggaggagatgacgatgtagttttgcttttagttttcccaaacctgtttacattttttaaaaatgtaaccaacccataattgcattttacttgtcgtggttcgatctgattgtattgtcgaaggactatttttgaacctgtccaaataaactctgcaaagtatttccacaag

SEQ ID NO: 154336 - DNA, 2400 bp, Homo sapiens
  Payload ID: 10327
  Gene Symbol: MIPEP
  Gene Name: mitochondrial intermediate peptidase
  Uniprot ID: Q99797
  ENST ID: ENST00000382172
  CDS Start-End: 100-2241
cggcgtgggctgctgccttggaaacgcggagcgcgcgctcccagcgaaagcagcagggcagggatctgcgttggaggaagggactgctctggtgctagaatgctgtgcgtcggaaggctgggcggcttgggagccagagcagcagctctgccgccccgccgggcgggccggggaagcctcgaagccgggatccgggcccgaagggtcagcaccagctggtctcccgtgggcgccgccttcaatgtcaagccccagggcagccgcttggacctgttcggcgagcgccggggtctttttggagttcctgagctgagtgccccagaaggatttcatattgcacaagaaaaagccttgagaaagacagaattgcttgtggaccgtgcatgttccaccccacctgggccccagaccgtgctgatcttcgatgagctctcggattccttatgcagagtggccgacttggctgattttgtgaaaatcgctcaccctgagccagcattcagagaagctgcggaagaagcttgtagaagtattggcaccatggtagagaagttgaacacaaatgtggatttatatcaaagtttgcaaaaattactagctgataaaaaacttgtggattcccttgatccagaaacaaggcgagtggctgaactgtttatgtttgattttgaaattagtggaatccatctagacaaagaaaagcgtaaaagagcagtggacctcaatgttaaaatcttggatttgagtagtacatttcttatgggaaccaattttcccaacaagattgagaagcatctcttaccagaacacattcgtcgtaactttacatctgctggggatcatatcataattgatggtctccacgcagaatcaccagatgacttggtgcgagaagctgcttataaaatttttctttatcccaatgctggtcaattgaaatgtttagaagaattgctcagcagcagagatcttctggcaaagttggtggggtattccacgttttctcacagggctctccaaggaacgatagctaaaaatccagagactgtcatgcagttccttgaaaaactatctgacaaactttctgaaagaactctgaaagattttgagatgatacgagggatgaaaatgaaactgaatcctcaaaattccgaagtaatgccctgggaccccccttactacagtggtgtgattcgtgcagaaaggtataatattgagcccagcctatattgcccgtttttctctcttggagcatgcatggaaggcctgaatattttgcttaacagactgttggggatttcattatatgcagagcagcctgcaaaaggagaggtgtggagcgaagatgtccgaaaactggctgttgttcatgaatctgaaggattgttggggtacatttactgtgatttttttcagcgagcagacaaaccacatcaggattgccatttcactatccgtggaggcagactaaaggaagatggagactatcaactcccagttgtagttcttatgctgaatcttccccgttcctcaaggagttctccaactttgctaactcctagcatgatggaaaatcttttccatgaaatgggacatgccatgcattcaatgctaggacgtactcgttaccaacacgtcactgggaccaggtgccctactgattttgctgaggttccttctattctgatggagtactttgcaaatgattatcgagtagttaaccaatttgccagacattatcagactggacagccactgccaaaaaatatggtgtctcgtctttgtgaatctaaaaaggtttgtgctgcagctgatatgcaacttcaggtcttttatgccactctggatcaaatctaccatgggaagcatcccctgaggaattcaaccacagacattctcaaggaaacacaagagaaattctatggcctaccatatgttccaaatactgcctggcagctgcgattcagccacctcgtggggtatggtgctagatattactcttacctcatgtccagagcggtcgcctccatggtttggaaggagtgttttctacaggatcctttcaacagggctgccggggagcgctatcgcagggagatgctggcccacggtggaggcagggagcccatgctcatggttgaaggtatgcttcagaagtgtccttctgttgatgacttcgtaagtgccctcgtttccgacttggatctggacttcgaaactttcctcatggattctgaataaaagaaacactctacacctcttaaatcaaggtcatgtagataatgactttgttataaatgctacagctgtgagagcttgtttctgatttcattgttcgcttctgtaattctgaaaaactttaaactggtagaacttggaataaataatttgttttaatta

SEQ ID NO: 154337 - DNA, 2734 bp, Homo sapiens
  Payload ID: 10328
  Gene Symbol: MTFMT
  Gene Name: mitochondrial methionyl-tRNA formyltransferase
  Uniprot ID: Q96DP5
  ENST ID: ENST00000220058
  CDS Start-End: 15-1184
cggcggccgaggcgatgagggtgttggtgcggcgctgttggggtcctccgctggctcatggcgccaggcgtgggaggccgagtccccagtggcgagcactggcccgactcggctgggaggactgccgggactccagagtccgcgagaagcctccctggcgggtgctcttcttcggcacggaccagttcgcccgcgaggcgctgcgggcgctgcacgccgccagggaaaacaaagaagaagagttaatcgacaaactggaggtggtcacaatgccttccccatcaccaaaaggactgccagtgaagcaatatgctgtgcagtctcagcttcccgtatatgagtggccggatgtgggatctggagaatatgatgttggagtagtggcttcgtttggccgacttttgaatgaggctcttattcttaaatttccctatggcatattgaatgttcatcccagttgcctcccgagatggcgtggcccagcccctgtaatccatacagtgcttcacggagacacagttactggagtaacaattatgcaaattagacctaaaaggtttgatgtaggcccaattctcaaacaagaaactgttcctgtgccacccaagagcactgcaaaggaattggaagcagtgttgtcaagactgggtgccaacatgctcatttcagttttgaaaaatttgcctgaaagtctgagcaatggaaggcagcagccaatggagggggcgacttacgcccctaagatttctgctggtaccagttgtataaaatgggaggaacaaacttcagaacaaatattcagactttaccgtgccattggaaatataattccgttgcagacgctctggatggcgaataccattaaacttctggatttggtagaagttaacagttcagtccttgctgatccaaaattaacgggacaggctcttattccaggatcagtaatataccacaaacagtcacaaatactattggtttattgcaaggatggttggattggtgttcgatcagtgatgctcaagaaatcactaacagctactgacttctacaatggatatttgcacccctggtaccagaaaaattcccaagctcaaccaagccaatgcagatttcagactctcagacttccaacaaagaagaagcagaaaaaaactgttgctatgcaacaatgcattgagtagttaggaagaagatggataaaaacctattacatatttgtaatttattaaaaaccttatttacaaggaattatctggacttttttttttttttttttttttgagacagagtctcactctgtcacccaggctggaatccagtggcactatctcagctcactgcaacctccgcctcccaggttcaagcaattctcctgcctcagcctcctgagtagctgggattacaggcacacgccaccacacgcagctaatttttgtatttttagtagagatggggtttcaccatgttggtcaggctggtctcgaactcctgaccttgtgatctgcccacctcagcctcccaaagtgctatgattacagacgtgagccaccgtgcctggcctggaattatctggactttcaaagaagatggcattattataagaagagaagattattgccgaaaagatggattgcctcactttccactttttatgtaacagtagttaaaaaacagctttttttttacttgaattacaaaaaagtttaaataaaacttgtatttatgatacgaaactcaaggagattatctttccttaagaacaagggcaaccctaactggtgtatgtatgtacctacatacatactgagaagaggttttttgtttttatttttatttttttgagacggagtcttgttctgtggcccaggctggagtgcagtggcgtgatgtcagctcactgcaagctccacctcccgggttcacaccattctcctgcctcagcctcccaagtagctgggactacaggcgtccgccaccatgcctggctaatttttttttttgtatttttagtagagatggggtttcactgtgttagccaggatggtcttgatctcctgacctcgtgatccacccgccttggcctcccaaagtgctgggattacagctgtgagccaccgtgcctggccgagaagaggtttttttaaaaacagtgcatctatttaattttttaaaaatcgtgtcaccactgacattttaggagtattgaatctgcattttttatttcctataagtagtaaatccagctctttacatttcactaccagctagatttaaccaagtagtaaacgtaggtaatatttaataatctctgccacattgatctgtactataaattaacattttacatccagattttatttttttttattaatttttttagagatggggtcttgctctctcacacagtctggagtccagtggcgtgaaacactgcttactgcatcttcaacctcctgggcttaagtgatcctccagcctcagcctcccaaagtggggccaccacgcctggctaattttctttcttagtttttaaaaaaaattttgtagagataggggtctcactatgttgcttaggctggtcttgaactcctgggcccaagcaatcctcctgccttggcctctcaaagtgctgggattacaagcatgaaccactgcacccggcccaggttttcttgaagtaggaacgtgctaacatttttcaacttacttgtgcaataaaggttattgagca

SEQ ID NO: 154338 - DNA, 1216 bp, Homo sapiens
  Payload ID: 10328
  Gene Symbol: MTFMT
  Gene Name: mitochondrial methionyl-tRNA formyltransferase
  Uniprot ID: Q96DP5
  ENST ID: ENST00000543678
  CDS Start-End: 27-461
agggccggccgccggcggccgaggcgatgagggtgttggtgcggcgctgttggggtcctccgctggctcatggcgccaggcgtgggaggccgagtccccagtggcgagcactggcccgactcggctgggaggactgccgggactccagagtccgcgagaagcctccctggcgggtgctcttcttcggcacggaccagttcgcccgcgaggcgctgcgggcgctgcacgccgccagggaaaacaaagaagaagagttaatcgacaaactggaggtggtcacaatgccttccccatcaccaaaaggactgccagtgaagcaatatgctgtgcagtctcagcttcccgtatatgagtggccggatgtgggatctggagaatatgatgttggagtagtggcttcgtttggccgacttttgaatgaggctcttattcttaaatttccctactcatttcagttttgaaaaatttgcctgaaagtctgagcaatggaaggcagcagccaatggagggggcgacttacgcccctaagatttctgctggtaccagttgtataaaatgggaggaacaaacttcagaacaaatattcagactttaccgtgccattggaaatatagtaagttgggaagtcaggttgcagttctacctagttggttttctatgtgtgtaatttgctttctaaatatttttatttaggaataatcccaaataaaaatatcccaaataaaaggttgatcttaggaacaaaacctagaaaacctgaaatttattcttaaaaattctttaagctgtttaaagtgtttatagagaccttagaattcacaaagcacttttaaatatatgtatattgcagtttcacataaccaagttttactatcctacttcataggtgaggggaaagaaatgagatgactaacaggaatgtccagtcactaaataatgaacttaaatcttctcactcctaatcctgtgcttcttccagtatgtctttctgcctttagccaattttttacaatcaaattgttaaatcattgatttctacatatggtacaccaagtgtagtaatataacagtttgttaaaatgtctgagttaaattctcagttcattgataaatttgtggggttttttcctttcatttcaatagctacttgtgttatttgaacactgagcttaccgtatgtgtgtttgtgtgtgtgtgttgttttattttttgagac

SEQ ID NO: 154339 - DNA, 1522 bp, Homo sapiens
  Payload ID: 10328
  Gene Symbol: MTFMT
  Gene Name: mitochondrial methionyl-tRNA formyltransferase
  Uniprot ID: Q96DP5
  ENST ID: ENST00000558460
  CDS Start-End: 4-1173
gcgatgagggtgttggtgcggcgctgttggggtcctccgctggctcatggcgccaggcgtgggaggccgagtccccagtggcgagcactggcccgactcggctgggaggactgccgggactccagagtccgcgagaagcctccctggcgggtgctcttcttcggcacggaccagttcgcccgcgaggcgctgcgggcgctgcacgccgccagggaaaacaaagaagaagagttaatcgacaaactggaggtggtcacaatgccttccccatcaccaaaaggactgccagtgaagcaatatgctgtgcagtctcagcttcccgtatatgagtggccggatgtgggatctggagaatatgatgttggagtagtggcttcgtttggccgacttttgaatgaggctcttattcttaaatttccctatggcatattgaatgttcatcccagttgcctcccgagatggcgtggcccagcccctgtaatccatacagtgcttcacggagacacagttactggagtaacaattatgcaaattagacctaaaaggtttgatgtaggcccaattctcaaacaagaaactgttcctgtgccacccaagagcactgcaaaggaattggaagcagtgttgtcaagactgggtgccaacatgctcatttcagttttgaaaaatttgcctgaaagtctgagcaatggaaggcagcagccaatggagggggcgacttacgcccctaagatttctgctggtaccagttgtataaaatgggaggaacaaacttcagaacaaatattcagactttaccgtgccattggaaatataattccgttgcagacgctctggatggcgaataccattaaacttctggatttggtagaagttaacagttcagtccttgctgatccaaaattaacgggacaggctcttattccaggatcagtaatataccacaaacagtcacaaatactattggtttattgcaaggatggttggattggtgttcgatcagtgatgctcaagaaatcactaacagctactgacttctacaatggatatttgcacccctggtaccagaaaaattcccaagctcaaccaagccaatgcagatttcagactctcagacttccaacaaagaagaagcagaaaaaaactgttgctatgcaacaatgcattgagtagttaggaagaagatggataaaaacctattacatatttgtaatttattaaaaaccttatttacaaggaattatctggacttttttttttttttttttttttgagacagagtctcactctgtcacccaggctggaatccagtggcactatctcagctcactgcaacctccgcctcccaggttcaagcaattctcctgcctcagcctcctgatgctatgattacagacgtgagccaccgtgcctggcctggaattatctggactttcaaagaagatggcattattataagaagagaagattattgccgaaaagatggattgcctcactttccactttttatgtaacagtagtt

SEQ ID NO: 154340 - DNA, 1111 bp, Homo sapiens
  Payload ID: 10328
  Gene Symbol: MTFMT
  Gene Name: mitochondrial methionyl-tRNA formyltransferase
  ENST ID: ENST00000560717
  CDS Start-End: 1-405
cggcgctgttggggtcctccgctggctcatggcgccaggcgtgggaggccgagtccccagtggcgagcactggcccgactcggctgggaggactgccgggactccagagtccgcgagaagcctccctggcgggtgctcttcttcggcacggaccagttcgcccgcgaggcgctgcgggcgctgcacgccgccagggaaaacaaagaagaagagttaatcgacaaactggaggtggtcacaatgccttccccatcaccaaaaggactgccagtgaagcaatatgctgtgcagtctcagcttcccgtatatgagtggccggatgtgggatctggagaatatgatgttggagtagtggcttcgtttggccgacttttgaatgaggctcttattcttaaatttccctagtaagttttatttgtttgatgtaggcccaattctcaaacaagaaactgttcctgtgccacccaagagcactgcaaaggaattggaagcagtgttgtcaagactgggtgccaacatgctcatttcagttttgaaaaatttgcctgaaagtctgagcaatggaaggcagcagccaatggagggggcgacttacgcccctaagatttctgctggtaccagttgtataaaatgggaggaacaaacttcagaacaaatattcagactttaccgtgccattggaaatataattccgttgcagacgctctggatggcgaataccattaaacttctggatttggtagaagttaacagttcagtccttgctgatccaaaattaacgggacaggctcttattccaggatcagtaatataccacaaacagtcacaaatactattggtttattgcaaggatggttggattggtgttcgatcagtgatgctcaagaaatcactaacagctactgacttctacaatggatatttgcacccctggtaccagaaaaattcccaagctcaaccaagccaatgcagatttcagactctcagacttccaacaaagaagaagcagaaaaaaactgttgctatgcaacaatgcattgagtagttaggaagaagatggataaaaacctattacatatttgtaatttattaaaaaccttatttacaagga

SEQ ID NO: 154341 - DNA, 5601 bp, Homo sapiens
  Payload ID: 10329
  Gene Symbol: MTPAP
  Gene Name: mitochondrial poly(A) polymerase
  Uniprot ID: Q9NVV4
  ENST ID: ENST00000263063
  CDS Start-End: 45-1793
agcttcgcgctagtgctgttttttttttttttttttttttagcaatggcggttcccggcgtggggctcttgacccgtttgaacctgtgtgcccggagaagaactcgagtccagcggcctatcgtcaggcttttgagttgcccaggaactgtggccaaagaccttaggagagacgagcagccttcagggagcgtggagacaggctttgaagacaagattcccaaaaggagattctctgagatgcaaaatgaaagacgagaacaggcacagcggactgttttaatacattgcccagagaaaatcagtgaaaacaagtttcttaaatatttatcccaatttggacctattaataatcatttcttctatgaaagctttggtctctatgctgtcgtagaattttgccaaaaggaaagcataggttcactgcagaatgggactcatactccaagcacggccatggagactgcaattccattcagatcacgtttcttcaatctgaagttgaaaaaccagacttctgaacggtcacgcgtacggtcaagtaatcagttgccacgttcaaacaagcagctttttgaattactttgttatgcagaaagtatagacgatcagctgaacactctcttgaaggagttccagctaacagaggagaacactaagctccgatatctcacctgttctcttattgaagacatggccgccgcgtattttccagactgcatagtcagaccctttggctcctcagtcaacacttttgggaagttaggatgtgatttggacatgtttttggatctagatgaaaccagaaacctcagcgctcacaagatctcaggaaattttctgatggaatttcaagtgaaaaatgttccttcagaaagaattgcaactcagaagatcctgtctgtgttaggagagtgccttgaccactttggccctggctgtgtgggtgtgcaaaaaatattaaatgcccggtgtccgctcgtgaggttctcacaccaggcctccggatttcagtgtgatttgactacgaacaataggattgccttgacaagttccgaactcctttatatatatggtgccctagactcaagagtgagagccttggtgttcagtgtacggtgctgggctcgagcacattcactaacaagtagtattcctggtgcatggattacaaatttctcccttacaatgatggtcatcttttttctccagagaagatcaccccctattcttccaacactagattccttaaaaaccctagcagatgcagaagataaatgtgtaatagaaggcaacaactgcacatttgttcgtgacttgagtagaattaaaccttcacagaacacagaaacattagaattactactgaaggaattttttgagtattttggcaattttgctttcgataaaaattccataaatattcgacagggaagggagcaaaacaaacctgattcttctcctctgtacattcagaatccatttgaaacttctctcaacataagcaaaaatgtaagtcaaagccagctgcaaaaatttgtagatttggcccgagaaagtgcctggattttacaacaggaagatacagatcgaccttccatatcaagtaatcggccctgggggctggtatccctattgctaccatctgctccaaacagaaagtcctttaccaagaagaaaagcaataagtttgcaattgaaacagtcaaaaacttgctagaatctttaaaaggtaacagaacagaaaatttcacaaaaaccagtgggaagagaacaattagtactcagacatgatggctgctacattgtgtaaagaactgggcttagcctatcaaatggtctgtggacttacttggaaaaactgatttgaaactttcacagatctcagctttcatctgatgtcacttttcatgatcttctcattggcccccttaacctggtctgaagttctgggatgttttcagtttgatcagtctgatactcagtggcactttattaaaacatcagctgtggagtgtggcggtgcacacctgtagtcccagctgctcaggaggctgaggcaggaggatctcttgagcccaggattttgaatccatcgtggacaacatagcaagattccatctctaaaaaaaatgaaaataaacataagccacaaggaatgggtgaaagattattgtaatgtgctttaactaaataggtaaatatactaaacaaatgctaaaactcagttttaggatgaaaccattgttgatatccacatcagtccctgtttagaaaacatttaaaatgacttttagttatgtacagtacgttggcaatgaatacattaagcttcaaaatttggtagtgctctcgaatatgtatatttgtatttttcaagcgaagttctcttattcacatataaattaaagtgggttggtactgatatcaaaaaatgtttatgtttttagaacagacatttcagtcactgcattcttaggtattccaaaccaaatatgatgacatcaatagattgcattttaaaaatattgtttgatttttctattttcaaaaataaaattctgtttctaactaaaatgtgatattcccagtattccttcacatctcttttgagaactcccctcttcctgcaggaaagagacatatttgtctctcagtatatgcagaaaattggttccaggaccatccacgtacacccagatctgcacacactgaactccttcagtcctgtggagcccgtgcatgggagaattccaccttgcacataagcagattttgcatcctgtgaaagtactgtattttctttctttcttttttttttttttttttttttgagacagagtctcgctctgtcgcccaggctagagtgcagtggcgcaatctcggctcactgcaagctctgcctcccaggttcacgccattctcctgcctcagcctctctgagtagctgggactataggtgcccgccaccacgcccggacaatttttttgtatttttagtagagacagggtttcaccatggtctcgatctcccgacctcgtgatcagcccacctcaacctcccaaagtgctgggattacaagcgtgagccaccatgcctggccgagaatactgtattttcaatccaagtttggttggaaaaaatctgtgtgtaaatggacttcgcagttgaaacccatgttgttcaatgggcaactgtatattgaaatttaatttccattacattctctgtggagcaacttttttgctttgtttcgttttgtttctgagacggagttttgctcttgttgcccaggctggggtgcaatggcacaatctcagctcactgcaacctccgcctcccggattcaagtgattctcctgcctcagctgggattacaggcgcccaccaccaagcccagctaatttttgtagttttagtagggacagggtttcaccatgttggccaggctgatctcgaactcctgacctcaggtgatcgcccaccttggccttccaaagtgttggaattacaggcgtgagccactgcacctggcttctgtggagtaactttctatttaagaagcaagtaaggcctgggcatagcggcacatgcctgtagtcccaggtacttgggaggccgaggcacaaggactgcttgaacctgggaggcagaggctgcagtgagctgagatcacagcactgtactccatcctgggcgacagtgagactctctcaaaggaaaagaagcaagtagtatagtgtttaaaaacagacttgagcgagactggctcaatgacaagttactcagtctcttggggcccctgtttgatctgtaaaatggggatcatgatcagatcaatgtgaggattaagcgagggatgtaggaaaatgctaggtcagtgcattttcctggcgcgaagtaaatgttacttctctttaactgttgcctttcggtgtttgtggtatgtaattaccttttttgctactcaaaattcagatttagagtttgtagtactttaaaaatttttcccatttaaattttatgtcagaaattataatgggttctgcatgggatattttaagaaactcagcattgttatgaagcaaatgaattctgtgtccttgtgtctgtgctattggattgcacatttgacaccaacaaatatcagtgttctgtacaggcgatgtctttaaaagccatttttcatttgttctttattttgttgggctagaaatccatattgatttaaaaagcttaaaaagcataaaccacttaagggtttctaaatgaaatttttttttctgttcacagatatttagtcagatattttcttttttaggttggtgctaggtgtaatatggttatttaagcacataaagtatgtgtatgggttagcattttcttttctttttggtaatttgtaggacagccttgacactaggctgttttacttttcagaatcagatttaattatgtgattaattttaaatctacaaagacttgttttttgtttttttttttgagagcaaatcttgctctgtcacccaggctagactgcagtggtgcgatctcggctcactgcaacctctgcctcctgggttcaagcgatactcctgccccagcctcccaagtaactgggattacaggcgcctgccaccatgcctagctaatttttgtatgttagtagagacggggtttcaccatgttggccaggctggtcttgaattcctgacctcaagtgatctacctgtctcagcctctcaaagtgctgggattacaggttacaggtgtgagccaccgcacctggcctacaaagacccttttttttttttttttttgagatgggtctccctctgtcacccaggctggagagtgcagtgatcttggctcactgaaacctccacttcccgggttcaggtgattcttctgcctcagcctcctgagtagctgggattacaggtgcatgccaccacacctggctaagttttctatttttagtagagatggggttttactctgttggccaggctggtctcgaactcctgacctcaggtgacctgcccacctcgccctcccaaaatgctgggattacaggcatgagccaccacgcctggctgcaaagaccttttaatacacagttttaaagtctgttcaactgaatatagactacagacaaatatattttctcataactttagtgtatcacaacccagatttttaaaatatttttattacgtgatagtgataactagcaattatttgtcattgctgtttcttaattaaaaataattgcaatgttaagtaaaacttttttcaagtttttttcttctataactattactaggctttcattcagtagctttcacctgtaatgagttttactaagtatgtgaaagtaattttgataggagactacccagatcaaaacgatttcagctatagcccactagtataattcctggagctattatccatctttagaaaatttgagaattagccagagactttctaggaaataacgattagcctgaaacgttataggaaaactgtgtgtaattatctcattcaccttcagttaccataaaggagaagggaaaataaagttgagttgaaataaga

SEQ ID NO: 154342 - DNA, 695 bp, Homo sapiens
  Payload ID: 10329
  Gene Symbol: MTPAP
  Gene Name: mitochondrial poly(A) polymerase
  ENST ID: ENST00000421701
  CDS Start-End: 1-453
gaccttaggagagacgagcagccttcagggagcgtggagacaggctttgaagacaagattcccaaaaggagattctctgagatgcaaaatgaaagacgagaacaggcacagcggactgttttaatacattgcccagagaaaatcagtgaaaacaagtttcttaaatatttatcccaatttggacctattaataatcatttcttctatgaaagctttggtctctatgctgtcgtagaattttgccaaaaggaaagcataggttcactgcagaatgggactcatactccaagcacggccatggagactgcaattccattcagatcacgtttcttcaatctgaagttgaaaaaccagacttctgaacggtcacgcgtacggtcaagtaatcagttgccacgttcaaacaagcagctttttgaattactttgttatgcagaaagtgtaagtttttaggtgtacctcaacttttagaactatgtatttttttatgaacaataaagattcctgtaaaatgttcaagctacattattgtttaatgggtatagatcttcagttttacaaggtgaaaagagttacggagatgaatcgtggtggtggatgcataatgagatgaaggaaagtttttttctatttctagctttctaagaatgtcgtcatgctcaacacattgagtagatgttgagttttgacatttg

SEQ ID NO: 154343 - DNA, 816 bp, Homo sapiens
  Payload ID: 10329
  Gene Symbol: MTPAP
  Gene Name: mitochondrial poly(A) polymerase
  ENST ID: ENST00000417581
  CDS Start-End: 160-816
gatctctgtaggggaacccagggtcgccgccgttgctgaggcagaagtgagatgtgtgatgtttgtttggggcgactcctgtgtacagtaatggagttgtttagacttccatgaaattcaggctttgaagacaagattcccaaaaggagattctctgagatgcaaaatgaaagacgagaacaggcacagcggactgttttaatacattgcccagagaaaatcagtgaaaacaagtttcttaaatatttatcccaatttggacctattaataatcatttcttctatgaaagctttggtctctatgctgtcgtagaattttgccaaaaggaaagcataggttcactgcagaatgggactcatactccaagcacggccatggagactgcaattccattcagatcacgtttcttcaatctgaagttgaaaaaccagacttctgaacggtcacgcgtacggtcaagtaatcagttgccacgttcaaacaagcagctttttgaattactttgttatgcagaaagtatagacgatcagctgaacactctcttgaaggagttccagctaacagaggagaacactaagctccgatatctcacctgttctcttattgaagacatggccgccgcgtattttccagactgcatagtcagaccctttggctcctcagtcaacacttttgggaagttaggatgtgatttggacatgtttttggatctagatgaaaccagaaacctcagcgctcacaagatctcaggaaattttctgatggaatttcaagtgaaaaatgttccttcagaaagaattgcaactcagaagatc

SEQ ID NO: 154344 - DNA, 976 bp, Homo sapiens
  Payload ID: 10330
  Gene Symbol: MPC1
  Gene Name: mitochondrial pyruvate carrier 1
  ENST ID: ENST00000341756
  CDS Start-End: 266-466
aaggcgtggccgggtgtcgtgaggcgggccttcgggctggctcgccgtcggctgccggggggttggccggggtgtcattggctctgggaagcggcagcagaggcagggaccactcggggtctggtgtcggcacagccatggcgggcgcgttggtgcggaaagcggcggactatgtccgaagcaaggatttccgggactacctcatgagtagcacttctggggcccagtagccaactggggtcttcccattgctgccatcaatgatatgaaaaagtctccagagattatcagtgggcggatgacatttgccctctgttgctattctttgacattcatgagatttgcctacaaggtacagcctcggaactggcttctgtttgcatgccacgcaacaaatgaagtagcccagctcatccagggagggcggcttatcaaacacgagatgactaaaacggcatctgcataacaatggaaaaggaagaacaaggtcttgaagggacagcattgccagctgctgctgagtcacagatttcattataaatagcctccctaaggaaaatacactgaatgctatttttactaaccattctatttttatagaaatagctgagagtttctaaaccaactctctgctgccttacaagtattaaatattttacttctttccataaagagtagctcaaaatatgcaattaatttaataatttctgatgatggttttatctgcagtaatatgtatatcatctattagaatttacttaatgaaaaactgaagagaacaaaatttgtaaccactagcacttaagtactcctgattcttaacattgtctttaatgaccacaagacaaccaacagctggccacgtacttaaaattttgtccccactgtttaaaaatgttacctgtgtatttccatgcagtgtatatattgagatgctgtaacttaatggcaataaatgatttaaatatttgttaaa

SEQ ID NO: 154345 - DNA, 962 bp, Homo sapiens
  Payload ID: 10330
  Gene Symbol: MPC1
  Gene Name: mitochondrial pyruvate carrier 1
  Uniprot ID: Q9Y5U8
  ENST ID: ENST00000360961
  CDS Start-End: 123-452
gtcgtgaggcgggccttcgggctggctcgccgtcggctgccggggggttggccggggtgtcattggctctgggaagcggcagcagaggcagggaccactcggggtctggtgtcggcacagccatggcgggcgcgttggtgcggaaagcggcggactatgtccgaagcaaggatttccgggactacctcatgagtacgcacttctggggcccagtagccaactggggtcttcccattgctgccatcaatgatatgaaaaagtctccagagattatcagtgggcggatgacatttgccctctgttgctattctttgacattcatgagatttgcctacaaggtacagcctcggaactggcttctgtttgcatgccacgcaacaaatgaagtagcccagctcatccagggagggcggcttatcaaacacgagatgactaaaacggcatctgcataacaatggaaaaggaagaacaaggtcttgaagggacagcattgccagctgctgctgagtcacagatttcattataaatagcctccctaaggaaaatacactgaatgctatttttactaaccattctatttttatagaaatagctgagagtttctaaaccaactctctgctgccttacaagtattaaatattttacttctttccataaagagtagctcaaaatatgcaattaatttaataatttctgatgatggttttatctgcagtaatatgtatatcatctattagaatttacttaatgaaaaactgaagagaacaaaatttgtaaccactagcacttaagtactcctgattcttaacattgtctttaatgaccacaagacaaccaacagctggccacgtacttaaaattttgtccccactgtttaaaaatgttacctgtgtatttccatgcagtgtatatattgagatgctgtaacttaatggcaataaatgatttaaatatttgttaaa

SEQ ID NO: 154346 - DNA, 1192 bp, Homo sapiens
  Payload ID: 10330
  Gene Symbol: MPC1
  Gene Name: mitochondrial pyruvate carrier 1
  ENST ID: ENST00000621685
  CDS Start-End: 482-682
aaggcgtggccgggtgtcgtgaggcgggccttcgggctggctcgccgtcggctgccggggggttggccggggtgtcattggctctgggaagcggcagcagaggcagggaccactcggggtctggtgtcggcacagccatggcgggcgcgttggtgcggaaagcggcggactatgtccgaagcaaggatttccgggactacctcatgagtaggacaatcagagatgacttggttgtagtgtggaaaccagtagggaccttgggaagctgccaaaccctttctagctctgggctcagctgtaagaactgctgattcctacaggaacacttggacaatccaatacctaaatgttaaccatcaattaacccagtaaacctgcaagatggaaacgaagatttgttctcacgagtttcacgtgattatttaaacacttctggggcccagtagccaactggggtcttcccattgctgccatcaatgatatgaaaaagtctccagagattatcagtgggcggatgacatttgccctctgttgctattctttgacattcatgagatttgcctacaaggtacagcctcggaactggcttctgtttgcatgccacgcaacaaatgaagtagcccagctcatccagggagggcggcttatcaaacacgagatgactaaaacggcatctgcataacaatggaaaaggaagaacaaggtcttgaagggacagcattgccagctgctgctgagtcacagatttcattataaatagcctccctaaggaaaatacactgaatgctatttttactaaccattctatttttatagaaatagctgagagtttctaaaccaactctctgctgccttacaagtattaaatattttacttctttccataaagagtagctcaaaatatgcaattaatttaataatttctgatgatggttttatctgcagtaatatgtatatcatctattagaatttacttaatgaaaaactgaagagaacaaaatttgtaaccactagcacttaagtactcctgattcttaacattgtctttaatgaccacaagacaaccaacagctggccacgtacttaaaattttgtccccactgtttaaaaatgttacctgtgtatttccatgcagtgtatatattgagatgctgtaacttaatggcaataaatgatttaaatatttgttaaa

SEQ ID NO: 154347 - DNA, 977 bp, Homo sapiens
  Payload ID: 10330
  Gene Symbol: MPC1
  Gene Name: mitochondrial pyruvate carrier 1
  ENST ID: ENST00000621630
  CDS Start-End: 138-467
aaggcgtggccgggtgtcgtgaggcgggccttcgggctggctcgccgtcggctgccggggggttggccggggtgtcattggctctgggaagcggcagcagaggcagggaccactcggggtctggtgtcggcacagccatggcgggcgcgttggtgcggaaagcggcggactatgtccgaagcaaggatttccgggactacctcatgagaactcacttctggggcccagtagccaactggggtcttcccattgctgccatcaatgatatgaaaaagtctccagagattatcagtgggcggatgacatttgccctctgttgctattctttgacattcatgagatttgcctacaaggtacagcctcggaactggcttctgtttgcatgccacgcaacaaatgaagtagcccagctcatccagggagggcggcttatcaaacacgagatgactaaaacggcatctgcataacaatggaaaaggaagaacaaggtcttgaagggacagcattgccagctgctgctgagtcacagatttcattataaatagcctccctaaggaaaatacactgaatgctatttttactaaccattctatttttatagaaatagctgagagtttctaaaccaactctctgctgccttacaagtattaaatattttacttctttccataaagagtagctcaaaatatgcaattaatttaataatttctgatgatggttttatctgcagtaatatgtatatcatctattagaatttacttaatgaaaaactgaagagaacaaaatttgtaaccactagcacttaagtactcctgattcttaacattgtctttaatgaccacaagacaaccaacagctggccacgtacttaaaattttgtccccactgtttaaaaatgttacctgtgtatttccatgcagtgtatatattgagatgctgtaacttaatggcaataaatgatttaaatatttgttaaa

SEQ ID NO: 154348 - DNA, 798 bp, Homo sapiens
  Payload ID: 10331
  Gene Symbol: MPC2
  Gene Name: mitochondrial pyruvate carrier 2
  Uniprot ID: O95563
  ENST ID: ENST00000271373
  CDS Start-End: 160-543
ctcagcgcctccgccccggggcccccgctcacccaggtagcgactccgcagccgggacgggtcctccagcccgagggaccttttcctcacgtcccacaacagccagggacgagaacacagccacgctcccacccggctgccaacgatccctcggcggcgatgtcggccgccggtgcccgaggcctgcgggccacctaccaccggctcctcgataaagtggagctgatgctgcccgagaaattgaggccgttgtacaaccatccagcaggtcccagaacagttttcttctgggctccaattatgaaatgggggttggtgtgtgctggattggctgatatggccagacctgcagaaaaacttagcacagctcaatctgctgttttgatggctacagggtttatttggtcaagatactcacttgtaattattccaaaaaattggagtctgtttgctgttaatttctttgtgggggcagcaggagcctctcagctttttcgtatttggagatataaccaagaactaaaagctaaagcacacaaataaaagagttcctgatcacctgaacaatctagatgtggacaaaaccattgggacctagtttattatttggttattgataaagcaaagctaactgtgtgtttagaaggcactgtaactggtagctagttcttgattcaatagaaaaatgcagcaaacttttaataacagtctctctacatgacttaaggaacttatctatggatattagtaacatttttctaccatttgtccgtaataaaccatacttgctcgtatata

SEQ ID NO: 154349 - DNA, 2177 bp, Homo sapiens
  Payload ID: 10331
  Gene Symbol: MPC2
  Gene Name: mitochondrial pyruvate carrier 2
  Uniprot ID: O95563
  ENST ID: ENST00000367846
  CDS Start-End: 200-583
cgccccctcaaccttcgcggggcgcgggccgcagcttttcggttcacagcgggcagggaaagccgcgggaagggtactccaggcgagaggcggacgcgagtcgtcgtggcaggaaaagtgactagctccccttcgttgtcagccagggacgagaacacagccacgctcccacccggctgccaacgatccctcggcggcgatgtcggccgccggtgcccgaggcctgcgggccacctaccaccggctcctcgataaagtggagctgatgctgcccgagaaattgaggccgttgtacaaccatccagcaggtcccagaacagttttcttctgggctccaattatgaaatgggggttggtgtgtgctggattggctgatatggccagacctgcagaaaaacttagcacagctcaatctgctgttttgatggctacagggtttatttggtcaagatactcacttgtaattattccaaaaaattggagtctgtttgctgttaatttctttgtgggggcagcaggagcctctcagctttttcgtatttggagatataaccaagaactaaaagctaaagcacacaaataaaagagttcctgatcacctgaacaatctagatgtggacaaaaccattgggacctagtttattatttggttattgataaagcaaagctaactgtgtgtttagaaggcactgtaactggtagctagttcttgattcaatagaaaaatgcagcaaacttttaataacagtctctctacatgacttaaggaacttatctatggatattagtaacatttttctaccatttgtccgtaataaaccatacttgctcgtatataccccctgcctccttctgttccagtcagccaacatatgtacataaaagaacacacaaattcaagaagttggaagattaaattatctgcttatttagtgtaggatggtcaggtagctagctataagtgaaaggaaattttgctgaagagactgagaaatgggtagtggaatgactatcaagatgacctcaaactatttaaaaacattttaacttgccatgaagaatcttgatgatttttgtataaatgttgtataaaattcttttacagctacagatttttaaataggatcattgtaaagattaatgagataatgttttaacatagtgcctggtccatgataagtgttaaatttttcaattaccctcagtaactgataatgtagcagaaaatactctatattcagacagacctgaatttgaatcccagctctatgacttatctgttgtgactttttttttttttttttttttgagacagggtctcgctctgtggcccaggctggagtgcagtggcacaatctcggctcactgcaaaccctacctcctgggctcaagtgatcctcctgcctcagcctcccgagcagctgggactacaggcacacaccaccacacccagctaatttttgtatttttgtagaggtagggttttgtcatgttgcccaggctggtctcgaactcctgggctcaggtgatctgcccgcctcgtcctgtcaaagtgctggaatacaggcatgagccaccatacccagcctatgctgtgactttagacaagttaggaaagtacctagcagagtacctgggacataagtaggttttctgtaaatgtttgtgacctttggctccgttgtgaggagagactgagcatacattactccacgctacaaataattaactatctatttgatttgactttcagtgtggagtgcagagctttttttctaaaagtgctaataaagccagtcctcattaaaaatatagtcagatgagtcagcaaagcaagttatttcaaaatttgaagaaatgagacaaaacaactttttgagtaatactataacctatgaaaatttggcagttagcaattgaaaaccttgtactttatcatctgtcccttaaccatggcctaccattgaggagaaaagattagagagcttgacataggccacaatgaagaggttctgaagagtcaaactattattgctttcatttcataaaccacactgttaaattcatttgtgtgtttggcatgggtgtgcacacatgtgtttcctaggttaagcatttaggaaaaacattatgaaatatgacatagacacaaaaaagtttattaaaaatttatgtga

SEQ ID NO: 154350 - DNA, 645 bp, Homo sapiens
  Payload ID: 10331
  Gene Symbol: MPC2
  Gene Name: mitochondrial pyruvate carrier 2
  ENST ID: ENST00000458574
  CDS Start-End: 331-645
ccgggcctccagggcgcagcgttagatggcggtggcagcagcggcgcctgggcccctgaagcccggccgcacccgggccggagctcgcctcatactctccttcttagactaaccagaacatccaaagatcagcaacagtctcctccctcagcccccctccaacaggaggaggcggaggcggaggcgatggcgactcctccctctcctcgtcctggataccctccccgccaaccctttctcgcgagatgacgaccaccctggggactgaggctgccagggacgagaacacagccacgctcccacccggctgccaacgatccctcggcggcgatgtcggccgccggtgcccgaggcctgcgggccacctaccaccggctcctcgataaagtggagctgatgctgcccgagaaattgaggccgttgtacaaccatccagcaggtcccagaacagttttcttctgggctccaattatgaaatgggggttggtgtgtgctggattggctgatatggccagacctgcagaaaaacttagcacagctcaatctgctgttttgatggctacagggtttatttggtcaagatactcacttgtaattattccaaaaaattggagtctgtttgctgttaatttctttgtgggggca

SEQ ID NO: 154351 - DNA, 1490 bp, Homo sapiens
  Payload ID: 10332
  Gene Symbol: MRPL1
  Gene Name: mitochondrial ribosomal protein L1
  Uniprot ID: Q9BYD6
  ENST ID: ENST00000315567
  CDS Start-End: 330-1307
gtcgctctgagtacacttgcaggatcaaaaaagaaaaagaataagaaggaaggattaaaataatcacagcatcgccaacaggatcgtattttcccgaaggtggttaaccagccataccggaaccacgaaacacacagggtcctgggcaacacggaggactaacagtaacaccgccacgccggcagcaaagctcattttggtccccgccccgttcctctttctctttttaactccttccctctttgcggattctagaacggaacctttttttaattcttcccagtagaaacgtaggaacaatttcgtgaacgcaatccggagtgcccaacatggcggcggccgtaaggtgcatgggtagagccttgatacatcatcaaaggcatagcctttccaagatggtttatcagacatcactttgttcttgttctgtaaacatccgagtgcccaacagacattttgctgctgctacaaagtctgcaaagaaaacaaaaaaaggtgctaaagaaaaaacaccagatgagaaaaaagatgaaatagaaaaaataaaagcatatccctatatggaaggcgaacctgaggatgatgtctatttaaaacgcttatacccgagacagatatatgaggtggagaaagctgttcacttacttaagaaatttcaaattcttgactttactagtccaaagcaaagtgtttatcttgatttgacactggatatggcactgggaaagaagaaaaacgtggagccatttaccagtgttcttagtttgccatacccatttgcttccgaaatcaataaagttgctgtatttacagagaatgcatcagaggtcaaaatagcggaagaaaatggagctgcatttgcaggaggcactagtctgatacagaagatttgggatgatgaaattgttgcagacttttacgtagctgttccagaaataatgcctgaacttaatcgattaaggaagaaactgaataaaaaatatccaaagctttctcgaaattccattggccgtgacatccccaaaatgcttgaattatttaaaaatggacatgaaattaaggtagatgaagaaagggagaactttctccagaccaaaatagcaacattggatatgtcaagtgaccagatagctgccaatctgcaagcagttattaatgaagtttgtaggcacagaccgctgaatttgggtccctttgtggtacgtgctttccttcgtagttcaacaagtgaaggtttattactgaagattgatccattgttgcctaaagaagtaaaaaatgaagaaagtgaaaaagaagatgcctaaatgtggtgaattgtgaaattactttcagtggtttaagaagcaatggagaaaatgataatacagcataatttttacatttgatgtcttgttattgatcatacttgaaagtgaactttaacattgaaaaatcgtacagtcatttcaagaataagaaaataaaattttctctttgtctgaacctgc

SEQ ID NO: 154352 - DNA, 898 bp, Homo sapiens
  Payload ID: 10332
  Gene Symbol: MRPL1
  Gene Name: mitochondrial ribosomal protein L1
  ENST ID: ENST00000502384
  CDS Start-End: 1-694
aaggtctgcaaagaaaacaaaaaaaggtgctaaagaaaaaacaccagatgagaaaaaagatgaaatagaaaaaataaaagcatatccctatatggaaggcgaacctgaggatgatgtctatttaaaacgcttatacccgagacagatatatgaggtggagaaagctgttcacttacttaagaaatttcaaattcttgactttactagtccaaagcaaagtgtttatcttgatttgacactggatatggcactgggaaagaagaaaaacgtggagccatttaccagtgttcttagtttgccatacccatttgcttccgaaatcaataaagttgctgtatttacagagaatgcatcagaggtcaaaatagcggaagaaaatggagctgcatttgcaggaggcactagtctgatacagaagatttgggatgatgaaattgttgcagacttttacgtagctgttccagaaataatgcctgaacttaatcgattaaggaagaaactgaataaaaaatatccaaagctttctcgaaattccattggccgtgacatccccaaaatgcttgaattatttaaaaatggacatgaaattaaggtagatgaagaaagggagaactttctccagaccaaaatagcaacagtccctttgtggtacgtgctttccttcgtagttcaacaagtgaaggtttattactgaagattgatccattgttgcctaaagaagtaaaaaatgaagaaagtgaaaaagaagatgcctaaatgtggtgaattgtgaaattactttcagtggtttaagaagcaatggagaaaatgataatacagcataatttttacatttgatgtcttgttattgatcatacttgaaagtgaactttaacattgaaaaatcgtacagtcattt

SEQ ID NO: 154353 - DNA, 2013 bp, Homo sapiens
  Payload ID: 10333
  Gene Symbol: MRPL10
  Gene Name: mitochondrial ribosomal protein L10
  Uniprot ID: Q7Z7H8
  ENST ID: ENST00000290208
  CDS Start-End: 454-1269
caagtgagctgcccaccttggcctcccaaagtgttgggattacaggcgtgagccaccacacccagcaaaatttctaacaagctctcaaatgatgctgatgttgctggttggggtggaggtggggcataccttgagagccactagattagaccaggggttggcgtattatggcagggccagtcactgtgttttataaaattctattggtacatagtttctgctgtctctttaaatattgtctgtggctgcttttggcagagttgagcattagagacagattacatgggccccaaacttaaaatatttactgtttgaccattttaagaaaaagtttatttaaccttatcccctttttctttctctctctctctctctctttccttccttccttccttccttctttttttttctgagacggagtcttactctgtgcccaggctagagtgcagtggcatgatctcggctcactgcaacctccacctcccgggttcaagcgattctcctgcctcagcctctcaagtagctgggattacaggccggctgcctaccctccagactgtccgctatggctccaaggctgttacccgccaccgtcgtgtgatgcactttcagcggcagaagctgatggctgtgactgaatatatccccccgaaaccagccatccacccatcatgcctgccatctcctcccagccccccacaggaggagataggcctcatcaggcttctccgccgggagatagcagcagttttccaggacaaccgaatgatagccgtctgccagaatgtggctctgagtgcagaggacaagcttcttatgcgacaccagctgcggaaacacaagatcctgatgaaggtcttccccaaccaggtcctgaagcccttcctggaggattccaagtaccaaaatctgctgcccctttttgtggggcacaacatgctgctggtcagtgaagagcccaaggtcaaggagatggtacggatcttaaggactgtgccattcctgccgctgctaggtggctgcattgatgacaccatcctcagcaggcagggctttatcaactactccaagctccccagcctgcccctggtgcagggggagcttgtaggaggcctcacctgcctcacagcccagacccactccctgctccagcaccagcccctccagctgaccaccctgttggaccagtacatcagagagcaacgcgagaaggattctgtcatgtcggccaatgggaagccagatcctgacactgttccggactcgtagccagcctgtttagccagccctgcgcataaatacactctgcgttattggctgtgctctcctcaatgggacatgtggaagaacttggggtcggggagtgtgtttgtcacttggttttcactagtaatgatattgtcaggtatagggccacttggagatgcagaggattccatttcagatgtcagtcaccggcttcgtccttagttttcccaacttgggacgtgataggagcaaagtctctccattctccaggtccaaggcagagatcctgaaaagatagggctattgtcccctgcctccttggtcactgcctcttgctgcacgggctcctgagcccacccccttggggcacaacctgccactgccacagtagctcaaccaagcagttgtgctgagaatggcacctggtgagagcctgctgtgtgccaggctttgtgctgagtgctgtacatgtattagttcctttactgctgaccacattgtacccatttcacagagaaggagcagagaaattaagtggcttgctcaaggtcatgcagttagtaagtggcagaacagggacttgaaccaagccctctgctctgaagaccgcgtcctgaatttcttcactagagcttcctcatcaggttacccagaagtgggtcccatccaccatccaggtgtgcttggatgttagttctccaccctcgaggtgtacgctgtgaaaagtttgggagcactgctttataataaaatgaaatatattct

SEQ ID NO: 154354 - DNA, 1725 bp, Homo sapiens
  Payload ID: 10333
  Gene Symbol: MRPL10
  Gene Name: mitochondrial ribosomal protein L10
  Uniprot ID: Q7Z7H8
  ENST ID: ENST00000351111
  CDS Start-End: 7-792
gtggagatggctgcggccgtggcggggatgctgcgagggggtctcctgccccaggcgggccggctgcctaccctccagactgtccgctatggctccaaggctgttacccgccaccgtcgtgtgatgcactttcagcggcagaagctgatggctgtgactgaatatatccccccgaaaccagccatccacccatcatgcctgccatctcctcccagccccccacaggaggagataggcctcatcaggcttctccgccgggagatagcagcagttttccaggacaaccgaatgatagccgtctgccagaatgtggctctgagtgcagaggacaagcttcttatgcgacaccagctgcggaaacacaagatcctgatgaaggtcttccccaaccaggtcctgaagcccttcctggaggattccaagtaccaaaatctgctgcccctttttgtggggcacaacatgctgctggtcagtgaagagcccaaggtcaaggagatggtacggatcttaaggactgtgccattcctgccgctgctaggtggctgcattgatgacaccatcctcagcaggcagggctttatcaactactccaagctccccagcctgcccctggtgcagggggagcttgtaggaggcctcacctgcctcacagcccagacccactccctgctccagcaccagcccctccagctgaccaccctgttggaccagtacatcagagagcaacgcgagaaggattctgtcatgtcggccaatgggaagccagatcctgacactgttccggactcgtagccagcctgtttagccagccctgcgcataaatacactctgcgttattggctgtgctctcctcaatgggacatgtggaagaacttggggtcggggagtgtgtttgtcacttggttttcactagtaatgatattgtcaggtatagggccacttggagatgcagaggattccatttcagatgtcagtcaccggcttcgtccttagttttcccaacttgggacgtgataggagcaaagtctctccattctccaggtccaaggcagagatcctgaaaagatagggctattgtcccctgcctccttggtcactgcctcttgctgcacgggctcctgagcccacccccttggggcacaacctgccactgccacagtagctcaaccaagcagttgtgctgagaatggcacctggtgagagcctgctgtgtgccaggctttgtgctgagtgctgtacatgtattagttcctttactgctgaccacattgtacccatttcacagagaaggagcagagaaattaagtggcttgctcaaggtcatgcagttagtaagtggcagaacagggacttgaaccaagccctctgctctgaagaccgcgtcctgaatttcttcactagagcttcctcatcaggttacccagaagtgggtcccatccaccatccaggtgtgcttggatgttagttctccaccctcgaggtgtacgctgtgaaaagtttgggagcactgctttataataaaatgaaatatattctacttcctttattttgtggtttacacggttgtcctccctctaaacttactctcaggggcttctctgtcatctgactttcctcactcttgcttcccttcctaggaaaatcctcttcccctatacctgttcccacaaatggcatcccgcgcatgcttgccctattaaaggcagctgacagctgtacccacta

SEQ ID NO: 154355 - DNA, 612 bp, Homo sapiens
  Payload ID: 10333
  Gene Symbol: MRPL10
  Gene Name: mitochondrial ribosomal protein L10
  ENST ID: ENST00000423147
  CDS Start-End: 13-159
cttccggtggagatggctgcggccgtggcggggatgctgcgagggggtctcctgccccaggcgggtaaggagtggcccaggtcctcacggcgtgtcttgcggccgctctctagtcctcatctgccctcctctactactgattcttcccataatctctgaccccagctagatcgctggcctccttaccccgtccagttccttgtgactcgactggctagagtgcagtggcatgatctcggctcactgcaacctccacctcccgggttcaagcgattctcctgcctcagcctctcaagtagctgggattacaggccggctgcctaccctccagactgtccgctatggctccaaggctgttacccgccaccgtcgtgtgatgcactttcagcggcagaagctgatggctgtgactgaatatatccccccgaaaccagccatccacccatcatgcctgccatctcctcccagccccccacaggaggagataggcctcatcaggcttctccgccgggagatagcagcagttttccaggacaaccgaatgatagccgtctgccagaatgtggctctgagtgcagaggacaagcttcttatgcgacaccagctgcggaa

SEQ ID NO: 154356 - DNA, 1622 bp, Homo sapiens
  Payload ID: 10333
  Gene Symbol: MRPL10
  Gene Name: mitochondrial ribosomal protein L10
  Uniprot ID: Q7Z7H8
  ENST ID: ENST00000414011
  CDS Start-End: 92-907
ttccgtccattcttccggtggagatggctgcggccgtggcggggatgctgcgagggggtctcctgccccaggcgggctagagtgcagtggcatgatctcggctcactgcaacctccacctcccgggttcaagcgattctcctgcctcagcctctcaagtagctgggattacaggccggctgcctaccctccagactgtccgctatggctccaaggctgttacccgccaccgtcgtgtgatgcactttcagcggcagaagctgatggctgtgactgaatatatccccccgaaaccagccatccacccatcatgcctgccatctcctcccagccccccacaggaggagataggcctcatcaggcttctccgccgggagatagcagcagttttccaggacaaccgaatgatagccgtctgccagaatgtggctctgagtgcagaggacaagcttcttatgcgacaccagctgcggaaacacaagatcctgatgaaggtcttccccaaccaggtcctgaagcccttcctggaggattccaagtaccaaaatctgctgcccctttttgtggggcacaacatgctgctggtcagtgaagagcccaaggtcaaggagatggtacggatcttaaggactgtgccattcctgccgctgctaggtggctgcattgatgacaccatcctcagcaggcagggctttatcaactactccaagctccccagcctgcccctggtgcagggggagcttgtaggaggcctcacctgcctcacagcccagacccactccctgctccagcaccagcccctccagctgaccaccctgttggaccagtacatcagagagcaacgcgagaaggattctgtcatgtcggccaatgggaagccagatcctgacactgttccggactcgtagccagcctgtttagccagccctgcgcataaatacactctgcgttattggctgtgctctcctcaatgggacatgtggaagaacttggggtcggggagtgtgtttgtcacttggttttcactagtaatgatattgtcaggtatagggccacttggagatgcagaggattccatttcagatgtcagtcaccggcttcgtccttagttttcccaacttgggacgtgataggagcaaagtctctccattctccaggtccaaggcagagatcctgaaaagatagggctattgtcccctgcctccttggtcactgcctcttgctgcacgggctcctgagcccacccccttggggcacaacctgccactgccacagtagctcaaccaagcagttgtgctgagaatggcacctggtgagagcctgctgtgtgccaggctttgtgctgagtgctgtacatgtattagttcctttactgctgaccacattgtacccatttcacagagaaggagcagagaaattaagtggcttgctcaaggtcatgcagttagtaagtggcagaacagggacttgaaccaagccctctgctctgaagaccgcgtcctgaatttcttcactagagcttcctcatcaggttacccagaagtgggtcccatccaccatccaggtgtgcttggatgttagttctccaccctcgaggtgtacgctgtgaaaagtttgggagca

SEQ ID NO: 154357 - DNA, 1576 bp, Homo sapiens
  Payload ID: 10333
  Gene Symbol: MRPL10
  Gene Name: mitochondrial ribosomal protein L10
  ENST ID: ENST00000421763
  CDS Start-End: 20-166
gtccattcttccggtggagatggctgcggccgtggcggggatgctgcgagggggtctcctgccccaggcgggtaaggagtggcccaggtcctcacggcgtgtcttgcggccgctctctagtcctcatctgccctcctctactactgattcttcccataatctctgaccccagctagatcgctggcctccttaccccgtccagttccttgtgactcgactggccggctgcctaccctccagactgtccgctatggctccaaggctgttacccgccaccgtcgtgtgatgcactttcagcggcagaagctgatggctgtgactgaatatatccccccgaaaccagccatccacccatcatgcctgccatctcctcccagccccccacaggaggagataggcctcatcaggcttctccgccgggagatagcagcagttttccaggacaaccgaatgatagccgtctgccagaatgtggctctgagtgcagaggacaagcttcttatgcgacaccagctgcggaaacacaagatcctgatgaaggtcttccccaaccaggtcctgaagcccttcctggaggattccaagtaccaaaatctgctgcccctttttgtggggcacaacatgctgctggtcagtgaagagcccaaggtcaaggagatggtacggatcttaaggactgtgccattcctgccgctgctaggtggctgcattgatgacaccatcctcagcaggcagggctttatcaactactccaagctccccagcctgcccctggtgcagggggagcttgtaggaggcctcacctgcctcacagcccagacccactccctgctccagcaccagcccctccagctgaccaccctgttggaccagtacatcagagagcaacgcgagaaggattctgtcatgtcggccaatgggaagccagatcctgacactgttccggactcgtagccagcctgtttagccagccctgcgcataaatacactctgcgttattggctgtgctctcctcaatgggacatgtggaagaacttggggtcggggagtgtgtttgtcacttggttttcactagtaatgatattgtcaggtatagggccacttggagatgcagaggattccatttcagatgtcagtcaccggcttcgtccttagttttcccaacttgggacgtgataggagcaaagtctctccattctccaggtccaaggcagagatcctgaaaagatagggctattgtcccctgcctccttggtcactgcctcttgctgcacgggctcctgagcccacccccttggggcacaacctgccactgccacagtagctcaaccaagcagttgtgctgagaatggcacctggtgagagcctgctgtgtgccaggctttgtgctgagtgctgtacatgtattagttcctttactgctgaccacattgtacccatttcacagagaaggagcagagaaattaagtggcttgctcaaggtcatgcagttagtaagtggcagaacagggacttgaaccaagccctctgctctgaagaccgcgtcctgaatttcttcactagagcttcctcatca

SEQ ID NO: 154358 - DNA, 1605 bp, Homo sapiens
  Payload ID: 10334
  Gene Symbol: MRPL11
  Gene Name: mitochondrial ribosomal protein L11
  Uniprot ID: Q9Y3B7
  ENST ID: ENST00000310999
  CDS Start-End: 95-673
gtgaggacccttgacctctggcccaagatggtggcgcccagagcttcgctcttgctgctcccctgaggtgaactgaagccagcagccccgcatcatgtcaaagctcggccgggccgcccggggcctcaggaagcccgaggtcggcggtgtgatccgggcgatcgtgcgggcaggcctggccatgcccgggcccccactaggcccagtgctgggtcagagaggcgtttccatcaaccagttttgcaaggagttcaatgagaggacaaaggacatcaaggaaggcattcctctgcctaccaagattttagtgaagcctgacaggacatttgaaattaagattggacagcccactgtttcctacttcctgaaggcagcagctgggattgaaaagggggcccggcaaacagggaaagaggtggcaggcctggtgaccttgaagcatgtgtatgagattgcccgcatcaaagctcaggatgaggcatttgccctgcaggatgtacccctgtcgtctgttgtccgctccatcatcgggtctgcccgttctctgggcattcgcgtggtgaaggacctcagttcagaagagcttgcagctttccagaaggaacgagccatcttcctggctgctcagaaggaggcagatttggctgcccaagaagaagctgccaagaagtgacccttgccccaccaactcccagatttcaaaggaggtagttgcaaaagctgtgcccaaggggaggaaggaggtcacaccaatatgatgatggttttcatgactttgaatgatatatttttgtacatctagctgtatcgaggcatcaggcctgaataaacatcctttcttacccactgtcatcttctatcttgggacctcagggaagggaaccagtactggtggtagccaatatgggcagacattaggaaattggggtcttcatactgcttctcagatgtgcaaactgaggttcagccaagcaaagtaacttgcccaggtccttttttttcttttttaagttataattttgttttattgcccaggttctgaattggtgccagaggtaggaatagaacccaggccttctcatttgaaatcctgtgttcttcccctccccagggtgggaactatggttgctagggctgaggtgtattgcttacttcttccatcaaaaatctcttttatctctgaacaacttgccacctctgcagaaacaagtccctgtggagatctcagttcagccccaggcagggttactacatggagtacccagatcccaggggctacttcaggcccttctactaagctcctgaccctggctctgggtcagatgttggctgaacatgaactattgtagggctgacagctacagaccacagaaagagcaaagcttcagtaggttcctgcctgatggagaagtcctcgggaagcccttggccttctatttcctcattgtcctttcagagaagagagcaggagttgggggagaaaggagattcgcatttactgaccatctgttatgtgctagacacttcattttacactgagaaaatatggaaagcatagataaacacctaaaagaaaataaaaacctcatgttatcccaccaccca

SEQ ID NO: 154359 - DNA, 922 bp, Homo sapiens
  Payload ID: 10334
  Gene Symbol: MRPL11
  Gene Name: mitochondrial ribosomal protein L11
  Uniprot ID: Q9Y3B7
  ENST ID: ENST00000329819
  CDS Start-End: 81-626
cctctggcccaagatggtggcgcccagagcttcgctcttgctgctcccctgaggtgaactgaagccagcagccccgcatcatgtcaaagctcggccgggccgcccggggcctcaggaagcccgaggtcggcggtgtgatccgggcgatcgtgcgggcaggcctggccatgcccgggcccccactaggcccagtgctgggtcagagaggcgtttccatcaaccagttttgcaaggagttcaatgagaggacaaaggacatcaaggaaggcattcctctgcctaccaagattttagtgaagcctgacaggacatttgaaattaagattggacagcccactgtttcctacttcctgaaggcagcagctgggattgaaaagggggcccggcaaacagggaaagaggtggcaggcctggtgaccttgaagcatgtgtatgagattgcccgcatcaaagctcaggatgaggcatttgccctgcaggatgtacccctgtcgtctgttgtccgctccatcatcgggtctgcccgttctctgggcattcgcgtggtgaaggaacgttgttctgcaaatgttctaagaaatggaaagatctccatgaaggatccaagtgggagaagttcagtgtgacctgggtctgtcgtcctagagcctcagttcagaagagcttgcagctttccagaaggaacgagccatcttcctggctgctcagaaggaggcagatttggctgcccaagaagaagctgccaagaagtgacccttgccccaccaactcccagatttcaaaggaggtagttgcaaaagctgtgcccaaggggaggaaggaggtcacaccaatatgatgatggttttcatgactttgaatgatatatttttgtacatctagctgtatcgaggcatcaggcctgaataaacatcctttctta

SEQ ID NO: 154360 - DNA, 1527 bp, Homo sapiens
  Payload ID: 10334
  Gene Symbol: MRPL11
  Gene Name: mitochondrial ribosomal protein L11
  Uniprot ID: Q9Y3B7
  ENST ID: ENST00000430466
  CDS Start-End: 95-595
gtgaggacccttgacctctggcccaagatggtggcgcccagagcttcgctcttgctgctcccctgaggtgaactgaagccagcagccccgcatcatgtcaaagctcggccgggccgcccggggcctcaggaagcccgagagaggcgtttccatcaaccagttttgcaaggagttcaatgagaggacaaaggacatcaaggaaggcattcctctgcctaccaagattttagtgaagcctgacaggacatttgaaattaagattggacagcccactgtttcctacttcctgaaggcagcagctgggattgaaaagggggcccggcaaacagggaaagaggtggcaggcctggtgaccttgaagcatgtgtatgagattgcccgcatcaaagctcaggatgaggcatttgccctgcaggatgtacccctgtcgtctgttgtccgctccatcatcgggtctgcccgttctctgggcattcgcgtggtgaaggacctcagttcagaagagcttgcagctttccagaaggaacgagccatcttcctggctgctcagaaggaggcagatttggctgcccaagaagaagctgccaagaagtgacccttgccccaccaactcccagatttcaaaggaggtagttgcaaaagctgtgcccaaggggaggaaggaggtcacaccaatatgatgatggttttcatgactttgaatgatatatttttgtacatctagctgtatcgaggcatcaggcctgaataaacatcctttcttacccactgtcatcttctatcttgggacctcagggaagggaaccagtactggtggtagccaatatgggcagacattaggaaattggggtcttcatactgcttctcagatgtgcaaactgaggttcagccaagcaaagtaacttgcccaggtccttttttttcttttttaagttataattttgttttattgcccaggttctgaattggtgccagaggtaggaatagaacccaggccttctcatttgaaatcctgtgttcttcccctccccagggtgggaactatggttgctagggctgaggtgtattgcttacttcttccatcaaaaatctcttttatctctgaacaacttgccacctctgcagaaacaagtccctgtggagatctcagttcagccccaggcagggttactacatggagtacccagatcccaggggctacttcaggcccttctactaagctcctgaccctggctctgggtcagatgttggctgaacatgaactattgtagggctgacagctacagaccacagaaagagcaaagcttcagtaggttcctgcctgatggagaagtcctcgggaagcccttggccttctatttcctcattgtcctttcagagaagagagcaggagttgggggagaaaggagattcgcatttactgaccatctgttatgtgctagacacttcattttacactgagaaaatatggaaagcatagataaacacctaaaagaaaataaaaacctcatgttatcccaccaccca

SEQ ID NO: 154361 - DNA, 506 bp, Homo sapiens
  Payload ID: 10334
  Gene Symbol: MRPL11
  Gene Name: mitochondrial ribosomal protein L11
  ENST ID: ENST00000528272
  CDS Start-End: 1-192
gagattgcccgcatcaaagctcaggatgaggcatttgccctgcaggatgtacccctgtcgtctgttgtccgctccatcatcgggtctgcccgttctctgggcattcgcgtggtgaaggaacgttgttctgcaaatgttctaagaaatggaaagatctccatgaaggatccaagtgggagaagttcagtgtgacctgggtctgtcgtcctagaggcaagtggagaatgcctcagttcagaagagcttgcagctttccagaaggaacgagccatcttcctggctgctcagaaggaggcagatttggctgcccaagaagaagctgccaagaagtgacccttgccccaccaactcccagatttcaaaggaggtagttgcaaaagctgtgcccaaggggaggaaggaggtcacaccaatatgatgatggttttcatgactttgaatgatatatttttgtacatctagctgtatcgaggcatcaggcctgaataaacatcctttcttaccca

SEQ ID NO: 154362 - DNA, 812 bp, Homo sapiens
  Payload ID: 10334
  Gene Symbol: MRPL11
  Gene Name: mitochondrial ribosomal protein L11
  ENST ID: ENST00000534488
  CDS Start-End: 73-300
ccaagatggtggcgcccagagcttcgctcttgctgctcccctgaggtgaactgaagccagcagccccgcatcatgtcaaagctcggccgggccgcccggggcctcaggaagcccgaggtcggcggtgtgatccgggcgatcgtgcgggcaggcctggccatgcccgggcccccactaggcccagtgctgggtcagagaggcgtttccatcaaccagttttgcaaggagttcaatgagaggacaaaggacatcaaggaaggcattcctctgcctaccaagattttagtgaaggacatttgaaattaagattggacagcccactgtttcctacttcctgaaggcagcagctgggattgaaaagggggcccggcaaacagggaaagaggtggcaggcctggtgaccttgaagcatgtgtatgagattgcccgcatcaaagctcaggatgaggcatttgccctgcaggatgtacccctgtcgtctgttgtccgctccatcatcgggtctgcccgttctctgggcattcgcgtggtgaaggacctcagttcagaagagcttgcagctttccagaaggaacgagccatcttcctggctgctcagaaggaggcagatttggctgcccaagaagaagctgccaagaagtgacccttgccccaccaactcccagatttcaaaggaggtagttgcaaaagctgtgcccaaggggaggaaggaggtcacaccaatatgatgatggttttcatgactttgaatgatatatttttgtacatctagctgtatcgaggcatcaggcctgaataaacatcctttctta

SEQ ID NO: 154363 - DNA, 1028 bp, Homo sapiens
  Payload ID: 10335
  Gene Symbol: MRPL12
  Gene Name: mitochondrial ribosomal protein L12
  Uniprot ID: P52815
  ENST ID: ENST00000333676
  CDS Start-End: 146-742
cggctagagcgtcatttccggctcgaatgcccggcagccgtggcggctagagcgttcctccccagctcgaatgcccggcggccgaggcggctagagcgtcgcctcctcccggggaaccgcgtgtgaccttccagcccgcggaccgatgctgccggcggccgctcgccccctgtgggggccttgccttgggcttcgggccgctgcgttccgccttgccaggcgacaggtgccatgtgtctgtgccgtgcgacatatgaggagcagcggccatcagaggtgtgaggccctcgctggtgcacccctggataacgcccccaaggagtacccccccaagatacagcagctggtccaggacatcgccagcctcactctcttggaaatctcagacctcaacgagctcctgaagaaaacgttgaagatccaggatgtcgggcttgtgccgatgggtggtgtgatgtctggggctgtccctgctgcagcagcccaggaggcggtggaagaagatatccccatagcgaaagaacggacacatttcaccgtccgcctgaccgaggcgaagcccgtggacaaagtgaagctgatcaaggaaatcaagaactacatccaaggcatcaacctcgtccaggcaaagaagctggtggagtccctgccccaggaaatcaaagccaatgtcgccaaagctgaggcggagaagatcaaggcggccctggaggcggtgggcggcaccgtggttctggagtagcctccagctcggaggacttgtgttcaggggtcctgggccccgggcgaggtcccgccctcccgtggtcactggctccgcccccagcaccaggcgcccagtggagccgtttgggagaattgcctgcgccacgcagcggggccggacaggccgcacagacctactgtggcgggagggaggggcggctgctgcctggtgacggcacccggaggcccaccaggacgcgccaccggtgaatgtgcctctggtggctgctgagaaaaatacactgtgcagctcagtgtgtgga

SEQ ID NO: 154364 - DNA, 885 bp, Homo sapiens
  Payload ID: 10335
  Gene Symbol: MRPL12
  Gene Name: mitochondrial ribosomal protein L12
  ENST ID: ENST00000541223
  CDS Start-End: 15-551
cagcccgcggaccgatgctgccggcggccgctcgccccctgtgggggccttgccttgggcttcgggccgctgcgttccgccttgccaggcgacaggtgccatgtgtctgtgccgtgcgacatatgaggagcagcggccatcagaggtgtgaggccctcgctggtgcacccctggataacgcccccaaggagtacccccccaagatacagcagctggtccaggacatcgccagcctcactctcttggaaatctcagacctcaacgagctcctgaagaaaacgttgaagatccaggatgtcgggcttgtgccgatgggtggtgtgatgtctggggctgtccctgctgcagcagcccaggaggcggtggaagaagatatccccatagcgaaagaacggacacatttcaccgtccgcctgaccgaggcgaagcccgtggacaaagtgaagctgatcaaggaaatcaagaactacatcaaggcatcaacctcgtccaggcaaagaagctggtggagtccctgcccaggaaatcaaagccaatgtcgccaaagctgaggcggagaagatcaaggcggccctggaggcggtgggcggcaccgtggttctggagtagcctccagctcggaggacttgtgttcaggggtcctgggccccgggcgaggtcccgccctcccgtggtcactggctccgcccccagcaccaggcgcccagtggagccgtttgggagaattgcctgcgccacgcagcggggccggacaggccgcacagacctactgtggcgggagggaggggcggctgctgcctggtgacggcacccggaggcccaccaggacgcgccaccggtgaatgtgcctctggtggctgctgagaaaaatacactgtgcagctc

SEQ ID NO: 154365 - DNA, 1086 bp, Homo sapiens
  Payload ID: 10336
  Gene Symbol: MRPL13
  Gene Name: mitochondrial ribosomal protein L13
  Uniprot ID: Q9BYD1
  ENST ID: ENST00000306185
  CDS Start-End: 293-829
gtttaggtcggctggaaattatgtcctccgtcggttttccgcagtttttccaccaagcgagatatttttgggagttattccctaaataactgcattatatgctcctttcatgacgaaattgctgccgtggagaagactggaggaaactcgaggaagagggagaagccgacaagtgctcgacgggctaggaactgtcctgcttgggtgttagcgtttcccgccgggccagtaaggctgagtgacccggcgtggctactaggagaaggacgtacggtcctgctagtagaggaatatgtcgagtttctctagggcgccccagcaatgggccacttttgctagaatatggtatctcttagatgggaaaatgcagccacctggcaaacttgctgctatggcatctataagacttcagggattacataaacctgtgtaccatgcactgagtgactgtggggatcatgttgttataatgaacacaagacacattgcattttctggaaacaaatgggaacaaaaagtatactcttcgcatactggctacccaggtggatttagacaagtaacagctgctcagcttcacctgagggatccagtggcaattgtaaaactagctatttatggcatgctgccaaaaaaccttcacagaagaacaatgatggaaaggttgcatctttttccagatgagtatattccagaagatattcttaagaatttagtagaggagcttcctcaaccacgaaaaatacctaaacgtctagatgagtacacacaagaagaaatagacgccttcccaagattgtggactccacctgaagattatcggctataagagaataagaattgcagaaaataacagtgaagtgattgaaactttcttctgatgagtttctctaacctacaggatggagtaaaacaactgctacagttcagcacctgttttatgtgccgaatcactgtggggaaaggtcaggaaggtatagtccttcaataggaaattgtaattaaaatataattttatagaaccatttttatgtaatctgatttgaatgttatagttgataataataaaatcacttacttggttga

SEQ ID NO: 154366 - DNA, 703 bp, Homo sapiens
  Payload ID: 10336
  Gene Symbol: MRPL13
  Gene Name: mitochondrial ribosomal protein L13
  ENST ID: ENST00000521648
  CDS Start-End: 1-144
tatattccagaagatattcttaagaatttagtagaggagcttcctcaaccacgaaaaatacctaaacgtctagatgagtacacacaagaagaaatagacgccttcccaagattgtggactccacctgaagattatcggctataagagaataagaattgcagaaaataacagtgaagtgattgaaactttcttctgatgagtttctctaacctacaggatggagtaaaacaactgctacagttcagcacctgttttatgtgccgaatcactgtggggaaaggtcaggaagatcccttctgcttactatgacattacccagagccacggcggacagtggtgagagtgcagcagactcactggcactggcaggtgctcatgtctcatgcatatgcaaggagcttctgggttctgtctcagggtactcatgccaagacagcctccgagattgaaagttaacaccctgagaaacaaggctcaaccacaaggattcaggaatcagtgaaggaaagcttcaacctcccatcctctaggggacagttctaagaaggatcttctcacttctcagaagtcaaggtagaattgaatccccactgcctatagctgctgctgataatgcacctttaggttggcttttccttgttccctgtctcatttgtgctgctccctcactgctatttcctttagtcacttttcaaataaactg

SEQ ID NO: 154367 - DNA, 1418 bp, Homo sapiens
  Payload ID: 10336
  Gene Symbol: MRPL13
  Gene Name: mitochondrial ribosomal protein L13
  ENST ID: ENST00000518696
  CDS Start-End: 309-485
atttccggttcccttcgtttaggtcggctggaaattatgtcctccgtcggttttccgcagtttttccaccaagcgagatatttttgggagttattccctaaataactgcattatatgctcctttcatgacgaaattgctgccgtggagaagactggaggaaactcgaggaagagggagaagccgacaagtgctcgacgggctaggaactgtcctgcttgggtgttagcgtttcccgccgggccagtaaggctgagtgacccggcgtggctactaggagaaggacgtacggtcctgctagtagaggaatatgtcgagtttctctagggcgccccagcaatgggccacttttgctagaatatggtatctcttagatgggaaaatgcagccacctggcaaacttgctgctatggcatctataagacttcagggattacataaacctgtgtaccatgcactgactacccaggtggatttagacaagtaacagctgctcagcttcacctgagggatccagtggcaattgtaaaactagctatttatggcatgctgccaaaaaaccttcacagaagaacaatgatggaaaggttgcatctttttccagatgagtatattccagaagatattcttaagaatttagtagaggagcttcctcaaccacgaaaaatacctaaacgtctagatgagtacacacaagaagaaatagacgccttcccaagattgtggactccacctgaagattatcggctataagagaataagaattgcagaaaataacagtgaagtgattgaaactttcttctgatgagtttctctaacctacaggatggagtaaaacaactgctacagttcagcacctgttttatgtgccgaatcactgtggggaaaggtcaggaaggtatagtccttcaataggaaattgtaattaaaatataattttatagaaccatttttatgtaatctgatttgaatgttatagttgataataataaaatcacttacttggttgactatttagtgttgcatttaatgataaaaaacagaccctgtgtatagaattgcagttacacattccaaaaatgcctctccatgcagattttctcaagtttgcaggtcactattcttgtcccttgtgaacaagctctaccttcacttttcatttcagtggctttttttatctaacttgtcatccatctaaattcatatttgcagcttagtagggtaaagtttgccctgaaatatttataaactgctatctttttctgtgtcccatatagcctcttggccccacaatgacaccagaatacataatgcctgtctgctcgttagaaatccctcttccctgccagtgattctgtttgtagactctccacactgttttcccatatctgtcctgttggcttccattcatctctgtact

SEQ ID NO: 154368 - DNA, 633 bp, Homo sapiens
  Payload ID: 10336
  Gene Symbol: MRPL13
  Gene Name: mitochondrial ribosomal protein L13
  ENST ID: ENST00000518918
  CDS Start-End: 191-633
gtcgagtttctctagggcgccccaggtgagctcggactcttatggcttgatggggttcattatactggcagaaggagagcgttggttccggcagattaagtagtgaagctggggcggcagggaagccgagaccctcggccaagagcaatgggccacttttgctagaatatggtatctcttagatgggaaaatgcagccacctggcaaacttgctgctatggcatctataagacttcagggattacataaacctgtgtaccatgcactgagtgactgtggggatcatgttgttataatgaacacaagacacattgcattttctggaaacaaatgggaacaaaaagtatactcttcgcatactggctacccaggtggatttagacaagtaacagctgctcagcttcacctgagggatccagtggcaattgtaaaactagctatttatggcatgctgccaaaaaaccttcacagaagaacaatgatggaaaggttgcatctttttccagatgagtatattccagaagatattcttaagaatttagtagaggagcttcctcaaccacgaaaaatacctaaacgtctagatgagtacacacaagaagaaatagacgccttcccaagattgtggactcc

SEQ ID NO: 154369 - DNA, 959 bp, Homo sapiens
  Payload ID: 10337
  Gene Symbol: MRPL14
  Gene Name: mitochondrial ribosomal protein L14
  Uniprot ID: Q6P1L8
  ENST ID: ENST00000372014
  CDS Start-End: 133-570
atcgcgtccgccgggctgggcctggcgcgcaggcgctaggaagaggccgcgtggggcgaaggcggcgcttggctggtggggcccgcggcgggattttcccgggcggcgagagcggatctatcttgggatcccatggctttctttactgggctctggggccccttcacctgtgtaagcagagtgctgagccatcactgtttcagcaccactgggagtctgagtgcgattcagaagatgacgcgggtacgagtggtggacaacagtgccctggggaacagcccataccatcgggctcctcgctgcatccatgtctataagaagaatggagtgggcaaggtgggcgaccagatactactggccatcaagggacagaagaaaaaggcgctcattgtggggcactgcatgcctggcccccgaatgacccccagattcgactccaacaacgtggtcctcattgaggacaacgggaaccctgtggggacacgaattaagacacccatccccaccagcctgcgcaagcgggaaggcgagtattccaaggtgctggccattgctcagaactttgtgtgagttgagcccaggcctctggttgcaggactcgtgaatggagcagttctgagaaccacccttttgctaagggagcttgggagccacatggctgctcccttcacactgggtaacagtgtagtatcctgtgagagaataaatgtattcatttatgtgtttttccagagctttctgggatgtgggaaaataaattacactgaagcagttgaaaggtggcttacccgagtctggccacacggggtagcattctttacatggagcagccttggtgccagggtctgagcccttgcttttctggtttggaccctataagttcatccaggactgtcaggccctggaaaactgaggtacacaccaaatgccaatttataaatgtaccatggctctaacca

SEQ ID NO: 154370 - DNA, 1147 bp, Homo sapiens
  Payload ID: 10338
  Gene Symbol: MRPL15
  Gene Name: mitochondrial ribosomal protein L15
  Uniprot ID: Q9P015
  ENST ID: ENST00000260102
  CDS Start-End: 75-965
acaaagcagcccccgagaccacgtggcctccgagcagctcagggcgcccttgaaagttcttggatctgcgggttatggccggtcccttgcagggcggtggggcccgggccctggacctactccggggcctgccgcgtgtgagcctggccaacttaaagccgaatcccggctccaagaaaccggagagaagaccaagaggtcggagaagaggtagaaaatgtggcagaggccataaaggagaaaggcaaagaggaacccggccccgcttgggctttgagggaggccagactccattttacatccgaatcccaaaatacgggtttaacgaaggacatagtttcagacgccagtataagcctttgagtctcaatagactgcagtatcttattgatttgggtcgtgttgatcctagtcaacctattgacttaacccagcttgtcaatgggagaggtgtgaccatccagccacttaaaagggattatggtgtccagctggttgaggagggtgctgacacctttacggcaaaagttaatattgaagtacagttggcttcagaactagctattgctgccattgaaaaaaatggtggtgttgttactacagccttctatgatccaagaagtctggacattgtatgcaaacctgttccattctttcttcgtggacaacccattccaaaaagaatgcttccaccagaagaactggtaccatattacactgatgcaaagaaccgtgggtacctggcggatcctgccaaatttcctgaagcacgacttgaactcgccaggaagtatggttatatcttacctgatatcactaaagatgaactcttcaaaatgctctgtactaggaaggatccaaggcagattttctttggtcttgctccaggatgggtggtgaatatggccgataagaaaatcctaaaacctacagatgaaaatctccttaagtattatacctcatgaattcccgtccaaggaagcagagttgttaaagagtactggaataggggctgaaggatctatattcccttattgcattttccttatgtataattttccagatggtgatgttacttttcagtgtactcatatgtctcattttcatctaaaattaaatggcaggaaacaaggactgcatagagaaa

SEQ ID NO: 154371 - DNA, 601 bp, Homo sapiens
  Payload ID: 10338
  Gene Symbol: MRPL15
  Gene Name: mitochondrial ribosomal protein L15
  ENST ID: ENST00000519831
  CDS Start-End: 8-601
gcgggttatggccggtcccttgcagggcggtggggcccgggccctggacctactccggggcctgccgcgtgtgagcctggccaacttaaagccgaatcccggctccaagaaaccggagagaagaccaagaggtcggagaagaggtagaaaatgtggcagaggccataaaggagaaaggcaaagaggaacccggccccgcttgggctttgagggaggccagactccattttacatccgaatcccaaaatacgggtttaacgaaggacatagtttcagacgccagtataagcctttgagtctcaatagactgcagtatcttattgatttgggtcgtgttgatcctagtcaacctattgacttaacccagcttgtcaatgggagaggtgtgaccatccagccacttaaaagggattatggtgtccagctggttgaggagggtgctgacacctttacggcaaaagttaatattgaagtacagttggcttcagaactagctattgctgccattgaaaaaaatggtggtgttgttactacagccttctatgatccaagaagtctgggtaagtttgttccacggtcattttcttctttctctctttgt

SEQ ID NO: 154372 - DNA, 853 bp, Homo sapiens
  Payload ID: 10338
  Gene Symbol: MRPL15
  Gene Name: mitochondrial ribosomal protein L15
  ENST ID: ENST00000522521
  CDS Start-End: 1-714
caggagagaagaccaagaggtcggagaagaggccagactccattttacatccgaatcccaaaatacgggtttaacgaaggacatagtttcagacgccagtataagcctttgagtctcaatagactgcagtatcttattgatttgggtcgtgttgatcctagtcaacctattgacttaacccagcttgtcaatgggagaggtgtgaccatccagccacttaaaagggattatggtgtccagctggttgaggagggtgctgacacctttacggcaaaagttaatattgaagtacagttggcttcagaactagctattgctgccattgaaaaaaatggtggtgttgttactacagccttctatgatccaagaagtctggacattgtatgcaaacctgttccattctttcttcgtggacaacccattccaaaaagaatgcttccaccagaagaactggtaccatattacactgatgcaaagaaccgtgggtacctggcggatcctgccaaatttcctgaagcacgacttgaactcgccaggaagtatggttatatcttacctgatatcactaaagatgaactcttcaaaatgctctgtactaggaaggatccaaggcagattttctttggtcttgctccaggatgggtggtgaatatggccgataagaaaatcctaaaacctacagatgaaaatctccttaagtattatacctcatgaattcccgtccaaggaagcagagttgttaaagagtactggaataggggctgaaggatctatattcccttattgcattttccttatgtataattttccagatggtgatgttacttttcagtgtactcatatgtctcatttt

SEQ ID NO: 154373 - DNA, 1182 bp, Homo sapiens
  Payload ID: 10339
  Gene Symbol: MRPL16
  Gene Name: mitochondrial ribosomal protein L16
  Uniprot ID: Q9NX20
  ENST ID: ENST00000300151
  CDS Start-End: 215-970
actcaacctcccccggaactcaacccccgtcgctcgagtttctttcgcttccgtcgggactctgcggagtggacccgagtgaacacaacttccggccccactgagcggtgtcctgagccgattacagctaggtagtggagcgccgctgcttacctgggtgcaggagacagccggagtcgctgggggagctccgcgccgccggacgcccgtgaccatgtggaggctgctggctcgcgctagtgcgccgctcctgcgggtgcccttgtcagattcctgggcactcctccccgccagtgctggcgtaaagacactgctcccagtaccaagttttgaagatgtttccattcctgaaaaacccaagcttagatttattgaaagggcaccacttgtgccaaaagtaagaagagaacctaaaaatttaagtgacatacggggaccttccactgaagctacggagtttacagaaggcaattttgcaatcttggcattgggtggtggctacctgcattggggccactttgaaatgatgcgcctgacaatcaaccgctctatggaccccaagaacatgtttgccatatggcgagtaccagcccctttcaagcccatcactcgcaaaagtgttgggcatcgcatggggggaggcaaaggtgctattgaccactacgtgacacctgtgaaggctggccgccttgttgtagagatgggtgggcgttgtgaatttgaagaagtgcaaggtttccttgaccaggttgcccacaagttgcccttcgcagcaaaggctgtgagccgcgggactctagagaagatgcgaaaagatcaagaggaaagagaacgtaacaaccagaacccctggacatttgagcgaatagccactgccaacatgctgggcatacggaaagtactgagcccatatgacttgacccacaaggggaaatactggggcaagttctacatgcccaaacgtgtgtagtgagtgtaggagataactgtatataggctactgaaagaaggattctgcatttctattcccctcagcctacccactgaagtctttgggtagctcttaagccataactaaggagcagcatttgagtagatttctgaaaaacaatgttatttgttgatttaaaaagaaaactgtatttttattaaataaaatttaaacatcacttcaggatataa

SEQ ID NO: 154374 - DNA, 574 bp, Homo sapiens
  Payload ID: 10339
  Gene Symbol: MRPL16
  Gene Name: mitochondrial ribosomal protein L16
  ENST ID: ENST00000534340
  CDS Start-End: 316-574
gcggtggctcacgcctttaatagcagcactttgggaggccgaggcgggcgaatcacttgagattcctgggcactcctccccgccagtgctggcgtaaagacactgctcccagtaccaagttttgaagatgtttccattcctgaaaaacccaagcttagatttattgaaagggcaccacttgtgccaaaagtaagaagagaacctaaaaatttaagtgacatacggggaccttccactgaagctacggagtttacagaaggcaattttgcaatcttggcattgggtggtggctacctgcattggggccactttgaaatgatgcgcctgacaatcaaccgctctatggaccccaagaacatgtttgccatatggcgagtaccagcccctttcaagcccatcactcgcaaaagtgttgggcatcgcatggggggaggcaaaggtgctattgaccactacgtgacacctgtgaaggctggccgccttgttgtagagatgggtgggcgttgtgaatttgaagaagtgcaaggtttccttgaccaggttgcccacaagttgcccttcgcagcaaaggctg

SEQ ID NO: 154375 - DNA, 1969 bp, Homo sapiens
  Payload ID: 10340
  Gene Symbol: MRPL17
  Gene Name: mitochondrial ribosomal protein L17
  Uniprot ID: Q9NRX2
  ENST ID: ENST00000288937
  CDS Start-End: 106-633
accacgctccgagctaaggcgcatgcgttccctgaaattgccgccaccggctctaccttccagtttccagttccggcctccaaggggcgggcagaagttggaaacatgcggctgtcggtcgctgcagcgatctcccatggccgcgtatttcgccgtatgggcctcggtcccgagtcccgcatccatctgttgcggaacttgctcacagggctggtgcggcacgaacgcatcgaggcaccatgggcgcgtgtggacgaaatgaggggctacgcggagaagctcatcgactatgggaagctgggagacactaacgaacgagccatgcgcatggctgacttctggctcacagagaaggatttgatcccaaagctgtttcaagtactggcccctcggtacaaagatcaaactgggggctacacaagaatgctgcagatcccaaatcggagtttggatcgggccaagatggcagtgatcgagtataaagggaattgcctcccacccctgcctctgcctcgcagagacagccaccttacactcctaaaccagctgctgcagggtttgcggcaggacctcaggcaaagccaggaagcaagcaaccacagctcccacacagctcaaacaccagggatttaactggatctgaagagtctgcagcccttaatcagtacccatgatcacaggcctttggagcacttttactctctgagaagaactggagctagagatgtaaaatggacagtcttgatggggttgagaaccttctggggagccagatgaccctctctttgcacaatagataaaagtctttatatgaatatatataaatttatttattttttccttcctgtgggatttctggagaatgagaattatccaaatgctcagtctacctgagatagtaaattcatggcttatgcttctggtccttaaatttgggttatttttggttagtgcaattttgtttttcttaatgccagtttacatgggaatgcatcctataattccaaatgttgccagaggtggttgtgttttgacatctggtctcctagagatgagtgcttgggatttcttagagaaagattacttcctgacaggggtaggggagtgacaatctgcaagtgaaacttccttaaacaatctagtaccctgcgaaccttcaggggatactgcaatcagtcctctgttttgaggcaggatcacacattaccttaatgtgttcccttcaaccccctgaatgggcctgggaggagaggacccaagaactcagatgttccaccagtttggccaaaggggtggagacattcagcagaggatgttgggctccaggataagctccttcctcttggtgaggggaaggggtaagaaagagggtctatgcgagagaaggattaggaaattaaacctcctaggaatttcctggaagtttttattgttgtcaaatctggcctctctgggaacccagaaaagggaaatccggcttcagaatgtgagaagctgggagcccctttcttggcacagccaggctgccgttcccttgggttcagaggctttagtagggtagtagttatggaaggacttagaaaggagccatcagtcttggtccaaacacttgatagcagtgcctgataattgccatatccccagtaaagtgggtagaagagattttatcttaggctctatcttctgagtgtatttggcccactgaacccatccactgtctgagataataagtaagagtaagggtaaagggatcactggtgtagcagacatggcttcagtgacagaacgaactattctggtgctaatttagctgtagctgccttagtctgatactcatctactcccaacagagctctttatctctttttctctactatggtttgttcttcacactatagccagaaagctcttatattttaaatgaaatatagtagacactcaaaacatttatgaaataaagctacaactc

SEQ ID NO: 154376 - DNA, 448 bp, Homo sapiens
  Payload ID: 10340
  Gene Symbol: MRPL17
  Gene Name: mitochondrial ribosomal protein L17
  ENST ID: ENST00000532203
  CDS Start-End: 21-448
ggcgggcagaagttggaaacatgcggctgtcggtcgctgcagcgatctcccatggccgcgtatttcgccgtatgggcctcggtcccgagtcccgcatccatctgttgcggaacttgctcacagggctggtgcggcacgaacgcatcgaggcaccatgggcgcgtgtggacgaaatgaggggctacgcggagaaggagaaggatttgatcccaaagctgtttcaagtactggcccctcggtacaaagatcaaactgggggctacacaagaatgctgcagatcccaaatcggagtttggatcgggccaagatggcagtgatcgagtataaagggaattgcctcccacccctgcctctgcctcgcagagacagccaccttacactcctaaaccagctgctgcagggtttgcggcaggacctcaggcaaagccaggaagcaagcaaccacag

SEQ ID NO: 154377 - DNA, 978 bp, Homo sapiens
  Payload ID: 10341
  Gene Symbol: MRPL18
  Gene Name: mitochondrial ribosomal protein L18
  Uniprot ID: Q9H0U6
  ENST ID: ENST00000367034
  CDS Start-End: 123-665
ggagagtttggggatctacagcagccaaaggcttgtccctgactttatatggctgctcctggcgagcgactgagtcgtccgtgaggaaaaagaggcgaggcttttccgagatcgtctcagcgatggcgcttcggtcgcggttttgggggttgttctcggtttgcaggaaccctgggtgcaggttcgcagccctgtcaaccagctccgagccggcagcgaaacctgaagtggaccctgtggaaaatgaagctgtcgccccagaattcaccaaccggaacccccggaacctggagcttttatctgtagccaggaaagagcggggctggcggacggtgtttccctcccgtgagttctggcacaggttgcgagttataaggactcagcatcatgtagaagcacttgtggagcatcagaatggcaaggttgtggtttcggcctccactcgtgagtgggctattaaaaagcacctttatagtaccagaaatgtggtggcttgtgagagtataggacgagtgctggcacagagatgcttagaggcgggaatcaacttcatggtctaccaaccaaccccgtgggaggcagcctcagactcgatgaaacgactacaaagtgccatgacagaaggtggtgtggttctacgggaacctcagagaatctatgaataaatggaagcattaattgttttgaacatgtaaatataaatctgtcagccactacagccatcaaaagagagcatctggaagaacagccagcttggaagttttacagcaataatgttgcagtggaatattatttgtagttaaggtcatcctcctcccctttctgtttttttaaatcaagaactacgttctgcccctctcttgggcttcagaagcatctaagaaaagcagtcatcaattataattaactttcaaagggcaagtcagaagttgtttataaattacaaaataaaggcatattatgaactcttattttctg

SEQ ID NO: 154378 - DNA, 693 bp, Homo sapiens
  Payload ID: 10342
  Gene Symbol: MRPL19
  Gene Name: mitochondrial ribosomal protein L19
  ENST ID: ENST00000358788
  CDS Start-End: 15-536
gtgagctagctggcatggcggcctgcattgcagcggggcactgggctgcaatgggcctaggccggagtttccaagccgccaggactctgctccccccgccggcctctatcgcctgcagggtccacgcggggcctgtccggcagcagagcactgggccttccgagcccggtgcgttccaaccgccgccgaaaccggtcatcgtggacaagcaccgccccgtggaaccggaacgcaggttcttgagtcctgaattcattcctcgaaggggaagaacagatcctctgaaatttcaaatagaaagaaaagatatgttagaaaggagaaaagtactccacattccagagttctatgttggaagtattcttcgtgttactacagctgacccatatgccagtggaaaaatcagccagtttctggggatttgcattcagagatcaggaagaggacttggagctactttcatccttaggaatgttatcgaaggacaagggccagtgtatattcataatcctgaaagatggctgcctgggccatgagaacacaaatcagatcactgaacagagaaaagtaccttcgagattcaatctcttctaaaatccactgagttttttcatctactgagaagtttccacttgtggatgtctcatctttgcctgttaataaataaaattgacttcatactacaaattctca

SEQ ID NO: 154379 - DNA, 3479 bp, Homo sapiens
  Payload ID: 10342
  Gene Symbol: MRPL19
  Gene Name: mitochondrial ribosomal protein L19
  Uniprot ID: P49406
  ENST ID: ENST00000393909
  CDS Start-End: 26-904
gtagtcttgacgtgagctagctggcatggcggcctgcattgcagcggggcactgggctgcaatgggcctaggccggagtttccaagccgccaggactctgctccccccgccggcctctatcgcctgcagggtccacgcggggcctgtccggcagcagagcactgggccttccgagcccggtgcgttccaaccgccgccgaaaccggtcatcgtggacaagcaccgccccgtggaaccggaacgcaggttcttgagtcctgaattcattcctcgaaggggaagaacagatcctctgaaatttcaaatagaaagaaaagatatgttagaaaggagaaaagtactccacattccagagttctatgttggaagtattcttcgtgttactacagctgacccatatgccagtggaaaaatcagccagtttctggggatttgcattcagagatcaggaagaggacttggagctactttcatccttaggaatgttatcgaaggacaaggtgtcgagatttgctttgaactttataatcctcgggtccaggagattcaggtggtcaaattagagaaacggctggatgatagcttgctatacttacgagatgcccttcctgaatatagcacttttgatgtgaatatgaagccagtagtacaagagcctaaccaaaaagttcctgttaatgagctgaaagtaaaaatgaagcctaagccctggtctaaacgctgggaacgtccaaattttaatattaaaggaatcagatttgatctttgtttaactgaacagcaaatgaaagaagctcagaagtggaatcagccatggcttgaatttgatatgatgagggaatatgatacttcaaaaattgaagctgcaatatggaaggaaattgaagcgtcgaaaaggtcttgattctgagaatgaatttggttagttgcagaagatacattggctctaagaggatatattttgagaccaatttaatttcatttataagaacatagtaattaagtgaactaagcattcattgttttattaatactttttttctaaaataaaacttgtacaccagtttattactctaaaaagagaattacacatgccaaatggaccaatgtccatttgcttattggaggcaaagctacaatagaagtcagagcatcaccagaatggtctttaatgagcatggaacctgagcaaagggaataggtgggatgaattttttttttaattgtgaaacaattcataagcacaatatgatttacagaataataaacattcatgtacccactatcaggttaagaaatagaacatttattaatatgtaggaatgttaagaaataaaacatttaataagatctcagaagactccagtaaatctgcaattgtatctctctcctttttaaatgtaaatatcatcttgacttgttaattattcccttgcatttcttttagtttactgccaacacatatattcttcaacaatatatttaattttgaaaaacctgaaaaaaaaaacctgttagcaagtataaaggggcagtattactattattgcatgaaggcttcaagggaaacgttacagtctttgggtcatagtctggcttcagcttcctctgagagtttacagaggccaattttgagcaaattcatggctaaggttatgagtgagttctgctaaacagaaggctcaccacaaggtatctggcaggattatactgggtagctggatgttgcagaaatgtggttagaggaagtaaactgttttttgatgctcacagcatgatgaatcaaactctgtatcttaggattaggttaaaacaatacctttggtatgatatgagtgttgttgctgatccatgcagcatggattggaaagctggggtataagcacacatgctaaagaaaaacatgtaatttggtccatactcacctggatatactgttcctcaggttaaaaaatacagtactatcctaaatcttgaaggcaactctcagcctatccattgagttaccttcagatctgccctctggttcctagctgtcttgggactaacttctttcctgcgctcagctgttttctggattccatgttttccattttattgagtactaacttgttttgctgcagcacatcctttggtagcttctagaggaagtttgtgtggaggtaaaatttttgagaccttgcatgtctcatgtttgattgatactttatacgtttaggtaggaggtaattttccttcaggactttaaaaatattgttgctccattttctttgtttctattgttgtattgagaaatccaatgccattttgatttccccatcataaatttcatgatgatgtgtcttggtgtgggtctatatttatccattgtattgggttttaggtgaacccttccagatagtaactcatttctgtcagttctgggaaacacttagcattggttgatgatttattctctgctgctttgttctcccaactattatttggatgttggatatccagcactgggtatctattttcttacctccctcccttgaccccagtctctgttttttagctctttagctcaatcttccaactctttgctattgtattttaaaatcttaagaccccttcttgatttgtagaagttccttttcttacaaccaaaaagcctttatctatggatttgttcacagataaggggtattcaatatagtgtatttttttttcatttaaaattgtttgcgcatctatttcctccaaatttctttctgtatttattttttgttgtctatatttcagacttttccaggatatctgataatctttggctgtcttcttatggttgaaagagggactaaaaagcttggaaagcctttgggttgtgggaaggggctgtctttaggattatctgaatgggcttttttgggagtcccctcctccacatgaatattttggttttgtcagattccctagaatagaggcttccaatctccttcctggaggggtctgtccaggaaggagattgtctaggggtctgtcagacagcagctttcagctacttccttgatctttttcactaatgattatatagtcatctaactactgtcaacaagtaatagatatcctatccttcacttgtttagattatttgctgagataacctctcaaaagaacctctcaaaataaaaggttaacaagagcctatatcttatatttttcttctctttatcttgttagaagatagctattaaaacctgttctttttctgtcttgataaacacacttcaatcttggtagaatggtagatgggacagtatattttaggacctaaagctctgcaaatgtatgatcagcttgtaagtacaggtgctcaaaaacatgtaaacaatcatgctttttactctgtaggaatatctttaaaattcttgtgaatttttccccagaagtaaagcaaatcttcccccagaaataaaattaaatgtgcataatctaaa

SEQ ID NO: 154380 - DNA, 1076 bp, Homo sapiens
  Payload ID: 10342
  Gene Symbol: MRPL19
  Gene Name: mitochondrial ribosomal protein L19
  Uniprot ID: P49406
  ENST ID: ENST00000409374
  CDS Start-End: 6-884
ctggcatggcggcctgcattgcagcggggcactgggctgcaatgggcctaggccggagtttccaagccgccaggactctgctccccccgccggcctctatcgcctgcagggtccacgcggggcctgtccggcagcagagcactgggccttccgagcccggtgcgttccaaccgccgccgaaaccggtcatcgtggacaagcaccgccccgtggaaccggaacgcaggttcttgagtcctgaattcattcctcgaaggggaagaacagatcctctgaaatttcaaatagaaagaaaagatatgttagaaaggagaaaagtactccacattccagagttctatgttggaagtattcttcgtgttactacagctgacccatatgccagtggaaaaatcagccagtttctggggatttgcattcagagatcaggaagaggacttggagctactttcatccttaggaatgttatcgaaggacaaggtgtcgagatttgctttgaactttataatcctcgggtccaggagattcaggtggtcaaattagagaaacggctggatgatagcttgctatacttacgagatgcccttcctgaatatagcacttttgatgtgaatatgaagccagtagtacaagagcctaaccaaaaagttcctgttaatgagctgaaagtaaaaatgaagcctaagccctggtctaaacgctgggaacgtccaaattttaatattaaaggaatcagatttgatctttgtttaactgaacagcaaatgaaagaagctcagaagtggaatcagccatggcttgaatttgatatgatgagggaatatgatacttcaaaaattgaagctgcaatatggaaggaaattgaagcgtcgaaaaggtcttgattctgagaatgaatttgccgggggccatcaagtataagaccacaggaccacgtgattcataaagaactactgtcaaaactagggccgccattaccaacatgtgaccttgagaaggcaatcaacgctgagagcttcattcctctgatacataaagatttataatcacctttgagtttgaagataacttggatt

SEQ ID NO: 154381 - DNA, 475 bp, Homo sapiens
  Payload ID: 10342
  Gene Symbol: MRPL19
  Gene Name: mitochondrial ribosomal protein L19
  ENST ID: ENST00000453233
  CDS Start-End: 1-240
aaagttcctgttaatgagctgaaagtaaaaatgaagcctaagccctggtctaaacgctgggaacgtccaaattttaatattaaaggaatcagatttgatctttgtttaactgaacagcaaatgaaagaagctcagaagtggaatcagccatggcttgaatttgatatgatgagggaatatgatacttcaaaaattgaagctgcaatatggaaggaaattgaagcgtcgaaaaggtcttgattctgagaatgaatttggtaccttcgagattcaatctcttctaaaatccactgagttttttcatctactgagaagtttccacttgtggatgtctcatctttgcctgttaataaataaaattgacttcatactacaaattctcaaaagaaaaaagtaaaatgctttgaaaataaaggtaatatcatggatgtataaacatatgcatatgtaaatacataaatatgcttaaattttg

SEQ ID NO: 154382 - DNA, 744 bp, Homo sapiens
  Payload ID: 10342
  Gene Symbol: MRPL19
  Gene Name: mitochondrial ribosomal protein L19
  ENST ID: ENST00000476622
  CDS Start-End: 315-744
tggagatcagaggcaaccccagcgttggtcccccgtgggacgccgggttgggggagattgcggggctctgcgggatctcagggttggcacgagagttctgacctccgtcgtccgctcccgcaggggtccacgcggggcctgtccggcagcagagcactgggccttccgagcccggtgcgttccaaccgccgccgaaaccggtcatcgtggacaagcaccgccccgtggaaccggaacgcaggttcttgagtcctgaattcattcctcgaaggggaagaacagatcctctgaaatttcaaatagaaagaaaagatatgttagaaaggagaaaagtactccacattccagagttctatgttggaagtattcttcgtgttactacagctgacccatatgccagtggaaaaatcagccagtttctggggatttgcattcagagatcaggaagaggacttggagctactttcatccttaggaatgttatcgaaggacaaggtgtcgagatttgctttgaactttataatcctcgggtccaggagattcaggtggtcaaattagagaaacggctggatgatagcttgctatacttacgagatgcccttcctgaatatagcacttttgatgtgaatatgaagccagtagtacaagagcctaaccaaaaagttcctgttaatgagctgaaagtaaaaatgaagcctaagccctggtctaaacgctgggaacgtccaaattttaatattaaag

SEQ ID NO: 154383 - DNA, 359 bp, Homo sapiens
  Payload ID: 10342
  Gene Symbol: MRPL19
  Gene Name: mitochondrial ribosomal protein L19
  ENST ID: ENST00000492255
  CDS Start-End: 1-175
ggtcaaattagagaaacggctggatgatagcttgctatacttacgagatgcccttcctgaatatagcacttttgatgtgaatatgaagccagtagtacaagagcctaaccaaaaagttcctgttaatgagccgggggccatcaagtataagaccacaggaccacgtgattcataaagaactactgtcaaaactagggccgccattaccaacatgtgaccttgagaaggcaatcaacgctgagagcttcattcctctgatacataaagatttataatcacctttgagtttgaagataacttggattaagtaaccataataaattctaataaaatattggttgtcctttccctctactaaa

SEQ ID NO: 154384 - DNA, 899 bp, Homo sapiens
  Payload ID: 10343
  Gene Symbol: MRPL2
  Gene Name: mitochondrial ribosomal protein L2
  ENST ID: ENST00000230413
  CDS Start-End: 14-691
gggtgtcgtgctgatggccctgtgcgcactgacccgcgctctgcgctctctgaacctggcgcccccgaccgtcgccgcccctgccccgagtctgttccccgccgcccagatgatgaacaatggcctcctccaacagccctctgccttgatgttgctcccctgccgcccagttcttacttctgtggcccttaatgccaactttgtgtcctggaagagtcgtaccaagtacaccattacaccagtgaagatgaggaagtctgggggccgagaccacacaggccgaatccgggtgcatggtattggcgggggccacaagcaacgttatcgaatgattgactttctgcgtttccggcctgaggagaccaagtcaggaccctttgaggagaaggttatccaagtccgctatgatccctgtaggtcagcagacatagctctggttgctgggggcagccggaaacgctggatcatcgccacagaaaacatgcaggctggagatacaatcttgaactctaaccacataggccgaatggcagttgctgctcgggaaggggatgcgcatcctcttggggctctgcctgtggggaccctcatcaacaacgtggaaagtgagccaggccggggtgcccaatatatccgagctgcaggtgctggaaacgtgcgtagcaacagtaggccgagtatccaacgttgatcataacaaacgggtcattggcaaggcaggtcgcaaccgctggctgggcaagaggcctaacagtgggcggtggcaccgcaaggggggctgggctggccgaaagattcggccactaccccccatgaagagttacgtgaagctgccttctgcttctgcccaaagctgatatccctgtactctaataaaatgccccccccccccgttttaa

SEQ ID NO: 154385 - DNA, 1588 bp, Homo sapiens
  Payload ID: 10343
  Gene Symbol: MRPL2
  Gene Name: mitochondrial ribosomal protein L2
  Uniprot ID: Q5T653
  ENST ID: ENST00000388752
  CDS Start-End: 426-1343
ttttggaggctggagttttgtaaggttggttggagggggtttgttcatctttctggtagtgcgagaataagagatggcagagaccttaaccttcagccccaggataccctcaaagactcacctgcaatctgccggtgtggctgccgctcttgccggtactgcccctttaaatccatgatggctgccgctcgaggcaattgttttgacgggtctgggggggcggggcctgtttcctagtcacgcgacattagagctgcccgcggattggctctcacggcgttcaggtaggaaaggaggtgtgtatccagcttgggctccagttttctgcccgcctccttttacgttattgcggagcgacggcgccggacagtcaacgtcatctaggagcaccgagcagcttggctaaaagtaagggtgtcgtgctgatggccctgtgcgcactgacccgcgctctgcgctctctgaacctggcgcccccgaccgtcgccgcccctgccccgagtctgttccccgccgcccagatgatgaacaatggcctcctccaacagccctctgccttgatgttgctcccctgccgcccagttcttacttctgtggcccttaatgccaactttgtgtcctggaagagtcgtaccaagtacaccattacaccagtgaagatgaggaagtctgggggccgagaccacacaggccgaatccgggtgcatggtattggcgggggccacaagcaacgttatcgaatgattgactttctgcgtttccggcctgaggagaccaagtcaggaccctttgaggagaaggttatccaagtccgctatgatccctgtaggtcagcagacatagctctggttgctgggggcagccggaaacgctggatcatcgccacagaaaacatgcaggctggagatacaatcttgaactctaaccacataggccgaatggcagttgctgctcgggaaggggatgcgcatcctcttggggctctgcctgtggggaccctcatcaacaacgtggaaagtgagccaggccggggtgcccaatatatccgagctgcagggacgtgtggtgtgctactgcggaaggtgaatggcacagccattatccagctgccctctaagaggcagatgcaggtgctggaaacgtgcgtagcaacagtaggccgagtatccaacgttgatcataacaaacgggtcattggcaaggcaggtcgcaaccgctggctgggcaagaggcctaacagtgggcggtggcaccgcaaggggggctgggctggccgaaagattcggccactaccccccatgaagagttacgtgaagctgccttctgcttctgcccaaagctgatatccctgtactctaataaaatgccccccccccccgttttaatctgttactgtggttttgttttgggtgttttttgttttttttgttgttgttttttttttgcgggggaggggatggtacagactaaacgtggggaaaagaagtaaaaagtgtggaagagaaagtacaggacactgggtctgtccccaccccaattcccttacaagtaatggagccggggatggaaataaatgacgtccaaggtc

SEQ ID NO: 154386 - DNA, 905 bp, Homo sapiens
  Payload ID: 10343
  Gene Symbol: MRPL2
  Gene Name: mitochondrial ribosomal protein L2
  ENST ID: ENST00000487429
  CDS Start-End: 41-325
agcaccgagcagcttggctaaaagtaagggtgtcgtgctgatggccctgtgcgcactgacccgcgctctgcgctctctgaacctggcgcccccgaccgtcgccgcccctgccccgagtctgttccccgccgcccaggtaatccatcttacccgggaagaaggctgcttccattcgggctgccggagatggggtctgcgggcatgcgaggcgggagttgcgagtctggtcaggagtcatgcagatgatgaacaatggcctcctccaacagccctctgccttgatgttgctcccctgccgcccagttcttacttctgtggcccttaatgccaactttgtgtcctggaagagtcgtaccaagtacaccattacaccagtgaagatgaggaagtctgggggccgagaccacacaggtgggaacaaggacagggggatttaagcagtcaaaaggaaaaacatgttaagaccctagacttgtatattgacacacttgtaccttgtaaggcagaggaatgtaattaaaaagcacttatttggctccttttgcatgtagtatgtgtacaggagtcagagagtagaatacaaagcaataggtaattggtctatgcttctaaagacaatttgggtaattgaagaaaatgggccatacacaggaagtgccatgacattttccttcatacccttcaaaaatttataacaggctgggtaaggtggctcacgactgtaatcccagcattttgggaggccgaggcgggcagatcacctgacgtcacaagtttaagaccaggctggccaacatggcaaaacctcatctctactaaaactttaaaaattggtcaggcgcagtggctcacgcctgtaatcccaacactttgagaggccaaggcaggcagatcacttgaggcca

SEQ ID NO: 154387 - DNA, 689 bp, Homo sapiens
  Payload ID: 10343
  Gene Symbol: MRPL2
  Gene Name: mitochondrial ribosomal protein L2
  ENST ID: ENST00000468957
  CDS Start-End: 58-348
agtcaacgtcatctaggagcaccgagcagcttggctaaaagtaagggtgtcgtgctgatggccctgtgcgcactgacccgcgctctgcgctctctgaacctggcgcccccgaccgtcgccgcccctgccccgagtctgttccccgccgcccagatgatgaacaatggcctcctccaacagccctctgccttgatgttgctcccctgccgcccagttcttacttctgtggcccttaatgccaactttgtgtcctggaagagtcgtaccaagtacaccattacaccagtgaagatgaggaagtctgggggccgagaccacacaggtgggaacaaggacagggggatttaagcagtcaaaaggaaaaacatgttaagaccctagacttgtatattgacacacttgtaccttgtaaggcagaggaatgtaattaaaaagcacttatttggctccttttgcatgtagtatgtgtacaggagtcagagagtagaatacaaagcaataggtaattggtctatgcttctaaagacaatttgggtaattgaagaaaatgggccatacacaggaagtgccatgacattttccttcatacccttcaaaaatttataacaggctgggtaaggtggctcacgactgtaatcccagcattttgggaggccgaggcgggcagatcacctgacgtcacaagttta

SEQ ID NO: 154388 - DNA, 570 bp, Homo sapiens
  Payload ID: 10343
  Gene Symbol: MRPL2
  Gene Name: mitochondrial ribosomal protein L2
  ENST ID: ENST00000489623
  CDS Start-End: 54-365
aacgtcatctaggagcaccgagcagcttggctaaaagtaagggtgtcgtgctgatggccctgtgcgcactgacccgcgctctgcgctctctgaacctggcgcccccgaccgtcgccgcccctgccccgagtctgttccccgccgcccagatgatgaacaatggcctcctccaacagccctctgccttgatgttgctcccctgccgcccagttcttacttctgtggcccttaatgccaactttgtgtcctggaagagtcgtaccaagtacaccattacaccagtgaagatgaggaagtctgggggccgagaccacacaggtgctggaaacgtgcgtagcaacagtaggccgagtatccaacgttgatcataacaaacgggtcattggcaaggcaggtcgcaaccgctggctgggcaagaggcctaacagtgggcggtggcaccgcaaggggggctgggctggccgaaagattcggccactaccccccatgaagagttacgtgaagctgccttctgcttctgcccaaagctgatatccctgtactctaataaaatgccccccccccccgttt

SEQ ID NO: 154389 - DNA, 721 bp, Homo sapiens
  Payload ID: 10344
  Gene Symbol: MRPL20
  Gene Name: mitochondrial ribosomal protein L20
  Uniprot ID: Q9BYC9
  ENST ID: ENST00000344843
  CDS Start-End: 97-546
cggaagcgctcgtgaccaccatttccgacccgggcaagatggcagcggcgctgcgcgtgcgttgttgagtgttcgggacgccggcctgcaggcgccatggtcttcctcaccgcgcagctctggctgcggaatcgcgtcaccgaccgctactttcggatccaggaggtgctgaagcacgccaggcacttccggggaaggaaaaatcgctgctacaggttggcggtcagaaccgtgattcgagcctttgtgaaatgcaccaaagcccgatacctgaagaaaaagaacatgaggaccctctggattaatcgaattacagctgctagccaggaacatggactgaagtatccagcgctcattgggaatttagttaagtgccaggtggagctcaacaggaaagtcctagcggatctggccatctacgagccaaagactttcaaatctttggctgccttggccagtaggaggcgacacgaaggatttgctgctgccttgggggatgggaaggaacctgaaggcattttttccagagtggtgcagtaccactgaggactgttgctgtattgattaggaaaagagacagagtaatttgcagtttgtttgatttatacttttgtttatctacaacccaataacagacatgagggatggccctgtctctctgggacagagcctcacagatgatgtccatgttttgtgtgaatgaaactcaaacactcttcag

SEQ ID NO: 154390 - DNA, 588 bp, Homo sapiens
  Payload ID: 10344
  Gene Symbol: MRPL20
  Gene Name: mitochondrial ribosomal protein L20
  ENST ID: ENST00000492508
  CDS Start-End: 1-201
cgctgctacaggttggcggtcagaaccgtgattcgagcctttgtgaaatgcaccaaagcccgatacctgaagaaaaagaacatgaggaccctctggattaatcgaattacagctgctagccaggaacatggactgaagtatccagcgctcattgggaatttagttaaggcacttccaggttggcttaaagggttaccctaggccagcagtcagctcagtcagggtggtgaccaaggaccctgaacaaggtgtttggttccccgggccgacatcaggactggagtccagcctccctgcagattccacaggtgcttccctcacccgtgtccacatttatccttcagcatcctgcctggaagtcctctgctgtgccacccagataggattctcctaggccttccctccccccaggcgagtgtgcagctgggttcttcctgagccagcgccgcaaccacgcggagccggagtgtgtgtctcacactgacagcaggttctgattcattcttttttcagtgccaggtggagctcaacaggaaagtcctagcggatctggccatctacgagccaaagactttcaaatctttggct

SEQ ID NO: 154391 - DNA, 1049 bp, Homo sapiens
  Payload ID: 10344
  Gene Symbol: MRPL20
  Gene Name: mitochondrial ribosomal protein L20
  Uniprot ID: Q9BYC9
  ENST ID: ENST00000482352
  CDS Start-End: 74-541
tccgacccgggcaagatggcagcggcgctgcgcgtgcgttgttgagtgttcgggacgccggcctgcaggcgccatggtcttcctcaccgcgcagctctggctgcggaatcgcgtcaccgaccgctactttcggatccaggaggtgctgaagcacgccaggcacttccggggaaggaaaaatcgctgctacaggttggcggtcagaaccgtgattcgagcctttgtgaaatgcaccaaagcccgatacctgaagaaaaagaacatgaggaccctctggattaatcgaattacagctgctagccaggaacatggactgaagtatccagcgctcattgggaatttagttaaggtatgggtgagtatgtgggtcccactgaaattctggacatctgcagaaaccatcatgcggggcgtggtggtgcttcctgtagtcccagctaatcaggaggctgaggccagaggatccctggagactgacttctgggctgtagtttgctatgctgatggggtgtccatgttaagtgtggtatcaatatggtgacctcttgggagcaagggaccaccacgttgcctaaggaggggtgaaccagcccaggctggaaacggagcaggtcacaattcccatgttgatgagtgatgagattgtgcctaggaatagtgccagcaacagcctgggcaacatagtgagaccactctctacaaaaaaataaaatttgctgggtgtggtggtacagagacatgtaatgtcagctactgaggagtctgaagcagggggatcactttgagcccccaggagtttgaagctgcagtgagctatgatggtaccactgcactctagcctaggtgagagcaggaccccgtctgacagaataaagaaagccatggctgggcagggtggctcaggcctgtgatcccagcactttgggaggctgaggtgggcaggagatggagactagcctggccaacgtggtgaaaccctgtctctactaaaaatacaaaaattagccaggtgtggtggcgggcacctagaattccagctactctggagg

SEQ ID NO: 154392 - DNA, 683 bp, Homo sapiens
  Payload ID: 10345
  Gene Symbol: MRPL21
  Gene Name: mitochondrial ribosomal protein L21
  Uniprot ID: Q7Z2W9
  ENST ID: ENST00000362034
  CDS Start-End: 11-628
ggctgcggccatggcagcatcttccctgacggtcaccttagggcggctggcgtccgcgtgcagccacagcatcctgagaccttcggggcccggagcagcctccctttggtctgcttctcgaaggttcaattcacagagcacttcatatctaccaggatatgttcctaaaacatccctgagttcaccaccttggccagaagttgttctgccagacccagttgaggagaccagacaccatgcagaggtcgtgaagaaggtgaatgagatgatcgtcacggggcagtatggcaggctctttgccgtggtgcactttgccagccgccagtggaaggtgacctctgaagacctgatcttaattggaaatgaactagaccttgcgtgtggagagagaattcgactggagaaggtcctgctggttggggcagacaacttcacgctgcttggcaagccactcctcggaaaggatcttgttcgagtagaagccacagtcattgaaaagacagaatcatggccaagaatcattatgagattcaggaaaaggaaaaacttcaagaagaaaagaatcgtcacgaccccgcagactgtcctccggataaacagcattgagattgctccgtgtttgttgtgattaccgagttaatacttacaaaaggataaaaataaactcctgcttcccaaggaga

SEQ ID NO: 154393 - DNA, 662 bp, Homo sapiens
  Payload ID: 10345
  Gene Symbol: MRPL21
  Gene Name: mitochondrial ribosomal protein L21
  Uniprot ID: Q7Z2W9
  ENST ID: ENST00000450904
  CDS Start-End: 245-607
accttagggcggctggcgtccgcgtgcagccacagcatcctgagaccttcggggcccggagcagcctccctttggtctgcttctcgaaggttcaattcacagagcacttcatatctaccagggtaatatcaaaatatatgttcctaaaacatccctgagttcaccaccttggccagaagttgttctgccagacccagttgaggagaccagacaccatgcagaggtcgtgaagaaggtgaatgagatgatcgtcacggggcagtatggcaggctctttgccgtggtgcactttgccagccgccagtggaaggtgacctctgaagacctgatcttaattggaaatgaactagaccttgcgtgtggagagagaattcgactggagaaggtcctgctggttggggcagacaacttcacgctgcttggcaagccactcctcggaaaggatcttgttcgagtagaagccacagtcattgaaaagacagaatcatggccaagaatcattatgagattcaggaaaaggaaaaacttcaagaagaaaagaatcgtcacgaccccgcagactgtcctccggataaacagcattgagattgctccgtgtttgttgtgattaccgagttaatacttacaaaaggataaaaataaactcctgcttcccaaggaga

SEQ ID NO: 154394 - DNA, 654 bp, Homo sapiens
  Payload ID: 10345
  Gene Symbol: MRPL21
  Gene Name: mitochondrial ribosomal protein L21
  ENST ID: ENST00000544567
  CDS Start-End: 5-115
ggccatggcagcatcttccctgacggtcaccttagggcggctggcgtccgcgtgcagccacagcatcctgagaccttcggggcccggagcagatatgttcctaaaacatccctgagttcaccaccttggccagaagttgttctgccagacccagttgaggagaccagacaccatgcagggggtggagcaggggctgggccgccagcagtgaggtgctcacaaggggtgctggctgtcaggtccaccctagggccccaccaccaggagctgcacatcacactgcagcgcgtgggggagcaggtgagggtgactgcccacccacccgccttcccctgcagaggtcgtgaagaaggtgaatgagatgatcgtcacggggcagtatggcaggctctttgccgtggtgcactttgccagccgccagtggaaggtgacctctgaagacctgatcttaattggaaatgaactagaccttgcgtgtggagagagaattcgactggagaaggtcctgctggttggggcagacaacttcacgctgcttggcaagccactcctcggaaaggatcttgttcgagtagaagccacagtcattgaaaagacagaatcatggccaagaatcattatgagattcaggaaaaggaaaaacttcaagaagaa

SEQ ID NO: 154395 - DNA, 764 bp, Homo sapiens
  Payload ID: 10345
  Gene Symbol: MRPL21
  Gene Name: mitochondrial ribosomal protein L21
  ENST ID: ENST00000541279
  CDS Start-End: 18-470
cggccgaggctgcggccatggcagcatcttccctgacggtcaccttagggcggctggcgtccgcgtgcagccacagcatcctgagaccttcggggcccggagcagcctccctttggtctgcttctcgaaggttcaattcacagagcacttcatatctaccaggatatgttcctaaaacatccctgagttcaccaccttggccagaagttgttctgccagacccagttgaggagaccagacaccatgcagaggtcgtgaagaaggtgaatgagatgatcgtcacggggcagtatggcaggctctttgccgtggtgcactttgccagccgccagtggaaggtgacctctgaagacctgatcttaattggaaatgaactagaccttgcgtgtggagagagaattcgactggagaaggtcctgctggttggggcagacaacttcacgctgcttggcaagccactcctcgggtaatggctgtgaagtgctgggctttgtctggggctccagggctggacatgcagacagtggtcacagtgcaattaggccagaaaggatcttgttcgagtagaagccacagtcattgaaaagacagaatcatggccaagaatcattatgagattcaggaaaaggaaaaacttcaagaagaaaagaatcgtcacgaccccgcagactgtcctccggataaacagcattgagattgctccgtgtttgttgtgattaccgagttaatacttacaaaaggataaaaataaactcctgcttccc

SEQ ID NO: 154396 - DNA, 555 bp, Homo sapiens
  Payload ID: 10345
  Gene Symbol: MRPL21
  Gene Name: mitochondrial ribosomal protein L21
  ENST ID: ENST00000541265
  CDS Start-End: 23-172
gtttccggccgaggctgcggccatggcagcatcttccctgacggtcaccttagggcggctggcgtccgcgtgcagccacagcatcctgagaccttcggggcccggagcagcctccctttggtctgcttctcgaaggttcaattcacagagcacttcatatctaccagggtaatatcaaaatatatgttcctaaaacatccctgagttcaccaccttggccagaagttgttctgccagacccagttgaggagaccagacaccatgcagaggtcgtgaagaaggtgaatgagatgatcgtcacggggcagtatggcaggctctttgccgtggtgcactttgccagccgccagtggaaggtgacctctgaagacctgatcttaattggaaatgaactagaccttgcgtgtggagagagaattcgactggagaaggtgagaccaccgagcttctctggatattcagggactcagccaccaagtcctgctggttggggcagacaacttcacgctgcttggcaagccactcctcggaaaggatcttgttcgagtagaagcc

SEQ ID NO: 154397 - DNA, 2283 bp, Homo sapiens
  Payload ID: 10345
  Gene Symbol: MRPL21
  Gene Name: mitochondrial ribosomal protein L21
  ENST ID: ENST00000565125
  CDS Start-End: 26-175
tccgtttccggccgaggctgcggccatggcagcatcttccctgacggtcaccttagggcggctggcgtccgcgtgcagccacagcatcctgagaccttcggggcccggagcagcctccctttggtctgcttctcgaaggttcaattcacagagcacttcatatctaccagggtaatatcaaaatatatgttcctaaaacatccctgagttcaccaccttggccagaagttgttctgccagacccagttgaggagaccagacaccatgcagaggtcgtgaagaaggtgaatgagatgatcgtcacggggcagtatggcaggctctttgccgtggtgcactttgccagccgccagtggaaggtgacctctgaagacctgatcttaattggaaatgaactagaccttgcgtgtggagagagaattcgactggagaaggtcctgctggttggggcagacaacttcacgctgcttggcaagccactcctcgggtaatggctgtgaagtgctgggctttgtctggggctccagggctggacatgcagacagtggtcacagtgcaattaggccagaaaggatcttgttcgagtagaagccacagtcattgaaaagacagaatcatggccaagaatcattatgagattcaggaaaaggaaaaacttcaagaagaaaagaagtaagttagagaaagtaccgctgggccctgttgcacggtgctggttgcccaggcgcatgcggacggagggtgtggggcacgtgggtctcgggacaggaagcccaggcaggtctcaacctggctgccactgcccacttgccaccctcatcctagagggagcacccagagggtccagcctcgctccccttctcctccacgctccacgcgtgaccccacctcgctccccttctcctccacgctccgcacgtgaccccacctcgctccccttctcctccaccctccgcgcgtgaccccacctcgctccccttctcctccaccctccgcgcatgaccccacctcgctccccttctcctccaccctccgcgcgtgaccccacctcgctccccttctcctccaccctccgcgcgtgaccccacctcgctccccttctcctccaccctccgcgcgtgaccccacctcgctccccttctcctccaccctccgcgcgtgaccccacctcgctccccttctcctccaccctccgcgcgtgaccccacctcgctccccttctcctccaccctccgcgcgtgaccccacctcgctccccttctcctccaccctccgcgcgtgaccccacctcgctccccttctcctccaccctccgcgcgtgaccccacctcgctccccttctcctccaccctccgcgcgtgacccacctcgctccccttctcctccaccctccgcgcgtgaacccacctcgctccccttctcctccaccctccgcgcgtgaacccacctcgctccccttctccaccctccacgcgtgaccccacctcgctccccttctcctccaccctccacgcatgaccccactttgttccaacccatgacgcctagcactgtccccaaagcagcagtgaatccgcaagcaggtgtagggctgtcctagcaggtctgcactgaggacatcccccatagtgggcatcctgagggatggcacccacggggcatgggccacatagctgagcggctgcagaattctgtccctcacagctcttgctataactgcagttgccggcctaaaccaccaacagtgggcatagttaaatatacccagaatactggtattggctgtcaccttagagtcatctgggtaggggagcctctcatgtaccttctgacacttccaggtagcctcaaggtcactcaggtggggccatcctcccacgcactccagaagtcacagcatagacagtgtgggaggagaggtgaggtgccagcgcagggcactcctggccatgaggcgtctggtgtcccagcctctgcacctgccaacagagtgaacgaacaagctagcgaggcagtcagtgcacacctggagataaacacggccatgtgcagcaggggacgttgccggggtcgcgctggctggggagggctgtgtgcagagcccctgctgtaactgatgacaacagtcagggtctgtggtcaagcctgtgacatcctttctttcagtcgtcacgaccccgcagactgtcctccggataaacagcattgagattgctccgtgtttgttgtgattaccgagttaatacttacaaaaggataaaaataaactcctgcttcccaagg

SEQ ID NO: 154398 - DNA, 932 bp, Homo sapiens
  Payload ID: 10345
  Gene Symbol: MRPL21
  Gene Name: mitochondrial ribosomal protein L21
  ENST ID: ENST00000567045
  CDS Start-End: 237-824
gcggctggcgtccgcgtgcagccacagcatcctgagaccttcggggcccggagcagcctccctttggtctgcttctcgaaggttcaattcacagagcacttcatatctaccagggtaatatcaaaatatatgttcctaaaacatccctgagttcaccaccttggccagaagttgttctgccagacccagttgaggagaccagacaccatgcagaggtcgtgaagaaggtgaatgagatgatcgtcacggggcagtatggcaggctctttgccgtggtgcactttgccagccgccagtggaaggtgacctctgaagacctgatcttaattggaaatgaactagaccttgcgtgtggagagagaattcgactggagaaggtcctgctggttggggcagacaacttcacgctgcttggcaagccactcctcggaaaggatcttgttcgagtagaagccacagtcattgaaaagacagaatcatggccaagaatcattatgagattcaggaaaaggaaaaacttcaagaagaaaagaagtaagttagagaaagtaccgctgggccctgttgcacggtgctggttgcccaggcgcatgcggacggagggtgtggggcacgtgggtctcgggacaggaagcccaggcaggtctcaacctggctgccactgcccacttgccaccctcatcctagagggagcacccagagggtccagcctcgctccccttctcctccacgctccacgcgtgaccccacctcgctccccttctcctccacgctccgcacgtgaccccacctcgctccccttctcctccaccctccgcgcgtgaccccacctcgctccccttctcctccaccctccgcgcatgaccccacctcgctccccttctcctccaccctccgcgcgtgaccccacctcgctccccttctcctccacc

SEQ ID NO: 154399 - DNA, 3035 bp, Homo sapiens
  Payload ID: 10346
  Gene Symbol: MRPL22
  Gene Name: mitochondrial ribosomal protein L22
  Uniprot ID: Q9NWU5
  ENST ID: ENST00000265229
  CDS Start-End: 141-521
gtagcgggagggcgaaagatggcggcggcagtactgggacagttgggtgcgttatggatacataacctgaggagccgggggaagctggccttggggaaatctaccactgtcgaagacaaataaaatatagcaaagacaagatgtggtatttggcaaaattgatacgaggaatgtctattgaccaggctttggctcagttggaattcaatgacaaaaaaggggccaaaataattaaagaggttctcttagaagcacaagatatggcagtgagagaccataacgtggaattcaggtccaatttatatatagctgagtccacctcaggacgaggccagtgcctgaaacgcatccgctaccatggcagaggtcgctttgggatcatggagaaggtttattgccattattttgtgaagttggtggaagggcccccacctccacctgagccaccaaagacggcagttgcccatgccaaagagtatattcagcagcttcgcagccggaccatcgttcacactctatgatgaggagattcagactccacagtgtatatattttgccatttattttctaaaaataaacaaaaattgaaggcaaatgctttttatgatttctcattgaattattgaaacagtgtataactgctagttgtaaatgaatatttataaggctttgcccatttcttttgagcctctgggcatatttgtatgcatttgcgacttggaaggggaaatcagctttaaacatagtaacagactatatttcaaaaggcttttggagtaactttgaaagggaatgttaactttccaactagtgtcctgcaggtggctgttttgatactggacttgaatacagtgttatgaggtaagaaaattgcttttatttcacttaattttctcttgggaccatgggaagttagagtggctgcatgttgtttcattacagtattttagggtgttcagtggtaccgtttttcctttcactgttggcacaggccagtgagtcaaaaattatattttcctttactgttttagcagtaactcgaaactacaggagtttattagatatacgaatctaaaactccaaaaacctttaactttgaaaattttcttttggttaagcaaagcctgtttttatttcttcttccaacagtgctttatattgtttggatatcttgtttaggattgatttatttttcagggtaaattcaattactgagagaggaattgaaccaatctcagcattgcattctaaaatggggcagtaggtggcactcaaccttttattagcagaaaattgttagtttcaaattagagtgttcaacactgcttccctctcattcatacacgtcttcattaagaagaagtactctttgtctacagccctagtccaacttttgcatgcaaaagaagaatcgaggatgcttgcttgttaatgcagacttctgggccccaccccaatgattcaattcactaggtcttatggggggctggtttcagaaatctatgttttaaacaaacacttccaggtaattctgttgtaggggactacgctttgagaatacggctttaggagaatgaaaaaatgtagttttattgccatgttttaagatggcattaataatagttactgtttactgggaacttgttatttgcaagctctgtgctagtattttacataattcttcacaacatcctgaaaatgtagcttttgttttaccactttacaaaggaataaaccgaagcacacagaattcaaataactatcacaagtcacacagcatgtaaatattggggctatgattgaaaggtttctaaagtagctggttctgcataccttttgagtatacagctgggtttttgtgtctctccagttaacctaatgcatgggtaaaaagacatcaggggtcagtggaataaaccaaggtgtaggacagattcattctgggtcctaagctgttgtagcatggagtcagggaaataacactggaatattaaaaggtaaccttcattctagtctgtgcattctcattagccagaaagaagactggataggtctcttcccttgctggcctccatttcattcatttatgaaacaagagactcaatgttctctgtagaaaaccttttttagaatcacttgaagaatttgtttaaaaatgcaaattcctgggctctactctcagactaagtgaatcagaagctttggtgtgggagaccatggaacctgcagttttaataaatgccccagtgatttgcatgttggagaattatcacaccaggtcactgtgctctcatgtggtggggatgctccacgattgctcttggagttgtgacttccttgggtgtgactaaagccaggtggtgccatggacatcataaatataaattatgtaagtgaaggcactgcttcagtcaggctgtaaaagctattttgaaagtggtaaggaaaaagtaggattgtaatgaagaaaatttccttcccaggttaagccttcatttggaactgcttccagtacgttacaaaaagtaataatagctaacctgtgtcactgactgtatctggtactattttaagcactatatatacattatctcaatgaatctttcccattgtgacatccggctagttttcgtggctaagagtgtactttctaacatccatgaacattgtggtccccacctgaagtttcactttgcatgttcagtgatatggtttggctctgtgttcccacccaatcttatctcaaattgtaatccccatgtgtccagggagggacctgtaatccccacctagtgacggagggaggtgattgatgatgggtgtggtgtaccccatgctgttctcgtgatagtgagtgggttctcatgagatctgatggttttataagtgtttgaaagttccctcttcactcgctgtcttgcctgctgccatgtaaaatgtgcctacttcaccctctgccatgattgtaagtttcctgaggcctccccagccatgcagaactttgacacaattaaatgtcttttctttataaatta

SEQ ID NO: 154400 - DNA, 784 bp, Homo sapiens
  Payload ID: 10346
  Gene Symbol: MRPL22
  Gene Name: mitochondrial ribosomal protein L22
  ENST ID: ENST00000439747
  CDS Start-End: 17-715
agcgggagggcgaaagatggcggcggcagtactgggacagttgggtaaggatttcttagtggttaagcgacagaagggagtcgagatggaatctgagttgacggcttgtgttgatgttgcaggtgcgttatggatacataacctgaggagccgggggaagctggccttgggtgttttacctcaatcatatatccacacaagtgcttctcttgacatttctcgaaaatgggagaagaagaataaaattgtttatcctccacaactgcctggagaacctcggagaccagcagaaatctaccactgtcgaagacaaataaaatatagcaaagacaagatgtggtatttggcaaaattgatacgaggaatgtctattgaccaggctttggctcagttggaattcaatgacaaaaaaggggccaaaataattaaagaggttctcttagaagcacaagatatggcagtgagagaccataacgtggaattcaggtccaatttatatatagctgagtccacctcaggacgaggccagtgcctgaaacgcatccgctaccatggcagaggtcgctttgggatcatggagaaggtttattgccattattttgtgaagttggtggaagggcccccacctccacctgagccaccaaagacggcagttgcccatgccaaagagtatattcagcagcttcgcagccggaccatcgttcacactctatgatgaggagattcagactccacagtgtatatattttgccatttattttctaaaaataaacaaaaattgaag

SEQ ID NO: 154401 - DNA, 3162 bp, Homo sapiens
  Payload ID: 10346
  Gene Symbol: MRPL22
  Gene Name: mitochondrial ribosomal protein L22
  ENST ID: ENST00000522038
  CDS Start-End: 10-648
gggcgaaagatggcggcggcagtactgggacagttgggtgcgttatggatacataacctgaggagccgggggaagctggccttggggcttctttcatttcacagtgttttacctcaatcatatatccacacaagtgcttctcttgacatttctcgaaaatgggagaagaagaataaaattgtttatcctccacaactgcctggagaacctcggagaccagcagaaatctaccactgtcgaagacaaataaaatatagcaaagacaagatgtggtatttggcaaaattgatacgaggaatgtctattgaccaggctttggctcagttggaattcaatgacaaaaaaggggccaaaataattaaagaggttctcttagaagcacaagatatggcagtgagagaccataacgtggaattcaggtccaatttatatatagctgagtccacctcaggacgaggccagtgcctgaaacgcatccgctaccatggcagaggtcgctttgggatcatggagaaggtttattgccattattttgtgaagttggtggaagggcccccacctccacctgagccaccaaagacggcagttgcccatgccaaagagtatattcagcagcttcgcagccggaccatcgttcacactctatgatgaggagattcagactccacagtgtatatattttgccatttattttctaaaaataaacaaaaattgaaggcaaatgctttttatgatttctcattgaattattgaaacagtgtataactgctagttgtaaatgaatatttataaggctttgcccatttcttttgagcctctgggcatatttgtatgcatttgcgacttggaaggggaaatcagctttaaacatagtaacagactatatttcaaaaggcttttggagtaactttgaaagggaatgttaactttccaactagtgtcctgcaggtggctgttttgatactggacttgaatacagtgttatgaggtaagaaaattgcttttatttcacttaattttctcttgggaccatgggaagttagagtggctgcatgttgtttcattacagtattttagggtgttcagtggtaccgtttttcctttcactgttggcacaggccagtgagtcaaaaattatattttcctttactgttttagcagtaactcgaaactacaggagtttattagatatacgaatctaaaactccaaaaacctttaactttgaaaattttcttttggttaagcaaagcctgtttttatttcttcttccaacagtgctttatattgtttggatatcttgtttaggattgatttatttttcagggtaaattcaattactgagagaggaattgaaccaatctcagcattgcattctaaaatggggcagtaggtggcactcaaccttttattagcagaaaattgttagtttcaaattagagtgttcaacactgcttccctctcattcatacacgtcttcattaagaagaagtactctttgtctacagccctagtccaacttttgcatgcaaaagaagaatcgaggatgcttgcttgttaatgcagacttctgggccccaccccaatgattcaattcactaggtcttatggggggctggtttcagaaatctatgttttaaacaaacacttccaggtaattctgttgtaggggactacgctttgagaatacggctttaggagaatgaaaaaatgtagttttattgccatgttttaagatggcattaataatagttactgtttactgggaacttgttatttgcaagctctgtgctagtattttacataattcttcacaacatcctgaaaatgtagcttttgttttaccactttacaaaggaataaaccgaagcacacagaattcaaataactatcacaagtcacacagcatgtaaatattggggctatgattgaaaggtttctaaagtagctggttctgcataccttttgagtatacagctgggtttttgtgtctctccagttaacctaatgcatgggtaaaaagacatcaggggtcagtggaataaaccaaggtgtaggacagattcattctgggtcctaagctgttgtagcatggagtcagggaaataacactggaatattaaaaggtaaccttcattctagtctgtgcattctcattagccagaaagaagactggataggtctcttcccttgctggcctccatttcattcatttatgaaacaagagactcaatgttctctgtagaaaaccttttttagaatcacttgaagaatttgtttaaaaatgcaaattcctgggctctactctcagactaagtgaatcagaagctttggtgtgggagaccatggaacctgcagttttaataaatgccccagtgatttgcatgttggagaattatcacaccaggtcactgtgctctcatgtggtggggatgctccacgattgctcttggagttgtgacttccttgggtgtgactaaagccaggtggtgccatggacatcataaatataaattatgtaagtgaaggcactgcttcagtcaggctgtaaaagctattttgaaagtggtaaggaaaaagtaggattgtaatgaagaaaatttccttcccaggttaagccttcatttggaactgcttccagtacgttacaaaaagtaataatagctaacctgtgtcactgactgtatctggtactattttaagcactatatatacattatctcaatgaatctttcccattgtgacatccggctagttttcgtggctaagagtgtactttctaacatccatgaacattgtggtccccacctgaagtttcactttgcatgttcagtgatatggtttggctctgtgttcccacccaatcttatctcaaattgtaatccccatgtgtccagggagggacctgtaatccccacctagtgacggagggaggtgattgatgatgggtgtggtgtaccccatgctgttctcgtgatagtgagtgggttctcatgagatctgatggttttataagtgtttgaaagttccctcttcactcgctgtcttgcctgctgccatgtaaaatgtgcctacttcaccctctgccatgattgtaagtttcctgaggcctccccagccatgcagaactttgacacaattaaatgtcttttctttataaatta

SEQ ID NO: 154402 - DNA, 511 bp, Homo sapiens
  Payload ID: 10346
  Gene Symbol: MRPL22
  Gene Name: mitochondrial ribosomal protein L22
  ENST ID: ENST00000519059
  CDS Start-End: 1-117
gagatggaatctgagttgacggcttgtgttgatgttgcaggtgcgttatggatacataacctgaggagccgggggaagctggccttggggaaatctaccactgtcgaagacaaataaaatatagcaaagacaagatgtggtatttggcaaaattgatacgaggaatgtctattgaccaggctttggctcagttggaattcaatgacaaaaaaggggccaaaataattaaagaggttctcttagaagcacaagatatggcagtgagagaccataacgtggaattcaggtccaatttatatatagctgagtccacctcaggacgaggccagtgcctgaaacgcatccgctaccatggcagaggtcgctttgggatcatggagaaggtttattgccattattttgtgaagttggtggaagggcccccacctccacctgagccaccaaagacggcagttgcccatgccaaagagtatattcagcagcttcgcagccggaccatcgttcacactct

SEQ ID NO: 154403 - DNA, 3176 bp, Homo sapiens
  Payload ID: 10346
  Gene Symbol: MRPL22
  Gene Name: mitochondrial ribosomal protein L22
  Uniprot ID: Q9NWU5
  ENST ID: ENST00000523037
  CDS Start-End: 42-662
ggcgcttgaactcggcggcttccgtagcgggagggcgaaagatggcggcggcagtactgggacagttgggtgcgttatggatacataacctgaggagccgggggaagctggccttgggtgttttacctcaatcatatatccacacaagtgcttctcttgacatttctcgaaaatgggagaagaagaataaaattgtttatcctccacaactgcctggagaacctcggagaccagcagaaatctaccactgtcgaagacaaataaaatatagcaaagacaagatgtggtatttggcaaaattgatacgaggaatgtctattgaccaggctttggctcagttggaattcaatgacaaaaaaggggccaaaataattaaagaggttctcttagaagcacaagatatggcagtgagagaccataacgtggaattcaggtccaatttatatatagctgagtccacctcaggacgaggccagtgcctgaaacgcatccgctaccatggcagaggtcgctttgggatcatggagaaggtttattgccattattttgtgaagttggtggaagggcccccacctccacctgagccaccaaagacggcagttgcccatgccaaagagtatattcagcagcttcgcagccggaccatcgttcacactctatgatgaggagattcagactccacagtgtatatattttgccatttattttctaaaaataaacaaaaattgaaggcaaatgctttttatgatttctcattgaattattgaaacagtgtataactgctagttgtaaatgaatatttataaggctttgcccatttcttttgagcctctgggcatatttgtatgcatttgcgacttggaaggggaaatcagctttaaacatagtaacagactatatttcaaaaggcttttggagtaactttgaaagggaatgttaactttccaactagtgtcctgcaggtggctgttttgatactggacttgaatacagtgttatgaggtaagaaaattgcttttatttcacttaattttctcttgggaccatgggaagttagagtggctgcatgttgtttcattacagtattttagggtgttcagtggtaccgtttttcctttcactgttggcacaggccagtgagtcaaaaattatattttcctttactgttttagcagtaactcgaaactacaggagtttattagatatacgaatctaaaactccaaaaacctttaactttgaaaattttcttttggttaagcaaagcctgtttttatttcttcttccaacagtgctttatattgtttggatatcttgtttaggattgatttatttttcagggtaaattcaattactgagagaggaattgaaccaatctcagcattgcattctaaaatggggcagtaggtggcactcaaccttttattagcagaaaattgttagtttcaaattagagtgttcaacactgcttccctctcattcatacacgtcttcattaagaagaagtactctttgtctacagccctagtccaacttttgcatgcaaaagaagaatcgaggatgcttgcttgttaatgcagacttctgggccccaccccaatgattcaattcactaggtcttatggggggctggtttcagaaatctatgttttaaacaaacacttccaggtaattctgttgtaggggactacgctttgagaatacggctttaggagaatgaaaaaatgtagttttattgccatgttttaagatggcattaataatagttactgtttactgggaacttgttatttgcaagctctgtgctagtattttacataattcttcacaacatcctgaaaatgtagcttttgttttaccactttacaaaggaataaaccgaagcacacagaattcaaataactatcacaagtcacacagcatgtaaatattggggctatgattgaaaggtttctaaagtagctggttctgcataccttttgagtatacagctgggtttttgtgtctctccagttaacctaatgcatgggtaaaaagacatcaggggtcagtggaataaaccaaggtgtaggacagattcattctgggtcctaagctgttgtagcatggagtcagggaaataacactggaatattaaaaggtaaccttcattctagtctgtgcattctcattagccagaaagaagactggataggtctcttcccttgctggcctccatttcattcatttatgaaacaagagactcaatgttctctgtagaaaaccttttttagaatcacttgaagaatttgtttaaaaatgcaaattcctgggctctactctcagactaagtgaatcagaagctttggtgtgggagaccatggaacctgcagttttaataaatgccccagtgatttgcatgttggagaattatcacaccaggtcactgtgctctcatgtggtggggatgctccacgattgctcttggagttgtgacttccttgggtgtgactaaagccaggtggtgccatggacatcataaatataaattatgtaagtgaaggcactgcttcagtcaggctgtaaaagctattttgaaagtggtaaggaaaaagtaggattgtaatgaagaaaatttccttcccaggttaagccttcatttggaactgcttccagtacgttacaaaaagtaataatagctaacctgtgtcactgactgtatctggtactattttaagcactatatatacattatctcaatgaatctttcccattgtgacatccggctagttttcgtggctaagagtgtactttctaacatccatgaacattgtggtccccacctgaagtttcactttgcatgttcagtgatatggtttggctctgtgttcccacccaatcttatctcaaattgtaatccccatgtgtccagggagggacctgtaatccccacctagtgacggagggaggtgattgatgatgggtgtggtgtaccccatgctgttctcgtgatagtgagtgggttctcatgagatctgatggttttataagtgtttgaaagttccctcttcactcgctgtcttgcctgctgccatgtaaaatgtgcctacttcaccctctgccatgattgtaagtttcctgaggcctccccagccatgcagaactttgacacaattaaatgtcttttctttataaatta

SEQ ID NO: 154404 - DNA, 693 bp, Homo sapiens
  Payload ID: 10346
  Gene Symbol: MRPL22
  Gene Name: mitochondrial ribosomal protein L22
  ENST ID: ENST00000614620
  CDS Start-End: 7-693
cgaaagatggcggcggcagtactgggacagttgggtgcgttatggatacataacctgaggagccgggggaagctggccttgggtgttttacctcaatcatatatccacacaagtgcttctcttgacatttctcgaaaatgggagaagaagaataaaattgtttatcctccacaactgcctggagaacctcggagaccagcagaaatctaccactgtcgaagacaaataaaatatagcaaagacaagatgtggtatttggcaaaattgatacgaggaatgtctattgaccaggctttggctcagttggaattcaatgacaaaaaaggggccaaaataattaaagaggttctcttagaagcacaagatatggcagtgagagaccataacgtggaattcaggtccaatttatatatagctgagtccacctcaggacgaggccagtgcctgaaacgcatccgctaccatggcagaggtcgctttgggatcatggagaaggtttattgccattattttgtgaagttggtggaagggcccccacctccacctgagccaccaaagacggcagttgcccatgccaaagagtatattcagcagttcgcagccggaccatcgttcacactctatgatgaggagattcagactccacagtgtatatattttgccatttattttctaaaaataaacaaaaattga

SEQ ID NO: 154405 - DNA, 919 bp, Homo sapiens
  Payload ID: 10347
  Gene Symbol: MRPL23
  Gene Name: mitochondrial ribosomal protein L23
  ENST ID: ENST00000381514
  CDS Start-End: 23-514
cccggaagcgcgcgtggccgccatggcgcggaatgtggtgtaccccctgtaccggctgggtggcccacaacttcgggtgttccgaaccaacttcttcattcagctggtgcggcccggtgtggcccagcccgaggacaccgtgcagttccggatccccatggaaatgacaagggtggacctcaggaattacctcgagggcatctataacgtgcccgtggctgctgtgcggacacgggtgcagcatggctctaacaagagaagagatcacagaaacgtgaggatcaagaagccggactacaaggtcgcctacgtgcagctggtgccgcaccctcggtccctgcctctctgtctccagcaccgctcacagctccgcacccccagaattccctgcattgtcgcctttgcgtcttggggccctgggagcaagcacgatgcctgcagtgccctgtgcgtggtggccagggcctgggctgcggtgtacgtgagtgcccgtctcatctccgtagccggctaagagtcctttcaaggccaagaattcttctctttgaccacatttccacccctccgcctgccctaggatgctctccatagtggacgctgcactttgccatggcatgccgggtggacaggactgctggggcccccgtgttccagcctctcctgcgcctccagatacggctgcttcctgggtctgggtgtctgaggggacgtccctcaaggttcccacccagctcagcctgtcaggagccgcaccctgcgaggcctgagaccacaccatgccgggtggggacacacgggccctgagtgacctgttgggcatctgcgttcaccaccccaccctgtctgagatcatccccagcaccagtccccccaaatcgcttcattatttctttgtaaatagggctttttctagtcaaaa

SEQ ID NO: 154406 - DNA, 643 bp, Homo sapiens
  Payload ID: 10347
  Gene Symbol: MRPL23
  Gene Name: mitochondrial ribosomal protein L23
  Uniprot ID: Q16540
  ENST ID: ENST00000381519
  CDS Start-End: 86-547
gggggcgctgtgccaggcggcggccgtgcggggcgggcgcgctgctccttccgcctcgcggaccccggaagcgcgcgtggccgccatggcgcggaatgtggtgtaccccctgtaccggctgggtggcccacaacttcgggtgttccgaaccaacttcttcattcagctggtgcggcccggtgtggcccagcccgaggacaccgtgcagttccggatccccatggaaatgacaagggtggacctcaggaattacctcgagggcatctataacgtgcccgtggctgctgtgcggacacgggtgcagcatggctctaacaagagaagagatcacagaaacgtgaggatcaagaagccggactacaaggtcgcctacgtgcagctggcccatggacagaccttcacgttcccagatctgtttcccgagaaagacgagagccctgaaggcagcgctgccgacgacctctacagcatgctcgaggaggagaggcagcagaggcagagcagcgacccgcggcggggcggcgtccccagctggttcgggctgtgacggggtggccagcagggacgcgccccaggtgggcagctgtggcagagcagtcccgacacctaaataaaagtcttgctgcaggagaaagagccggaa

SEQ ID NO: 154407 - DNA, 551 bp, Homo sapiens
  Payload ID: 10347
  Gene Symbol: MRPL23
  Gene Name: mitochondrial ribosomal protein L23
  ENST ID: ENST00000397294
  CDS Start-End: 20-520
ggaagcgcgcgtggccgccatggcgcggaatgtggtgtaccccctgtaccggctgggtggcccacaacttcgggtgttccgaaccaacttcttcattcagctggtgcggcccggtgtggcccagcccgaggacaccgtgcagttccggatccccatggaaatgacaagggtggacctcaggaattacctcgagggcatctataacgtgcccgtggctgctgtgcggacacgggtgcagcatggctctaacaagagaagagatcacagaaacgtgaggatcaagaagccggactacaaggtcgcctacgtgcagctgccctcccagacacccagcaaggagcaaaatggccagggcagcaccctctgtttccggagcagctgcagcaaggggtggtcaacctgggggaccagggaccccagacccgcttggagtcctgtgggtggccgcattcccaggaaggctggatccggaggaccggccaacaggatcgctcaggatggacgtcttctactcaagtaagaccttggcagccttggtcggctccatagtc

SEQ ID NO: 154408 - DNA, 613 bp, Homo sapiens
  Payload ID: 10347
  Gene Symbol: MRPL23
  Gene Name: mitochondrial ribosomal protein L23
  ENST ID: ENST00000397297
  CDS Start-End: 32-607
ctcgcggaccccggaagcgcgcgtggccgccatggcgcggaatgtggtgtaccccctgtaccggctgggtggcccacaacttcgggtgttccgaaccaacttcttcattcagctggtgcggcccggtgtggcccagcccgaggacaccgtgcagttccggatccccatggaaatgacaagggtggacctcaggaattacctcgagggcatctataacgtgcccgtggctgctgtgcggacacgggtgcagcatggctctaacaagagaagagatcacagaaacgtgaggatcaagaagccggactacaaggtcgcctacgtgcagctgccctcccagacacccagcaaggagcaaaatggccagggcagcaccctctgtttccggagcagctgcagcaaggggtggtcaacctgggggaccagggaccccagacccgcttggagtcctgtgggtggccgcattcccaggaaggctggatccggaggaccggccaacaggatcgctcaggatggacgtcttctactcaagaacctcaggcccagagtccccaggagggagcagccggcaacacggtttccgctgtggagacggggcgtcctggcttgagttcac

SEQ ID NO: 154409 - DNA, 736 bp, Homo sapiens
  Payload ID: 10347
  Gene Symbol: MRPL23
  Gene Name: mitochondrial ribosomal protein L23
  Uniprot ID: Q16540
  ENST ID: ENST00000397298
  CDS Start-End: 86-547
gggggcgctgtgccaggcggcggccgtgcggggcgggcgcgctgctccttccgcctcgcggaccccggaagcgcgcgtggccgccatggcgcggaatgtggtgtaccccctgtaccggctgggtggcccacaacttcgggtgttccgaaccaacttcttcattcagctggtgcggcccggtgtggcccagcccgaggacaccgtgcagttccggatccccatggaaatgacaagggtggacctcaggaattacctcgagggcatctataacgtgcccgtggctgctgtgcggacacgggtgcagcatggctctaacaagagaagagatcacagaaacgtgaggatcaagaagccggactacaaggtcgcctacgtgcagctggcccatggacagaccttcacgttcccagatctgtttcccgagaaagacgagagccctgaaggcagcgctgccgacgacctctacagcatgctcgaggaggagaggcagcagaggcagagcagcgacccgcggcggggcggcgtccccagctggttcgggctgtgacggggtggccagcagggacgcgccccaggtgggcagctgtggcagagcagcgacccgcggcggggcggcatccccagctggttcgggccgtgacggggcggccagcagggacgcgccccaggtgggcagctgtggcagagcagtcccgacacctaaataaaagtcttgctgcaggagaaagagccggaa

SEQ ID NO: 154410 - DNA, 805 bp, Homo sapiens
  Payload ID: 10347
  Gene Symbol: MRPL23
  Gene Name: mitochondrial ribosomal protein L23
  ENST ID: ENST00000429295
  CDS Start-End: 1-355
gtaccccctgtaccggctgggtggcccacaacttcgggtgttccgaaccaacttcttcattcagctggtgcggcccggtgtggcccagcccgaggacaccgtgcagttccggatccccatggaaatgacaagggtggacctcaggaattacctcgagggcatctataacgtgcccgtggctgctgtgcggacacgggtgcagcatggctctaacaagagaagagatcacagaaacgtgaggatcaagaagccggactacaaggtcgcctacgtgcagctggtccccaaggagcagtatcccctccttctcgtgaacccgagccacatgctgtggcctgggctggggcttggctgacacggacatattctgaactctcagcagaagatgtaagaccagttaattggcagagccggtcctgatttatcaactgccgcacgtgcatgtttcttcgcccatggacagaccttcacgttcccagatctgtttcccgagaaagacgagagccctgaaggcagcgctgccgacgacctctacagcatgctcgaggaggagaggcagcagaggcagagcagcgacccgcggcggggcggcgtccccagctggttcgggctgtgacggggtggccagcagggacgcgccccaggtgggcagctgtggcagagcagcgacccgcggcggggcggcatccccagctggttcgggccgtgacggggcggccagcagggacgcgccccaggtgggcagctgtggcagagcagtcccgacacctaaataaaagtcttgctgcaggagaaagagccggaa

SEQ ID NO: 154411 - DNA, 883 bp, Homo sapiens
  Payload ID: 10348
  Gene Symbol: MRPL24
  Gene Name: mitochondrial ribosomal protein L24
  Uniprot ID: Q96A35
  ENST ID: ENST00000361531
  CDS Start-End: 138-788
atgtgctgaaaatccgaagtgccgcggaaagtggaggtgagggccgcccgccctagaggtgcccgtccgagaggcagagctgacaaggaaggtttcgagcgttttgctggcaaagggatttcttacaacctccaggcatgcgtctttctgccctgctggccttggcatccaaggtcactctgcccccccattaccgctatgggatgagccccccaggctctgttgcagacaagaggaagaaccccccatggatcaggcggcgcccagtggttgtggaacccatctctgatgaagactggtatctgttctgtggggacacggtggagatcctagaaggcaaggatgccgggaagcagggcaaagtggttcaagttatccggcagcgaaactgggtggtcgtgggagggctgaacacacattaccgctacattggcaagaccatggattaccggggaaccatgatccctagtgaagcccccttgctccaccgccaggtcaaacttgtggatcctatggacaggaaacccactgagatcgagtggagatttactgaagcaggagagcgggtacgagtctccacacgatcagggagaattatccctaaacccgaatttcccagagctgatggcatcgtccctgaaacgtggattgatggccccaaagacacatcagtggaagatgctttagaaagaacctatgtgccctgtctaaagacactgcaggaggaggtgatggaggccatggggatcaaggagacccggaaatacaagaaggtctattggtattgagcctggggcagagcagctcctccccaacttctgtcccagccttgaaggctgaggcacttctttttcagatgccaataaagagcactttatgagtc

SEQ ID NO: 154412 - DNA, 883 bp, Homo sapiens
  Payload ID: 10348
  Gene Symbol: MRPL24
  Gene Name: mitochondrial ribosomal protein L24
  Uniprot ID: Q96A35
  ENST ID: ENST00000368211
  CDS Start-End: 140-790
agaaagtcgacgggcgtggcgggggaggggacgctgagggcccatgtgctgaaaatccgaagtgccgcggaaagtggagagctgacaaggaaggtttcgagcgttttgctggcaaagggatttcttacaacctccaggcatgcgtctttctgccctgctggccttggcatccaaggtcactctgcccccccattaccgctatgggatgagccccccaggctctgttgcagacaagaggaagaaccccccatggatcaggcggcgcccagtggttgtggaacccatctctgatgaagactggtatctgttctgtggggacacggtggagatcctagaaggcaaggatgccgggaagcagggcaaagtggttcaagttatccggcagcgaaactgggtggtcgtgggagggctgaacacacattaccgctacattggcaagaccatggattaccggggaaccatgatccctagtgaagcccccttgctccaccgccaggtcaaacttgtggatcctatggacaggaaacccactgagatcgagtggagatttactgaagcaggagagcgggtacgagtctccacacgatcagggagaattatccctaaacccgaatttcccagagctgatggcatcgtccctgaaacgtggattgatggccccaaagacacatcagtggaagatgctttagaaagaacctatgtgccctgtctaaagacactgcaggaggaggtgatggaggccatggggatcaaggagacccggaaatacaagaaggtctattggtattgagcctggggcagagcagctcctccccaacttctgtcccagccttgaaggctgaggcacttctttttcagatgccaataaagagcactttatgag

SEQ ID NO: 154413 - DNA, 514 bp, Homo sapiens
  Payload ID: 10348
  Gene Symbol: MRPL24
  Gene Name: mitochondrial ribosomal protein L24
  ENST ID: ENST00000412846
  CDS Start-End: 219-514
atgtgctgaaaatccgaagtgccgcggaaagtggaggtgagggccgcccgccctagaggtgcccgtccgagaggcaggtgcgggaagagcctatccttttccctggccatggctcagtcgcctccccagggtttatttgcaccggaagtttggagcggagctgacaaggaaggtttcgagcgttttgctggcaaagggatttcttacaacctccaggcatgcgtctttctgccctgctggccttggcatccaaggtcactctgcccccccattaccgctatgggatgagccccccaggctctgttgcagacaagaggaagaaccccccatggatcaggcggcgcccagtggttgtggaacccatctctgatgaagactggtatctgttctgtggggacacggtggagatcctagaaggcaaggatgccgggaagcagggcaaagtggttcaagttatccggcagcgaaactgggtggtcgtgggagggctgaacacacattaccgctacattgg

SEQ ID NO: 154414 - DNA, 448 bp, Homo sapiens
  Payload ID: 10348
  Gene Symbol: MRPL24
  Gene Name: mitochondrial ribosomal protein L24
  ENST ID: ENST00000420938
  CDS Start-End: 245-448
cttgtctgtaaaagggactttacgatgcatctggcaacctcaccttcctcactgggcaatgtgaagaccaaatgccggcaatgaaattcccagcattaggtttgtcatatagtagtcctctctaagcatttgttgaatactcacaggaacacttaggccagtcagcattaattgaaaataacagagctgacaaggaaggtttcgagcgttttgctggcaaagggatttcttacaacctccaggcatgcgtctttctgccctgctggccttggcatccaaggtcactctgcccccccattaccgctatgggatgagccccccaggctctgttgcagacaagaggaagaaccccccatggatcaggcggcgcccagtggttgtggaacccatctctgatgaagactggtatctgttctgtggggacacggtggagatcctagaaggcaag

SEQ ID NO: 154415 - DNA, 990 bp, Homo sapiens
  Payload ID: 10348
  Gene Symbol: MRPL24
  Gene Name: mitochondrial ribosomal protein L24
  ENST ID: ENST00000434558
  CDS Start-End: 472-990
agatctgacattttgtaactagatcggctactagcattggaagggcccacgtttcatcccttcctctagaaagcctaccggcagtttttgaatctgccctgcccccactccagcagagaaggacagggagagcattggcggtagccctgtctggaaagggcggccctttgccttgaacaggaagccacaaccacctagaaaatggagccttcttctctagaaactacaattcccagcggcctccacgcagagcatgcgcgggaatgtgccaggcgggccagccgaaccagcttgcctttcgattcccgacatgcttcatggtgtgttccggtttccttgatttcctacccccgccaaacttcctgtttccagctttctagcggcggactacaactcccagcatgctgagagagctgacaaggaaggtttcgagcgttttgctggcaaagggatttcttacaacctccaggcatgcgtctttctgccctgctggccttggcatccaaggtcactctgcccccccattaccgctatgggatgagccccccaggctctgttgcagacaagaggaagaaccccccatggatcaggcggcgcccagtggttgtggaacccatctctgatgaagactggtatctgttctgtggggacacggtggagatcctagaaggcaaggatgccgggaagcagggcaaagtggttcaagttatccggcagcgaaactgggtggtcgtgggagggctgaacacacattaccgctacattggcaagaccatggattaccggggaaccatgatccctagtgaagcccccttgctccaccgccaggtcaaacttgtggatcctatggacaggaaacccactgagatcgagtggagatttactgaagcaggagagcgggtacgagtctccacacgatcagggagaattatccctaaacccgaatttcccagagctgatggcatcgtccctgaaacgtggattgatggc

SEQ ID NO: 154416 - DNA, 716 bp, Homo sapiens
  Payload ID: 10349
  Gene Symbol: MRPL27
  Gene Name: mitochondrial ribosomal protein L27
  Uniprot ID: Q9P0M9
  ENST ID: ENST00000225969
  CDS Start-End: 45-491
cggaagtagaaacttttcgagaccggaagtgagtgatcgaaagcatggcgtcggtggtgttggcgctgaggacccggacagccgttacatccttgctaagccccactccggctacagctcttgctgtcagatacgcatccaagaagtcgggtggtagctccaaaaacctcggtggaaagtcatcaggcagacgccaaggcattaagaaaatggaaggtcactatgttcatgctgggaacatcattgcaacacagcgccatttccgctggcacccaggtgcccatgtgggtgttgggaagaataaatgtctgtatgccctggaagaggggatagtccgctacactaaggaggtctacgtgcctcatcccagaaacacggaggctgtggatctgatcaccaggctgcccaagggtgctgtgctctacaagacttttgtccacgtggttcctgccaagcctgagggcaccttcaaactggtagctatgctttgatgtcctgttgaggccatcggacagagactggagcccaggtgacaggagatggtgataccagaagtcaagggttggggtggcgacacggcctcccgaggaagaggtctgcttgatggtgactctgcaggagactctgaagtgactgctgggaaaccctttgggagacctgacctggggccaaaaataaagtgagccagcgtcatgaacgcatgctatttagggaca

SEQ ID NO: 154417 - DNA, 2441 bp, Homo sapiens
  Payload ID: 10349
  Gene Symbol: MRPL27
  Gene Name: mitochondrial ribosomal protein L27
  ENST ID: ENST00000442592
  CDS Start-End: 38-322
agaaacttttcgagaccggaagtgagtgatcgaaagcatggcgtcggtggtgttggcgctgaggacccggacagccgttacatccttgctaagccccactccggctacagctcttgctgtcagatacgcatccaagaagtcgggtggtagctccaaaaacctcggtggaaagtcatcaggcagacgccaaggcattaagaaaatggaaggtcactatgttcatgctgggaacatcattgcaacacagcgccatttccgctggcacccaggtgcccatgtgagttgctccgttgctgcccccctttttccttttctaggttgacctctccttgcccctaagcatggtaataacagttgcatgtattgagtgcttaccaaatggcaagcattgtgctgattcccatgcctacacgatctcatttcttccttaccacatccctgtaagtaaggtgaaatgccagagacctagacggggtggaaggagcaagtgactgctgggatttgcaccaggtctgcctaactcccagatcactatgatttgccctggtgttgcattggcctggtattcttggttctcctttctaaccctcagttcttggaggacaagatacctggtgatttaaaatattattttagtcttgggaaactaatttcaatttattagtttttcattattctaagacttcttcctttgtataaacttacttgcagatggttgaaagatagcttgaatttaatgaaatagaattcagtgtgccaggagttaggttcataccaggtggggatttcagtttcagcaagttggcatcatttttatagggtaggacagttctttgttacagagacataacgatactgtactctccacattattttaaatattagttgcctttgtaaacagtttcccctcccccacccctttttcgataattttagtaggtacaaaaaggttgatagtaacctgtatttatttcaaagatgctaatttgtatgtgaattgattatgtatgtagtagctttttaccttttagaacttaagacattagatgtgtggctatgtcaacaataataatcaaagctaacacattttgagctagacagtattctaggccctttatgattgttgagcattaatcctcaaaatgaccctgtaaaatagttaatattatccccatttgacagacgaaaaaatagaggcacagtgaagtaacttgcctaagaccacacaggagtaagtagcagtgctggtatttgaaccaggcatcctggctccagagcccattcttttaatcagagagacagagaataatgctggactacctgggtaaaatttgccacacacccagcctgaagttctaaaagaaaaagctaaaaaatatggttaaaaactgtatatacaacacagtttaatctctctgcttcatatttcacatctgaaaagtggcgttggaaataatacctctttcactaggtgagaattaaatgacttaatgtgtattaaagggcttacatgggtattagctaatgcagtagtatgattgttttattagcatatgcattatccatatagctttggtttatattttccatagagcctaaactttatagatcactatctaaatgaaaatttacatcaaactagtgttttaatatgacagttctagtgttgtttaagtctaagtgaagatttagggcatcttcctgggttttgggatttgtgcagtgtggcttctgaccagctgcatagacatggctccaggtaacagtccctgggactgagcagtggcccatgttggctgttggagctttcttttccctcatttgttatgagtcaataaagaagcagaaggtttggacgtgctagccagtgggaaagggaacctgagatggagctctctgatcaccctttcagccccagggcccggctctgtgtgagaagtctgtcccaaaattctgggacggaccacctcgctgaccagctgaccagctgaccaggtctgtgtgttgcaggtgggtgttgggaagaataaatgtctgtatgccctggaagaggggatagtccgctacactaaggaggtctacgtgcctcatcccagaaacacggaggctgtggatctgatcaccaggctgcccaagggtgctgtgctctacaagacttttgtccacgtggttcctgccaagcctgagggcaccttcaaactggtagctatgctttgatgtcctgttgaggccatcggacagagactggagcccaggtgacaggagatggtgataccagaagtcaagggttggggtggcgacacggcctcccgaggaagaggtctgcttgatggtgactctgcaggagactctgaagtgactgctgggaaaccctttgggagacctgacctggggccaaaaataaagtgagccagcgtcatgaacgcatgctatttagggac

SEQ ID NO: 154418 - DNA, 732 bp, Homo sapiens
  Payload ID: 10349
  Gene Symbol: MRPL27
  Gene Name: mitochondrial ribosomal protein L27
  ENST ID: ENST00000507088
  CDS Start-End: 216-497
ggtggagccgtgagtgagggcgtttgaagagcacttgtctttctcctgcctcagcagcacggacgggttccttggcggttggggatttggttacatccttgctaagccccactccggctacagctcttgctgtcagatacgcatccaagaagtcgggtggtagctccaaaaacctcggtggaaagtcatcaggcagacgccaaggcattaagaaaatggaaggtcactatgttcatgctgggaacatcattgcaacacagcgccatttccgctggcacccaggtgcccatgtgggtgttgggaagaataaatgtctgtatgccctggaagaggggatagtccgctacactaaggaggtctacgtgcctcatcccagaaacacggaggctgtggatctgatcaccaggctgcccaagggtgctgtgctctacaagacttttgtccacgtggttcctgccaagcctgagggcaccttcaaactggtagctatgctttgatgtcctgttgaggccatcggacagagactggagcccaggtgacaggagatggtgataccagaagtcaagggttggggtggcgacacggcctcccgaggaagaggtctgcttgatggtgactctgcaggagactctgaagtgactgctgggaaaccctttgggagacctgacctggggccaaaaataaagtgagccagcgtcatgaacgcatgctatttagggacacacctggatg

SEQ ID NO: 154419 - DNA, 636 bp, Homo sapiens
  Payload ID: 10349
  Gene Symbol: MRPL27
  Gene Name: mitochondrial ribosomal protein L27
  ENST ID: ENST00000508200
  CDS Start-End: 1-409
aagccccactccggctacagctcttgctgtcagatacgcatccaagaagtcgggtggtagctccaaaaacctcggtggaaagtcatcaggcagacgccaaggcattaagaaaatggaaggtcactatgttcatgctgggaacatcattgcaacacagcgccatttccgctggcacccaggtgcccatgtctgtgtgttgcaggtgggtgttgggaagaataaatgtctgtatgccctggaagaggggatagtccgctacactaaggaggtctacgtgcctcatcccagaaacacggaggctgtggatctgatcaccaggctgcccaagggtgctgtgctctacaagacttttgtccacgtggttcctgccaagcctgagggcaccttcaaactggtagctatgctttgatgtcctgttgaggccatcggacagagactggagcccaggtgacaggagatggtgataccagaagtcaagggttggggtggcgacacggcctcccgaggaagaggtctgcttgatggtgactctgcaggagactctgaagtgactgctgggaaaccctttgggagacctgacctggggccaaaaataaagtgagccagcgtcatgaacgcatgctatttagggacaca

SEQ ID NO: 154420 - DNA, 742 bp, Homo sapiens
  Payload ID: 10349
  Gene Symbol: MRPL27
  Gene Name: mitochondrial ribosomal protein L27
  ENST ID: ENST00000503633
  CDS Start-End: 27-281
gagaccggaagtgagtgatcgaaagcatggcgtcggtggtgttggcgctgaggacccggacagccgttacatccttgctaagccccactccggctacagctcttgctgtcagatacgcatccaagaagtcgggtggtagctccaaaaacctcggtggaaagtcatcaggcagacgccaaggcattaagaaaatggaaggtcactatgttcatgctgggaacatcattgcaacacagcgccatttccgctggcacccaggtgcccattggcgttggaaataatacctctttcactaggtctgtgtgttgcaggtgggtgttgggaagaataaatgtctgtatgccctggaagaggggatagtccgctacactaaggaggtctacgtgcctcatcccagaaacacggaggctgtggatctgatcaccaggctgcccaagggtgctgtgctctacaagacttttgtccacgtggttcctgccaagcctgagggcaccttcaaactggtagctatgctttgatgtcctgttgaggccatcggacagagactggagcccaggtgacaggagatggtgataccagaagtcaagggttggggtggcgacacggcctcccgaggaagaggtctgcttgatggtgactctgcaggagactctgaagtgactgctgggaaaccctttgggagacctgacctggggccaaaaataaagtgagccagcgtcatgaacgcatgctatttagggac

SEQ ID NO: 154421 - DNA, 869 bp, Homo sapiens
  Payload ID: 10349
  Gene Symbol: MRPL27
  Gene Name: mitochondrial ribosomal protein L27
  ENST ID: ENST00000511860
  CDS Start-End: 384-665
aaaattagctgggcgtggtggcgtacacctgtaatcccagctacttgggaggctgaggcaggagaatcgcttgaatccgggacgcggaggttgcagggagccaggactatgccattgcactccagcttgggcaacaagagtgaagctccgtctttaaaaaaaaaaaagaaagaaagtcgtgggtgagcctgaaaccgaagcctttctggatgtactgggctccccaagtctgttctggcccctccgtggtgcatgaggttacatccttgctaagccccactccggctacagctcttgctgtcagatacgcatccaagaagtcgggtggtagctccaaaaacctcggtggaaagtcatcaggcagacgccaaggcattaagaaaatggaaggtcactatgttcatgctgggaacatcattgcaacacagcgccatttccgctggcacccaggtgcccatgtgggtgttgggaagaataaatgtctgtatgccctggaagaggggatagtccgctacactaaggaggtctacgtgcctcatcccagaaacacggaggctgtggatctgatcaccaggctgcccaagggtgctgtgctctacaagacttttgtccacgtggttcctgccaagcctgagggcaccttcaaactggtagctatgctttgatgtcctgttgaggccatcggacagagactggagcccaggtgacaggagatggtgataccagaagtcaagggttggggtggcgacacggcctcccgaggaagaggtctgcttgatggtgactctgcaggagactctgaagtgactgctgggaaaccctttgggagacctgacctggggccaaaaataaagtgagccagcgtcatg

SEQ ID NO: 154422 - DNA, 1098 bp, Homo sapiens
  Payload ID: 10350
  Gene Symbol: MRPL28
  Gene Name: mitochondrial ribosomal protein L28
  Uniprot ID: Q13084
  ENST ID: ENST00000199706
  CDS Start-End: 37-807
cggttccggtgggctctgaaccctgaaaggctcgcgatgcctctacacaagtatcccgtgtggctctggaagcggctgcagctgcgggagggcatctgttcccgcctgcccggccactacctgcgctccctggaggaggagcggacgcccactcccgtgcactataggcctcatggggccaagttcaagatcaaccccaagaacgggcagcgggagcgtgtggaggacgtgcccattcccatctactttccccccgaatcccagcgggggttgtggggcggcgagggctggatcctgggccaaatatatgccaacaacgacaagctctccaagaggctgaagaaagtgtggaagccacagctgtttgagcgagagttctacagtgagatcctggacaagaagttcacagtgactgtgaccatgcggaccctggacctcatcgatgaggcttatgggctcgacttttacatcctcaagaccccgaaggaggacctgtgctccaagtttgggatggacctgaagcgagggatgctgctgcggcttgcccggcaggacccccagctgcaccccgaggaccccgagcggcgggcagccatctacgacaagtacaaggaatttgccatcccagaggaggaggcagagtgggtgggcctcacgctggaggaggccattgagaagcagagacttttggaggagaaggaccctgtacccctgttcaagatctatgtggcggagctgatccagcagctgcagcagcaggcactgtcagagccggcggtggtgcagaagagagccagtggccagtgaccacacagctcctccatgcctgaccaacaggcccagctttccctgccaggccctttgcactgaggacacagatcccggggagctgtgagggccaccggtgggcagtgggtggatcctggtttcgtgtgctgcccatgcaccttccagcccggggccagcttggcagggatccccaggaggcctgggccgcccagaggctcctctcaggctgggccccgacgtttgcggcagtgttccttgtgcccgtggggccgggagcgagtaaagtctgggccaggctgtgtgtgtgta

SEQ ID NO: 154423 - DNA, 865 bp, Homo sapiens
  Payload ID: 10350
  Gene Symbol: MRPL28
  Gene Name: mitochondrial ribosomal protein L28
  Uniprot ID: Q13084
  ENST ID: ENST00000389675
  CDS Start-End: 33-803
aaccctgaaaggtgggcgcgggcaggctcgcgatgcctctacacaagtatcccgtgtggctctggaagcggctgcagctgcgggagggcatctgttcccgcctgcccggccactacctgcgctccctggaggaggagcggacgcccactcccgtgcactataggcctcatggggccaagttcaagatcaaccccaagaacgggcagcgggagcgtgtggaggacgtgcccattcccatctactttccccccgaatcccagcgggggttgtggggcggcgagggctggatcctgggccaaatatatgccaacaacgacaagctctccaagaggctgaagaaagtgtggaagccacagctgtttgagcgagagttctacagtgagatcctggacaagaagttcacagtgactgtgaccatgcggaccctggacctcatcgatgaggcttatgggctcgacttttacatcctcaagaccccgaaggaggacctgtgctccaagtttgggatggacctgaagcgagggatgctgctgcggcttgcccggcaggacccccagctgcaccccgaggaccccgagcggcgggcagccatctacgacaagtacaaggaatttgccatcccagaggaggaggcagagtgggtgggcctcacgctggaggaggccattgagaagcagagacttttggaggagaaggaccctgtacccctgttcaagatctatgtggcggagctgatccagcagctgcagcagcaggcactgtcagagccggcggtggtgcagaagagagccagtggccagtgaccacacagctcctccatgcctgaccaacaggcccagctttccctgccaggccctttgcactg

SEQ ID NO: 154424 - DNA, 722 bp, Homo sapiens
  Payload ID: 10350
  Gene Symbol: MRPL28
  Gene Name: mitochondrial ribosomal protein L28
  ENST ID: ENST00000447696
  CDS Start-End: 67-722
aaaggtgggcgcgggcaggtggggtgtgggggggcgccggggcagaaggggaggggcaggctcgcgatgcctctacacaagtatcccgtgtggctctggaagcggctgcagctgcgggagggcatctgttcccgcctgcccggccactacctgcgctccctggaggaggagcggacgcccactcccgtgcactataggcctcatggggccaagttcaagatcaaccccaagaacgggcagcgggagcgtgtggaggacgtgcccattcccatctactttccccccgaatcccagcgggggttgtggggcggcgagggctggatcctgggccaaatatatgccaacaacgacaagctctccaagaggctgaagaaagtgtggaagccacagctgtttgagcgagagttctacagtgagatcctggacaagaagttcacagtgactgtgaccatgcggaccctggacctcatcgatgaggcttatgggctcgacttttacatcctcaagaccccgaaggaggacctgtgctccaagtttgggatggacctgaagcgagggatgctgctgcggcttgcccggcaggacccccagctgcaccccgaggaccccgagcggcgggcagccatctacgacaagtacaaggaatttgccatcccagaggaggaggcagagtgggtgggcctcacgctggaggaggccattgagaagcagagacttttgga

SEQ ID NO: 154425 - DNA, 619 bp, Homo sapiens
  Payload ID: 10350
  Gene Symbol: MRPL28
  Gene Name: mitochondrial ribosomal protein L28
  ENST ID: ENST00000450882
  CDS Start-End: 37-619
cgggtgagagccgggggccggggtagcgggctcgcgatgcctctacacaagtatcccgtgtggctctggaagcggctgcagctgcgggagggcatctgttcccgcctgcccggccactacctgcgctccctggaggaggagcggacgcccactcccgtgcactataggcctcatggggccaagttcaagatcaaccccaagaacgggcagcgggagcgtgtggaggacgtgcccattcccatctactttccccccgaatcccagcgggggttgtggggcggcgagggctggatcctgggccaaatatatgccaacaacgacaagctctccaagaggctgaagaaagtgtggaagccacagctgtttgagcgagagttctacagtgagatcctggacaagaagttcacagtgactgtgaccatgcggaccctggacctcatcgatgaggcttatgggctcgacttttacatcctcaagaccccgaaggaggacctgtgctccaagtttgggatggacctgaagcgagggatgctgctgcggcttgcccggcaggacccccagctgcaccccgaggaccccgagcggcgggcagccatctacgacaagtacaaggaatttg

SEQ ID NO: 154426 - DNA, 800 bp, Homo sapiens
  Payload ID: 10350
  Gene Symbol: MRPL28
  Gene Name: mitochondrial ribosomal protein L28
  ENST ID: ENST00000441883
  CDS Start-End: 79-800
acaggggccggagtgagaaccgggggccggggtagggggtagcgggtgagagccgggggccggggtagcgggctcgcgatgcctctacacaagtatcccgtgtggctctggaagcggctgcagctgcgggagggcatctgttcccgcctgcccggccactacctgcgctccctggaggaggagcggacgcccactcccgtgcactataggcctcatggggccaagttcaagatcaaccccaagaacgggcagcgggagcgtgtggaggacgtgcccattcccatctactttccccccgaatcccagcgggggttgtggggcggcgagggctggatcctgggccaaatatatgccaacaacgacaagctctccaagaggctgaagaaagtgtggaagccacagctgtttgagcgagagttctacagtgagatcctggacaagaagttcacagtgactgtgaccatgcggaccctggacctcatcgatgaggcttatgggctcgacttttacatcctcaagaccccgaaggaggacctgtgctccaagtttgggatggacctgaagcgagggatgctgctgcggcttgcccggcaggacccccagctgcaccccgaggaccccgagcggcgggcagccatctacgacaagtacaaggaatttgccatcccagaggaggaggcagagtgggtgggcctcacgctggaggaggccattgagaagcagagacttttggaggagaaggaccctgtacccctgttcaagatctatgtggcggagctgatccagcagctgcagcagca

SEQ ID NO: 154427 - DNA, 310 bp, Homo sapiens
  Payload ID: 10350
  Gene Symbol: MRPL28
  Gene Name: mitochondrial ribosomal protein L28
  ENST ID: ENST00000429738
  CDS Start-End: 150-296
tccggcaaaggagcacgctgagtgaagaaccgcagttctggcaaacaggactgataaagtaggggtgaggtggggtgactcaggccgggggagcaaccagaggccgtggggagtcggggtaaagttaggatggggaggaggcctgtgtgatgagcagagcaggtgggagaggcgagcagagcaggtgggggaggcgagcagagcttcgaggcctgggccgcccagaggctcctctcaggctgggccccgacgtttgcggcagtgttccttgtgcccgtggggccgggagcgagtaaagtctgggccaggc

SEQ ID NO: 154428 - DNA, 1706 bp, Homo sapiens
  Payload ID: 10351
  Gene Symbol: MRPL3
  Gene Name: mitochondrial ribosomal protein L3
  Uniprot ID: P09001
  ENST ID: ENST00000264995
  CDS Start-End: 149-1195
agagagcatcggccggcgaccgttccggcggccattgcgaaaacttccccacggctactgcgtccacgtggcggtggcgtggggactccctgaaagcagagcggcagggcgcccggaagtcgtgagtcgagtcttcccgggctaatccatgccgggttggaggctgctgacgcaggtcggcgcccaggtgctgggtcgactcggggacggcctgggtgctgccctgggcccggggaacagaacacacatctggctttttgttagaggtcttcatggaaagagtggtacatggtgggatgagcatctttctgaagaaaatgtcccattcattaagcagttggtctctgatgaagataaagcccaattagcaagtaaactgtgtcctctgaaagatgaaccatggcctatacatccttgggaaccaggttcctttagagttggtcttattgccttgaagctgggcatgatgcctttatggaccaaggatggtcaaaagcatgtggtcacattacttcaggtacaagactgtcatgtcttaaaatatacgtcaaaggaaaactgtaatggaaaaatggcaaccctgtctgtaggaggaaaaactgtatcacgttttcgtaaagctacatccatattggaattttaccgggaacttggattgccgccgaaacagacagttaaaatctttaatataacagataatgctgcaattaaaccaggcactcctctttatgctgctcactttcgtccaggacagtatgtggatgtcacagccaaaactattggtaaaggttttcaaggtgtcatgaaaagatggggatttaaaggccagcctgctacgcatggtcaaacgaaaacccacaggagacctggagctgttgcaactggtgatattggcagagtctggcctggaactaaaatgcctggaaaaatgggaaacatatacaggacagaatatggactgaaagtgtggagaataaacacaaagcacaacataatctatgtaaatggctctgtacctggacataaaaattgcttagtaaaggtcaaagattctaaactgcctgcatataaggatctcggtaaaaatctaccattccctacatattttcctgatggagatgaagaggaactgccagaagatttgtatgatgaaaacgtgtgtcagcccggtgcgccttctattacatttgcctaacatctttggacgtggcagaaccttacatattctgtgagcttcgatgagccagagtgatatcataaccaccagaaatcatactctcctttcttagtcacaacaaaatcacacatgtcatctttgtcaagggcataaatatatcattcatacccccattaaattttgttagaaaaattaccacattaaatatatgagttaagtagattggatttgctgaaattggtgttgggcatattagcaaaatattcttaatttgtggactcgattcttttttactacatatttcccaagttatcttaagatgtctgtaaatttaacttttattaaagttttgtcaatctttgtgaaatagtggttgtggaacagtagaaaaccatatggggactatagtgcaacctatttgggtaaagaaaccatttgctaaaatggagaaagtaaatagatttttatttaaattacagaaacatgttaaaggccggacaaaggaaagacaataaaatcataaattatc

SEQ ID NO: 154429 - DNA, 1457 bp, Homo sapiens
  Payload ID: 10351
  Gene Symbol: MRPL3
  Gene Name: mitochondrial ribosomal protein L3
  ENST ID: ENST00000425847
  CDS Start-End: 163-1290
tttctttccgtcgcagagagcatcggccggcgaccgttccggcggccattgcgaaaacttccccacggctactgcgtccacgtggcggtggcgtggggactccctgaaagcagagcggcagggcgcccggaagtcgtgagtcgagtcttcccgggctaatccatgccgggttggaggctgctgacgcaggtcggcgcccaggtgctgggtcgactcggggacggcctgggtgctgccctgggcccggggaacagggtaacgactaacagtttaaatgtgagccttatccgaaggaatgtggggagtgaggaaaaggttggagacctgaaaaaaagaacacacatctggctttttgttagaggtcttcatggaaagagtggtacatggtgggatgagcatctttctgaagaaaatgtcccattcattaagcagttggtctctgatgaagataaagcccaattagcaagtaaactgtgtcctctgaaagatgaaccatggcctatacatccttgggaaccaggttcctttagagttggtcttattgccttgaagctgggcatgatgcctttatggaccaaggatggtcaaaagcatgtggtcacattacttcaggtacaagactgtcatgtcttaaaatatacgtcaaaggaaaactgtaatggaaaaatggcaaccctgtctgtaggaggaaaaactgtatcacgttttcgtaaagctacatccatattggaattttaccgggaacttggattgccgccgaaacagacagttaaaatctttaatataacagataatgctgcaattaaaccaggcactcctctttatgctgctcactttcgtccaggacagtatgtggatgtcacagccaaaactattggtaaaggttttcaaggtgtcatgaaaagatggggatttaaaggccagcctgctacgcatggtcaaacgaaaacccacaggagacctggagctgttgcaactggtgatattggcagagtctggcctggaactaaaatgcctggaaaaatgggaaacatatacaggacagaatatggactgaaagtgtggagaataaacacaaagcacaacataatctatgtaaatggctctgtacctggacataaaaattgcttagtaaaggtcaaagattctaaactgcctgcatataaggatctcggtaaaaatctaccattccctacatattttcctgatggagatgaagaggaactgccagaagatttgtatgatgaaaacgtgtgtcagcccggtgcgccttctattacatttgcctaacatctttggacgtggcagaaccttacatattctgtgagcttcgatgagccagagtgatatcataaccaccagaaatcatactctcctttcttagtcacaacaaaatcacacatgtcatctttgtcaagggcataaatatatcattcatacccccattaaattttgtt

SEQ ID NO: 154430 - DNA, 659 bp, Homo sapiens
  Payload ID: 10351
  Gene Symbol: MRPL3
  Gene Name: mitochondrial ribosomal protein L3
  ENST ID: ENST00000512877
  CDS Start-End: 131-659
accgttccggcggccattgcgaaaacttccccacggctactgcgtccacgtggcggtggcgtggggactccctgaaagcagagcggcagggcgcccggaagtcgtgagtcgagtcttcccgggctaatccatgccgggttggaggctgctgacgcaggtcggcgcccaggtgctgggtcgactcggggacggcctgggtgctgccctgggcccggggaacagaacacacatctggctttttgttagaggtcttcatggaaagagtggtacatggtgggatgagcatctttctgaagaaaatgtcccattcattaagcagttggtctctgatgaagataaagcccaattagcaagtaaactgtgtcctctgaaagatgaaccatggcctatacatccttgggaaccaggttcctttagagttggtcttattgccttgaagctgggcatgatgcctttatggaccaaggatggtcaaaagcatgtggtcacattacttcagaaagctacatccatattggaattttaccgggaacttggattgccgccgaaacagacagttaaaatctttaatataacagataatgctgcaattaaaccaggcactcctctttatgctgctcactttcgtccaggacagtatgtggatgtcacagccaaaa

SEQ ID NO: 154431 - DNA, 848 bp, Homo sapiens
  Payload ID: 10351
  Gene Symbol: MRPL3
  Gene Name: mitochondrial ribosomal protein L3
  ENST ID: ENST00000507669
  CDS Start-End: 384-848
gcggccattgcgaaaacttccccacggctactgcgtccacgtggcggtggcgtggggactccctgaaagcagagcggcagggcgcccggaagtcgtgagtcgagtcttcccgggctaatccatgccgggttggaggctgctgacgcaggtcggcgcccagaacacacatctggctttttgttagaggtcttcatggaaagagtggtacatggtgggatgagcatctttctgaagaaaatgtcccattcattaagcagttggtctctgatgaagataaagcccaattagcaagtaaactgtgtcctctgaaagatgaaccatggcctatacatccttgggaaccaggttcctttagagttggtcttattgccttgaagctgggcatgatgcctttatggaccaaggatggtcaaaagcatgtggtcacattacttcaggtacaagactgtcatgtcttaaaatatacgtcaaaggaaaactgtaatggaaaaatggcaaccctgtctgtaggaggaaaaactgtatcacgttttcgtaaagctacatccatattggaattttaccgggaacttggattgccgccgaaacagacagttaaaatctttaatataacagataatgctgcaattaaaccaggcactcctctttatgctgctcactttcgtccaggacagtatgtggatgtcacagccaaaactattggtaaaggttttcaaggtgtcatgaaaagatggggatttaaaggccagcctgctacgcatggtcaaacgaaaacccacaggagacctggagctgttgcaactggtgatattggcagagtctggcctggaactaaaatgcctggaaaa

SEQ ID NO: 154432 - DNA, 532 bp, Homo sapiens
  Payload ID: 10351
  Gene Symbol: MRPL3
  Gene Name: mitochondrial ribosomal protein L3
  ENST ID: ENST00000510154
  CDS Start-End: 448-532
cattgcgaaaacttccccacggctactgcgtccacgtggcggtggcgtggggactccctgaaagcagagcggcagggcgcccggaagtcgtgagtcgagtcttcccgggctaatccatgccgggttggaggctgctgacgcagggtaacgactaacagtttaaatgtgagccttatccgaaggaatgtggggagtgaggaaaaggttggagacctgaaaaaaagaacacacatctggctttttgttagaggtcttcatggaaagagtggtacatggtgggatgagcatctttctgaagaaaatgtcccattcattaagcagttggtctctgatgaagataaagcccaattagcaagtaaactgtgtcctctgaaagatgaaccatggcctatacatccttgggaaccaggttcctttagagttggtcttattgccttgaagctgggcatgatgcctttatggaccaaggatggtcaaaagcatgtggtcacattacttcaggtacaagactgtcatgtcttaaaatatacgt

SEQ ID NO: 154433 - DNA, 1377 bp, Homo sapiens
  Payload ID: 10351
  Gene Symbol: MRPL3
  Gene Name: mitochondrial ribosomal protein L3
  ENST ID: ENST00000511168
  CDS Start-End: 1-1090
tttctttccgtcgcagagagcatcggccggcgaccgttccggcggccattgcgaaaacttccccacggctactgcgtccacgtggcggtggcgtggggactccctgaaagcagagcggcagggcgcccggaagtcaacacacatctggctttttgttagaggtcttcatggaaagagtggtacatggtgggatgagcatctttctgaagaaaatgtcccattcattaagcagttggtctctgatgaagataaagcccaattagcaagtaaactgtgtcctctgaaagatgaaccatggcctatacatccttgggaaccaggttcctttagagttggtcttattgccttgaagctgggcatgatgcctttatggaccaaggatggtcaaaagcatgtggtcacattacttcaggtacaagactgtcatgtcttaaaatatacgtcaaaggaaaactgtaatggaaaaatggcaaccctgtctgtaggaggaaaaactgtatcacgttttcgtaaagctacatccatattggaattttaccgggaacttggattgccgccgaaacagacagttaaaatctttaatataacagataatgctgcaattaaaccaggcactcctctttatgctgctcactttcgtccaggacagtatgtggatgtcacagccaaaactattggtaaaggttttcaaggtgtcatgaaaagatggggatttaaaggccagcctgctacgcatggtcaaacgaaaacccacaggagacctggagctgttgcaactggtgatattggcagagtctggcctggaactaaaatgcctggaaaaatgggaaacatatacaggacagaatatggactgaaagtgtggagaataaacacaaagcacaacataatctatgtaaatggctctgtacctggacataaaaattgcttagtaaaggtcaaagattctaaactgcctgcatataaggatctcggtaaaaatctaccattccctacatattttcctgatggagatgaagaggaactgccagaagatttgtatgatgaaaacgtgtgtcagcccggtgcgccttctattacatttgcctaacatctttggacgtggcagaaccttacatattctgtgagcttcgatgagccagagtgatatcataaccaccagaaatcatactctcctttcttagtcacaacaaaatcacacatgtcatctttgtcaagggcataaatatatcattcatacccccattaaattttgttagaaaaattaccacattaaatatatgagttaagtagattggatttgctgaaattggtgttgggcatattagcaaaatattcttaatttgtggactcgattcttttttactacatatttcc

SEQ ID NO: 154434 - DNA, 2605 bp, Homo sapiens
  Payload ID: 10352
  Gene Symbol: MRPL30
  Gene Name: mitochondrial ribosomal protein L30
  Uniprot ID: Q8TCC3
  ENST ID: ENST00000338148
  CDS Start-End: 199-684
ctctttctagggactttcctgagtgggagggatttcgccggaacaaaaatgcctcagtttggaggtcgcgctcactgcgacggcaggctttgagtgtagcacttggtagttcttcctctgctctgcttcccttcggaggaaaatttcaggctgaaggtttagcgggtgccgcctctaaagagagcaatcactacacttatggctgggattttgcgcttagtagttcaatggcccccaggcagactacagactgtgacaaaaggtgtggagtctcttatttgtacagattggattcgtcacaaattcaccagatcaagaattccagaaaaagtgtttcaggcctcacctgaagatcatgaaaaatacggtggggatccacagaaccctcataaactgcatattgttaccagaataaaaagtacaagaagacgtccatattgggaaaaagatataataaagatgcttggattagaaaaagcacatacccctcaagttcacaagaatatcccttcagtgaatgcaaaattgaaagtagttaagcatttgataagaatcaagcccttgaagttgccacaaggacttccagcagaggagaacatgtctaacacgtgcctcaaaagcactggggagttagtagtgcagtggcatctgaaacctgtggagcagaaagcacatgagtcctaatgccccagcagcttccgattggaaaatgcaaattgtttttatttaaagatggtgagaaagtgttttcattaaaatatgttttcaaaaccattttcaggccgggcacggtggctcacctgtaatcccagcactttgggaggccaaggcgggcagatcacctgaggtcaagagttcgagaccagcctgaccaacatggagaaacccccatctctactgaaaatacagaattagccaggcatggtggcacatgcctgtaacccagctactcgggaggctgaagcaggagaatcacttgaacccgggaggcagaggttgcagtgagctgagatggtgccactgtactccagcctgggtgataggatgagactccatctcaggggaaaaaaaaaaatttttttttcactgactaaacctgctgcagctctcttttactacagacttggagattttagtttaatttggtttaattctctgtcctttccctttcactgtttcactccaaaacatgtaagaatggcaatgtttgaacatctgcgtttgggtctactgccaccttagcaagcctcattaaccattttataaaaattgcgttagtattgttgttgttgtttttgagacagggtcttgctctgtcacccaagctggaatacagtggcatgatttcagttcactgcagcctcgacctcccaggctcaagtgatcctcccacctcagcctccagagtagctaggactacaggcagtgtgccaccacatccagctaattttttaaagttttttcatagagacagggactcactatgttgtccaagctggtctcaaactcctgggttcaagccatcctcccacctcagcctcccaaaatgctgggattacaggcatgagccactgtacccagccaaaattgttttcttttttaagtgaattcaacaatttctgtgagtggctctttgcatgaacactgtgcaaggtgttggagaaatccaaagctgaccaaaacatggtccccaccttttggagcttacagtctgttctggggaacagagattcagccaaagtcaagaaacactggatgccagctagattatctgttctgtgctttggtgtctataagtacatatgtggatatgggttcattttatccctaaacttagtaccaaaccagcatttaatatctaattataaatctaatttggcctaaactttattattgcacactgcctgaacaaaacctatttgtctctatgtaaattttttcctcatggaacaagggtgtgaaatgaaaatattttaggatttattcaaaaacagactattctgttttcagcttcagaattgttctttgaatcctaaggaacctctgtcaacagttgaggttgctgttgaaaagaaagaagaaggaggcggaaatctctcagggagaattatttcctttcttttctattttagatacctggaggggtggggagaagtaagaattgtaagggaggttcagtagtggggaattctgtgacagctgattgaagatgatgatgaagaacctctgcattctagttaccctttgcttcccttcacctcttgtaaaatttggcttggcaacaatgacattgtcatgcttattgtcccaatatccatcctgtcgtagatcttaatgtttttgatcgttgcgttaaagtggaagtgccacccacagtgaaaccagatcccattaataaataagcttaaaggcaactgcagttttaattccatagttattgaatatccagtgtgtgtaaggcctggaggggagccaaaggacactaacttctaagagctccgtctagttggagagaaacctgtgtgccacaacatacagtgtccttgcttatgtggggtcgaagacatctgtgaaaataaaagcagcctctgctaatttagcgcca

SEQ ID NO: 154435 - DNA, 1497 bp, Homo sapiens
  Payload ID: 10352
  Gene Symbol: MRPL30
  Gene Name: mitochondrial ribosomal protein L30
  Uniprot ID: Q8TCC3
  ENST ID: ENST00000409841
  CDS Start-End: 29-514
gcctctaaagagagcaatcactacacttatggctgggattttgcgcttagtagttcaatggcccccaggcagactacagactgtgacaaaaggtgtggagtctcttatttgtacagattggattcgtcacaaattcaccagatcaagaattccagaaaaagtgtttcaggcctcacctgaagatcatgaaaaatacggtggggatccacagaaccctcataaactgcatattgttaccagaataaaaagtacaagaagacgtccatattgggaaaaagatataataaagatgcttggattagaaaaagcacatacccctcaagttcacaagaatatcccttcagtgaatgcaaaattgaaagtagttaagcatttgataagaatcaagcccttgaagttgccacaaggacttccagcagaggagaacatgtctaacacgtgcctcaaaagcactggggagttagtagtgcagtggcatctgaaacctgtggagcagaaagcacatgagtcctaatgccccagcagcttccgattggaaaatgcaaattgtttttatttaaagatggtgagaaagtgttttcattaaaatatgttttcaaaaccattttcaggccgggcacggtggctcacctcctcccaaaatgctgggattacaggcatgagccactgtacccagccaaaattgttttcttttttaagtgaattcaacaatttctgtgagtggctctttgcatgaacactgtgcaaggtgttggagaaatccaaagctgaccaaaacatggtccccaccttttggagcttacagtctgttctggggaacagagattcagccaaagtcaagaaacactggatgccagctagattatctgttctgtgctttggtgtctataagtacatatgtggatatgggttcattttatccctaaacttagtaccaaaccagcatttaatatctaattataaatctaatttggcctaaactttattattgcacactgcctgaacaaaacctatttgtctctatgtaaattttttcctcatggaacaagggtgtgaaatgaaaatattttaggatttattcaaaaacagactattctgttttcagcttcagaattgttctttgaatcctaaggaacctctgtcaacagttgaggttgctgttgaaaagaaagaagaaggaggcggaaatctctcagggagaattatttcctttcttttctattttagatacctggaggggtggggagaagtaagaattgtaagggaggttcagtagtggggaattctgtgacagctgattgaagatgatgatgaagaacctctgcattctagttaccctttgcttcccttcacctcttgtaaaatttggcttggcaacaatgacattgtcatgcttattgtcccaatatccatcctgtcgtagatcttaatgtttttgatcgttgcgttaaagtggaagtgccacccacagtgaaaccagatcccattaataaataa

SEQ ID NO: 154436 - DNA, 562 bp, Homo sapiens
  Payload ID: 10352
  Gene Symbol: MRPL30
  Gene Name: mitochondrial ribosomal protein L30
  ENST ID: ENST00000409145
  CDS Start-End: 92-397
agttcttcctctgctctgcttcccttcggaggaaaatttcaggctgaaggtttagcgggtgccgcctctaaagagagcaatcactacacttatggctgggattttgcgcttagtagttcaatggcccccaggcagactacagactgtgacaaaaggtgtggagtctcttatttgtacagattggattcgtcacaaattcaccagatcaagaattccagaaaaagtgtttcaggcctcacctgaagatcatgaaaaatacggtggggatccacagaaccctcataaactgcatattgttaccagaataaaaagtacaagaagacgtccatattgggaaaaagatataataaagatgcttggattagaaaaagtatgcaattattttaatcatctttagtgttgtttacattgctttaaattttatacttttaaaactttgcggtatacatttattatttattttgtattacttagggtaatttatttataaatttggcttagaatgaaccttcaatttaacattttactgaaacatggaactatctgcttttcagattgataa

SEQ ID NO: 154437 - DNA, 1035 bp, Homo sapiens
  Payload ID: 10353
  Gene Symbol: MRPL32
  Gene Name: mitochondrial ribosomal protein L32
  Uniprot ID: Q9BYC8
  ENST ID: ENST00000223324
  CDS Start-End: 188-754
tgtggccgatttcctttcatttccccgcccctcacctttcctttactctctatgattggaggagagtcagagctgctccaagagcatgcggggtgttgtagttctaagaagcgaggcttgcccgattctgtgcctgtgcgcatgctgaaagcaggggcgggaccggggcggtcttccagcagggaaaatggcgctggccatgctggtcttggtggtttcgccgtggtctgcggcccggggagtgcttcgaaactactgggagcgactgctacggaagcttccgcagagccggccgggctttcccagtcctccgtggggaccagcattagcagtacagggcccagccatgtttacagagccagcaaatgataccagtggaagtaaagagaattccagccttttggacagtatcttttggatggcagctcccaaaaatagacgcaccattgaagttaaccggtgtaggagaagaaatccgcagaagcttattaaagttaagaacaacatagacgtttgtcctgaatgtggtcacctgaaacagaaacatgtcctttgtgcctactgctatgaaaaggtgtgcaaggagactgcagaaatcagacgacagatagggaagcaagaagggggcccttttaaggctcccaccatagagactgtggtgctgtacacgggagagacaccgtctgaacaagatcagggcaagaggatcattgaacgagacagaaagcgaccatcctggttcacccagaattgacaccaaagatgttaaaagggtaacttcacagtaaatcatttctcctgaaatagaggaagattctttatgttgttgtgcttgtttttaaatcatcagtatagtttaacacattctttctaagcagttttgtgtgggataatttgaagaatatattatgagtaaactccgaaaattttgtttatccaaaggctcaatggattatgtttctattatatacaaggttttaagtaaacataaaatttccagaacaaaaataaaaaatttaaaattcatagcaaaaa

SEQ ID NO: 154438 - DNA, 730 bp, Homo sapiens
  Payload ID: 10353
  Gene Symbol: MRPL32
  Gene Name: mitochondrial ribosomal protein L32
  ENST ID: ENST00000413995
  CDS Start-End: 1-128
aagagaattccagccttttggacagtatcttttggatggcagctcccaaaaatagacgcaccattgaagttaaccggtgtaggagaagaaatccgcagaagcttattaaagttaagtcttcctgttaaagtgaggtggaactagatggtgtatgatgacctcatgtagcctgaacatcctaagaaagttaaaataacaacatagacgtttgtcctgaatgtggtcacctgaaacagaaacatgtcctttgtgcctactgctatgaaaaggtgtgcaaggagactgcagaaatcagacgacagatagggaagcaagaagggggcccttttaaggctcccaccatagagactgtggtgctgtacacgggagagacaccgtctgaacaagatcagggcaagaggatcattgaacgagacagaaagcgaccatcctggttcacccagaattgacaccaaagatgttaaaagggtaacttcacagtaaatcatttctcctgaaatagaggaagattctttatgttgttgtgcttgtttttaaatcatcagtatagtttaacacattctttctaagcagttttgtgtgggataatttgaagaatatattatgagtaaactccgaaaattttgtttatccaaaggctcaatggattatgtttctattatatacaaggttttaagtaaacataaaatttccagaacaaaaataaaaaatttaaaattcatagcaaaaa

SEQ ID NO: 154439 - DNA, 2734 bp, Homo sapiens
  Payload ID: 10353
  Gene Symbol: MRPL32
  Gene Name: mitochondrial ribosomal protein L32
  ENST ID: ENST00000432845
  CDS Start-End: 12-335
cagcagggaaaatggcgctggccatgctggtcttggtggtttcgccgtggtctgcggcccggggagtgcttcgaaactactgggagcgactgctacggaagcttccgcagagccggccgggctttcccagtcctccgtggggaccagcattagcagtacagggcccagccatgtttacagagccagcaaatgataccagtggaagtaaagagaattccagccttttggacagtatcttttggatggcagctcccaaaaatagacgcaccattgaagttaaccggtgtaggagaagaaatccgcagaagcttattaaagttaaggtaatgcattgatttttgtgggtgtgcttttcctcaagtcctccattgaataagctcatggtagattcctatagcctaggaataaattattatcagattatatgtgtctactttcctctggcctaaatgaaatacagtattctcattatatacataatgagaaggctagagcctgctgtcctctagcctgagtattagaaacacagtcaaggaaggagtgagtttggagactgggcaaggaacgaggctgtgaggtgcctacatgacttctgaattgtgagctgtgtcagtcttgagctgtgtgagttttgaactacagatgagtaaacatcctaactatggcagagcctagaattaaagctagaagcagtaggtatactgaatcttgggttttacaagcccttacatatttgttttatttttttatcatttccaacaaaataccatgaaggaaaaccctaagataagtaatataatagctaacaacaattaagtgtctatgatgtatctcagtgccttatgtttattatatctcatcatgtcttatagccctccaaagcaaataagatattcttcattattaggatgaaaaaactgaggcaaaaagaatttgcctgtggtcacacagctatgaagcagtagattttcgagctctgatttttgacctcatgttcttttaaagattttctttgtgttctcctatcctcagacaatttcagattctcctcgctgacaacatggatgtactgtcttcattgatctagtaaagaaaaattacagtgtgtattacctctgatctgttcatgtatggttttaacagttaggatttcagttactgtttacttcatggcgttccacaacagcagcaccatacagatgaaactcgagaacagaaagctgactttcataagcatccacattctgttaagcaaaaccttagaacttaagccagaaagtattattgagtgatggttggggctgaacttaaatgtagaactgaaaaacactttattacttaagacttacagtaattcataaatttgctcaagaggacgtaagattttaggaatgagatcttgcactgatctattatgtgacttccctgatcgcatttattctgaaggaatagttcttatcctgtgcatttattttcttccttgaattattttctgttacatacggtatatagtgtgttatgttgggtactttgatcacgaaaggaagaccagctgactgtgggtgtcttcataccttcagttgtgcatgcaatccagtttccagtagtggagcaaaatgagaatatggttaggcaagtaatatacaagcctctttcttcctttcagaaaaggaaattcttttgttatctgcctcacaaatgttagtatattaatcttatcaagtgtttaaagcttctttaatgatcctgtttagtatttttctttgtattttctttcaaacctacatctagaataagttgataaatcttttagaggttataatgtttctattttatatttaaagttggagatatatatatatctatatctatctctatatatatatatatacacacacatatatatatcattaaaataccctaagaatgtaacatagaaaataattttacattaaggaataatcagtgttcatttttaaaaagaaaaattataccatatacgaaacctgtattctgtacaggaatttgaattacactgtgataaaaagaggaagccaaggaagtcaacttgtaatgttcttatcttgttttccctaagatagattgaaagacaaagggaattcacttttccttggtgtcttatttaagatgctgattgtttgggtcacttcattatgttgacaaattccttatttgatatttagtatttggagttaggggaaatgagtatttcttttttcttttttacataactacaactgctgtgtttaagtaaagataccagattcaggttggctgaattctagttctagtttttctctaattcaaactcagtgttgcttgtcttcagtcttcctgttaaagtgaggtggaactagatggtgtatgatgacctcatgtagcctgaacatcctaagaaagttaaaataacaacatagacgtttgtcctgaatgtggtcacctgaaacagaaacatgtcctttgtgcctactgctatgaaaaggtgtgcaaggagactgcagaaatcagacgacagatagggaagcaagaagggggcccttttaaggctcccaccatagagactgtggtgctgtacacgggagagacaccgtctgaacaagatcagggcaagaggatcattgaacgagacagaaagcgaccatcctggttcacccagaattgacaccaaagatgttaaaagggtaacttcacagtaaatcatttctcctgaaat

SEQ ID NO: 154440 - DNA, 518 bp, Homo sapiens
  Payload ID: 10354
  Gene Symbol: MRPL33
  Gene Name: mitochondrial ribosomal protein L33
  Uniprot ID: O75394
  ENST ID: ENST00000296102
  CDS Start-End: 62-259
gcagttgttgttggttgggggccttttggccggtgacggagactgcccaggtgtggtcaccatgttcctctccgcggtcttctttgccaagagcaagtcaaaaaacattctggtgagaatggtgagcgaagctgggacaggtttctgcttcaacaccaagagaaaccgactgcgggaaaaactgactcttttgcattatgatccagttgtgaaacaaagagtcctcttcgtggaaaagaaaaaaatacgctccctttaaacggtggattgaaaatgactttgatttataaagagaagactgagggcggggatactgattcagaaatcctgtagcgtgtaataaaagaagaggaaatggcatggaatcactgcctcctgtgatttgaaggccattgtgaaggaaaacaatgcagtgaaagaaagttcttcatattaggacagatatcattgcatcacatttatttatctttctgggtatttttatagcccttaataaaaaatattaaaatagcctgtgc

SEQ ID NO: 154441 - DNA, 404 bp, Homo sapiens
  Payload ID: 10354
  Gene Symbol: MRPL33
  Gene Name: mitochondrial ribosomal protein L33
  Uniprot ID: O75394
  ENST ID: ENST00000379666
  CDS Start-End: 62-226
gcagttgttgttggttgggggccttttggccggtgacggagactgcccaggtgtggtcaccatgttcctctccgcggtcttctttgccaagagcaagtcaaatgaaacaaagagtcctcttcgtggaaaagaaaaaaatacgctccctttaaacggtggattgaaaatgactttgatttataaagagaagactgagggcggggatactgattcagaaatcctgtagcgtgtaataaaagaagaggaaatggcatggaatcactgcctcctgtgatttgaaggccattgtgaaggaaaacaatgcagtgaaagaaagttcttcatattaggacagatatcattgcatcacatttatttatctttctgggtatttttatagcccttaataaaaaatattaaaatag

SEQ ID NO: 154442 - DNA, 527 bp, Homo sapiens
  Payload ID: 10354
  Gene Symbol: MRPL33
  Gene Name: mitochondrial ribosomal protein L33
  ENST ID: ENST00000448427
  CDS Start-End: 40-249
cttttggccggtgacggagactgcccaggtgtggtcaccatgttcctctccgcggtcttctttgccaagagcaagtcaaagctgtggttatggtttttggaagaccacagaggtgaaatgtcattttcatcacatcatattaagggcacatatgatcaacatgacttcttactgatggtgttaaccctggtcacctggctaagtggtgatttacaagtcaagttaaaatgtccccagaagtggccttgaaccgaatatctccaatgctctcccctttcatatctagcgtggtccggaatggaaaagtgggactggatgctacaaactgtttgaggataactgacttaaaatctggctgcacatcattgactcctgggcccaactgtgaccgatttaaactgcacataccatatgctggagagacattaaagtgggatatcattttcaatgcccaatacccagaactgcctcccgattttatctttggagaagatgctgaattcctgccagacccctcagctttgcag

SEQ ID NO: 154443 - DNA, 968 bp, Homo sapiens
  Payload ID: 10355
  Gene Symbol: MRPL34
  Gene Name: mitochondrial ribosomal protein L34
  Uniprot ID: Q9BQ48
  ENST ID: ENST00000252602
  CDS Start-End: 226-504
ccggctacctgttggtgtgtatgcagagcatccctgtgccccgcggatatagactggcgcgcctctgttgcgcaggcgcagaactacaacttcagggttttccccaacggcctcttttttgcacgttaggagaaactacatttcccataatcctttgttccagggctggagcggctctgggctccggaatcgcccgcagccggtactgcgggacccactgcggatatggctgtcttggctggatccctgttgggccccacgagtaggtcggcagcgttgctgggtggcaggtggctccagccccgggcctggctggggttcccagacgcctggggcctccccaccccgcagcaggcccggggcaaggctcgcgggaatgagtatcagccgagcaacatcaaacgcaagaacaagcacggctgggtccggcgcctgagcacgccggccggcgtgcaggtcatccttcgccgaatgctcaagggccgcaagtcgctgagccattgaggatcgcgacgcagtcggcgggaccctcatggaagcatcgccctcgcctcggaccttgcctggcgctatttttgcagggagctggggagcaggaacgcctcggacctgagtgctctccatattgtggggttgaagtctggatgggagcttgccaagtccctttttaggctttttaattaggaagcatttcgaacctgcgcaacagaccaaagaacagtacaaagaacatccgtgtacccagtaccctgactaccgactacctacaacccgtccctgccccatcctgagttcttttgaagctgatctcaggcatcggattatttcttctgtaaatatttcagaatgtatctctccaagatgagagctcattaaaagacaattacaaagcttatcacatccaaaagaattatcaataattttgaaatattattaaacgtgtaataaatgttcaaagttccacttgc

SEQ ID NO: 154444 - DNA, 793 bp, Homo sapiens
  Payload ID: 10355
  Gene Symbol: MRPL34
  Gene Name: mitochondrial ribosomal protein L34
  Uniprot ID: Q9BQ48
  ENST ID: ENST00000600434
  CDS Start-End: 351-629
accaagcgatgccccgccggcccagcggctacttcttgtcttctggaggcgccggcagtggctccggtagagccttgggcgagggctcgggctcccagagcaggaattcgtggagcagcgtgttgaccgtctcagggcattccagcatcaccatgtggctgccctcgtcgatgagcttcaggaatgccaggagcaggatctgcagaagacgcagggctcaaggagagaatgaggccacttggtagtggtcaagccctggggaccaagccttccatggaggggttcttgggctggagcggctctgggctccggaatcgcccgcagccggtactgcgggacccactgcggatatggctgtcttggctggatccctgttgggccccacgagtaggtcggcagcgttgctgggtggcaggtggctccagccccgggcctggctggggttcccagacgcctggggcctccccaccccgcagcaggcccggggcaaggctcgcgggaatgagtatcagccgagcaacatcaaacgcaagaacaagcacggctgggtccggcgcctgagcacgccggccggcgtgcaggtcatccttcgccgaatgctcaagggccgcaagtcgctgagccattgaggatcgcgacgcagtcggcgggaccctcatggaagcatcgccctcgcctcggaccttgcctggcgctatttttgcagggagctggggagcaggaacgcctcggacctgagtgctctccatattgtggggttgaagtctggatgggagcttgccaagtccctttt

SEQ ID NO: 154445 - DNA, 603 bp, Homo sapiens
  Payload ID: 10355
  Gene Symbol: MRPL34
  Gene Name: mitochondrial ribosomal protein L34
  ENST ID: ENST00000602206
  CDS Start-End: 22-132
actgcgggacccactgcggatatggctgtcttggctggatccctgttgggccccacgagtaggctcgcgggaatgagtatcagccgagcaacatcaaacgcaagaacaagcacggctgggtccggcgcctgagcacgccggccggcgtgcaggtcatccttcgccgaatgctcaagggccgcaagtcgctgagccattgaggatcgcgacgcagtcggcgggaccctcatggaagcatcgccctcgcctcggaccttgcctggcgctatttttgcagggagctggggagcaggaacgcctcggacctgagtgctctccatattgtggggttgaagtctggatgggagcttgccaagtccctttttaggctttttaattaggaagcatttcgaacctgcgcaacagaccaaagaacagtacaaagaacatccgtgtacccagtaccctgactaccgactacctacaacccgtccctgccccatcctgagttcttttgaagctgatctcaggcatcggattatttcttctgtaaatatttcagaatgtatctctccaagatgagagctcattaaaagacaattacaaagcttatcacatccaaaa

SEQ ID NO: 154446 - DNA, 555 bp, Homo sapiens
  Payload ID: 10355
  Gene Symbol: MRPL34
  Gene Name: mitochondrial ribosomal protein L34
  Uniprot ID: Q9BQ48
  ENST ID: ENST00000594999
  CDS Start-End: 131-409
ggtgtctagggcctggagatgggaccagctgcctgcctgccccctaccccaggttgggcgccgctaagggctggagcggctctgggctccggaatcgcccgcagccggtactgcgggacccactgcggatatggctgtcttggctggatccctgttgggccccacgagtaggtcggcagcgttgctgggtggcaggtggctccagccccgggcctggctggggttcccagacgcctggggcctccccaccccgcagcaggcccggggcaaggctcgcgggaatgagtatcagccgagcaacatcaaacgcaagaacaagcacggctgggtccggcgcctgagcacgccggccggcgtgcaggtcatccttcgccgaatgctcaagggccgcaagtcgctgagccattgaggatcgcgacgcagtcggcgggaccctcatggaagcatcgccctcgcctcggaccttgcctggcgctatttttgcagggagctggggagcaggaacgcctcggacctgagtgctctccatattgtggggttgaagtctggatggga

SEQ ID NO: 154447 - DNA, 863 bp, Homo sapiens
  Payload ID: 10355
  Gene Symbol: MRPL34
  Gene Name: mitochondrial ribosomal protein L34
  ENST ID: ENST00000595444
  CDS Start-End: 33-587
cctcctcctgctgcggctgtgctcaccaagcgatgccccgccggcccagcggctacttcttgtcttctggaggcgccggcagtggctccggtagagccttgggcgagggctcgggctcccagagcaggaattcgtggagcagcgtgttgaccgtctcagggcattccagcatcaccatgtggctgccctcgtcgatgagcttcaggaatgccaggagcaggatctgcagaagacgcagggctcaagggctggagcggctctgggctccggaatcgcccgcagccggtactgcgggacccactgcggatatggctgtcttggctggatccctgttgggccccacgagtaggtcggcagcgttgctgggtggcaggtggctccagccccgggcctggctggggttcccagacgcctggggcctccccaccccgcagcaggcccggggcaaggctcgcgggaatgagtatcagccgagcaacatcaaacgcaagaacaagcacggctgggtccggcgcctgagcacgccggccggcgtgcaggtcatccttcgccgaatgctcaagggccgcaagtcgctgagccattgaggatcgcgacgcagtcggcgggaccctcatggaagcatcgccctcgcctcggaccttgcctggcgctatttttgcagggagctggggagcaggaacgcctcggacctgagtgctctccatattgtggggttgaagtctggatgggagcttgccaagtccctttttaggctttttaattaggaagcatttcgaacctgcgcaacagaccaaagaacagtacaaagaacatccgtgtacccagtaccctgactaccgactacctacaacccgtccctg

SEQ ID NO: 154448 - DNA, 1061 bp, Homo sapiens
  Payload ID: 10356
  Gene Symbol: MRPL35
  Gene Name: mitochondrial ribosomal protein L35
  Uniprot ID: Q9NZE8
  ENST ID: ENST00000254644
  CDS Start-End: 137-649
agatgacattgaataaatgttgagtggacaactttgttcttttcctcttccttgactccgcctccttgctttcccttcattctcttttgctcttgtgcttttaaacccaaagcggccgccgtaggcgaaggtgaagatggctgcctctgcctttgctggtgcagtgagagcagcttcaggaatcctacggcccctgaatattttggcatcttcaacctaccgcaactgtgtcaagaatgcctctcttatttctgcattgtccactggacgttttagtcatattcagacaccagttgtttcctccactcccagacttaccacatctgagagaaacctgacatgtgggcatacctcagtgatccttaatagaatggcccccgtgcttccaagtgtcctgaagctgccagtcagatctctaacatacttcagtgcaagaaaaggcaagagaaagaccgtgaaagctgtcatcgataggtttcttcgacttcattgtggcctttgggtgaggagaaaggctggctataagaaaaaattatggaaaaagacacctgcaaggaagaagcgattgagggaatttgtattctgcaataaaacccagagtaaactcttagataaaatgacgacgtccttctggaagaggcgaaactgacggcaaagccaaccacttagaagccttccacatctttgtcacctgcctggctcctgctctctgatgtacctctgggtagtgagatggaaatggtgcctgcagaagttggggagaaggatacttttgcacagcctccatgatgtctttattgcaaatatggatgacaagggtctctgttacaggggcctcagagcaccttcgtttctcctctagaccagggacaggtgtagagataaggactggcaaccagagcctcagcatccaaagatggactgaagtgggatggctgacaggcacataacttacgggaaagggaatttcatacatacgatttttgttttgtgggtaggagggcttatcatcaacactgattttataatctgacaataaatgtctttcattaaagagttta

SEQ ID NO: 154449 - DNA, 3727 bp, Homo sapiens
  Payload ID: 10356
  Gene Symbol: MRPL35
  Gene Name: mitochondrial ribosomal protein L35
  Uniprot ID: Q9NZE8
  ENST ID: ENST00000337109
  CDS Start-End: 35-601
aaacccaaagcggccgccgtaggcgaaggtgaagatggctgcctctgcctttgctggtgcagtgagagcagcttcaggaatcctacggcccctgaatattttggcatcttcaacctaccgcaactgtgtcaagaatgcctctcttatttctgcattgtccactggacgttttagtcatattcagacaccagttgtttcctccactcccagacttaccacatctgagagaaacctgacatgtgggcatacctcagtgatccttaatagaatggcccccgtgcttccaagtgtcctgaagctgccagtcagatctctaacatacttcagtgcaagaaaaggcaagagaaagaccgtgaaagctgtcatcgataggtttcttcgacttcattgtggcctttgggtgaggagaaaggctggctataagaaaaaattatggaaaaagacacctgcaaggaagaagcgattgagggaatttgtattctgcaataaaacccagagtaaactcttagataaaatgacgacgtccttctggaagaggcgaaactggtacgttgatgatccttatcagaagtatcatgatcgaacaaacctgaaagtatagatcagaagtttcacttgtttctcagttattggatatgtatctttgtgtacatatctttgcaaaaatggataagtacaaaacttgatgtaaattgtaccaatgaatacgtaaacatacagtgacaacattaaacttagaaaagttttaaaacttaatggatcagactttgccagatttggttagggaaacagaaatttagaatggtgcattatttttaacaaatggtattggcttaactagttgtttcagttatgctcttttagttgcaaggaatctcaagtgggacaaacataaaaagactcaaaagctacaagttagctcaagcaatgtgacattatttcaaggatatgtgccagggaattcaggaaccacctcaccaaccccatctcccactcagaaatcacctcccagcctcaggaagagtagaaattgggtggtgctcctcagcaggggaaggtggatgtttaggcttgggctctgcatgcatgtgacttgcttctttttgcattgttaactccattctctctattcaccaacttctctacacagcttttgcatacttacagtttctgttcctttgtaataactttaacttgcacctttgaggttcttttctacatgatgaccttcagctcctgctgctagtctccaattgccaagggaatttaactgggccagactacctttttatactaggtctggttgggtcattgtctagagtagggattggctgtccttaagtcaggagcccgctttgtattagcaggtttgcatgcagcaaaaaaacagttatgtgagcagtttcacttggaggttcacatggggtggcagcacacttaacatctaacacaccaggttcattgtgttcataacacttgtcatttactgtaacaacattttttcataggagagtaaatagcccttcagcatgctcattcatgaaacagaagaggctgtacaagtgaagacaagggctttttatgcaagttttgaaagataggtatttattttttctagagacaggagttttgctctgttgcccaggctggagtgcagtggtgcaatcatagctcattgaagcctcgcactcctgggctcaagtggtcctcctgcctcagcttactgagtaaggatatgtatttcttaaaagttagtttatccacttcagatttcatgttttcatttgtaaggataaacttttcccacaaattttcaacaatcattgtagaaactaagggggagaaagtaatctcagttgttttagaaacgaaaaagttaagcattgtttacttgaagtgggcagggaagcagcactgagtaaagttcaattgagtggttacagtctagggcagtggttcccaactctccgatcagaatcatctgggaagcattttcaaacagcaaagtactttgaaaaccattattaaatagaattatgcatgaattactgtttcagatcctttaatgtggtagttggtaataataagatgaaattcctctgttgttagtaaaattatgaaattgaagttctgcagcatgtcaggccaggattattagggagattcctcgaaactagtgtgtgtttattaaaaggagaaaggataacaatagaatgttctaaaaccagaagtccaagtgcgtgtctacttatgggaccaataaataaagaacagacatttgatttgaggtgaggtaaaagcctgaaacatggaatggcattctgttttgatggattttcatttcttcgcacttctgagacggcaaagccaaccacttagaagccttccacatctttgtcacctgcctggctcctgctctctgatgtacctctgggtagtgagatggaaatggtgcctgcagaagttggggagaaggatacttttgcacagcctccatgatgtctttattgcaaatatggatgacaagggtctctgttacaggggcctcagagcaccttcgtttctcctctagaccagggacaggtgtagagataaggactggcaaccagagcctcagcatccaaagatggactgaagtgggatggctgacaggcacataacttacgggaaagggaatttcatacatacgatttttgttttgtgggtaggagggcttatcatcaacactgattttataatctgacaataaatgtctttcattaaagagtttacctaaatgatgttcgattatatgtataatttataaaatatttatgtatagtttgtttattcaggtatatgtataatttattgaacacctactatgtcccagcatatctacaaaactgggtacatacatactgtctaactgctaatccacatttccagtcttacaaaggacataatgattagttaagccctaatttagatttgaggaaactgaagctgagagagggttaagtaaattacccaaagtacagctaataagacccagaatctcagtctcactccttgggatcctgtgtatttccctgagtcttctaacatatgaaaattcatatctaaatcaacaagtgactgtaatctggtactataaatactaaataaacacttcttcataacactgtaccaattcagcttttaaattttattactttgctttcctgtcctttgccaactcttaacctagttaatcctagttctgttgacattggaccaggctcagtaaataaacgaatggatttccagcctttttttcccatctgttcctgcttttagtcctctgaatctgcttcttttcttactgctgctttattttacagtgattttgtcaaacatagaatacaggactaaaaatgcaaagaaattgggtctgtgtttaattttgatgtttcaaattttgagcttccaagtctttgtggccacccaatgaagtttgagtctgcctgttcagatgtgaaaggtaagggctgcagcaggtttaagggtggcccttcaccaccctgttgtcacctgcacaggcactcccccatttgcagatgaagaaatgttcagagaagaaaaatgatggaccaaacgtctgtttgcacaattgaaactctaccagtggactattctattttcacagctacctagtttctgccgatgatttttttaaatgtgaaataaacagtgatactttcaggtt

SEQ ID NO: 154450 - DNA, 651 bp, Homo sapiens
  Payload ID: 10356
  Gene Symbol: MRPL35
  Gene Name: mitochondrial ribosomal protein L35
  ENST ID: ENST00000409180
  CDS Start-End: 29-562
aaagcggccgccgtaggcgaaggtgaagatggctgcctctgcctttgctggtgcagtgagagcagcttcaggaatcctacggcccctgaatattttggcatcttcaacctaccgcaactgtgtcaagaatgcctctcttatttctgcattgtccactggacgttttagtcatattcagacaccagttgtttcctccactcccagacttaccacatctgagagaaacctgacatgtgggcatacctcagtgatccttaatagaatggcccccgtgcttccaagtgtcctgaagctgccagtcagatctctaacatacttcagtgcaagaaaaggcaagagaaagaccgtgaaagctgtcatcgataggtttcttcgacttcattgtggcctttgggtgaggagaaaggctggctataagaaaaaattatggaaaaagacacctgcaaggaagaagcgattgagggaatttgtattctgcaataaaacccagagtaaactcttagataaaatgacgacgtccttctggaagaggcgaaactggcactcccccatttgcagatgaagaaatgttcagagaagaaaaatgatggaccaaacgtctgtttgcacaattgaaactctaccagtggactattctattttcacagctac

SEQ ID NO: 154451 - DNA, 833 bp, Homo sapiens
  Payload ID: 10356
  Gene Symbol: MRPL35
  Gene Name: mitochondrial ribosomal protein L35
  ENST ID: ENST00000605125
  CDS Start-End: 35-322
aaacccaaagcggccgccgtaggcgaaggtgaagatggctgcctctgcctttgctggtgcagtgagagcagcttcaggaatcctacggcccctgaatattttggcatcttcaacctaccgcaactgtgtcaagaatgcctctcttatttctgcattgtccactggacgttttagtcatattcagacaccagttgtttcctccactcccagacttaccacatctgagagaaacctgacatgtgggcatacctcagtgatccttaataggctggctataagaaaaaattatggaaaaagacacctgcaaggaagaagcgattgagggaatttgtattctgcaataaaacccagagtaaactcttagataaaatgacgacgtccttctggaagaggcgaaactggtacgttgatgatccttatcagaagtatcatgatcgaacaaacctgaaagtatagatcagaagtttcacttgtttctcagttattggatatgtatctttgtgtacatatctttgcaaaaatggataagtacaaaacttgatgtaaattgtaccaatgaatacgtaaacatacagtgacaacattaaacttagaaaagttttaaaacttaatggatcagactttgccagatttggttagggaaacagaaatttagaatggtgcattatttttaacaaatggtattggcttaactagttgtttcagttatgctcttttagttgcaaggaatctcaagtgggacaaacataaaaagactcaaaagctacaagttagctcaagcaatgtgacattatttcaaggatatgtgccagggaattcaggaaccacctcac

SEQ ID NO: 154452 - DNA, 587 bp, Homo sapiens
  Payload ID: 10357
  Gene Symbol: MRPL36
  Gene Name: mitochondrial ribosomal protein L36
  Uniprot ID: Q9P0J6
  ENST ID: ENST00000382647
  CDS Start-End: 42-353
cagtgcgcagacgcaggggtcggcgccggattcaccacaacatggcaaatctttttataaggaaaatggtgaaccctctgctctatctcagtcgtcacacggtgaagcctcgagccctctccacatttctatttggatccattcgaggtgcagcccccgtggctgtggaacccggggcagcagtgcgctcacttctctcacccggcctcctgccccatctgctgcctgcgctggggttcaaaaacaagactgtccttaagaagcgctgcaaggactgttacctggtgaagaggcggggtcggtggtacgtctactgtaaaacccatccgaggcacaagcagagacagatgtagaccctttccctccagagtcacgcacatactcgtcatcgcatcacttgggagaatggttgtatcttatggaaggaattatcacatcaaggagtcaggggaaagtgactggaagcaaacgccctaaaagttacccatcacgtttcagtgtaaatgagtaactatagaagacattgcgttatcttatttccaaaacgttccaactaaaaaacattttcctattaaaatagaccttcc

SEQ ID NO: 154453 - DNA, 610 bp, Homo sapiens
  Payload ID: 10357
  Gene Symbol: MRPL36
  Gene Name: mitochondrial ribosomal protein L36
  Uniprot ID: Q9P0J6
  ENST ID: ENST00000505059
  CDS Start-End: 61-372
ccagtgcgcagacgcaggggtcggcgccgggtgagagcgtgcggccggattcaccacaacatggcaaatctttttataaggaaaatggtgaaccctctgctctatctcagtcgtcacacggtgaagcctcgagccctctccacatttctatttggatccattcgaggtgcagcccccgtggctgtggaacccggggcagcagtgcgctcacttctctcacccggcctcctgccccatctgctgcctgcgctggggttcaaaaacaagactgtccttaagaagcgctgcaaggactgttacctggtgaagaggcggggtcggtggtacgtctactgtaaaacccatccgaggcacaagcagagacagatgtagaccctttccctccagagtcacgcacatactcgtcatcgcatcacttgggagaatggttgtatcttatggaaggaattatcacatcaaggagtcaggggaaagtgactggaagcaaacgccctaaaagttacccatcacgtttcagtgtaaatgagtaactatagaagacattgcgttatcttatttccaaaacgttccaactaaaaaacattttcctattaaaatagaccttccgaat

SEQ ID NO: 154454 - DNA, 686 bp, Homo sapiens
  Payload ID: 10357
  Gene Symbol: MRPL36
  Gene Name: mitochondrial ribosomal protein L36
  Uniprot ID: Q9P0J6
  ENST ID: ENST00000508987
  CDS Start-End: 138-449
gccacgtgacccccccccccgccgccatcttccttcctggcagcagcgtccgcgtgccagtgcgcagacgcaggggtcggcgccgggtgagagcgtgcggccgggtaagggagccgtcttctcagattcaccacaacatggcaaatctttttataaggaaaatggtgaaccctctgctctatctcagtcgtcacacggtgaagcctcgagccctctccacatttctatttggatccattcgaggtgcagcccccgtggctgtggaacccggggcagcagtgcgctcacttctctcacccggcctcctgccccatctgctgcctgcgctggggttcaaaaacaagactgtccttaagaagcgctgcaaggactgttacctggtgaagaggcggggtcggtggtacgtctactgtaaaacccatccgaggcacaagcagagacagatgtagaccctttccctccagagtcacgcacatactcgtcatcgcatcacttgggagaatggttgtatcttatggaaggaattatcacatcaaggagtcaggggaaagtgactggaagcaaacgccctaaaagttacccatcacgtttcagtgtaaatgagtaactatagaagacattgcgttatcttatttccaaaacgttccaactaaaaaacattttcctattaaaatagaccttccgaa

SEQ ID NO: 154455 - DNA, 793 bp, Homo sapiens
  Payload ID: 10357
  Gene Symbol: MRPL36
  Gene Name: mitochondrial ribosomal protein L36
  ENST ID: ENST00000510999
  CDS Start-End: 687-793
tgagagtgggggctgcgagagggtggggccggccaccttgggaccctcgggcgtgtctccccgagtgggctgcggtcagaggagcgtgggccggggcctggcggtctcagagggccagggttggggggtgcgggtccgaccgtgggcgcccgacctggcgacaggagggggtgtccagcgaccccggggcgggagaactggcggctcccgaacgcgacctcacagcccgcgcgcagggccggctccggtgccgcagtgtcctccgggccctgcaggcccagctcttcccagccggggccgctgaaccctaagggccggggcgcgtggggaagcaggggcgggcgaccggggtgccagagttccgtgctcttccggagcgggggcctgtcccgaaactggcccgagggagggcccctgggtctgggaagagttggagggaggagctcatcagttgaaccgtccttgacctggtgtctgtttggaaagggatgcggcctaagtttaagctccctcccagccaagtgagcggctcctcaacatcgcagggctttgcacactcacctacacttgcagcaggcgggaaagggaaggaagccaccgtccactgccccttattctcctggcacacttggctgattaaggcagtgttcaagctcaggtcgaggctgcagctgattcaccacaacatggcaaatctttttataaggaaaatggtgaaccctctgctctatctcagtcgtcacacggtgaagcctcgagccctctccacatttctatttggatccattcgagg

SEQ ID NO: 154456 - DNA, 595 bp, Homo sapiens
  Payload ID: 10357
  Gene Symbol: MRPL36
  Gene Name: mitochondrial ribosomal protein L36
  Uniprot ID: Q9P0J6
  ENST ID: ENST00000505818
  CDS Start-End: 46-357
atgcgcacggcttctggcggcgccaaacacccgattcaccacaacatggcaaatctttttataaggaaaatggtgaaccctctgctctatctcagtcgtcacacggtgaagcctcgagccctctccacatttctatttggatccattcgaggtgcagcccccgtggctgtggaacccggggcagcagtgcgctcacttctctcacccggcctcctgccccatctgctgcctgcgctggggttcaaaaacaagactgtccttaagaagcgctgcaaggactgttacctggtgaagaggcggggtcggtggtacgtctactgtaaaacccatccgaggcacaagcagagacagatgtagaccctttccctccagagtcacgcacatactcgtcatcgcatcacttgggagaatggttgtatcttatggaaggaattatcacatcaaggagtcaggggaaagtgactggaagcaaacgccctaaaagttacccatcacgtttcagtgtaaatgagtaactatagaagacattgcgttatcttatttccaaaacgttccaactaaaaaacattttcctattaaaatagaccttccgaat

SEQ ID NO: 154457 - DNA, 1179 bp, Homo sapiens
  Payload ID: 10358
  Gene Symbol: MRPL37
  Gene Name: mitochondrial ribosomal protein L37
  ENST ID: ENST00000336230
  CDS Start-End: 169-1047
ctcattcgttcccagcaggccctgcgcgcggcaacatggcggggtccaggtggaggtcttgaggctatcagatcggtatggcattggcgtccgggcccgcaaggcgggcgctagctggctccgggcagctcggccttgggggcttcggggccccgagacgcggggcgtatgagtggggcgtgcgctccacgcggaagtcggagcctcctcccctggatagggtgtacgagatccctggactggagcccatcacctttgcggggaagatgcacttcgtgccctggctggcgcggccgatctttccgccctgggaccgcggctacaaggacccaaggttctaccgctcgccccctcttcacgagcatccgctgtacaaagaccaggcctgctatatctttcaccaccgttgccgccttctcgaggtctcttctccttcaagtccgtggttctggtggagcccgactgagcactaaggatcctctgcccaccatcgcctccagagaggagattgaagctactaagaatcatgttctagagaccttctaccccatatcacccatcatcgatcttcatgaatgcaatatttatgatgtgaaaaatgacacaggattccaggaaggctatccttacccctatccccataccctgtacttactggacaaagccaatttacgaccacaccgccttcaaccagatcagctgcgggccaagatgatcctgtttgcttttggcagtgccctggctcaggcccggctcctctatgggaatgatgccaaggtcttggagcagcccgtggtggtgcagagcgtgggcacggatggacgtgtcttccatttcctagtgtttcaactgaataccacagacctggactgtaacgagggtgtcaagaatttggcctgggtggactcagaccagctcctctatcagcatttttggtgtctcccagtgatcaaaaagagagtggttgtggaacctgttggcccagttggtttcaagccagagacattcagaaagtttttagctctatatttgcatggtgctgcgtgagcggaggacccctctgaatcctgaaacccctcttgcctctcttccacggaagagggcctgggccccgtggagcctcagtgcccgtttggcctgctgctctcgctgacaataaagagcccttgcgttgcactg

SEQ ID NO: 154458 - DNA, 1483 bp, Homo sapiens
  Payload ID: 10358
  Gene Symbol: MRPL37
  Gene Name: mitochondrial ribosomal protein L37
  Uniprot ID: Q9BZE1
  ENST ID: ENST00000360840
  CDS Start-End: 78-1349
ctcattcgttcccagcaggccctgcgcgcggcaacatggcggggtccaggtggaggtcttgaggctatcagatcggtatggcattggcgtccgggcccgcaaggcgggcgctagctggctccgggcagctcggccttgggggcttcggggccccgagacgcggggcgtatgagtggggcgtgcgctccacgcggaagtcggagcctcctcccctggatagggtgtacgagatccctggactggagcccatcacctttgcggggaagatgcacttcgtgccctggctggcgcggccgatctttccgccctgggaccgcggctacaaggacccaaggttctaccgctcgccccctcttcacgagcatccgctgtacaaagaccaggcctgctatatctttcaccaccgttgccgccttctcgagggtgtaaagcaggccctctggctcaccaagaccaagttaatagaaggccttcccgagaaagtgcttagccttgttgatgatccaaggaaccacatagagaaccaagacgagtgcgttctgaatgtgatctctcacgcccgtctctggcagaccactgaggaaatccccaagagagagacctactgcccggtcatcgtggacaacctaatacagctgtgtaaatctcagattctcaagcatccttctctggccaggaggatctgtgtccaaaactccacgttttctgctacctggaaccgagagtctcttctccttcaagtccgtggttctggtggagcccgactgagcactaaggatcctctgcccaccatcgcctccagagaggagattgaagctactaagaatcatgttctagagaccttctaccccatatcacccatcatcgatcttcatgaatgcaatatttatgatgtgaaaaatgacacaggattccaggaaggctatccttacccctatccccataccctgtacttactggacaaagccaatttacgaccacaccgccttcaaccagatcagctgcgggccaagatgatcctgtttgcttttggcagtgccctggctcaggcccggctcctctatgggaatgatgccaaggtcttggagcagcccgtggtggtgcagagcgtgggcacggatggacgtgtcttccatttcctagtgtttcaactgaataccacagacctggactgtaacgagggtgtcaagaatttggcctgggtggactcagaccagctcctctatcagcatttttggtgtctcccagtgatcaaaaagagagtggttgtggaacctgttggcccagttggtttcaagccagagacattcagaaagtttttagctctatatttgcatggtgctgcgtgagcggaggacccctctgaatcctgaaacccctcttgcctctcttccacggaagagggcctgggccccgtggagcctcagtgcccgtttggcctgctgctctcgctgacaataaagagcccttgcgttgcactgaa

SEQ ID NO: 154459 - DNA, 868 bp, Homo sapiens
  Payload ID: 10358
  Gene Symbol: MRPL37
  Gene Name: mitochondrial ribosomal protein L37
  ENST ID: ENST00000398219
  CDS Start-End: 1-794
agtctcttctccttcaagtccgtggttctggtggagcccgactgagcactaaggatcctctgcccaccatcgcctccagagaggagattgaagctactaagaatcatgttctagagaccttctaccccatatcacccatcatcgatcttcatgaatgcaatatttatgatgtgaaaaatgacacaggattccaggaaggctatccttacccctatccccataccctgtacttactggacaaagccaatttacgaccacaccgccttcaaccagatcagctgcgggccaagatgatcctgtttgcttttggcagtgccctggctcaggcccggctcctctatgggaatgatgccaaggtcttggagcagcccgtggtggtgcagagcgtgggcacggatggacgtgtcttccatttcctagtgtttcaactgaataccacagacctggactgtaacgagggtgtcaagaatttggcctgggtggactcagaccagctcctctatcagcatttttggtgtctcccagtgatcaaaaagagagtggttgtgacaggtccttgcttctccaaatcccaaatgtctaccagcttcgtcctcactccctcattcaacgcaggagaggaagtgatgcagcggaacttgagggcctcagccagcctcccgcccagtacaggctccccagccagtgagctggtgaaggagcaggagcacgctgcagggagagtgctgcgccgggtcatgctggatagcgaaaccccacgagaggaacttccagcagcagacttttggaaatgaaatggtgacattcccattgtgaacgtatttctcactgtctcatatatttaaattcctggttgttccattcaaaa

SEQ ID NO: 154460 - DNA, 1582 bp, Homo sapiens
  Payload ID: 10358
  Gene Symbol: MRPL37
  Gene Name: mitochondrial ribosomal protein L37
  ENST ID: ENST00000605337
  CDS Start-End: 49-1500
ggcaacatggcggggtccaggtggaggtcttgaggctatcagatcggtatggcattggcgtccgggcccgcaaggcgggcgctagctggctccgggcagctcggccttgggggcttcggggccccgagacgcggggcgtatgagtggggcgtgcgctccacgcggaagtcggagcctcctcccctggatagggtgtacgagatccctggactggagcccatcacctttgcggggaagatgcacttcgtgccctggctggcgcggccgatctttccgccctgggaccgcggctacaaggacccaaggttctaccgctcgccccctcttcacgagcatccgctgtacaaagaccaggcctgctatatctttcaccaccgttgccgccttctcgagggtgtaaagcaggccctctggctcaccaagaccaagttaatagaaggccttcccgagaaagtgcttagccttgttgatgatccaaggaaccacatagagaaccaagacgagtgcgttctgaatgtgatctctcacgcccgtctctggcagaccactgaggaaatccccaagagagagacctactgcccggtcatcgtggacaacctaatacagctgtgtaaatctcagattctcaagcatccttctctggccaggaggatctgtgtccaaaactccacgttttctgctacctggaaccgagagtctcttctccttcaagtccgtggttctggtggagcccgactgagcactaaggatcctctgcccaccatcgcctccagagaggagattgaagctactaagaatcatgttctagagaccttctaccccatatcacccatcatcgatcttcatgaatgcaatatttatgatgtgaaaaatgacacaggattccaggaaggctatccttacccctatccccataccctgtacttactggacaaagccaatttacgaccacaccgccttcaaccagatcagctgcgggccaagatgatcctgtttgcttttggcagtgccctggctcaggcccggctcctctatgggaatgatgccaaggtcttggagcagcccgtggtggtgcagagcgtgggcacggatggacgtgtcttccatttcctagtgtttcaactgaataccacagacctggactgtaacgagggtgtcaagaatttggcctgggtggactcagaccagctcctctatcagcatttttggtgtctcccagtgatcaaaaagagagtggttgtgaaaaataaaagacattccagcggaccaaaatgtgtttgcaagacaagaaatggaaaatggcttttagacggcccccaaatatttaaagtgagatggataccttccctcccaacccaccttccgccaaggccatcgcgactccacaagaacacagaatttgcaggcccaggaaaagaaggcagacgcctcaaacacaaaacatcttgttatgcaccaggaacaaaaactgtgcccaagaagtcaccttgcattttgtaatcagtgtaataaactccaacccacattccccaaacatgtcaggaagggctgcggaaaaaagatgtccctttaataaaacgtt

SEQ ID NO: 154461 - DNA, 1888 bp, Homo sapiens
  Payload ID: 10359
  Gene Symbol: MRPL38
  Gene Name: mitochondrial ribosomal protein L38
  Uniprot ID: Q96DV4
  ENST ID: ENST00000309352
  CDS Start-End: 539-1681
cgggttttcaccgtgttggccaggatggtctcgatctcctgacttcgtgatccacccgccttggcctcccaaagtgctgggattcccggcgtgagccaccgcgcccagccctcaatctgggttttaaacccaagcagagtccggaatcggagctcgcaccccttctcccaaccaggcctgcgtccctggggaaatcaggacgcagcgtccaggggttggaggagggccccggcggccgaccccggtctgtgccgccccctggtggccagccatgggcgagcatatgactgctctcggctccgccccgccgtccaacgggcacttccggagccgggcgtctacagaccgcggccaccttccacctgcgcccgaggcagacggtgcaggggcctccgggacaggcgtctgaggcctgctccgcagcgcgggcccgggggcgggcctaggggcggggcctgctgtggtgcgctcaggcaccgcgctggccacctgtgcccgggtcctagtggcggccgcagtgtcgcaggccggagggaagatggcggcgccctggtggcgagccgcgctgtgcgagtgtcggagatggcggggcttcagcacctcggccgtcctgggccgccggacacccccgctggggccgatgcccaacagtgacatcgacttgagcaacctggagcggctggagaagtaccggagcttcgaccgctaccggcgccgagcagagcaggaggcgcaggccccgcactggtggcggacctaccgagagtatttcggggagaagacagatcccaaagagaagattgatattgggctgcctccacccaaagtctcccggacccaacagctactggaacggaaacaggccatccaggagcttcgggccaatgtggaagaggagcgggctgcccgcctccgcacagccagtgtcccgctggatgccgtgcgggccgagtgggagaggacctgtggcccctaccacaagcagcgtctggctgagtattacggcctctaccgagacctgttccacggtgccacctttgtgccccgagtccccctgcacgtggcctacgctgtgggtgaggatgacctgatgcctgtgtactgtggcaatgaggtgactccaaccgaggctgcccaagcgccagaggtgacctatgaggcagaagagggctccttgtggacgttgctactcactagcttggatgggcacctgctggagccagatgctgagtacctccactggctgctaaccaacatcccgggtaaccgggtggctgaaggacaggtgacgtgtccctacctcccccccttccctgcccgaggctccggcatccaccgtcttgccttcctgctcttcaagcaggaccagccgattgacttctctgaggacgcacgcccctcaccctgctatcagctggcccagcggaccttccgcacttttgatttctacaagaaacaccaagaaaccatgactccagccggcttgtccttcttccagtgccgctgggatgactccgtcacctacatcttccaccagcttctggacatgcgggagccggtgtttgagttcgtgcggccgcccccttaccaccccaagcagaagcgcttcccccaccggcagcccctgcgctacctggaccggtacagggacagtcatgagcccacctatggcatctactaaggagccagagtgtgcgcatttcagagcatgggattgatcggcagcaagagtaaagacacagctccagaggcccacactgtggggtctgggccctgccttaggcagcccccctctttggccccctcccgtcaggcccagggcttggagtgaaagtgactctcaggtggtggggtggggaatgtgaataaacatgatttcttgccgggc

SEQ ID NO: 154462 - DNA, 1110 bp, Homo sapiens
  Payload ID: 10360
  Gene Symbol: MRPL39
  Gene Name: mitochondrial ribosomal protein L39
  Uniprot ID: Q9NYK5
  ENST ID: ENST00000352957
  CDS Start-End: 43-1059
agggcggagaaggacttgcgcgcgacggttctcaccgctgctatggaggcgctggccatgggttcccgggcgctgcggctctggctggtcgcacccggtggcgggatcaaatggagatttatagcaacatcgtcagcttctcagctgtcaccgacagaattgacagaaatgcggaatgatctctttaataaagagaaagccaggcagttatcattaactccccgaactgagaagatagaagttaagcatgttgggaaaactgaccccggtactgtcttcgtgatgaataaaaacatttcaactccctacagttgtgccatgcatttaagcgagtggtattgcaggaagtccattctggctctggtggatggacagccttgggacatgtataagcctttaacaaagtcctgtgaaattaaatttcttactttcaaagattgtgatccaggagaagtgaataaggcatattggcgttcctgtgctatgatgatgggctgtgtgatagagagggcattcaaagatgaatatatggtcaatttggtcagagctccagaagttcctgtaatttctggtgccttctgttatgacgtagttttggatagcaaacttgatgagtggatgccaacaaaagagaacttacgttccttcacaaaagatgctcatgctttaatttataaagatcttccatttgaaactctggaagttgaagcaaaagtggcattggaaatatttcaacacagcaagtacaaagtagatttcatagaagagaaggcatctcagaaccctgagagaatagtcaagctacacagaataggtgacttcattgatgtgagtgagggccctcttattccaagaacaagtatttgtttccagtatgaagtatcagcagttcacaatcttcaacccacccagccaagtctcatacgaagattccagggcgtgtctttacctgttcacttaagagcacattttacaatatgggataagctattggaaagatctcggaaaatggtaactgaagatcaaagtaaagcaacagaggaatgtacatctacctaataactttctaaaatttaaatatgtataataaaataaatgttttaaatataa

SEQ ID NO: 154463 - DNA, 1199 bp, Homo sapiens
  Payload ID: 10360
  Gene Symbol: MRPL39
  Gene Name: mitochondrial ribosomal protein L39
  Uniprot ID: Q9NYK5
  ENST ID: ENST00000307301
  CDS Start-End: 43-1104
agggcggagaaggacttgcgcgcgacggttctcaccgctgctatggaggcgctggccatgggttcccgggcgctgcggctctggctggtcgcacccggtggcgggatcaaatggagatttatagcaacatcgtcagcttctcagctgtcaccgacagaattgacagaaatgcggaatgatctctttaataaagagaaagccaggcagttatcattaactccccgaactgagaagatagaagttaagcatgttgggaaaactgaccccggtactgtcttcgtgatgaataaaaacatttcaactccctacagttgtgccatgcatttaagcgagtggtattgcaggaagtccattctggctctggtggatggacagccttgggacatgtataagcctttaacaaagtcctgtgaaattaaatttcttactttcaaagattgtgatccaggagaagtgaataaggcatattggcgttcctgtgctatgatgatgggctgtgtgatagagagggcattcaaagatgaatatatggtcaatttggtcagagctccagaagttcctgtaatttctggtgccttctgttatgacgtagttttggatagcaaacttgatgagtggatgccaacaaaagagaacttacgttccttcacaaaagatgctcatgctttaatttataaagatcttccatttgaaactctggaagttgaagcaaaagtggcattggaaatatttcaacacagcaagtacaaagtagatttcatagaagagaaggcatctcagaaccctgagagaatagtcaagctacacagaataggtgacttcattgatgtgagtgagggccctcttattccaagaacaagtatttgtttccagtatgaagtatcagcagttcacaatcttcaacccacccagccaagtctcatacgaagattccagggcgtgtctttacctgttcacttaagagcacattttacaatatgggataagctattggaaagatctcggaaaatgactccatttcccattctccttctatttactacgcagtcattcttcactacctcgcctgagtcgtacctcctccatggaacagtctcagagtaactgaagatcaaagtaaagcaacagaggaatgtacatctacctaataactttctaaaatttaaatatgtataataaaataaatgttttaaatataa

SEQ ID NO: 154464 - DNA, 900 bp, Homo sapiens
  Payload ID: 10360
  Gene Symbol: MRPL39
  Gene Name: mitochondrial ribosomal protein L39
  ENST ID: ENST00000419219
  CDS Start-End: 10-900
accgctgctatggaggcgctggccatgggttcccgggcgctgcggctctggctggtcgcacccggtggcgggatcaaatggagatttatagcaacatcgtcagcttctcagctgtcaccgacagaattgacagaaatgcggaatgatctctttaataaagagaaagccaggcagttatcattaactccccgaactgagaagatagaagttaagcatgttgggaaaactgaccccggtactgtcttcgtgatgaataaaaacatttcaactccctacagttgtgccatgcatttaagcgagtggtattgcaggaagtccattctggctctggtggatggacagccttgggacatgtataagcctttaacaaagtcctgtgaaattaaatttcttactttcaaagattgtgatccaggagaagtgaataaggcatattggcgttcctgtgctatgatgatgggctgtgtgatagagagggcattcaaagatgaatatatggtcaatttggtcagagctccagaagttcctgttttggatagcaaacttgatgagtggatgccaacaaaagagaacttacgttccttcacaaaagatgctcatgctttaatttataaagatcttccatttgaaactctggaagttgaagcaaaagtggcattggaaatatttcaacacagcaagtacaaagtagatttcatagaagagaaggcatctcagaaccctgagagaatagtcaagctacacagaataggtgacttcattgatgtgagtgagggccctcttattccaagaacaagtatttgtttccagtatgaagtatcagcagttcacaatcttcaacccacccagccaagtctcatacgaagattccagggcgtgtctttacctgttcacttaaga

SEQ ID NO: 154465 - DNA, 1455 bp, Homo sapiens
  Payload ID: 10361
  Gene Symbol: MRPL4
  Gene Name: mitochondrial ribosomal protein L4
  Uniprot ID: Q9BYD3
  ENST ID: ENST00000253099
  CDS Start-End: 288-1223
aaagtaggctaggcctacggaagctgggtcttcttgctgtgaggtcgcgttccccagtgttacggagggtccttgaggcaggagtgaaaattgggtctgggggttagtcctggggtggaggtctgggcacgccgggtcggaccccctccatcttcggttttgcacaccccgctttccagcgcggagtcgcggcgggtagggcggcgtcgcgtgcgtgacgtcatccagcggcgcctcgcgaggctccagtggccttgacctcccgcggcgtgggaggctgcgcggcgatgctgcagttcgtccgggccggggcgcgggcctggcttcggcctaccggcagccagggcctgagttccctggcggaagaggcagcgcgtgcgaccgagaacccggagcaggtggcgagcgagggtctcccggagcccgtgctgcgcaaagtcgagctcccggtacccactcatcgacgcccagtgcaggcctgggtcgagtccttgcggggcttcgagcaggagcgcgtgggcctggccgacctgcaccccgatgttttcgccaccgcgcccaggctggacatactgcaccaggttgctatgtggcagaagaacttcaagagaattagctatgccaagaccaagacgagagccgaggtgcggggcggtggccggaagccttggccgcagaaaggcactgggcgggcccggcatggcagcatccgctctccgctctggcgaggaggaggtgttgcccatggcccccggggccccacaagttactactacatgctgcccatgaaggtgcgggcgctgggtctcaaagtggcactgaccgtcaagctggcccaggacgacctgcacatcatggactccctagagctgcccaccggagacccacagtacctgacagagctggcgcactaccgccgctggggggactccgtactcctcgtggacttaacacacgaggagatgccacagagcatcgtggaggccacctctaggcttaagaccttcaacttgatcccggctgttggcctaaatgtgcacagcatgctcaagcaccagacgctggtcctgacgctgcccaccgtcgccttcctggaggacaagctgctctggcaggactcacgttacagacccctctaccccttcagcctgccctacagcgacttcccccgacccctaccccacgctacccagggcccagcggccaccccgtaccactgttgatgtgaagcacctcttctgagccaggccgagcccctggccgacttgggagcctcaggcccacgcccacccttcgaggaaggtgtcacctggaccccttcattccacggaggaagctgaggccacagggagcggccatcgccattgggaaggggcgactccacggaaagcccagacgggcttctgcatccattccctctttttgtttttaaaataaattgtatttttgaatcaa

SEQ ID NO: 154466 - DNA, 1320 bp, Homo sapiens
  Payload ID: 10361
  Gene Symbol: MRPL4
  Gene Name: mitochondrial ribosomal protein L4
  Uniprot ID: Q9BYD3
  ENST ID: ENST00000307422
  CDS Start-End: 155-1090
cccaaagtaggctaggcctacggaagctgggtcttcttgctgtgagcgcggagtcgcggcgggtagggcggcgtcgcgtgcgtgacgtcatccagcggcgcctcgcgaggctccagtggccttgacctcccgcggcgtgggaggctgcgcggcgatgctgcagttcgtccgggccggggcgcgggcctggcttcggcctaccggcagccagggcctgagttccctggcggaagaggcagcgcgtgcgaccgagaacccggagcaggtggcgagcgagggtctcccggagcccgtgctgcgcaaagtcgagctcccggtacccactcatcgacgcccagtgcaggcctgggtcgagtccttgcggggcttcgagcaggagcgcgtgggcctggccgacctgcaccccgatgttttcgccaccgcgcccaggctggacatactgcaccaggttgctatgtggcagaagaacttcaagagaattagctatgccaagaccaagacgagagccgaggtgcggggcggtggccggaagccttggccgcagaaaggcactgggcgggcccggcatggcagcatccgctctccgctctggcgaggaggaggtgttgcccatggcccccggggccccacaagttactactacatgctgcccatgaaggtgcgggcgctgggtctcaaagtggcactgaccgtcaagctggcccaggacgacctgcacatcatggactccctagagctgcccaccggagacccacagtacctgacagagctggcgcactaccgccgctggggggactccgtactcctcgtggacttaacacacgaggagatgccacagagcatcgtggaggccacctctaggcttaagaccttcaacttgatcccggctgttggcctaaatgtgcacagcatgctcaagcaccagacgctggtcctgacgctgcccaccgtcgccttcctggaggacaagctgctctggcaggactcacgttacagacccctctaccccttcagcctgccctacagcgacttcccccgacccctaccccacgctacccagggcccagcggccaccccgtaccactgttgatgtgaagcacctcttctgagccaggccgagcccctggccgacttgggagcctcaggcccacgcccacccttcgaggaaggtgtcacctggaccccttcattccacggaggaagctgaggccacagggagcggccatcgccattgggaaggggcgactccacggaaagcccagacgggcttctgcatccattccctctttttgtttttaaaataaattgtatttttgaatc

SEQ ID NO: 154467 - DNA, 1620 bp, Homo sapiens
  Payload ID: 10361
  Gene Symbol: MRPL4
  Gene Name: mitochondrial ribosomal protein L4
  ENST ID: ENST00000393733
  CDS Start-End: 28-1101
tcccgcggcgtgggaggctgcgcggcgatgctgcagttcgtccgggccggggcgcgggcctggcttcggcctaccggcagccagggcctgagttccctggcggaagaggcagcgcgtgcgaccgagaacccggagcaggtggcgagcgagggtctcccggagcccgtgctgcgcaaagtcgagctcccggtacccactcatcgacgcccagtgcaggcctgggtcgagtccttgcggggcttcgagcaggagcgcgtgggcctggccgacctgcaccccgatgttttcgccaccgcgcccaggctggacatactgcaccaggttgctatgtggcagaagaacttcaagagaattagctatgccaagaccaagacgagagccgaggtgcggggcggtggccggaagccttggccgcagaaaggcactgggcgggcccggcatggcagcatccgctctccgctctggcgaggaggaggtgttgcccatggcccccggggccccacaagttactactacatgctgcccatgaaggtgcgggcgctgggtctcaaagtggcactgaccgtcaagctggcccaggacgacctgcacatcatggactccctagagctgcccaccggagacccacagtacctgacagagctggcgcactaccgccgctggggggactccgtactcctcgtggacttaacacacgaggagatgccacagagcatcgtggaggccacctctaggcttaagaccttcaacttgatcccggctgttgccacaagatggcgacatgagcctaagtcaagtcctgtccctcaacccacgcccctcgctggcttccccacctctctcaggatgaaagcccaagtcatcagggtggcacgtcaggccctgcacgatgtgccccgtcacctccctgccctcccgtcatttgccctgggtctcccccaccagaatgggagccaggagtcccagccaggcacaggaccgagcctggctctcggtcagcaggtgatgagctgggagcagctccttggccagaggcttacaggcaacaagcggccaggcagggtctggccccgggctgctgggctcacaaagtcacactagaccacagtgacgatctctgtaagcacaaagggactccgatgtgggtggggtgaggagagaggcagccccggcctgaccggccccccgccccgcccccaccccgcccccaggcctaaatgtgcacagcatgctcaagcaccagacgctggtcctgacgctgcccaccgtcgccttcctggaggacaagctgctctggcaggactcacgttacagacccctctaccccttcagcctgccctacagcgacttcccccgacccctaccccacgctacccagggcccagcggccaccccgtaccactgttgatgtgaagcacctcttctgagccaggccgagcccctggccgacttgggagcctcaggcccacgcccacccttcgaggaaggtgtcacctggaccccttcattccacggaggaagctgaggccacagggagcggccatcgccattgggaaggggcgactccacggaaagcccagacgggcttctgcatccattccctctttttgtttttaaaat

SEQ ID NO: 154468 - DNA, 876 bp, Homo sapiens
  Payload ID: 10361
  Gene Symbol: MRPL4
  Gene Name: mitochondrial ribosomal protein L4
  ENST ID: ENST00000590702
  CDS Start-End: 1-360
cagaagaacttcaagagaattagctatgccaagaccaagacgagagccgaggtgcggggcggtggccggaagccttggccgcagaaaggcactgggcgggcccggcatggcagcatccgctctccgctctggcgaggaggaggtgttgcccatggcccccggggccccacaagttactactacatgctgcccatgaaggtgcgggcgctgggtctcaaagtggcactgaccgtcaagctggcccaggacgacctgcacatcatggactccctagagctgcccaccggagacccacagtacctgacagagctggcgcactaccgccgctggggggactccgtactcctcgtggacttgtgagggcacagggcagagcaggggcagggggccctgagctccgtactctgagggttcaacccccactccctggcctctcttacagaacacacgaggagatgccacagagcatcgtggaggccacctctaggcttaagaccttcaacttgatcccggctgttggtgagcaaagagcccaggcccctagagtgcgcatgtgcaggctccgctgttagaatcacagcggttcaaatccggcatctggtcgctgagtggcctcaggcagtgaccacgctcccggacccaaccttcagcttgcccaaagcaataatctttcctaaagaagtgcttggctggggatggtggctcacgcttgtaatcccagtactttgggaggccaaggcagtctgggcaatatagtgaggctcccatctgtactaaaaataaaaaagttaggcgtggcgatgtgcacctgtagtcccagctactcgggggctgagccaggcggatagcttgagctcagggggccaaggctgcagt

SEQ ID NO: 154469 - DNA, 1423 bp, Homo sapiens
  Payload ID: 10361
  Gene Symbol: MRPL4
  Gene Name: mitochondrial ribosomal protein L4
  Uniprot ID: Q9BYD3
  ENST ID: ENST00000590669
  CDS Start-End: 245-1036
gtcgcgttccccagtgttacggagggtccttgaggcaggagtgaaaattgggtctgggggttagtcctggggtggaggtctgggcacgccgggtcggaccccctccatcttcggttttgcacaccccgctttccagcgcggagtcgcggcgggtagggcggcgtcgcgtgcgtgacgtcatccagcggcgcctcgcgaggctccagtggccttgacctcccgcggcgtgggaggctgcgcggcgatgctgcagttcgtccgggccggggcgcgggcctggcttcggcctaccggcagccagggcctgagttccctggcggaagaggcagcgcgtgcgaccgagaacccggagcaggtggcgagcgagggtctcccggagcccgtgctgcgcaaagtcgagctcccggtacccactcatcgacgcccagtgcaggcctgggtcgagtccttgcggggcttcgagcaggagcgcgtgggcctggccgacctgcaccccgatgttttcgccaccgcgcccaggctggacatactgcaccaggttgctatgtggcagaagaacttcaagagaattagctatgccaagaccaagacgagagccgaggtgcggggcggtggccggaagccttggccgcagaaaggcactgggcgggcccggcatggcagcatccgctctccgctctggcgaggaggaggtgttgcccatggcccccggggccccacaagttactactacatgctgcccatgaaggtgcgggcgctgggtctcaaagtggcactgaccgtcaagctggcccaggacgacctgcacatcatggactccctagagctgcccaccggagacccacagtacctgacagagctggcgcactaccgccgctggggggactccgtactcctcgtggacttaacacacgaggagatgccacagagcatcgtggaggccacctctaggcttaagaccttcaacttgatcccggctgttggtgagcaaagagcccaggcccctagagtgcgcatgtgcaggctccgctgttagaatcacagcggttcaaatccggcatctggtcgctgagtggcctcaggcagtgaccacgctcccggacccaaccttcagcttgcccaaagcaataatctttcctaaagaagtgcttggctggggatggtggctcacgcttgtaatcccagtactttgggaggccaaggcagtctgggcaatatagtgaggctcccatctgtactaaaaataaaaaagttaggcgtggcgatgtgcacctgtagtcccagctactcgggggctgagccaggcggatagcttgagctcagggggccaaggctgcagtgagtcatgatcgcaccactgcacccaaacctggggagagagctagactcttgtctcaaaaaaaaaaaaaaaaaaaaaaaaaaa

SEQ ID NO: 154470 - DNA, 777 bp, Homo sapiens
  Payload ID: 10361
  Gene Symbol: MRPL4
  Gene Name: mitochondrial ribosomal protein L4
  ENST ID: ENST00000591054
  CDS Start-End: 175-558
ccggctcgtcggaggcgggacccaaagtaggctaggcctacggaagctgggtcttcttgctgtgagcgcggagtcgcggcgggtagggcggcgtcgcgtgcgtgacgtcatccagcggcgcctcgcgaggctccagtggccttgacctcccgcggcgtgggaggctgcgcggcgatgctgcagttcgtccgggccggggcgcgggcctggcttcggcctaccggcagccagggcctgagttccctggcggaagaggcagcgcgtgcgaccgagaacccggagcaggtggcgagcgagggtctcccggagcccgtgctgcgcaaagtcgagctcccggtacccactcatcgacgcccagtgcaggcctgggtcgagtccttgcggggcttcgagcaggagcgcgtgggcctggccgacctgcaccccgatgttttcgccaccgcgcccaggctggacatactgcaccaggttgctatgtggcagaagaacttcaagagaattgaggtgttgcccatggcccccggggccccacaagttactactacatgctgcccatgaaggtgcgggcgctgggtctcaaagtggcactgaccgtcaagctggcccaggacgacctgcacatcatggactccctagagctgcccaccggagacccacagtacctgacagagctggcgcactaccgccgctggggggactccgtactcctcgtggacttaacacacgaggagatgccacagagcatcgtggaggccacctctaggcttaagaccttca

SEQ ID NO: 154471 - DNA, 747 bp, Homo sapiens
  Payload ID: 10361
  Gene Symbol: MRPL4
  Gene Name: mitochondrial ribosomal protein L4
  ENST ID: ENST00000590150
  CDS Start-End: 257-747
tcttgctgtgaggtcgcgttccccagtgttacggagggtccttgaggcaggagtgaaaattgggtctgggggttagtcctggggtggaggtctgggcacgccgggtcggaccccctccatcttcggttttgcacaccccgctttccagcgcggagtcgcggcgggtagggcggcgtcgcgtgcgtgacgtcatccagcggcgcctcgcgaggctccagtggccttgacctcccgcggcgtgggaggctgcgcggcgatgctgcagttcgtccgggccggggcgcgggcctggcttcggcctaccggcagccaggggtcgtctctcactttcgcccaacccttgcagggcctgagttccctggcggaagaggcagcgcgtgcgaccgagaacccggagcaggtggcgagcgagggtctcccggagcccgtgctgcgcaaagtcgagctcccggtacccactcatcgacgcccagtgcaggcctgggtcgagtccttgcggggcttcgagcaggagcgcgtgggcctggccgacctgcaccccgatgttttcgccaccgcgcccaggctggacatactgcaccaggttgctatgtggcagaagaacttcaagagaattagctatgccaagaccaagacgagagccgaggtgcggggcggtggccggaagccttggccgcagaaaggcactgggcgggcccggcatggcagcatccgctctccgctctggcgaggaggaggtgttgccca

SEQ ID NO: 154472 - DNA, 827 bp, Homo sapiens
  Payload ID: 10361
  Gene Symbol: MRPL4
  Gene Name: mitochondrial ribosomal protein L4
  ENST ID: ENST00000588502
  CDS Start-End: 68-730
gggcgcgggcctggcttcggcctaccggcagccaggtgaggccaggggctggaggcgtggtcgaaggatgaaatttgggggtgtccaggggtcgtctctcactttcgcccaacccttgcagggcctgagttccctggcggaagaggcagcgcgtgcgaccgagaacccggagcaggtggcgagcgagggtctcccggagcccgtgctgcgcaaagtcgagctcccggtacccactcatcgacgcccagtgcaggcctgggtcgagtccttgcggggcttcgagcaggagcgcgtgggcctggccgacctgcaccccgatgttttcgccaccgcgcccaggctggacatactgcaccaggttgctatgtggcagaagaacttcaagagaattagctatgccaagaccaagacgagagccgaggtgcggggcggtggccggaagccttggccgcagaaaggcactgggcgggcccggcatggcagcatccgctctccgctctggcgaggaggaggtgttgcccatggcccccggggccccacaagttactactacatgctgcccatgaaggtgcgggcgctgggtctcaaagtggcactgaccgtcaagctggcccaggacgacctgcacatcatggactccctagagctgcccaccggagacccacagtacctgacagagctggcgcactaccgccgctggggggactccgtactcctcgtggacttgtgagggcacagggcagagcaggggcagggggccctgagctccgtactctgagggttcaacccccactccctggcctctcttacagaacacacgaggagat

SEQ ID NO: 154473 - DNA, 1118 bp, Homo sapiens
  Payload ID: 10361
  Gene Symbol: MRPL4
  Gene Name: mitochondrial ribosomal protein L4
  ENST ID: ENST00000592514
  CDS Start-End: 218-1118
ggctgaattgggccagagaggtctcattggctgaattcctgcaccggctcgtcggaggcgggacccaaagtaggctaggcctacggaagctgggtcttcttgctgtgagcgcggagtcgcggcgggtagggcggcgtcgcgtgcgtgacgtcatccagcggcgcctcgcgaggctccagtggccttgacctcccgcggcgtgggaggctgcgcggcgatgctgcagttcgtccgggccggggcgcgggcctggcttcggcctaccggcagccagggcctgagttccctggcggaagaggcagcgcgtgcgaccgagaacccggagcaggtggcgagcgagggtctcccggagcccgtgctgcgcaaagtcgagctcccggtacccactcatcgacgcccagtgcaggcctgggtcgagtccttgcggggcttcgagcaggagcgcgtgggcctggccgacctgcaccccgatgttttcgccaccgcgcccaggctggacatactgcaccaggttgctatgtggcagaagaacttcaagagaattagctatgccaagaccaagacgagagccgaggtgcggggcggtggccggaagccttggccgcagaaaggcactgggcgggcccggcatggcagcatccgctctccgctctggcgaggaggaggtgttgcccatggcccccggggccccacaagttactactacatgctgcccatgaaggtgcgggcgctgggtctcaaagtggcactgaccgtcaagctggcccaggacgacctgcacatcatggactccctagagctgcccaccggagacccacagtacctgacagagctggcgcactaccgccgctggggggactccgtactcctcgtggacttaacacacgaggagatgccacagagcatcgtggaggccacctctaggcttaagaccttcaacttgatcccggctgttggcctaaatgtgcacagcatgctcaagcaccagacgctggtcctgacgctgcccaccgtcgccttcctggaggacaagctgctctggcaggactcacgttacagacccctctaccccttcagcctgccctacagcgacttcccccgacccctaccccacgcta

SEQ ID NO: 154474 - DNA, 1387 bp, Homo sapiens
  Payload ID: 10362
  Gene Symbol: MRPL40
  Gene Name: mitochondrial ribosomal protein L40
  Uniprot ID: Q9NQ50
  ENST ID: ENST00000333130
  CDS Start-End: 654-1274
agttgcaacccgggccgcccgcagaggcaggcggggcccaggtggcgtggaccgcccgtcaccagctctgcctcgccagtctgagtccgacttattaactagcttccgtcattcatcaacacgcgctattgggcatcttgcgagcgccgggctccgcgccggcgccggaatgcgatccgggcttcggactcgaacgaatgcgggggacgagccaaccctggtgggggaggctggggcggacgcgtttattagaagatcggggccgtttgcctagacatgaacatttggactcggaggagcagagggacgccccctcggccgctccggctgcactgcggagccgaggcccgcgcgagggcgcagaccgaccaaccggctagggcctgactggctagactgtgcccgctgcagaggcgcgctcccagcacagggcggggacggaagggaggaccccgagccgcgtgaaacgcaaggccctcgtgtgtgcgcagctgacaccctaggcggggctgcgtcgggggcggggacaggcgcgtcccagcccacgcagccggaacgcctgagcgctgggcgcctggtctgccggacctcagcagggggcaccgcgggccggactgtggaggggcgcacgcccggaagcggcgagggtagccatgacggcctccgtgctgcgaagtatctcgctagccctgcgcccgactagcgggcttctgggaacttggcagacgcagcttagagagactcaccagcgagcgtcattgttgtctttctgggaactcattcccatgagatcagaacctcttcgaaaaaagaagaaggtagatcctaaaaaagaccaagaagcaaaggagcgcttgaaaaggaagatccgaaaactggaaaaggctactcaagagctaattcctattgaagattttattacccctctaaagttcttggataaagcaagagagcggcctcaggtggagctcacctttgaggagactgagaggagagctctgcttctgaagaagtggtccttgtacaagcagcaagagcgtaagatggagagggacaccatcagggctatgctagaagcccagcaggaagctctggaggaactgcaactggaatccccgaagctccatgctgaggccatcaagcgggatcctaacctgttcccctttgagaaggaagggccacattacacaccaccgatccctaactaccaaccccctgaaggcaggtacaatgacatcaccaaggtgtacacacaagtggagtttaagagatagacttgcaggctgctatccttaacatgctgcccctgagagtaggaatgaccagggttcaagtctgctttccacagaatcaggcatgctgttaataaatactggtttaatcaaaa

SEQ ID NO: 154475 - DNA, 1262 bp, Homo sapiens
  Payload ID: 10363
  Gene Symbol: MRPL41
  Gene Name: mitochondrial ribosomal protein L41
  Uniprot ID: Q8IXM3
  ENST ID: ENST00000371443
  CDS Start-End: 789-1202
gggcgacttccgcgtggggtgagaggtcgcctgcgagggtgaccgggcaggagggctcagtgcgcaagccggacgtgctgggtccaagattattgattaatttgggcaccgcgagggctcgagtccccccacaccactgcccggcctgcgggggagcacagacagcccgggccctcccggctgcaggtcccgggctttccccgcgcggttgccggctccgcccagaggagccgcgcccggcggaggggtaagaaaggcagggtcgcggcgtcaacgcggcggccgtctcgagtccagggcccgcgtcctccccgacctcccgacgccacctcacggcctcagggggactgggctcccgggaaaccgccggccacctggcggacgaacacaggcagtggcgggcagtggagacgccagggaccaccgcgctgagagcgatcactcatccgccagccccgccccgcgagccccgccccgcgagccccgccccgcgagccccgccccgcgagccccgccccgcgagccccgccccgcgagccccgcaccgccggccccgcaccgccagccccgcgagccccgccccgccccgcgcgctcctcgcattggccgagtccccgcggccacaccccctaccagattggggccgctattggacgcggcggccgcggccaatcggagccgctcttgctgcgacgcagcggtcggaagcggagcaaggtcgaggccgggttggcgccggagccggggccgcttggagctcgtgtggggtctccggtccagggcgcggcatgggcgtcctggccgcagcggcgcgctgcctggtccggggtgcggaccgaatgagcaagtggacgagcaagcggggcccgcgcagcttcaggggccgcaagggccggggcgccaagggcatcggcttcctcacctcgggctggaggttcgtgcagatcaaggagatggtcccggagttcgtcgtcccggatctgaccggcttcaagctcaagccctacgtgagctacctcgcccctgagagcgaggagacgcccctgacggccgcgcagctcttcagcgaagccgtggcgcctgccatcgaaaaggacttcaaggacggtaccttcgaccctgacaacctggaaaagtacggcttcgagcccacacaggagggaaagctcttccagctctaccccaggaacttcctgcgctagctgggcgggggaggggcggcctgccctcatctcatttctattaaacgcctttgccagcta

SEQ ID NO: 154476 - DNA, 2105 bp, Homo sapiens
  Payload ID: 10364
  Gene Symbol: MRPL42
  Gene Name: mitochondrial ribosomal protein L42
  ENST ID: ENST00000358678
  CDS Start-End: 132-287
aaacaagatggcgggttcgtggtgagaagccgtcaaggagtagaaattggtatgcttagaagcagattctaaaagcagtttctcttcagaacatcttttttcataccacttgataagcatcttgaaacaccatggctgtagctgcagtaaaatgggtgatgtcaaagagaactatcttgaaacatttatttccagtccaaaattcgggcgtacatgtgcaggtttgttacgtggatgtattacatatactgaggtttgggcttcaactgaacccgtcacccaaatagtgaacatagtacccaatagatggagctttatattgtgtttgtcataaatctacgtattctcctctaccagatgactataattgcaacgtagagcttgctctgacttctgatggcaggacaatagtatgctaccacccttctgtggacattccatatgaacacacaaaacctatccctcggccagatcctgtgcataataatgaagaaacacatgatcaagtgctgaaaaccagattggaagaaaaagttgaacaccttgaggaaggacctatgatagaacaacttagcaaaatgttctttactactaagcaccgttggtatcctcatggacggtatcacagatgtcgtaagaatctgaatcctccaaaagacagatgatgcggaggttcctgggggaatcaaagagaaatgtgcctcatttgccatttgagaaaatgcagtctggtgtattcagtaatatatagtaaagtaataatgataaaatatcttttcatatattagaatgtgtacttttatataaagtaattctggatttgacattctcatttagagaaacctattttcttttttctttttctattttagtgtttcatttatgtgcggtctccaatttaggacttttccatagtgccaaagccatacatattcagtagaacatcaataaattacatcagaaattcaacactttattataaaacgggcttcgtgttagataattttgctaaacagtaggctactgtaagtgttctgagcatatttaagacaggctagcattttcaatttacaatattttcaactgatagtaggtttattgggatgtaaccctatgataagttgagaaacatctctttttgtgtgtctactgtgatttaagtatttttaatcatcagccaagcattgttagtagtataaatatgattaataaaaatgtgcatggctttcctgaaggagattttttaattgcctttgagaataaactcataaggtctaccaagaaaataaatgttatgatgtttcagttggcttctaggaaataattaaattagtgatattttaatcaggttttactatctgctaggccccttccatcaattcttattaaattctcaaaataatcctttgaaaagggagtataattacattttacagtgactcgaaccttacccaaacaagtgggagagccaggagccaaactatcaggctccaaagcttttttttagtgcatcacaatgacaaaggggtggttttctttcacccaagaatgtgctttcctggaaatttttctagatagaatattatgtaatttgttttgaaggttttttttcctgactgtcttaaagattatgctagctttagaacacatgcaaacagctgcagctctgtgattaaaatgttaaggtcactagaatagtgttaggaaaatgttaatagataattctgctgcctctattagcttatgtatgatccttaatagcattgcttccccttcagtttctatttaggaggtgaagaatcttttaataaggtagaaagttgctttatttaaatttgtactgtagaatgtttgtgatacagtatttgtaaaattgatatgaaaaataatttctcaaagtctattgtttgatctagttattttaataaaggaactctagaagtttcaagtggccagtgaagtgtgaggaatagagagtaaaggaaataattaataatggtgaccctctgttaagtggtttactttttccattaatataaatttcatttggaaagattaaaaaaacaagtttgattgaacttgataaatcagaaatatttaccagc

SEQ ID NO: 154477 - DNA, 1983 bp, Homo sapiens
  Payload ID: 10364
  Gene Symbol: MRPL42
  Gene Name: mitochondrial ribosomal protein L42
  ENST ID: ENST00000393128
  CDS Start-End: 133-552
gaaacaagatggcgggttcgtggtgagaagccgtcaaggagtagaaattggtatgcttagaagcagattctaaaagcagtttctcttcagaacatcttttttcataccacttgataagcatcttgaaacaccatggctgtagctgcagtaaaatgggtgatgtcaaagagaactatcttgaaacatttatttccagtccaaaatggagctttatattgtgtttgtcataaatctacgtattctcctctaccagatgactataattgcaacgtagagcttgctctgacttctgatggcaggacaatagtatgctaccacccttctgtggacattccatatgaacacacaaaacctatccctcggccagatcctgtgcataataatgaagaaacacatgatcaagtgctgaaaaccagattggaagaaaaagttgaacaccttgaggaaggacctatgatagaacaacttagcaaaatgttctttactactaagcaccgttggtatcctcatggacgatgtcgtaagaatctgaatcctccaaaagacagatgatgcggaggttcctgggggaatcaaagagaaatgtgcctcatttgccatttgagaaaatgcagtctggtgtattcagtaatatatagtaaagtaataatgataaaatatcttttcatatattagaatgtgtacttttatataaagtaattctggatttgacattctcatttagagaaacctattttcttttttctttttctattttagtgtttcatttatgtgcggtctccaatttaggacttttccatagtgccaaagccatacatattcagtagaacatcaataaattacatcagaaattcaacactttattataaaacgggcttcgtgttagataattttgctaaacagtaggctactgtaagtgttctgagcatatttaagacaggctagcattttcaatttacaatattttcaactgatagtaggtttattgggatgtaaccctatgataagttgagaaacatctctttttgtgtgtctactgtgatttaagtatttttaatcatcagccaagcattgttagtagtataaatatgattaataaaaatgtgcatggctttcctgaaggagattttttaattgcctttgagaataaactcataaggtctaccaagaaaataaatgttatgatgtttcagttggcttctaggaaataattaaattagtgatattttaatcaggttttactatctgctaggccccttccatcaattcttattaaattctcaaaataatcctttgaaaagggagtataattacattttacagtgactcgaaccttacccaaacaagtgggagagccaggagccaaactatcaggctccaaagcttttttttagtgcatcacaatgacaaaggggtggttttctttcacccaagaatgtgctttcctggaaatttttctagatagaatattatgtaatttgttttgaaggttttttttcctgactgtcttaaagattatgctagctttagaacacatgcaaacagctgcagctctgtgattaaaatgttaaggtcactagaatagtgttaggaaaatgttaatagataattctgctgcctctattagcttatgtatgatccttaatagcattgcttccccttcagtttctatttaggaggtgaagaatcttttaataaggtagaaagttgctttatttaaatttgtactgtagaatgtttgtgatacagtatttgtaaaattgatatgaaaaataatttctcaaagtctattgtttgatctagttattttaataaaggaactctagaagtttcaagtggccagtgaagtgtgaggaatagagagtaaaggaaataattaataatggtgaccctctgttaagtggtttactttttccattaatataaatttcatttggaaagattaaaaaaacaagtttgattgaacttgataaatcagaaata

SEQ ID NO: 154478 - DNA, 920 bp, Homo sapiens
  Payload ID: 10364
  Gene Symbol: MRPL42
  Gene Name: mitochondrial ribosomal protein L42
  Uniprot ID: Q9Y6G3
  ENST ID: ENST00000552217
  CDS Start-End: 137-565
tgaaacaagatggcgggttcgtggtgagaagccgtcaagcaggagtagaaattggtatgcttagaagcagattctaaaagcagtttctcttcagaacatcttttttcataccacttgataagcatcttgaaacaccatggctgtagctgcagtaaaatgggtgatgtcaaagagaactatcttgaaacatttatttccagtccaaaatggagctttatattgtgtttgtcataaatctacgtattctcctctaccagatgactataattgcaacgtagagcttgctctgacttctgatggcaggacaatagtatgctaccacccttctgtggacattccatatgaacacacaaaacctatccctcggccagatcctgtgcataataatgaagaaacacatgatcaagtgctgaaaaccagattggaagaaaaagttgaacaccttgaggaaggacctatgatagaacaacttagcaaaatgttctttactactaagcaccgttggtatcctcatggacggtatcacagatgtcgtaagaatctgaatcctccaaaagacagatgatgcggaggttcctgggggaatcaaagagaaatgtgcctcatttgccatttgagaaaatgcagtctggtgtattcagtaatatatagtaaagtaataatgataaaatatcttttcatatattagaatgtgtacttttatataaagtaattctggatttgacattctcatttagagaaacctattttcttttttctttttctattttagtgtttcatttatgtgcggtctccaatttaggacttttccatagtgccaaagccatacatattcagtagaacatcaataaattacatcagaaattcaacactttattataaaacgggcttcgtgttagataattttgctaaacagtagg

SEQ ID NO: 154479 - DNA, 775 bp, Homo sapiens
  Payload ID: 10364
  Gene Symbol: MRPL42
  Gene Name: mitochondrial ribosomal protein L42
  Uniprot ID: Q9Y6G3
  ENST ID: ENST00000549561
  CDS Start-End: 98-526
caggagtagaaattggtatgcttagaagcagattctaaaagcagtttctcttcagaacatcttttttcataccacttgataagcatcttgaaacaccatggctgtagctgcagtaaaatgggtgatgtcaaagagaactatcttgaaacatttatttccagtccaaaatggagctttatattgtgtttgtcataaatctacgtattctcctctaccagatgactataattgcaacgtagagcttgctctgacttctgatggcaggacaatagtatgctaccacccttctgtggacattccatatgaacacacaaaacctatccctcggccagatcctgtgcataataatgaagaaacacatgatcaagtgctgaaaaccagattggaagaaaaagttgaacaccttgaggaaggacctatgatagaacaacttagcaaaatgttctttactactaagcaccgttggtatcctcatggacggtatcacagatgtcgtaagaatctgaatcctccaaaagacagatgatgcggaggttcctgggggaatcaaagagaaatgtgcctcatttgccatttgagaaaatgcagtctggtgtattcagtaatatatagtaaagttgacttatatccaaaattctacaaattcttagctatgttataaatgtagaaagaagtgaaaaatcaaaatatgattatgaagattttcttctcttccgagtacaaagctctgctaaataaggatttacccaagatgcccacatccacatacttatgt

SEQ ID NO: 154480 - DNA, 15582 bp, Homo sapiens
  Payload ID: 10364
  Gene Symbol: MRPL42
  Gene Name: mitochondrial ribosomal protein L42
  Uniprot ID: Q9Y6G3
  ENST ID: ENST00000549982
  CDS Start-End: 162-590
gcgcagcgctgtttcgtgggaccaggattgaaacaagatggcgggttcgtggtgagaagccgtcaaggagtagaaattggtatgcttagaagcagattctaaaagcagtttctcttcagaacatcttttttcataccacttgataagcatcttgaaacaccatggctgtagctgcagtaaaatgggtgatgtcaaagagaactatcttgaaacatttatttccagtccaaaatggagctttatattgtgtttgtcataaatctacgtattctcctctaccagatgactataattgcaacgtagagcttgctctgacttctgatggcaggacaatagtatgctaccacccttctgtggacattccatatgaacacacaaaacctatccctcggccagatcctgtgcataataatgaagaaacacatgatcaagtgctgaaaaccagattggaagaaaaagttgaacaccttgaggaaggacctatgatagaacaacttagcaaaatgttctttactactaagcaccgttggtatcctcatggacggtatcacagatgtcgtaagaatctgaatcctccaaaagacagatgatgcggaggttcctgggggaatcaaagagaaatgtgcctcatttgccatttgagaaaatgcagtctggtgtattcagtaatatatagtaaagtaataatgataaaatatcttttcatatattagaatgtgtacttttatataaagtaattctggatttgacattctcatttagagaaacctattttcttttttctttttctattttagtgtttcatttatgtgcggtctccaatttaggacttttccatagtgccaaagccatacatattcagtagaacatcaataaattacatcagaaattcaacactttattataaaacgggcttcgtgttagataattttgctaaacagtaggctactgtaagtgttctgagcatatttaagacaggctagcattttcaatttacaatattttcaactgatagtaggtttattgggatgtaaccctatgataagttgagaaacatctctttttgtgtgtctactgtgatttaagtatttttaatcatcagccaagcattgttagtagtataaatatgattaataaaaatgtgcatggctttcctgaaggagattttttaattgcctttgagaataaactcataaggtctaccaagaaaataaatgttatgatgtttcagttggcttctaggaaataattaaattagtgatattttaatcaggttttactatctgctaggccccttccatcaattcttattaaattctcaaaataatcctttgaaaagggagtataattacattttacagtgactcgaaccttacccaaacaagtgggagagccaggagccaaactatcaggctccaaagcttttttttagtgcatcacaatgacaaaggggtggttttctttcacccaagaatgtgctttcctggaaatttttctagatagaatattatgtaatttgttttgaaggttttttttcctgactgtcttaaagattatgctagctttagaacacatgcaaacagctgcagctctgtgattaaaatgttaaggtcactagaatagtgttaggaaaatgttaatagataattctgctgcctctattagcttatgtatgatccttaatagcattgcttccccttcagtttctatttaggaggtgaagaatcttttaataaggtagaaagttgctttatttaaatttgtactgtagaatgtttgtgatacagtatttgtaaaattgatatgaaaaataatttctcaaagtctattgtttgatctagttattttaataaaggaactctagaagtttcaagtggccagtgaagtgtgaggaatagagagtaaaggaaataattaataatggtgaccctctgttaagtggtttactttttccattaatataaatttcatttggaaagattaaaaaaacaagtttgattgaacttgataaatcagaaatatttaccagctttgtcgatggtgtattcttgaaaaatgtttggttttctttcaggttgacttatatccaaaattctacaaattcttagctatgttataaatgtagaaagaagtgaaaaatcaaaatatgattatgaagattttcttctcttccgagtacaaagctctgctaaataaggatttacccaagatgcccacatccacatacttatgtgtcagtgctttggagaattaactttgactttattctactggaagtatagattaacactgtgctttctgggattttgcttttcatgggttgctgatttttaattttgctaaataagcacatagtccgtgatcaccagcatcacctgccctctgttcctcccccgtcccccagggataagaacctgttatccaccatcagtaacattttatgaaagatctacttatttgtctgttttgcagacattttaaaattcgtaaagtgggatgcttctttaatttaaatacatttagcttcatgaaaaactcactacacagttcttgttcaagcattattgggaaaccaccagagggcactctcacccagggcttaatttgaacatctcgcccaaaagtgacttttaaaagcacttaattagcagagaatttggatgttcattagttgagaatgactagtagaataaatggtaatagtgaaattaagtgctggaatattctgagtagaccaatagcaaaaactgatttttttttttttttaaagaaaaggtcttgctgtgtcgcccaggatggagtgcagtggcacaatcacattgcactgcaacctcaatatcctgggctcaagcaatcctcccaccgcagcctcccgaattgctgagactacacatgtgtgctaccatgcctggctaattgttttaattttttttatagagacggggtttcgccatgttgcccaggctggtcttgaactcctgggctcaaagcgatccacccaccttggcctccaaaagtatgggattacaggtgtgagccactgtgcccagccttattttttttttttaagataatattgttaacattttgtatttctctgcataaatatatttcaaaaataaaaatagagctcataatatatgctgttttgtaatgcttttttcacttaataggaattttttccgtatcattaagtactctgatttaatgggtgcatattattctataatctggcttgtcataatttaattaactccctgctgttagacaaaatcattgtttctgttccatcttgtgaataatgctgttattaacatcctggtggattattaccattttctttttttattttttttttaaatttatttcttcttttttttttcttataatctcatcagaagctggcaagatcattactgttttcttagatttgtttctgtaagtgcaatcgttgaatcaccatgtccggcatccatgtttatgtacatttttaaagtcagtggtttaaactgtatactttttgggttttggagatggaggtttgctctgcccaagctggaatgcaatggcgcgatcttggctcactgcagcctccacctcccgggttcaagtgattctcctgcctcagcctccttaagtagttgggattacaagtgtgcaccaccatactcaggtaattttgcatttttagtagagacagggtttcaccatgttggtcaggctggtctcgaactcctgacctcaagtgtccacacaccttggcctcccaaagtgctgggtgggattataggtgtgagcctccatgcctggcctaaactgcatactcctaacatcagtatatagaaatattttctctttagttctattaaaattttaaaaaatctttatcaatttagtaggcaaagactggaaaatgttttaatttgatcagccactttaatgtatgtctcatttcaaagcatataaagtatacaagtttcaggtcctagcttaaacctataagaggccttattatgggcttatttcctttgcagccctttaccataatgtgtttcttctacctcccctgcacaacattgtttatatgccccctaaaatgtaacttctttagattctgttgttacgtgcaacactgtatatctctccatagcacttaatcagagtttgtaattaggcatctttttgtgtgattatttggtaaatgtccatatcccctactagcctataagctccatgacttctaggtaccctgtctgactacgtgtatcactgtttctaccgcctaacattgcctagcacattcattgcttcacaggcatctgaatatggttttataaaatacattgctctagtgcacaggattttaagctaaggatttcatgaatgggatttggggtaggggcatctatgaaattcctgaaattgtgtagaattttgagaatatgtgttttcctggggatagagtatgtagtttctcagcaactcattacagtctgtcacatcatgccctaattctacttgcctgtagctaaacacctaataacattagaactgaaatgatagtgatatgcaagatagcacgtgtggtttccacatattctaagaggcatcttcaattagattccaaaaatttttaagaaaaaaagatataatgtgccatcattttggatggttctgggcacttcaggtaaacccttactcaaagaatactttttcagtttcaatgtgtatttttaaaatttccagaagatgagttgaatatcagcccacaaacactggtagtaagcaaactattttatttgctaaaggcataaataaatgtctcctttgcttttaggcaaagggaatgcttcttcagatttttttttttccccagaagttcaaaataacttgctcatagtcttcccaaaataattttcaaacattctaacaccaaagaaagatactcccaattgagctcagccatcagcctcctactattttttaatgtgctgtttaaccttgtgaatgtgagaatattttgaatgcactgggaaggaatactcaggaacaatatgtaatgtgctttctagttttgcacaaaggcattcattttgatttagtaacaacctcatacttacatagcatatccttctgcagaaatgcttcacagccatgactgcttgaattcttgtcatgttgcttgtaaatgagctcctgtttttagatggagaaatggaggcagagtctcacaattacatgtgagaatagcaagtagaaccttatgattacttctgagtcttttttttttttttttttttgagatggagtttcacttttgtcacccaggctggagtgcagtacagtggccagtggcatgatctcagcccactgcaacctccgcctcataggctcaagcaattctcctgcctcagcctcccgagtagctgggattatgagcgtgcaccagcatgcctggctgattttttgtattttcagtagagatggggtttcaccacgttggccaggctggtcttgaactcctgacctcaggtgatctgcccaccttggccccccaaaatactgggattacaagggtgagccactgtgcccagcctcttctgagtcttcaattcagcaagaatgtctcttttttttttttttttttttttgggacagagtcttgctcttgttgccttggctggagtgtagtggcacattctcagctcactgcaacctccacctcccgggttcaagcgattctcctgcctcagcttcccaagtagctgggactataggcatgcaacaccatgtccggctaattttttgtatttagtagagatggggtttctccatgttggtcaggctggtctcaaactcctgacctcaggtgatccacctgctttcgcctcctgaagtgctgggattacaggcatgagccaccacgcccggccaagaatgtcttttctttataatgttgtctctaagcatgtaatcttttcggcaaattttattaagcacctatagagttcaagccactgtgggttcaaagatagccctcattcctgattgacaaagtatcttgctatgaccatcccttctttcccctctagtcaaaattagtctcttcttcactcataatgcaaagtacattggattactattatgccacttacttgaataattgtcttgatgagtaatatatgtagtcagtaacatggttaagtgtggcaatttggattgatcccattggacttttcaattgctgcatccaggtgtaattaccataagagcatagaagatagaatcgtaaagctgaaagacatcttaaagatgatttttggggactgatttggaaacagatccaaagacactaattgacttgcccaagatcacagattgtggcagaaccaaccaatgtcttttttaaacattaaggacatcttatatgtatatttatgcatatacatactgatgaaatgtgcctttagcaatagatgtgtccagtgatgtactaatgaagatttaacaactggttctaacttgtaatgtttgccagtttccatgactgggtcttacaagttgttgtgcactgactccatcattccactggatgtgcccctgaaatcatatatttactactaaaaccattagattgtttccttgttccagttatgcattcagagacactccaccttattttctgattacatttgcagggagaaataactccttacttgtcagtttcagccttcacttttagtttctttttcttttcctttttccaacccagtataccttagaaactttcagtttcttttaaggatttaataacttgcttataagtgtttaaaatgacttaatgggttctatcttttaagggaactttggatgaatccttgaatatcagttatctattgccaattaacaaatcaccccaaagctcattggcttaaaacaacaatctttcattagtttgcgttcttccaggtaattcttatagtctggatccagctcagcttatcttggctggacttgcccatgcagctgaggtcactagttgggttgttgaggctggctagtcctagatggtgtcactcatatgtctggtattgagtgactgtcacctggggcattagggggactgtgtctctcatcatccagcaagctaggcctggattcttcacatggctttaggatttcaagagtatgagattggggctgggcatgatgactcacacctgtaatcccagcactttgggaggccaaggttgggggatttcttgagcccaggagttcaagaccagcctgggcaacatagtgagagcccatctgtaaaaaaaaaaattttttgagatggagtttcgcccttgttgcccaggctggagtgcaatggcgcaatctcagcccaccagaacctttgcctcttgggttcaagcgattctcctgcctcagtctcctgagtagctgagattacaggcatgagccaccacgcccagctaattttgtatttttagtagagatgggtttctccgtgttggtcaggctggtcttgaattccccacctcaggtgatctgcctgcctcagcctcccaaagtgctgggattacaggtgtgagccaccacgcctggtcttctacaaaaaaattttaaaaaattagctgggggtggggagggtggggtggtgctgcatgcctgtagtcccagctatttgggaggctgagatgggaggattgcttgagcccatgagattgaggctgtagtgagccatgattgtgccactgcactctaggctgggcaacagaacaagcacctgtatcaaaacaaacaaaaaagtgcaagattggaagcttcgaggcttcttgaggcctagtctcagaactggcacaatatcacttcataaggctatctcagattcaagggagtaagaggagagatgctacctattaaaaggagaagcagcaaatactatggccattctcttcacaatagttgtcaccaaaacgtaatcgatttgtttatgggtttacattgtcatgtctccacaggacaatgcacatggtatgtttgtcagaacccagttggagttttgtttcccagcatccaaaggaaatccctaactttcattttttcttcccgtaagcagccccgaacacttacttataagccatctctacctgaattagcaatcatggataagctcaataactgatcatttccttatcagtttaaaccatatatattttaacactgtctctttttcacacacactagttagctaagaatgagctggggggctgggcgtggtagttcacacctgtaatcccagcactttaggaggcggaggtgggcggatcacttgaggtcaggagtttgagaccagcctagctaacatggtgaaaccccgtctctactaaaaatgcaaaaattagctgggtgtggtggcaggcatctgtaatcctagctactcaggaggctgaggcaggagaatcccttgaacccaggaggcagaggttgcagtgggccaagatcacaccactgcactccagtctgggtgataaaacgagattccgtctcaaaaaaaaaaaaaaaactgccaaaacgctttttgcaaagtggttgtaccattttatattctcaccaccatgaatgaaagttccaattgctatattcttgccctcatttgataatatttttagttttagccattctaatggatatatagtaataatttgatggttttaatttgcatttctctgatgatcaataacattaagttttgattcaggtacttgttgggcactcatatctttggtgaaatatctgttcaaatcatttgctcttttttttttcttagcacttaaaaaagactttttgccaggcacagtggcacatgcctgtagacctagctactcaggaggctaagacaggaggatcacttgagtccagaagttctgggttgtagtgagctatgtcaatcaggtgtttgcactaagttcagcataaatgtagtgacctcctgggtcactgggacccagagttgcctaaggagcgtcagaagtggagcaggtcaaaactcctgtgctgatcagtagtgggatcacacctgtgaatagccactgcactgcagcctgggcaacatagtgagatcctcatctcctgaaaaaaaaaaaaaactttagtttttaaaagtagttttaggttctgagcaaaattgagaggagggtacagaaataacttatatatcctcagtgctcccctcccccatgcctccctcatcaccatcccccagcagagtggcacattggttacaattgataaacctacactgacacatcattatcacccaaagcctattgtttccattagggttcactcttggtgctgtacaatctatgggtttgaacaaaggtacaatgacatgtatccatctttatagtcatgcagagtctacactgtcctaaaaacccttggctctgcctcttcgtcgtgtcctccccactgacccccggctaccactggtcttttcactgtctccgtaagtttttcctttttcagaacgccatatagttggaatcataaagtatatatagccttttcacattggtttctttcactggataatatgcatttgtttcctctatgtcttttcacagtttgatagctcatttctttttagcatcgagtaatactccattgtctgggtgtacaacagtttatccattcacctgctgaaggacatcttggttgattgcttccaagttttggcaattatgaataaaattgctatagatatccatgtgtaggtttttgtgtccatttaagctttcaactcctttgggtaaataccaaagagcacaattgttggattgaatgctaagagaatgtttcgttttgtaaaaaaccaccaaactgtcctacagagaggctgtaccattttgcattcccaccagcagtgaataagggttcctattgctcaacatccctgtcagcacttggtgttagtgttctgaattttggccattctaaaaggtgtgtagtggtgtctcacttgttttgtgtttttctctgctcagacagctcatccacatcacatttattttaatttgcatttccctgataatatgtgatatggaacatctatttactcattattttttcttcttatgattgaagttataatatttctttaaatattttggataaatcttttgtcagatatatgcactggaaatatttttatgggggaccagtgttaagattagatctgtttaaagagaaaggagagaaagtttcaggcagggaatgcaatcgatgtgaaggtttggggtaatttgtttcatttatctttaacaccatgttatggatggcaaaataacttcactggctttttttatcaagaaaagacttaccttttctgaatgcaacagtattagtaaacctaatggtgacaataaaagcgattctgaataaatgaaaaccaatagattgttctagttttactcataaatataattcttcatatactgagttcagttttttagccataaatgaagacatgggaaaaccataacatgttatttgctgagaagttctggcaaatgaagcaataaaataatcaaaactaaatcaacatttaaatacagaacataaagagataaatccaaaaccagaagatctctttgaaagaaaaacctaagtaattaaaaaactgaaagcacagatattcattatttcacaaataaacgttaatgctttttagacatctttaagcaactttagattgctaaaactaaaaaatgcaattaagacaataatcttatatatagacaataattgtcttaataataatcagcatcaaagattcttagaaatgttgggagactgtgtggcaaagaaagtacttcaattaccagttaccaacacacaacaatttgaaatatccaggaagatcaacccatagaacaaagaaagctaataaattaccttttcttgcaattggtttgatgtaccattaatatatagatattactaatatggcaattagtttatatgctatttgaatatgatagtaatatgaaggaagattctcttttttccacttcattgccaacaaacagctaactctaaacaacagtaaagtgtggaataaattactttgttaattaatgtggtttgaagctttgtaggaatccaattggatggatagcagcagtggtaagagaacattccggaataattacctaaattaaggagcttgccctagaatgtaaatcaacctactatatctttttatttgaaaaagtcttggtagaaaaagcatatcaactgaactgtacagtgtgttcagtgacttagtaaagaacataacttgtgtaaaggctaatgcaataagtttgagattgttctctttatgtaatagtttggaaaacaaacaactgtgattacatttagagatatgatgattatctagagggaaagttctgttgagcatatttgaacatttaattattgctgcaagaagccagtttggtcccagctttataaagatatacattgggctgggtgcggtggctcatgcctgtaatcccagcactttgggaggccgaggcaggcggatcacctgaggtcagaggttcgagaccagcctggccaacatggtgaaaccccatctctactaaaaatacaaaaattagctgggcgtggtggcacacacctgtattccttgctactcgggaggctaaggcaggagaatcgcttgaacccaggaagcagaggttgcagtgagccaagattgtgccactgcacaccagcctggataaaaagagtgaaactctgcctcaaaataaaataataaaatgaaataaagatataaattggccagctagagttacctgaagttactatcttcaattatctgaagacagttctgatagcttcagaattctttcatacaaggcaggaatgcaacttgttttttaatggcagataaaatcaaagagcaaaagcaaaaggtagaagcttgaaagaccagagttgctacagattgttattacatgttccataatttaacaattgtcattgaagttggtgattgtcttgatattgcacatctgtaagaagtaatcaaactattgtgaatttgatagaatgctttaagttttattttccaacaaaagaatgtctacatacggcaaattcatagatctggaatccatttatgtcatcaaaagaggatttaaatttaattgtaagcttatatgatacattgttctaactggcaactaatgaaggattaaaaatgaattttgaaaataccacaccacttgcttcattttggataaaagttaaaagtgaatattctgagtatgctgaaattagtttaaaaacttttttttcccattccgaccattatccctttgtaaatctggtttcatcttatgaataatattttttaaaaaccatggaaacagtttagatatacatcaatccatgaaagtagtagtattgtcaatctaccctggattacatattttaacgagaaagaaaccagctcatttgtgacatttagaattttttttttttttttttttttttgagagagagggtctcattcattttattgcccaggctggagtgcagtggtgcaatcgtagctcactgtaaccttgaacttctgggctcaagcaatcctctcacctcagcctgcagctggagcttcaggtgtctgccatcacgcctggcaaatttattttttgtagagaccaagtctccttgtgttacccaggttggtatcaaactcctggtctcaagtgatcctcccatctcggcccccacaagtgttgagatgacaggtgtgagccaccttgcttgacctaaaaacttttgaatattaatatgcattgtgtttattcaaagtatatctaatggtctaataaacagaatcactacttcaattataatcttcagttataattgaagaatgacaaaaagttgagttatagaaattatattaatcttaaattcacattttcagtgaaagtttttaaataattttttctctttccgttttatgtgtgttccaattctatttattgaaatttaattttatatccattaacataattaaaaattggggcttttaaaaaatgtttttcattctactaatttcattttataatttataaaagtactagaccacaatggattaaagaactatcctttcatcacagatagttcaatgactcctgtttttttttagaccgagtcttgctctgtcaccccagctggagtgcagtggtgtgatcttggctcactgcaacctccgtctcccaggttcaagcaagtctcctgcctcagccttccgagtagctgggactacaggtgcccaccaccacacccggctaatttttgtatttttagtagagacggggtttcaccatgttggtcaggctggtcttgaactcctgacctcatgatctgcctgcctcggcctcccaaagtgctaggattacaggcgtgagccaccatgcccagccaactcctgttttatagtgtactttctggaatattattcagctttctcttgaattcttttagtaactaggagttcactacgtttccatggacctaactccaataatgattggacagttttctccctctgctttttctttctttctttcttttttttttttttttttttgagatggcgtctcctctgtcaatctcggttcattgcaacctccacctcccaagctcaagcgattcttgtgcctcagcctcctgagtagctgggattacaggcacccaccaccacacctggctaatttttttttttggtagagacagggtttcaccatgttgaccaggctggtcttgaactcccgacctcaggtgatctggctgccttggcctcccaaagtgctgacattacaggcatgagccactgcacctggccattattggacagttttaatggaaagtgtttccttatattgagtggaaatcagtctgcttatggtttataatcctcagacttgattctccccctgaatctatatgaaataaatttactcctatttgaaaatatttgtcatattccttcttatttttctttaagctttattttttcttattatccatatgacatgtttccagaactctcccttatcctgattgtcctcctttagacacatgcttttaatgatatatttcttaaaatgtattacccaggacaacatatttttttttactgtggacagtatacttttacgaatggtgccaataatgcattacattttttagcagtcatgtcatcctcttgatttgcattgagtcatcatttcttaagagggaatcaggatatcaaaatagtctccaaactcagctgattccttctgcagatacactctccacccttcttgattccttttcgggagaaaagaaaaaagtttattttcattgctaacctcactgatttttaattttaccatttaaatgttagtaacagctggtaatgtaaccaaagaagatttttggcaggggatgatgcattcagagccttcactctggctacagggagaccatggaggatgggctggaacggaagcacgatggactcctgggcacaccgttaagtgactgatggagtcattcagctgacaaatgataatggcctggattaaggaaggagaagaggggaccaagaaatgccagagatacataggaagtaaaaattaataggccttggcaactattttttttttttttttttgagacagagacttgctgtgttgcccaggctggagtgcagtggggtgatctcggctcactgcaacctctgcctcctggattcaagcaattttcgtgcctcaacctcctgagtagctgggactacaggtgtgcatcaccattcccaggtaatttttgtatttttagtatagatggagtttcgccattctggccaggctggtctcgagctcctgacctcaagtgattcgcccgcgtcggcctcccaaagggctgggattacagacatcagccactgcacctgggttggcaactaatttacacggaatggcagagagtgattaatgaaaaagcggggagaaaagctgctcttgacatctgaaagctgacttggcattcacagctaggctatgttattttcctattgggcataagtctcacagaataccaacattaaacaagatgactctgaaaccttaataaagtgagaaaaaacaagtccactttgtaattttgtctaagcacaggcaaaaagagggtcatggtgccatccagaaaataccaaaaatcaccctctctcagctaaaatgagcaactgctactttaccagtgacagctttgtcccagctctagtctgccttccctatagagaagatgtattgagataatcatgaaattctccttctttctgatagtatccaatctggagcaaacccgtttccttagaccctctcccaatcccaaattctatactaggttcttctaaacactctcatactgagacaccccatggttccctatgttgtgtgttcttctttgctgcaatgagtaataaactcaacttgtttaact

SEQ ID NO: 154481 - DNA, 725 bp, Homo sapiens
  Payload ID: 10364
  Gene Symbol: MRPL42
  Gene Name: mitochondrial ribosomal protein L42
  ENST ID: ENST00000551396
  CDS Start-End: 113-274
tgagaagccgtcaagcaggagtagaaattggtatgcttagaagcagattctaaaagcagtttctcttcagaacatcttttttcataccacttgataagcatcttgaaacaccatggctgtagctgcagtaaaatgggtgatgtcaaagagaactatcttgaaacatttatttccagtccaaaattcgggcgtacatgtgcagatggagctttatattgtgtttgtcataaatctacgtattctcctctaccagatgactataattgcaacgtagagcttgctctgacttctgatggcaggacaatagtatgctaccacccttctgtggacattccatatgaacacacaaaacctatccctcggccagatcctgtgcataataatgaagaaacacatgatcaagtgctgaaaaccagattggaagaaaaagttgaacaccttgaggaaggacctatgatagaacaacttagcaaaatgttctttactactaagcaccgttggtatcctcatggacggtatcacagatgtcgtaagaatctgaatcctccaaaagacagatgatgcggaggttcctgggggaatcaaagagaaatgtgcctcatttgccatttgagaaaatgcagtctggtgtattcagtaatatatagtaaagtaataatgataaaatatcttttcatatattagaatgtgtacttttatataaagtaattctggatttgacattc

SEQ ID NO: 154482 - DNA, 701 bp, Homo sapiens
  Payload ID: 10364
  Gene Symbol: MRPL42
  Gene Name: mitochondrial ribosomal protein L42
  ENST ID: ENST00000547098
  CDS Start-End: 135-602
aaacaagatggcgggttcgtggtgagaagccgtcaagcaggagtagaaattggtatgcttagaagcagattctaaaagcagtttctcttcagaacatcttttttcataccacttgataagcatcttgaaacaccatggctgtagctgcagtaaaatgggtgatgtcaaagagaactatcttgaaacatttatttccagtccaaaatggagctttatattgtgtttgtcataaatctacgtattctcctctaccagatgactataattgcaacgtagagcttgctctgacttctgatggcaggacaatagtatgctaccacccttctgtggacattccatatgaacacacaaaacctatccctcggccagatcctgtgcataataatgaagaaacacatgatcaagtgctgaaaaccagattggaagaaaaagttgaacaccttgaggaaggacctatgatagaacaacttagcaaaatgttctttactactaagcaccgttggtatcctcatggacgaggcaaggtctcactcactgtgttgcgcaggctgattttaaactcctggactcaagtgatcctcctccctcagctgggattgtaagaatgagccactgccactgtacttttaaatttacatataatttagctaaaatgaaatagtacttctttttttctttattttaatgggggaatttaacca

SEQ ID NO: 154483 - DNA, 692 bp, Homo sapiens
  Payload ID: 10364
  Gene Symbol: MRPL42
  Gene Name: mitochondrial ribosomal protein L42
  ENST ID: ENST00000548545
  CDS Start-End: 73-459
aagcagattctaaaagcagtttctcttcagaacatcttttttcataccacttgataagcatcttgaaacaccatggctgtagctgcagtaaaatgggtgatgtcaaagagaactatcttgaaacatttatttccagtccaaaatggagctttatattgtgtttgtcataaatctacgtattctcctctaccagatgactataattgcaacgtagagcttgctctgacttctgatggcaggacaatagtatgctaccacccttctgtggacattccatatgaacacacaaaacctatccctcggccagatcctgtgcataataatgaagaaacacatgatcaagtgctgaaaaccagattggaagaaaaagttgaacaccttgaggaaggacctatgatagaacaacttagcaaaatgttctttactactaagcaccgttggtatcctcatggacggtaagttttcttttcttttcttcaatccctactacatacagtaaaggaacacatggattttcttgcaataacaaacttctgaagtggtgttttgcatgaggaaattaaccctaagtagaatcacctactatgttgtactttttttttcttttctgagacaggatctcgctctgtcacccaggctggagtgcagtgccacaatctcagctcactgcagcctcaacctccagtgctcaa

SEQ ID NO: 154484 - DNA, 747 bp, Homo sapiens
  Payload ID: 10365
  Gene Symbol: MRPL43
  Gene Name: mitochondrial ribosomal protein L43
  Uniprot ID: Q8N983
  ENST ID: ENST00000299179
  CDS Start-End: 52-660
cccgcccccctctcctcgctgcttaggctccgcggcctccaagctgtagctatgacggcgcgcgggactccgagccgcttcttggccagcgttctccacaacggactgggtcgctatgtgcagcagctgcagcgtctgagcttcagcgtcagccgcgacggcgcctcgtctcgcggcgccagggagttcgtggagcgggaggtgatcgacttcgcccgacggaatccaggggtcgtaatatatgtaaactcgcgtccgtgctgcgtgcccagagtagtggccgaataccttaacggggctgtgcgcgaggagagcatccactgcaagtcggtcgaggagatctcgacgctggtgcagaagctggccgaccagtcgggcttggacgtgatccgcatccgcaagcccttccacaccgacaaccctagcatccagggccagtggcaccccttcaccaacaagccgaccacgttccgcgggctacgcccccgagaggttcaggatcctgccccagcccaggacactggcctgagactgtctgcagttgcaccgcagatcctcctgcccggctggcccgacccaatatcagttcagtcatccgatcttccttggggaaatacccattaccgtcctgaacccttgtcatccactacttggctataagctccagaagtgacaagacacttcacatcttaaatatgtttcctagtttataattcatttgggcagtaaatgtttgttgagcactta

SEQ ID NO: 154485 - DNA, 2134 bp, Homo sapiens
  Payload ID: 10365
  Gene Symbol: MRPL43
  Gene Name: mitochondrial ribosomal protein L43
  Uniprot ID: Q8N983
  ENST ID: ENST00000318325
  CDS Start-End: 55-702
agtcccgcccccctctcctcgctgcttaggctccgcggcctccaagctgtagctatgacggcgcgcgggactccgagccgcttcttggccagcgttctccacaacggactgggtcgctatgtgcagcagctgcagcgtctgagcttcagcgtcagccgcgacggcgcctcgtctcgcggcgccagggagttcgtggagcgggaggtgatcgacttcgcccgacggaatccaggggtcgtaatatatgtaaactcgcgtccgtgctgcgtgcccagagtagtggccgaataccttaacggggctgtgcgcgaggagagcatccactgcaagtcggtcgaggagatctcgacgctggtgcagaagctggccgaccagtcgggcttggacgtgatccgcatccgcaagcccttccacaccgacaaccctagcatccagggccagtggcaccccttcaccaacaagccgaccacgttccgcgggctacgcccccgagaggttcaggatcctgccccagcccaggacactggcctgagactgtctgcagttgcaccgcagatcctcctgcccggctggcccgacccaccagacctccccacagtggatcctatctcatcctcattgacctctgctccagcccctatgctgtccgcagtttcttgcctcccgattgtccctgcactgaccactgtgtgctcagcgtgaaggctgcatagaagtgtgtacggcttgaggtttcagcatccaggctgcagaccccacgcagtgtctcatacagtggaatgtggcagatgagacgggctttcaggaaggaagtccacttcttctgcaggatcttcttccctcccaggtctccctggggaggtagaggcacgggataaggggccagggtcagaggtccagcctctatacccgtgccccaacgtcagcccaatccaccttgcagacacgagccacacgggccacacggtgactgctgcggctctgagtgaagctgccagagccctcctcagtggcacgctccgtgaagaagtagtacaccttgtcatcatcacccactgcactggccttgctctcccgcacgaggacggagaacacaaactccgcatctgtgggtcaggcagtttgagaggcttttgagacaggctggggattcctttccctcactctgaggctgacccctcacttgacaacacacaggaatggaatggacaggctcacctggggatttgggggtggggtggtcagctggccaagggagtaaaaatgaagaaatagtcccctaccccccatcatcctgtgcctcatcctcctaaccattgagccaatgcattggtgtctcctcagttctcagggagtgtgggtggcggctccggcggatgtcaggaatgctccggaattcatacctagtggctgtgtagaggcctccatctggcgtggggatattccaggcatgagagacatgtcatattcaacagggcacatgacatatacatggtggcaggtcctagagatgagatccacatcctaaaaataccatgtctgtgatagggaagaaggcctgctcaccaatgatgaggcctgtgaagccacgggctgggtcataaggacacttctccttcccctcctcgaagctggttggcaaggtgaaggcctcagcatcctagggaacaaggaaccagcagtaagtggttccgaagacaggcagggacagtggctcaaagtcagatcagtctggggtcagggatcagcgatcagggataggggcaggttgtatggcagatgcacctgacagcaataacttaagcatcccctgagaatgaccttatggcctcaaaacaatgtatgtttggagttccaaatctgcaagtggccaacctagagattcactccttatctatgaagaacatctgagcccctagcccatcctgtggaacacatgctgtccaggggatcaaggccctttgttttgggttaaatgaagtttgccaggtggaggtgattagggggaggatgctaagtgaaaatgctataaaaactgcatggtttttacaaaggggaatggttctccagtgcagcccgccgccactggagtgccctgtatggaagtccccttaataaaccatccgtctccttc

SEQ ID NO: 154486 - DNA, 1010 bp, Homo sapiens
  Payload ID: 10365
  Gene Symbol: MRPL43
  Gene Name: mitochondrial ribosomal protein L43
  Uniprot ID: Q8N983
  ENST ID: ENST00000318364
  CDS Start-End: 73-552
ccggaagcctcgaggtttagtcccgcccccctctcctcgctgcttaggctccgcggcctccaagctgtagctatgacggcgcgcgggactccgagccgcttcttggccagcgttctccacaacggactgggtcgctatgtgcagcagctgcagcgtctgagcttcagcgtcagccgcgacggcgcctcgtctcgcggcgccagggagttcgtggagcgggaggtgatcgacttcgcccgacggaatccaggggtcgtaatatatgtaaactcgcgtccgtgctgcgtgcccagagtagtggccgaataccttaacggggctgtgcgcgaggagagcatccactgcaagtcggtcgaggagatctcgacgctggtgcagaagctggccgaccagtcgggcttggacgtgatccgcatccgcaagcccttccacaccgacaaccctagcatccagggccagtggcaccccttcaccaacaagccgaccacgttccgcgggctacgcccccgagaggttcaggatcctgccccagcccaggtgcaagcacagtgaagagttgccccaccaactgcagccccaggctttggactgttactccggtaaaggtggttcttcccctttgggattccaagcccaggcaaatggaacccatcaatgggcaagttgacagaggttctgcttgggataatgaagagctgcctgtttctttccagtgcctgcttctgggggcagtgaccttgtgaaccactcatttttatgcaagtggcatccctaaaacctgagatgaggaagacttcaagggttttacagggcccttgttttttaaatccaaattgataataatgatctcaaaacacagtgagaggtctgaaggctggcttctgaagaatccctgatgtcttattggaacaaccactgagctacggagagctctgctgtgatgggctaggcactttatatctgtgtgaatacagatttataaaacaggttaataaacttatccaaggtca

SEQ ID NO: 154487 - DNA, 894 bp, Homo sapiens
  Payload ID: 10365
  Gene Symbol: MRPL43
  Gene Name: mitochondrial ribosomal protein L43
  Uniprot ID: Q8N983
  ENST ID: ENST00000342071
  CDS Start-End: 73-780
ccggaagcctcgaggtttagtcccgcccccctctcctcgctgcttaggctccgcggcctccaagctgtagctatgacggcgcgcgggactccgagccgcttcttggccagcgttctccacaacggactgggtcgctatgtgcagcagctgcagcgtctgagcttcagcgtcagccgcgacggcgcctcgtctcgcggcgccagggagttcgtggagcgggaggtgatcgacttcgcccgacggaatccaggggtcgtaatatatgtaaactcgcgtccgtgctgcgtgcccagagtagtggccgaataccttaacggggctgtgcgcgaggagagcatccactgcaagtcggtcgaggagatctcgacgctggtgcagaagctggccgaccagtcgggcttggacgtgatccgcatccgcaagcccttccacaccgacaaccctagcatccagggccagtggcaccccttcaccaacaagccgaccacgttccgcgggctacgcccccgagaggttcaggatcctgccccagcccaggatgcggctgagttcctcggcgaaggagcagggccctgctggtactccattgttgctctgcctcagaagcacatagctattgccattcatcctccgcagccggctgggcagtgccaccaagccattggacactggcctgagactgtctgcagttgcaccgcagatcctcctgcccggctggcccgacccaatatcagttcagtcatccgatcttccttggggaaatacccattaccgtcctgaacccttgtcatccactacttggctataagctccagaagtgacaagacacttcacatcttaaatatgtttcctagtttataattcatttgggcagtaaatgtttgttgagcactt

SEQ ID NO: 154488 - DNA, 798 bp, Homo sapiens
  Payload ID: 10365
  Gene Symbol: MRPL43
  Gene Name: mitochondrial ribosomal protein L43
  Uniprot ID: Q8N983
  ENST ID: ENST00000370234
  CDS Start-End: 41-535
ctcctcgctgcttaggctccgcggcctccaagctgtagctatgacggcgcgcgggactccgagccgcttcttggccagcgttctccacaacggactgggtcgctatgtgcagcagctgcagcgtctgagcttcagcgtcagccgcgacggcgcctcgtctcgcggcgccagggagttcgtggagcgggaggtgatcgacttcgcccgacggaatccaggggtcgtaatatatgtaaactcgcgtccgtgctgcgtgcccagagtagtggccgaataccttaacggggctgtgcgcgaggagagcatccactgcaagtcggtcgaggagatctcgacgctggtgcagaagctggccgaccagtcgggcttggacgtgatccgcatccgcaagcccttccacaccgacaaccctagcatccagggccagtggcaccccttcaccaacaagccgaccacgttccgcgggctacgcccccgagaggttcaggatcctgccccagcccagtgcctgcttctgggggcagtgaccttgtgaaccactcatttttatgcaagtggcatccctaaaacctgagatgaggaagacttcaagggttttacagggcccttgttttttaaatccaaattgataataatgatctcaaaacacagtgagaggtctgaaggctggcttctgaagaatccctgatgtcttattggaacaaccactgagctacggagagctctgctgtgatgggctaggcactttatatctgtgtgaatacagatttataaaacaggttaataaacttatccaag

SEQ ID NO: 154489 - DNA, 866 bp, Homo sapiens
  Payload ID: 10365
  Gene Symbol: MRPL43
  Gene Name: mitochondrial ribosomal protein L43
  Uniprot ID: Q8N983
  ENST ID: ENST00000370236
  CDS Start-End: 41-520
ctcctcgctgcttaggctccgcggcctccaagctgtagctatgacggcgcgcgggactccgagccgcttcttggccagcgttctccacaacggactgggtcgctatgtgcagcagctgcagcgtctgagcttcagcgtcagccgcgacggcgcctcgtctcgcggcgccagggagttcgtggagcgggaggtgatcgacttcgcccgacggaatccaggggtcgtaatatatgtaaactcgcgtccgtgctgcgtgcccagagtagtggccgaataccttaacggggctgtgcgcgaggagagcatccactgcaagtcggtcgaggagatctcgacgctggtgcagaagctggccgaccagtcgggcttggacgtgatccgcatccgcaagcccttccacaccgacaaccctagcatccagggccagtggcaccccttcaccaacaagccgaccacgttccgcgggctacgcccccgagaggttcaggatcctgccccagcccaggtgcaagcacagtgaagagttgccccaccaactgcagccccaggctttggactgttactccgtgcctgcttctgggggcagtgaccttgtgaaccactcatttttatgcaagtggcatccctaaaacctgagatgaggaagacttcaagggttttacagggcccttgttttttaaatccaaattgataataatgatctcaaaacacagtgagaggtctgaaggctggcttctgaagaatccctgatgtcttattggaacaaccactgagctacggagagctctgctgtgatgggctaggcactttatatctgtgtgaatacagatttataaaacaggttaataaacttatccaaggtcaca

SEQ ID NO: 154490 - DNA, 824 bp, Homo sapiens
  Payload ID: 10365
  Gene Symbol: MRPL43
  Gene Name: mitochondrial ribosomal protein L43
  ENST ID: ENST00000370241
  CDS Start-End: 14-568
ccaagctgtagctatgacggcgcgcgggactccgagccgcttcttggccagcgttctccacaacggactgggtcgctatgtgcagcagctgcagcgtctgagcttcagcgtcagccgcgacggcgcctcgtctcgcggcgccagggagttcgtggagcgggaggtgatcgacttcgcccgacggaatccaggggtcgtaatatatgtaaactcgcgtccgtgctgcgtgcccagagtagtggccgaataccttaacggggctgtgcgcgaggagagcatccactgcaagtcggtcgaggagatctcgacgctggtgcagaagctggccgaccagtcgggcttggacgtgatccgcatccgcaagcccttccacaccgacaaccctagcatccagggccagtggcaccccttcaccaacaagccgaccacgttccgcgggctacgcccccgagaggttcaggatcctgccccagcccaggacactggcctgagactgtctgcagttgcaccgcagatcctcctgcccggctggcccgacccaacacgagccacacgggccacacggtgactgctgcggctctgagtgaagctgccagagccctcctcagtggcacgctccgtgaagaagtagtacaccttgtcatcatcacccactgcactggccttgctctcccgcacgaggacggagaacacaaactccgcatctgtgggtcaggcagtttgagaggcttttgagacaggctggggattcctttccctcactctgaggctgacccctcacttgacaacacacaggaatggaatggacaggctcacctggggat

SEQ ID NO: 154491 - DNA, 884 bp, Homo sapiens
  Payload ID: 10365
  Gene Symbol: MRPL43
  Gene Name: mitochondrial ribosomal protein L43
  Uniprot ID: Q8N983
  ENST ID: ENST00000370242
  CDS Start-End: 55-840
agtcccgcccccctctcctcgctgcttaggctccgcggcctccaagctgtagctatgacggcgcgcgggactccgagccgcttcttggccagcgttctccacaacggactgggtcgctatgtgcagcagctgcagcgtctgagcttcagcgtcagccgcgacggcgcctcgtctcgcggcgccagggagttcgtggagcgggaggtgatcgacttcgcccgacggaatccaggggtcgtaatatatgtaaactcgcgtccgtgctgcgtgcccagagtagtggccgaataccttaacggggctgtgcgcgaggagagcatccactgcaagtcggtcgaggagatctcgacgctggtgcagaagctggccgaccagtcgggcttggacgtgatccgcatccgcaagcccttccacaccgacaaccctagcatccagggccagtggcaccccttcaccaacaagccgaccacgttccgcgggctacgcccccgagaggttcaggatcctgccccagcccaggatgcggctgagttcctcggcgaaggagcagggccctgctggtactccattgttgctctgcctcagaagcacatagctattgccattcatcctccgcagccggctgggcagtgccaccaagccattggacactggcctgagactgtctgcagttgcaccgcagatcctcctgcccggctggcccgacccaccagacctccccacagtggatcctatctcatcctcattgacctctgctccagcccctatgctgtccgcagtttcttgcctcccgattgtccctgcactgaccactgtgtgctcagcgtgaaggctgcatagaagtgtgtacggcttgaggtttcagcatccaggctgcagacccc

SEQ ID NO: 154492 - DNA, 727 bp, Homo sapiens
  Payload ID: 10365
  Gene Symbol: MRPL43
  Gene Name: mitochondrial ribosomal protein L43
  ENST ID: ENST00000448244
  CDS Start-End: 1-509
gcgggactccgagccgcttcttggccagcgttctccacaacggactgggtcgctatgtgcagcagctgcagcgtctgagcttcagcgtcagccgcgacggcgcctcgtctcgcggcgccagggagttcgtggagcgggaggtgatcgacttcgcccgacggaatccaggggtcgtaatatatgtaaactcgcgtccgtgctgcgtgcccagagtagtggccgaataccttaacggggctgtgcgcgaggagagcatccactgcaagtcggtcgaggagatctcgacgctggtgcagaagctggccgaccagtcgggcttggacgtgatccgcatccgcaagcccttccacaccgacaaccctagcatccagggccagtggcaccccttcaccaacaagccgaccacgttccgcgggctacgcccccgagaggttcaggatcctgccccagcccaggatgcggctgagttcctcggcgaaggagcagggccctgctggacactggcctgagactgtctgcagttgcaccgcagatcctcctgcccggctggcccgacccaatatcagttcagtcatccgatcttccttggggaaatacccattaccgtcctgaacccttgtcatccactacttggctataagctccagaagtgacaagacacttcacatcttaaatatgtttcctagtttataattcatttgggcagtaaatgtttgttgagcactta

SEQ ID NO: 154493 - DNA, 844 bp, Homo sapiens
  Payload ID: 10365
  Gene Symbol: MRPL43
  Gene Name: mitochondrial ribosomal protein L43
  ENST ID: ENST00000523148
  CDS Start-End: 1-445
ggagttcgtggagcgggaggtgatcgacttcgcccgacggaatccaggggtcgtaatatatgtaaactcgcgtccgtgctgcgtgcccagagtagtggccgaataccttaacggggctgtgcgcgaggagagcatccactgcaagtcggtcgaggagatctcgacgctggtgcagaagctggccgaccagtcgggcttggacgtgatccgcatccgcaagcccttccacaccgacaaccctagcatccagggccagtggcaccccttcaccaacaagccgaccacgttccgcgggctacgcccccgagaggttcaggatcctgccccagcccaggacactggcctgagactgtctgcagttgcaccgcagatcctcctgcccggctggcccgacccactcgaggacaagctctccttcgatcccgccggacgccgggagacgtgacccagatcctggggaacactgttcgccacgcggccccctccccgcgctggtccccgactccgtggtggccggtttgcaccccgcgcagcccgaggcctggcccgcgcccctctagagccgtcatgcaggaccgggggacttggtggtgagaaaggcctggcccagcttggagggtagaatggacgtgggggaggccttgcccgacccccggcccgcagccccaggctcacgccagggcgccgcccgcactcctcgccttgctcacctttgcgctcggatccggggccatagagacagcgacgcgcggctccgcggccccacagcaccagctgcgagaggaaggggccgcggctggaggcggggcggggggggggtggtggaggcggagccgggggtggg

SEQ ID NO: 154494 - DNA, 903 bp, Homo sapiens
  Payload ID: 10365
  Gene Symbol: MRPL43
  Gene Name: mitochondrial ribosomal protein L43
  ENST ID: ENST00000477279
  CDS Start-End: 73-207
ccggaagcctcgaggtttagtcccgcccccctctcctcgctgcttaggctccgcggcctccaagctgtagctatgacggcgcgcgggactccgagccgcttcttggccagcgttctccacaacggactgggtcgctatgtgcagcagctgcagcgtctgagcttcagcgtcagccgcgacggcgcctcgtctcgcggcgccagttaacggggctgtgcgcgaggagagcatccactgcaagtcggtcgaggagatctcgacgctggtgcagaagctggccgaccagtcgggcttggacgtgatccgcatccgcaagcccttccacaccgacaaccctagcatccagggccagtggcaccccttcaccaacaagccgaccacgttccgcgggctacgcccccgagaggttcaggatcctgccccagcccaggtgcaagcacagtgaagagttgccccaccaactgcagccccaggctttggactgttactccggtaaaggtggttcttcccctttgggattccaagcccaggcaaatggaacccatcaatgggcaagttgacagaggttctgcttgggataatgaagagctgcctgtttctttccagtgcctgcttctgggggcagtgaccttgtgaaccactcatttttatgcaagtggcatccctaaaacctgagatgaggaagacttcaagggttttacagggcccttgttttttaaatccaaattgataataatgatctcaaaacacagtgagaggtctgaaggctggcttctgaagaatccctgatgtcttattggaacaaccactgagctacggagagctctgctgtgatgggctaggcactttatatctgtgtgaatacagatttataaaacaggttaataaacttatccaaggtca

SEQ ID NO: 154495 - DNA, 1748 bp, Homo sapiens
  Payload ID: 10366
  Gene Symbol: MRPL44
  Gene Name: mitochondrial ribosomal protein L44
  Uniprot ID: Q9H9J2
  ENST ID: ENST00000258383
  CDS Start-End: 70-1068
ggggaagtgtgttacggggacactggcccgactactttcgttccgtcttccatcgttttctctcgtgcaatggcgtccgggctggtaagattgctgcagcagggacatcgctgcctcctggctccagtcgcccccaagctggtccctccggttcggggagtgaagaagggattccgcgccgccttccgcttccagaaggagttagagcggcagcgccttctgcggtgcccgccgccgcccgtgcgccgttcagagaagccgaactgggattaccatgcagaaatacaagcttttggacatcggttacaggaaaacttttccttagatcttctcaaaactgcatttgttaatagctgctatattaaaagtgaggaggccaaacgccaacaacttgggatagagaaagaagctgttcttctgaatcttaaaagtaatcaagaactatccgaacaagggacatctttttcacagacttgccttacacagtttcttgaagacgagtacccagacatgcccactgaaggcataaaaaatcttgttgactttctcactggtgaggaagtcgtgtgtcacgtggctagaaacttggctgtggagcagttaacactgagtgaagaattcccagtgcccccagctgtgttacagcagactttctttgcagttattggagccctgttacagagcagtggacctgagaggactgcacttttcatcagggacttcttaattactcaaatgactggaaaagagctctttgagatgtggaagataataaatcccatggggctattggtagaagaactgaagaaaaggaatgtttcagctcctgaatcaagacttactaggcagtctggtggcaccacagctttgcctttgtattttgttggcttatactgtgataaaaagttgattgcagaaggacctggggaaacagtattggttgcagaagaagaggctgctcgagtggcccttagaaaactttatggattcacagaaaatagacggccgtggaactattccaagcccaaagaaaccttgagagcagaaaagagcatcactgccagctagccgccatggatgcagcagcctgaaacttgagagcgaaagtgagataaatgtcaaaggtgtttcaagccagacattttcacaattgtgaagaaatagatgttttgtttctgttttttactgtgttcccaaaattaaataagtgttaaccaagtcacagtgtttttggttttgtttttctgaaatcttggtttgatcaaatctttttttttttctcttgagatggagtcttactctgtcgcccaggctggactgcagtggtgcgatctcggctcactgcaacctccacctcacaggttcaagcgattctcgtggctcagcctccctagtagctgggattacaggcacacaccaccatacctggctaatttttgtatttttggtagacatggggtttcaccaagttggctaggctagtcttgaactcctgacctcaggtgatccacccgccttggcctcccaaagtgctgggattacaggtgtgagccactatacccgaccagatcaaatctttttttgacatttttgcaaaaaaattttcctaatgttcttgatttaattgtatagaatttgtataattaggtgtattttatttgcgtctagctttgaggtatcataatttatgtatcttatgtgaattttttgctgtaataccaataaagttttttttctccacatgttaa

SEQ ID NO: 154496 - DNA, 1554 bp, Homo sapiens
  Payload ID: 10367
  Gene Symbol: MRPL45
  Gene Name: mitochondrial ribosomal protein L45
  ENST ID: ENST00000619548
  CDS Start-End: 162-932
cactcccgcgagcacgtgcgcgtcctcgctgctcacatttcggcggagggcgcgctccctggaaaattccactcctgtgctagctccaccctatgcggcttttctcctacccgacgctcttcactctcagctcccttcccggcggcctttgcgggaacaagatggcagcccccatacctcaagggttctcttgtttatcgaggtttttgggctggtggtctcggcagccagttctggtgactcagtccgcagctatagttccagtaagaactaaaaaacgtttcacacctcctatttatcaacctaaatttaaaacagaaaaggagtttatgcaacatgcccggaaagcaggattggttattcctccagaaaaatcggaccgttccatacatctggcctgtacagctggtatatttgatgcctatgttcctcctgagggtgatgcacgcatatcatctctttcaaaggagggactgatagagagaactgaacgaatgaagaagactatggcatcacaagtgtcaatccggaggataaaagactatgatgccaactttaaaataaaggacttccctgaaaaagctaaggatatctttattgaagctcacctttgtctaaataactcagaccatgaccggcttcataccttggtaactgaacactgttttccaactctggccatctatgaccggtttggccggttgatgtatggacaggaagatgtacccaaggatgtcctggagtatgttgtattcgaaaagcagttgacaaacccctatggaagctggagaatgcataccaagatcgttcccccatgggcaccccctaagcagcccatccttaagacggtgatgatccctggccctcagctgaaaccagaagaagaatatgaagaggcacaaggagaggcccagaagcctcagctagcctgatgacaaaaatgacttctagggtgaagcctgggtgatgaggctgctggaagctttgaagtctcccattcccctcatgctataaaaagaactacctttgttctctcccatcctgctcaggtcttttcagcagtctcatcatcagcaaccatgactgatgactgggccctagcaggtggcaggtataacatggccatggacactcttcttttttaaattttatgtctagcttctgagtctagatgaaagacagtatgtttcagagaacattggatatcagtttttcccacagcagggactgtgagagacaaccagcagcatcctctttgtaatcacagggcagggatcagagtttgaaatgaaatgttgtcagggtgttggaaaaattttggtgagttctgcacatttcccctggttcaggctgggcatggaccagccttcagatggcagaagtggaagatgagcctacttgtgagcgatgtgactttaaggaaatgaagactggggaagaataattagtgtttataagacatttaagaggccctttttcatatactgactcactgatgaatcagcatttgcattttatggaaaaatataaatccaaagaaataatttatccctt

SEQ ID NO: 154497 - DNA, 1554 bp, Homo sapiens
  Payload ID: 10367
  Gene Symbol: MRPL45
  Gene Name: mitochondrial ribosomal protein L45
  ENST ID: ENST00000613510
  CDS Start-End: 162-932
cactcccgcgagcacgtgcgcgtcctcgctgctcacatttcggcggagggcgcgctccctggaaaattccactcctgtgctagctccaccctatgcggcttttctcctacccgacgctcttcactctcagctcccttcccggcggcctttgcgggaacaagatggcagcccccatacctcaagggttctcttgtttatcgaggtttttgggctggtggtttcggcagccagttctggtgactcagtccgcagctatagttccagtaagaactaaaaaacgtttcacacctcctatttatcaacctaaatttaaaacagaaaaggagtttatgcaacatgcccggaaagcaggattggttattcctccagaaaaatcggaccgttccatacatctggcctgtacagctggtatatttgatgcctatgttcctcctgagggtgatgcacgcatatcatctctttcaaaggagggactgatagagagaactgaacgaatgaagaagactatggcatcacaagtgtcaatccggaggataaaagactatgatgccaactttaaaataaaggacttccctgaaaaagctaaggatatctttattgaagctcacctttgtctaaataactcagaccatgaccgacttcataccttggtaactgaacactgttttccaactctggccatctatgaccggtttggccggttgatgtatggacaggaagatgtacccaaggatgtcctggagtatgttgtattcgaaaagcagttgacaaacccctatggaagctggagaatgcataccaagatcgttcccccatgggcaccccctaagcagcccatccttaagacggtgatgatccctggccctcagctgaaaccagaagaagaatatgaagaggcacaaggagaggcccagaagcctcagctagcctgatgacaaaaatgacttctagggtgaagcctgggtgatgaggctgctggaagctttgaagtctcccattcccctcatgctataaaaagaactacctttgttctctcccatcctgctcaggtcttttcagcagtctcatcatcagcaaccatgactgatgactgggccctagcaggtggcaggtataacatggccatggacactcttcttttttaaattttatgtctagcttctgagtctagatgaaagacagtatgtttcagagaacattggatatcagtttttcccacagcagggactgtgagagacaaccagcagcatcctctttgtaatcacagggcagggatcagagtttgaaatgaaatgttgtcagggtgttggaaaaattttggtgagttctgcacatttcccctggttcaggctgggcatggaccagccttcagatggcagaagtggaagatgagcctacttgtgagcgatgtgactttaaggaaatgaagactggggaagaataattagtgtttataagacatttaagaggccctttttcatatactgactcactgatgaatcagcatttgcattttatggaaaaatataaatccaaagaaataatttatccctt

SEQ ID NO: 154498 - DNA, 1705 bp, Homo sapiens
  Payload ID: 10367
  Gene Symbol: MRPL45
  Gene Name: mitochondrial ribosomal protein L45
  Uniprot ID: Q9BRJ2
  ENST ID: ENST00000621878
  CDS Start-End: 162-1082
cactcccgcgagcacgtgcgcgtcctcgctgctcacatttcggcggagggcgcgctccctggaaaattccactcctgtgctagctccaccctatgcggcttttctcctacccgacgctcttcactctcagctcccttcccggcggcctttgcgggaacaagatggcagcccccatacctcaagggttctcttgtttatcgaggtttttgggctggtggtttcggcagccagttctggtgactcagtccgcagctatagttccagtaagaactaaaaaacgtttcacacctcctatttatcaacctaaatttaaaacagaaaaggagtttatgcaacatgcccggaaagcaggattggttattcctccagaaaaatcggaccgttccatacatctggcctgtacagctggtatatttgatgcctatgttcctcctgagggtgatgcacgcatatcatctctttcaaaggagggactgatagagagaactgaacgaatgaagaagactatggcatcacaagtgtcaatccggaggataaaagactatgatgccaactttaaaataaaggacttccctgaaaaagctaaggatatctttattgaagctcacctttgtctaaataactcagaccatgaccgacttcataccttggtaactgaacactgttttccagacatgacttgggacatcaaatataagaccgtccgctggagctttgtggaatctttagagccctctcatgttgttcaagttcgctgttcaagtatgatgaaccagggcaacgtgtacggccagatcaccgtacgcatgcacacccggcagactctggccatctatgaccggtttggccggttgatgtatggacaggaagatgtacccaaggatgtcctggagtatgttgtattcgaaaagcagttgacaaacccctatggaagctggagaatgcataccaagatcgttcccccatgggcaccccctaagcagcccatccttaagacggtgatgatccctggccctcagctgaaaccagaagaagaatatgaagaggcacaaggagaggcccagaagcctcagctagcctgatgacaaaaatgacttctagggtgaagcctgggtgatgaggctgctggaagctttgaagtctcccattcccctcatgctataaaaagaactacctttgttctctcccatcctgctcaggtcttttcagcagtctcatcatcagcaaccatgactgatgactgggccctagcaggtggcaggtataacatggccatggacactcttcttttttaaattttatgtctagcttctgagtctagatgaaagacagtatgtttcagagaacattggatatcagtttttcccacagcagggactgtgagagacaaccagcagcatcctctttgtaatcacagggcagggatcagagtttgaaatgaaatgttgtcagggtgttggaaaaattttggtgagttctgcacatttcccctggttcaggctgggcatggaccagccttcagatggcagaagtggaagatgagcctacttgtgagcgatgtgactttaaggaaatgaagactggggaagaataattagtgtttataagacatttaagaggccctttttcatatactgactcactgatgaatcagcatttgcattttatggaaaaatataaatccaaagaaataatttatccctta

SEQ ID NO: 154499 - DNA, 1705 bp, Homo sapiens
  Payload ID: 10367
  Gene Symbol: MRPL45
  Gene Name: mitochondrial ribosomal protein L45
  ENST ID: ENST00000613675
  CDS Start-End: 162-1082
cactcccgcgagcacgtgcgcgtcctcgctgctcacatttcggcggagggcgcgctccctggaaaattccactcctgtgctagctccaccctatgcggcttttctcctacccgacgctcttcactctcagctcccttcccggcggcctttgcgggaacaagatggcagcccccatacctcaagggttctcttgtttatcgaggtttttgggctggtggtctcggcagccagttctggtgactcagtccgcagctatagttccagtaagaactaaaaaacgtttcacacctcctatttatcaacctaaatttaaaacagaaaaggagtttatgcaacatgcccggaaagcaggattggttattcctccagaaaaatcggaccgttccatacatctggcctgtacagctggtatatttgatgcctatgttcctcctgagggtgatgcacgcatatcatctctttcaaaggagggactgatagagagaactgaacgaatgaagaagactatggcatcacaagtgtcaatccggaggataaaagactatgatgccaactttaaaataaaggacttccctgaaaaagctaaggatatctttattgaagctcacctttgtctaaataactcagaccatgaccggcttcataccttggtaactgaacactgttttccagacatgacttgggacatcaaatataagaccgtccgctggagctttgtggaatctttagagccctctcatgttgttcaagttcgctgttcaagtatgatgaaccagggcaacgtgtacggccagatcaccgtacgcatgcacacccggcagactctggccatctatgaccggtttggccggttgatgtatggacaggaagatgtacccaaggatgtcctggagtatgttgtattcgaaaagcagttgacaaacccctatggaagctggagaatgcataccaagatcgttcccccatgggcaccccctaagcagcccatccttaagacggtgatgatccctggccctcagctgaaaccagaagaagaatatgaagaggcacaaggagaggcccagaagcctcagctagcctgatgacaaaaatgacttctagggtgaagcctgggtgatgaggctgctggaagctttgaagtctcccattcccctcatgctataaaaagaactacctttgttctctcccatcctgctcaggtcttttcagcagtctcatcatcagcaaccatgactgatgactgggccctagcaggtggcaggtataacatggccatggacactcttcttttttaaattttatgtctagcttctgagtctagatgaaagacagtatgtttcagagaacattggatatcagtttttcccacagcagggactgtgagagacaaccagcagcatcctctttgtaatcacagggcagggatcagagtttgaaatgaaatgttgtcagggtgttggaaaaattttggtgagttctgcacatttcccctggttcaggctgggcatggaccagccttcagatggcagaagtggaagatgagcctacttgtgagcgatgtgactttaaggaaatgaagactggggaagaataattagtgtttataagacatttaagaggccctttttcatatactgactcactgatgaatcagcatttgcattttatggaaaaatataaatccaaagaaataatttatccctta

SEQ ID NO: 154500 - DNA, 1019 bp, Homo sapiens
  Payload ID: 10368
  Gene Symbol: MRPL46
  Gene Name: mitochondrial ribosomal protein L46
  Uniprot ID: Q9H2W6
  ENST ID: ENST00000312475
  CDS Start-End: 43-882
agggatccctgggagccgcggtgcattgtgggagaacgaaagatggcggcgcccgtaaggcggacgctgttaggggtggcggggggttggcggcggttcgagaggctctgggccggcagtctaagctctcgcagcctggctcttgcagccgcaccctcaagcaacggatccccatggcgcttgttgggcgcgttgtgcctgcagcggccacctgtagtctccaagccgttgaccccattgcaggaagagatggcgtctctactgcagcagattgagatagagagaagcctgtattcagaccacgagcttcgtgctctggatgaaaaccagcgactggcaaagaagaaagctgaccttcatgatgaagaagatgaacaggatatattgctggcgcaagatttggaagatatgtgggagcagaaatttctacagttcaaacttggagctcgcataacagaagctgatgaaaagaatgaccgaacatccctgaacaggaagctagacaggaaccttgtcctgttagtcagagagaagtttggagaccaggatgtttggatactgccccaggcagagtggcagcctggggagacccttcgaggaacagctgaacgaaccctggccacactctcagaaaacaacatggaagccaagttcctaggaaatgcaccctgtgggcactacacattcaagttcccccaggcaatgcggacagagagtaacctcggagccaaggtgttcttcttcaaagcactgctattaactggagacttttcccaggctgggaataagggccatcatgtgtgggtcactaaggatgagctgggtgactatttgaaaccaaaatacctggcccaagttaggaggtttgtttcagacctctgatgggccgagctgcctgtggacggtgctcagacaagtctgggattagagcctcaaggacattgtgtgattgcctcacatttgcaggtaatatcaagcagcaaactaaattctgagaaataaacgagtctattactgtg

SEQ ID NO: 154501 - DNA, 670 bp, Homo sapiens
  Payload ID: 10368
  Gene Symbol: MRPL46
  Gene Name: mitochondrial ribosomal protein L46
  ENST ID: ENST00000560703
  CDS Start-End: 13-273
ggagaacgaaagatggcggcgcccgtaaggcggacgctgttaggggtggcggggggttggcggcggttcgagaggctctgggccggcagtctaagctctcgcagcctggctcttgcagccgcaccctcaagcaacggatccccatggcgcttgttgggcgcgttgtgcctgcagcggccacctgtagtctccaagccgttgaccccattgcaggaagagatggcgtctctactgcagcagaagctgatgaaaagaatgaccgaacatccctgaacaggaagctagacaggaaccttgtcctgttagtcagagagaagtttggagaccaggatgtttggatactgccccaggcagagtggcagcctggggagacccttcgaggaacagctgaacgaaccctggccacactctcagaaaacaacatggaagccaagttcctaggaaatgcaccctgtgggcactacacattcaagttcccccaggcaatgcggacagagagtaacctcggagccaaggtgttcttcttcaaagcactgctattaactggagacttttcccaggctgggaataagggccatcatgtgtgggtcactaaggatgagctgggtgactatttgaaaccaaaatacctggcccaagttaggaggtttgtttcagacctctgatgggc

SEQ ID NO: 154502 - DNA, 727 bp, Homo sapiens
  Payload ID: 10368
  Gene Symbol: MRPL46
  Gene Name: mitochondrial ribosomal protein L46
  ENST ID: ENST00000559538
  CDS Start-End: 1-137
tagtcagagagaagtttggagaccaggatgtttggatactgccccaggcagagtggcagcctggggagacccttcgaggaacagctgaacgaaccctggccacactctcaggtgacacccattttaaaggtggatgaactttgttttacagaccaaatgtcctcgtccttcaccagcagatagcgactgggctgattcaccaacagttagcgactgggctgattcgccaacagatagcgactgggctgattcgccagcagatagcgactgggctgattcgccagcatagcgactgggctgattcgccagcagatagcgactgggctgaatgtaggaactagaaaacaacatggaagccaagttcctaggaaatgcaccctgtgggcactacacattcaagttcccccaggcaatgcggacagagagtaacctcggagccaaggtgttcttcttcaaagcactgctattaactggagacttttcccaggctgggaataagggccatcatgtgtgggtcactaaggatgagctgggtgactatttgaaaccaaaatacctggcccaagttaggaggtttgtttcagacctctgatgggccgagctgcctgtggacggtgctcagacaagtctgggattagagcctcaaggacattgtgtgattgcctcacatttgcaggtaatatcaagcagcaaactaaattctgagaaataaacgagtctattactg

SEQ ID NO: 154503 - DNA, 1002 bp, Homo sapiens
  Payload ID: 10368
  Gene Symbol: MRPL46
  Gene Name: mitochondrial ribosomal protein L46
  ENST ID: ENST00000558531
  CDS Start-End: 14-523
gggagaacgaaagatggcggcgcccgtaaggcggacgctgttaggggtggcggggggttggcggcggttcgagaggctctgggccggcagtctaagctctcgcagcctggctcttgcagccgcaccctcaagcaacggatccccatggcgcttgttgggcgcgttgtgcctgcagcggccacctgtagtctccaagccgttgaccccattgcaggaagagatggcgtctctactgcagcagattgagatagagagaagcctgtattcagaccacgagcttcgtgctctggatgaaaaccagcgactggcaaagaagaaagctgaccttcatgatgaagaagatgaacaggatatattgctggcgcaagatttggaagatatgtgggagcagaaatttctacagttcaaacttggagctcgcataacaggttgtgatccttttaggccagccagaaggaagggaaaaggggtatttggattcccaaataaaagacagttgcttggcccctgctttgtgttttaagtaacaaataatttcatattcttttctttgttgctcacatctaccataatacgacttaaaaagtctgtcttattttcgggtgagaggtaagggtattggaatagccttttctctcagttaaactttgtgaatgttatctgtgtttaactccaagtttgagactgagagtggggcaaatgaagcctttttccactaattcctgtgttttatgtgaaatccctcttaaagcgggagattgagttctgttttccttgtttcacagatgaagactgaagaacagagaaagtaggggctagttaagtcagtaatagtatcaaaaccaatgaagtagttgtgtttgaattagtatgatcattgtttcttttttgaagactcaaaatatggtttgctgttcaaagaagcttacctcttgatttcttaccttttagtttcctcaagattgtgagactcttccctggaagaggtcagagttagagaga

SEQ ID NO: 154504 - DNA, 1126 bp, Homo sapiens
  Payload ID: 10369
  Gene Symbol: MRPL47
  Gene Name: mitochondrial ribosomal protein L47
  Uniprot ID: Q9HD33
  ENST ID: ENST00000259038
  CDS Start-End: 17-709
ccagttatgcgaaaacatggctgcggccggtttggcccttctttgtaggagagtttcatccgccctgaaatcttcccgatcgttaataactcctcaggtccctgcctgcacaggattacttcataccacattgtcaaggaaaggactagaagaattttttgatgacccaaaaaactgggggcaagaaaaagtaaaatctggagcagcatggacctgtcagcaactaaggaacaaaagtaatgaagatttacacaaactttggtatgtcttactgaaagaaagaaacatgcttctaaccctagagcaggaggccaagcggcagagattgccaatgccaagtccagagcggttagataaggtagtagattccatggatgcattagataaagttgtccaggaaagagaagatgccctaaggcttcttcagactggtcaagaaagagctagacctggtgcttggagaagagacatctttggaagaatcatctggcacaagttcaagcagtgggttataccttggcacctaaataaaagatacaataggaaacgattctttgccttgccttatgtggaccattttctcagactggaacgtgagaaacgagcccgcatcaaagcacggaaggaaaatttagagagaaagaaagcaaaaattcttttaaaaaagtttccacatcttgctgaagcccaaaagtcaagtcttgtctaagatgtctgaactattaaatttaccattttgtttttcttgaatagtctgtgtacaggagtaaatatgttaagtggtttataaagaaattctgtttttagtcaagtgactttactaatcagttgttctaagtgtgaatatggcatgctaattagctaatttggtagaagctaatttgcttctaaaaatcaggtataaagttcagatgagattcccactttataaattctgacatttaagcaggctttaaatgtcacctgctaccttagagtgtgaaggtgatggtaactgccacagcaaaggcaataccgtagtttttgaatttgaataatagttttacctctgttgttaataggctatgaagaggatgtgggtattgctgttaataaacggaggactttgattcaaaataatgagaaa

SEQ ID NO: 154505 - DNA, 673 bp, Homo sapiens
  Payload ID: 10369
  Gene Symbol: MRPL47
  Gene Name: mitochondrial ribosomal protein L47
  Uniprot ID: Q9HD33
  ENST ID: ENST00000392659
  CDS Start-End: 210-632
cgcgttttgccagttatgcgaaaacatggctgcggccggtttggcccttctttgtaggagagtttcatccgccctgaaatcttcccgatcgttaataactcctcaggtccctgcctgcacagggagcagcatggacctgtcagcaactaaggaacaaaagtaatgaagatttacacaaactttggtatgtcttactgaaagaaagaaacatgcttctaaccctagagcaggaggccaagcggcagagattgccaatgccaagtccagagcggttagataaggtagtagattccatggatgcattagataaagttgtccaggaaagagaagatgccctaaggcttcttcagactggtcaagaaagagctagacctggtgcttggagaagagacatctttggaagaatcatctggcacaagttcaagcagtgggttataccttggcacctaaataaaagatacaataggaaacgattctttgccttgccttatgtggaccattttctcagactggaacgtgagaaacgagcccgcatcaaagcacggaaggaaaatttagagagaaagaaagcaaaaattcttttaaaaaagtttccacatcttgctgaagcccaaaagtcaagtcttgtctaagatgtctgaactattaaatttaccattttgtttttcttgaa

SEQ ID NO: 154506 - DNA, 1370 bp, Homo sapiens
  Payload ID: 10369
  Gene Symbol: MRPL47
  Gene Name: mitochondrial ribosomal protein L47
  Uniprot ID: Q9HD33
  ENST ID: ENST00000476781
  CDS Start-End: 31-783
ggaaacgcgttttgccagttatgcgaaaacatggctgcggccggtttggcccttctttgtaggagagtttcatccgccctgaaatcttcccgatcgttaataactcctcaggtccctgcctgcacagggttttttcttagtttgttgcctaagagtacaccaaatgtgacatcctttcaccaatatagattacttcataccacattgtcaaggaaaggactagaagaattttttgatgacccaaaaaactgggggcaagaaaaagtaaaatctggagcagcatggacctgtcagcaactaaggaacaaaagtaatgaagatttacacaaactttggtatgtcttactgaaagaaagaaacatgcttctaaccctagagcaggaggccaagcggcagagattgccaatgccaagtccagagcggttagataaggtagtagattccatggatgcattagataaagttgtccaggaaagagaagatgccctaaggcttcttcagactggtcaagaaagagctagacctggtgcttggagaagagacatctttggaagaatcatctggcacaagttcaagcagtgggttataccttggcacctaaataaaagatacaataggaaacgattctttgccttgccttatgtggaccattttctcagactggaacgtgagaaacgagcccgcatcaaagcacggaaggaaaatttagagagaaagaaagcaaaaattcttttaaaaaagtttccacatcttgctgaagcccaaaagtcaagtcttgtctaagatgtctgaactattaaatttaccattttgtttttcttgaatagtctgtgtacaggagtaaatatgttaagtggtttataaagaaattctgtttttagtcaagtgactttactaatcagttgttctaagtgtgaatatggcatgctaattagctaatttggtagaagctaatttgcttctaaaaatcaggtataaagttcagatgagattcccactttataaattctgacatttaagcaggctttaaatgtcacctgctaccttagagtgtgaaggtgatggtaactgccacagcaaaggcaataccgtagtttttgaatttgaataatagttttacctctgttgttaataggctatgaagaggatgtgggtattgctgttaataaacggaggactttgattcaaaataatgagaaatacatttagtccttaaagtagtaatcacagtgcacaacagtccaaaatatatttctggaatggctaatttttatttaattctgtaagcctaaggtaaaaagcataggcagtaacttttactagtcaataaaaagcagttctaccaatccactggtaattaatacactaaa

SEQ ID NO: 154507 - DNA, 1536 bp, Homo sapiens
  Payload ID: 10370
  Gene Symbol: MRPL48
  Gene Name: mitochondrial ribosomal protein L48
  Uniprot ID: Q96GC5
  ENST ID: ENST00000310614
  CDS Start-End: 657-1295
aggccgaggcgggcggatcacctgaggtcgggagttcaagaccagcctgacaaacatggagaaacctcatctctagtaaaaatataaaaattaggcgggcgtggtggcgggcacctgtaatcccagctacttggagacagaattgcttgaacccgagaggcggaggtggcagtgagctgagatcgtgccactacactccagcctgcgcaacagagcgagactccgtctcaaacaaacaaaaaagtcagatctgtgctagacgctgaaaggaattaatcagacaggatctcagtcttttaagaactttcaaatacagagaagaggtggtaacaaatcattagtgtataatattgtaagcgaaaaattagaattgtgtgctaagtactggggtaacacagagatggtaattaattctttctggagaaacagcagtgaatgtgacaacctgagtgagggtggaaagcaggagaatttctagactctgaatttcagaagcttccggaactaaaatgatgtggaagttgagtgagtctcggtgggatattgctgctgcacctggtcaaggccgttccttcagtgttttcagacgccctgggaacgcggctgcagggtccggtcttcggtttgcacagctagaggccgcgcagcagcaaaggatgagcggaaccttggaaaaggtgctgtgcctgaggaacaataccatttttaagcaagccttttctctcttaaggtttagaacttcaggagagaagcccatctattctgtaggtggaattctactaagtatcagtcggccctacaagacaaagcccacccacggcattggaaagtacaagcacttaattaaagcagaagagcccaagaagaagaagggaaaagtggaagtgagagccattaatttggggacagattatgaatatggggttttaaatattcatctgactgcatatgatatgaccctggcagagagttatgcccagtatgttcacaacctctgcaactctctctccattaaagtcgaggaaagttatgcaatgccaaccaaaaccatagaagtgttgcagttgcaggaccaaggcagcaaaatgctcctggactcagtgcttaccacccatgagcgagtggttcagatcagcggtttgagtgctacgtttgcagaaattttcttggaaataatccaaagcagtcttcctgaaggagtcagactgtcagtgaaggagcacactgaagaagacttcaagggacgattcaaagctcgaccagaactggaagaactgttggccaagttgaagtagctactgtagaccctttcatgccagcagtggtcatattgagtgccaaagagaagagcttactgggtagttagagttcatcaggagacccaacccttagatttcataagtacccattcccatagccagtaatgtcctcactcctctgtggcttggctgtacttgccatttcttaccacttacctatgaggtaatgcttgttatcttccatctaataaaaatctgctgcagatgtgtatatgta

SEQ ID NO: 154508 - DNA, 1922 bp, Homo sapiens
  Payload ID: 10370
  Gene Symbol: MRPL48
  Gene Name: mitochondrial ribosomal protein L48
  ENST ID: ENST00000314282
  CDS Start-End: 1352-1693
gctaatttttatgttttttgcagagctgggattttgccatgttatccaggctggtcctgaactcctaggctcaagcagtctgcctgcctcagcctcccaaagtgcaggaattataggcgtgagccactgtgcctagctgatactatttttgtacatgcttccagagatattttttaaatatgcaagcaaataagcatgtatgtaattacacacatgcacacacacacatatctattctcttccagctcccccattttatatgtgtggcaacattttgaacacattattctacagtttgcttttatcatttgttttatcttaaagacctttccagtatctgtacataaagaagtggttatttatttatttatttatttagagatggagtctcgttctgtcgctcaggttcgagtgcagtggcgggatctcagctcattgcaacctccgcctcccgggttcaagcaattctcctgcctcagcctcccaagcagctgggactacaggcgcacaccaccgtgcccagctaattttcatatttttagtagagacggggtttcaccatattggctaggctggtctcgaactcctgacctcatcatccacctgcctcggcctcccaaagtgctgggattacagacgtgagccaccgcgcccggccccttatttctttttacagctgcataatttacttaataagtctccctccttttctgttttgaaacaggatctcactctgttgcccaagctagagtgcagttgcgtgaccacggctcactgcagcctcaacccctcagactcaagccatcatctcacctgagcctcctgagtagctgggattacaggcacttgccacaatgcccagctaattaagaaaattttttttgtagagtcgggatctagctatgttgtcagggctgctcttgaaccctttggctcaagttatcctcctatcttggcctcaaagttctgggattacaggtgtcagccactgtacccagctataagtccctctctttatgggcatttaggttagattattttcggttgaggtgctttcttctttctgaagtatgttgtgttaaatattttttcccaggctttgttttaactttttttttttttttttcccttgagatggagtctcgccctgtcacccaggctggagtgcaatggcgtgatctcggcgcacttcaacctcgcctcccaggttcaagtgattctcctgcctcagtctcctgagtagctgggattacagcccaagaagaagaagggaaaagtggaagtgagagccattaatttggggacagattatgaatatggggttttaaatattcatctgactgcatatgatatgaccctggcagagagttatgcccagtatgttcacaacctctgcaactctctctccattaaagtcgaggaaagttatgcaatgccaaccaaaaccatagaagtgttgcagttgcaggaccaaggcagcaaaatgctcctggactcagtgcttaccacccatgagcgagtggttcagatcagcggtttgagtgctacgtttgcagaaattttcttggaaataatccaaagcagtcttcctgaaggagtcagactgtcagtgaaggagcacactgaagaagacttcaagggacgattcaaagctcgaccagaactggaagaactgttggccaagttgaagtagctactgtagaccctttcatgccagcagtggtcatattgagtgccaaagagaagagcttactgggtagttagagttcatcaggagacccaacccttagatttcataagtacccattcccatagccagtaatgtcctcactcctctgtggcttggctgtacttgccatttcttaccacttacctatgaggtaatgcttgttatcttccatctaataaaaatctgctgcaga

SEQ ID NO: 154509 - DNA, 1058 bp, Homo sapiens
  Payload ID: 10370
  Gene Symbol: MRPL48
  Gene Name: mitochondrial ribosomal protein L48
  ENST ID: ENST00000398483
  CDS Start-End: 482-823
cctgggaacgcggctgcagggtccggtcttcggtttgcacagctagaggccgcgcagcagcaaaggatgagcggaaccttggaaaaggctggtctggaactcctggaaaagagcccatggaaatctgtcattaaggccagcatctgacatgggtatataaggcctctcgacgtctgatgccactgttctcttcccgactccttagttgctttagtcagctaacctcgtcattatttgccaaatgtgctgtgcctgaggaacaataccatttttaagcaagccttttctctcttaaggtggaattctactaagtatcagtcggccctacaagacaaagcccacccacggcattggaaagtacaagcacttaattaaagcagaagagcccaagaagaagaagggaaaagtggaagtgagagccattaatttggggacagattatgaatatggggttttaaatattcatctgactgcatatgatatgaccctggcagagagttatgcccagtatgttcacaacctctgcaactctctctccattaaagtcgaggaaagttatgcaatgccaaccaaaaccatagaagtgttgcagttgcaggaccaaggcagcaaaatgctcctggactcagtgcttaccacccatgagcgagtggttcagatcagcggtttgagtgctacgtttgcagaaattttcttggaaataatccaaagcagtcttcctgaaggagtcagactgtcagtgaaggagcacactgaagaagacttcaagggacgattcaaagctcgaccagaactggaagaactgttggccaagttgaagtagctactgtagaccctttcatgccagcagtggtcatattgagtgccaaagagaagagcttactgggtagttagagttcatcaggagacccaacccttagatttcataagtacccattcccatagccagtaatgtcctcactcctctgtggcttggctgtacttgccatttcttaccacttacctatgaggtaatgcttgttatcttccatctaataaaaatctgctgcagatgtgta

SEQ ID NO: 154510 - DNA, 1197 bp, Homo sapiens
  Payload ID: 10370
  Gene Symbol: MRPL48
  Gene Name: mitochondrial ribosomal protein L48
  ENST ID: ENST00000411840
  CDS Start-End: 628-969
ttttcagacgccctgggaacgcggctgcagggtccggtcttcggtttgcacagctagaggccgcgcagcagcaaaggatgagcggaaccttggaaaaggctggtctggaactcctggaaaagagcccatggaaatctgtcattaaggccagcatctgacatgggtatataaggcctctcgacgtctgatgccactgttctcttcccgactccttagttgctttagtcagctaacctcgtcattatttgccaaatgaagagggttcatgactgagcagatcctcagcaacgtctgtaactctgcaaaagctaaggatttctcttagccatctccccctggatttcctgccaggtgctgtgcctgaggaacaataccatttttaagcaagccttttctctcttaaggtttagaacttcaggagagaagcccatctattctgtaggtggaattctactaagtatcagtcggccctacaagacaaagcccacccacggcattggaaagtacaagcacttaattaaagcagaagagcccaagaagaagaagggaaaagtggaagtgagagccattaatttggggacagattatgaatatggggttttaaatattcatctgactgcatatgatatgaccctggcagagagttatgcccagtatgttcacaacctctgcaactctctctccattaaagtcgaggaaagttatgcaatgccaaccaaaaccatagaagtgttgcagttgcaggaccaaggcagcaaaatgctcctggactcagtgcttaccacccatgagcgagtggttcagatcagcggtttgagtgctacgtttgcagaaattttcttggaaataatccaaagcagtcttcctgaaggagtcagactgtcagtgaaggagcacactgaagaagacttcaagggacgattcaaagctcgaccagaactggaagaactgttggccaagttgaagtagctactgtagaccctttcatgccagcagtggtcatattgagtgccaaagagaagagcttactgggtagttagagttcatcaggagacccaacccttagatttcataagtacccattcccatagccagtaatgtcctcactcctctgtggcttggctgtacttgccatttcttaccacttacctatgaggtaatgcttgttatcttccatctaataaaaatctgctgcag

SEQ ID NO: 154511 - DNA, 598 bp, Homo sapiens
  Payload ID: 10370
  Gene Symbol: MRPL48
  Gene Name: mitochondrial ribosomal protein L48
  ENST ID: ENST00000535277
  CDS Start-End: 520-598
cctgggaacgcggctgcagggtccggtcttcggtttgcacagctagaggccgcgcagcagcaaaggatgagcggaaccttggaaaaggctggtctggaactcctggaaaagagcccatggaaatctgtcattaaggccagcatctgacatgggtatataaggcctctcgacgtctgatgccactgttctcttcccgactccttagttgctttagtcagctaacctcgtcattatttgccaaatgtgctgtgcctgaggaacaataccatttttaagcaagccttttctctcttaaggtttagaacttcaggagagaagcccatctattctgtaggtggaattctactaagtatcagtcggccctacaagacaaagcccacccacggcattggaaagtacaagcacttaattaaagcagaagagcccaagaagaagaagggaaaagtggaagtgagagccattaatttggggacagattatgaatatggggttttaaatattcatctgactgcatatgatatgaccctggcagagagttatgcccagtatgttcacaacctctgcaactctctctccattaaagtcgaggaaaggtatg

SEQ ID NO: 154512 - DNA, 531 bp, Homo sapiens
  Payload ID: 10370
  Gene Symbol: MRPL48
  Gene Name: mitochondrial ribosomal protein L48
  ENST ID: ENST00000497094
  CDS Start-End: 500-531
agtgttttcagacgccctgggaacgcggctgcagggtccggtcttcggtttgcacagctagaggccgcgcagcagcaaaggatgagcggaaccttggaaaaggtgctgtgcctgaggaacaataccatttttaagcaagccttttctctcttaaggtttagaacttcaggagagaagcccatctattctgtaggtggaattctactaagtatcagtcggccctacaagacaaagcccacccacggcattggaaagtacaagcacttaattaaagcagaagagatggagtctcgccctgtcacccaggctggagtgcaatggcgtgatctcggcgcacttcaacctcgcctcccaggttcaagtgattctcctgcctcagtctcctgagtagctgggattacagcccaagaagaagaagggaaaagtggaagtgagagccattaatttggggacagattatgaatatggggttttaaatattcatctgactgcatatgatatgaccctggcagagagttatgcccagtatgt

SEQ ID NO: 154513 - DNA, 1004 bp, Homo sapiens
  Payload ID: 10370
  Gene Symbol: MRPL48
  Gene Name: mitochondrial ribosomal protein L48
  ENST ID: ENST00000540162
  CDS Start-End: 96-254
aaggccgttccttcagtgttttcagacgccctgggaacgcggctgcagggtccggtcttcggtttgcacagctagaggccgcgcagcagcaaaggatgagcggaaccttggaaaaggtgctgtgcctgaggaacaataccatttttaagcaagccttttctctcttaaggtttagaacttcaggagagaagcccatctattctgtagagagagacggtcttgcttgtggcccaggcttgagtacagtggcatgatcatagctccctgcagcctcgaactcctgggttcaagcaatcctcctgcctcagcctctggagtagctgggattacaggtggaattctactaagtatcagtcggccctacaagacaaagcccacccacggcattggaaagtacaagcacttaattaaagcagaagagcccaagaagaagaagggaaaagtggaagtgagagccattaatttggggacagattatgaatatggggttttaaatattcatctgactgcatatgatatgaccctggcagagagttatgcccagtatgttcacaacctctgcaactctctctccattaaagtcgaggaaagttatgcaatgccaaccaaaaccatagaagtgttgcagttgcaggaccaaggcagcaaaatgctcctggactcagtgcttaccacccatgagcgagtggttcagatcagcggtttgagtgctacgtttgcagaaattttcttggaaataatccaaagcagtcttcctgaaggagtcagactgtcagtgaaggagcacactgaagaagacttcaagggacgattcaaagctcgaccagaactggaagaactgttggccaagttgaagtagctactgtagaccctttcatgccagcagtggtcatattgagtgccaaagagaagagcttactgggtagttagagttcatcaggagacccaacccttagatttcataagtacccattcccatagccagtaatgtcctcactcctctg

SEQ ID NO: 154514 - DNA, 742 bp, Homo sapiens
  Payload ID: 10370
  Gene Symbol: MRPL48
  Gene Name: mitochondrial ribosomal protein L48
  ENST ID: ENST00000544819
  CDS Start-End: 88-240
tccttcagtgttttcagacgccctgggaacgcggctgcagggtccggtcttcggtttgcacagctagaggccgcgcagcagcaaaggatgagcggaaccttggaaaaggtgctgtgcctgaggaacaataccatttttaagcaagccttttctctcttaaggtggaattctactaagtatcagtcggccctacaagacaaagcccacccacggcattggaaagtacaagcacttaattaaagcagaagagcccaagaagaagaagggaaaagtggaagtgagagccattaatttggggacagattatgaatatggggttttaaatattcatctgactgcatatgatatgaccctggcagagagttatgcccagtatgttcacaacctctgcaactctctctccattaaagtcgaggaaagttatgcaatgccaaccaaaaccatagaagtgttgcagttgcaggaccaaggcagcaaaatgctcctggactcagtgcttaccacccatgagcgagtggttcagatcagcggtttgagtgctacgtttgcagaaattttcttggaaataatccaaagcagtcttcctgaaggagtcagactgtcagtgaaggagcacactgaagaagacttcaagggacgattcaaagctcgaccagaactggaagaactgttggccaagttgaagtagctactgtagaccctttcatgccagcagtggtcatattgagtgccaaagagaaga

SEQ ID NO: 154515 - DNA, 699 bp, Homo sapiens
  Payload ID: 10370
  Gene Symbol: MRPL48
  Gene Name: mitochondrial ribosomal protein L48
  ENST ID: ENST00000543058
  CDS Start-End: 16-168
gcgcagcagcaaaggatgagcggaaccttggaaaaggtgctgtgcctgaggaacaataccatttttaagcaagccttttctctcttaaggtttagaacttcaggagagaagcccatctattctgtagcccaagaagaagaagggaaaagtggaagtgagagccattaatttggggacagattatgaatatggggttttaaatattcatctgactgcatatgatatgaccctggcagagagttatgcccagtatgttcacaacctctgcaactctctctccattaaagtcgaggaaagatcagcggtttgagtgctacgtttgcagaaattttcttggaaataatccaaagcagtcttcctgaaggagtcagactgtcagtgaaggagcacactgaagaagacttcaagggacgattcaaagctcgaccagaactggaagaactgttggccaagttgaagtagctactgtagaccctttcatgccagcagtggtcatattgagtgccaaagagaagagcttactgggtagttagagttcatcaggagacccaacccttagatttcataagtacccattcccatagccagtaatgtcctcactcctctgtggcttggctgtacttgccatttcttaccacttacctatgaggtaatgcttgttatcttccatctaataaaaatctgctgcagatgtgtata

SEQ ID NO: 154516 - DNA, 661 bp, Homo sapiens
  Payload ID: 10370
  Gene Symbol: MRPL48
  Gene Name: mitochondrial ribosomal protein L48
  ENST ID: ENST00000542303
  CDS Start-End: 64-429
gggaacgcggctgcagggtccggtcttcggtttgcacagctagaggccgcgcagcagcaaaggatgagcggaaccttggaaaaggtgctgtgcctgaggaacaataccatttttaagcaagccttttctctcttaaggtttagaacttcaggagagaagcccatctattctgtaggtggaattctactaagtatcagtcggccctacaagacaaagcccacccacggcattggaaagtacaagcacttaattaaagcagaagagatcagcggtttgagtgctacgtttgcagaaattttcttggaaataatccaaagcagtcttcctgaaggagtcagactgtcagtgaaggagcacactgaagaagacttcaagggacgattcaaagctcgaccagaactggaagaactgttggccaagttgaagtagctactgtagaccctttcatgccagcagtggtcatattgagtgccaaagagaagagcttactgggtagttagagttcatcaggagacccaacccttagatttcataagtacccattcccatagccagtaatgtcctcactcctctgtggcttggctgtacttgccatttcttaccacttacctatgaggtaatgcttgttatcttccatctaataaaaatctgctgcagatgt

SEQ ID NO: 154517 - DNA, 996 bp, Homo sapiens
  Payload ID: 10370
  Gene Symbol: MRPL48
  Gene Name: mitochondrial ribosomal protein L48
  ENST ID: ENST00000544140
  CDS Start-End: 90-242
gttccttcagtgttttcagacgccctgggaacgcggctgcagggtccggtcttcggtttgcacagctagaggccgcgcagcagcaaaggatgagcggaaccttggaaaaggtgctgtgcctgaggaacaataccatttttaagcaagccttttctctcttaaggtggaattctactaagtatcagtcggccctacaagacaaagcccacccacggcattggaaagtacaagcacttaattaaagcagaagagcccaagaagaagaagggaaaagtggaagtgagagccattaatttggggacagattatgaatatggggttttaaatattcatctgactgcatatgatatgaccctggcagagagttatgcccagtatgttcacaacctctgcaactctctctccattaaagtcgaggaaagttatgcaatgccaaccaaaaccatagaagtgttgcagttgcaggaccaaggcagcaaaatgctcctggactcagtgcttaccacccatgagcgagtggttcaggtaggcactccaggagaataaaaaatgtatttgcttctcctggttcttttctctgtccactttttcactttctattatgctcttttcttttctttcttgaataatagtgttctccaggttcagttcttgatgcctccatctctccttttataataccttccccctatgcagtctcattcattccttaggcctcagtgatcatcatttaatactgataacccccagatgtatatatctccagtcctgatctgttggctgaggcttgaaacttgatacccagttgtctactggccttctcgacttggatgttccacaggagtcctccctgcactctgtctatgcaaaattagttgtagagggactgattttcctctttttctgtaatcctccccacctttgagcctaatgtgtcacccttctttgtcctctgatatccattcattcaccaaattctatagcttctacctccta

SEQ ID NO: 154518 - DNA, 1560 bp, Homo sapiens
  Payload ID: 10370
  Gene Symbol: MRPL48
  Gene Name: mitochondrial ribosomal protein L48
  ENST ID: ENST00000508278
  CDS Start-End: 101-226
tggtcaaggccgttccttcagtgttttcagacgccctgggaacgcggctgcagggtccggtcttcggtttgcacagctagaggccgcgcagcagcaaaggatgagcggaaccttggaaaaggtgctgtgcctgaggaacaataccatttttaagcaagccttttctctcttaaggtttagaacttcaggagagaagcccatctattctgtagatgggactgtctagttgcaggaaaacaagctcagggcttccactgattctacattatggtggaattctactaagtatcagtcggccctacaagacaaagcccacccacggcattggaaagtacaagcacttaattaaagcagaagagcccaagaagaagaagggaaaagtggaagtgagagccattaatttggggacagattatgaatatggggttttaaatattcatctgactgcatatgatatgaccctggcagagagttatgcccagtatgttcacaacctctgcaactctctctccattaaagtcgaggaaagttatgcaatgccaaccaaaaccatagaagtgttgcagttgcaggaccaaggcagcaaaatgctcctggactcagtgcttaccacccatgagcgagtggttcagatcagcggtttgagtgctacgtttgcagaaattttcttggaaataatccaaagcagtcttcctgaaggagtcagactgtcagtgaaggagcacactgaagaagacttcaagggacgattcaaagctcgaccagaactggaagaactgttggccaagttgaagtagctactgtagaccctttcatgccagcagtggtcatattgagtgccaaagagaagagcttactgggtagttagagttcatcaggagacccaacccttagatttcataagtacccattcccatagccagtaatgtcctcactcctctgtggcttggctgtacttgccatttcttaccacttacctatgaggtaatgcttgttatcttccatctaataaaaatctgctgcagatgtgtatatgtatgtgtgtgtgagagagagaaattggcccatcctgtggagtatctttaagagattctatattctggccaggcaccgtggtgcatccctgtaatcccagcactttgcgaggccgaggcaggaggactgctcgaggccaggagcttgagaccagcctggcaacattctgtctttaccaaaaacattcttttttttttttccgaaacggagtctcgctctgttgcccaggctggagtgcagtggcacgatctagactcactgcaagctctgcctcccgggttcacaccattctcctgcctcagcctcccaagtagctgggactgcaggcgcccgccaccacacctggctaattttttgtatttttagtagagacggggttttaccatgttagccaagatggtctcgatctcctgacctcgtgatccgccagccttggcctcccaaagtgctgggattacaggtgtgagccactgcacccagccaaactttttattttaattagctggacgtggtggtatgcacttg

SEQ ID NO: 154519 - DNA, 287 bp, Homo sapiens
  Payload ID: 10370
  Gene Symbol: MRPL48
  Gene Name: mitochondrial ribosomal protein L48
  ENST ID: ENST00000537007
  CDS Start-End: 249-287
ggtcttcggtttgcacagctagaggccgcgcagcagcaaaggatgagcggaaccttggaaaaggtggaattctactaagtatcagtcggccctacaagacaaagcccacccacggcattggaaagtacaagcacttaattaaagcagaagagcccaagaagaagaagggaaaagtggaagtgagagccattaatttggggacagattatgaatatggggttttaaatattcatctgactgcatatgatatgaccctggcagagagttatgcccagtatgttcacaac

SEQ ID NO: 154520 - DNA, 2019 bp, Homo sapiens
  Payload ID: 10371
  Gene Symbol: MRPL49
  Gene Name: mitochondrial ribosomal protein L49
  Uniprot ID: Q13405
  ENST ID: ENST00000279242
  CDS Start-End: 20-520
gctggcgtagcaggtaaagatggcagctaccatgttccgggctacgctgcggggatggagaaccggtgtccagcggggctgcgggctacggctgttgagccagacccagggccctccagattaccccaggtttgtggagtctgtggatgaatatcagtttgtggagcgcctgttaccggctaccaggatcccagatcccccaaagcatgaacattatcctacccctagtggctggcagcctcccagagaccccccacccaacctgccttactttgtacgacgctctcggatgcacaacatccccgtctacaaggacatcacgcatggcaaccggcagatgactgtgatccggaaagtggaaggggacatctgggccctgcagaaagacgtggaagattttctgagcccgctgctggggaagacacctgtcacccaggtcaatgaggtgacaggtaccctacggatcaagggctactttgaccaggagcttaaagcctggctcttggagaaaggcttctgaggcccagccgagcagcctgcttgtcagcatgccctgtggatcaagtctagggggcctcaggaggagggaggtgggtgttggagcccctgagacaggggatacagaaactagggctaaaggactttggggtcaggccttgcttgcataaaggagaaaacaactctatgtacatgctgggggagagtgcctaatgtgggagaccaaatagggatcaccaggctaatggggggcgtcagcagctttctctccctcctatcttggcctgttcttttttgttttttgagacggagtctcactctgttgcccagggtggagtgcagtggcatgatcttggctcactgcaacttccacctctgggatcaagggattctcctgcctcagcctcttgagtagctgggattacaggcgcccaccaccacagcctgctaatttttgtatttttagtagagatggggtttcaccatgttggccaggctggtctcaaactcctgactcgaagtgatccgcccaccttggcctcccaaagcgttgggattataggcatgagccatgtgcctggtccaccttggcctgttttgtttttctttccttgggctcagcaattcaaattctagttgttatttggtggaagcagtagcccaaccccagtttaggggaaggtagcacagggcagagccactgggcactttgtttccttggccctccgaagctcactgttgcaaatacccccaagcctttgctctaggccagatcttgtttggtgcaggtgatggagaacacagatgactcgggcatgggtcttggagatcttctgttcaaagtacagtgctggcactggggcacagagtgcccacgttagccccgggctctgatagagaggtaggaggcacgttcttggtcactgttccattgcagaccagacttgctggcctgaccacaagggagtggctgggaactcacagccagcatagggacatccccctgcagccttctgacctgcaatcaaggctggggaggggtttgcaggcaggaatatgctgacctttcaccctgccatcccatcccaaccccagctcactagccttcatatatgccttatacttggagtcacaggggccaaaggcctgagaccccaccctgcccccaaactggctaagacagctttcagttcctgactccccaacttggtctctgccctgaagcagggcactgaactctgggctgcttctctgtgtgtaaaatgggcacatcttcctaatctgttaatggtcagtggtgtccccaaggatagtgctggcttccatggaaaccctcactcctggagattccattccattttcaagtgtacagccacagcaaggagcccgacactgatttgatcgattctgtgacacaaaccccaccaattgttaatgcaagtttttatttggctgtatatacaatttaagctattaaaatttgtacaatatttacaaattaaataatcatctgaaactgtc

SEQ ID NO: 154521 - DNA, 688 bp, Homo sapiens
  Payload ID: 10371
  Gene Symbol: MRPL49
  Gene Name: mitochondrial ribosomal protein L49
  ENST ID: ENST00000533943
  CDS Start-End: 1-382
taccatgttccgggctacgctgcggggatggagaaccggtgtccagcggggctgcgggctacggctgttggtgagagcgctgagcgaggagctgagggcatcgcgtgggtaccccccacccaacctgccttactttgtacgacgctctcggatgcacaacatccccgtctacaaggacatcacgcatggcaaccggcagatgactgtgatccggaaagtggaaggggacatctgggccctgcagaaagacgtggaagattttctgagcccgctgctggggaagacacctgtcacccaggtcaatgaggtgacaggtaccctacggatcaagggctactttgaccaggagcttaaagcctggctcttggagaaaggcttctgaggcccagccgagcagcctgcttgtcagcatgccctgtggatcaagtctagggggcctcaggaggagggaggtgggtgttggagcccctgagacaggggatacagaaactagggctaaaggactttggggtcaggccttgcttgcataaaggagaaaacaactctatgtacatgctgggggagagtgcctaatgtgggagaccaaatagggatcaccaggctaatggggggcgtcagcagctttctctccctcctatcttggcctgttcttttttgttttttgagacggagtctcactctgttgccc

SEQ ID NO: 154522 - DNA, 1906 bp, Homo sapiens
  Payload ID: 10371
  Gene Symbol: MRPL49
  Gene Name: mitochondrial ribosomal protein L49
  Uniprot ID: Q13405
  ENST ID: ENST00000526319
  CDS Start-End: 29-529
gcacagaaggctggcgtagcaggtaaagatggcagctaccatgttccgggctacgctgcggggatggagaaccggtgtccagcggggctgcgggctacggctgttgagccagacccagggccctccagattaccccaggtttgtggagtctgtggatgaatatcagtttgtggagcgcctgttaccggctaccaggatcccagatcccccaaagcatgaacattatcctacccctagtggctggcagcctcccagagaccccccacccaacctgccttactttgtacgacgctctcggatgcacaacatccccgtctacaaggacatcacgcatggcaaccggcagatgactgtgatccggaaagtggaaggggacatctgggccctgcagaaagacgtggaagattttctgagcccgctgctggggaagacacctgtcacccaggtcaatgaggtgacaggtaccctacggatcaagggctactttgaccaggagcttaaagcctggctcttggagaaaggcttctgaggcccagccgagcagcctgcttgtcagcatgccctgtggatcaagtctagggggcctcaggaggagggagtgcctaatgtgggagaccaaatagggatcaccaggctaatggggggcgtcagcagctttctctccctcctatcttggcctgttcttttttgttttttgagacggagtctcactctgttgcccagggtggagtgcagtggcatgatcttggctcactgcaacttccacctctgggatcaagggattctcctgcctcagcctcttgagtagctgggattacaggcgcccaccaccacagcctgctaatttttgtatttttagtagagatggggtttcaccatgttggccaggctggtctcaaactcctgactcgaagtgatccgcccaccttggcctcccaaagcgttgggattataggcatgagccatgtgcctggtccaccttggcctgttttgtttttctttccttgggctcagcaattcaaattctagttgttatttggtggaagcagtagcccaaccccagtttaggggaaggtagcacagggcagagccactgggcactttgtttccttggccctccgaagctcactgttgcaaatacccccaagcctttgctctaggccagatcttgtttggtgcaggtgatggagaacacagatgactcgggcatgggtcttggagatcttctgttcaaagtacagtgctggcactggggcacagagtgcccacgttagccccgggctctgatagagaggtaggaggcacgttcttggtcactgttccattgcagaccagacttgctggcctgaccacaagggagtggctgggaactcacagccagcatagggacatccccctgcagccttctgacctgcaatcaaggctggggaggggtttgcaggcaggaatatgctgacctttcaccctgccatcccatcccaaccccagctcactagccttcatatatgccttatacttggagtcacaggggccaaaggcctgagaccccaccctgcccccaaactggctaagacagctttcagttcctgactccccaacttggtctctgccctgaagcagggcactgaactctgggctgcttctctgtgtgtaaaatgggcacatcttcctaatctgttaatggtcagtggtgtccccaaggatagtgctggcttccatggaaaccctcactcctggagattccattccattttcaagtgtacagccacagcaaggagcccgacactgatttgatcgattctgtgacacaaaccccaccaattgttaatgcaagtttttatttggctgtatatacaatttaagctattaaaatttgtacaatatttacaaattaaataatcatctg

SEQ ID NO: 154523 - DNA, 518 bp, Homo sapiens
  Payload ID: 10371
  Gene Symbol: MRPL49
  Gene Name: mitochondrial ribosomal protein L49
  ENST ID: ENST00000534078
  CDS Start-End: 37-207
agttgcgcgcacagaaggctggcgtagcaggtaaagatggcagctaccatgttccgggctacgctgcggggatggagaaccggtgtccagcggggctgcgggctacggctgttgaccccccacccaacctgccttactttgtacgacgctctcggatgcacaacatccccgtctacaaggacatcacgcatggcaaccggcagatgactgtgatccggaaagtggaaggggacatctgggccctgcagaaagacgtggaagattttctgagcccgctgctggggaagacacctgtcacccaggtcaatgaggtgacaggtaccctacggatcaagggctactttgaccaggagcttaaagcctggctcttggagaaaggcttctgaggcccagccgagcagcctgcttgtcagcatgccctgtggatcaagtctagggggcctcaggaggagggaggtgggtgttggagcccctgagacaggggatacagaaactagggctaaaggactttggggtca

SEQ ID NO: 154524 - DNA, 489 bp, Homo sapiens
  Payload ID: 10371
  Gene Symbol: MRPL49
  Gene Name: mitochondrial ribosomal protein L49
  ENST ID: ENST00000531705
  CDS Start-End: 12-311
agcaggtaaagatggcagctaccatgttccgggctacgctgcggggatggagaaccggtgtccagcggggctgcgggctacggctgttgagccagacccagggccctccagattaccccaggtttgtggagtctgtggatgaatatcagtttgtggagcgcctgttaccggctaccaggatcccagatcccccaaagcatgaacattatcctacccctagtggctggcagcctcccagagaccccaccctgcccccaaactggctaagacagctttcagttcctgactccccaacttggtctctgccctgaagcagggcactgaactctgggctgcttctctgtgtgtaaaatgggcacatcttcctaatctgttaatggtcagtggtgtccccaaggatagtgctggcttccatggaaaccctcactcctggagattccattccattttcaagtgtacagccacagcaaggagcccgacactgatttg

SEQ ID NO: 154525 - DNA, 501 bp, Homo sapiens
  Payload ID: 10371
  Gene Symbol: MRPL49
  Gene Name: mitochondrial ribosomal protein L49
  ENST ID: ENST00000526171
  CDS Start-End: 27-449
acagaaggctggcgtagcaggtaaagatggcagctaccatgttccgggctacgctgcggggatggagaaccggtgtccagcggggctgcgggctacggctgttgagccagacccagggccctccagattaccccaggtttgtggagtctgtggatgaatatcagtttgtggagcgcctgttaccggctaccaggatcccagatcccccaaagcatgaacattatcctacccctagtggctggcagcctcccagagaccccccacccaacctgccttactttgtacgacgctctcggatgcacaacatccccgtctacaaggacatcacgcatggcaaccggcagatgactgtgatccggaaagtggaaggggacatctgggtaagtgggtgggtgggtctgggactgggcctgaccctttcagggctgaagggacaggagtctttttaagggaagggactcttggcctgacctgatttgtcatctttccccaggccctgca

SEQ ID NO: 154526 - DNA, 3332 bp, Homo sapiens
  Payload ID: 10372
  Gene Symbol: MRPL50
  Gene Name: mitochondrial ribosomal protein L50
  Uniprot ID: Q8N5N7
  ENST ID: ENST00000374865
  CDS Start-End: 23-499
aggcccgtggatctcatcgaagatggcggcgcgatctgtgtcgggcattaccagaagagtcttcatgtggacagtctcagggacaccatgtagagaattttggtctcgattcagaaaagagaaagagccagtggttgttgagacagtagaagagaaaaaggaacctatcctagtgtgtccacctttacgaagccgagcatacacaccacctgaagatctccagagtcgtttggaatcttacgttaaagaagtttttggttcatctcttcctagtaattggcaagacatctccctggaagatagtcgtctaaagttcaatcttctggctcatttagctgatgacttgggtcatgtagtccctaactccagactccaccagatgtgcagggttagagatgttcttgatttctataatgtccctattcaagatagatctaaatttgatgaactcagtgccagtaatctgccccccaatttgaaaatcacttggagttactaagcaattcggaagagaaacacattgaaatcactgtctttccctgagcaagggggctgctcattagatcttttgatactttaccatgtgaaatactaccagaactgttctctaaacccactttttctgtagaggaatgtatcatctttttttttctcatattacaaatggacaaataacggactttctattttcatatttgctgaaaccattttttaaatgaaattaggtcattatttatgaaaagttttgagagggcactgtcaacttgggtttaagacaggaggacattgcaagttcacacctttcataagcataaagtagttgcaagaaagtattttcatcctgttaggattcatatctaagatagagttatgcattgcacatacacaaataaacttttattagatagatacctataaaagaaacataaaagtatgttgtgtattactgacagttctagattaatttcttttagaattaaagtagatttgttaaagtgtattgtgtgttgtaaattttttaagtgaaatttgcttgcgctctgccttgccatttctttccagtaagtataattttgaaaaaattagaatatatgccaaatattgagtgctgtgactcttcctcataagagatgtgccagattctatgtctaattgcatattctcttcagaggagatgatgcttattttaaacctttttctctataacttttaaaaagtggtgctgagtattcactagagtggcaagtctttgtgctttaatgcactcaatttgtggaaattacttaaatagcaggttatcagatggttctgaatgacaaaggtgttaaatttgggatttttttttcaagctttagatatggctggagagtaatgagacagaaggaatgtcttatattgttctgactgctgacaattcctaaagaaaagtgatagaagggtttttaacaaaataagttgcatttattctctttcccagggttactcctttgaagagggcaaaattcagttgggaatataaattctggaatcttcatgaagaaaattagttaacagtatagacatgccctacaaatatcatccacaggcacttcattcaagaacttcaggtgtcagagtgcctggagctctggagcttagacattagagttgattccttggggattggttccaggacacctacttggataccaaagtccacagatgcccaagccccttttataaaatgatgtagtatttgcatattatgtatgcacatcctcccatatactttaaatcatctttagattacttatactgaatagaatgtaaatagtatttacaattgtgaatacaatgtatttagttatgtaaatatgtaaattttaaagttatgtaaatatgtagctatgtaaatagctataaaataatatttacaattgtgaatagtatgtaaatagttgtgaacataactattgtgaataatatgttatatgttatagttgtgaatgtaaatagtattcacaattgtgaatacaatgtaaatagctttcacaattgtgaatacaatgtaagtagctatgtaaatagtgaatacaatgtaaatagctatgtaaatagttgttatgctgattagggaataatgagaaggaaaaaaagtatacatattcagtacagatgcagtcatctttttttcccctcgaacatttttgatccacaattggttgaatccacagatggggaacacacagtcttggtaaatttaaccaacaaggagggtaaacgcatcccaacagggaaggtaaactgcacatccatcagtacctctagagggcatcactggtttatagctcaatacagtgactatatcagaataatggcctttagttttcctgaaagattaaattaggcttgctgttgttgaatgagataatcaaacatatgatgtaattttaaagggtttacatacagaaggcctgctgtatgtcctgcttctgctgtgtaaaagattcagcatggaatcattggaattttatgtacaggatttcattatctcattttctatacaatttttccttctgatccagagacacggaaaaacaaagggcaagatggaaataagggatgagaaggtctatgtggaaaaacagttacaactggagtggtaactgcaaaaaccaagcagcttcatgtgatcgttaggacagaagaaatttctcctttgtagcctagagcaatattctcaaaatttaatgcgcatgttaatcatttggggatcttttattcattttttcatgtggggatcttttaaaaatgcaaattctgatttggtaagtctggagtaggtcctgagcttctgcatgcttcaaaagctgattatgttttgagaacatggatctagatgctggtattgaggtgggagacaagtactgccacctgaaacaacagtcttggtaaatttagccgacgagggtaaacacatcctaacagggaaggtaaactgtacgtccatcagtaccactagagggcatcactggtttatagttcaatacagtgaatatatcagaataatggcctttagttttcctgaaagattaaattaggcttgctaacttgtttaatgagataatcagacatatgatgtaattttaaagggtttacatttttaaaaatttaatgattgctacataaaaagggtatcagttaactaattttacttagatggaacttctgtaagcttagtaggtatgcttaaataaagcctgctaataaaatagagattcagactcaatagaatggttttacatatgtaatatatgttttaaactgcataaaataaactcctccctcctttc

SEQ ID NO: 154527 - DNA, 1234 bp, Homo sapiens
  Payload ID: 10373
  Gene Symbol: MRPL51
  Gene Name: mitochondrial ribosomal protein L51
  Uniprot ID: Q4U2R6
  ENST ID: ENST00000229238
  CDS Start-End: 463-849
gtaaaataggggtaataaaaacagctacagcggaagactgttgtgaggcacagagaaagggcttggtcattggaagcgggttccaggttctcaaccttcatttccttcacggttgaaggacgccaaagaaagcggaaagggtgaattttcttgaaatctcagttttggggaatcttagcgacgagtcgcggacctcagcttgtccggcgctccaaaacttccggcaggcggaccggaagcactgaggcgggaagggtggtagaggcccctcctgccggaacccggggggcggggctcgtggctgttgcggatggggcgtaggtgggcggtgcgcccacagctgcctgggtaaggcccaagatggctgtcttcgccttagtactcgtgtgaagttggcggggacggttcctgtcatcttcttgggcttatttggtgtgctgttgaaggggggagactagagaaatggcagggaacctcttatccggggcaggtaggcgcctgtgggactgggtgcctctggcgtgcagaagcttctctcttggtgtgcctagattgatcggtataaggctcactctcccgccccccaaagtggttgatcgttggaacgagaaaagggccatgttcggagtgtatgacaacatcgggatcctgggaaactttgaaaagcaccccaaagaactgatcagggggcccatatggcttcgaggttggaaagggaatgaattgcaacgttgtatccgaaagaggaaaatggttggaagtagaatgttcgctgatgacctgcacaaccttaataaacgcatccgctatctctacaaacactttaaccgacatgggaagtttcgatagaagagaaagctgagaacttcggaaaaggctcatctgtcaccctggagaagggaaactgtacttttccctgtgaggaaacggctttgtattttctctgtaataaaatggggcttctttggaatttgatagccacatacttttgttttcctctagatgctgcctctactcatgtagactatgaagtcttgactcatcctagatcttaggatcttaggtttgggcttcacaccacttgccttttacagtctagctatacctaattcctttaaaaagaaaagttggtgagaatgttattggcgctttttgacataatgctgttatgttaatagtgtttctaaagagccttccacactgaaatgaaatataagagaaaaatggagtcata

SEQ ID NO: 154528 - DNA, 441 bp, Homo sapiens
  Payload ID: 10373
  Gene Symbol: MRPL51
  Gene Name: mitochondrial ribosomal protein L51
  ENST ID: ENST00000543703
  CDS Start-End: 223-321
gcctgcgaatccctccttggccgcaaggtccccctttgcccagtcggcggggaggaggccgtatttctgctggccagagacgtcgcgtccctggctgggcattcagtcacccccaggaaaggaggaaactttgaaaagcaccccaaagaactgatcagggggcccatatggcttcgaggttggaaagggaatgaattgcaacgttgtatccgaaagaggaaaatggttggaagtagaatgttcgctgatgacctgcacaaccttaataaacgcatccgctatctctacaaacactttaaccgacatgggaagtttcgatagaagagaaagctgagaacttcggaaaaggctcatctgtcaccctggagaagggaaactgtacttttccctgtgaggaaacggctttgtattttctctgtaataaaatggggcttctttgga

SEQ ID NO: 154529 - DNA, 472 bp, Homo sapiens
  Payload ID: 10373
  Gene Symbol: MRPL51
  Gene Name: mitochondrial ribosomal protein L51
  ENST ID: ENST00000543959
  CDS Start-End: 123-353
aggcaagtccacgctgggagttagaaggcatcgcctctaatccaggtgtgcctagattgatcggtataaggctcactctcccgccccccaaagtggttgatcgttggaacgagaaaagggccatgttcggagtgtatgacaacatcgggatcctgggaaactttgaaaagcaccccaaagaactgatcagggggcccatatggcttcgaggttggaaagggaatgaattgcaacgttgtatccgaaagaggaaaatggttggaagtagaatgttcgctgatgacctgcacaaccttaataaacgcatccgctatctctacaaacactttaaccgacatgggaagtttcgatagaagagaaagctgagaacttcggaaaaggctcatctgtcaccctggagaagggaaactgtacttttccctgtgaggaaacggctttgtattttctctgtaataaaatggggcttctttgg

SEQ ID NO: 154530 - DNA, 501 bp, Homo sapiens
  Payload ID: 10373
  Gene Symbol: MRPL51
  Gene Name: mitochondrial ribosomal protein L51
  ENST ID: ENST00000538814
  CDS Start-End: 152-382
atgtaggcaccccgataactgcttcgtagtataataggcggctcagattaattccctcccttccccatccccaggtgtgcctagattgatcggtataaggctcactctcccgccccccaaagtggttgatcgttggaacgagaaaagggccatgttcggagtgtatgacaacatcgggatcctgggaaactttgaaaagcaccccaaagaactgatcagggggcccatatggcttcgaggttggaaagggaatgaattgcaacgttgtatccgaaagaggaaaatggttggaagtagaatgttcgctgatgacctgcacaaccttaataaacgcatccgctatctctacaaacactttaaccgacatgggaagtttcgatagaagagaaagctgagaacttcggaaaaggctcatctgtcaccctggagaagggaaactgtacttttccctgtgaggaaacggctttgtattttctctgtaataaaatggggcttctttgg

SEQ ID NO: 154531 - DNA, 343 bp, Homo sapiens
  Payload ID: 10373
  Gene Symbol: MRPL51
  Gene Name: mitochondrial ribosomal protein L51
  ENST ID: ENST00000540949
  CDS Start-End: 123-343
gttgcggatggggcgtaggtgggcggtgcgcccacagctgcctgggtgtgcctagattgatcggtataaggctcactctcccgccccccaaagtggttgatcgttggaacgagaaaagggccatgttcggagtgtatgacaacatcgggatcctgggaaactttgaaaagcaccccaaagaactgatcagggggcccatatggcttcgaggttggaaagggaatgaattgcaacgttgtatccgaaagaggaaaatggttggaagtagaatgttcgctgatgacctgcacaaccttaataaacgcatccgctatctctacaaacactttaaccgacatgggaa

SEQ ID NO: 154532 - DNA, 601 bp, Homo sapiens
  Payload ID: 10373
  Gene Symbol: MRPL51
  Gene Name: mitochondrial ribosomal protein L51
  ENST ID: ENST00000537701
  CDS Start-End: 203-433
cgcctgcgaatccctccttggccgcaaggtccccctttgcccagtcggcggggaggaggccgtatttctgctggccagagacgtcgcgtccctggctgggcattcagtcacccccaggaaaggaggtgtgcctagattgatcggtataaggctcactctcccgccccccaaagtggttgatcgttggaacgagaaaagggccatgttcggagtgtatgacaacatcgggatcctgggaaactttgaaaagcaccccaaagaactgatcagggggcccatatggcttcgaggttggaaagggaatgaattgcaacgttgtatccgaaagaggaaaatggttggaagtagaatgttcgctgatgacctgcacaaccttaataaacgcatccgctatctctacaaacactttaaccgacatgggaagtttcgatagaagagaaagctgagaacttcggaaaaggctcatctgtcaccctggagaagggaaactgtacttttccctgtgaggaaacggctttgtattttctctgtaataaaatggggcttctttggaatttgatagccacatacttttgttttcctctagatgctgcctctactc

SEQ ID NO: 154533 - DNA, 814 bp, Homo sapiens
  Payload ID: 10373
  Gene Symbol: MRPL51
  Gene Name: mitochondrial ribosomal protein L51
  ENST ID: ENST00000543164
  CDS Start-End: 460-690
gcctgcgaatccctccttggccgcaaggtccccctttgcccagtcggcggggaggaggccgtatttctgctggccagagacgtcgcgtccctggctgggcattcagtcacccccaggaaaggaggcaagtccacgctgggagttagaaggcatcgcctctaatccaggtttcgccatctcctctgctaagtgacgtccagcaagtcacttcactttcaggacctcaaatctcctccccagtagtaaaataggggtaataaaaacagctacagcggaagactgttgtgaggcacagagaaagggcttggtcattggaagcgggttccaggttctcaaccttcatttccttcacggttgaaggacgccaaagaaagcggaaagggtgtgcctagattgatcggtataaggctcactctcccgccccccaaagtggttgatcgttggaacgagaaaagggccatgttcggagtgtatgacaacatcgggatcctgggaaactttgaaaagcaccccaaagaactgatcagggggcccatatggcttcgaggttggaaagggaatgaattgcaacgttgtatccgaaagaggaaaatggttggaagtagaatgttcgctgatgacctgcacaaccttaataaacgcatccgctatctctacaaacactttaaccgacatgggaagtttcgatagaagagaaagctgagaacttcggaaaaggctcatctgtcaccctggagaagggaaactgtacttttccctgtgaggaaacggctttgtattttctctgtaataaaatggggcttctttggaattt

SEQ ID NO: 154534 - DNA, 1042 bp, Homo sapiens
  Payload ID: 10374
  Gene Symbol: MRPL52
  Gene Name: mitochondrial ribosomal protein L52
  ENST ID: ENST00000311892
  CDS Start-End: 205-363
gctgctttagggactgttctcttcagtgagtggcaggtgtccggaggctgcactgcagcgtagccgcttgggcgggcggccagtggcgactacagcagggactggctgccaacccctccggctacgggccccttaccgagctcccagactggtcatatgcgggggtatgatcctgcttaattggataattggtgactgaggaagatggtgaagattttttctacttgttatttactagacgagttgtactgctgtcacaggaaatggacgctggattacaagcatggcagctcaggcagcagaagttgcaggaagaacaaaggaagcaggaaaatgctcttaaacccaaaggggcttcactgaagagcccacttccaagtcaataaaaagcaactcctgcctcccttcctcaccctgtctctggatttcttttctatcacctagatgcttcatccagccagaagatagccttcacgttccccatctgtcttcagagaaaaagagctgggacaccaagaacaagctgttagatcactgcctgggaggcttggcttagtactctcatctctggttccattccagttcagctaagtcttgctttaaaatttttacctcctagctgggtgcggtggctcacgcctgtaatcccagcactttgggaggctgaggcgggcagatcacaagatcaggagttcgagaccagcctggccaacccagcctggtcaacatggtgaaaccctgtccctactaaagatacaaacaattagccgggcgtggtggggtgcgcttgtaatcccagctactcaggaggctgaggcaggagaatcgcttaaactcgggaggtagaggttgcagtgagccaaggtcacaccattgcactccaacctgggcgacagggcgagactccgtctcaaaaaaaaaaaaaaatttacctcctttgcaggccataggactagcccaactatgagaaatagctgttctgtgaacgtgaaaaggggacagcagttttcccagttttggccaggcagtcaagcctttaaca

SEQ ID NO: 154535 - DNA, 1118 bp, Homo sapiens
  Payload ID: 10374
  Gene Symbol: MRPL52
  Gene Name: mitochondrial ribosomal protein L52
  Uniprot ID: Q86TS9
  ENST ID: ENST00000355151
  CDS Start-End: 31-402
ttccggctaccccggctactcctgctcagcatggctgctttagggactgttctcttcacaggtgtccggaggctgcactgcagcgtagccgcttgggcgggcggccagtggcgactacagcagggactggctgccaacccctccggctacgggccccttaccgagctcccagactggtcatatgcggatggccgccctgctcccccaatgaaaggccagcttcgaagaaaagctgaaagggagacgtttgcaagacgagttgtactgctgtcacaggaaatggacgctggattacaagcatggcagctcaggcagcagaagttgcaggaagaacaaaggaagcaggaaaatgctcttaaacccaaaggggcttcactgaagagcccacttccaagtcaataaaaagcaactcctgcctcccttcctcaccctgtctctggatttcttttctatcacctagatgcttcatccagccagaagatagccttcacgttccccatctgtcttcagagaaaaagagctgggacaccaagaacaagctgttagatcactgcctgggaggcttggcttagtactctcatctctggttccattccagttcagctaagtcttgctttaaaatttttacctcctagctgggtgcggtggctcacgcctgtaatcccagcactttgggaggctgaggcgggcagatcacaagatcaggagttcgagaccagcctggccaacccagcctggtcaacatggtgaaaccctgtccctactaaagatacaaacaattagccgggcgtggtggggtgcgcttgtaatcccagctactcaggaggctgaggcaggagaatcgcttaaactcgggaggtagaggttgcagtgagccaaggtcacaccattgcactccaacctgggcgacagggcgagactccgtctcaaaaaaaaaaaaaaatttacctcctttgcaggccataggactagcccaactatgagaaatagctgttctgtgaacgtgaaaaggggacagcagttttcccagttttggccaggcagtcaagcctttaacagctcatgcacagtttaggccatgtacagctggcatctaataaatgttttcatgaaaaaga

SEQ ID NO: 154536 - DNA, 1111 bp, Homo sapiens
  Payload ID: 10374
  Gene Symbol: MRPL52
  Gene Name: mitochondrial ribosomal protein L52
  Uniprot ID: Q86TS9
  ENST ID: ENST00000397496
  CDS Start-End: 27-395
ggctaccccggctactcctgctcagcatggctgctttagggactgttctcttcagtgtccggaggctgcactgcagcgtagccgcttgggcgggcggccagtggcgactacagcagggactggctgccaacccctccggctacgggccccttaccgagctcccagactggtcatatgcggatggccgccctgctcccccaatgaaaggccagcttcgaagaaaagctgaaagggagacgtttgcaagacgagttgtactgctgtcacaggaaatggacgctggattacaagcatggcagctcaggcagcagaagttgcaggaagaacaaaggaagcaggaaaatgctcttaaacccaaaggggcttcactgaagagcccacttccaagtcaataaaaagcaactcctgcctcccttcctcaccctgtctctggatttcttttctatcacctagatgcttcatccagccagaagatagccttcacgttccccatctgtcttcagagaaaaagagctgggacaccaagaacaagctgttagatcactgcctgggaggcttggcttagtactctcatctctggttccattccagttcagctaagtcttgctttaaaatttttacctcctagctgggtgcggtggctcacgcctgtaatcccagcactttgggaggctgaggcgggcagatcacaagatcaggagttcgagaccagcctggccaacccagcctggtcaacatggtgaaaccctgtccctactaaagatacaaacaattagccgggcgtggtggggtgcgcttgtaatcccagctactcaggaggctgaggcaggagaatcgcttaaactcgggaggtagaggttgcagtgagccaaggtcacaccattgcactccaacctgggcgacagggcgagactccgtctcaaaaaaaaaaaaaaatttacctcctttgcaggccataggactagcccaactatgagaaatagctgttctgtgaacgtgaaaaggggacagcagttttcccagttttggccaggcagtcaagcctttaacagctcatgcacagtttaggccatgtacagctggcatctaataaatgttttcatgaaaaaga

SEQ ID NO: 154537 - DNA, 333 bp, Homo sapiens
  Payload ID: 10374
  Gene Symbol: MRPL52
  Gene Name: mitochondrial ribosomal protein L52
  Uniprot ID: Q86TS9
  ENST ID: ENST00000397505
  CDS Start-End: 1-264
atggctgctttagggactgttctcttcacaggtgtccggaggctgcactgcagcgtagccgcttgggcgggcggccagtggcgactacagcagggactggctgccaacccctccggctacgggccccttaccgagctcccagactggtcatatgcggagacgagttgtactgctgtcacaggaaatggacgctggattacaagcatggcagctcaggcagcagaagttgcaggaagaacaaaggaagcaggaaaatgctcttaaacccaaaggggcttcactgaagagcccacttccaagtcaataaaaagcaactcctgcctcccttcctca

SEQ ID NO: 154538 - DNA, 411 bp, Homo sapiens
  Payload ID: 10374
  Gene Symbol: MRPL52
  Gene Name: mitochondrial ribosomal protein L52
  ENST ID: ENST00000432849
  CDS Start-End: 11-343
cctgctcagcatggctgctttagggactgttctcttcagtgtccggaggctgcactgcagcgtagccgcttgggcgggcggccagtggcgactacagcagggactggctgccaacccctccggctacgggccccttaccgagctcccagactggtcatatgcggatggccgccctgctcccccaatgaaaggccagcttcgaagaaaagctgaaagggagacgtttgcagtgagtgagacgagttgtactgctgtcacaggaaatggacgctggattacaagcatggcagctcaggcagcagaagttgcaggaagaacaaaggaagcaggaaaatgctcttaaacccaaaggggcttcactgaagagcccacttccaagtcaataaaaagcaactcctgcctcccttcctc

SEQ ID NO: 154539 - DNA, 895 bp, Homo sapiens
  Payload ID: 10374
  Gene Symbol: MRPL52
  Gene Name: mitochondrial ribosomal protein L52
  Uniprot ID: Q86TS9
  ENST ID: ENST00000555345
  CDS Start-End: 305-499
cggctactcctgctcagcatggctgctttagggactgttctcttcagtgagtgggtatagatagggaccgtggactcgggggccctttggggacgggcacaggacccctgatccggctgcgcggcctctcccccaactctgctctgttctcccagcaggtgtccggaggctgcactgcagcgtagccgcttgggcgggcggccagtggcgactacagcagggactggctgccaacccctccggctacgggccccttaccgagctcccagactggtcatatgcggatggccgccctgctcccccaatgaaaggccagcttcgaagaaaagctgaaagggagacgtttgcaagacgagttgtactgctgtcacaggaaatggacgctggattacaagcatggcagctcaggcagcagaagttgcaggaagaacaaaggaagcaggaaaatgctcttaaacccaaaggggcttcactgaagagcccacttccaagtcaataaaaagcaactcctgcctcccttcctcaccctgtctctggatttcttttctatcacctagatgcttcatccagccagaagatagccttcacgttccccatctgtcttcagagaaaaagagctgggacaccaagaacaagctgttagatcactgcctgggaggcttggcttagtactctcatctctggttccattccagttcagctaagtcttgctttaaaatttttacctcctagctgggtgcggtggctcacgcctgtaatcccagcactttgggaggctgaggcgggcagatcacaagatcaggagttcgagaccagcctggccaacccagcctggtcaacatggtgaaaccctgtccctactaaagatacaaacaattagccgggcgtggtgggg

SEQ ID NO: 154540 - DNA, 586 bp, Homo sapiens
  Payload ID: 10374
  Gene Symbol: MRPL52
  Gene Name: mitochondrial ribosomal protein L52
  Uniprot ID: Q86TS9
  ENST ID: ENST00000553711
  CDS Start-End: 368-562
gctcagcatggctgctttagggactgttctcttcagtgagtgggtatagatagggaccgtggactcgggggccctttggggacgggcacaggacccctgatccggctgcgcggcctctcccccaactctgctctgttctcccagcaggtgtccggaggctgcactgcagcgtagccgcttgggcgggcggccagtggcgactacagcagggactggctgccaacccctccggctacgggccccttaccgagctcccagactggtcatatgcgggggtatgatcctgcttaattggataattggtgactgaggaagatggtgaagattttttctacttgttatttactatggccgccctgctcccccaatgaaaggccagcttcgaagaaaagctgaaagggagacgtttgcaagacgagttgtactgctgtcacaggaaatggacgctggattacaagcatggcagctcaggcagcagaagttgcaggaagaacaaaggaagcaggaaaatgctcttaaacccaaaggggcttcactgaagagcccacttccaagtcaataaaaagcaactcctgcctcccttcct

SEQ ID NO: 154541 - DNA, 922 bp, Homo sapiens
  Payload ID: 10374
  Gene Symbol: MRPL52
  Gene Name: mitochondrial ribosomal protein L52
  ENST ID: ENST00000557221
  CDS Start-End: 260-415
tggctgctttagggactgttctcttcagtgagtgggtatagatagggaccgtggactcgggggccctttggggacgggcacaggacccctgatccggctgcgcggcctctcccccaactctgctctgttctcccagcaggtgtccggaggctgcactgcagcgtagccgcttgggcgggcggccagtggcgactacagcagggactggctgccaacccctccggctacgggccccttaccgagctcccagactggtcatatgcggagacgagttgtactgctgtcacaggaaatggacgctggattacaagcatggcagctcaggcagcagaagttgcaggaagaacaaaggaagcaggaaaatgctcttaaacccaaaggggcttcactgaagagcccacttccaagtcaataaaaagcaactcctgcctcccttcctcaccctgtctctggatttcttttctatcacctagatgcttcatccagccagaagatagccttcacgttccccatctgtcttcagagaaaaagagctgggacaccaagaacaagctgttagatcactgcctgggaggcttggcttagtactctcatctctggttccattccagttcagctaagtcttgctttaaaatttttacctcctagctgggtgcggtggctcacgcctgtaatcccagcactttgggaggctgaggcgggcagatcacaagatcaggagttcgagaccagcctggccaacccagcctggtcaacatggtgaaaccctgtccctactaaagatacaaacaattagccgggcgtggtggggtgcgcttgtaatcccagctactcaggaggctgaggcaggagaatcgcttaaactcgggaggtagaggttgcagtgagccaaggtcacaccattgcactccaacctgggcga

SEQ ID NO: 154542 - DNA, 398 bp, Homo sapiens
  Payload ID: 10374
  Gene Symbol: MRPL52
  Gene Name: mitochondrial ribosomal protein L52
  Uniprot ID: Q86TS9
  ENST ID: ENST00000556840
  CDS Start-End: 178-372
tttagggactgttctcttcagtgagtggcaggtgtccggaggctgcactgcagcgtagccgcttgggcgggcggccagtggcgactacagcagggactggctgccaacccctccggctacgggccccttaccgagctcccagactggtcatatgcggatggccgccctgctcccccaatgaaaggccagcttcgaagaaaagctgaaagggagacgtttgcaagacgagttgtactgctgtcacaggaaatggacgctggattacaagcatggcagctcaggcagcagaagttgcaggaagaacaaaggaagcaggaaaatgctcttaaacccaaaggggcttcactgaagagcccacttccaagtcaataaaaagcaactcctgcctcccttcctca

SEQ ID NO: 154543 - DNA, 451 bp, Homo sapiens
  Payload ID: 10374
  Gene Symbol: MRPL52
  Gene Name: mitochondrial ribosomal protein L52
  ENST ID: ENST00000555536
  CDS Start-End: 225-383
gcaggtgtccggaggctgcactgcagcgtagccgcttgggcgggcggccagtggcgactacagcagggactggctgccaacccctccggctacgggccccttaccgagctcccagactggtcatatgcgggggtatgatcctgcttaattggataattggtgactgaggaagatggtgaagattttttctacttgttatttactatggccgccctgctcccccaatgaaaggccagcttcgaagaaaagctgaaagggagacgtttgcagtgagtgagacgagttgtactgctgtcacaggaaatggacgctggattacaagcatggcagctcaggcagcagaagttgcaggaagaacaaaggaagcaggaaaatgctcttaaacccaaaggggcttcactgaagagcccacttccaagtcaataaaaagcaactcctgcctcccttcctc

SEQ ID NO: 154544 - DNA, 220 bp, Homo sapiens
  Payload ID: 10374
  Gene Symbol: MRPL52
  Gene Name: mitochondrial ribosomal protein L52
  ENST ID: ENST00000556465
  CDS Start-End: 4-220
agcatggctgctttagggactgttctcttcagtgtccggaggctgcactgcagcgtagccgcttgggcgggcggccagtggcgactacagcagggactggctgccaacccctccggctacgggccccttaccgagctcccagactggtcatatgcggagacgagttgtactgctgtcacaggaaatggacgctggattacaagcatggcagctcaggcag

SEQ ID NO: 154545 - DNA, 1162 bp, Homo sapiens
  Payload ID: 10375
  Gene Symbol: MRPL53
  Gene Name: mitochondrial ribosomal protein L53
  Uniprot ID: Q96EL3
  ENST ID: ENST00000258105
  CDS Start-End: 663-1001
gctagaatgcacttcaacttaagtcctgggagctacgctaattcatggagaaccacagaggtttaataggcatttctatacctggatcagccccaaggacagtattaccctgtactgcccttcctattactattttcagtcatttactaatattgggctgtagtactttcacgtttaagctttggctattcagagctcactacgtttaatcttcagttacctgaatggtgtttaccttctggtgtggatcatcccggcttgtgttagtgctctctctttggaagaagccaggatttaagatcgagttagcctagatgtggcccagcagggtacagaaggggaaaggctgcagaaaacgggcgtattttcgtgcaaagaggtttttgcgccatttatttatggttttcaccgtcgtatgagaggactattcatgataggctgtatttgctgacagcctactttgggctcccccatgcgttgtgccgaaaccacctctttctttcctgccttcctccgcctgggctaggaagcccagagctgcggttcgcaggcctgctaagcagccggcggccggaagtctatcccgcagaagcgcagccattcacggcctcacgcaatgcgacacttccgcctgcacgagttcttccggggcggaggtcaccatggcagctgccttggctcggcttggtctgcggcctgtcaaacaggttcgggttcagttctgtcccttcgagaaaaacgtggaatcgacgaggaccttcctgcagacggtgagcagtgagaaggtccgctccactaatctcaactgctcagtgattgcggacgtgaggcatgacggctccgagccctgcgtggacgtgctgttcggagacgggcatcgcctgattatgcgcggcgctcatctcaccgctctggaaatgctcaccgccttcgcctcccacatccgggccagggacgcggcgggcagcggggacaagccgggcgctgatactggtcgctgacagcgccaaagagaccaacaagatgattttagcgtggactaggacacttaacctaagaagagtttcacttaatcattcaaatcactatctgaagggtcacggagcgcaaaataaagtttaaaaccctgctaccacaatgtttctggaacaagactagatca

SEQ ID NO: 154546 - DNA, 386 bp, Homo sapiens
  Payload ID: 10375
  Gene Symbol: MRPL53
  Gene Name: mitochondrial ribosomal protein L53
  ENST ID: ENST00000409710
  CDS Start-End: 28-240
acgagttcttccggggcggaggtcaccatggcagctgccttggctcggcttggtctgcggcctgtcaaacaggttcgggttcagttctgtcccttcgagaaaaacgtggaatcgacgaggagacgggcatcgcctgattatgcgcggcgctcatctcaccgctctggaaatgctcaccgccttcgcctcccacatccgggccagggacgcggcgggcagcggggacaagccgggcgctgatactggtcgctgacagcgccaaagagaccaacaagatgattttagcgtggactaggacacttaacctaagaagagtttcacttaatcattcaaatcactatctgaagggtcacggagcgcaaaataaagtttaaaaccctgctacc

SEQ ID NO: 154547 - DNA, 626 bp, Homo sapiens
  Payload ID: 10376
  Gene Symbol: MRPL54
  Gene Name: mitochondrial ribosomal protein L54
  Uniprot ID: Q6P161
  ENST ID: ENST00000330133
  CDS Start-End: 38-454
ccggaaacgtgcacttgcaagctgcccgcaatacgtcatggcgaccaaacgccttttcggggctacccggacgtgggccggctggggggcctgggagctcctaaaccccgccacttccggaagactcctggcccgggattatgccaagaaaccagttatgaagggggccaaatcgggaaaaggtgcagtgaccagcgaggccctcaaggaccccgacgtatgcacagatcctgtccagctcaccacatatgccatgggcgtcaacatctacaaggaagggcaggatgtacccctgaaaccggatgctgagtaccctgaatggctgttcgagatgaacttgggtcccccaaagaccctggaggagctggaccccgagagccgggagtactggcggcggctgcggaaacagaacatctggcgccacaaccggctgagcaagaacaagaggttgtagcatggagggcccggcatcgctgacccccacgccgagggcttgccgttttcccggaggacgtggacttttgtgagacaagaggcggctccccagcctgggtttccatgtgaccccacagtggggctggaccagggccctggaggccaataaagagctttctgggtagacccta

SEQ ID NO: 154548 - DNA, 491 bp, Homo sapiens
  Payload ID: 10376
  Gene Symbol: MRPL54
  Gene Name: mitochondrial ribosomal protein L54
  ENST ID: ENST00000589174
  CDS Start-End: 1-230
cgaccaaacgccttttcggggctacccggacgtgggccggctggggggcctgggagctcctaaaccccgccacttccggaagactcctggcccgggattatgccaagaaaccagtccaccctctggagtcggctttcggcaccctgaccctgacccagggtctgaccctaggcctgagtgaggactggcctccctgcagtcccaacaactcctgccctgcctggctgtgatggggcgggatcacgagggctggagtccaccagattagaggaggctgagggtgacacgtagttagggagtgatggggcctcttgctgggggtagatcacctcatggaccccacgtcctgcagaacccccaagggtcatgccctcggccccacccttgccacagcagccccacccatgcctaggtgggtgccctgggggatttggactgggctcacccaccctccggcttcctctgtccacaagctggatgggcggggcggg

SEQ ID NO: 154549 - DNA, 632 bp, Homo sapiens
  Payload ID: 10377
  Gene Symbol: MRPL55
  Gene Name: mitochondrial ribosomal protein L55
  Uniprot ID: Q7Z7F7
  ENST ID: ENST00000295008
  CDS Start-End: 165-551
agtgacgtcgtgggctgcagcgcagcagcacccaacgcatctagcaggaaaggagagggagctttccccgaagaccctcctggaccagccccaggctcctgtgctggttgcacgccagggcctgtactgaccacctccacgtgccactggggctgtaaggaggaatggcggccgtgggcagcctgcttggccggctgaggcagagcaccgtgaaggccaccggacctgcactccgccgcctgcacacatcctcctggcgagctgacagcagcagggcctcactcactcgtgtgcaccgccaggcttatgcacgactctaccccgtgctgctggtgaagcaggatggctccaccatccacatccgctacagggagccacggcgcatgctggcgatgcccatagatctggacaccctgtctcctgaggagcgccgggccaggctgcggaagcgtgaggctcagctccagtcgaggaaggagtacgagcaggagctcagtgatgacttgcatgtggagcgctaccgacagttctggaccaggaccaagaagtgaccgtggctccagccaccccgggacattgctaagatgggagggctgttcttaaatcactcgttcttgaagctgccacctgga

SEQ ID NO: 154550 - DNA, 744 bp, Homo sapiens
  Payload ID: 10377
  Gene Symbol: MRPL55
  Gene Name: mitochondrial ribosomal protein L55
  Uniprot ID: Q7Z7F7
  ENST ID: ENST00000336520
  CDS Start-End: 277-663
agtgacgtcgtgggctgcagcgcagcagcacccaacgcagtgagtaccttgatctcctgcgtggcctcgtccctggtcttagttccaccgggcagcgggagtcaggaccgcctgtcctcagacccctccgcagcgactgtggcggccgcagtctagcaggaaaggagagggagctttccccgaagaccctcctggaccagccccaggctcctgtgctggttgcacgccagggcctgtactgaccacctccacgtgccactggggctgtaaggaggaatggcggccgtgggcagcctgcttggccggctgaggcagagcaccgtgaaggccaccggacctgcactccgccgcctgcacacatcctcctggcgagctgacagcagcagggcctcactcactcgtgtgcaccgccaggcttatgcacgactctaccccgtgctgctggtgaagcaggatggctccaccatccacatccgctacagggagccacggcgcatgctggcgatgcccatagatctggacaccctgtctcctgaggagcgccgggccaggctgcggaagcgtgaggctcagctccagtcgaggaaggagtacgagcaggagctcagtgatgacttgcatgtggagcgctaccgacagttctggaccaggaccaagaagtgaccgtggctccagccaccccgggacattgctaagatgggagggctgttcttaaatcactcgttcttgaagctgccacctgga

SEQ ID NO: 154551 - DNA, 722 bp, Homo sapiens
  Payload ID: 10377
  Gene Symbol: MRPL55
  Gene Name: mitochondrial ribosomal protein L55
  Uniprot ID: Q7Z7F7
  ENST ID: ENST00000336300
  CDS Start-End: 255-641
gcctgccagtgacgtcgtgggctgcagcgcagcagcacccaacgcagtgagtaccttgatctcctgcgtggcctcgtccctggtcttagttccaccgggcagcgggagtcaggaccgcctgtcctcagacccctccgcagcgactgtggcggccgcaggcggttctgagaagtccaagggttgctgggagaggttggttgcacgccagggcctgtactgaccacctccacgtgccactggggctgtaaggaggaatggcggccgtgggcagcctgcttggccggctgaggcagagcaccgtgaaggccaccggacctgcactccgccgcctgcacacatcctcctggcgagctgacagcagcagggcctcactcactcgtgtgcaccgccaggcttatgcacgactctaccccgtgctgctggtgaagcaggatggctccaccatccacatccgctacagggagccacggcgcatgctggcgatgcccatagatctggacaccctgtctcctgaggagcgccgggccaggctgcggaagcgtgaggctcagctccagtcgaggaaggagtacgagcaggagctcagtgatgacttgcatgtggagcgctaccgacagttctggaccaggaccaagaagtgaccgtggctccagccaccccgggacattgctaagatgggagggctgttcttaaatcactcgttcttgaagctgccacctgga

SEQ ID NO: 154552 - DNA, 661 bp, Homo sapiens
  Payload ID: 10377
  Gene Symbol: MRPL55
  Gene Name: mitochondrial ribosomal protein L55
  Uniprot ID: Q7Z7F7
  ENST ID: ENST00000348259
  CDS Start-End: 194-580
gcagcgcagcagcacccaacgcagtgagtaccttgatctcctgcgtggcctcgtccctggtcttagttccaccgggcagcgggagtcaggaccgcctgtcctcagacccctccgcagcgactgtggcggccgcaggttgcacgccagggcctgtactgaccacctccacgtgccactggggctgtaaggaggaatggcggccgtgggcagcctgcttggccggctgaggcagagcaccgtgaaggccaccggacctgcactccgccgcctgcacacatcctcctggcgagctgacagcagcagggcctcactcactcgtgtgcaccgccaggcttatgcacgactctaccccgtgctgctggtgaagcaggatggctccaccatccacatccgctacagggagccacggcgcatgctggcgatgcccatagatctggacaccctgtctcctgaggagcgccgggccaggctgcggaagcgtgaggctcagctccagtcgaggaaggagtacgagcaggagctcagtgatgacttgcatgtggagcgctaccgacagttctggaccaggaccaagaagtgaccgtggctccagccaccccgggacattgctaagatgggagggctgttcttaaatcactcgttcttgaagctgccacctgga

SEQ ID NO: 154553 - DNA, 1423 bp, Homo sapiens
  Payload ID: 10377
  Gene Symbol: MRPL55
  Gene Name: mitochondrial ribosomal protein L55
  ENST ID: ENST00000366731
  CDS Start-End: 1175-1342
agtgacgtcgtgggctgcagcgcagcagcacccaacgcagtgagtaccttgatctcctgcgtggcctcgtccctggtcttagttccaccgggcagcgggagtcaggaccgcctgtcctcagacccctccgcagcgactgtggcggccgcagtctagcaggaaaggagagggagctttccccgaagaccctcctggaccagccccaggctcctgtgctggtgaggccgagggagagggatgtgggcataggacacgtagcaggatttccattttagaggcagccggacctgtcttcaggtcccttccttggtgagagacaggggtacgccagaggaagctgggcgctcggcctctgtgcagcctcatctcctggaatctgagtattgaaaactgggcttttacttcgcacacctcagcacagactcccatgggaatccaggtcacagcaaagcagccctgggcctccattctcctttaagcaagcatgacaatcctcacttcactgagtttttattaaaactagcaatgaccttagaaagcaaggcatgacctcagctccacttttgaggctgcagtccattcagagaggtttcgcagactcggtaacggccagaacagacagcctgggccctgccgcaggctgactcagaatctttgggagtagtgaccaacttctgcttttggaaaaacctctacaggcggttctgagaagtccaagggttgctgggagaggttggttgcacgccagggcctgtactgaccacctccacgtgccactggggctgtaaggaggaatggcggccgtgggcagcctgcttggtccttgctattgtccactgtcccctgtgctggaagctttgtgcccttgctcagcctggcagcctcttcctggctagggggccagaacgcctctgaccacagcctgtggctcctgaggaagccccgaggctcatcctgccccggcacgggtcaccagctctgccggctgaggcagagcaccgtgaaggccaccggacctgcactccgccgcctgcacacatcctcctggcgagctgacagcagcagggcctcactcactcgtgtgcaccgccaggcttatgcacgactctaccccgtgctgctggtgaagcaggatggctccaccatccacatccgctacagggagccacggcgcatgctggcgatgcccatagatctggacaccctgtctcctgaggagcgccgggccaggctgcggaagcgtgaggctcagctccagtcgaggaaggagtacgagcaggagctcagtgatgacttgcatgtggagcgctaccgacagttctggaccaggaccaagaagtgaccgtggctccagccaccccgggacattgctaagatgggagggctgttcttaaatcactcgttcttgaagctgccacctgga

SEQ ID NO: 154554 - DNA, 722 bp, Homo sapiens
  Payload ID: 10377
  Gene Symbol: MRPL55
  Gene Name: mitochondrial ribosomal protein L55
  ENST ID: ENST00000366732
  CDS Start-End: 474-641
cttagaaagcaaggcatgacctcagctccacttttgaggctgcagtccattcagagaggtttcgcagactcggtaacggccagaacagacagcctgggccctgccgcaggctgactcagaatctttgggagtagtgaccaacttctgcttttggaaaaacctctacaggcggttctgagaagtccaagggttgctgggagaggttggttgcacgccagggcctgtactgaccacctccacgtgccactggggctgtaaggaggaatggcggccgtgggcaccggctgaggcagagcaccgtgaaggccaccggacctgcactccgccgcctgcacacatcctcctggcgagctgacagcagcagggcctcactcactcgtgtgcaccgccaggcttatgcacgactctaccccgtgctgctggtgaagcaggatggctccaccatccacatccgctacagggagccacggcgcatgctggcgatgcccatagatctggacaccctgtctcctgaggagcgccgggccaggctgcggaagcgtgaggctcagctccagtcgaggaaggagtacgagcaggagctcagtgatgacttgcatgtggagcgctaccgacagttctggaccaggaccaagaagtgaccgtggctccagccaccccgggacattgctaagatgggagggctgttcttaaatcactcgttcttgaagctgccacctgga

SEQ ID NO: 154555 - DNA, 834 bp, Homo sapiens
  Payload ID: 10377
  Gene Symbol: MRPL55
  Gene Name: mitochondrial ribosomal protein L55
  Uniprot ID: Q7Z7F7
  ENST ID: ENST00000366733
  CDS Start-End: 367-753
tgggaatccaggtcacagcaaagcagccctgggcctccattctcctttaagcaagcatgacaatcctcacttcactgagtttttattaaaactagcaatgaccttagaaagcaaggcatgacctcagctccacttttgaggctgcagtccattcagagaggtttcgcagactcggtaacggccagaacagacagcctgggccctgccgcaggctgactcagaatctttgggagtagtgaccaacttctgcttttggaaaaacctctacaggcggttctgagaagtccaagggttgctgggagaggttggttgcacgccagggcctgtactgaccacctccacgtgccactggggctgtaaggaggaatggcggccgtgggcagcctgcttggccggctgaggcagagcaccgtgaaggccaccggacctgcactccgccgcctgcacacatcctcctggcgagctgacagcagcagggcctcactcactcgtgtgcaccgccaggcttatgcacgactctaccccgtgctgctggtgaagcaggatggctccaccatccacatccgctacagggagccacggcgcatgctggcgatgcccatagatctggacaccctgtctcctgaggagcgccgggccaggctgcggaagcgtgaggctcagctccagtcgaggaaggagtacgagcaggagctcagtgatgacttgcatgtggagcgctaccgacagttctggaccaggaccaagaagtgaccgtggctccagccaccccgggacattgctaagatgggagggctgttcttaaatcactcgttcttgaagctgccacctgga

SEQ ID NO: 154556 - DNA, 990 bp, Homo sapiens
  Payload ID: 10377
  Gene Symbol: MRPL55
  Gene Name: mitochondrial ribosomal protein L55
  Uniprot ID: Q7Z7F7
  ENST ID: ENST00000366734
  CDS Start-End: 523-909
aggcagccggacctgtcttcaggtcccttccttggtgagagacaggggtacgccagaggaagctgggcgctcggcctctgtgcagcctcatctcctggaatctgagtattgaaaactgggcttttacttcgcacacctcagcacagactcccatgggaatccaggtcacagcaaagcagccctgggcctccattctcctttaagcaagcatgacaatcctcacttcactgagtttttattaaaactagcaatgaccttagaaagcaaggcatgacctcagctccacttttgaggctgcagtccattcagagaggtttcgcagactcggtaacggccagaacagacagcctgggccctgccgcaggctgactcagaatctttgggagtagtgaccaacttctgcttttggaaaaacctctacaggcggttctgagaagtccaagggttgctgggagaggttgcaggttgcacgccagggcctgtactgaccacctccacgtgccactggggctgtaaggaggaatggcggccgtgggcagcctgcttggccggctgaggcagagcaccgtgaaggccaccggacctgcactccgccgcctgcacacatcctcctggcgagctgacagcagcagggcctcactcactcgtgtgcaccgccaggcttatgcacgactctaccccgtgctgctggtgaagcaggatggctccaccatccacatccgctacagggagccacggcgcatgctggcgatgcccatagatctggacaccctgtctcctgaggagcgccgggccaggctgcggaagcgtgaggctcagctccagtcgaggaaggagtacgagcaggagctcagtgatgacttgcatgtggagcgctaccgacagttctggaccaggaccaagaagtgaccgtggctccagccaccccgggacattgctaagatgggagggctgttcttaaatcactcgttcttgaagctgccacctgga

SEQ ID NO: 154557 - DNA, 1212 bp, Homo sapiens
  Payload ID: 10377
  Gene Symbol: MRPL55
  Gene Name: mitochondrial ribosomal protein L55
  Uniprot ID: Q7Z7F7
  ENST ID: ENST00000366735
  CDS Start-End: 745-1131
gggagctttccccgaagaccctcctggaccagccccaggctcctgtgctggtgaggccgagggagagggatgtgggcataggacacgtagcaggatttccattttagaggcagccggacctgtcttcaggtcccttccttggtgagagacaggggtacgccagaggaagctgggcgctcggcctctgtgcagcctcatctcctggaatctgagtattgaaaactgggcttttacttcgcacacctcagcacagactcccatgggaatccaggtcacagcaaagcagccctgggcctccattctcctttaagcaagcatgacaatcctcacttcactgagtttttattaaaactagcaatgaccttagaaagcaaggcatgacctcagctccacttttgaggctgcagtccattcagagaggtttcgcagactcggtaacggccagaacagacagcctgggccctgccgcaggctgactcagaatctttgggagtagtgaccaacttctgcttttggaaaaacctctacaggcggttctgagaagtccaagggttgctgggagaggttggtgagtggcgtggtgattacatgtgtcttggaagcatcctgggctgggatttgataagaaaccattaggtggaagaaccttccttttaaaaaagatctcttcattctctgcctagcaggttgcacgccagggcctgtactgaccacctccacgtgccactggggctgtaaggaggaatggcggccgtgggcagcctgcttggccggctgaggcagagcaccgtgaaggccaccggacctgcactccgccgcctgcacacatcctcctggcgagctgacagcagcagggcctcactcactcgtgtgcaccgccaggcttatgcacgactctaccccgtgctgctggtgaagcaggatggctccaccatccacatccgctacagggagccacggcgcatgctggcgatgcccatagatctggacaccctgtctcctgaggagcgccgggccaggctgcggaagcgtgaggctcagctccagtcgaggaaggagtacgagcaggagctcagtgatgacttgcatgtggagcgctaccgacagttctggaccaggaccaagaagtgaccgtggctccagccaccccgggacattgctaagatgggagggctgttcttaaatcactcgttcttgaagctgccacctgga

SEQ ID NO: 154558 - DNA, 660 bp, Homo sapiens
  Payload ID: 10377
  Gene Symbol: MRPL55
  Gene Name: mitochondrial ribosomal protein L55
  Uniprot ID: Q7Z7F7
  ENST ID: ENST00000366736
  CDS Start-End: 193-579
caggaaaggagagggagctttccccgaagaccctcctggaccagccccaggctcctgtgctgtgaccaacttctgcttttggaaaaacctctacaggcggttctgagaagtccaagggttgctgggagaggttggttgcacgccagggcctgtactgaccacctccacgtgccactggggctgtaaggaggaatggcggccgtgggcagcctgcttggccggctgaggcagagcaccgtgaaggccaccggacctgcactccgccgcctgcacacatcctcctggcgagctgacagcagcagggcctcactcactcgtgtgcaccgccaggcttatgcacgactctaccccgtgctgctggtgaagcaggatggctccaccatccacatccgctacagggagccacggcgcatgctggcgatgcccatagatctggacaccctgtctcctgaggagcgccgggccaggctgcggaagcgtgaggctcagctccagtcgaggaaggagtacgagcaggagctcagtgatgacttgcatgtggagcgctaccgacagttctggaccaggaccaagaagtgaccgtggctccagccaccccgggacattgctaagatgggagggctgttcttaaatcactcgttcttgaagctgccacctgga

SEQ ID NO: 154559 - DNA, 705 bp, Homo sapiens
  Payload ID: 10377
  Gene Symbol: MRPL55
  Gene Name: mitochondrial ribosomal protein L55
  Uniprot ID: Q7Z7F7
  ENST ID: ENST00000366738
  CDS Start-End: 130-624
gcagtctagcaggaaaggagagggagctttccccgaagaccctcctggaccagccccaggctcctgtgctggttgcacgccagggcctgtactgaccacctccacgtgccactggggctgtaaggaggaatggcggccgtgggcagcctgcttggcctggcagcctcttcctggctagggggccagaacgcctctgaccacagcctgtggctcctgaggaagccccgaggctcatcctgccccggcacgggtcaccagctctgccggctgaggcagagcaccgtgaaggccaccggacctgcactccgccgcctgcacacatcctcctggcgagctgacagcagcagggcctcactcactcgtgtgcaccgccaggcttatgcacgactctaccccgtgctgctggtgaagcaggatggctccaccatccacatccgctacagggagccacggcgcatgctggcgatgcccatagatctggacaccctgtctcctgaggagcgccgggccaggctgcggaagcgtgaggctcagctccagtcgaggaaggagtacgagcaggagctcagtgatgacttgcatgtggagcgctaccgacagttctggaccaggaccaagaagtgaccgtggctccagccaccccgggacattgctaagatgggagggctgttcttaaatcactcgttcttgaagctgccacctgga

SEQ ID NO: 154560 - DNA, 641 bp, Homo sapiens
  Payload ID: 10377
  Gene Symbol: MRPL55
  Gene Name: mitochondrial ribosomal protein L55
  Uniprot ID: Q7Z7F7
  ENST ID: ENST00000366739
  CDS Start-End: 174-560
ccccatgcagtctagcaggaaaggagagggagctttccccgaagaccctcctggaccagccccaggctcctgtgctggcggttctgagaagtccaagggttgctgggagaggttggttgcacgccagggcctgtactgaccacctccacgtgccactggggctgtaaggaggaatggcggccgtgggcagcctgcttggccggctgaggcagagcaccgtgaaggccaccggacctgcactccgccgcctgcacacatcctcctggcgagctgacagcagcagggcctcactcactcgtgtgcaccgccaggcttatgcacgactctaccccgtgctgctggtgaagcaggatggctccaccatccacatccgctacagggagccacggcgcatgctggcgatgcccatagatctggacaccctgtctcctgaggagcgccgggccaggctgcggaagcgtgaggctcagctccagtcgaggaaggagtacgagcaggagctcagtgatgacttgcatgtggagcgctaccgacagttctggaccaggaccaagaagtgaccgtggctccagccaccccgggacattgctaagatgggagggctgttcttaaatcactcgttcttgaagctgccacctgga

SEQ ID NO: 154561 - DNA, 644 bp, Homo sapiens
  Payload ID: 10377
  Gene Symbol: MRPL55
  Gene Name: mitochondrial ribosomal protein L55
  Uniprot ID: Q7Z7F7
  ENST ID: ENST00000366740
  CDS Start-End: 177-563
ccccatgcagtctagcaggaaaggagagggagctttccccgaagaccctcctggaccagccccaggctcctgtgctggcggttctgagaagtccaagggttgctgggagaggttgcaggttgcacgccagggcctgtactgaccacctccacgtgccactggggctgtaaggaggaatggcggccgtgggcagcctgcttggccggctgaggcagagcaccgtgaaggccaccggacctgcactccgccgcctgcacacatcctcctggcgagctgacagcagcagggcctcactcactcgtgtgcaccgccaggcttatgcacgactctaccccgtgctgctggtgaagcaggatggctccaccatccacatccgctacagggagccacggcgcatgctggcgatgcccatagatctggacaccctgtctcctgaggagcgccgggccaggctgcggaagcgtgaggctcagctccagtcgaggaaggagtacgagcaggagctcagtgatgacttgcatgtggagcgctaccgacagttctggaccaggaccaagaagtgaccgtggctccagccaccccgggacattgctaagatgggagggctgttcttaaatcactcgttcttgaagctgccacctgga

SEQ ID NO: 154562 - DNA, 603 bp, Homo sapiens
  Payload ID: 10377
  Gene Symbol: MRPL55
  Gene Name: mitochondrial ribosomal protein L55
  Uniprot ID: Q7Z7F7
  ENST ID: ENST00000366741
  CDS Start-End: 136-522
ccccatgcagtctagcaggaaaggagagggagctttccccgaagaccctcctggaccagccccaggctcctgtgctggttgcacgccagggcctgtactgaccacctccacgtgccactggggctgtaaggaggaatggcggccgtgggcagcctgcttggccggctgaggcagagcaccgtgaaggccaccggacctgcactccgccgcctgcacacatcctcctggcgagctgacagcagcagggcctcactcactcgtgtgcaccgccaggcttatgcacgactctaccccgtgctgctggtgaagcaggatggctccaccatccacatccgctacagggagccacggcgcatgctggcgatgcccatagatctggacaccctgtctcctgaggagcgccgggccaggctgcggaagcgtgaggctcagctccagtcgaggaaggagtacgagcaggagctcagtgatgacttgcatgtggagcgctaccgacagttctggaccaggaccaagaagtgaccgtggctccagccaccccgggacattgctaagatgggagggctgttcttaaatcactcgttcttgaagctgccacctgga

SEQ ID NO: 154563 - DNA, 630 bp, Homo sapiens
  Payload ID: 10377
  Gene Symbol: MRPL55
  Gene Name: mitochondrial ribosomal protein L55
  Uniprot ID: Q7Z7F7
  ENST ID: ENST00000366742
  CDS Start-End: 163-549
gctgcacctgtgataagcccttgtccccatgcagtctagcaggaaaggagagggagctttccccgaagaccctcctggaccagccccaggctcctgtgctgcaggttgcacgccagggcctgtactgaccacctccacgtgccactggggctgtaaggaggaatggcggccgtgggcagcctgcttggccggctgaggcagagcaccgtgaaggccaccggacctgcactccgccgcctgcacacatcctcctggcgagctgacagcagcagggcctcactcactcgtgtgcaccgccaggcttatgcacgactctaccccgtgctgctggtgaagcaggatggctccaccatccacatccgctacagggagccacggcgcatgctggcgatgcccatagatctggacaccctgtctcctgaggagcgccgggccaggctgcggaagcgtgaggctcagctccagtcgaggaaggagtacgagcaggagctcagtgatgacttgcatgtggagcgctaccgacagttctggaccaggaccaagaagtgaccgtggctccagccaccccgggacattgctaagatgggagggctgttcttaaatcactcgttcttgaagctgccacctgga

SEQ ID NO: 154564 - DNA, 726 bp, Homo sapiens
  Payload ID: 10377
  Gene Symbol: MRPL55
  Gene Name: mitochondrial ribosomal protein L55
  Uniprot ID: Q7Z7F7
  ENST ID: ENST00000366744
  CDS Start-End: 259-645
gcgcagcagcacccaacgcagtgagtaccttgatctcctgcgtggcctcgtccctggtcttagttccaccgggcagcgggagtcaggaccgcctgtcctcagacccctccgcagcgactgtggcggccgcagtgaccaacttctgcttttggaaaaacctctacaggcggttctgagaagtccaagggttgctgggagaggttgcacgccagggcctgtactgaccacctccacgtgccactggggctgtaaggaggaatggcggccgtgggcagcctgcttggccggctgaggcagagcaccgtgaaggccaccggacctgcactccgccgcctgcacacatcctcctggcgagctgacagcagcagggcctcactcactcgtgtgcaccgccaggcttatgcacgactctaccccgtgctgctggtgaagcaggatggctccaccatccacatccgctacagggagccacggcgcatgctggcgatgcccatagatctggacaccctgtctcctgaggagcgccgggccaggctgcggaagcgtgaggctcagctccagtcgaggaaggagtacgagcaggagctcagtgatgacttgcatgtggagcgctaccgacagttctggaccaggaccaagaagtgaccgtggctccagccaccccgggacattgctaagatgggagggctgttcttaaatcactcgttcttgaagctgccacctgga

SEQ ID NO: 154565 - DNA, 565 bp, Homo sapiens
  Payload ID: 10377
  Gene Symbol: MRPL55
  Gene Name: mitochondrial ribosomal protein L55
  Uniprot ID: Q7Z7F7
  ENST ID: ENST00000366746
  CDS Start-End: 98-484
agtgacgtcgtgggctgcagcgcagcagcacccaacgcagttgcacgccagggcctgtactgaccacctccacgtgccactggggctgtaaggaggaatggcggccgtgggcagcctgcttggccggctgaggcagagcaccgtgaaggccaccggacctgcactccgccgcctgcacacatcctcctggcgagctgacagcagcagggcctcactcactcgtgtgcaccgccaggcttatgcacgactctaccccgtgctgctggtgaagcaggatggctccaccatccacatccgctacagggagccacggcgcatgctggcgatgcccatagatctggacaccctgtctcctgaggagcgccgggccaggctgcggaagcgtgaggctcagctccagtcgaggaaggagtacgagcaggagctcagtgatgacttgcatgtggagcgctaccgacagttctggaccaggaccaagaagtgaccgtggctccagccaccccgggacattgctaagatgggagggctgttcttaaatcactcgttcttgaagctgccacctgga

SEQ ID NO: 154566 - DNA, 603 bp, Homo sapiens
  Payload ID: 10377
  Gene Symbol: MRPL55
  Gene Name: mitochondrial ribosomal protein L55
  Uniprot ID: Q7Z7F7
  ENST ID: ENST00000366747
  CDS Start-End: 136-522
agtgacgtcgtgggctgcagcgcagcagcacccaacgcagcggttctgagaagtccaagggttgctgggagaggttggttgcacgccagggcctgtactgaccacctccacgtgccactggggctgtaaggaggaatggcggccgtgggcagcctgcttggccggctgaggcagagcaccgtgaaggccaccggacctgcactccgccgcctgcacacatcctcctggcgagctgacagcagcagggcctcactcactcgtgtgcaccgccaggcttatgcacgactctaccccgtgctgctggtgaagcaggatggctccaccatccacatccgctacagggagccacggcgcatgctggcgatgcccatagatctggacaccctgtctcctgaggagcgccgggccaggctgcggaagcgtgaggctcagctccagtcgaggaaggagtacgagcaggagctcagtgatgacttgcatgtggagcgctaccgacagttctggaccaggaccaagaagtgaccgtggctccagccaccccgggacattgctaagatgggagggctgttcttaaatcactcgttcttgaagctgccacctgga

SEQ ID NO: 154567 - DNA, 685 bp, Homo sapiens
  Payload ID: 10377
  Gene Symbol: MRPL55
  Gene Name: mitochondrial ribosomal protein L55
  Uniprot ID: Q7Z7F7
  ENST ID: ENST00000391867
  CDS Start-End: 219-605
cgcagcgcctgccagtgacgtcgtgggctgcagcgcagcagcacccaacgcatctagcaggaaaggagagggagctttccccgaagaccctcctggaccagccccaggctcctgtgctggcggttctgagaagtccaagggttgctgggagaggttgcaggttgcacgccagggcctgtactgaccacctccacgtgccactggggctgtaaggaggaatggcggccgtgggcagcctgcttggccggctgaggcagagcaccgtgaaggccaccggacctgcactccgccgcctgcacacatcctcctggcgagctgacagcagcagggcctcactcactcgtgtgcaccgccaggcttatgcacgactctaccccgtgctgctggtgaagcaggatggctccaccatccacatccgctacagggagccacggcgcatgctggcgatgcccatagatctggacaccctgtctcctgaggagcgccgggccaggctgcggaagcgtgaggctcagctccagtcgaggaaggagtacgagcaggagctcagtgatgacttgcatgtggagcgctaccgacagttctggaccaggaccaagaagtgaccgtggctccagccaccccgggacattgctaagatgggagggctgttcttaaatcactcgttcttgaagctgccacctgg

SEQ ID NO: 154568 - DNA, 767 bp, Homo sapiens
  Payload ID: 10377
  Gene Symbol: MRPL55
  Gene Name: mitochondrial ribosomal protein L55
  ENST ID: ENST00000411464
  CDS Start-End: 639-767
caggaaaggagagggagctttccccgaagaccctcctggaccagccccaggctcctgtgctggtgaggccgagggagagggatgtgggcataggacacgtagcaggatttccattttagaggcagccggacctgtcttcaggtcccttccttggtgagagacaggggtacgccagaggaagctgggcgctcggcctctgtgcagcctcatctcctggaatctgagtattgaaaactgggcttttacttcgcacacctcagcacagactcccatgggaatccaggtcacagcaaagcagccctgggcctccattctcctttaagcaagcatgacaatcctcacttcactgagtttttattaaaactagcaatgaccttagaaagcaaggcatgacctcagctccacttttgaggctgcagtccattcagagaggtttcgcagactcggtaacggccagaacagacagcctgggccctgccgcaggctgactcagaatctttgggagtagtgaccaacttctgcttttggaaaaacctctacaggcggttctgagaagtccaagggttgctgggagaggttggttgcacgccagggcctgtactgaccacctccacgtgccactggggctgtaaggaggaatggcggccgtgggcagcctgcttggccggctgaggcagagcaccgtgaaggccaccggacctgcactccgccgcctgcacacatcctcctggcgagctgacagcagcagggcctcactcactcgtgtg

SEQ ID NO: 154569 - DNA, 864 bp, Homo sapiens
  Payload ID: 10377
  Gene Symbol: MRPL55
  Gene Name: mitochondrial ribosomal protein L55
  Uniprot ID: Q7Z7F7
  ENST ID: ENST00000430433
  CDS Start-End: 290-784
cgcagcgcctgccagtgacgtcgtgggctgcagcgcagcagcacccaacgcagtgagtaccttgatctcctgcgtggcctcgtccctggtcttagttccaccgggcagcgggagtcaggaccgcctgtcctcagacccctccgcagcgactgtggcggccgcagtctagcaggaaaggagagggagctttccccgaagaccctcctggaccagccccaggctcctgtgctggttgcacgccagggcctgtactgaccacctccacgtgccactggggctgtaaggaggaatggcggccgtgggcagcctgcttggcctggcagcctcttcctggctagggggccagaacgcctctgaccacagcctgtggctcctgaggaagccccgaggctcatcctgccccggcacgggtcaccagctctgccggctgaggcagagcaccgtgaaggccaccggacctgcactccgccgcctgcacacatcctcctggcgagctgacagcagcagggcctcactcactcgtgtgcaccgccaggcttatgcacgactctaccccgtgctgctggtgaagcaggatggctccaccatccacatccgctacagggagccacggcgcatgctggcgatgcccatagatctggacaccctgtctcctgaggagcgccgggccaggctgcggaagcgtgaggctcagctccagtcgaggaaggagtacgagcaggagctcagtgatgacttgcatgtggagcgctaccgacagttctggaccaggaccaagaagtgaccgtggctccagccaccccgggacattgctaagatgggagggctgttcttaaatcactcgttcttgaagctgccacctgg

SEQ ID NO: 154570 - DNA, 544 bp, Homo sapiens
  Payload ID: 10377
  Gene Symbol: MRPL55
  Gene Name: mitochondrial ribosomal protein L55
  ENST ID: ENST00000457264
  CDS Start-End: 316-544
cagtgacgtcgtgggctgcagcgcagcagcacccaacgcagtgagtaccttgatctcctgcgtggcctcgtccctggtcttagttccaccgggcagcgggagtcaggaccgcctgtcctcagacccctccgcagcgactgtggcggccgcagtctagcaggaaaggagagggagctttccccgaagaccctcctggaccagccccaggctcctgtgctggcggttctgagaagtccaagggttgctgggagaggttggttgcacgccagggcctgtactgaccacctccacgtgccactggggctgtaaggaggaatggcggccgtgggcagcctgcttggccggctgaggcagagcaccgtgaaggccaccggacctgcactccgccgcctgcacacatcctcctggcgagctgacagcagcagggcctcactcactcgtgtgcaccgccaggcttatgcacgactctaccccgtgctgctggtgaagcaggatggctccaccatccacatccgctacagggagccacggcgcatgctggcgg

SEQ ID NO: 154571 - DNA, 790 bp, Homo sapiens
  Payload ID: 10377
  Gene Symbol: MRPL55
  Gene Name: mitochondrial ribosomal protein L55
  ENST ID: ENST00000483159
  CDS Start-End: 777-790
gcagcagcacccaacgcagtgagtaccttgatctcctgcgtggcctcgtccctggtcttagttccaccgggcagcgggagtcaggaccgcctgtcctcagacccctccgcagcgactgtggcggccgcagtctagcaggaaaggagagggagctttccccgaagaccctcctggaccagccccaggctcctgtgctggtgaggccgagggagagggatgtgggcataggacacgtagcaggatttccattttagaggcagccggacctgtcttcaggtcccttccttggtgagagacaggggtacgccagaggaagctgggcgctcggcctctgtgcagcctcatctcctggaatctgagtattgaaaactgggcttttacttcgcacacctcagcacagactcccatgggaatccaggtcacagcaaagcagccctgggcctccattctcctttaagcaagcatgacaatcctcacttcactgagtttttattaaaactagcaatgaccttagaaagcaaggcatgacctcagctccacttttgaggctgcagtccattcagagaggtttcgcagactcggtaacggccagaacagacagcctgggccctgccgcaggctgactcagaatctttgggagtagtgaccaacttctgcttttggaaaaacctctacaggcggttctgagaagtccaagggttgctgggagaggttgcaggttgcacgccagggcctgtactgaccacctccacgtgccactggggctgtaaggaggaatggcggccgtggg

SEQ ID NO: 154572 - DNA, 224 bp, Homo sapiens
  Payload ID: 10377
  Gene Symbol: MRPL55
  Gene Name: mitochondrial ribosomal protein L55
  ENST ID: ENST00000495434
  CDS Start-End: 199-224
acgtcgtgggctgcagcgcagcagcacccaacgcatctagcaggaaaggagagggagctttccccgaagaccctcctggaccagccccaggctcctgtgctggcggttctgagaagtccaagggttgctgggagaggttggttgcacgccagggcctgtactgaccacctccacgtgccactggggctgtaaggaggaatggcggccgtgggcagcctgcttgg

SEQ ID NO: 154573 - DNA, 694 bp, Homo sapiens
  Payload ID: 10377
  Gene Symbol: MRPL55
  Gene Name: mitochondrial ribosomal protein L55
  ENST ID: ENST00000459783
  CDS Start-End: 446-613
ctagcaggttgcacgccagggcctgtactgaccacctccacgtgccactggggctgtaaggaggaatggcggccgtgggcagcctgcttggtccttgctattgtccactgtcccctgtgctggaagctttgtgcccttgctcagcctggcagcctcttcctggctagggggccagaacgcctctgaccacagcctgtggctcctgaggaagccccgaggctcatcctgccccggcacgggtcaccagctctgccggctgaggcagagcaccgtgaaggccaccggacctgcactccgccgcctgcacacatcctcctggcgagctgacagcagcagggcctcactcactcgtgtgcaccgccaggcttatgcacgactctaccccgtgctgctggtgaagcaggatggctccaccatccacatccgctacagggagccacggcgcatgctggcgatgcccatagatctggacaccctgtctcctgaggagcgccgggccaggctgcggaagcgtgaggctcagctccagtcgaggaaggagtacgagcaggagctcagtgatgacttgcatgtggagcgctaccgacagttctggaccaggaccaagaagtgaccgtggctccagccaccccgggacattgctaagatgggagggctgttcttaaatcactcgttcttgaagctgccacctgga

SEQ ID NO: 154574 - DNA, 636 bp, Homo sapiens
  Payload ID: 10377
  Gene Symbol: MRPL55
  Gene Name: mitochondrial ribosomal protein L55
  ENST ID: ENST00000464148
  CDS Start-End: 565-636
gccagtgacgtcgtgggctgcagcgcagcagcacccaacgcaaggcagccggacctgtcttcaggtcccttccttggtgagagacaggggtacgccagaggaagctgggcgctcggcctctgtgcagcctcatctcctggaatctgagtattgaaaactgggcttttacttcgcacacctcagcacagactcccatgggaatccaggtcacagcaaagcagccctgggcctccattctcctttaagcaagcatgacaatcctcacttcactgagtttttattaaaactagcaatgaccttagaaagcaaggcatgacctcagctccacttttgaggctgcagtccattcagagaggtttcgcagactcggtaacggccagaacagacagcctgggccctgccgcaggctgactcagaatctttgggagtagtgaccaacttctgcttttggaaaaacctctacaggcggttctgagaagtccaagggttgctgggagaggttgcaggttgcacgccagggcctgtactgaccacctccacgtgccactggggctgtaaggaggaatggcggccgtgggcagcctgcttggccggctgaggcagagcaccgtgaaggccaccggacctgcactccgc

SEQ ID NO: 154575 - DNA, 2246 bp, Homo sapiens
  Payload ID: 10378
  Gene Symbol: MRPL57
  Gene Name: mitochondrial ribosomal protein L57
  Uniprot ID: Q9BQC6
  ENST ID: ENST00000309594
  CDS Start-End: 79-387
gcgagacgggtgcgcttacgccacggcgtctgctggcggccgcggagacgcagagtcttgagcagcgcggcaggcaccatgttcctgactgcgctcctctggcgcggccgcattcccggccgtcagtggatcgggaagcaccggcggccgcggttcgtgtcgttgcgcgccaagcagaacatgatccgccgcctggagatcgaggcggagaaccattactggctgagcatgccctacatgacccgggagcaggagcgcggccacgccgcggtgcgcaggagggaggccttcgaggccataaaggcggccgccacttccaagttccccccgcatagattcattgcggaccagctcgaccatctcaatgtcaccaagaaatggtcctaatcctgagtcgtcacccttggattttatggatcacggagctgaccatctttacctggtcctggaactgaaaaactgtagcttgtgtgaaaatgagcctttggaccagtctttattaaaacaaacaaacatgagtagtctgcatatcgaatatctagagctctaaacccccaatacttaaaagtctaattgctgtcctgtggtttcattagtctgataggaagatagggatttcctcagtcacagatgatattttgaaggaaagctgcaataaagccacaatgatttgaggtctttgcttaagtatgagatacttgatgggggctttatcatgcaacattagtttgcttaccttaagaattgcccaaaaatgaaagaaaatatgagcttttcagttaaacatactcctaaaaacattttccgggattttactactaaaattggacatttaagcgaagtaaaagaggccgggtgcggtggctcacgcctgtaatcccaacactttaggagtccaaggcgggcggatcacttgaggtcaggagttcaagaccagcttggccaaggtgataaaacccgtctctactaatacaaaaaaaattagctgggtatgttggtgcaggcttgcaatcccagctacttgggacgctgaggtgggaggatcgcctgaacctcagaggcagaggttgcaatgaagcggaggttgcagtgagccgagagcatgccgctgcactccagcctgggagactgcatctcaaaaaagaaaaataaacgaagtaaaagatatttatcagagctgttacaggaaggtgtattttttagctattttggcagggtgctgtggtgcttgcatgtagtcccagctattcaggaatattgcttgagtccagcttgggcaacatagcgagaccctatctaaaataacaataatatatggccaggcgggatggctcacgcctgtaatcccagcactttgggaggctgaggcgggcagatcacttgaggccaggagttcaagaccagcccaaccaacatggtgaaaccctgtctccactgaaaatacataaaattagccgggtgcagtggtgaggcctgtaatcccagctactcaggaggctgaggcaggagaatcgcttgcacccaggaggtggaggctgcagtaagtcgagattgtgtcactgcactctagcctgggcgacagaaaaagaaaatttaggtggggaaaaaaatcagaattgcgtctgtgggaacaggaataaaggagaaaccactattgactgggaagacacacaaagaactttgtcaaagttgtatggctgaggcccacacggtggctcacttctgtaatcccatcactttgggaggcttaggcagaaggatcacctgagatcaggagttccagaccagcctggccaacatggcgaaaccccatctctactaaaaatacaaaaattagccgggcgtggtggcttacgcctgtaatcccagcactttgggaggccaaggtgggcggatcacaaggtcaggagttcgagaccagcctggccaatatggtgaaaccccatctctactaaaaatataaaaatcagcaaaaaaaatttagccaggcttggtcatgcatgcctgtaatcctagctactgggaaggctgaggaaggagaattgcttgaacccaggtggtggaggttgcagtgagctgagatcgtgccactgctctccagcctgcatgacgggagtgagacaccatctcaaaaaatacatataataatataaataaaaatatcttttttgaaaataatttaatataccatgtaatttaccagttgaagatgttcgctttcagaatataataaaaatagtcaaaaa

SEQ ID NO: 154576 - DNA, 882 bp, Homo sapiens
  Payload ID: 10379
  Gene Symbol: MRPL9
  Gene Name: mitochondrial ribosomal protein L9
  ENST ID: ENST00000368829
  CDS Start-End: 6-707
tgaacatggcggcgcccgttgtcacggccccgggcagagctctgctgcgggcgggcgctggacggctgcttcggggaggcgtccaggagctactgcggccgcgacatgaagggaacgcccctgacctggcctgcaacttcagcctttctcaaaatcggggcacggtcatcgtggagcgctggtggaaggtaccgctggccggggagggccggaagccgcgcctgcaccggcgacatcgcgtctataagctggtggaggacacgaagcatcggcccaaagaaaacctggagctcatcctgacgcagtcggtggagaatgttggagtccggggtgacctggtctcagtgaagaaatctttaggccggaatcgactccttcctcagggactggctgtatatgcatcccctgaaaacaagaagctgtttgaagaggagaaattgctgagacaagaaggaaaattagagaagatccagaccaaggcaggtgaggcgcttggtgttgtggttgccccacatacattaaagttaccagaagagcctatcacacggtggggcgagtattggtgtgaggtgacggtaaatgggcttgatactgtgagagtgcctatgtctgtcgtgaactttgagaagcccaagaccaaaagatataagtactggttagcccagcaagctgccaaggctatggcccccaccagcccccagatctaaatctactctccctccaaggcagcaaagcagaatcgggagcagtggagcagaaatgtgcaagcaccctgatctcactcccagctctgaccaaatacagaattttagagaacatctgaagacatcagactgcactgcgtatacatgttgaattcttcatttttgccatctttaactg

SEQ ID NO: 154577 - DNA, 1296 bp, Homo sapiens
  Payload ID: 10379
  Gene Symbol: MRPL9
  Gene Name: mitochondrial ribosomal protein L9
  Uniprot ID: Q9BYD2
  ENST ID: ENST00000368830
  CDS Start-End: 86-889
ggcgcgccgcaggcagcactggcgggggcctttcctgccgccgacgccggggtcctccctcaggtctcattctgtgcctgtgaacatggcggcgcccgttgtcacggccccgggcagagctctgctgcgggcgggcgctggacggctgcttcggggaggcgtccaggagctactgcggccgcgacatgaagggaacgcccctgacctggcctgcaacttcagcctttctcaaaatcggggcacggtcatcgtggagcgctggtggaaggtaccgctggccggggagggccggaagccgcgcctgcaccggcgacatcgcgtctataagctggtggaggacacgaagcatcggcccaaagaaaacctggagctcatcctgacgcagtcggtggagaatgttggagtccggggtgacctggtctcagtgaagaaatctttaggccggaatcgactccttcctcagggactggctgtatatgcatcccctgaaaacaagaagctgtttgaagaggagaaattgctgagacaagaaggaaaattagagaagatccagaccaaggcaggtgaggcgacagtgaaatttctaaaaagctgtcgcctggaggtagggatgaagaacaatgtcaaatgggagctgaaccctgaaatagttgcccgccacttctttaagaatcttggtgttgtggttgccccacatacattaaagttaccagaagagcctatcacacggtggggcgagtattggtgtgaggtgacggtaaatgggcttgatactgtgagagtgcctatgtctgtcgtgaactttgagaagcccaagaccaaaagatataagtactggttagcccagcaagctgccaaggctatggcccccaccagcccccagatctaaatctactctccctccaaggcagcaaagcagaatcgggagcagtggagcagaaatgtgcaagcaccctgatctcactcccagctctgaccaaatacagaattttagagaacatctgaagacatcagactgcactgcgtatacatgttgaattcttcatttttgccatctttaactgtcatcactggggcagggaagtcctgttccagaagtaccaggctgtagatttgataagctagatgcagtagaccgaaaccatccaaaacctgtttagcttcttcctccattggagtttattgggacaaacaggagagccagccattgtctccagtacttgcctcattctcatcatccaaactgaacatttgtatcccaagcagaaataaagagaatatgttctttttaagtaa

SEQ ID NO: 154578 - DNA, 2110 bp, Homo sapiens
  Payload ID: 10380
  Gene Symbol: MRPS10
  Gene Name: mitochondrial ribosomal protein S10
  Uniprot ID: P82664
  ENST ID: ENST00000053468
  CDS Start-End: 17-622
ggtcgggaccggcaagatggcggcgcggacagcgttcggtgctgtgtgccggcgcctctggcagggattggggaatttttctgtaaacacttctaagggcaatacagccaaaaatggtggcttgcttctcagtaccaatatgaagtgggtacagttttcaaacctacacgttgatgttccaaaggatttgaccaaacctgtggtaacaatctctgatgaaccagacatattatataagcgcctctcggttttggtgaaaggtcacgataaggctgtattggacagttatgaatattttgctgtgcttgctgctaaagaacttggtatctctattaaagtacatgaacctccaaggaaaatagagcgatttactcttctccaatcagtgcatatttacaagaagcacagagttcagtatgaaatgagaacactttacagatgtttagagttagaacatctaactggaagcacagcagatgtctacttggaatatattcagcgaaacttacctgaaggggttgccatggaagtaacaaagacacaattagaacagttaccagaacacatcaaggagccaatctgggaaacactatcagaagaaaaagaagaaagcaagtcataaagcctcagggaggccatttttgcctaaatttgaaatgagggtgggccagatgagtatgtttaagtggagagtgcttccagctgagatgatttgagtctgccctaactgctccattgagttctcgtgccctcatcagctgagggcagggaatggaactttaatggaagaaccacttttatctattctttttattcattgtttcagttctgatttcagcaaacatgagcaaaccactttgactgaaagcagaaagagtgaaaattctattttgttacgctactggtgttcaattattagtttgtaccatttttaatttatgtcagttgatgcatctgaaaataagtgcttggagtgttcgtacccttatttttttttaagattcctagaaggaatctttggttaattcagattgagcagttaaagtttttgctatttacctttgtgcaggctggcatatgctaatttgggggtggtaaccaaccgattttatctcatgtaagcattacattttgaagactgaatatacttcacagcagatcaaacacatttatggcatgcactgacctcttcttggagcccagaactttatagagttgcctaccagggttactgtaatggaatttatgatcttaagaaattactagttgtattatttatcctatgattcattcattcaataagcttttactgcataaactttacatccagcactgtagttaagtacccaaaattgaatagaaataatggcttttgaaaatcgcacaaagcaggccaggcacggtggctcacgcctgtaatcccagcattttgggaggccgaggcaggcggatcacgaggtcaagagatccagaccatcctggctaacacggtgaaaccccgtctctaataaaaatacaaaaattagctggacatggtggcacgtgcctgtaatcccagctactcaggaggctgaggcaggagaattgcgtgaacccgggcccggtggaggctgcagtgagacgagatcgcgccactgcactccagcctggcgacagagcgagacgccgtctcaaaaaaaaaaaaagaaaattgtgcaaagcataggtaaatatttttctttattaagcttctcactgagaagccctctttattttggtaaatgtcactctgtttgttaggagatgtctgcttttccatgaaatgaaatagtggctaaagccctgaaagaggcaagactacaatgggctgaaacagttggtatagcaaccccagagaagtgcttcattttctttttatagtagaagcaggtccatgtcttttgtggtttcctgcacatctttggagtagttatgacttctcagtttttccccccttaaactgcattgcctattcttttttcctgacatgctatcaggtatcagtgtgttgaatacatactgcttgtgtatcagacttacgttactgtcatcaccattaaaagaattgcagctttgtgccccatgaccttca

SEQ ID NO: 154579 - DNA, 3644 bp, Homo sapiens
  Payload ID: 10381
  Gene Symbol: MRPS11
  Gene Name: mitochondrial ribosomal protein S11
  Uniprot ID: P82912
  ENST ID: ENST00000325844
  CDS Start-End: 266-850
agtcccggaactgctagaacgaaccattcgcatatggagggggtgacccaccatctcagaacattaaaaaagggaaagaatcccctggtgaactacagtgaaagtcttattgagcatttaaatggaaataaaaatattcagtggacctaatgaagagtagatgactttcccttctgtcccctccccgacaggcactcatggtaccggcgccggcgcagctgtgactgtcgctgcagacggaaactgactggggtcaattcaagtcatgcaggctgtgagaaacgcggggtcgcggttcctgcggtcctggacttggccccagacagccggcagggtcgtggccagaacgccggccgggaccatctgcacaggcgctcgacagctccaagacgctgcggccaagcagaaagttgaacagaacgcggctcccagccacaccaagttcagcatttaccctcccattccaggagaggagagctctctgaggtgggcaggaaagaaatttgaggagatcccaattgcacacattaaagcatcccacaacaacacacagatccaggtagtctctgctagtaatgagccccttgcctttgcttcctgtggcacagagggatttcggaatgccaagaagggcacaggcatcgcagcacagacagcaggcatagccgcagcggcgagagctaaacaaaagggcgtgatccacatccgagttgtggtgaaaggcctggggccaggacgcttgtctgccatgcacggactgatcatgggcggcctggaagtgatctcaatcacagacaacaccccaatcccacacaacggctgccgccccaggaaggctcggaagctgtgatgggaaggaggcctgcacttggacctgacctcaagcctcagctccagtgggaccttgtaaaatgctccctgtcagagctctccagaatatgcttgttggagatccttcaggcagtaagggagagttttgcctccttacacagtggcctttgcttgcacctccagctggagatgggtgtgccccagaagtaagctttgcatctcttacaagaggggagctacaggggcagccgtggcctaggcccaaactctgctctgagaaaataaatatctgtaccacctgtcataattttgagattttttgctttcagagttacgtaattcctaattcctcttgaaaaagagagtgtgaaatgaggtgaggcctcagatgaaagtaaaatataaatgtgagttgctatttaccagacacttctggtttcagatatttcttttctagccccttacccaagatttctagagctaatcctagtaacttttcttattaatgacttataatttggccccaaattggagctttttgccacctacctctggattctgatggatttcgccattatgggcatgtttaaagttagccctaaacacaggattttctacaagtggacagtcaaactccccacactaaagtggcagtcatcgtttacactccatgggcttcagcagtcccagcactaacgagagagtgccctaaaagcggggagggtagagttgtacaaaacatgattcttggccaggcacggtggctcacacctgtaaccctggcactttgggaggccaaggcgggtggatcacttgagtccagttagagaccagcctgggcaacatggtgaaaccccctctctactaaaaatacaaaaattaaccaggcatggtggtgtgcgcctgtaatcccagctactctggaggctgaggcatgaaaatcgcttgaacccaggaggtggaggctgcagtgagctgagatcatcctactgcactccagcccaggtgacagcgagactgtctcaaaaaaataaataaatataaataaaaatttaaaaaaattaaaaaaaaaaacctgatgattctctagaaaatagggtggatggcaggatgggcttgagtagagtccaaatctagaagtgcagaaagcaagttgataaggaacctgggtagtgctggcagtggggcacaactcaggacccccaggcaggactgactgctcctctgttggggctctagggttcctggatacggcacagaggccaaaggtgggggctctagagacacgaccagagagtcccctcttccacaggcaaagactaagggtgagagtatcaccagaagctgagaaggagtggtcaagtacacaaaagcactgttcctcccagatgagtgcaggaagggctgctgaccagaaggggaaggcactgtggagttttacttctgtgtccagccagctaagtactgtgatctgcctgaactcagtataggaaaagacacagatgcccccttaaataggcaagaggctgtgttaggacaaagaaaggaggaagatcacgaaccaagacatgaatttagaggaaaaatgcctccctactgccttctctttagtccttagcaggtcctatgaaggccatcttgtgacagtgaccaaagaagcccaaccggaggcttcttggatcaaagccactgtcggaaggaattagactgtttcaccgcaaaactacatataaacacaatgcattaaaacatggtgcacttgaaaattgcacttcgcgatttgatatggtttggtggacagagggcccgtagccatcagacagttcaatcagggtctgagcaggaaacagctcacaaggtttaagagaaaagctcaatgaaagctctttgcagaggcatgggtaagattaaggaaataaagaaggtggactacaaagcagctgccaccctaggctagaagaggcagggaagaacagttcctagaacctggcaggagctgccacagcagcagagtgcacctctgccaaaaccatggcctgagggagagggaagaaatgcctggctgttcccggcctgtagtcccttgctggggtcccccttggctgatcccaaaaggaagcaaaaaggaagggaactcagtgttgtggtacttggaggctcagcctcccaggctgcagagtggatctggaggggcacgtagaggatagtaaacacaggaggcttctgtggcttctgtaagtcctccatacaccataggtttttattttggttttggtttttgagtctcgttgtcacccaggctggattgcagtggtacgaccatggttcactgcagcctcaaactcctgggctcaagtgatcctccagcttcagcctcctgtgagcatctgggactacaggcgcatgccaccacacatggataatttttgtattttttgtattgagaccaggtcttgaactcctggtctcaagcagtccccccacctcggcctcccaaagtgctgggataacaggcgtgagccactgcgcctgatccacacaccatagtttttaaaatgttattttactcacaagagggctttggaaaggaagatcctgcccagcagagcctacatgcgcagacaggacagaggacccttaaggatcaatggtcttgttgccggaaatggatgtctggcgcaacccccggagctagttttggggaggccgccttgttgactgtgcactggaaaatgcacattgctttatcgtgagctctcggtgcacagtgtggtttccaggctctgagtggccaataaagctggtgctgtctt

SEQ ID NO: 154580 - DNA, 766 bp, Homo sapiens
  Payload ID: 10381
  Gene Symbol: MRPS11
  Gene Name: mitochondrial ribosomal protein S11
  Uniprot ID: P82912
  ENST ID: ENST00000353598
  CDS Start-End: 1-486
atgcaggctgtgagaaacgcggggtcgcggttcctgcggtcctggacttggccccagacagccggcagggtcgtggccagaacgccggccgggaccatctgcacaggcgctcgacagctccaagacgctgcggccaagcagaaagttgaacagaacgcggctcccagccacaccaagttcagcacacagatccaggtagtctctgctagtaatgagccccttgcctttgcttcctgtggcacagagggatttcggaatgccaagaagggcacaggcatcgcagcacagacagcaggcatagccgcagcggcgagagctaaacaaaagggcgtgatccacatccgagttgtggtgaaaggcctggggccaggacgcttgtctgccatgcacggactgatcatgggcggcctggaagtgatctcaatcacagacaacaccccaatcccacacaacggctgccgccccaggaaggctcggaagctgtgatgggaaggaggcctgcacttggacctgacctcaagcctcagctccagtgggaccttgtaaaatgctccctgtcagagctctccagaatatgcttgttggagatccttcaggcagtaagggagagttttgcctccttacacagtggcctttgcttgcacctccagctggagatgggtgtgccccagaagtaagctttgcatctcttacaagaggggagctacaggggcagccgtggcctaggcccaaactctgctctgagaaaataaatatctgtaccacc

SEQ ID NO: 154581 - DNA, 1060 bp, Homo sapiens
  Payload ID: 10381
  Gene Symbol: MRPS11
  Gene Name: mitochondrial ribosomal protein S11
  ENST ID: ENST00000560708
  CDS Start-End: 266-622
agtcccggaactgctagaacgaaccattcgcatatggagggggtgacccaccatctcagaacattaaaaaagggaaagaatcccctggtgaactacagtgaaagtcttattgagcatttaaatggaaataaaaatattcagtggacctaatgaagagtagatgactttcccttctgtcccctccccgacaggcactcatggtaccggcgccggcgcagctgtgactgtcgctgcagacggaaactgactggggtcaattcaagtcatgcaggctgtgagaaacgcggggtcgcggttcctgcggtcctggacttggccccagacagccggcagggtcgtggccagaacgccggccgggaccatctgcacaggcgctcgacagctccaagacgctgcggccaagcagaaagttgaacagaacgcggctcccagccacaccaagttcagcatttaccctcccattccaggagaggagagctctctgaggtgggcaggaaagaaatttgaggagatcccaattgcacacattaaagcatcccacaacaaagggatttcggaatgccaagaagggcacaggcatcgcagcacagacagcaggcatagccgcagcggcgagagctaaacaaaagggcgtgatccacatccgagttgtggtgaaaggcctggggccaggacgcttgtctgccatgcacggactgatcatgggcggcctggaagtgatctcaatcacagacaacaccccaatcccacacaacggctgccgccccaggaaggctcggaagctgtgatgggaaggaggcctgcacttggacctgacctcaagcctcagctccagtgggaccttgtaaaatgctccctgtcagagctctccagaatatgcttgttggagatccttcaggcagtaagggagagttttgcctccttacacagtggcctttgcttgcacctccagctggagatgggtgtgccccagaagtaagctttgcatctcttacaagaggggagctacaggggcagccgtggcctaggcccaaactctgctctgagaaaataaatatct

SEQ ID NO: 154582 - DNA, 1207 bp, Homo sapiens
  Payload ID: 10382
  Gene Symbol: MRPS12
  Gene Name: mitochondrial ribosomal protein S12
  Uniprot ID: O15235
  ENST ID: ENST00000308018
  CDS Start-End: 471-887
gaaccgctctatgtccagctgagggagtgcgctgtagccctcgcgcgcatactcgtacaggaggttccggtttcgtttctctgtagtgaaacttctccttggactatcgttggagatgcagcctccccggggccggaacccccgacgagtcagcaaaggccacaagcgccgcgccatggacgcagccatcttggaccgggaacaaggcggcacttcgtcccgcccactccgcgtttagaccaattgcaaggcagcgaacctgaccgtgacgagccaatcagatcctgaggaaagttgaccgcgatagagtccttcgtcgcccaatcgtcgtctgtgtcccgcctcttcagtgacgcgaggcagaaccagccaatccctgcacggatagcgcccggaagaggctagaagctggattcagcgtgtccgcgacctcacctttaggtcctgtgagggacggcccaggtggcaggatgtcctggtctggccttctccatggcctcaacacgtccctaacttgtggcccagctctggttccccggctctgggctacctgctccatggctaccctgaaccagatgcaccgcctggggccccccaagcggccgcctcggaagctgggccccacggaaggccggccgcagctgaagggtgtggtcctgtgcacgtttacccgcaagccgaagaagcccaactcagccaatcgcaagtgctgtcgagtgcggctcagcactggccgcgaggccgtctgcttcatccctggggagggccacaccctgcaggagcaccagattgtccttgtggagggcggccgcacccaggacctgccaggcgtcaagctcaccgttgtgcgtggcaagtacgactgtggccacgtgcagaagaagtgacggctgggggcacagtgggctgggcgcccctgcagaacatgaaccttccgctcctggctgccacagggtcctccgatgctggcctttgcgcctctagaggcagccactcatggattcaagtcctggctccgcctcttccatcaggaccactattaagccataggagtcctgggggtgcaaagggtgcccctctgtcaacacccttggctcctgtgtttagaggggtggcctgaaggaccttttctgctgggacaagacactgtactgccctctgctgggaaggggttttaataaacagaccctggcgcttgtgatgtaaa

SEQ ID NO: 154583 - DNA, 929 bp, Homo sapiens
  Payload ID: 10382
  Gene Symbol: MRPS12
  Gene Name: mitochondrial ribosomal protein S12
  Uniprot ID: O15235
  ENST ID: ENST00000402029
  CDS Start-End: 193-609
gtcggtggaatcctggggtcctccaaatctaccaggccatctccccagtttcccagttcttcctgcgtgcgggcgagagtggttgggccctcgggaacccactcagagcgaggctaaatttacggagggactttctgttagcagcatgagggcctgtggttagacctatagagggacggcccaggtggcaggatgtcctggtctggccttctccatggcctcaacacgtccctaacttgtggcccagctctggttccccggctctgggctacctgctccatggctaccctgaaccagatgcaccgcctggggccccccaagcggccgcctcggaagctgggccccacggaaggccggccgcagctgaagggtgtggtcctgtgcacgtttacccgcaagccgaagaagcccaactcagccaatcgcaagtgctgtcgagtgcggctcagcactggccgcgaggccgtctgcttcatccctggggagggccacaccctgcaggagcaccagattgtccttgtggagggcggccgcacccaggacctgccaggcgtcaagctcaccgttgtgcgtggcaagtacgactgtggccacgtgcagaagaagtgacggctgggggcacagtgggctgggcgcccctgcagaacatgaaccttccgctcctggctgccacagggtcctccgatgctggcctttgcgcctctagaggcagccactcatggattcaagtcctggctccgcctcttccatcaggaccactattaagccataggagtcctgggggtgcaaagggtgcccctctgtcaacacccttggctcctgtgtttagaggggtggcctgaaggaccttttctgctgggacaagacactgtactgccctctgctgggaaggggttttaataaacagaccctggcgcttgtgatgtaaa

SEQ ID NO: 154584 - DNA, 1220 bp, Homo sapiens
  Payload ID: 10382
  Gene Symbol: MRPS12
  Gene Name: mitochondrial ribosomal protein S12
  Uniprot ID: O15235
  ENST ID: ENST00000407800
  CDS Start-End: 342-758
agctggattcagcgtgtccgcgacctcacctttaggtcctgtgaggtcggtggaatcctggggtcctccaaatctaccaggccatctccccagtttcccagttcttcctgcgtgcgggcgagagtggttgggccctcgggaacccactcagagcgaggctaaatttacggagggactttctgttagcagcatgagggcctgtggttagacctatagaggtatttcctttgatttaagccagaaagtcctgagagcggatcggggagcatttgcggatcggtcactttttcctcctttctgagtctcttatcccctaccacagggacggcccaggtggcaggatgtcctggtctggccttctccatggcctcaacacgtccctaacttgtggcccagctctggttccccggctctgggctacctgctccatggctaccctgaaccagatgcaccgcctggggccccccaagcggccgcctcggaagctgggccccacggaaggccggccgcagctgaagggtgtggtcctgtgcacgtttacccgcaagccgaagaagcccaactcagccaatcgcaagtgctgtcgagtgcggctcagcactggccgcgaggccgtctgcttcatccctggggagggccacaccctgcaggagcaccagattgtccttgtggagggcggccgcacccaggacctgccaggcgtcaagctcaccgttgtgcgtggcaagtacgactgtggccacgtgcagaagaagtgacggctgggggcacagtgggctgggcgcccctgcagaacatgaaccttccgctcctggctgccacagggtcctccgatgctggcctttgcgcctctagaggcagccactcatggattcaagtcctggctccgcctcttccatcaggaccactattaagccataggagtcctgggggtgcaaagggtgcccctctgtcaacacccttggctcctgtgtttagaggggtggcctgaaggaccttttctgctgggacaagacactgtactgccctctgctgggaaggggttttaataaacagaccctggcgcttgtgatgtaaatccccttgtggagtatttgccctctgtgtggctgtggcagtggacatctctgagcttcagtttcctccagaaaatagctccattggtggtatctcctttgtttggtttggtgaagattaaattcgatgctctatgtgcataa

SEQ ID NO: 154585 - DNA, 1207 bp, Homo sapiens; identical to SEQ ID NO: 154582
  Payload ID: 10382
  Gene Symbol: MRPS12
  Gene Name: Mitochondrial ribosomal protein S12
  ENST ID: ENST00000634246
  CDS Start-End: 471-887

SEQ ID NO: 154586 - DNA, 1220 bp, Homo sapiens; identical to SEQ ID NO: 154584
  Payload ID: 10382
  Gene Symbol: MRPS12
  Gene Name: Mitochondrial ribosomal protein S12
  ENST ID: ENST00000634704
  CDS Start-End: 342-758

SEQ ID NO: 154587 - DNA, 929 bp, Homo sapiens; identical to SEQ ID NO: 154583
  Payload ID: 10382
  Gene Symbol: MRPS12
  Gene Name: Mitochondrial ribosomal protein S12
  ENST ID: ENST00000634400
  CDS Start-End: 193-609

SEQ ID NO: 154588 - DNA, 2115 bp, Homo sapiens
  Payload ID: 10383
  Gene Symbol: MRPS14
  Gene Name: mitochondrial ribosomal protein S14
  Uniprot ID: O60783
  ENST ID: ENST00000476371
  CDS Start-End: 18-404
agtttgtagcggacaacatggcggccttcatgctgggctcgctgctgcggacgttcaagcagatggttccttcatcagcttcaggccaagttcgaagtcactatgtagactggagaatgtggcgcgatgtgaagagacgaaaaatggcctatgaatacgcagatgagaggctacgtattaattcactcaggaagaataccattttgccaaaaattcttcaggatgtggctgatgaagaaattgctgccctcccccgggatagctgtcctgttagaatcagaaatcggtgtgttatgacgtcccgtccgcgtggtgtgaagcggcgctggaggcttagtcgtatagtcttccgtcacttagctgaccatgggcaactttctgggatccagcgagcgacatggtaaatgagctccagaacctattgagcttgcagggaagccaagcttgcagttccagcaagcaaagattttttttaatagaccaaaccctaatctctacaggggcccagtacagttgtttggcctacctgatgctatctctaaactacttttaaaatgaagacatttgggtgtttcatgtcagtgaattatcttttctcttggacttaacaaacatactgttcccatacatagtacaaagagtagcataataaatattttctgtgaatgttttttataccctccttttaagtttaatcttttagtaacatataggggtttttgtattaagagcattatttcataaaatgctatcttatacataatccaactaattgacatgtagctcatgtatggcagtttgtaatcctggactagctttgctgacctgcagagctccccttaactattattgttagataaacagattggatagcaaggctgctgttctggattatctaatgctccacttcttcttgtgatggctgaacaaaagaaccactaagtgttttcttgtccatccttaagggactttaaaacaaattatgcctctttaagtccttgaaagtctccatctaaagaggaaaagtttgttggaacagtatatattccctatttttatgtttatttaatccataacagaaatgagtaagggtagcacaaagttctcattcagtaactcaacagtgtgatcatcagcccagtgataaaaatatacatactgaatggaagtacctacttaacatcaggaaaatattcctggagaacttaataaatcaggaggtgaggggtgagatttttttctgcacacagagggaacaaaagcacaaagaagcaaaggcactctgtagcatcagagaaccacagtcacttcagtagatcagaaatatgaagcacaagacaaggcccgtattgtggaggatctcacaaatcatgtgaaggaattaagactgacataccaggtattacagagttttaagcacaggaatgacatcatcagtttgtaatacaggtaagtgacagctgtgtggcagatggccatgagaggaaaaagctacaggcaagacaaccagttaggaggatgtcttagttgttgaggaagatgaaggcctgaactaacattgtggtattagtagaggagagaggacagatttttaaagttttaggaaagaaaattgggcaagacttacaagactgattatatctaagaggtaaagatggttctctgggttcctgataaaagtgtctagatagatggtagagggcaattccaagagggcaactccaagatagaaaatttggaaaaagaacaaatttaggggaaacagaagataagcgagttcaggttccagtcatgcggtgttggagatgcctgtgtcatctgatgaagactagtacgcagctggatagcagagtccgaaactcaggtggaggtgaagttatgagggaattatcacaatctagtttggattcatatttcttaaatatgtatgacaacttaccaactggaatgttctagctaatatctcaacttagaatccatctcactaccaatgggcaaacacttgtgttctaaagttacttgcaagtagtttatactgccaacttgatatatatacatgctatagtttgaacattttgtgtacttccaaaattcacattaaaatctaatccacaa

SEQ ID NO: 154589 - DNA, 910 bp, Homo sapiens
  Payload ID: 10383
  Gene Symbol: MRPS14
  Gene Name: mitochondrial ribosomal protein S14
  ENST ID: ENST00000367677
  CDS Start-End: 8-190
ggacaacatggcggccttcatgctgggctcgctgctgcggacgttcaagcaggtcaggcctctacttttatccacaccgctacccctcaccgctgaatctcataacccacgggtcccccacggctctgccacctgtagtgctcgatggttccttcatcagcttcaggccaagttcgaagtcactatgtagactggagaatgtggcgcgatgtgaagagacgaaaaatggcctatgaatacgcagatgagaggctacgtattaattcactcaggaagaataccattttgccaaaaattcttcaggatgtggctgatgaagaaattgctgccctcccccgggatagctgtcctgttagaatcagaaatcggtgtgttatgacgtcccgtccgcgtggtgtgaagcggcgctggaggcttagtcgtatagtcttccgtcacttagctgaccatgggcaactttctgggatccagcgagcgacatggtaaatgagctccagaacctattgagcttgcagggaagccaagcttgcagttccagcaagcaaagattttttttaatagaccaaaccctaatctctacaggggcccagtacagttgtttggcctacctgatgctatctctaaactacttttaaaatgaagacatttgggtgtttcatgtcagtgaattatcttttctcttggacttaacaaacatactgttcccatacatagtacaaagagtagcataataaatattttctgtgaatgttttttataccctccttttaagtttaatcttttagtaacatataggggtttttgtattaagagcattatttcataaaatgctatcttatacataatccaactaattgacatgtagctcatgtatggcagtttgtaatcctggactagctttgctgacctg

SEQ ID NO: 154590 - DNA, 1006 bp, Homo sapiens
  Payload ID: 10384
  Gene Symbol: MRPS15
  Gene Name: mitochondrial ribosomal protein S15
  Uniprot ID: P82914
  ENST ID: ENST00000373116
  CDS Start-End: 163-936
gtcacgccacctaatccattctctcggtcttcgtctgctccggtattgcaactgcctcgattggtcgatcctgggccagcatggcggcgcccatgtaacccggtccgtgccgcaaagcgaacggcggccgcggcgcgggccccgcgggggttagaggtcaccatgctgagggtcgcgtggaggacgctgagtttgattcggacccgggcagttacccaggtcctagtacccgggctgccgggcggtgggagcgccaagtttcctttcaaccagtggggcctgcagcctcgaagtctcctcctccaggccgcgcgcggatatgtcgtccggaaaccagcccagtctaggctggatgatgacccacctccctctacgctgctcaaagactaccagaatgtccctggaattgagaaggttgatgatgtcgtgaaaagactcttgtctttggaaatggccaacaagaaggagatgctaaaaatcaagcaagaacagtttatgaagaagattgttgcaaacccagaggacaccagatccctggaggctcgaattattgccttgtctgtcaagatccgcagttatgaagaacacttggagaaacatcgaaaggacaaagcccacaaacgctatctgctaatgagcattgaccagaggaaaaagatgctcaaaaacctccgtaacaccaactatgatgtctttgagaagatatgctgggggctgggaattgagtacaccttcccccctctgtattaccgaagagcccaccgccgattcgtgaccaagaaggctctgtgcattcgggttttccaggagactcaaaagctgaagaagcgaagaagagccttaaaggctgcagcagcagcccaaaaacaagcaaagcggaggaacccagacagccctgccaaagccataccaaagacactcaaagacagccaataaattctgttcaatcatttctttctgtcttgaagaatgataggagagatgatggggctctttttggcctgaa

SEQ ID NO: 154591 - DNA, 866 bp, Homo sapiens
  Payload ID: 10385
  Gene Symbol: MRPS16
  Gene Name: mitochondrial ribosomal protein S16
  ENST ID: ENST00000372940
  CDS Start-End: 212-511
attgtgggaagtatagggcggcaagcggaggaggcgtggcgagcggatcatccgcttccggagtcgaggttttcgggcttgtaccgcttggcggtgcggcctggtgtcggcttgcaggttctttctgtgtttgttctctgccctgccaaggccgtagagctggtgcgtgcgggtagcggggctctccgaggagccgcacgccggcggcaccatggtccacctcactactctcctctgcaaggcctaccgtgggggccacttaaccatccgccttgccctgggtggctgcaccaatcggccgttctaccgcattgtggctgctcacaacaagtgtcccagggatggccgtttcgtagagcagctgggctcctatgatccattgcccaacagtcatggagaaaaactcgttgccctcaacctagacaggatccgtcattggattggctgcggggcccacctctctaagcctatggaaaagcttctgggtctcaagtattcccatgtgttttaaaagcctgaagtcagtgagatgaaattcaacatcaagaatttgaagtaacttgtaaggaaaaataatataaagataccattggggcagtggctcacacctgtaatctcagcactttgggaggctgaggtggaaggatcacttgaagccagagtttgagaccagcctgtgcaacacagcaagaccccgtctctacaaaaacttaaaaaattagctggctgtggtgttgctcacccatagttccagctactcgggaagctgaggcagtaagatcacttgagcccaggaggccgatgctgcagtgaactgtgattgttccactacagtccagcctgggtgacagagaaaagaaaaagaa

SEQ ID NO: 154592 - DNA, 2634 bp, Homo sapiens
  Payload ID: 10385
  Gene Symbol: MRPS16
  Gene Name: mitochondrial ribosomal protein S16
  Uniprot ID: Q9Y3D3
  ENST ID: ENST00000372945
  CDS Start-End: 212-625
attgtgggaagtatagggcggcaagcggaggaggcgtggcgagcggatcatccgcttccggagtcgaggttttcgggcttgtaccgcttggcggtgcggcctggtgtcggcttgcaggttctttctgtgtttgttctctgccctgccaaggccgtagagctggtgcgtgcgggtagcggggctctccgaggagccgcacgccggcggcaccatggtccacctcactactctcctctgcaaggcctaccgtgggggccacttaaccatccgccttgccctgggtggctgcaccaatcggccgttctaccgcattgtggctgctcacaacaagtgtcccagggatggccgtttcgtagagcagctgggctcctatgatccattgcccaacagtcatggagaaaaactcgttgccctcaacctagacaggatccgtcattggattggctgcggggcccacctctctaagcctatggaaaagcttctgggtcttgctggctttttccctctgcatcctatgatgatcacaaatgctgagagactgcgaaggaaacgggcacgtgaagtcctgttagcttctcagaaaacagatgcagaagctacagatacagaggctacagaaacataaatgagctgactttagtgagcatagcagtgggaacaaggtcaaggtccttttgaaacactgcagcgatcttaattttgttagatttggagttcaataaatggagtatcctgagttgcccttgctcttctggcctggcctgcacagggcccagggagagatttgttcttgtgtgacttagagctgggtgtgggtactaattagcttttttcgactttgtcttgggatagacagtggctatgggaggattggacttttgagttgggctctgggtctcttggacaactttacaatttactggcttccaagacttcctgcttcaaaacccccagccagactattcatggcccattcagatcttcatgttcatcccacaagtgcaagaacagttaacctttcttaattgatttttgtaattggaggtttatattgtcttgcctaatgcatattctctttttttttttttttttgagacggagtcttgttctgttgccaggctggagtgcggtggtgcaatctcagctcactgcaatctccacctcctgggttcaagaggttctcctgcctcagcctcctgagtagccggggagctacaagcatgcaccaccacacccagctaattttttttttttttttgagaggagtctcgctctgtcgcccaggcttgagtgcagtggcgcgatctcggctcactgcaagctctgtctcctgggttcatgccattctcctgcttcagcctcccgagtagtcccaggagtagctgggactacaggtgcccaccaccacacccagctaatttttttgtatttttagtagagatggggtttcaccatgttatccaggatggttttgatctcctgacctcgtgatccgcccgccttggcctcccaaaagtgctgggattataggcgtgagccaccgcccgggcaaatttttgtatttttagtagagatggggtttcaccgtgttggccaggatggtctcaatctgaccttgtgatctgcccacctcggcctcccaaagtgctaggattactggcgtgagccaccactcctagccttaatgcatattcttaaatatacaaaggtagatttgttatgaaaattgctttggggctctaataacctaccttttaagaatgagaaactgctgggcttaagggagttcagtatgaatcaagattgaaccattcaaatgtggctgtgatttctgcatatatcatagatgggatccttctgagaatactggaatagggaattaggacaccaagccaattcagctgtgaaccttattcttgtacttttctttcttgctggtaattttatggagcaggttaagaaggctgctctgtgttaggataaactgtataccaataatgttgacaacctgtaatgagtgttgcattttacttcttgtatcttttccttcctaccttgatgccagtaatctataagggatctttatagtttgaatgtatttgaataacttcagtatactttagttctacttttttatttgactcacaaccattcttaggtctcaagtattcccatgtgttttaaaagcctgaagtcagtgagatgaaattcaacatcaagaatttgaagtaacttgtaaggaaaaataatataaagataccattggggcagtggctcacacctgtaatctcagcactttgggaggctgaggtggaaggatcacttgaagccagagtttgagaccagcctgtgcaacacagcaagaccccgtctctacaaaaacttaaaaaattagctggctgtggtgttgctcacccatagttccagctactcgggaagctgaggcagtaagatcacttgagcccaggaggccgatgctgcagtgaactgtgattgttccactacagtccagcctgggtgacagagaaaagaaaaagaaaacattacataatttggctagagcataataatttgattttctggtttttgaaaatttgagttgcaataaaaggatatttcagtgtgcgatttcaa

SEQ ID NO: 154593 - DNA, 1845 bp, Homo sapiens
  Payload ID: 10386
  Gene Symbol: MRPS17
  Gene Name: mitochondrial ribosomal protein S17
  Uniprot ID: Q9Y2R5
  ENST ID: ENST00000285298
  CDS Start-End: 130-522
atgcacggcctacgagaggggtagtgtgggactgagccaatgcgtacggcgtgacgccatcccgctgcgaccggcgctccccggggcaggtggctgcatagtcttggcggaggtgaccaaagccacgtaatgtccgtagttcgctcatccgtccatgccagatggattgtggggaaggtgattgggacaaaaatgcaaaagactgctaaagtgagagtgaccaggcttgttctggatccctatttattaaagtattttaataagcggaaaacctactttgctcacgatgcccttcagcagtgcacagttggggatattgtgcttctcagagctttacctgttccacgagcaaagcatgtgaaacatgaactggctgagatcgttttcaaagttggaaaagtcatagatccagtgacaggaaagccctgtgctggaactacctacctggagagtccgttgagttcggaaaccacccagctaagcaaaaatctggaagaactcaatatctcttcagcacagtgaagcgggagtggaagaaggatctaaagggaaaaactgacatgtttatgttatggaaaaagaaatttttctaagtttcatcacaaactgtgtccagtttctctgtggtgtttatgaaatagctaaaagcaaatgaagtaaagggcatactatggtttttcacaaaggtttatggtcgtgtttcaaattttcatcatttcagtgaacatacttccacgttacattaagtgtgcctagcagtctgttgcattttgtaagctcacagttttttgttttgagatggaatctcactctgtcacccaggctggagtgcagtggtgcaatcttggctcactgcaagctccgcctcccgggttcacgccgttctcctgcctcagcctcccgagtagctgggactacaggcgcctgccaccatgcccagctaatttttttttttttttttttggtatttttagtagagacggggtttcaccgtgttagccaggatggtcttgatctcctgacctcgtgatctgcctgccttggcctctcagagtgctgggattacaggcgtgagccactgtgcttagcaagctcactgttttagaaggttttatttttgtcttttgagacagggttttgctttgttgtgggggctggagtgcagtggtatgatcttggctcactgcagccttgacctccctggctctagcatctttccaccccagccttctgagtagctgggaacacaggagcgtaccactacacttggctgattttttgtaaattttgtagagacagggtctccctgtgttgcccaggttggtctcggactcctgggagcaatctgcccatcttggcctaacagtgctgggattacaggcctgagccactgtgcccagccggtttcctttatttcattcaaaggaattttgaatttatcttagaacctttattttgaaggaagaaagtcttttttttttttgagctggagtttcactcttgttgcccaggctggagtgcaatggcatgatctcagcccaccacgacctccgcctcccaggttcaagtgattctgcttcagcctcctgagtagctaggattacaggcatgtgccaccacgcccagctaattttgtatttttagtagggatggggtttctccatgtttgtcaggctagtcttgaactccggacctcaggtgatccgcccgcctgggcctctcaaagtgcttggattacaggcatgagccactgcatgtaatgaccagccactggtcagaattctttcaatcaagctgtgttaataagaatattgatgtgtggaaaataaaattttacaattctgt

SEQ ID NO: 154594 - DNA, 718 bp, Homo sapiens
  Payload ID: 10386
  Gene Symbol: MRPS17
  Gene Name: mitochondrial ribosomal protein S17
  ENST ID: ENST00000443449
  CDS Start-End: 332-718
cggggtattgctgccgggggaggatttgctggggacccaaggcaccctcgcgtgagagccctgagagcgaatcgcttcgtctgacctcggggttgtctggggcgagggcacgaatcaccccaacctttccgaagcctggtggaatggcttgtgaactgatctcaaaagcagcccaagtcatccgtcgctgggccggggagggggacaccgcggcggccccgccgagtgctacctgggcactgagcctgtggggagaggcgacccagcggggtggagagagataagggaccagtaacgtccagcgtttgtccgtggtgaccaaagccacgtaatgtccgtagttcgctcatccgtccatgccagatggattgtggggaaggtgattgggacaaaaatgcaaaagactgctaaagtgagagtgaccaggcttgttctggatccctatttattaaagtattttaataagcggaaaacctactttgctcacgatgcccttcagcagtgcacagttggggatattgtgcttctcagagctttacctgttccacgagcaaagcatgtgaaacatgaactggctgagatcgttttcaaagttggaaaagtcatagatccagtgacaggaaagccctgtgctggaactacctacctggagagtccgttgagttcggaaaccacccagctaagcaaaaatctggaagaactcaatatctcttcagca

SEQ ID NO: 154595 - DNA, 785 bp, Homo sapiens
  Payload ID: 10387
  Gene Symbol: MRPS18A
  Gene Name: mitochondrial ribosomal protein S18A
  Uniprot ID: Q9NVS2
  ENST ID: ENST00000372116
  CDS Start-End: 13-396
aggtttttgaagatggcggccctcaaggctctggtgtccggctgtgggcggcttctccgtgggctactagcgggcccggcagcgaccagctggtctcggcttccagctcgcgggttcagggaagtggtggagacccaagaagggaagacaactataattgaaggccgtatcacagcgactcccaaggagagtccaaatcctcctaacccctctggccagtgccccatctgccgttggaacctgaagcacaagtataactatgacgatgttctgctgcttagccagttcatccggcctcatggaggcatgctgccccgaaagatcacaggcctatgccaggaagaacaccgcaagatcgaggagtgtgtgaagatggcccaccgagcaggtacctgacgcgctgggctcctggctccgtcaagcccatctacaaaaaaggcccccgctggaacagggtgcgcatgcccgtggggtcaccccttctgagggacaatgtctgctactcaagaacaccttggaagctgtatcactgacagagagcagtgcttccagagttcctcctgcacctgtgctggggagtaggaggcccactcacaagcccttggccacaactatactcctgtcccaccccaccacgatggcctggtccctccaacatgcatggacaggggacagtgggactaacttcagtacccttggcctgcacagtagcaatgctgggagctagaggcaggcagggcagttgggtcccttgccagctgctatggggcttaggccatgctcag

SEQ ID NO: 154596 - DNA, 1062 bp, Homo sapiens
  Payload ID: 10387
  Gene Symbol: MRPS18A
  Gene Name: mitochondrial ribosomal protein S18A
  Uniprot ID: Q9NVS2
  ENST ID: ENST00000372133
  CDS Start-End: 13-603
aggtttttgaagatggcggccctcaaggctctggtgtccggctgtgggcggcttctccgtgggctactagcgggcccggcagcgaccagctggtctcggcttccagctcgcgggttcagggaagtggtggagacccaagaagggaagacaactataattgaaggccgtatcacagcgactcccaaggagagtccaaatcctcctaacccctctggccagtgccccatctgccgttggaacctgaagcacaagtataactatgacgatgttctgctgcttagccagttcatccggcctcatggaggcatgctgccccgaaagatcacaggcctatgccaggaagaacaccgcaagatcgaggagtgtgtgaagatggcccaccgagcaggtctattaccaaatcacaggcctcggcttcctgaaggagttgttccgaagagcaaaccccaactcaaccggtacctgacgcgctgggctcctggctccgtcaagcccatctacaaaaaaggcccccgctggaacagggtgcgcatgcccgtggggtcaccccttctgagggacaatgtctgctactcaagaacaccttggaagctgtatcactgacagagagcagtgcttccagagttcctcctgcacctgtgctggggagtaggaggcccactcacaagcccttggccacaactatactcctgtcccaccccaccacgatggcctggtccctccaacatgcatggacaggggacagtgggactaacttcagtacccttggcctgcacagtagcaatgctgggagctagaggcaggcagggcagttgggtcccttgccagctgctatggggcttaggccatgctcagtgctggggacaggagttttgcccaacgcagtgtcataaactgggttcatgggcttacccattgggtgtgcgctcactgcttgggaagtgcagggggtcctgggcacattgccagctgggtgctgagcattgagtcactgatctcttgtgatggggccaatgagtcaattgaattcatgggccaaacaggtcccatcctcttcatgac

SEQ ID NO: 154597 - DNA, 803 bp, Homo sapiens
  Payload ID: 10387
  Gene Symbol: MRPS18A
  Gene Name: mitochondrial ribosomal protein S18A
  ENST ID: ENST00000427312
  CDS Start-End: 13-803
aggtttttgaagatggcggccctcaaggctctggtgtccggctgtgggcggcttctccgtgggctactagcgggcccggcagcgaccagctggtctcggcttccagctcgcgggttcagggaagtggtggagacccaagaagggaagacaactataattgaaggccgtatcacagcgactcccaaggagagtccaaatcctcctaacccctctggccagtgccccatctgccgttggaacctgaagcacaagtataactatgacgatgttctgctgcttagccagttcatccggcctcatggaggcatgctgccccgaaagatcacaggcctatgccaggaagaacaccgcaagatcgaggagtgtgtgaagatggcccaccgagcaggtagaaggccctggggaccaagaggggcagagggctgcaggcactctctccccacccagctgccccatgtttcagcccctcctggaagaaaagtggatatccggagtgttaattatactcaccacccaatgccaaccttcccgctcccttgggctttccctctggccccctcagagctgcagagggagctgcaaagactatcccctcttccccgccactcaggtctattaccaaatcacaggcctcggcttcctgaaggagttgttccgaagagcaaaccccaactcaaccggtacctgacgcgctgggctcctggctccgtcaagcccatctacaaaaaaggcccccgctggaacagggtgcgcatgcccgtggggtcaccccttctgagggacaatgtctgctactcaagaac

SEQ ID NO: 154598 - DNA, 1532 bp, Homo sapiens
  Payload ID: 10388
  Gene Symbol: MRPS18B
  Gene Name: mitochondrial ribosomal protein S18B
  Uniprot ID: Q9Y676
  ENST ID: ENST00000259873
  CDS Start-End: 158-934
agcttctcccccatgccttccctttcacgcttccgtcctgacgcaaacgtggggccgccttccgcactgcgggcttgtccttggccctgccctactcagtttcctgaagcatgcgcagttgcctttccgtcaattcctgtcctgggcgtacgtcaagatggcggcgtctgtattaaacaccgtgctgaggcggcttcctatgctatctctcttccgaggttctcacagagttcaggttcccctccagactctttgcaccaaagctccctctgaggaagattctttgtcctcagttcccatttctccttataaggatgagccctggaaatatctggaatcagaagaataccaggagcgatatggttctcgccccgtctgggctgactaccgccgcaaccacaagggtggtgtacccccacagcggactcggaagacatgtattcgtcggaataaagttgttgggaatccctgccccatctgtcgagatcacaagttgcatgttgactttaggaacgtgaagctcttggagcaatttgtctgcgcccacacgggtatcatcttctatgctccatacacaggagtctgtgtgaagcagcacaagcggttgacccaggccatccagaaagccagggatcatggtctcctcatttaccacatcccccaggttgaaccacgggaccttgacttcagtacctctcatggggctgtgagtgctactccgccagcccccaccctggtctcaggtgacccctggtacccatggtacaactggaaacagccaccggagagagaactgtctcgccttcgccggctttaccagggtcatctccaagaagagagtggccccccacctgagtcaatgcccaagatgccccctagaacaccagcggaagcctcctccactgggcagacaggccctcagagtgctctgtaggagctgtagactgggaagagaggccaggcgtggtggctcactcctgtaatcccagcactttgggaagccaaggtgggctgatcacttgatcccaggagtttgagaccagcctgggcaccatggtgaaacctcgtctttaccaaaaaatacaaaaattagctgggtgtggtggtgcacacctgtagtctcaactattggggaggctaaggtaggatcacttgatcccaggaggcggaggttgcagtgagttgcagtcacacccctgcactccagcctgggtgacagctagaccctgtctcaaaaaaaaaaaaaaagactgggaagagagctagagggactaggagataatgtgtatgtaggtttatgtgatgggatatcaccctgaagagttgtgtcttttgtggccagtgacaaatccaggaaatgaatgttgctgatagggataaatcttgaggctgagggcgggtggtacagatgtgtatgggaaaccccaacccctatatattgtaaatagatgggctgggctaaacattgttgccgtttcatacttctaccaactcagcttttacacaataaagctctactgtctctggtttgc

SEQ ID NO: 154599 - DNA, 1252 bp, Homo sapiens
  Payload ID: 10388
  Gene Symbol: MRPS18B
  Gene Name: mitochondrial ribosomal protein S18B
  ENST ID: ENST00000400594
  CDS Start-End: 7-654
gtcaagatggcggcgtctgtattaaacaccgtgctgaggcggcttcctatgctatctctcttccgaggttctcacagagttcaggttcccctccagactctttgcaccaaagctccctctgaggaagattctttgtcctcagttcccatttctccttataaggatgagccctggaaatatctggaatcagaagaataccaggagcgatatggttctcgccccgtctgggctgactaccgccgcaaccacaagggtggtgtacccccacagcggactcggaagacatgtattaacgtgaagctcttggagcaatttgtctgcgcccacacgggtatcatcttctatgctccatacacaggtctcctcatttaccacatcccccaggttgaaccacgggaccttgacttcagtacctctcatggggctgtgagtgctactccgccagcccccaccctggtctcaggtgacccctggtacccatggtacaactggaaacagccaccggagagagaactgtctcgccttcgccggctttaccagggtcatctccaagaagagagtggccccccacctgagtcaatgcccaagatgccccctagaacaccagcggaagcctcctccactgggcagacaggccctcagagtgctctgtaggagctgtagactgggaagagaggccaggcgtggtggctcactcctgtaatcccagcactttgggaagccaaggtgggctgatcacttgatcccaggagtttgagaccagcctgggcaccatggtgaaacctcgtctttaccaaaaaatacaaaaattagctgggtgtggtggtgcacacctgtagtctcaactattggggaggctaaggtaggatcacttgatcccaggaggcggaggttgcagtgagttgcagtcacacccctgcactccagcctgggtgacagctagaccctgtctcaaaaaaaaaaaaaaagactgggaagagagctagagggactaggagataatgtgtatgtaggtttatgtgatgggatatcaccctgaagagttgtgtcttttgtggccagtgacaaatccaggaaatgaatgttgctgatagggataaatcttgaggctgagggcgggtggtacagatgtgtatgggaaaccccaacccctatatattgtaaatagatgggctgggctaaacattgttgccgtttcatacttctaccaactcagcttttacacaataaagctctactgtctctggtttgc

SEQ ID NO: 154600 - DNA, 1532 bp, Homo sapiens; identical to SEQ ID NO: 154598
  Payload ID: 10388
  Gene Symbol: MRPS18B
  Gene Name: mitochondrial ribosomal protein S18B
  Uniprot ID: Q9Y676
  ENST ID: ENST00000327800
  CDS Start-End: 158-934

SEQ ID NO: 154601 - DNA, 1252 bp, Homo sapiens; identical to SEQ ID NO: 154599
  Payload ID: 10388
  Gene Symbol: MRPS18B
  Gene Name: mitochondrial ribosomal protein S18B
  ENST ID: ENST00000440992
  CDS Start-End: 7-654

SEQ ID NO: 154602 - DNA, 1252 bp, Homo sapiens; identical to SEQ ID NO: 154599
  Payload ID: 10388
  Gene Symbol: MRPS18B
  Gene Name: mitochondrial ribosomal protein S18B
  ENST ID: ENST00000437247
  CDS Start-End: 7-654

SEQ ID NO: 154603 - DNA, 1252 bp, Homo sapiens; identical to SEQ ID NO: 154599
  Payload ID: 10388
  Gene Symbol: MRPS18B
  Gene Name: mitochondrial ribosomal protein S18B
  ENST ID: ENST00000428224
  CDS Start-End: 7-654

SEQ ID NO: 154604 - DNA, 1532 bp, Homo sapiens; identical to SEQ ID NO: 154598
  Payload ID: 10388
  Gene Symbol: MRPS18B
  Gene Name: mitochondrial ribosomal protein S18B
  Uniprot ID: Q9Y676
  ENST ID: ENST00000426945
  CDS Start-End: 158-934

SEQ ID NO: 154605 - DNA, 1532 bp, Homo sapiens; identical to SEQ ID NO: 154598
  Payload ID: 10388
  Gene Symbol: MRPS18B
  Gene Name: mitochondrial ribosomal protein S18B
  Uniprot ID: Q9Y676
  ENST ID: ENST00000430402
  CDS Start-End: 158-934

SEQ ID NO: 154606 - DNA, 1252 bp, Homo sapiens; identical to SEQ ID NO: 154599
  Payload ID: 10388
  Gene Symbol: MRPS18B
  Gene Name: mitochondrial ribosomal protein S18B
  ENST ID: ENST00000412843
  CDS Start-End: 7-654

SEQ ID NO: 154607 - DNA, 1252 bp, Homo sapiens; identical to SEQ ID NO: 154599
  Payload ID: 10388
  Gene Symbol: MRPS18B
  Gene Name: mitochondrial ribosomal protein S18B
  ENST ID: ENST00000418070
  CDS Start-End: 7-654

SEQ ID NO: 154608 - DNA, 1532 bp, Homo sapiens; identical to SEQ ID NO: 154598
  Payload ID: 10388
  Gene Symbol: MRPS18B
  Gene Name: mitochondrial ribosomal protein S18B
  Uniprot ID: Q9Y676
  ENST ID: ENST00000412451
  CDS Start-End: 158-934

SEQ ID NO: 154609 - DNA, 1532 bp, Homo sapiens; identical to SEQ ID NO: 154598
  Payload ID: 10388
  Gene Symbol: MRPS18B
  Gene Name: mitochondrial ribosomal protein S18B
  Uniprot ID: Q9Y676
  ENST ID: ENST00000454427
  CDS Start-End: 158-934

SEQ ID NO: 154610 - DNA, 1532 bp, Homo sapiens; identical to SEQ ID NO: 154598
  Payload ID: 10388
  Gene Symbol: MRPS18B
  Gene Name: mitochondrial ribosomal protein S18B
  Uniprot ID: Q9Y676
  ENST ID: ENST00000451032
  CDS Start-End: 158-934

SEQ ID NO: 154611 - DNA, 1643 bp, Homo sapiens
  Payload ID: 10389
  Gene Symbol: MRPS18C
  Gene Name: mitochondrial ribosomal protein S18C
  Uniprot ID: Q9Y3D5
  ENST ID: ENST00000295491
  CDS Start-End: 114-542
agcgttctcctgcggaacctttgaacggggtactcgagcccacaggggaagagcagcggaaggggcctttcggaacgatttggaacgaaaggaagtggaagaaacgcggaaccatggccgctgtggttgctgtttgcggtggtctagggaggaagaagttgacacacttggtaacggctgctgtcagccttacacatcccgggactcacacggtgctttggagaagaggttgttcacaacaggtatccagcaatgaggacctgcccatttcaatggaaaatccttataaagaacctcttaagaaatgtatcttgtgtggaaagcatgtagattataagaatgtacagcttttgtcccagtttgtttctccatttactggatgcatttatggaaggcacattacaggtctttgtgggaagaaacagaaagaaatcacaaaagcaattaagagagctcaaataatggggtttatgccagttacatacaaggatcctgcatatctcaaggaccctaaagtttgtaacatcagatatcgggaataaattctatcacgttaccactaataaacttattttacagtaagtggttgtatgatgccaatactgactcaaaccaacctttggatagaaaagtgtttgaggagtgaggtaaagaatgacacttccccttcataccaatgtccattaagcagattgcttatttaaaatgttaacactcatcacattttatctatgttgaataaaagtggttctgtgtgattgtcatttatatctgatccccaaatagctcatacaataatccattcaatagaatggaattaaaactgttcagaatgattttccaactagcaaatataagtatgcctggttaagatatcttccctttgtagaaatgttacattgggatggatagtggtgctgtcacagaaggacaaaatattcctagacgagtctaccctcaaaccagtagtgtcttttacatgaagagatgatttacacctaatagacattgaatatgatagacatacatgtatatatgtatcagttctgagttccactggcctatcccaaatacactggattaccaggcttgtactgtattcaaaatgatagatttgctaaatttcatgcaaaggactctaaactaggggagagattactgtttgtgttgtgttatagttgtgtaataattaaggctgccagatttagcaagtacaaatgtaggacaaatttaaattttagatgatgttttgcaaatttattgcatgatatccagcattttatctggcaactctagccataatgtacttctaaaaaagtatcacttaaggagaattttaatgactcagataaattttcatataaatttctttccatattttgaaaataaggctattcttgcttttccattttattttttaatagacatggtctcaatacgttgcccaggctggtctctaactcctaacttcaatcaatcctcctgacttgtcttccctaagtgctgggattacaggtgtgagccactgtgcctggtctcacttttccaattctaaagaatgtgtctgtgtaagccttcccctcaacaacttagtgaaaggtgaaaaaaaggtttggaaataaaagcatctgatgtttgaaaaa

SEQ ID NO: 154612 - DNA, 490 bp, Homo sapiens
  Payload ID: 10389
  Gene Symbol: MRPS18C
  Gene Name: mitochondrial ribosomal protein S18C
  ENST ID: ENST00000505719
  CDS Start-End: 1-279
gttgctgtttgcggtggtctagggaggaagaagttgacacacttggtaacggctgctgtcagccttacacatcccgggactcacacggtgctttggagaagaggttgttcacaacaggtatccagcaatgaggacctgcccatttcaatggaaaatccttataaagaacctcttaagaaatgtatcttgtgtggaaagcatgtagattataagaatgtacaggtctttgtgggaagaaacagaaagaaatcacaaaagcaattaagagagctcaaataatggggtttatgccagttacatacaaggatcctgcatatctcaaggaccctaaagtttgtaacatcagatatcgggaataaattctatcacgttaccactaataaacttattttacagtaagtggttgtatgatgccaatactgactcaaaccaacctttggatagaaaagtgtttgaggagtgaggtaaagaatgacacttccccttcata

SEQ ID NO: 154613 - DNA, 350 bp, Homo sapiens
  Payload ID: 10389
  Gene Symbol: MRPS18C
  Gene Name: mitochondrial ribosomal protein S18C
  ENST ID: ENST00000507349
  CDS Start-End: 24-230
ggaagtggaagaaacgcggaaccatggccgctgtggttgctgtttgcggtggtctagggaggaagaagttgacacacttggtaacggctgctgtcagccttacacatcccgggactcacacggtgctttggagaagaggttgttcacaacaggtatccagcaatgaggacctggtctttgtgggaagaaacagaaagaaatcacaaaagcaattaagagagctcaaataatggggtttatgccagttacatacaaggatcctgcatatctcaaggaccctaaagtttgtaacatcagatatcgggaataaattctatcacgttaccactaataaacttattttacagtaa

SEQ ID NO: 154614 - DNA, 855 bp, Homo sapiens
  Payload ID: 10389
  Gene Symbol: MRPS18C
  Gene Name: mitochondrial ribosomal protein S18C
  ENST ID: ENST00000509970
  CDS Start-End: 1-340
cgctgtggttgctgtttgcggtggtctagggaggaagaagttgacacacttggtaacggctgctgtcagccttacacatcccgggactcacacggtgctttggagaagaggttgttcacaacaggtatccagcaatgaggacctgcttttgtcccagtttgtttctccatttactggatgcatttatggaaggcacattacaggtctttgtgggaagaaacagaaagaaatcacaaaagcaattaagagagctcaaataatggggtttatgccagttacatacaaggatcctgcatatctcaaggaccctaaagtttgtaacatcagatatcgggaataaattctatcacgttaccactaataaacttattttacactgaagaaatacaactcagtcaatgaagctaaaggaataatgacatctcgttcaacaagggacagcatctatgatggggtctcacaagattatattggagcacatatagaaagctgatatatagcacttgatattggcattacagatcaaataggggaaatgactgatattcaataataatttggggacatttggttttccctatgaaaactaaaaagtaaaaatacatataggtttgtgtaagtatatgtttgcacaatgataaaactgcctaatgacacatttctcagaaggtacatagccttcattaagcaactcataactgtataaatctaatcaagatgtcaggttatcctaaaaaatgtcagtcattaacttgatatgaactctatctagaagtggttgacgtgtttgatatgttaacttacctttaattcctcttgtaatgaagcatacatttcatttatcttatgtacctc

SEQ ID NO: 154615 - DNA, 666 bp, Homo sapiens
  Payload ID: 10389
  Gene Symbol: MRPS18C
  Gene Name: mitochondrial ribosomal protein S18C
  ENST ID: ENST00000507019
  CDS Start-End: 96-440
ctttgaacggggtactcgagcccacaggggaagagcagcggaaggggcctttcggaacgatttggaacgaaaggaagtggaagaaacgcggaaccatggccgctgtggttgctgtttgcggtggtctagggaggaagaagttgacacacttggtaacggctgctgtcagccttacacatcccgggactcacacggtgctttggagaagaggttgttcacaacaggtatccagcaatgaggacctgcttttgtcccagtttgtttctccatttactggatgcatttatggaaggcacattacaggtctttgtgggaagaaacagaaagaaatcacaaaagcaattaagagagctcaaataatggggtttatgccagttacatacaaggatcctgcatatctcaaggaccctaaagtttgtaacatcagatatcgggaataaattctatcacgttaccactaataaacttattttacagtaagtggttgtatgatgccaatactgactcaaaccaacctttggatagaaaagtgtttgaggagtgaggtaaagaatgacacttccccttcataccaatgtccattaagcagattgcttatttaaaatgttaacactcatcacattttatctatgttgaataaaagtggttctgtgtgattgtcattta

SEQ ID NO: 154616 - DNA, 1510 bp, Homo sapiens
  Payload ID: 10390
  Gene Symbol: MRPS2
  Gene Name: mitochondrial ribosomal protein S2
  Uniprot ID: Q9Y399
  ENST ID: ENST00000241600
  CDS Start-End: 81-971
gccccgcgcggatggcgacggaaggggaggccgctcggcctggcctggagggagacctcgctctgccccgcgtcccagccatggcgacatcctcggccgcgctgccccgaatactcggcgcgggtgcccgggccccgtcgcgctggttgggctttctcgggaaggcgaccccccggcctgctcggccgagccgcaggacgcttggaagcgcgacggcccttatgatccgcgagtcggaggacagcaccgatttcaacgacaagattttgaatgagcccctcaagcactctgacttcttcaatgtcaaggaactgttttccgtgagaagcctcttcgatgcccgagtccatctgggacacaaagctggctgtcggcacaggtttatggagccgtacatctttgggagccgcctggaccacgacatcatcgacctggaacagacagccacgcacctccagctggccttgaacttcaccgcccacatggcctaccgcaagggcatcatcttgtttataagccgcaaccggcagttctcgtacctgattgagaacatggcccgtgactgtggcgagtacgcccacactcgctacttcaggggcggcatgctgaccaacgcgcgcctcctctttggccccacggtccgcctgccggacctcatcatcttcctgcacacgctcaacaacatctttgagccacacgtggccgtgagagacgcagccaagatgaacatccccacagtgggcatcgtggacaccaactgcaacccctgcctcatcacctaccctgtacccggcaatgacgactctccgctggctgtgcacctctactgcaggctcttccagacggccatcacccgggccaaggagaagcggcagcaggttgaggctctctatcgcctgcagggccagaaggagcccggggaccaggggccagcccaccctcctggggctgacatgagccattccctgtgatgttcactctcctcccaaagcaaaccacagccaagcctgtctgagctgggagtccccttccccagccctgggtcagcggcatcctcagtcgttgttacttactcagctgatgtcacagtgcagacatccaccgttccaccacagaaccagtggctgagcggaccaacgttgccatgtgcgtttgctctgtggggaacagagcacagagggtgagcgacatgtgcagaacggccccttggctgcagttaggacctcagtggctggtatggccaagctgctagaagatgctgctgtccctgtgatcccagcagccctcccttcaccgtgacccctgacctttgtcaggaaggtgcagtttttcttctcaatctaaatgcctttcaggtgggccgcttccttggctacctggttccagggggctgttttgtaatgagatgctgctggcaggccactcagaggctcccagctgggttggtgggacagccaggccagatgacctgattccagcaaaaataaaactcagatttgggcaaaatgag

SEQ ID NO: 154617 - DNA, 1640 bp, Homo sapiens
  Payload ID: 10390
  Gene Symbol: MRPS2
  Gene Name: mitochondrial ribosomal protein S2
  Uniprot ID: Q9Y399
  ENST ID: ENST00000371785
  CDS Start-End: 210-1100
aacctgccgggcgactccccaagggccgggaaggtcgggacggcgagagattccctgctgggaccgtcggaggtcccagccgcctggggacagcgctgtggctcctccgggcctgtaggcggcactgcggccccgcgcggatggcgacggaaggggaggccgctcggcctggcctggagggagacctcgctctgccccgcgtcccagccatggcgacatcctcggccgcgctgccccgaatactcggcgcgggtgcccgggccccgtcgcgctggttgggctttctcgggaaggcgaccccccggcctgctcggccgagccgcaggacgcttggaagcgcgacggcccttatgatccgcgagtcggaggacagcaccgatttcaacgacaagattttgaatgagcccctcaagcactctgacttcttcaatgtcaaggaactgttttccgtgagaagcctcttcgatgcccgagtccatctgggacacaaagctggctgtcggcacaggtttatggagccgtacatctttgggagccgcctggaccacgacatcatcgacctggaacagacagccacgcacctccagctggccttgaacttcaccgcccacatggcctaccgcaagggcatcatcttgtttataagccgcaaccggcagttctcgtacctgattgagaacatggcccgtgactgtggcgagtacgcccacactcgctacttcaggggcggcatgctgaccaacgcgcgcctcctctttggccccacggtccgcctgccggacctcatcatcttcctgcacacgctcaacaacatctttgagccacacgtggccgtgagagacgcagccaagatgaacatccccacagtgggcatcgtggacaccaactgcaacccctgcctcatcacctaccctgtacccggcaatgacgactctccgctggctgtgcacctctactgcaggctcttccagacggccatcacccgggccaaggagaagcggcagcaggttgaggctctctatcgcctgcagggccagaaggagcccggggaccaggggccagcccaccctcctggggctgacatgagccattccctgtgatgttcactctcctcccaaagcaaaccacagccaagcctgtctgagctgggagtccccttccccagccctgggtcagcggcatcctcagtcgttgttacttactcagctgatgtcacagtgcagacatccaccgttccaccacagaaccagtggctgagcggaccaacgttgccatgtgcgtttgctctgtggggaacagagcacagagggtgagcgacatgtgcagaacggccccttggctgcagttaggacctcagtggctggtatggccaagctgctagaagatgctgctgtccctgtgatcccagcagccctcccttcaccgtgacccctgacctttgtcaggaaggtgcagtttttcttctcaatctaaatgcctttcaggtgggccgcttccttggctacctggttccagggggctgttttgtaatgagatgctgctggcaggccactcagaggctcccagctgggttggtgggacagccaggccagatgacctgattccagcaaaaataaaactcagatttgggcaaaatgaga

SEQ ID NO: 154618 - DNA, 810 bp, Homo sapiens
  Payload ID: 10390
  Gene Symbol: MRPS2
  Gene Name: mitochondrial ribosomal protein S2
  ENST ID: ENST00000453385
  CDS Start-End: 1-810
cggaggggcccgttggggatgcggtggggagcgggcgtggtgcattcgggactcggcgccaggacctctatctacttccccccaggtgcccgggccccgtcgcgctggttgggctttctcgggaaggcgaccccccggcctgctcggccgagccgcaggacgcttggaagcgcgacggcccttatgatccgcgagtcggaggacagcaccgatttcaacgacaagattttgaatgagcccctcaagcactctgacttcttcaatgtcaaggaactgttttccgtgagaagcctcttcgatgcccgagtccatctgggacacaaagctggctgtcggcacaggtttatggagccgtacatctttgggagccgcctggaccacgacatcatcgacctggaacagacagccacgcacctccagctggccttgaacttcaccgcccacatggcctaccgcaagggcatcatcttgtttataagccgcaaccggcagttctcgtacctgattgagaacatggcccgtgactgtggcgagtacgcccacactcgctacttcaggggcggcatgctgaccaacgcgcgcctcctctttggccccacggtccgcctgccggacctcatcatcttcctgcacacgctcaacaacatctttgagccacacgtggccgtgagagacgcagccaagatgaacatccccacagtgggcatcgtggacaccaactgcaacccctgcctcatcacctaccctgtacccggcaatgacgactctccgctggctgtgcacctctactgcaggctcttccagacggcc

SEQ ID NO: 154619 - DNA, 1462 bp, Homo sapiens
  Payload ID: 10391
  Gene Symbol: MRPS21
  Gene Name: mitochondrial ribosomal protein S21
  ENST ID: ENST00000581066
  CDS Start-End: 448-711
ggggaaaggaaggctggcttggcgagagggcaggtttgcgggctttcgcccccttttccaaagaccaacaaagagtccttccccaactcccaactcaaccccttttggaactatgtgtggtggttgggaccctgtggcgcatccttgtcgctcgtgtccttctcatgcccggcgacgcgtctttgtggtaacgccctgctgccatctcttttcttctctatgcgaggatttggactggcagtgagaataagagacaacgattcacgtctactttctaggatgacttccatgtgctccatctcgcgcgtccctgagcatgttgaatttccaaatcctaaataagccgcgcggtgtagtttgtattatgttgcgtttctctttctgctttcctcgccctttctccatcatcctttaggctctacagagtgaaggtttaaatccaaggtcatggcaaaacatctgaagttcatcgccaggactgtgatggtacaggaagggaacgtggaaagcgcatacaggaccctaaacagaatcctcactatggatgggctcattgaggacattaagcatcggcggtattatgagaagccatgctgccggcgacagagggaaagctatgaaaggtgccggcggatctacaacatggaaatggctcgcaagatcaacttcttgatgcgaaagaatcgggcagatccgtggcagggctgctgaggcctgtgggtgggacacccagtgcgaaaccctcatccagttttctctccatctcttttctttgtacaatcccatttcctattaccattctctgcaataaactcaaatcacatgtctgcaagaaggcctccaaatatagaaacaatcccattagtcagcagtggaccctgtcttttattaagtgaaagaagaaactgagtctgaaagtactctaggagtagaatggtatttgccagggactggaggagggggcagtgaggagttattgtttaatgggtacagagtttcagtttgggcagatgaaaaagttcaggagacgatggcctggcatggtggctcacgcctgttatcccaacactttgggaggctgaggcgggcggctcacttgaggccaggagtttgagaccagcttggccaatgtggtgaaaccccatctctactaaaaatacaaaaaaaaattggccgggcgtggtggtgcacgcctgtaatcccagatacttgggtggctgaggcaggagaattgcttgaactggggaggaagaggttgcagtgagccaagatcatgccactgcactccaacctgggcgacagagtgagactccatctcaaaacaaaaaaacggagatggatgatgaatggtgatggcggttgctcaaaaagttgaatgtacttaatgccactgaactatacccttaaatggtcacgatggtaaattttgtgttttactacaataaaaacttttttgaaagtc

SEQ ID NO: 154620 - DNA, 1226 bp, Homo sapiens
  Payload ID: 10391
  Gene Symbol: MRPS21
  Gene Name: mitochondrial ribosomal protein S21
  ENST ID: ENST00000614145
  CDS Start-End: 212-475
aggtgtagagtccaggcccggggaagagaggcagtcaacagaggccagaaaggacgttgctatggtttccacgcacgttgtctccctcggcctgtttctttgcgcggcgctggcgattccgtaatttccgcttccggtagtgagaacccttccggtgggctaggtactgagcgcgcgaggctctacagagtgaaggtttaaatccaaggtcatggcaaaacatctgaagttcatcgccaggactgtgatggtacaggaagggaacgtggaaagcgcatacaggaccctaaacagaatcctcactatggatgggctcattgaggacattaagcatcggcggtattatgagaagccatgctgccggcgacagagggaaagctatgaaaggtgccggcggatctacaacatggaaatggctcgcaagatcaacttcttgatgcgaaagaatcgggcagatccgtggcagggctgctgaggcctgtgggtgggacacccagtgcgaaaccctcatccagttttctctccatctcttttctttgtacaatcccatttcctattaccattctctgcaataaactcaaatcacatgtctgcaagaaggcctccaaatatagaaacaatcccattagtcagcagtggaccctgtcttttattaagtgaaagaagaaactgagtctgaaagtactctaggagtagaatggtatttgccagggactggaggagggggcagtgaggagttattgtttaatgggtacagagtttcagtttgggcagatgaaaaagttcaggagacgatggcctggcatggtggctcacgcctgttatcccaacactttgggaggctgaggcgggcggctcacttgaggccaggagtttgagaccagcttggccaatgtggtgaaaccccatctctactaaaaatacaaaaaaaaattggccgggcgtggtggtgcacgcctgtaatcccagatacttgggtggctgaggcaggagaattgcttgaactggggaggaagaggttgcagtgagccaagatcatgccactgcactccaacctgggcgacagagtgagactccatctcaaaacaaaaaaacggagatggatgatgaatggtgatggcggttgctcaaaaagttgaatgtacttaatgccactgaactatacccttaaatggtcacgatggtaaattttgtgttttactacaataaaaacttttttgaaagtc

SEQ ID NO: 154621 - DNA, 1120 bp, Homo sapiens
  Payload ID: 10392
  Gene Symbol: MRPS22
  Gene Name: mitochondrial ribosomal protein S22
  Uniprot ID: P82650
  ENST ID: ENST00000310776
  CDS Start-End: 9-1091
tgataatcatggcgcccctcggaacaactgtattgctgtggagcctcttgaggagttctccgggcgtggaacgggtctgtttccgggctcgaatccagccctggcacggtggcctgctccaaccgctaccttgctctttcgagatggggctgccacgccgccggttcagctccgaggccgcagaatctggtagcccagagaccaagaaacctacatttatggatgaggaagttcaaagcatactcacgaaaatgacaggcttgaacttgcagaagacttttaagccagctatacaagaactgaagccaccaacctataagctaatgactcaggcacagttggaagaggctacaagacaggcagttgaggcagctaaagtacgattaaaaatgccaccagttctggaagagcgagtaccaataaatgatgtgttagctgaagataagattttggaaggaacagaaacaaccaaatatgtgtttactgatatatcatatagcataccacaccgggagcgttttattgtcgtcagagaaccaagtggcacactacgcaaagcctcttgggaagaacgggaccgaatgatacaagtttatttcccaaaagaaggtcgtaaaattttgacaccaataattttcaaggaagaaaatcttaggactatgtatagccaggacaggcatgttgatgtcctcaatctctgctttgcccagtttgagccagattccacagagtatatcaaggttcatcacaagacctatgaagatatagataaacgtggaaaatatgaccttttacgttcaacaagatactttggtggaatggtgtggtattttgtaaataataaaaagattgatggtttgctgattgaccagattcagagagatttaatcgatgatgcaaccaacttggtccagctgtatcacgtgctccatccagatggccagtcggctcaaggggccaaggatcaggctgctgagggaataaatttaatcaaggtctttgcaaaaacagaagcacagaagggagcctatatagaactaacactgcagacttatcaagaagcactcagtcgccattctgcagcttcctaaaaatattttaaaaatacatttattttact

SEQ ID NO: 154622 - DNA, 532 bp, Homo sapiens
  Payload ID: 10392
  Gene Symbol: MRPS22
  Gene Name: mitochondrial ribosomal protein S22
  ENST ID: ENST00000495225
  CDS Start-End: 378-532
gccacgaagcttccttttgagaagctgcttgtgttctgggcccccacccatgcagcgaatgaatgagcgttgaagttgagtttggacgtggttgcttcagtatccagcggtccttccctagcaacacaggccatttaggagcaccacctaaggcttcttccccttcctacagatggattgctgagttgatgagaggaggaactctgggacctgtgcctctgggaaagcagaatctttcagaagactggaagagaaaatctgaaggcagcaaatctcaggtgctagaacataaagtgaggactgagaagctggaaaagagagatggctgatgctgagtgctcagaggtggcttctggaagaaaaagacttgagctgagatggttcaaacaggcaggagtgaaggcattccaggctgggagcagagtatgagcaaaggcagggagattcctggcagtgactcagaatctggtagcccagagaccaagaaacctacatttatggatgaggaagttcaaagcatactcacgaaaat

SEQ ID NO: 154623 - DNA, 1547 bp, Homo sapiens
  Payload ID: 10392
  Gene Symbol: MRPS22
  Gene Name: mitochondrial ribosomal protein S22
  Uniprot ID: P82650
  ENST ID: ENST00000495075
  CDS Start-End: 433-1515
cctcttcctgggcggcgatctctgggacagatgcgcagaagacttcctgctcaacgacgacgtcctccctgagagcgcccaggaaaacgtccacttccagcccagcagacgagtcgtcctgcgctcctgagcgttcgtcgacagagctcaggaggacctctgggatcaggatgagggtgtgtccatcgagagacactcgcaggatcgacgttggcgggagctccagcaccaggtcgacgtcgtccaggggcacacgcagggcacagcccgcggccaggaccactatggagcactttgagtatatcatcccactgtctcctggagggcaagattcagccttaagggggttcccttgtatgtgagtgctgcaagaactgggtgtgactcggaatccctcccaaccacttccggcgcaagtggcttctgataatcatggcgcccctcggaacaactgtattgctgtggagcctcttgaggagttctccgggcgtggaacgggtctgtttccgggctcgaatccagccctggcacggtggcctgctccaaccgctaccttgctctttcgagatggggctgccacgccgccggttcagctccgaggccgcagaatctggtagcccagagaccaagaaacctacatttatggatgaggaagttcaaagcatactcacgaaaatgacaggcttgaacttgcagaagacttttaagccagctatacaagaactgaagccaccaacctataagctaatgactcaggcacagttggaagaggctacaagacaggcagttgaggcagctaaagtacgattaaaaatgccaccagttctggaagagcgagtaccaataaatgatgtgttagctgaagataagattttggaaggaacagaaacaaccaaatatgtgtttactgatatatcatatagcataccacaccgggagcgttttattgtcgtcagagaaccaagtggcacactacgcaaagcctcttgggaagaacgggaccgaatgatacaagtttatttcccaaaagaaggtcgtaaaattttgacaccaataattttcaaggaagaaaatcttaggactatgtatagccaggacaggcatgttgatgtcctcaatctctgctttgcccagtttgagccagattccacagagtatatcaaggttcatcacaagacctatgaagatatagataaacgtggaaaatatgaccttttacgttcaacaagatactttggtggaatggtgtggtattttgtaaataataaaaagattgatggtttgctgattgaccagattcagagagatttaatcgatgatgcaaccaacttggtccagctgtatcacgtgctccatccagatggccagtcggctcaaggggccaaggatcaggctgctgagggaataaatttaatcaaggtctttgcaaaaacagaagcacagaagggagcctatatagaactaacactgcagacttatcaagaagcactcagtcgccattctgcagcttcctaaaaatattttaaaaatacatttattttactaaa

SEQ ID NO: 154624 - DNA, 1099 bp, Homo sapiens
  Payload ID: 10392
  Gene Symbol: MRPS22
  Gene Name: mitochondrial ribosomal protein S22
  ENST ID: ENST00000465056
  CDS Start-End: 1-1080
atggcgcccctcggaacaactgtattgctgtggagcctcttgaggagttctccgggcgtggaacgggtctgtttccgggctcgaatccagccctggcacggtggcctgctccaaccgctaccttgctctttcgagatggggctgccacgccgccggttcagctccgaggccgaatctggtagcccagagaccaagaaacctacatttatggatgaggaagttcaaagcatactcacgaaaatgacaggcttgaacttgcagaagacttttaagccagctatacaagaactgaagccaccaacctataagctaatgactcaggcacagttggaagaggctacaagacaggcagttgaggcagctaaagtacgattaaaaatgccaccagttctggaagagcgagtaccaataaatgatgtgttagctgaagataagattttggaaggaacagaaacaaccaaatatgtgtttactgatatatcatatagcataccacaccgggagcgttttattgtcgtcagagaaccaagtggcacactacgcaaagcctcttgggaagaacgggaccgaatgatacaagtttatttcccaaaagaaggtcgtaaaattttgacaccaataattttcaaggaagaaaatcttaggactatgtatagccaggacaggcatgttgatgtcctcaatctctgctttgcccagtttgagccagattccacagagtatatcaaggttcatcacaagacctatgaagatatagataaacgtggaaaatatgaccttttacgttcaacaagatactttggtggaatggtgtggtattttgtaaataataaaaagattgatggtttgctgattgaccagattcagagagatttaatcgatgatgcaaccaacttggtccagctgtatcacgtgctccatccagatggccagtcggctcaaggggccaaggatcaggctgctgagggaataaatttaatcaaggtctttgcaaaaacagaagcacagaagggagcctatatagaactaacactgcagacttatcaagaagcactcagtcgccattctgcagcttcctaaaaatattttaaaaatacat

SEQ ID NO: 154625 - DNA, 1065 bp, Homo sapiens
  Payload ID: 10392
  Gene Symbol: MRPS22
  Gene Name: mitochondrial ribosomal protein S22
  ENST ID: ENST00000478464
  CDS Start-End: 106-1065
ggaaggtcagggaagggttcctggcaaatatgaccaaagctgagatctggttagccatgctaaggagaaagcaagaagcttctcaagcataggggacagtagcagatgtccagaaatgagactgagcacagatatttgggaacccattttggagcagaatctggtagcccagagaccaagaaacctacatttatggatgaggaagttcaaagcatactcacgaaaatgacaggcttgaacttgcagaagacttttaagccagctatacaagaactgaagccaccaacctataagctaatgactcaggcacagttggaagaggctacaagacaggcagttgaggcagctaaagtacgattaaaaatgccaccagttctggaagagcgagtaccaataaatgatgtgttagctgaagataagattttggaaggaacagaaacaaccaaatatgtgtttactgatatatcatatagcataccacaccgggagcgttttattgtcgtcagagaaccaagtggcacactacgcaaagcctcttgggaagaacgggaccgaatgatacaagtttatttcccaaaagaaggtcgtaaaattttgacaccaataattttcaaggaagaaaatcttaggactatgtatagccaggacaggcatgttgatgtcctcaatctctgctttgcccagtttgagccagattccacagagtatatcaaggttcatcacaagacctatgaagatatagataaacgtggaaaatatgaccttttacgttcaacaagatactttggtggaatggtgtggtattttgtaaataataaaaagattgatggtttgctgattgaccagattcagagagatttaatcgatgatgcaaccaacttggtccagctgtatcacgtgctccatccagatggccagtcggctcaaggggccaaggatcaggctgctgagggaataaatttaatcaaggtctttgcaaaaacagaagcacagaagggagcctatatagaactaacactgcagacttatcaagaagcactcagtcgccattctgcagcttcctaa

SEQ ID NO: 154626 - DNA, 827 bp, Homo sapiens
  Payload ID: 10392
  Gene Symbol: MRPS22
  Gene Name: mitochondrial ribosomal protein S22
  ENST ID: ENST00000466690
  CDS Start-End: 1-496
aacaactgtattgctgtggagcctcttgaggagttctccgggcgtggaacgggtctgtttccgggctcgaatccagccctggcacggtggcctgctccaaccgctaccttgctctttcgagatggggctgccacgccgccggttcagctccgaggccgcagaatctggtagcccagagaccaagaaacctacatttatggatgaggaagttcaaagcatactcacgaaaatgacaggcttgaacttgcagaagacttttaagccagctatacaagaactgaagccaccaacctataagctaatgactcaggcacagttggaagaggctacaagacaggcagttgaggcagctaaagtacgattaaaaatgccaccagttctggaagagcgagtaccaataaatgatgtgttagctgaagataagattttggaaggaacagaaacaaccaaatatgtgtttactgatatatcatatagcataccacaccggtgttgatggaagtttcatctatgttatcttcagaacacatttagagactcctacacctctgaaaacttgagagtcagtactgtttggttaatttatacattaatcaggagcgttttattgtcgtcagagaaccaagtggcacactacgcaaagcctcttgggaagaacgggaccgaatgatacaagtttatttcccaaaagaaggtcgtaaaattttgacaccaataattttcaaggaagaaaatcttaggactatgtatagccaggacaggcatgttgatgtcctcaatctctgctttgcccagtttgagccagattccacagagtatatcaaggt

SEQ ID NO: 154627 - DNA, 600 bp, Homo sapiens
  Payload ID: 10392
  Gene Symbol: MRPS22
  Gene Name: mitochondrial ribosomal protein S22
  ENST ID: ENST00000465373
  CDS Start-End: 1-600
ggaacaactgtattgctgtggagcctcttgaggagttctccgggcgtggaacgggtctgtttccgggctcgaatccagccctggcacggtggcctgctccaaccgctaccttgctctttcgagatggggctgccacgccgccggttcagctccgaggccgcttcttatttactaaagtccattttagcagaatctggtagcccagagaccaagaaacctacatttatggatgaggaagttcaaagcatactcacgaaaatgacaggcttgaacttgcagaagacttttaagccagctatacaagaactgaagccaccaacctataagctaatgactcaggcacagttggaagaggctacaagacaggcagttgaggcagctaaagtacgattaaaaatgccaccagttctggaagagcgagtaccaataaatgatgtgttagctgaagataagattttggaaggaacagaaacaaccaaatatgtgtttactgatatatcatatagcataccacaccgggagcgttttattgtcgtcagagaaccaagtggcacactacgcaaagcctcttgggaagaacgggaccgaatgatacaagtt

SEQ ID NO: 154628 - DNA, 363 bp, Homo sapiens
  Payload ID: 10392
  Gene Symbol: MRPS22
  Gene Name: mitochondrial ribosomal protein S22
  ENST ID: ENST00000480644
  CDS Start-End: 1-363
caaatatgtgtttactgatatatcatatagcataccacaccgggagcgttttattgtcgtcagagaaccaagtggcacactacgcaaagcctcttgggaagaacgggaccgaatgatacaagtttatttcccaaaagaaggtcgtaaaattttgacaccaataattttcaaggaagaaaatcttaggtttgagccagattccacagagtatatcaaggttcatcacaagacctatgaagatatagataaacgtggaaaatatgaccttttacgttcaacaagatactttggtggaatggtgtggtattttgtaaataataaaaagattgatggtttgctgattgaccagattcagagagattt

SEQ ID NO: 154629 - DNA, 1401 bp, Homo sapiens
  Payload ID: 10392
  Gene Symbol: MRPS22
  Gene Name: mitochondrial ribosomal protein S22
  Uniprot ID: P82650
  ENST ID: ENST00000498505
  CDS Start-End: 6-512
taatcatggcgcccctcggaacaactgtattgctgtggagcctcttgaggagttctccgggcgtggaacgggtctgtttccgggctcgaatccagccctggcacggtggcctgctccaaccgctaccttgctctttcgagatggggctgccacgccgccggttcagctccgaggccgaatctggtagcccagagaccaagaaacctacatttatggatgaggaagttcaaagcatactcacgaaaatgacaggcttgaacttgcagaagacttttaagccagctatacaagaactgaagccaccaacctataagctaatgactcaggcacagttggaagaggctacaagacaggcagttgaggcagctaaagtacgattaaaaatgccaccagttctggaagagcgagtaccaataaatgatgtgttagctgaagataagattttggaaggaacagaaacaaccaaatatgtgtttactgatatatcatatagcataccacaccggtgttgatggaagtttcatctatgttatcttcagaacacatttagagactcctacacctctgaaaacttgagagtcagtactgtttggttaatttatacattaatcaggagcgttttattgtcgtcagagaaccaagtggcacactacgcaaagcctcttgggaagaacgggaccgaatgatacaagtttatttcccaaaagaaggtcgtaaaattttgacaccaataattttcaaggaagaaaatcttaggactatgtatagccaggacaggcatgttgatgtcctcaatctctgctttgcccagtttgagccagattccacagagtatatcaaggttcatcacaagacctatgaagatatagataaacgtggaaaatatgaccttttacgttcaacaagatactttggtggaatggtgtggtattttgtaaataataaaaagattgatggtttgctgattgaccagattcagagagatttaatcgatgatgcaaccaacttggtccagctgtatcacgtgctccatccagatggccagtcggctcaaggggccaaggatcaggctgctgagggaataaatttaatcaaggtctttgcaaaaacagaagcacagaagggagcctatatagaactaacactgcagacttatcaagaagcactcagtcgccattctgcagcttcctaaaaatattttaaaaatacatttattttactaaatactgactacatttctctgttaatattgagctaaatgttaaaaaatggccagattaaaagatatcaatttgtagttctccctacaaagcaaaaattattaccctactcacttttcgtaggctacaaggatatttgagtgcctggttatgaatttctcaaatcatgttagatgagcgt

SEQ ID NO: 154630 - DNA, 5621 bp, Homo sapiens
  Payload ID: 10393
  Gene Symbol: MRPS23
  Gene Name: mitochondrial ribosomal protein S23
  Uniprot ID: Q9Y3D9
  ENST ID: ENST00000313608
  CDS Start-End: 47-619
tccggttccggtagcagctagtcacgctcggtaccaggcgcagatcatggcaggcagccggctggaaaccgtagggagcatcttctctcggactcgggacctggttcgggccggggtgctgaaggagaagcccctgtggtttgacgtatatgacgcctttcccccgctgagggagcccgtcttccaaaggcctcgagtgcgatatggcaaagccaaagctcccatccaagacatctggtaccacgaggatcggattagagcgaagttttattcagtgtatgggtctggtcaaagagcttttgatctattcaatccaaacttcaagtctacctgtcaacggtttgtggagaagtacactgagctacagaaacttggagaaacagatgaagagaagttatttgtggaaacagggaaggctttattggcagaaggtgtcattttaagacgagtaggcgaagcaaggactcaacacggaggtagtcacgtttcccggaaatccgaacacttgagtgtcagaccacagactgcgttggaagaaaacgagactcagaaagaagttccacaggaccagcatttggaggcacctgcagaccagtcgaaaggtctcttgcctccctgaaggacctgtatactgtgtatgctggcattcacactctactcactggctgaatgttgagctatttttaaacagttgaactgtgtaaatgtttcttgatctctaaggtattatgtttgccttctcttagttatttctgggttgtcacaaagctcagtatcatggtttgacagaagcagttatgtgaacttttatgttaggacattactaaataaagaattccctagctgcttataaagtaaatttactttgaattgtaaataacatgaagaaacctttataaagattgttcaaatgggactcaatctgactaggcttgctttgatgtttgttagtatgtgggctggctacatctgattcccgggtacatatttcttctgatccatcagacttatacgtgtacacatgttgtggaaccttggctagctggttttgtctgcagagaatctttgtacttcttgctatagaacgattatctctccacttgagaggccaagctgacttgcgctttgtggtaagagtgaggacctgtcattgctgatacacaaagaccaaaactgtaactttaatgtcatggattgagtgtgctggagacagttaacataggcctgcacagactaggctgttcagtaaatacttgttgaatgaatgagtgaacgaatggttatatccagctaaagactggattcatatggtgtagataacaggattgccaagaaaggaggcagctaatttaggtgatgctctccaccagcatccacctgcctccctggggccaaagtgtgcctacaagtccttatcaacttccctgccttcctcgtttccccaggttttactaaatacatgaaatatccctctgagattgcagcctttgtatatgtggtcaagccagtggtttttagctgttagtagtaagctgcttcagaaattccctattttaaaactcatgtagattttctacccagtgattctttgtgtatgctctcatctctcctggtacactgtgaggcaggtccacatctcacagtctgtatatagtacacatccatgcacgtgggtgcttggttcatgcaggtgaatgaatacattaggcaaaagcagctctcagccatgctgcttccccctcgacctttatcactgtttcacaactgcttgcatttggagaatgctttacttttccgtagggaagtaaatttcatccattcagagacattacacaaccattgagaccaaacatcgggccagaccttgggaagaggacttaaaaagcaggtgaaagacacagtctattctcagaggaacaattgaggggtcactcatctctttaaaccttaggtttctggttttttaagggcaggttttttttgccacaatgatgaatatttaaaaaatgtttttttccttcatgtctggattgatgtcccatttttgctatttttgtttgttttcctcctctgtagatttttaattttttttttttttttttttttttttttgcgatggagtatcactttgtttcccaggctggagtacagtggagccatcttggcccactgcaacctccgcctcccaggttcaagcagttcttctgcctcagcctcccaagtagctgggattacaggtgtatgctatgacgcccggctaatttttgtatttttagtagaaacgggcttttaaccatgttgcccaggctgatctcaaactgctggcctcaagtgatccacccatctcaacctcccaaaatgctgggattacgggtgttagccaccatgcctggccttaattttttttttttttaattttgttttaggagatgggggtctcactgtgttacccaggctgggtgcagtggtgcataccctgccgcagtcttaactcctgggctgaagccatcctggctcacttcccgaatagctaggactataggcatgtgccaccacgcctggctctttaacattttttttgtttgtttttttttgtagagatggagtcttgctatgttgcccaggctggcctggtctcaaactcctggcctcaagcgatcctcctgcctcagccgcccaaagtgctgggattacaggcctgagcgaccgtactggggctgaagacttttaaagaagttatttgttgcataattctttaaaaaaattatacatgcacatggttcaaaacttaacagtaaaaagctagtctcccacccctgttccccagccacccttttccccttccctgaggccatcactatcaccatttccttgtgcgctcttccagaaatattttgggcatggacaggacactatgcatactgttctgtaccttgcttttctagttactatgtctcagagatccactgtgatttaatcagtgcccgattgaagaaaatgttctttgttttactgtgttgcaaatgggctgctagagttatgggatgctggatcaaggagcagatcattttgagttttgatatcttcgtccatagaaattgtgcttaactatactctcatagcaatgtatgagaatgcgttcccctacacattctgatcttgttaaaccagactgggactctggaccagaagggaaagaccatccctgtatagcaaatatctggatggggagaaagctgctgtcactcattgacttctttaggttaagtcttagtgatcaaaacatagtgaaagatatgaagcttactttggaaactcagaactatttccacagtttgggcaaaagctgtcatcagatccccatcacgttttggagagaatggaagcatgaccgcattcttggctttaaagagcttaaaatcaggccgggctccatggctcacgcctgtaatcccagcactttgggaggccaaggtgggcggatcacctgaggtcaggagttcgagaccagcctggccaacatagtgaaaccccatctttactaaaaatacaaaaaaattagctgggcgtgcgggcgtgtgcctgtaataccagctacccgggaggctgaggcaggagaatcgctggaacccaggaggcagaggctgcagttgagccgagattgtgccactgcactccagcttgggcgacagagcaagaccctgtctcaaaaaaaaaaaaaaaaaaatcttaaaatcgagttgggactacaagagtgacttgtgaaacagcaagatgaacaggaatccttttaaactttgatataaaagtacagtagaggttcaggggcaaggaatcagttctggatttgtctaggaatactgcatgagagcctggaaaggcagtgggatggacatgtacatgcggtttctttgggcaggaacaccctcccttctaccatggtctgtaggaattgaaccttccgtgccgttttcaaatgctgtctgtgctcggaaaatacataatatcaagtcccttactgaaccccctacagattgtgttcataaggtgcttcactgctgttggtctacctggcctactgtttgtactcctgcctcatttactgtggccttcattcaagtagtaatgattatttacctattaagagtatagggtgggcgtggtggctcatgtaatcccagcactttgggaagtcaagatgggtagatcacttgaagtcaggagtttgagaccagcctgggcaacatgatgaaaccccatctctactaaaaatacaaaagttagctggatgtggtggcagcctcctgtaatcccaactactcggcaggctgaggcaggagaatcgcttgaacccaggaggtggaggttacagtgagctgagatcatgctacagcaccccagcctgggcgacagaagagagacactgtctcaaaaaaaaaaaaaaaaaaagtataaaggagggcagaaattcttattcttttaacccattgaaacattaaacagcctttcaggagcagaccctcctacggatttgctgaatccaaggcgaggaaggcatatatccaggttacagtgaagtttgccccagacaagtaatgaagatttgggttctagatctggatactccaggcagtttttactatgtgaccctgtgcctgtcacagtatttcagcctgtaaaatatggacaatgtttgcctttttggcttccagttagctttgtgaggattaattgagatgagtgcaaagctcatttgtaatgtgtggctggtggttttattactattttgagcagtagtggaaaagcccatttgaactggtaggatgagataagatcatggtggccttgacaactacatggaggagccagttgggtatgggaaagtttgagcagggaaagaaagaatgtagtgaaagcagtgtcaggtcaaagaaaggtttgcctaggagtgatgtaaagaatgggatggaggagtgggcagggaaggaggaaagaggagacatgtcagagggaccaaaaaggaggcagcaagtccaaggtcacaaacctgagtgactagaaaacttagcagcatcactaacacccagttggtgacgtggaactggtgctctcctgggagagagcttcaattctcaacctactaagttgaaggtgatggtgctatatctaagtggcagacagagataagggataggtgtctacaggggcaagatttggagccaggagaagaaatgagctctccaagggtagtggggagagatctgggatgttgggggctggcaggtaaatgctttaagtgatagaataggaggaatgagaaagccagcaaaagaaattcacgtcccatgtcttccatcatctatatgtctgacttgtttaagtggtcctggattcaccaaattttatagagctctgcctctgcctttattgggtaggcctgatttttgatgatgtccttaaaaggctagcctgattcttcttgtagttttgtagaacactttgtatcgagagttctctgataatgaaagtggtattacagaataatctgcccccgaaggactcctgattttgttaaagtgatacctttctctgtaaataaatgatggcgtgccacttaaaaa

SEQ ID NO: 154631 - DNA, 516 bp, Homo sapiens
  Payload ID: 10393
  Gene Symbol: MRPS23
  Gene Name: mitochondrial ribosomal protein S23
  ENST ID: ENST00000579380
  CDS Start-End: 332-516
tccggttccggtagcagctagtcacgctcggtaccaggcgcagatcatggcaggcagccggctggaaaccgtagggagcatcttctctcggtgtgtgctcccagccgtggtgggctgagggtgcctcccccaggctggggttctcagccggtcacgctcttccttggagcggacctgagcagggcgaggcgtattgcagggtgcgggggctgagctgggactcgggacctggttcgggccggggtgctgaaggagaagcccctgtggtttgacgtatatgacgcctttcccccgctgagggagcccgtcttccaaaggcctcgagtgcgatatggcaaagccaaagctcccatccaagacatctggtaccacgaggatcggattagagcgaagttttattcagtgtatgggtctggtcaaagagcttttgatctattcaatccaaacttcaagtctacctgtcaacggtttgtggagaagtacactgagctacagaaacttggagaaacagatgaa

SEQ ID NO: 154632 - DNA, 580 bp, Homo sapiens
  Payload ID: 10393
  Gene Symbol: MRPS23
  Gene Name: mitochondrial ribosomal protein S23
  ENST ID: ENST00000578444
  CDS Start-End: 35-493
agcagctagtcacgctcggtaccaggcgcagatcatggcaggcagccggctggaaaccgtagggagcatcttctctcggactcgggacctggttcgggccggggtgctgaaggagaagcccctgtggtttgacgtatatgacgcctttcccccgctgagggagcccgtcttccaaaggcctcgagtgcgatatggcaaagccaaagctcccatccaagacatctggtaccacgaggatcggattagagcgaagttttattcagtgtatgggtctggtcaaagagcttttgatctattcaatccaaacttcaagtctacctgtcaacggtttgtggagaagtacactgagctacagaaacttggagaaacagatgaagagaagttatttgtggaaacagggaaggctttattggcagaaggtgtcattttaagacgagtaggcgaagcaaggactgtgagtatttcattgttaaaattgttactgggtttatagttgtccctcagtatgcacaggggattggtgctagggcccctgcagataccaatattcacagatgctgaaataccttttataaagtgc

SEQ ID NO: 154633 - DNA, 707 bp, Homo sapiens
  Payload ID: 10394
  Gene Symbol: MRPS24
  Gene Name: mitochondrial ribosomal protein S24
  Uniprot ID: Q96EL2
  ENST ID: ENST00000317534
  CDS Start-End: 63-566
gtccgcggtcgtccccacccctcagcgcgctgtggtacgtcccgcgctccgcttggcccaagatggcggcctccgtgtgcagcgggttgctggggccacgggtgctgtcctggagccgagagctgccttgcgcttggcgcgccctgcacacctccccggtctgcgccaagaaccgggcggcccgagtacgcgtaagcaagggggacaagccggtgacctacgaggaggcacacgcgccgcactacatcgcccaccgtaaaggctggctgtcgctgcacacaggtaacctggatggagaggaccatgccgcagagcgaacggtggaggatgttttccttcgcaagttcatgtggggtaccttcccaggctgcctggctgaccagctggttttaaagcgccggggtaaccagttggagatctgtgccgtggtcctgaggcagttgtctccacacaagtactacttcctcgtgggctacagtgaaactttgctgtcctacttttacaaatgtcctgtgcgactccacctccaaactgtgccctcaaaggttgtgtataagtacctctagaacaatccccttttttccatcaagctgtagcctgcagagaatggaaacgtgggaaaggaatggtatgtgggggaaatgcatcccctcagaggactgaggcatagtctctcatctgctattgaataaagaccttctatcttg

SEQ ID NO: 154634 - DNA, 743 bp, Homo sapiens
  Payload ID: 10394
  Gene Symbol: MRPS24
  Gene Name: mitochondrial ribosomal protein S24
  ENST ID: ENST00000418740
  CDS Start-End: 388-606
cccgcgctccgcttggcccaagatggcggcctccgtgtgcagcgggttgctggggccacgggtgagtggggcgactcggcaggtccctgcgagtcggaggtggggtccctagtttccgcctcacgcgccctccctccacaggtgctgtcctggagccgagagctgccttgcgcttggcgcgccctgcacacctccccggtctgcgccaagaaccgggcggcccgagtacgcgtaagcaagggggacaagccggtgacctacgaggaggcacacgcgccgcactacatcgcccaccgtaaaggctggctgtcgctgcacacaggtaacctggatggagaggaccatgccgcagagcgaacggtggaggatgttttccttcgcaagttcatgtggggtaccttcccaggctgcctggctgaccagctggttttaaagcgccggggtaaccagttggagatctgtgccgtggtcctgaggcagttgtctccacacaagtactacttcctcgtgggctacagtgaaactttgctgtcctacttttacaaatgtcctgtgcgactccacctccaaactgtgccctcaaaggttgtgtataagtacctctagaacaatccccttttttccatcaagctgtagcctgcagagaatggaaacgtgggaaaggaatggtatgtgggggaaatgcatcccctcagaggactgaggcatagtctctcatctgctattgaataaagaccttctat

SEQ ID NO: 154635 - DNA, 4586 bp, Homo sapiens
  Payload ID: 10395
  Gene Symbol: MRPS25
  Gene Name: mitochondrial ribosomal protein S25
  Uniprot ID: P82663
  ENST ID: ENST00000253686
  CDS Start-End: 142-663
agcgtctcctgtgcgtctgcgcgggaagtggaacctggctctggggagaagccgcgtgagatccgcgcgggtgctagctagtcctttctcgtcgctgctcggctcgcggcccgtggggtcggccccgccaccgttgccgccatgcccatgaagggccgcttccccatccgccgcaccctgcaatatctgagccaggggaacgtggtgttcaaggactccgtgaaggtcatgacagtgaattacaacacgcatggggagctgggcgagggcgccaggaagtttgtgtttttcaacatacctcagattcaatacaaaaacccttgggtgcagatcatgatgtttaagaacatgacgccgtcacccttcctgcgattctacttagattctggggagcaggtcctggtggatgtggagaccaagagcaataaggagatcatggagcacatcagaaaaatcttggggaagaatgaggaaaccctcagggaagaggaggaggagaaaaagcagctttctcacccagccaacttcggccctcgaaagtactgcctgcgggagtgcatctgtgaagtggaagggcaggtgccctgccccagcctggtgccattacccaaggagatgagggggaagtacaaagccgctctgaaagccgatgcccaggactaaggcccacggtcactgtgggctggggtgatggtgtctgaccagtggggagattggaatgggattactttggcccagggaagcccctggttctgtccctggagactctggaaatccttttgcattaaaaggactttacacacctgtgtaaaaggatgtgggagaggagggtctgaagctgagctgctaaatgaatatccctgctctgctggtcaataaaacgcttcctaatagcagcttggcgtgtatctggtcctagtgaagaggaaggcctgtgtagcagaaaggctttgggcctgagaggttaaggccacagcctgttgacacctgttttggtcctgcgaccctttactggtctccgctggctttgaatcttcctctgggctctactctggagaacataagggctgctgtggttgagtctggctagcactgtctgtggttggcagtgtgtacacccctccgttcagttccttgggggtatttttcagaaatccaaaggcaacccttcgtgcagtgctcacttttttaagtacagttgattacccttgcctgctggggggcctagccatgggccagagatggaggagccccagtggctgacaggccagcctcactcaggcacgtacctgctgaccagtcagccactgccaacccatggcccagccactgtgtgcattagcagggaggtttgtaggccatggaggaaatgaggagacaccacctagtggagacattggggccctgctggggggatggtgtctatagctggctctgctggctccctcaggccctgcttaccaagctctggaggagggagtgctgcattactgagcaccttccttgttctttcctcataggacactgatgttactgtcactttagttatgctaaagtggaggtttcagcctccagaagacagcagagccttctagggtcaccttaagaataggtttagctaggctgggtgtggtggctcatgcctgtaatcccagcactttgggaggctgatgtgggcggatagttgagcccaggagttcgagaccagcctgggcaacatggcaagaccttgtctctacaaaaagtacaaaaattagatgggtgtggtgtttcgcgtctgtagtcccagctatttgggaagctgaggtgggaggatctcgagcctgcgagatcaaggctgcagtgaatcatgatcgtgcgctactgcactccagcctgggccacagagcaagactgtctcaagaaaaaaaattttttaaataagtttaattataaagtgaaggaccagttggaccacggacccctagaaactcagccaaggagacctgactttatctgagacaggaaggcagtggttaaaagaattaaaaaaggacagtggtgcttgacagagcaggactgaagttttcattcctctacctgctggggccttggtcaagtcctaaaagctttccaggtctgtaactggttttgtctgtaaaatggggaaaaggttaccttttctgccacatgaagtagctggctggtgaaatgatgtcatactacgatgtgtttcattaactgttggagattatcacattaaattgagcagatttggatcttttacatttgatgctcaagtttgattctgtaccagatctgggtttggggtgatggcttgtcgggggtgggaggggaaggtgggcagagactgatgtataatggacaggtgttccttgagtgacagacttacaaagggagtgtttaattgaaatctagcatcttgtctctctgctatcagcattttggctgggtggaaaaagctctcctccacagagagccctcccatgtctgctggtttcagttccccacccaactgactgaagtcttgaccttgataccacctgcctgggcgttctacttggctgcaagggctcttcagaaagcacctagttccttttggctttcatctgcagtgtaggtctccatagctagtgacacacaaagccttatgagagtattccttccctctagggcccaaagaggctgctaaccagcaggaatgtcctgaaccaaaaggagtggtgaccattctctagacagaataaatgtctggtccctaatgggacagataactagggtttgagttcaggcttgacacaggagcaatgggcagtgaggtggacagcccagaccctgaaaggacgtgtggagacagcagcagtcctgtggtgcagttactgcctgtgtggccagcttcacaggcagcagataatttgtggaaataaacattattttctttttttgttccctgtaggctacttgatcctggatagtttctctttaaacctttgtctttccctattttgtttagtagtgatgaaagatgggtttaaaatatacagaaatgggagaaaattaattagagaaaatgtgaggattttataattgataacatgttcttaattttacttgcacaagcagtgttcacagccttattctgaagtgaccacttttcttctctttgaggcactacctggcagcaccatctaaacctgtatcatctgctgtggtcccagttactcaggaggctgaggcaggaggatcacttgagcccaggaggttgaggctggagtgagccatgactgtaccactgcattccagcctgggtgacggagtgaggccctatctgcctgccagtgagttctgtcatgcatcagactttggacctcagaattttcacctggaacatgagaggtcagatgacataatgaatatgttctaacttctgaaacttttggagcttgtttttgcccttgatagcacgtatccttagagaataagcttgccaatttaaggcctgtctgtaatggcatctgaatgttccagcagcctaactgtgctctgctccagaaacatgtgtgtggcttccctacctccacaccaaggagctgccttgctgggtggatgtaaagactgtcctgccagggtttcccactaaaggtattaataagtccagtggaccacagagggcccaatccctcttggccgctaaggctaaggtaggagccagagagctgtagagacaggaccaccaggatgcttcatgtccataacacaagagagcgctgcattgtttgggggccaggcattactactatcatgaagaaaaatgaagagcaggatgcatgttagtctttaattcacttttaatagtataaacctcatttaggtagtagtattaagccacaacaataatgccacattgaaacagcatttaataaaatgcataaagctaattcatgcactgcaatactctatatacaaacacaacaatgcaaattcttcttcaagactgaagacattgattagatataaaattcagtttaaaaagaacatgctattttttaaatgccatcacataaacaaagtgatttcacagggagaagaaagctgtataaagctgcagctttcaacaggttttaaacctggcattaaaatgtaatggcaaaaccaatattttctatattgtgaagggcaaaggttacagaaacggtcccaagaaaatctaacacccaaattttcctttgatagatagatgcctttaaaagggctggtaatgcagttacattctaacagagaagtccaaactacaggtaaaaactacggcttgtactgtgaaaaatgtgcagcttttcagttataaaactagttgaacactggtttacaagataatccgtagaacagagagactgtagaaaaatattccagcacttgagttgtgtgtggcagcagcatttgagtccatgaatgctatggtcattaaaataattgattatactttcctaaagaaaagccattttttaatgcaaagtctactacttccaaatgttattccaaacattaaattttaacagtctatcaatcaataaatgttgaacattttt

SEQ ID NO: 154636 - DNA, 1119 bp, Homo sapiens
  Payload ID: 10395
  Gene Symbol: MRPS25
  Gene Name: mitochondrial ribosomal protein S25
  Uniprot ID: P82663
  ENST ID: ENST00000449354
  CDS Start-End: 67-504
agctagtcctttctcgtcgctgctcggctcgcggcccgtggggtcggccccgccaccgttgccgccatgcccatgaagggccgcttccccatccgccgcaccctgcaatatctgagccaggggaacgtggtgttcaaggactccgtgaaggtcatgacagtgaattacaacacgcatggggagctgggcgagggcgccaggaagtttgtgtttttcaacatacctcagattcaatacaaaaacccttgggtgcagatcatgatgtttaagaacatgacgccgtcacccttcctgcgattctacttagattctggggagcaggtcctggtggatgtggagaccaagagcaataaggagatcatggagcacatcagaaaaatcttggggaagaatgagcactacctggcagcaccatctaaacctgtatcatctgctgtggtcccagttactcaggaggctgaggcaggaggatcacttgagcccaggaggttgaggctggagtgagccatgactgtaccactgcattccagcctgggtgacggagtgaggccctatctgcctgccagtgagttctgtcatgcatcagactttggacctcagaattttcacctggaacatgagaggtcagatgacataatgaatatgttctaacttctgaaacttttggagcttgtttttgcccttgatagcacgtatccttagagaataagcttgccaatttaaggcctgtctgtaatggcatctgaatgttccagcagcctaactgtgctctgctccagaaacatgtgtgtggcttccctacctccacaccaaggagctgccttgctgggtggatgtaaagactgtcctgccagggtttcccactaaaggtattaataagtccagtggaccacagagggcccaatccctcttggccgctaaggctaaggtaggagccagagagctgtagagacaggaccaccaggatgcttcatgtccataacacaagagagcgctgcattgtttgggggccaggcattactactatcatgaagaaaaatgaagagcaggatgcatgttagtctttaattcacttttaatagtataaacctcatttaggtagtagtattaagccacaac

SEQ ID NO: 154637 - DNA, 590 bp, Homo sapiens
  Payload ID: 10395
  Gene Symbol: MRPS25
  Gene Name: mitochondrial ribosomal protein S25
  ENST ID: ENST00000420267
  CDS Start-End: 118-450
gaagtggaacctggctctggggagaagccgcgtgagatccgcgcgggtgctagctagtcctttctcgtcgctgctcggctcgcggcccgtggggtcggccccgccaccgttgccgccatgcccatgaagggccgcttccccatccgccgcaccctgcaatatctgagccaggggaacgtggtgttcaaggactccgtgaaggtcatgacagtgaattacaacacgcatggggagctgggcgagggcgccaggaagtttgtgtttttcaacatacctcagattcaatacaaaaacccttgggtgcagatcatgatgtttaagaacatgacgccgtcacccttcctgcgattctacttagattctggggagcaggtcctggtggatgtggagaccaagagcaataaggagatcatggagcacatcagaaaaatcttggggaagaatgagtgagttgtttggtttgacctggaaggaacaaacttctcagcccagagaatttgaggaagaaaggggtgtgtgggaagggtgttgagaggcactacctggcagcaccatctaaacctgtatcatctgctgtggtcccagttact

SEQ ID NO: 154638 - DNA, 723 bp, Homo sapiens
  Payload ID: 10395
  Gene Symbol: MRPS25
  Gene Name: mitochondrial ribosomal protein S25
  ENST ID: ENST00000447299
  CDS Start-End: 107-439
tggctctggggagaagccgcgtgagatccgcgcgggtgctagctagtcctttctcgtcgctgctcggctcgcggcccgtggggtcggccccgccaccgttgccgccatgcccatgaagggccgcttccccatccgccgcaccctgcaatatctgagccaggggaacgtggtgttcaaggactccgtgaaggtcatgacagtgaattacaacacgcatggggagctgggcgagggcgccaggaagtttgtgtttttcaacatacctcagattcaatacaaaaacccttgggtgcagatcatgatgtttaagaacatgacgccgtcacccttcctgcgattctacttagattctggggagcaggtcctggtggatgtggagaccaagagcaataaggagatcatggagcacatcagaaaaatcttggggaagaatgagtgagttgtttggtttgacctggaaggaacaaacttctcagcccagagaatttgaggaagaaaggggtgtgtgggaagggtgttgagagggaaaccctcagggaagaggaggaggagaaaaagcagctttctcacccagccaacttcggccctcgaaagtactgcctgcgggagtgcatctgtgaagtggaagggcaggtgccctgccccagcctggtgccattacccaaggagatgagggggaagtacaaagccgctctgaaagccgatgcccaggactaaggccca

SEQ ID NO: 154639 - DNA, 1281 bp, Homo sapiens
  Payload ID: 10395
  Gene Symbol: MRPS25
  Gene Name: mitochondrial ribosomal protein S25
  Uniprot ID: P82663
  ENST ID: ENST00000444840
  CDS Start-End: 124-513
gcgcgggaagtggaacctggctctggggagaagccgcgtgagatccgcgcgggtgctagctagtcctttctcgtcgctgctcggctcgcggcccgtggggtcggccccgccaccgttgccgccatgcccatgaagggccgcttccccatccgccgcaccctgcaatatctgagccaggggaacgtggtgttcaaggactccgtgaaggtcatgacagtgaattacaacacgcatggggagctgggcgagggcgccaggaagtttgtgtttttcaacatacctcagattcaatacaaaaacccttgggtgcagatcatgatgtttaagaacatgacgccgtcacccttcctgcgattctacttagggaaaccctcagggaagaggaggaggagaaaaagcagctttctcacccagccaacttcggccctcgaaagtactgcctgcgggagtgcatctgtgaagtggaagggcaggtgccctgccccagcctggtgccattacccaaggagatgagggggaagtacaaagccgctctgaaagccgatgcccaggactaaggcccacggtcactgtgggctggggtgatggtgtctgaccagtggggagattggaatgggattactttggcccagggaagcccctggttctgtccctggagactctggaaatccttttgcattaaaaggactttacacacctgtgtaaaaggatgtgggagaggagggtctgaagctgagctgctaaatgaatatccctgctctgctggtcaataaaacgcttcctaatagcagcttggcgtgtatctggtcctagtgaagaggaaggcctgtgtagcagaaaggctttgggcctgagaggttaaggccacagcctgttgacacctgttttggtcctgcgaccctttactggtctccgctggctttgaatcttcctctgggctctactctggagaacataagggctgctgtggttgagtctggctagcactgtctgtggttggcagtgtgtacacccctccgttcagttccttgggggtatttttcagaaatccaaaggcaacccttcgtgcagtgctcacttttttaagtacagttgattacccttgcctgctggggggcctagccatgggccagagatggaggagccccagtggctgacaggccagcctcactcaggcacgtacctgctgaccagtcagccactgccaacccatggcccagccactgtgtgcattagcagggaggtttgtaggccatggaggaaatgaggagacaccaccta

SEQ ID NO: 154640 - DNA, 1127 bp, Homo sapiens
  Payload ID: 10396
  Gene Symbol: MRPS26
  Gene Name: mitochondrial ribosomal protein S26
  Uniprot ID: Q9BYN8
  ENST ID: ENST00000380325
  CDS Start-End: 125-742
agaggccacacggccgggcggggcgtgagggacagcccgaggactacaggtcccaaggttccccgcgccgcttccggggcacggtggcgtcccggcaccgcggccgcagtgaggagactcggccatgctacgcgcgctgagccgcctgggcgcggggaccccgtgcaggccccgggcccctctggtgctgccagcgcgcggccgcaagacccgccacgacccgctggccaaatccaagatcgagcgagtgaacatgccgcccgcggtggaccctgcggagttcttcgtgctgatggagcgttaccagcactaccgccagaccgtgcgcgccctcaggatggagttcgtgtccgaggtgcagaggaaggtgcacgaggcccgagccggggttctggcggagcgcaaggccctgaaggacgccgccgagcaccgcgagctgatggcctggaaccaggcggagaaccggcggctgcacgagctgcggatagcgaggctgcggcaggaggagcgggagcaggagcagcggcaggcgttggagcaggcccgcaaggccgaagaggtgcaggcctgggcgcagcgcaaggagcgggaagtgctgcagctgcaggaagaggtgaaaaacttcatcacccgagagaacctggaggcacgggtggaagcagcattggactcccggaagaactacaactgggccatcaccagagaggggctggtggtcaggccacaacgcagggactcctaggggcccagtaaggacagtgcccgccagggaccatgtatgtatcatggcggaagagttggccctgacctggaataaagcagttggtgttgcttatgaggaaggttcagccttatccagcacagccttcacgttttgccctctgctgtcaccacttggtcagaaacttccaaacgcagtgccctgttctgccggtgtgtacagcctcagcgcaccaggagaccctagagtggtttccatctcacagagaatcagacagggccacagccccctcaggcagccaggtcatctgagtatcattaagagtagtgatgggaagattacagtctgagggccaaacgtgcctgcttcctgtttttgtaaataaagttttgttggaacacagcca

SEQ ID NO: 154641 - DNA, 2785 bp, Homo sapiens
  Payload ID: 10397
  Gene Symbol: MRPS27
  Gene Name: mitochondrial ribosomal protein S27
  Uniprot ID: Q92552
  ENST ID: ENST00000261413
  CDS Start-End: 41-1285
gtccgtaacccgttggctgttccttttggtacgctccaagatggctgcctccatagtgcggcgcgggatgctcctggcgcggcaagtggttcttcctcagctctctcctgcaggtaaaagatacctgctttcttcagcctatgtagacagccacaaatgggaagcaagagaaaaagaacattactgtcttgctgatcttgcatctttaatggataaaacatttgagagaaagttgcctgttagttctttaacaatatcacggcttatagacaacatttcctctcgggaagagatagatcatgcagagtattacctttacaagtttcgacacagccccaactgctggtacctgagaaactggactatccacacctggattaggcagtgtctaaaatatgatgcacaagacaaagccctatatacccttgtaaataaggttcaatatggaatttttccagataactttacattcaatttactgatggattctttcataaagaaagaaaattacaaagatgctttatctgtggtttttgaggtcatgatgcaagaagcctttgaagtgccttccacccaacttctctccctctatgttttatttcattgcctggcaaagaagacagacttcagttgggaagaggagaggaactttggtgcatcccttttgcttccaggcctaaaacaaaagaactcagtgggtttcagttcccagttgtatggctatgcacttcttgggaaggtggagttgcagcaagggctacgggctgtgtaccacaacatgcctctgatatggaaaccaggctaccttgacagagcccttcaagtgatggagaaagtggctgcctccccagaagacataaagctgtgtagagaagcgctcgatgtgctgggtgcagtgctgaaggctctgacttcagctgatggggcttcagaggagcagtcccaaaatgatgaagacaaccaggggtcagaaaaactggtggagcagttagacatcgaggaaacagagcagtccaagcttcctcaatacctggaacgatttaaggccttacattctaagcttcaagctctgggcaaaattgagtcagaaggtcttttaagtctgaccacccagcttgtcaaggaaaaactctccacctgtgaagcagaggacatcgccacctatgagcagaatctgcagcagtggcatctagaccttgtacagttgatccagagagaacagcaacagagggagcaagcgaagcaggagtaccaggctcagaaagcagcaaaggcatctgcctaatagggtcccccagggccccacctgtctcacaagaacttcactcaaccccgtgccaggactcagcagtggcctggacaacagcctcagcttcctctacccatcttcttttcttaaagcaggctatgtgccctacatggcaaggcaccatgactgcccatcgagatgccaagaagggctatggaactatgcaggtggctagtggtcagactgaagtcaccagctgaataccttaaggaggactcttgaggctcataatggagttcctggggcacagggattagttatgagcattaaagttcctaagacccagtgacagtactgggagaaaccaaggctgaagagtcaggttgaagcacaggcttttgttttttgttgtttttgttttttgagacagagtctcattctgtcacccaggctggagtgcagtggcgcaatcttggctcactgcaacctccgactcccaggttcaagcaattctcctgcctcggcctcctttagtaggtgggattacaggtgcataccaccacacctttctaatttttgcatttttagtagagatggggtttcaccatgttggtcaggctggtctcaacctcctgacctcaagtgatctgcccgcctcagcctcccaaagtgctgggatgataggcgtgagccaccacacccggccaagcacaggcttttgaatggtctccctctccccagcccaggtacatgaggccaaggtgaactgtgcatcctgagaccttgtgtccctgagtctcctttctgagtgcaagctgcactgtgagctggctgtgggatactcacacattcccacattctcctttctgccacatctcgcccttctggacctgcactgggagaaattcaggacaggagtgaactcaaggccatgaactcactggatttccatttttaggcacccatagggatgtttttaggatgtaagtttctgaggagaaagctagctctagcatgaagcttttttggattggcttctccatcgtgttggggtaacattttttttccaattttttttttcccaaaacatcgtctcagctcatttatcaagtaggtaaaatgagccttttgtgtacacacagaggcacatgtgcatgcacacacaacttgtgaacacacatttctgttaaagaagttagaaaatgagagatgggttggggcttgaagtgcatcagaggtatgaatgttgtaaaactgtcaggagatgtaaaattcctttctgaagtgtctcttctgtgaaagggttcagagcagattttgcttactatgtagtgttgcccttaagtacagtggtgtaattttattcaagattgtgctcttctatcaaaagcctctggaaataaatgttccgggatcatgttagtgtactctttatctttggggaaagggaggagggagagggactcattattgttactatgattttgaggagtgtactttaaaccctcccccattaaactatgggatttattgtaa

SEQ ID NO: 154642 - DNA, 956 bp, Homo sapiens
  Payload ID: 10397
  Gene Symbol: MRPS27
  Gene Name: mitochondrial ribosomal protein S27
  ENST ID: ENST00000508863
  CDS Start-End: 60-956
gatggctgcctccatagtgcggcgcgggatgctcctggcgcgctgatcttgcatctttaatggataaaacatttgagagaaagttgcctgttagttctttaacaatatcacggcttatagacaacatttcctctcgggaagagatagatcatgcagagtattacctttacaagtttcgacacagccccaactgctggtacctgagaaactggactatccacacctggattaggcagtgtctaaaatatgatgcacaagacaaagccctatatacccttgtaaataaggttcaatatggaatttttccagataactttacattcaatttactgatggattctttcataaagaaagaaaattacaaagatgctttatctgtggtttttgaggtcatgatgcaagaagcctttgaagtgccttccacccaacttctctccctctatgttttatttcattgcctggcaaagaagacagacttcagttgggaagaggagaggaactttggtgcatcccttttgcttccaggcctaaaacaaaagaactcagtgggtttcagttcccagttgtatggctatgcacttcttgggaaggtggagttgcagcaagggctacgggctgtgtaccacaacatgcctctgatatggaaaccaggctaccttgacagagcccttcaagtgatggagaaagtggctgcctccccagaagacataaagctgtgtagagaagcgctcgatgtgctgggtgcagtgctgaaggctctgacttcagctgatggggcttcagaggagcagtcccaaaatgatgaagacaaccaggggtcagaaaaactggtggagcagttagacatcgaggaaacagagcagtccaagcttcctcaatacctggaacgatttaaggccttacattctaagcttcaagctctgggcaaaattgagtcagaaggtcttttaagtctg

SEQ ID NO: 154643 - DNA, 1369 bp, Homo sapiens
  Payload ID: 10397
  Gene Symbol: MRPS27
  Gene Name: mitochondrial ribosomal protein S27
  Uniprot ID: Q92552
  ENST ID: ENST00000513900
  CDS Start-End: 11-1297
acgctccaagatggctgcctccatagtgcggcgcgggatgctcctggcgcggcaagtggttcttcctcagctctctcctgcaggtaaaagatacctgctttcttcagcctatgtagacagccacaaatgggaagcaagagaaaaagaacattactgtcttgctgatcttgcatctttaatggataaaacatttgagagaaagttgcctgttagttctttaacaatatcacggcttatagacaacatttcctctcgggaagagatagatcatgcagagtattacctttacaaaaagggagaatgctcatccagcaatccacagaattattccaggtttcgacacagccccaactgctggtacctgagaaactggactatccacacctggattaggcagtgtctaaaatatgatgcacaagacaaagccctatatacccttgtaaataaggttcaatatggaatttttccagataactttacattcaatttactgatggattctttcataaagaaagaaaattacaaagatgctttatctgtggtttttgaggtcatgatgcaagaagcctttgaagtgccttccacccaacttctctccctctatgttttatttcattgcctggcaaagaagacagacttcagttgggaagaggagaggaactttggtgcatcccttttgcttccaggcctaaaacaaaagaactcagtgggtttcagttcccagttgtatggctatgcacttcttgggaaggtggagttgcagcaagggctacgggctgtgtaccacaacatgcctctgatatggaaaccaggctaccttgacagagcccttcaagtgatggagaaagtggctgcctccccagaagacataaagctgtgtagagaagcgctcgatgtgctgggtgcagtgctgaaggctctgacttcagctgatggggcttcagaggagcagtcccaaaatgatgaagacaaccaggggtcagaaaaactggtggagcagttagacatcgaggaaacagagcagtccaagcttcctcaatacctggaacgatttaaggccttacattctaagcttcaagctctgggcaaaattgagtcagaaggtcttttaagtctgaccacccagcttgtcaaggaaaaactctccacctgtgaagcagaggacatcgccacctatgagcagaatctgcagcagtggcatctagaccttgtacagttgatccagagagaacagcaacagagggagcaagcgaagcaggagtaccaggctcagaaagcagcaaaggcatctgcctaatagggtcccccagggccccacctgtctcacaagaacttcactcaaccccgtgccaggactcagcagtggcct

SEQ ID NO: 154644 - DNA, 1183 bp, Homo sapiens
  Payload ID: 10397
  Gene Symbol: MRPS27
  Gene Name: mitochondrial ribosomal protein S27
  ENST ID: ENST00000515404
  CDS Start-End: 155-748
cttttggtacgctccaagatggctgcctccatagtgcggcgcgggatgctcctggcgcggtaaaagatacctgctttcttcagcctatgtagacagccacaaatgggaagcaagagaaaaagaacattactgtcttgctgatcttgcatctttaatggataaaacatttgagagaaagttgcctgttagttctttaacaatatcacggcttatagacaacatttcctctcgggaagagatagatcatgcagagtattacctttacaagtttcgacacagccccaactgctggtacctgagaaactggactatccacacctggattaggcagtgtctaaaatatgatgcacaagacaaagccctatatacccttgtaaataaggttcaatatggaatttttccagataactttacattcaatttactgatggattctttcataaagaaagaaaattacaaagatgctttatctgtggtttttgaggtcatgatgcaagaagcctttgaagtgccttccacccaacttctctccctctatgttttatttcattgcctggcaaagaagacagacttcagttgggaagaggagaggaactttggtgcatcccttttgcttccaggcctaaaacaaaagaactcagtgggtttcagttcccagttgtatggctatgcacttcttggtaagctaaatgatccttacaaatactgttcttcatggttagaattgttgcattcttccagttcataataaaattgtaatttgatttaaatttaccagtgaaatccaattagccttcgtttttagacataaaaatagaccttgatggccttacagttactccataagagagtaaagagggttcttaaaacctgccatcactggcaaagcaagaactagttctggtggatataggtaataatattcagtggtaatcagtctgaagaagggataaagaaagggatgttctggccctgtttagggagactagctagtagaatcttttccagtattaacaaagatctttctgtctctttagatctaaagtccagaaggtaagaaattaagagttagagttgaacttgtatctttggtattgttttcaggtaagggaagataaactaagagcagaagtagtagcacttcaggaaaagtggagtggttcatgggtaccatgtgattgca

SEQ ID NO: 154645 - DNA, 2628 bp, Homo sapiens
  Payload ID: 10397
  Gene Symbol: MRPS27
  Gene Name: mitochondrial ribosomal protein S27
  ENST ID: ENST00000457646
  CDS Start-End: 171-1247
aacccgttggctgttccttttggtacgctccaagatggctgcctccatagtgcggcgcgggatgctcctggcgcggtaaaagatacctgctttcttcagcctatgtagacagccacaaatgggaagcaagagaaaaagaacattactgtcttgctgatcttgcatctttaatggataaaacatttgagagaaagttgcctgttagttctttaacaatatcacggcttatagacaacatttcctctcgggaagagatagatcatgcagagtattacctttacaagtttcgacacagccccaactgctggtacctgagaaactggactatccacacctggattaggcagtgtctaaaatatgatgcacaagacaaagccctatatacccttgtaaataaggttcaatatggaatttttccagataactttacattcaatttactgatggattctttcataaagaaagaaaattacaaagatgctttatctgtggtttttgaggtcatgatgcaagaagcctttgaagtgccttccacccaacttctctccctctatgttttatttcattgcctggcaaagaagacagacttcagttgggaagaggagaggaactttggtgcatcccttttgcttccaggcctaaaacaaaagaactcagtgggtttcagttcccagttgtatggctatgcacttcttgggaaggtggagttgcagcaagggctacgggctgtgtaccacaacatgcctctgatatggaaaccaggctaccttgacagagcccttcaagtgatggagaaagtggctgcctccccagaagacataaagctgtgtagagaagcgctcgatgtgctgggtgcagtgctgaaggctctgacttcagctgatggggcttcagaggagcagtcccaaaatgatgaagacaaccaggggtcagaaaaactggtggagcagttagacatcgaggaaacagagcagtccaagcttcctcaatacctggaacgatttaaggccttacattctaagcttcaagctctgggcaaaattgagtcagaaggtcttttaagtctgaccacccagcttgtcaaggaaaaactctccacctgtgaagcagaggacatcgccacctatgagcagaatctgcagcagtggcatctagaccttgtacagttgatccagagagaacagcaacagagggagcaagcgaagcaggagtaccaggctcagaaagcagcaaaggcatctgcctaatagggtcccccagggccccacctgtctcacaagaacttcactcaaccccgtgccaggactcagcagtggcctggacaacagcctcagcttcctctacccatcttcttttcttaaagcaggctatgtgccctacatggcaaggcaccatgactgcccatcgagatgccaagaagggctatggaactatgcaggtggctagtggtcagactgaagtcaccagctgaataccttaaggaggactcttgaggctcataatggagttcctggggcacagggattagttatgagcattaaagttcctaagacccagtgacagtactgggagaaaccaaggctgaagagtcaggttgaagcacaggcttttgttttttgttgtttttgttttttgagacagagtctcattctgtcacccaggctggagtgcagtggcgcaatcttggctcactgcaacctccgactcccaggttcaagcaattctcctgcctcggcctcctttagtaggtgggattacaggtgcataccaccacacctttctaatttttgcatttttagtagagatggggtttcaccatgttggtcaggctggtctcaacctcctgacctcaagtgatctgcccgcctcagcctcccaaagtgctgggatgataggcgtgagccaccacacccggccaagcacaggcttttgaatggtctccctctccccagcccaggtacatgaggccaaggtgaactgtgcatcctgagaccttgtgtccctgagtctcctttctgagtgcaagctgcactgtgagctggctgtgggatactcacacattcccacattctcctttctgccacatctcgcccttctggacctgcactgggagaaattcaggacaggagtgaactcaaggccatgaactcactggatttccatttttaggcacccatagggatgtttttaggatgtaagtttctgaggagaaagctagctctagcatgaagcttttttggattggcttctccatcgtgttggggtaacattttttttccaattttttttttcccaaaacatcgtctcagctcatttatcaagtaggtaaaatgagccttttgtgtacacacagaggcacatgtgcatgcacacacaacttgtgaacacacatttctgttaaagaagttagaaaatgagagatgggttggggcttgaagtgcatcagaggtatgaatgttgtaaaactgtcaggagatgtaaaattcctttctgaagtgtctcttctgtgaaagggttcagagcagattttgcttactatgtagtgttgcccttaagtacagtggtgtaattttattcaagattgtgctcttctatcaaaagcctctggaaataaatgttccgggatca

SEQ ID NO: 154646 - DNA, 504 bp, Homo sapiens
  Payload ID: 10397
  Gene Symbol: MRPS27
  Gene Name: mitochondrial ribosomal protein S27
  ENST ID: ENST00000522095
  CDS Start-End: 8-292
ctccaagatggctgcctccatagtgcggcgcgggatgctcctggcgcggcaagtggttcttcctcagctctctcctgcaggtaaaagatacctgctttcttcagcctatgtagacagccacaaatgggaagcaagagaaaaagaacattactgtcttgctgatcttgcatctttaatggataaaacatttgagagaaagttgcctgttagttctttaacaatatcacggcttatagacaacatttcctctcgggaagagatagatcatgcagagtattacctttacaagtaagttttccatttgatttggctatgtactctgtgatttcacaccccttttttacataaaagttggtatatgttgtgtataattttgacaccttctaagtttatattttaaagatcttttcatatgagtatagagagagtttctgattttttataactgcattttattccatactgtgagtttattatttaaaccagttccctttttatggacct

SEQ ID NO: 154647 - DNA, 850 bp, Homo sapiens
  Payload ID: 10398
  Gene Symbol: MRPS28
  Gene Name: mitochondrial ribosomal protein S28
  Uniprot ID: Q9Y2Q9
  ENST ID: ENST00000276585
  CDS Start-End: 24-587
caaaggtcagaggtaaagaagtcatggcggcgctgtgtcggacccgtgctgtggctgccgagagccattttctgcgagtgtttctcttcttcaggccctttcggggtgtaggcactgagagtggatccgaaagtggtagttccaatgccaaggagcctaagacgcgcgcaggcggtttcgcgagcgcgttggagcggcactcggagcttctacagaaggtggagcccctacagaagggttctccaaaaaatgtggaatcctttgcatctatgctgagacattctcctcttacacagatgggacctgcaaaggataaactggtcattggacggatctttcatattgtggagaatgatctgtacatagattttggtggaaagtttcattgtgtatgtagaagaccagaagtggatggagagaaataccagaaaggaaccagggtccggttgcggctattagatcttgaacttacgtctaggttcctgggagcaacaacagatacaactgtactagaggctaatgcagttctcttgggaatccaggagagtaaagactcaagatcgaaagaagaacatcatgaaaaataaatgaactttgcttagtggattgactcctttgctgaagtcagttattcatcaagaatgcaattagactaattgtgaataaatgattgaatgaagatataataaataaaagctataattatagataactcttattagaattttctttagcaatattcccaccccccaccccttgttttgctcttaatgtttttttcctttggtggggatagtatacactgtactaagaaattgtcattcaataaatacgttttgagtgctgtcta

SEQ ID NO: 154648 - DNA, 487 bp, Homo sapiens
  Payload ID: 10398
  Gene Symbol: MRPS28
  Gene Name: mitochondrial ribosomal protein S28
  ENST ID: ENST00000518271
  CDS Start-End: 1-487
ggacccgtgctgtggctgccgagagccattttctgcgagtgtttctcttcttcaggccctttcggggtgtaggcactgagagtggatccgaaagtggtagttccaatgccaaggagcctaagacgcgcgcaggcggtttcgcgagcgcgttggagcggcactcggagcttctacagaagagatggggttttgccatgttgcccaggctggtcttgaactcctgggttcaagtgatcctcctgcgttggcctcccaaagtgctgggattacagatgacagatggttctccaaaaaatgtggaatcctttgcatctatgctgagacattctcctcttacacagatgggacctgcaaaggataaactggtcattggacggatctttcatattgtggagaatgatctgtacatagattttggtggaaagtttcattgtgtatgtagaagaccagaagtggatggagagaaataccagaaaggaaccagggt

SEQ ID NO: 154649 - DNA, 437 bp, Homo sapiens
  Payload ID: 10398
  Gene Symbol: MRPS28
  Gene Name: mitochondrial ribosomal protein S28
  ENST ID: ENST00000521605
  CDS Start-End: 42-302
cgcttgcggaggggaggtcaaaggtcagaggtaaagaagtcatggcggcgctgtgtcggacccgtgctgtggctgccgagagccattttctgcgagtgtttctcttcttcaggccctttcggggtgtaggcactgagagtggatccgaaagtggtagttccaatgccaaggagcctaagacgcgcgcaggcggtttcgcgagcgcgttggagcggcactcggagcttctacagaaggtggagcccctacagaaggaaataccagaaaggaaccagggtccggttgcggctattagatcttgaacttacgtctaggttcctgggagcaacaacagatacaactgtactagaggctaatgcagttctcttgggaatccaggagagtaaagactcaagatcgaaagaagaacatcatgaaaaataaatgaactttgctta

SEQ ID NO: 154650 - DNA, 555 bp, Homo sapiens
  Payload ID: 10398
  Gene Symbol: MRPS28
  Gene Name: mitochondrial ribosomal protein S28
  ENST ID: ENST00000519386
  CDS Start-End: 1-430
cttttgtgtggcatttgcgtactgggccgggtctgtccacactgcgcttgttttcctgggattgaatgctggtgggaagggttctccaaaaaatgtggaatcctttgcatctatgctgagacattctcctcttacacagatgggacctgcaaaggataaactggtcattggacggatctttcatattgtggagaatgatctgtacatagattttggtggaaagtttcattgtgtatgtagaagaccagaagtggatggagagaaataccagaaaggaaccagggtccggttgcggctattagatcttgaacttacgtctaggttcctgggagcaacaacagatacaactgtactagaggctaatgcagttctcttgggaatccaggagagtaaagactcaagatcgaaagaagaacatcatgaaaaataaatgaactttgcttagtggattgactcctttgctgaagtcagttattcatcaagaatgcaattagactaattgtgaataaatgattgaatgaagatataataaataaaagctataattatagataa

SEQ ID NO: 154651 - DNA, 403 bp, Homo sapiens
  Payload ID: 10398
  Gene Symbol: MRPS28
  Gene Name: mitochondrial ribosomal protein S28
  ENST ID: ENST00000519120
  CDS Start-End: 94-403
gggcggagcctggcttaggaaggggagctgaggtccggggcccagttttccggagttgcgggttctccaaaaaatgtggaatcctttgcatctatgctgagacattctcctcttacacagatgggacctgcaaaggataaactggtcattggacggatctttcatattgtggagaatgatctgtacatagattttggtggaaagtttcattgtgtatgtagaagaccagaagtggatggagagaaataccagaaaggaaccagggtccggttgcggctattagatcttgaacttacgtctaggttcctgggagcaacaacagatacaactgtactagaggctaatgcagttctcttgggaatccaggagagtaaagactcaagatcgaaagaagaacatcatg

SEQ ID NO: 154652 - DNA, 585 bp, Homo sapiens
  Payload ID: 10398
  Gene Symbol: MRPS28
  Gene Name: mitochondrial ribosomal protein S28
  ENST ID: ENST00000521434
  CDS Start-End: 168-545
gagttgcggtgcgttgtggctcagccctcggcccctagaatctgtgcttggtgtttttcttcctttcgttgtccttttgtgtggcatttgcgtactgggccgggtctgtccacactgcgcttgttttcctgggattgaatgctggtgggaagagatggggttttgccatgttgcccaggctggtcttgaactcctgggttcaagtgatcctcctgcgttggcctcccaaagtgctgggattacagatgacagatatgggacctgcaaaggataaactggtcattggacggatctttcatattgtggagaatgatctgtacatagattttggtggaaagtttcattgtgtatgtagaagaccagaagtggatggagagaaataccagaaaggaaccagggtccggttgcggctattagatcttgaacttacgtctaggttcctgggagcaacaacagatacaactgtactagaggctaatgcagttctcttgggaatccaggagagtaaagactcaagatcgaaagaagaacatcatgaaaaataaatgaactttgcttagtggattgactcctttgctgaagtca

SEQ ID NO: 154653 - DNA, 411 bp, Homo sapiens
  Payload ID: 10398
  Gene Symbol: MRPS28
  Gene Name: mitochondrial ribosomal protein S28
  ENST ID: ENST00000520946
  CDS Start-End: 86-411
tcgggaataggggcggagcctggcttaggaaggggagctgaggtccggggcccagttttccggagttgcgagatggggttttgccatgttgcccaggctggtcttgaactcctgggttcaagtgatcctcctgcgttggcctcccaaagtgctgggattacagatgacagatatgggacctgcaaaggataaactggtcattggacggatctttcatattgtggagaatgatctgtacatagattttggtggaaagtttcattgtgtatgtagaagaccagaagtggatggagagaaataccagaaaggaaccagggtccggttgcggctattagatcttgaacttacgtctaggttcctgggagcaacaacagatacaactgtactagaggctaatgcagttctcttggg

SEQ ID NO: 154654 - DNA, 783 bp, Homo sapiens
  Payload ID: 10398
  Gene Symbol: MRPS28
  Gene Name: mitochondrial ribosomal protein S28
  ENST ID: ENST00000518371
  CDS Start-End: 1-250
tatgctgagacattctcctcttacacagatgggacctgcaaaggataaactggtcattggacggatctttcatattgtggagaatgatctgtacatagattttggtggaaagtttcattgtgtatgtagaagaccagaagtggatggagagagtcccatttcgtggtatgctgtttggaggagattttcacaagtgatgataacctgtttttcttccaactctgactttggaaaacatcgtaaaagataaagaagttgtaatacaacatggatgaaccctgaaaacattatgccaaatgaaagaagccattcacaaaagatcatatattgtatgattccatttatatgaaatgttcagaatagacaaatccacagagacagaaagtagattagtcatccccagagtctagaataggggagggggagagattgctaatgagtacagggtttcttttttggggtgatgaaaatgttctaaaattaggttatggtaaaagctgtacagctctgagaatatattcaaagtcactgaattatacactttgggtagattttatgatatgtgaattatatctcaataaagctgttaaagttttagtataccactttagaatagtaaatatgttacatgtggactaaatcattagcctagcttcattttaatagaatgtaatatccacactgtaatatgtgaatctatacagctctaaaagatgactgtttaagacatttgtgtcttcttcaaccacatgatcagcagagttaaaaatgcacttgttcagc

SEQ ID NO: 154655 - DNA, 1678 bp, Homo sapiens
  Payload ID: 10399
  Gene Symbol: MRPS30
  Gene Name: mitochondrial ribosomal protein S30
  Uniprot ID: Q9NP92
  ENST ID: ENST00000507110
  CDS Start-End: 39-1358
gcttaagttgacctctgggtccggaatcgcgggcaaagatggcggcggccaggtgttggaggcctttgctacgcggtccgaggctttcattgcacaccgcggctaatgccgccgccacggctacagaaacgacctgccaagacgtcgcggcgacccccgtcgcgcggtacccgccgattgtggcctccatgacagccgacagcaaagctgcacggctgcggcggatcgagcgctggcaggcgacggtgcacgctgcggagtcggtagacgagaagctgcgaatcctcaccaagatgcagtttatgaagtacatggtttacccgcagaccttcgcgctgaatgccgaccgctggtaccagtacttcaccaagaccgtgttcctgtcgggtctgccgccgcccccagcggagcccgagcccgagcccgaacccgaacctgaacctgcgctggacctcgcggcgctgcgtgcggtcgcctgcgactgcctgctgcaggagcacttctacctgcggcgcaggcggcgcgtgcaccgttacgaggagagcgaggtcatatctttgcccttcctggatcagctggtgtcaaccctcgtgggcctcctcagcccacacaacccggccctggccgctgccgccctcgattatagatgcccagttcatttttactgggtgcgtggtgaagaaattattcctcgtggtcatcgaagaggtcgaattgatgacttgcgataccagatagatgataaaccaaacaaccagattcgaatatccaagcaactcgcagagtttgtgccattggattattctgttcctatagaaatccccactataaaatgtaaaccagacaaacttccattattcaaacggcagtatgaaaaccacatatttgttggctcaaaaactgcagatccttgctgttacggtcacacccagtttcatctgttacctgacaaattaagaagggaaaggcttttgagacaaaactgtgctgatcagatagaagttgtttttagagctaatgctattgcaagcctttttgcttggactggagcacaagctatgtatcaaggattctggagtgaagcagatgttactcgaccttttgtctcccaggctgtgatcacagatggaaaatacttttcctttttctgctaccagctaaatactttggcactgactacacaagctgatcaaaataaccctcgtaaaaatatatgttggggtacacaaagtaagcctctttatgaaacaattgaggataatgatgtgaaaggttttaatgatgatgttctacttcagatagttcactttctactgaatagaccaaaagaagaaaaatcacagctgttggaaaactgaaaaagcatatttgattgagaactgtgggaatatttaaattttactgaaggaacaataatgatgagatttgtaactgtcaactattaaatacattgatttttgagacaaatatttcttatgtcaacctgttattagatctcttactctgctcaaattcatcactgaaagatttaattttagttaccttttgttgatttaaaaataattgcatttgtatattgctaactgataagacaaattgagttattgagctattaaatgcacattttaatataaatgcagaaatcccaaataaaatgctaacatactgaattcagtaa

SEQ ID NO: 154656 - DNA, 1156 bp, Homo sapiens
  Payload ID: 10399
  Gene Symbol: MRPS30
  Gene Name: mitochondrial ribosomal protein S30
  ENST ID: ENST00000622078
  CDS Start-End: 39-1052
tatgaagtacatggtttacccgcagaccttcgcgctgaatgccgaccgctggtaccagtacttcaccaagaccgtgttcctgtcgggtctgccgccgcccccagcggagcccgagcccgagcccgaacccgaacctgaacctgcgctggacctcgcggcgctgcgtgcggtcgcctgcgactgcctgctgcaggagcacttacctgcggcgcggcggcgcgtgcaccgttacgaggagagcgaggtcatatctttgcccttcctggatcagctggtgtcaaccctcgtgggcctcctcagcccacacaacccggccctggccggccgccctcgattatagatgcccagttcatttttactgggtgcgtggtgaagaaattattcctcgtggtcatcgaagaggtcgaattgatgacttgcgataccagatagatgataaaccaaacaaccagattcgaatatccaagcaactcgcagagtttgtgccattggattattctgttcctatagaaatccccactataaaatgtaaaccagacaaacttccattattcaaacggcagtatgaaaaccacatatttgttggctcaaaaactgcagatccttgctgttacggtcacacccagtttcatctgttacctgacaaattaagaagggaaaggcttttgagacaaaactgtgctgatcagatagaagttgtttttagagctaatgctattgcaagcctttttgcttggactggagcacaagctatgtatcaaggattctggagtgaagcagatgttactcgaccttttgtctcccaggctgtgatcacagatggaaaatacttttcctttttctgctaccagctaaatactttggcactgactacacaagctgatcaaaataaccctcgtaaaaatatatgttggggtacacaaagtaagcctctttatgaaacaattgaggataatgatgtgaaaggttttaatgatgatgttctacttcagatagttcactttctactgaatagaccaaaagaagaaaaatcacagctgttggaaaactgaaaaagcatatttgattgagaactgtgggaatatttaaattttactgaaggaacaataatgatgagatttgtaactgtcaactattaaatacattgatttttgag

SEQ ID NO: 154657 - DNA, 1462 bp, Homo sapiens
  Payload ID: 10400
  Gene Symbol: MRPS31
  Gene Name: mitochondrial ribosomal protein S31
  Uniprot ID: Q92665
  ENST ID: ENST00000323563
  CDS Start-End: 38-1225
tttcagttgtgttcttggttcatttcgtgtctcggcgatgtttcctagagtctcgacgttcctacctcttcgccccctttcccgccaccctttgtcctctggaagcccggagacatcagcggctgcgattatgctactcactgttcggcacggaacagtcaggtaccgcagttcagcgctgttggcccggacaaaaaataacatccaaagatattttggcactaacagtgtgatctgtagcaagaaagataagcagtctgttcgaactgaggagacttccaaggagacttcagagagccaagacagtgaaaaggaaaatacgaaaaaagacttgttaggcattattaagggcatgaaagttgaattaagcacagtaaatgtacgaacaacaaagccccccaaaagaagaccacttaaaagtttggaagctacacttggcaggcttcgaagagctacagaatatgctccaaagaagagaattgagcccctgagtcctgagttggtggcagctgcatctgctgtggcagattctctcccttttgataagcaaacaaccaagtcagagctgctgagccagctccagcagcatgaggaagagtcaagggcacagagagatgcaaagcgacctaaaattagtttcagtaacataatatcagatatgaaagttgccagatctgctacagctagagttcgttcaagaccagagcttcggattcagtttgatgaaggctatgacaattatcctggccaggagaagacggatgatcttaaaaaaaggaaaaatatattcacagggaaaagacttaatatttttgacatgatggcagttactaaagaagcacctgaaacagacacatcaccttcactttgggatgtggaatttgctaagcagttagccacagtaaatgaacaaccccttcagaatggatttgaagagctgatccagtggacaaaagaggggaaactatgggagttcccaattaacaatgaagcaggttttgatgatgatggttcagaatttcatgaacatatatttctggagaaacacctggagagctttccaaaacaaggaccaattcgccacttcatggagctggtgacttgtggcctttccaaaaacccatatcttagtgttaaacagaaggttgaacacatagagtggtttagaaattattttaatgaaaaaaaggatattctaaaagaaagtaacatacagttcaattaagaccatggaaatttttatttcaaacaattagagatggatattacaactaaataaaataattttactagagtttgtatatgttatgttgattattacatttgatttggctggtataaatgttacattgttttcaaaaatatgatggtaactgaaaaatattcttgcatggagaaaaatcatcagtattcataggttcaaaagaatatctgggaattagtaatacatttaagacaacaa

SEQ ID NO: 154658 - DNA, 4241 bp, Homo sapiens
  Payload ID: 10401
  Gene Symbol: MRPS33
  Gene Name: mitochondrial ribosomal protein S33
  Uniprot ID: Q9Y291
  ENST ID: ENST00000324787
  CDS Start-End: 101-421
gcgcgagcttggagccgggtagagggcgggccttccgggacgagggcgcgtgggtgaggaaggtcaggtctaggaactctaactccttgccactcaagaaatgtcctccctttcagaatatgccttccgcatgtctcgtctcagtgcccggctatttggtgaagtcaccaggcctactaattccaagtctatgaaagtggtgaaactgtttagtgaactgcccttggccaagaagaaggagacttatgattggtatccaaatcaccacacttacgctgaactcatgcagacgctccgatttcttggactctacagagatgagcatcaggattttatggatgagcaaaaacgactaaagaagcttcgtggaaaggagaaaccaaagaaaggagaagggaaaagagcagcaaaaaggaaatagtgttggtccctcaagagggagactttcttcctcagtggcggagagaagaaagtgcatttattgtctttccacctattggaggaatgtcatcttcctaaatgaagtttatttggaggaacacagtcatctccttggtgaaatctaatccggttacattgtggctggtttcttgaacacattctaactgtgcaaaattatcttggccttggccgtgtaatgtgaggtttacctgattctctaatgaaataaatacctaagttattgtttgatgatttgtttggggtgggatgggatgctgggggaatggaggggaaacctcattaagtgagcatcctatagtgtcctcatttctcccttcttgcttactgactcacccagccctaaacttctttcatcttgggcctttcagccactgtctccaccaccaagctcacaaactttgtgtgtgtcttcacctactcctttgagaaatctattaagatgaatttgtagagtaagtatcttttaaaaggaagtattgaatacctgctctgtacaagatattggggccctggtaatacacgtggttagcaagagaaatactccctacctcatgtaagtttcagtcttgtgggagggactaatattacataattacatacaattgtattacatgctacaaaggaaaaagccagacttctataagagcatggatggatggatgaatgcagagagagatagccagaagcccaaatcacattagggagtttaaagaaagcttccctaaagaaatgatatttaagccaggcgctgttgctcacacctgtaatcccaccactttgggaggccgaggtgggtggatcacaaggtcaagagatcgagaccattttggccaacatggtgaaaccccacctactaaaaatgcaaaaattagctgggcgtcgtggcatgcacctgtagtctcagctactcgggatgctgaggcaggagaatcgcttgaacccgggaggcaaaggttgcagtgagttgagatcacgccactgcactccagcctggcaacagagcaagactacatctcaaaaaaaaaatgatatttaagctgaaccttgaagaataaataagaggttgccaaaaggaaaatggtgagaaaggggtttgaggcagagagtactatttgcaaagccctaaggtatgaagaaattgtctgttcaagaaacactgagtttgttcatggttggctgtaagaaaacagaggccagatcatgaagggctttggaaattctgtggaaaagcttgaacataactagaagttctatgagggatgactgttgtatagatttgagtagctcgctgctggttttattgtattccagcaatgagtttccaaagaaattgtgaaggcttggccgggcacagtggctcacgcctgtaatcccagcactttgggaggtcgaggcgggtggatcacgaggtcaggggatcgagaccatcctggctaacatggtgaaaccccgtctctactaaaaaatgcaaaaaagttagccgggcgtggtggtgggtgcctgtagtcccagctacttgggaggctgaggcaggagaatggcagggaggcggagcttgcagtaagctgagatggtgccactgcactccagcctgggcaacaaagcgagactctgtctcaaaaaaaaaattgtgaaggcttctctgatttttttttccaacagttgttctgaatctttagcatgtccagtaattttttaataactttttattattgtagtaaaaacataaaattaatgatcttaaccatatttaagtgtacaatagtgtcaatattcaaacatattattcaaaaaataatcaaaatataaaagcattttagtgcgatagtatttattggagtatgtatagcagctactccagccacagttttctttctctgtaacactcaatgattcctgaagtagaaagattcccagtacatatgtttaaatgaatgctatttttaaagatacctaatccagatggtatggctagggcctattttatagcctgtttaaaaaaataaaataaaataaaattgggtggtttgtatgtggtagaagtgaattccagcaaaaggagaattcattcatttagacctttttttttgtttgagacggagtctcactctcaccagctggagtgcagtggcgcaatctcagctcactgcaagctccacctcccgggttcacgccattctcctgcctcagcctcccaagtagctgggactacaggcgcccaccaccacgcccggctaatattttgtatttttagtagagaaggtgtctcactgtgttagccaggatggtctcaacctcttgacctcctgatccacccacctcagactcccaaagtgctggaattacaggcatgagccaccacacccagcccatttagaactttttactgagcacctgccatgtgctcgacacgtgatagttgtagaggatacagagacaaatagacttagtccctaagactgtgtgaatgagcatgtgtgtattacaaagtattggcaagatctcagaaacgtgcttagaaaagtgcagatgcactgttattcttggccaatgcagctgagccaggtgtaggtggatgactaccccaggatgttgagctgagaaacaggatctcagcctgaacccaatgtagctcagcagatgtttgaattatgtgatctccagcttttgggaaagatctgaatgtaagaggaacttaagagaattagcatgatattttaaagagaataactgcattacattctaacagcagacctgagtcggaaaacaagtaaagaatcgatgtattggtttgccgatggaagagcttcagtgagatctcagaccctgaccctgcagtgagccttggcaatgattgacagggaagtttgtagataacgcagaagtagattagtgtgccactgctccaggctgaaaatcagaaatgaaagctaaaatacatttgtacataagctataccttcaattgatagagcaagctgtgtgactcaaaacagcctgtacagaagtacgatggaccagctggaaggtatcaatagaagataaggaaaagttaactcttgacaccagggaagtcaacaaatttcaggacaacagtgaccaatggttaagatggtgactaagtgtaatcagaaaaaaatctttaactccaagtttagactagccagtttgtttaattggatttctctggtcaaaacctaaactattggtgctttctaacctgtggggatcagtgtgcatagaccattttgccctcgatttcagcataacatagtaaaaagactgggttttagattcaaaagtcatgggtttgtgatacagtgtacttactgattatgtgacgtcagttacttctctgaacctctttccttctctataaaatcataatgcttcactggattaatgaaataagatatttgtgaaaagaactctgtaaattataaaaagttaaaaacttttacatatagcacattatgtgactagtaagtactgctgtgtcttactagcgcaattttctgtggcagcattgacacgtatctcctaaaaatataaagttccccacgtttacaagcagcatgataggttcaggaagaggaggtagatgagaggtaacatcttattatttatgtaattatgggctccataagtttattttttaagcaccatatatgtgtgtgtttcaaaataaacataaggcatcatatatttaaacatatataaccataatgcttgtatttataaatcattttccaagaaagaataaatcaaaatttgaaattc

SEQ ID NO: 154659 - DNA, 853 bp, Homo sapiens
  Payload ID: 10401
  Gene Symbol: MRPS33
  Gene Name: mitochondrial ribosomal protein S33
  Uniprot ID: Q9Y291
  ENST ID: ENST00000393008
  CDS Start-End: 157-477
gcaattactctcttccatattggttaacagtagaaggctcagtttctctgctcatcacacggccttcggcactgtagctttgggtggtgggctgcagattaattttgtaaccaccttaagaaaaatacggaactctaactccttgccactcaagaaatgtcctccctttcagaatatgccttccgcatgtctcgtctcagtgcccggctatttggtgaagtcaccaggcctactaattccaagtctatgaaagtggtgaaactgtttagtgaactgcccttggccaagaagaaggagacttatgattggtatccaaatcaccacacttacgctgaactcatgcagacgctccgatttcttggactctacagagatgagcatcaggattttatggatgagcaaaaacgactaaagaagcttcgtggaaaggagaaaccaaagaaaggagaagggaaaagagcagcaaaaaggaaatagtgttggtccctcaagagggagactttcttcctcagtggcggagagaagaaagtgcatttattgtctttccacctattggaggaatgtcatcttcctaaatgaagtttatttggaggaacacagtcatctccttggtgaaatctaatccggttacattgtggctggtttcttgaacacattctaactgtgcaaaattatcttggccttggccgtgtaatgtgaggtttacctgattctctaatgaaataaatacctaagttattgtttgatgatttgtttggggtgggatgggatgctgggggaatggaggggaaacctcattaagtgagcatcctatagtgtcctcatttctcccttcttgcttactgactcaccc

SEQ ID NO: 154660 - DNA, 744 bp, Homo sapiens
  Payload ID: 10401
  Gene Symbol: MRPS33
  Gene Name: mitochondrial ribosomal protein S33
  Uniprot ID: Q9Y291
  ENST ID: ENST00000469351
  CDS Start-End: 162-482
attcccaccaaaacatactaccgaaccgtgcatgcccttccaggagagccagacctttctaactctccccagcccaccacctccccgggtcctccgcacaggcggcggcgctagccttactgcgcaggcgccaggaactctaactccttgccactcaagaaatgtcctccctttcagaatatgccttccgcatgtctcgtctcagtgcccggctatttggtgaagtcaccaggcctactaattccaagtctatgaaagtggtgaaactgtttagtgaactgcccttggccaagaagaaggagacttatgattggtatccaaatcaccacacttacgctgaactcatgcagacgctccgatttcttggactctacagagatgagcatcaggattttatggatgagcaaaaacgactaaagaagcttcgtggaaaggagaaaccaaagaaaggagaagggaaaagagcagcaaaaaggaaatagtgttggtccctcaagagggagactttcttcctcagtggcggagagaagaaagtgcatttattgtctttccacctattggaggaatgtcatcttcctaaatgaagtttatttggaggaacacagtcatctccttggtgaaatctaatccggttacattgtggctggtttcttgaacacattctaactgtgcaaaattatcttggccttggccgtgtaatgtgaggtttacctgattctctaatgaaataaatacctaagttat

SEQ ID NO: 154661 - DNA, 688 bp, Homo sapiens
  Payload ID: 10401
  Gene Symbol: MRPS33
  Gene Name: mitochondrial ribosomal protein S33
  Uniprot ID: Q9Y291
  ENST ID: ENST00000496958
  CDS Start-End: 106-426
agattgttcttgatgaactgaatgcagctaatacattttcagtgccgttgatgcctctatgactccgtaaaataatcggaactctaactccttgccactcaagaaatgtcctccctttcagaatatgccttccgcatgtctcgtctcagtgcccggctatttggtgaagtcaccaggcctactaattccaagtctatgaaagtggtgaaactgtttagtgaactgcccttggccaagaagaaggagacttatgattggtatccaaatcaccacacttacgctgaactcatgcagacgctccgatttcttggactctacagagatgagcatcaggattttatggatgagcaaaaacgactaaagaagcttcgtggaaaggagaaaccaaagaaaggagaagggaaaagagcagcaaaaaggaaatagtgttggtccctcaagagggagactttcttcctcagtggcggagagaagaaagtgcatttattgtctttccacctattggaggaatgtcatcttcctaaatgaagtttatttggaggaacacagtcatctccttggtgaaatctaatccggttacattgtggctggtttcttgaacacattctaactgtgcaaaattatcttggccttggccgtgtaatgtgaggtttacctgattctctaatgaaataaatacctaagttat

SEQ ID NO: 154662 - DNA, 622 bp, Homo sapiens
  Payload ID: 10401
  Gene Symbol: MRPS33
  Gene Name: mitochondrial ribosomal protein S33
  ENST ID: ENST00000467334
  CDS Start-End: 71-361
ggtagagggcgggccttccgggacgagggcgcgtgggtgaggaaggtcaggtctagaatatgccttccgcatgtctcgtctcagtgcccggctatttggtgaagtcaccaggcctactaattccaagtctatgaaagtggtgaaactgtttagtgaactgcccttggccaagaagaaggagacttatgattggtatccaaatcaccacacttacgctgaactcatgcagacgctccgatttcttggactctacagagatgagcatcaggattttatggatgagcaaaaacgactaaagaagcttcgtggaaaggagaaaccaaagaaaggagaagggaaaagagcagcaaaaaggaaatagtgttggtccctcaagagggagactttcttcctcagtggcggagagaagaaagtgcatttattgtctttccacctattggaggaatgtcatcttcctaaatgaagtttatttggaggaacacagtcatctccttggtgaaatctaatccggttacattgtggctggtttcttgaacacattctaactgtgcaaaattatcttggccttggccgtgtaatgtgaggtttacctgattctctaatgaaataaatacctaagtta

SEQ ID NO: 154663 - DNA, 1040 bp, Homo sapiens
  Payload ID: 10402
  Gene Symbol: MRPS34
  Gene Name: mitochondrial ribosomal protein S34
  ENST ID: ENST00000177742
  CDS Start-End: 32-709
ccggccggaccgctgaggacgcggacccgccatggcgcggaagaaggtgcgtccgcggctgatcgcggagctggcccgccgcgtgcgcgccctgcgggagcaactgaacaggccgcgcgactcccagctctacgcggtggactacgagaccttgacgcggccgttctctggacgccggctgccggtccgggcctgggccgacgtgcgccgcgagagccgcctcttgcagctgctcggccgcctcccgctcttcggcctgggccgcctggtcacgcgcaagtcctggctgtggcagcacgacgagccgtgctactggcgcctcacgcgggtgcggcccgactacacggcgcagaacttggaccacgggaaggcctggggcatcctgaccttcaaagacgcctctttttcttcatcagggaagactgagagcgaggcgcgggagatcgaacacgtcatgtaccatgactggcggctggtgcccaagcacgaggaggaggccttcaccgcgttcacgccggcgccggaagacagcctggcctccgtgccgtacccgcctctcctccgggccatgattatcgcagaacgacagaaaaatggagacacaagcaccgaggagcccatgctgaatgtgcagaggatacgcatggaaccctgggattaccctgcaaaacaggaagacaaaggaagggccaagggcacccccgtctagaatgccagaaccagcgggtggccttaggggctgtgaggcagtggggaccttattgatgaaagaaaccgtctttgcgttacacccgagtctgcctctcggagcagggagctcaccttccgcgacgtgttctgagggtctgcatcttaggggggagggctggggcaaatcgccacctgtgcctttcctctggccctgctgcccccacacccaactccgagggcccacgctggggaaagcgggaagcgctcgctccctttcccccattagtgctctctctgcctggatcccggcagaagctatgaaagggaataaagagaaaagaagtacccag

SEQ ID NO: 154664 - DNA, 1024 bp, Homo sapiens
  Payload ID: 10402
  Gene Symbol: MRPS34
  Gene Name: mitochondrial ribosomal protein S34
  Uniprot ID: P82930
  ENST ID: ENST00000397375
  CDS Start-End: 37-693
gacttccggccggaccgctgaggacgcggacccgccatggcgcggaagaaggtgcgtccgcggctgatcgcggagctggcccgccgcgtgcgcgccctgcgggagcaactgaacaggccgcgcgactcccagctctacgcggtggactacgagaccttgacgcggccgttctctggacgccggctgccggtccgggcctgggccgacgtgcgccgcgagagccgcctcttgcagctgctcggccgcctcccgctcttcggcctgggccgcctggtcacgcgcaagtcctggctgtggcagcacgacgagccgtgctactggcgcctcacgcgggtgcggcccgactacacggcgcagaacttggaccacgggaaggcctggggcatcctgaccttcaaagggaagactgagagcgaggcgcgggagatcgaacacgtcatgtaccatgactggcggctggtgcccaagcacgaggaggaggccttcaccgcgttcacgccggcgccggaagacagcctggcctccgtgccgtacccgcctctcctccgggccatgattatcgcagaacgacagaaaaatggagacacaagcaccgaggagcccatgctgaatgtgcagaggatacgcatggaaccctgggattaccctgcaaaacaggaagacaaaggaagggccaagggcacccccgtctagaatgccagaaccagcgggtggccttaggggctgtgaggcagtggggaccttattgatgaaagaaaccgtctttgcgttacacccgagtctgcctctcggagcagggagctcaccttccgcgacgtgttctgagggtctgcatcttaggggggagggctggggcaaatcgccacctgtgcctttcctctggccctgctgcccccacacccaactccgagggcccacgctggggaaagcgggaagcgctcgctccctttcccccattagtgctctctctgcctggatcccggcagaagctatgaaagggaataaagagaaaagaagtacccag

SEQ ID NO: 154665 - DNA, 543 bp, Homo sapiens
  Payload ID: 10402
  Gene Symbol: MRPS34
  Gene Name: mitochondrial ribosomal protein S34
  ENST ID: ENST00000613089
  CDS Start-End: 1-531
atggcgcggaagaaggtgcgtccgcggctgatcgcggagctggcccgccgcgtgcgcgccctgcgggagcaactgaacaggccgcgcgactcccagctctacgcggtggactacgagaccttgacgcggccgttctctggacgccggctgccggtccgggcctgggccgacgtgcgccgcgagagccgcctcttgcagctgctcggccgcctcccgctcttcggcctgggccgcctggtcacgcgcaagtcctggctgtggcagcacgacgagccgtgctactggcgcctcacgcgggtgcggcccgactacacggcgcagaacttggaccacgggaaggcctggggcatcctgaccttcaaagacgcctctttttcttcatcagggaagactgagagcgaggcgcgggagatcgaacacgtcatgtaccatgactggcggctggtgcccaagcacgaggaggaggccttcaccgcgtcacgccgggccggaagacagctggcctcctgccgtcccgcctctgggccatgattatcgcagaac

SEQ ID NO: 154666 - DNA, 1888 bp, Homo sapiens
  Payload ID: 10403
  Gene Symbol: MRPS35
  Gene Name: mitochondrial ribosomal protein S35
  Uniprot ID: P82673
  ENST ID: ENST00000081029
  CDS Start-End: 72-1043
gcttagcggccccaggcccgcccctgacactgaacgccgcttgtcccctccggcttgccgtcctcgcagccatggcggccgccgcgctcccagcatggctgtctctgcagtcgagggcaaggactctgcgtgcattctccactgccgtctactcggccactccggtcccgacacctagcctgccggaaagaacacccggaaatgaaaggccaccaagaagaaaggcactacctcctaggacagagaaaatggctgttgaccaggactggcctagtgtttacccagttgcagcaccatttaaaccctctgcagtacctcttcctgttcgaatgggttatccagtaaaaaagggcgtgcccatggcaaaggagggaaatctagaacttttaaagattcccaattttctgcatttgactcctgtagcaattaaaaagcactgtgaagcccttaaagatttttgcactgagtggccagccgcactggacagtgacgagaaatgtgagaagcattttccaattgaaattgacagcactgattatgtttcatcaggaccatctgttcggaaccccagagcacgagtagtagtcttaagagtaaagctttccagtttgaatttagatgatcacgcaaagaagaaattaattaaacttgtaggagagcgatactgcaagaccacagatgtgcttaccatcaaaacagataggtgccctttaaggaggcagaattacgattatgcagtgtatctactaacagtgttataccatgagtcttggaatactgaagaatgggaaaaaagtaagactgaagcagacatggaagagtatatatgggaaaatagctcatcagaaagaaatatcctggaaacgcttctccagatgaaagctgctgagaaaaatatggaaataaataaagaagagctccttggtactaaagaaattgaagagtacaaaaagtctgttgttagtcttaaaaatgaggaggaaaatgaaaattccatttctcagtacaaagaatccgtgaagagactattaaatgtgacatgaattatggagtagaaaaatctgcttgatttattaattttatgatatatgtgatcagtatctaatttgatataaaattgaaaatgttaaaaaatcattttttttcctcagagttaaaattatttccctcatactaatgcttaatggcaatgattactccagagttttttaatttttacactggggcaatagactaggaggtctctgatttcttcttggtctaaagtgttttgattttatttctacataatagctttggtattcatgtatatacatgcatttaattgtgattttatcacctttcccatttctttccccacaagctggcatttcagtagttgcttttgaataatggttttggttacctgggaaggcaggcccagaacccatttccttgacttgcagttccgggctgtgttcacatgactgctgtctagctgatgcatttttcacatttgtcaactctggttagaaacaggtcctcaggagtattctctaacctgatattttctaaaaagatatgttgattcaactttgtttagcatcctactttctagattgtggggctcattttgccagggccaagctaccagaaaagtagaagtggagattacctggtatgtatctctctgggtgccccagttagagctgccacagctcaggaaaaagatgaggcataacgaccttgaatgtaattggagtaagtgacaaaataagaactaccctgggaaaccctgcattcaatgtagctgtcaattcagtatttttaagtacacctgtcagctgtttcttaccacttcgatggttgtgattaatttaaaatcaaaataaaggaattactgagttta

SEQ ID NO: 154667 - DNA, 557 bp, Homo sapiens
  Payload ID: 10403
  Gene Symbol: MRPS35
  Gene Name: mitochondrial ribosomal protein S35
  ENST ID: ENST00000536569
  CDS Start-End: 23-148
ccggcttgccgtcctcgcagccatggcggccgccgcgctcccagcatggctgtctctgcagtcgagggcaaggactctgcgtgcattctccactgccgtctactcggccactccggtcccgacacctagcctgcgcactacctcctaggacagagaaaatggctgttgaccaggactggcctagtgtttacccagttgcagcaccatttaaaccctctgcagtacctcttcctgttcgaatgggttatccagtaaaaaagggcgtgcccatggcaaaggagggaaatctagaacttttaaagattcccaattttctgcatttgactcctgtagcaattaaaaagcactgtgaagcccttaaagatttttgcactgagtggccagccgcactggacagtgacgagaaatgtgagaagcattttccaattgaaattgacagcactgattatgtttcatcaggaccatctgttcggaaccccagagcacgagtagtagtcttaagagtaaagctttccagtttgaatttagatgatcacgcaaagaagaaattaattaaa

SEQ ID NO: 154668 - DNA, 466 bp, Homo sapiens
  Payload ID: 10403
  Gene Symbol: MRPS35
  Gene Name: mitochondrial ribosomal protein S35
  ENST ID: ENST00000542791
  CDS Start-End: 1-117
gcggccgccgcgctcccagcatggctgtctctgcagtcgagggcaaggactctgcgtgcattctccactgccgtctactcggccactccggtcccgacacctagcctgcaatactgaagaatgggaaaaaagtaagactgaagcagacatggaagagtatatatgggaaaatagctcatcagaaagaaatatcctggaaacgcttctccagatgaaagctgctgagaaaaatatggaaataaataaagaagagctccttggtactaaagaaattgaagagtacaaaaagtctgttgttagtcttaaaaatgaggaggaaaatgaaaattccatttctcagtacaaagaatccgtgaagagactattaaatgtgacatgaattatggagtagaaaaatctgcttgatttattaattttatgatatatgtgatcagtatctaatttgatataaaattgaaaatgttaa

SEQ ID NO: 154669 - DNA, 750 bp, Homo sapiens
  Payload ID: 10403
  Gene Symbol: MRPS35
  Gene Name: mitochondrial ribosomal protein S35
  ENST ID: ENST00000542199
  CDS Start-End: 1-488
gggcaaggactctgcgtgcattctccactgccgtctactcggccactccggtcccgacacctagcctgccggaaagaacacccggaaatgaaaggccaccaagaagaaaggcactacctcctaggacagagaaaatggctgttgaccaggactggcctagtgtttacccagttgcagcaccatttaaaccctctgcagtacctcttcctgttcgaatgggttatccagtaaaaaagggcgtgcccatggcaaaggagggaaatctagaacttttaaagattcccaattttctgcatttgactcctgtagcaattaaaaagcactgtgaagcccttaaagatttttgcactgagtggccagccgcactggacagtgacgagaaatgtgagaagcattttccaattgaaattgacagcactgattatgtttcatcaggaccatctgttcggaaccccagagcacgagtagtagtcttaagagaaatgtaaaaaaatataatcccagcagaatgtgagaaggcctgctttcctgtgctctcaccaacctacatattacctgtcaacttgataggtaaagctttccagtttgaatttagatgatcacgcaaagaagaaattaattaaacttgtaggagagcgatactgcaagaccacagatgtgcttaccatcaaaacagataggtgccctttaaggaggcagaattacgattatgcagtgtatctactaacagtgttataccatgagtcttgg

SEQ ID NO: 154670 - DNA, 1715 bp, Homo sapiens
  Payload ID: 10403
  Gene Symbol: MRPS35
  Gene Name: mitochondrial ribosomal protein S35
  Uniprot ID: P82673
  ENST ID: ENST00000538315
  CDS Start-End: 10-594
ctcgcagccatggcggccgccgcgctcccagcatggctgtctctgcagtcgagggcaaggactctgcgtgcattctccactgccgtctactcggccactccggtcccgacacctagcctgccggaaagaacacccggaaatgaaaggccaccaagaagaaaggcactacctcctaggacagagaaaatggctgttgaccaggactggcctagtgtttacccagttgcagcaccatttaaaccctctgcagtacctcttcctgttcgaatgggttatccagtaaaaaagggcgtgcccatggcaaaggagggaaatctagaacttttaaagattcccaattttctgcatttgactcctgtagcaattaaaaagcactgtgaagcccttaaagatttttgcactgagtggccagccgcactggacagtgacgagaaatgtgagaagcattttccaattgaaattgacagcactgattatgtttcatcaggaccatctgttcggaaccccagagcacgagtagtagtcttaagagtgccctttaaggaggcagaattacgattatgcagtgtatctactaacagtgttataccatgagtcttggaatactgaagaatgggaaaaaagtaagactgaagcagacatggaagagtatatatgggaaaatagctcatcagaaagaaatatcctggaaacgcttctccagatgaaagctgctgagaaaaatatggaaataaataaagaagagctccttggtactaaagaaattgaagagtacaaaaagtctgttgttagtcttaaaaatgaggaggaaaatgaaaattccatttctcagtacaaagaatccgtgaagagactattaaatgtgacatgaattatggagtagaaaaatctgcttgatttattaattttatgatatatgtgatcagtatctaatttgatataaaattgaaaatgttaaaaaatcattttttttcctcagagttaaaattatttccctcatactaatgcttaatggcaatgattactccagagttttttaatttttacactggggcaatagactaggaggtctctgatttcttcttggtctaaagtgttttgattttatttctacataatagctttggtattcatgtatatacatgcatttaattgtgattttatcacctttcccatttctttccccacaagctggcatttcagtagttgcttttgaataatggttttggttacctgggaaggcaggcccagaacccatttccttgacttgcagttccgggctgtgttcacatgactgctgtctagctgatgcatttttcacatttgtcaactctggttagaaacaggtcctcaggagtattctctaacctgatattttctaaaaagatatgttgattcaactttgtttagcatcctactttctagattgtggggctcattttgccagggccaagctaccagaaaagtagaagtggagattacctggtatgtatctctctgggtgccccagttagagctgccacagctcaggaaaaagatgaggcataacgaccttgaatgtaattggagtaagtgacaaaataagaactaccctgggaaaccctgcattcaatgtagctgtcaattcagtatttttaagtacacctgtcagctgtttcttaccacttcgatggttgtgattaatttaaaatcaaaataaaggaattactgagttt

SEQ ID NO: 154671 - DNA, 1286 bp, Homo sapiens
  Payload ID: 10404
  Gene Symbol: MRPS36
  Gene Name: mitochondrial ribosomal protein S36
  Uniprot ID: P82909
  ENST ID: ENST00000256441
  CDS Start-End: 71-382
acagctgcccgggactccagtgatcgccgcggctcgctcgcgccccggaaactgccccttctcgggggtcatgatgggcagcaagatggcgtctgctagtagggtcgttcaggtagtcaaaccacacactccattaataaggtttcctgacagaagagacaatcctaaacccaatgtatcagaagctttgagatcagcagggctaccatctcactcttctgtaatttcacaacattctaaaggaagtaaatcaccagatttgctgatgtatcagggtccaccagacactgcagaaataataaaaacattacctcagaaatacagaaggaaacttgtgtctcaagaagaaatggaatttatccaacgtggaggtcctgaataaccatggtggctgctgtttgtcatcagacaatagaattgtctttacaataaaggacttccaaaatgacagatgagaaactgtatattaaacacctttaataaatattatgaaaaaaatgaaatatagaaaatttagatggacacttgtatttcctaatttatgtatcttggtcagcttctccacaagcttacctaattgtttatatactttatacttattaaagtatacatttttaaatgttagcctattaatttactcttgattatcaaacattaccagtgttgaactattaaaagcacacaatgtgtagtaaactatcataggattcccataatttcactttactttctgtttaggcatggaaaaatttatcagtcagaattgctgttttagggacatgattttcctgaaattgggtgaggatcagtgaaataattactctattacttgttcttaattctctgttctctaatgttttttcattcacaagtttactggagtataactggcttagtaagtatatcctactctgaatgataaaaatatagtcaagctaaaataggtgactatactattaagatagagatcatacaaaagattccaaagaaagtcaaaaagtgtaaaatggaaaataagagatcaaaatgaatatagcataggaataaagatttcactagaaattgcaatttattatgttttggaggttgtaaggaagtcttgttttttggtttattttactgttttgtgatcttgtatgcaaatcctgataaccattaaccttctcaaacttaatgtctgagagcctcataaaatcaacatatttacttattaagcagtttatgaaactttaatggggcccctcctgtgccaagggtacgtatattgtgaagtaaagcctcacaaa

SEQ ID NO: 154672 - DNA, 1200 bp, Homo sapiens
  Payload ID: 10404
  Gene Symbol: MRPS36
  Gene Name: mitochondrial ribosomal protein S36
  ENST ID: ENST00000512880
  CDS Start-End: 434-550
gatgggcagcaagatggcgtctgctagtagggtcgttcaggtaaagcaatttgtcgcgtttccgcatcttgggcggtagggacggtgctgactatggcgacggcgtcggggagtaaaggcggtggcagaggcagagcggtgaccgcgcctctgcggagggccagtgacggcgcccgcgggtgtgtgtgaggatgggactttgagcctgttggaccgggcagtgaggtgggtccggcgccgagggttcgagccttgcggcaaccgtgcagcatcttggcaggtagtcaaaccacacactccattaataaggtttcctgacagaagagacaatcctaaacccaatgtatcagaagctttgagatcagcagggctaccatctcactcttctgtaatttcacaacattctaaaggaagtaaatcaccagatttgctgatgtatcagggtccaccagacactgcagaaataataaaaacattacctcagaaatacagaaggaaacttgtgtctcaagaagaaatggaatttatccaacgtggaggtcctgaataaccatggtggctgctgtttgtcatcagacaatagaattgtctttacaataaaggacttccaaaatgacagatgagaaactgtatattaaacacctttaataaatattatgaaaaaaatgaaatatagaaaatttagatggacacttgtatttcctaatttatgtatcttggtcagcttctccacaagcttacctaattgtttatatactttatacttattaaagtatacatttttaaatgttagcctattaatttactcttgattatcaaacattaccagtgttgaactattaaaagcacacaatgtgtagtaaactatcataggattcccataatttcactttactttctgtttaggcatggaaaaatttatcagtcagaattgctgttttagggacatgattttcctgaaattgggtgaggatcagtgaaataattactctattacttgttcttaattctctgttctctaatgttttttcattcacaagtttactggagtataactggcttagtaagtatatcctactctgaatgataaaaatatagtcaagctaaaataggtgactatactattaagatagagatcatacaaaagattccaaagaaagtcaaaaagtgtaaaatggaaaataagagatcaaaatgaat

SEQ ID NO: 154673 - DNA, 1200 bp, Homo sapiens; identical to SEQ ID NO: 154672
  Payload ID: 10404
  Gene Symbol: MRPS36
  Gene Name: mitochondrial ribosomal protein S36
  ENST ID: ENST00000602380
  CDS Start-End: 434-550

SEQ ID NO: 154674 - DNA, 1286 bp, Homo sapiens
  Payload ID: 10404
  Gene Symbol: MRPS36
  Gene Name: mitochondrial ribosomal protein S36
  Uniprot ID: P82909
  ENST ID: ENST00000613100
  CDS Start-End: 71-382
acagctgcccgggactccagtgatcgccgcggctcgctcgcgccccggaaactgccccttctcgggggtcatgatgggcagcaagatggcgtctgctagtagggtcgttcaggtagtcaaaccacacactccattaataaggtttcctgacagaagagacaatcctaaacccaatgtatcagaagctttgagatcagcagggctaccatctcactcttctgtaatttcacaacattctaaaggaagtaaatcaccagatttgctgatgtatcagggtccaccggacactgcagaaataataaaaacattacctcagaaatacagaaggaaacttgtgtctcaagaagaaatggaatttatccaacgtggaggtcctgaataaccatggtggctgctgtttgtcatcagacaatagaattgtctttacaataaaggacttccaaaatgacagatgagaaactgtatattaaacacctttaataaatattatgaaaaaaatgaaatatagaaaatttagatggacacttgtatttcctaatttatgtatcttggtcagcttctccacaagcttacctaattgtttatatactttatacttattaaagtatacatttttaaatgttagcctattaatttactcttgattatcaaacattaccagtgttgaactattaaaagcacacaatgtgtagtaaactatcataggattcccataatttcactttactttctgtttaggcatggaaaaatttatcagtcagaattgctgttttagggacatgattttcctgaaattgggtgaggatcagtgaaataattactctattacttgttcttaattctctgttctctaatgttttttcattcacaagtttactggagtataactggcttagtaagtatatcctactctgaatgataaaaatatagtcaagctaaaataggtgactatactattaagatagagatcatacaaaagattccaaagaaagtcaaaaagtgtaaaatggaaaataagagatcaaaatgaatatagcataggaataaagatttcactagaaattgcaatttattatgttttggaggttgtaaggaagtcttgttttttggtttattttactgttttgtgatcttgtatgcaaatcctgataaccattaaccttctcaaacttaatgtctgagagcctcataaaatcaacatatttacttattaagcagtttatgaaactttaatggggcccctcctgtgccaagggtacgtatattgtgaagtaaagcctcacaaa

SEQ ID NO: 154675 - DNA, 1200 bp, Homo sapiens
  Payload ID: 10404
  Gene Symbol: MRPS36
  Gene Name: mitochondrial ribosomal protein S36
  ENST ID: ENST00000618428
  CDS Start-End: 434-550
gatgggcagcaagatggcgtctgctagtagggtcgttcaggtaaagcaatttgtcgcgtttccgcatcttgggcggtagggacggtgctgactatggcgacggcgtcggggagtaaaggcggtggcagaggcagagcggtgaccgcgcctctgcggagggccagtgacggcgcccgcgggtgtgtgtgaggatgggactttgagcctgttggaccgggcagtgaggtgggtccggcgccgagggttcgagccttgcggcaaccgtgcagcatcttggcaggtagtcaaaccacacactccattaataaggtttcctgacagaagagacaatcctaaacccaatgtatcagaagctttgagatcagcagggctaccatctcactcttctgtaatttcacaacattctaaaggaagtaaatcaccagatttgctgatgtatcagggtccaccggacactgcagaaataataaaaacattacctcagaaatacagaaggaaacttgtgtctcaagaagaaatggaatttatccaacgtggaggtcctgaataaccatggtggctgctgtttgtcatcagacaatagaattgtctttacaataaaggacttccaaaatgacagatgagaaactgtatattaaacacctttaataaatattatgaaaaaaatgaaatatagaaaatttagatggacacttgtatttcctaatttatgtatcttggtcagcttctccacaagcttacctaattgtttatatactttatacttattaaagtatacatttttaaatgttagcctattaatttactcttgattatcaaacattaccagtgttgaactattaaaagcacacaatgtgtagtaaactatcataggattcccataatttcactttactttctgtttaggcatggaaaaatttatcagtcagaattgctgttttagggacatgattttcctgaaattgggtgaggatcagtgaaataattactctattacttgttcttaattctctgttctctaatgttttttcattcacaagtttactggagtataactggcttagtaagtatatcctactctgaatgataaaaatatagtcaagctaaaataggtgactatactattaagatagagatcatacaaaagattccaaagaaagtcaaaaagtgtaaaatggaaaataagagatcaaaatgaat

SEQ ID NO: 154676 - DNA, 1652 bp, Homo sapiens
  Payload ID: 10405
  Gene Symbol: MRPS5
  Gene Name: mitochondrial ribosomal protein S5
  Uniprot ID: P82675
  ENST ID: ENST00000272418
  CDS Start-End: 210-1502
cgcccgcggggctgtccgcggtcgcgccgggctccgcctgcagtgtggcccgtccggacagtccctcaccccggcctgcgctgctgcgtggactcgggcctcaggaattccgctgcggcccaaggcttgccgtttgacgaggagcagtcgcggtaggcggtgggcaaggctgccctgggcggaggccgaggcgcggctcggactccagcatggcgaccgcggtgcgcgctgtgggctgcctccccgtgctgtgtagcgggacggcaggtcatttattggggaggcagtgttccctaaacaccttaccagcagcttccattttggcatggaagagtgttctcggcaatggccatttgtcatcactgggaaccagagacacccatccctacgccagcttgagccgtgcactgcagacacaatgctgtatttcttctcccagtcacctgatgagccagcagtatagaccatatagtttcttcactaaattgactgcagatgagctgtggaaaggcgctttagcagagactggtgctggagcaaaaaaaggaagaggcaaaagaactaaaaagaagaaaagaaaggatctgaacaggggtcagatcattggtgaagggcgttatggttttctatggcccggactgaatgtccctcttatgaaaaatggagcagtgcagaccattgcccaaagaagcaaggaagagcaggagaaggtggaggcagacatgatccagcagagagaagagtgggaccgaaagaagaagatgaaggttaaacgggagcgaggatggagtggaaactcatggggaggcatcagtcttggcccccctgaccctggtccctgtggagaaacatatgaggattttgataccaggatacttgaggtaagaaacgttttcactatgactgcgaaagagggaagaaagaaatcgatccgtgtcttggtggctgtggggaacggaaaaggagctgcaggtttttctattgggaaagctactgatcggatggatgctttcaggaaagcaaagaacagagcagttcaccatttgcattatatagaacgatatgaagaccatacaatattccatgatatttcattaagatttaaaaggacgcatatcaagatgaagaaacaacccaaaggttacggcctccgctgccacagggccatcatcaccatctgccggctcattggcatcaaagacatgtatgccaaggtctctgggtccattaatatgctcagcctcacccagggcctcttccgtgggctctccagacaggaaacccatcaacagctggctgataagaagggcctccatgttgtggaaatccgggaggaatgtggccctctgcccattgtggttgcgtccccccgggggcccttgaggaaggatccagagccagaagatgaggttccagacgtcaaactggactgggaagatgtgaagactgcacagggaatgaagcgctctgtgtggtctaatttgaagagagccgccacgtaacctctctggccttgtgcagccagttcctgtgctgccctgcacctaggagagactcagcccctcacagcttgggatgttaccttgccttttgtttgttttgagggaagtttaatctttaaactctttggaaataaataattatagctttca

SEQ ID NO: 154677 - DNA, 1359 bp, Homo sapiens
  Payload ID: 10405
  Gene Symbol: MRPS5
  Gene Name: mitochondrial ribosomal protein S5
  Uniprot ID: P82675
  ENST ID: ENST00000345084
  CDS Start-End: 9-764
actccagcatggcgaccgcggtgcgcgctgtgggctgcctccccgtgctgtgtagcgggacggcaggtcatttattggggaggcagtgttccctaaacaccttaccagcagcttccattttggcatggaagagtgttctcggcaatggccatttgtcatcactgggaaccagagacacccatccctacgccagcttgagccgtgcactgcagacacaatgctgtatttcttctcccagtcacctgatgagccagcagtatagaccatatagtttcttcactaaattgactgcagatgagctgtggaaaggcgctttagcagagactggtgctggagcaaaaaaaggaagaggcaaaagaactaaaaagaagaaaagaaaggatctgaacaggggtcagatcattggtgaagggcgttatggttttctatggcccggactgaatgtccctcttatgaaaaatggagcagtgcagaccattgcccaaagaagcaaggaagagcaggagaaggtggaggcagacatgatccagcagagagaagagtgggaccgaaagaagaagatgaaggttaaacgggagcgaggatggagtggaaactcatggggaggcatcagtcttggcccccctgaccctggtccctgtggagaaacatatgaggattttgataccaggatacttgaggtttttctattgggaaagctactgatcggatggatgctttcaggaaagcaaagaacagagcagttcaccatttgcattatatagaacgatatgaagaccatacaatattccatgatatttcattaagatttaaaaggacgcatatcaagatgaagaaacaacccaaaggttacggcctccgctgccacagggccatcatcaccatctgccggctcattggcatcaaagacatgtatgccaaggtctctgggtccattaatatgctcagcctcacccagggcctcttccgtgggctctccagacaggaaacccatcaacagctggctgataagaagggcctccatgttgtggaaatccgggaggaatgtggccctctgcccattgtggttgcgtccccccgggggcccttgaggaaggatccagagccagaagatgaggttccagacgtcaaactggactgggaagatgtgaagactgcacagggaatgaagcgctctgtgtggtctaatttgaagagagccgccacgtaacctctctggccttgtgcagccagttcctgtgctgccctgcacctaggagagactcagcccctcacagcttgggatgttaccttgccttttgtttgttttgagggaagtttaatctttaaactctttggaaataaataattatagctttc

SEQ ID NO: 154678 - DNA, 990 bp, Homo sapiens
  Payload ID: 10406
  Gene Symbol: MRPS6
  Gene Name: mitochondrial ribosomal protein S6
  Uniprot ID: P82932
  ENST ID: ENST00000399312
  CDS Start-End: 179-556
cggcgtctgcgcagctgccagcgcctttaagcccgggctcgcgctctcggaccgtgctttcgccgcctgggagccgtccggcgcagcagtttctaggtccccactgtccccgccgtcccgccccttcgcgtcccgggaaccggctggcttccgagccgcactcgccgatcctccaggcatgccccgctacgagctggctttaatcctgaaagccatgcagcggccagagactgctgctactttgaaacgtacgatagaggccctgatggacagaggagcaatagtgagggacttggaaaacctgggtgaacgagcgcttccttataggatctctgcccacagtcagcagcacaacagaggcgggtatttcttggtggatttttatgcacccaccgcagctgttgaaagcatggtggagcacttgtctcgagatatagatgtgattagagggaatattgtcaaacaccctctgacccaggaactaaaagaatgtgaagggattgtcccagtcccactcgcagaaaaattatattccacaaagaagaggaagaagtgagaagattcgccagattttagccttatatgtaattccttcacatttgggcagcatggacgagaaggaagaatttgcaagtttggcctttatataagcatgtgttgcaggtgctgtttgatttttctaaggtatttttagcccttgatcccctttgcttgcgagaggtggggaactgctcactgacagcttctctgtaacctgcagtaccagtggatcgttcttgattttgttttcattagtgtcatttctttgtcattgaggacttttccccttacaacagtaacaccattttttgaagagcaaaacttataatacctcctgggattgtgagctagtcattcagcctgtgtaaccatgtggaaataaaaattgacgaccaatgtattatatggacaacttttgctttgagtaataaacttgattgtaggaatgtg

SEQ ID NO: 154679 - DNA, 1406 bp, Homo sapiens
  Payload ID: 10407
  Gene Symbol: MRPS7
  Gene Name: mitochondrial ribosomal protein S7
  Uniprot ID: Q9Y2R9
  ENST ID: ENST00000245539
  CDS Start-End: 228-956
ggagtgagtgccgtcaccgagggccgcgccagactgcgacggatacagggagggcaagggtttccttttggcgctcccctttggaccccggagtgaaaaactctaacgtccagatcagtggagagaaacgcagatttaggaccctgaggagtctttttcacccgtttcccgtcactcgctcaggcgcgccgagggcagtccttgtggggtcctcgtggccagccaagatggctgcccccgcagtgaaggttgcccgaggatggtcgggcctggcgttgggcgtgcggcgggctgtcttgcagcttccagggctaactcaggtgagatggagccgctatagtcctgaattcaaggatcccttgattgacaaggaatattatcgcaagccagtggaggagctaactgaggaggagaaatatgttcgggagctcaagaagactcagctcatcaaagctgctccagcagggaaaacaagttctgtgtttgaagacccagtcatcagtaaattcaccaacatgatgatgataggaggaaacaaagtactggccagatccctcatgattcagactctggaagctgtgaaaaggaagcagtttgagaagtaccatgccgcttctgcagaggaacaggcaaccatcgaacgcaacccctacaccatcttccatcaagcactgaaaaactgtgagcctatgattgggctggtacccatcctcaagggaggccgtttctaccaggtccctgtacccctacccgaccggcgtcgccgcttcctagccatgaagtggatgatcactgagtgccgggataaaaagcaccagcggacactgatgccggagaagctgtcacacaagctgctggaggctttccataaccagggccccgtgatcaagaggaagcatgacttgcacaagatggcagaggccaaccgtgccctggcccactaccgctggtggtagagtctccaggaggagcccagggccctctgccgcaagaaacagtgtgagctactgccacgctgaaaactacctgtgggttaaggatgtagttcctttgtaagggtgggcaggcctcgtaagaaagatgtagcagcatattcactatccgttaatccttctttctttgaggctggaacttgctctctctgcccctatttccttgtaaagagggagcacattgacttgggaatttcctccaggaaactcagggctgttttctcttcccttaggttggggcggacctttggatatataaaggaagcagttttagtatcagaaaagatttattagaaaattctcacgctgaactggtgtagcatgtggtgcagcattcagtgaaactggctggaggaaataggcttgtttccagagttgtccttatacaaaatgtataaaaagcagtttctggtg

SEQ ID NO: 154680 - DNA, 692 bp, Homo sapiens
  Payload ID: 10407
  Gene Symbol: MRPS7
  Gene Name: mitochondrial ribosomal protein S7
  ENST ID: ENST00000584678
  CDS Start-End: 1-470
aagacccagtcatcagtaaattcaccaacatgatgatgataggaggaaacaaagtactggccagatccctcatgattcagactctggaagctgtgaaaaggaagcagtttgagaagtaccatgccgcttctgcagaggaacaggcaaccatcgaacgcaacccctacaccatcttccatcaagcactgaaaaactgtgagcctatgattgggctggtacccatcctcaagggaggccgtttctaccaggtccctgtacccctacccgaccggcgtcgccgcttcctagccatgaagtggatgatcactgagtgccgggataaaaagcaccagcggacactgatgccggagaagctgtcacacaagctgctggaggctttccataaccagggccccgtgatcaagaggaagcatgacttgcacaagatggcagaggccaaccgtgccctggcccactaccgctggtggtagagtctccaggaggagcccagggccctctgccgcaagaaacagttggggcggacctttggatatataaaggaagcagttttagtatcagaaaagatttattagaaaattctcacgctgaactggtgtagcatgtggtgcagcattcagtgaaactggctggaggaaataggcttgtttccagagttgtccttatacaaaatgtataaaaagcagtttctggtg

SEQ ID NO: 154681 - DNA, 864 bp, Homo sapiens
  Payload ID: 10407
  Gene Symbol: MRPS7
  Gene Name: mitochondrial ribosomal protein S7
  ENST ID: ENST00000583407
  CDS Start-End: 1-87
cgggctgtcttgcagcttccaggcttttgcctgcctcctcctttccccccctcccaggctaactcaggtgagatggagccgctatagtcctgaattcaaggatcccttgattgacaaggaatattatcgcaagccagtggaggagctaactgaggaggagaaatatgttcgggagctcaagaagactcagctcatcaaagctgctccagcagggaaaacaagttctgtgtttgaagacccagtcatcagtaaattcaccaacatgatgatgataggaggaaacaaagtactggccagatccctcatgattcagactctggaagctgtgaaaaggaagcagtttgagaagtaccatgccgcttctgcagaggaacaggcaaccatcgaacgcaacccctacaccatcttccatcaagcactgaaaaactgtgagcctatgattgggctggtacccatcctcaagggaggccgtttctaccaggtccctgtacccctacccgaccggcgtcgccgcttcctagccatgaagtggatgatcactgagtgccgggataaaaagcaccagcggacactgatgccggagaagctgtcacacaagctgctggaggctttccataaccagggccccgtgatcaagaggaagcatgacttgcacaagatggcagaggccaaccgtgccctggcccactaccgctggtggtagagtctccaggaggagcccagggccctctgccgcaagaaacagtgtgagctactgccacgctgaaaactacctgtgggttaaggatgtagttcctttgtaagggtgggcaggcctcgtaagaaagatgtagcagcatattcactatccgttaatccttcttt

SEQ ID NO: 154682 - DNA, 1717 bp, Homo sapiens
  Payload ID: 10407
  Gene Symbol: MRPS7
  Gene Name: mitochondrial ribosomal protein S7
  ENST ID: ENST00000579761
  CDS Start-End: 228-779
ggagtgagtgccgtcaccgagggccgcgccagactgcgacggatacagggagggcaagggtttccttttggcgctcccctttggaccccggagtgaaaaactctaacgtccagatcagtggagagaaacgcagatttaggaccctgaggagtctttttcacccgtttcccgtcactcgctcaggcgcgccgagggcagtccttgtggggtcctcgtggccagccaagatggctgcccccgcagtgaaggttgcccgaggatggtcgggcctggcgttgggcgtgcggcgggctgtcttgcagcttccagggctaactcaggtgagatggagccgctatagtcctgaattcaaggatcccttgattgacaaggaatattatcgcaagccagtggaggagctaactgaggaggagaaatatgttcgggagctcaagaagactcagctcatcaaagctgctccagcagggaaaacaagttctgtgtttgaagacccagtcatcagtaaattcaccaacatgatgatgataggaggaaacaaagtactggccagatccctcatgattcagactctggaagctgtgaaaaggaagcagtttgagaagtaccatgccgcttctgcagaggaacaggcaaccatcgaacgcaacccctacaccatcttccatcaagcactgaaaaactgtgagcctatgattgggctggtacccatcctcaagggaggccgtttctaccaggtgaatgaatggccagggcaagaaagcagggccctccacatgtgaaacaagataggtggtgcttgggagttgggtcaagattgatagctttctagctggtgcagtgggattgcacctgtaatctcagcactttgggagcctaatgcaggatagcttgagctcaggagttaagagacagcagggcaacatagggagatcccgtctctacaaaaaaaacaaaaaaattagccaggtgtggtggtgtgcatctgtgctcccaactactcaggaggctgaggtaggaggatcacttgagtccaggaggtcaaggctgcagtgagttatgattacgcccctgcattccagcctgggcaagagagagaaaccttgtctcagaaaaaaaaaaaaaaaaaacggctgggcacggtggctcacacctgtaatcccagcactttgggaggccgaggtggatggattacctgaggtggggagttcgagatcaacaaggagaaaccctgtttctactaacaatacaaaattagccaggtgtggtggcacataccagtagtcccagctacttgggaggctgaagcaggagaatcgcttgaacccaggatgcagaggttgcagtgagccgagagcacaccaccgcactccagcctggcaacagagcaagacgccatctcaaaaaaaaaaaaaaaaaaagaattgagactgttacggtccactcatctgagtcctgtagcgtaaaaattataggcagaaggtggaagagagtgaagaagtatctaagtgacatctgggagcccacctcccttcgccttcttctgtcaagcatcctgtgtgtcctaacctgtaaaattctcatggcgagggactattcatatcctgtctttgtatgccagtgtttggcatagtgcttgaccgataactgatgcttcatcagtgtttgctgaacagtactaggtatctctttcatagcatttaattatattttattgtcc

SEQ ID NO: 154683 - DNA, 1638 bp, Homo sapiens
  Payload ID: 10407
  Gene Symbol: MRPS7
  Gene Name: mitochondrial ribosomal protein S7
  ENST ID: ENST00000579002
  CDS Start-End: 416-1231
cgcagtgaaggttgcccgaggatggtcgggcctggcgttgggcgtgcggcgggctgtcttgcagcttccagggtgagagggtggcgagcagcggcgggggggcgctgcgaggaaggaagggggccacaggcaggccgcgtgggcccctagagagagcattgccctgggggccggagtatctggattcaagcttctaagttagctgcgtgaccctgcgccaatccgaaggtttagtgactacctctcgcctaaggagtctggctgatctagggttctaacgcggagctgaaagtgcggttcagctaaagagctcagatctgggatcgcctgtgaattgggatgggtgtgtaggcgccaagcccatccttaccgttagcacttgaccaggaggagactttacccgcctgcttggggaatgtcctcctacttgggacaagggcctgaattgttgtggctcaggtttagctcgcggtctccgcgccgctccccctcgtcggcgcgttggcagtcatgcctattgttaagtcaaacctactcgcttgtggagtcagcttttgcctgcctcctcctttccccccctcccaggctaactcaggtgagatggagccgctatagtcctgaattcaaggatcccttgattgacaaggaatattatcgcaagccagtggaggagctaactgaggaggagaaatatgttcgggagctcaagaagactcagctcatcaaagctgctccagcagggaaaacaagttctgtgtttgaagacccagtcatcagtaaattcaccaacatgatgatgataggaggaaacaaagtactggccagatccctcatgattcagactctggaagctgtgaaaaggaagcagtttgagaagtaccatgccgcttctgcagaggaacaggcaaccatcgaacgcaacccctacaccatcttccatcaagcactgaaaaactgtgagcctatgattgggctggtacccatcctcaagggaggccgtttctaccaggtccctgtacccctacccgaccggcgtcgccgcttcctagccatgaagtggatgatcactgagtgccgggataaaaagcaccagcggacactgatgccggagaagctgtcacacaagctgctggaggctttccataaccagggccccgtgatcaagaggaagcatgacttgcacaagatggcagaggccaaccgtgccctggcccactaccgctggtggtagagtctccaggaggagcccagggccctctgccgcaagaaacagtgtgagctactgccacgctgaaaactacctgtgggttaaggatgtagttcctttgtaagggtgggcaggcctcgtaagaaagatgtagcagcatattcactatccgttaatccttctttctttgaggctggaacttgctctctctgcccctatttccttgtaaagagggagcacattgacttgggaatttcctccaggaaactcagggctgttttctcttcccttaggttggggcggacctttggatatataaaggaagcagttttagtatcagaaaagatttattagaaaattctcacgctgaactggtgtagcatgtggtgcagcattcagtgaaactggctggaggaaataggcttgtttcc

SEQ ID NO: 154684 - DNA, 731 bp, Homo sapiens
  Payload ID: 10407
  Gene Symbol: MRPS7
  Gene Name: mitochondrial ribosomal protein S7
  ENST ID: ENST00000581993
  CDS Start-End: 1-517
tcagctcatcaaagctgctccagcagggaaaacaagttctgtgtttgaagacccagtcatcagtaaattcaccaacatgatgatgataggaggaaacaaagtactggccagatccctcatgattcagactctggaagctgtgaaaaggaagcagtttgagaagtaccatgccgcttctgcagaggaacaggcaaccatcgaacgcaacccctacaccatcttccatcaagcactgaaaaactgtgagcctatgattgggctggtacccatcctcaagggaggccgtttctaccaggtccctgtacccctacccgaccggcgtcgccgcttcctagccatgaagtggatgatcactgagtgccgggataaaaagcaccagcggacactgatgccggagaagctgtcacacaagctgctggaggctttccataaccagggccccgtgatcaagaggaagcatgacttgcacaagatggcagaggccaaccgtgccctggcccactaccgctggtggtagagtctccaggaggagcccagggccctctgccgcaagaaacagtgttggggcggacctttggatatataaaggaagcagttttagtatcagaaaagatttattagaaaattctcacgctgaactggtgtagcatgtggtgcagcattcagtgaaactggctggaggaaataggcttgtttccagagttgtccttatacaaaatgtataaaaagca

SEQ ID NO: 154685 - DNA, 1500 bp, Homo sapiens
  Payload ID: 10408
  Gene Symbol: MRPS9
  Gene Name: mitochondrial ribosomal protein S9
  Uniprot ID: P82933
  ENST ID: ENST00000258455
  CDS Start-End: 111-1301
ccgagaagctcttgcacaggacagcctctggaaccccgcgccattagcgcctgcgccgtctctaggccccgccccctcacccctccggtcctggagctcccacagctaacatggcggcgccctgtgtgtcctacggcggagcagtttcgtaccggcttcttctctggggtaggggtagcctcgcccggaagcaaggcctctggaaaaccgcggcccctgagttgcaaacaaatgtcagatcccagatattaaggctaagacatactgcatttgtaataccaaagaaaaacgttcctacctcaaaacgtgaaacttacacagaggattttattaaaaagcagattgaagagttcaacataggaaagagacatttagccaacatgatgggagaagatccagaaactttcactcaagaagatattgacagagctattgcttaccttttcccaagtggtttgtttgagaaacgagccaggccagtaatgaagcatcctgaacagatttttccaagacaaagagcaatccagtggggagaagatggccgtccatttcactatctcttctatactggcaaacagtcatactattcattaatgcatgatgtatatggaatgttactcaatttagaaaaacatcaaagtcacttgcaagccaaaagtctgctcccagaaaaaactgtaaccagagacgtgattggcagcagatggctgattaaggaggaactagaagaaatgttagtggaaaaactgtcagatctagattatatgcagttcattcggctgctagaaaagttattgacatcgcagtgtggtgctgctgaggaagaatttgtgcagaggtttcgaagaagtgtaactcttgaatcaaaaaaacagctgattgaacctgtacagtatgatgagcaaggaatggcctttagcaaaagtgaaggtaaaagaaagactgcaaaagcagaagcaattgtttataaacatggaagtggaagaataaaagtaaatggaattgattaccagctttacttcccgatcacacaggacagagaacagctgatgttccctttccactttgttgaccggctgggaaagcacgacgtgacctgcacagtctcagggggcgggaggtcagcgcaggctggagcaatacgactggcaatggcaaaagccttgtgcagctttgtcaccgaggacgaggtcgagtggatgagacaagctggactacttactactgatccacgtgtgagggaacggaagaagccaggccaagagggagcccgcagaaagtttacgtggaagaaacgctaagggtttgctcccaggaaaggagaggaagagctatatatatgtgccgacatgtggcagacacacagtaaataatggctgaccagcatgagggcagtactgtcagaaatttctttgagctgtgagatggatttatttttaaatgctactttgtaaaggtgacctttaaaaaataaaaggaaaataaagaatgttagtttca

SEQ ID NO: 154686 - DNA, 652 bp, Homo sapiens
  Payload ID: 10408
  Gene Symbol: MRPS9
  Gene Name: mitochondrial ribosomal protein S9
  ENST ID: ENST00000413583
  CDS Start-End: 1-173
atcaaagtcacttgcaagccaaaagtctgctcccagaaaaaactgtaaccagagacgtgattggcagcagatggctgattaaggaggaactagaagaaatgttagtggaaaaactgtcagatctagatgtgcagaagtcattgagagtctgtgagatgcaatcaagagagtagctgagcacagaacgcccaggccagtgactggagaggagcatggagctctgcccacccaatatcctagtatatgcagttcattcggctgctagaaaagttattgacatcgcagtgtggtgctgctgaggaagaatttgtgcagaggtttcgaagaagtgtaactcttgaatcaaaaaaacagctgattgaacctgtacagtatgatgagcaaggaatggcctttagcaaaagtgaaggtaaaagaaagactgcaaaagcagaagcaattgtttataaacatggaagtggaagaataaaagtaaatggaattgattaccagctttacttcccgatcacacaggacagagaacagctgatgttccctttccactttgttgaccggctgggaaagcacgacgtgacctgcacagtctcagggggcgggaggtcagcgcaggctggagcaatacgactggcaatggcaaaagccttgtgcagct

SEQ ID NO: 154687 - DNA, 1841 bp, Homo sapiens
  Payload ID: 10409
  Gene Symbol: MRRF
  Gene Name: mitochondrial ribosome recycling factor
  Uniprot ID: Q96E11
  ENST ID: ENST00000297908
  CDS Start-End: 365-997
acaggacaatccggggcggggcctgagatgcagtcctgcgagggcggcctcctgtaagacctcttagcgggcccatcgctgaggtgcagggacatgtcgcggccgaactcacctcgtggcctcggcgtggtgctctcagctcatgcccggaaaccaggtcccgacgccgcggtcagacggacctctagacgcgtccgcctcaatgccgccagctgccaggccgcccgtgacgcgttaagcctgcgccgcctcctggcttcgtgacgtcacgacgtccgcgcagctgcggtcgccgccgtcgcacgagtctttccttagtaacctgggcgatagctgtggatgtttccaaggattgtcttcagtcatggccttgggattaaagtgcttccgcatggtccaccctacctttcgcaattatcttgcagcctctatcagacccgtttcagaagttacactgaagacagtgcatgaaagacaacatggccataggcaatacatggcctattcagctgtaccagtccgccattttgctaccaagaaagccaaaggatcccttgacaagattgctgtggtaactgctgacgggaagcttgctttaaaccagattagccagatctccatgaagtcgccacagctgattttggtgaatatggccagcttcccagagtgtacagctgcagctatcaaggctataagagaaagtggaatgaatctgaacccagaagtggaagggacgctaattcgggtacccattccccaagtaaccagagagcacagagaaatgctggtgaaactggccaaacagaacaccaacaaggccaaagactctttacggaaggttcgcaccaactcaatgaacaagctgaagaaatccaaggatacagtctcagaggacaccattaggctaatagagaaacagatcagccaaatggccgatgacacagtggcagaactggacaggcatctggcagtgaagaccaaagaactccttggatgaaagtccactggggccagcaatactccagagcccagtttctgctggatcccatgggtggcacattgggacttctctccctcccccatctacacagaagactgtcaccatgctgacagaagcctgtccttgtaaggcccagccttccaggggaacactcagacatgttcattctcttcctgcttctgctctgggccggtgggtggctctcagaaaatacttgctgctggcaaaaggcctgtactcaggcatttgctttgacttgatgttgccaagggactgaggccattggcaggcttagtaccacctgctcctcatcttaggagtctccttttcaaataattaggctctgttcccattttaaaactctgatattggccttcacctgtgactggacactttactagaggcccattttcactaaacaataaaatctaaataaattggaaggaataacaaccacaaaggaaagaatagagttggtctggattgatgatcactgaggatctgtatgtgaggcacccataacagtagttttgcctgtgagtcgtcttcacacatgctgttttctctgcctggctctctcttcccctccttacctggccagtcctgtttatcatcaggccttgtcttggatatcacgtcctctgggaagtcttcttttcccctctaacctaggaccctcattaccggctctcatagcacagtctactgctttgtacgaattctaagtattcttgttgcacttaattagcctgtatatcctcagaactttgtgtaatgcctggagcatagtaggcagtcatatgttgtatcgtgaataaattgcacatagtagctacccagc

SEQ ID NO: 154688 - DNA, 9826 bp, Homo sapiens
  Payload ID: 10409
  Gene Symbol: MRRF
  Gene Name: mitochondrial ribosome recycling factor
  Uniprot ID: Q96E11
  ENST ID: ENST00000344641
  CDS Start-End: 312-1100
gtaagacctcttagcgggcccatcgctgaggtgcagggacatgtcgcggccgaactcacctcgtggcctcggcgtggtgctctcagctcatgcccggaaaccaggtcccgacgccgcggtcagacggacctctagacgcgtccgcctcaatgccgccagctgccaggccgcccgtgacgcgttaagcctgcgccgcctcctggcttcgtgacgtcacgacgtccgcgcagctgcggtcgccgccgtcgcacgagtctttccttagtaacctgggcgatagctgtggatgtttccaaggattgtcttcagtcatggccttgggattaaagtgcttccgcatggtccaccctacctttcgcaattatcttgcagcctctatcagacccgtttcagaagttacactgaagacagtgcatgaaagacaacatggccataggcaatacatggcctattcagctgtaccagtccgccattttgctaccaagaaagccaaagccaaagggaaaggacagtcccaaaccagagtgaatattaatgctgccttggttgaggatataatcaacttggaagaggtgaatgaagaaatgaagtctgtgatagaagctctcaaggataatttcaataagactctcaatataaggacctcaccaggatcccttgacaagattgctgtggtaactgctgacgggaagcttgctttaaaccagattagccagatctccatgaagtcgccacagctgattttggtgaatatggccagcttcccagagtgtacagctgcagctatcaaggctataagagaaagtggaatgaatctgaacccagaagtggaagggacgctaattcgggtacccattccccaagtaaccagagagcacagagaaatgctggtgaaactggccaaacagaacaccaacaaggccaaagactctttacggaaggttcgcaccaactcaatgaacaagctgaagaaatccaaggatacagtctcagaggacaccattaggctaatagagaaacagatcagccaaatggccgatgacacagtggcagaactggacaggcatctggcagtgaagaccaaagaactccttggatgaaagtccactggggccagcaatactccagagcccagtttctgctggatcccatgggtggcacattgggacttctctccctcccccatctacacagaagactgtcaccatgctgacagaagcctgtccttgtaaggcccagccttccaggggaacactcagacatgttcattctcttcctgcttctgctctgggccggtgggtggctctcagaaaatacttgctgctggcaaaaggcctgtactcaggcatttgctttgacttgatgttgccaagggactgaggccattggcaggcttagtaccacctgctcctcatcttaggagtctccttttcaaataattaggctctgttcccattttaaaactctgatattggccttcacctgtgactggacactttactagaggcccattttcactaaacaataaaatctaaataaattggaaggaataacaaccacaaaggaaagaatagagttggtctggattgatgatcactgaggatctgtatgtgaggcacccataacagtagttttgcctgtgagtcgtcttcacacatgctgttttctctgcctggctctctcttcccctccttacctggccagtcctgtttatcatcaggccttgtcttggatatcacgtcctctgggaagtcttcttttcccctctaacctaggaccctcattaccggctctcatagcacagtctactgctttgtacgaattctaagtattcttgttgcacttaattagcctgtatatcctcagaactttgtgtaatgcctggagcatagtaggcagtcatatgttgtatcgtgaataaattgcacatagtagctacccagcaaatgctgacttcttttctttctagtcttaacactccctttctatcattttccactcttgtacttgttctcaacatttacttggtagtgacatacctttcctgcagggcctgcccattgttgacagacaagtagtttattgtggcttatcttcggatactgggttattaggtttttttccctccaattattttttattcattcattcattcctaatatagccattatgagttaggtatagttctaggcattatttataatcttgacagtaaacttaagagatgtgtattatcttcatttacaaataggaaaactaagtcttgacagtattaggtaatttgcccaaagtaacaaagcaaagctgatcagtggtagaaggttttcatgattcattgtcagcgtcatttacatagaggtgaagtttcttgtgcagggttacacacctagcaagtagcagagctggcattcaaattgaggcctgatgtgctaatgtaaaaggaaaaaaacaaactttttttccttttgtactttcacactcaacatggaacacttctgtgacaaggtgtgtgagtttgtttcccccacacaccaagcaattctccagcagacaccaactgggtatcctataattcaattcatttctgacattacctggaaatagtgtcagatcccacaggttgagggctccatctcccaagactgccaacacttttgatgccagtcatgagtctgggccacccatactcctgactgaccaactacaaactagagtccttgatttcctttggttcagttaatttcctaggacagctcacacaactcagggaaacacgttcactggtttattataaaagatacagctgaacagcccaatgaaggaggtacacagggcaaggttgagggagagggagagggtgtggagcttccatgccttctctgggctcacactctctcagcacctcaccaatctggaaggaaccactgtgtcctgctgccttcattagcatttagtgagcaccaattgtttgtcaggtgctgaactatgtactggcaatacaaaaatgggaaagatatgacccctgttttgggggggtacatagtgcactgaactaaattgctgtctataataatctattgggtggaaaagtaggaagttcattccagttctgcaaggtgtctgctttcagaatggagcccactttggtggtggcaaggcctggctgagttctttcaaagcaacatccaacttctctttgctctttgacttcctccagattctctcctgtgctggaggtaataagggttgcacttccctctttacttacactggtgaaacatgcagtgaggattcaaggtcaaaattgggtcaaagttaaactaacacagtctcctgccccacttacctgtcctctaaccccatccaccagccctaagtggtcatcacatgatcagaagtcagctgggggaagagcagggatagatagagcaattaaggagcctcttttggggtaagccacatgacaggggctttgcaacagtctttcatgagtggccgaaatcccccactcactgcaaatgtgcttctcaaagatgcaggattttttaataaacagaggaaatgataaattatgttgtaattccactccaaaggcatttggttcttaacagccaaatcctctgtagtctttaaataaacaaaaacttatttggtgaacagacagggaggaaaatgaaagattttctgtacttgggttccacatgtcaacaatttctctcctgtgtgtatgttggccaaagctgtatcatgataaatgaataaaggaaaacctcgagcccagggcagtcagacagctcagcaaatggctttcagatgattactcaatttcagttgacatttatcaaagagtttctctgtgactctgtgtcagggctgtagtggtgacagggacaagaatgagactacctgtttggatgtgctgagaatgagtaatgctggagcaattcattctccatctcttctctcctacagcctctctcaaaaagaaacactgggtatggaaattctcacacttgccagaagaattaaccacctcttctattcagtttaatgactttcaaagtcctatgaaatattcaggccagagagaatttgagaatttttttcctgtctggtgtgtgtgtgtgtgtgtgtgtgtgtgtgtgtgtgtgtgtgtgtgtgtgtgtgttggaaattacaaaataagttggaatgcagaaagttaaaaaaaaaatctcaccaggccctactcctttaaaattaggtatatatctttccagacctcctttctctgtgcatatatgtgtgtgtgtgtgtgtgtgttcgtttcattttgttttgcctttgagacagtgtctcactctgtcgcccatcatgcagtggcacaatcatagctcactgcagccttgaactctttggctcatgcaattctcccacctcagcctcctgagtagctgggactgcagctatgcaccaccacacctggcttttttttttttgctttgtttcctaggctggtctcaaacacctggcctcaagcggtccttctgcctcagcctcccaaagcgctgggattacaagtgtgagccactctgcctggccatatataatttttttttttttttttttgcaatggagtcttgctctgtcgcccacgctggagtgcattggcgcaatctcggctcactgcaacctctgcctccctggttcaagcagttttccctgcttcagcctcctgagtagctgggattacaggcgcccgccaccacacccagctaattttttatttttttttagtagagatggggtttcaccatgttggccaggctggtcttgaactcctgactcaggtgatccacctgtctcagcctcccaaattgctgggattacaggcatgaaccactgcgcccggccatataattttttagaaggagagaggggaactattcatattctgatgtttgcttttttttcttaccctgtaacaatcatggtcatctgtccatgtgtgtacataatagatacaatttattatttcattgtgatacagtattccataatatgggtctaccataacttaattcactattagcccatgacactatttaaaaattatttcacatgcattggagaatgtttaaagatgatttttttttttaagaaaaaagaaaggcccctattctaagattatctgataaggtctgctctttctccttcaacctcaggctaacatttattgaatgcctacagtcggccaggttccatgctagaccctttacacgtgttcccacattgaaacttctgatgaatccttgttaatgtaggtgttatgattatctgtgtttttctgtgaaaaaaacaggttcagaaaggatatttaacttgcccaaggtcacacaggtagtaagtgctagaatgaaatttcaaacccacatctgaccttgaagtaggtccttaatcagtgtgctttggttcccaagtcttcgctgaacacttactcaaaagggacctcgcgctgttctggacctggacggtgatgtgagagaagcagaagtcttgctttcataaaacacatagcaagctgttcctaattaatgactgcaagtaaaatagcatagtacctggcacattgtaaacaccaaagaaatggtagctcttatggagacagtaaagattacatattaatcccccacctgtttggccaacttctctagaatatgtcagagagcaagcaaaatgttcaccaagcagtgaataatgataataataacaacaataacagtattgacagatcagtaactaatatttgcttggtgctttttagttttcaaactgcttctacattctttgttgcattgaaaccactcagtgaaactttgcggttagacaaagagtgatcataaaagcttgtatcctcaaaagccactttgaggctttcttttgccctaatagacggtcatttttcatgatgtgcatttgaaatgatatgttccctattttgggggtacaaattttgatatgtatgcaggaaatgtagcttatagagtatgttgtttaggttttccattattttttgaccctttgatgagtcttggactgaaagtggtgtgtttcagacccctgctattaacatttctgttccttcttgcattttctgctttatgaaaatggattctgctttgtgaaagtactgctgtgttgttttatacatagcgctccagacgcttacatcttctttatttcattcagtgctcttagtctgaattttatcttgttgtatatcaggattacagctcttgcttgctttttgtttacatttgctttccccatttcttgatttttaagctttcagaatcactattttaggtgtttctttttttttttggaattgggttttgttcgatgaaccattctgaaactccttttttcttatttttatttttaattgtaaaatatacataaaatttactctcttaaccatgttttttttttagacagggtcttgctctgtcactcaggctggatttcagtggcatgatctcagctcactgtagccttgacaacctgggctgaagcaatcctcccacctcagcctcctgagtagctgggattacagccacgtgcaccgccacacctggctaacttttaaaattatttgtagagacaaggtcttggctatgttgcccaggctgatctcaaactcctgagctcaggtgattctcctaccttggcctcccaaagtgctgggattacaggcttgagcttctgtgcccagccttaaccattttaagtgtacagttcagtagcatttagtacatttacattgttgtacaaccatcctccagaactctttaccatgcagaactgacgctctatacccattacacaaccccagttcccccttctcagcccccagcaaccaccatttatgaatttataaatttgattaggaacatcatgttaagtggaatcatacaggatttgtctttttgtgactagtttatttcactgaagcatgatgtccttaaagtatatccatattgtagcatgtatcagaatttcctttctaaggctgagtaatctgttgtatatatgaataagtatatataaagctccttttaacagacacttaaattcatttacatttatttataatagtgatatgtttagtagaacccatttactttttctttattttcagtattaacataagtgatttggtgttttagccctaagcagataaaggattagagattagaatgaggaagagggttgcttcacatagacgaagttcagtttttgtggaataaacaaataagtgattatctctgtctgcctctttgtctctctctctctctcttttttttttaataagagatgaggggtctccctatgttgcccaggctggacttgaactcctgggttcaagtgatcctggaactgcagatatgcacagctgtgcccgaagatccctttctcttacattcctttcttctggtctgtgtttcagtccatcctacgctgttaagttagaacaacctgaaacagcttttatcatgtcactcttctctcagaaaccttcattggttccctgttgcctgctgaattatgtaaactcttcaccctggcattcagtaacttctgcaatctgggcctgatgtattcctttaattgtgatgcatctcttacaactaccctgataccaccagtgcttaagcgaaacggaattattagcttttctgaaagctaataattttgtgctgctttctctcaccttcaagccttttcttaggctattttctttgcctagtgtatgctcccttaaaccacttccccaccagcaggcaaaacttacctagtcttataagcccttcttggtcccatgttcttccttacactaactcattcattcattatccatcccgatgcttctcctgattcattcattcattatccataccgatgcctctcctgatccctaaacctgcctatgcctattaagcgcttggatttgcctcaagcatctgacgttcagctacccacctgcgtttcctctctcaggaaaagcctcaccatccacccaggtgccaagccaggacactgggagccacttttgcctccctgtccctctcccctcatccaataagtcaccaagtcctgtcaattctcccttcaacagacctttcctttccttcctgggcacacccttgagtggtgctcaccagggaacagatgtggcaaatgttccaggctggcctcacccgggtctctagacacttggctcagaggcagaacatggctaaccctagataagccttgtgtgaattcctggcaagaaagtcccctgctgtcttagtctgtgcattctctgactagcacagtatgtggcgagagcaggtgttgaggaaatgtttgtctaattctaaggggcctgccaggccttgatacaaatggcgtcacatttacatgaataacccagagtttctctaattatcctcacctgcctgcccaggaccttcaacctcatctgctaagtcggcctcaggcgtttctagacatcttaagggaccgcatggcatccaaggccactggcatctactgtactcccctcccaccggcgcttccctttgctagcatctgcagccacaagtgacacttaagggagatttacctccactactgggagtgttagtgtctgtgacaaaagtgctggttgctgggctgagggggtctgagcatgctgggtggaagccctgaagaggaagggagaaggtctctgcccacatcccacatttgccgtgcatccctgagttccaaagcagcctcgctaggctctagagcccctaaatctccaaagacagcagctcctccgcgagctagctgcccctgaccgaggctcacagcttgcctaggggagggcagggcaaaagtccctgctattctcttcctttcctggctcaggccttgatccaaatagctcccttcttccaagacactactccccaggcctcctcttcctgataataatagtggctaacaagttttactagattttaggcaactcaaggagctagctgttattttgttcattctacaagtgaggaaggaagcacagacagtggttaagttacatgtccagagacacacagagggcctagtgcagtagctcatgcctggaatctcagcactttgggtggctgaggtgggcgagtcacttgaggtcaggagttcgggaccagcctggccaacgtggtgaaaccccatctctactaaaaataaaaaatttagccaggtgtggtggcgggcgcctgtaatcccagctacttcggaggctgaagcaggagaatcacttgaacccaggaggcagaggttgcagtgagccaagattgcaccactgcactgcagcatgggcaacagagcgagactctgtctccacacagaggaacacttggcatcagggagtctgttgtctgacccgcaactaggcagcctcatacattattttcactaagagaccagtggggctggaaagggacttgtgaggtgctaagtagccagtgagagcttctgggtcctgtcgcagttttgccctttcttccctcaaaaaaaggtctctccacttctctgtgggaaaggcttgggcaagttctctggtttccaatgaggccagagaacctgtgctgatccctaacatcttcacccatcgggggcaaaataagtaaaataaaagtaatgtagcaaatgtttttataaaagtgttaatttaaattaacggactattacctattcttagagctttctcttttgtttttggcattaaaatatcctttctattataaaatgataa

SEQ ID NO: 154689 - DNA, 1176 bp, Homo sapiens
  Payload ID: 10409
  Gene Symbol: MRRF
  Gene Name: mitochondrial ribosome recycling factor
  Uniprot ID: Q96E11
  ENST ID: ENST00000373723
  CDS Start-End: 73-678
ccgccgtcgcacgagtctttccttagtaacctgggcgatagctgtggatgtttccaaggattgtcttcagtcatggccttgggattaaagtgcttccgcatggtccaccctacctttcgcaattatcttgcagcctctatcagacccgtttcagaagttacactgaagacagtgcatgaaagacaacatggccataggcaatacatggcctattcagctgtaccagtccgccattttgctaccaagaaagccaaagccaaagggaaaggacagtcccaaaccagagtgaatattaatgctgccttggttgaggatataatcaacttggaagaggtgaatgaagaaatgaagtctgtgatagaagctctcaaggataatttcaataagactctcaatataaggacctcaccaggatcccttgacaagattgctgtggtaactgctgacgggaagcttgctttaaaccagattagccagatctccatgaagtcgccacagctgattttggtgaatatggccagcttcccagagtgtacagctgcagctatcaaggctataagagaaagtggaatgaatctgaacccagaagtggaagggacgctaattcgggtacccattccccaatcagccaaatggccgatgacacagtggcagaactggacaggcatctggcagtgaagaccaaagaactccttggatgaaagtccactggggccagcaatactccagagcccagtttctgctggatcccatgggtggcacattgggacttctctccctcccccatctacacagaagactgtcaccatgctgacagaagcctgtccttgtaaggcccagccttccaggggaacactcagacatgttcattctcttcctgcttctgctctgggccggtgggtggctctcagaaaatacttgctgctggcaaaaggcctgtactcaggcatttgctttgacttgatgttgccaagggactgaggccattggcaggcttagtaccacctgctcctcatcttaggagtctccttttcaaataattaggctctgttcccattttaaaactctgatattggccttcacctgtgactggacactttactagaggcccattttcactaaacaataaaatctaaataaattggaaggaataacaaccacaaaggaaagaataga

SEQ ID NO: 154690 - DNA, 870 bp, Homo sapiens
  Payload ID: 10409
  Gene Symbol: MRRF
  Gene Name: mitochondrial ribosome recycling factor
  Uniprot ID: Q96E11
  ENST ID: ENST00000373729
  CDS Start-End: 107-763
cacgagtctttccttagtaacctgggcgatagctgcctctatcagacccgtttcagaagttacactgaagacagtgcatgaaagacaacatggccataggcaatacatggcctattcagctgtaccagtccgccattttgctaccaagaaagccaaagccaaagggaaaggacagtcccaaaccagagtgaatattaatgctgccttggttgaggatataatcaacttggaagaggtgaatgaagaaatgaagtctgtgatagaagctctcaaggataatttcaataagactctcaatataaggacctcaccaggatcccttgacaagattgctgtggtaactgctgacgggaagcttgctttaaaccagattagccagatctccatgaagtcgccacagctgattttggtgaatatggccagcttcccagagtgtacagctgcagctatcaaggctataagagaaagtggaatgaatctgaacccagaagtggaagggacgctaattcgggtacccattccccaagtaaccagagagcacagagaaatgctggtgaaactggccaaacagaacaccaacaaggccaaagactctttacggaaggttcgcaccaactcaatgaacaagctgaagaaatccaaggatacagtctcagaggacaccattaggctaatagagaaacagatcagccaaatggccgatgacacagtggcagaactggacaggcatctggcagtgaagaccaaagaactccttggatgaaagtccactggggccagcaatactccagagcccagtttctgctggatcccatgggtggcacattgggacttctctccctcccccatctacacagaagactgtcacca

SEQ ID NO: 154691 - DNA, 1501 bp, Homo sapiens
  Payload ID: 10409
  Gene Symbol: MRRF
  Gene Name: mitochondrial ribosome recycling factor
  Uniprot ID: Q96E11
  ENST ID: ENST00000394315
  CDS Start-End: 29-634
tggatgtttccaaggattgtcttcagtcatggccttgggattaaagtgcttccgcatggtccaccctacctttcgcaattatcttgcagcctctatcagacccgtttcagaagttacactgaagacagtgcatgaaagacaacatggccataggcaatacatggcctattcagctgtaccagtccgccattttgctaccaagaaagccaaagccaaagggaaaggacagtcccaaaccagagtgaatattaatgctgccttggttgaggatataatcaacttggaagaggtgaatgaagaaatgaagtctgtgatagaagctctcaaggataatttcaataagactctcaatataaggacctcaccaggatcccttgacaagattgctgtggtaactgctgacgggaagcttgctttaaaccagattagccagatctccatgaagtcgccacagctgattttggtgaatatggccagcttcccagagtgtacagctgcagctatcaaggctataagagaaagtggaatgaatctgaacccagaagtggaagggacgctaattcgggtacccattccccaatcagccaaatggccgatgacacagtggcagaactggacaggcatctggcagtgaagaccaaagaactccttggatgaaagtccactggggccagcaatactccagagcccagtttctgctggatcccatgggtggcacattgggacttctctccctcccccatctacacagaagactgtcaccatgctgacagaagcctgtccttgtaaggcccagccttccaggggaacactcagacatgttcattctcttcctgcttctgctctgggccggtgggtggctctcagaaaatacttgctgctggcaaaaggcctgtactcaggcatttgctttgacttgatgttgccaagggactgaggccattggcaggcttagtaccacctgctcctcatcttaggagtctccttttcaaataattaggctctgttcccattttaaaactctgatattggccttcacctgtgactggacactttactagaggcccattttcactaaacaataaaatctaaataaattggaaggaataacaaccacaaaggaaagaatagagttggtctggattgatgatcactgaggatctgtatgtgaggcacccataacagtagttttgcctgtgagtcgtcttcacacatgctgttttctctgcctggctctctcttcccctccttacctggccagtcctgtttatcatcaggccttgtcttggatatcacgtcctctgggaagtcttcttttcccctctaacctaggaccctcattaccggctctcatagcacagtctactgctttgtacgaattctaagtattcttgttgcacttaattagcctgtatatcctcagaactttgtgtaatgcctggagcatagtaggcagtcatatgttgtatcgtgaataaattgcacatagtagctacccagc

SEQ ID NO: 154692 - DNA, 858 bp, Homo sapiens
  Payload ID: 10409
  Gene Symbol: MRRF
  Gene Name: mitochondrial ribosome recycling factor
  ENST ID: ENST00000441707
  CDS Start-End: 400-858
tgcggtcgccgccgtcgcacgagtctttccttagtaacctgggcgatagctgatgagacggaagtcctgagagtttgaccgatttaaggtcacgtgcctaggaagtgctggaaccaagactcggagttttctctaagtttagtgcctttattttgttttaaaccacactgttgcatttccccccattttggaaagctttatagttggaaagaatgaaaacctgatctgaccccttcattttatggttgaaacaaaatctacgtaggagaaatcacttggtacaagtcacaagtcagtggtagagctgccgcaaatgctttttgaatacgtgtgattatgaatctaaatggcagatggcagggagtgataagtggatgtttccaaggattgtcttcagtcatggccttgggattaaagtgcttccgcatggtccaccctacctttcgcaattatcttgcagcctctatcagacccgtttcagaagttacactgaagacagtgcatgaaagacaacatggccataggcaatacatggcctattcagctgtaccagtccgccattttgctaccaagaaagccaaagccaaagggaaaggacagtcccaaaccagagtgaatattaatgctgccttggttgaggatataatcaacttggaagaggtgaatgaagaaatgaagtctgtgatagaagctctcaaggataatttcaataagactctcaatataaggacctcaccaggatcccttgacaagattgctgtggtaactgctgacgggaagcttgctttaaaccagattagccagatctccatgaagtcgccacagctgattttggtgaatatggccagcttcccagag

SEQ ID NO: 154693 - DNA, 867 bp, Homo sapiens
  Payload ID: 10409
  Gene Symbol: MRRF
  Gene Name: mitochondrial ribosome recycling factor
  Uniprot ID: Q96E11
  ENST ID: ENST00000467864
  CDS Start-End: 85-615
caagctttgtacttagatcttttacttagatctgctttttgtcttattctttttagtggatgtttccaaggattgtcttcagtcatggccttgggattaaagtgcttccgcatggtccaccctacctttcgcaattatcttgcagcctctatcagacccgtttcagaagttacactgaagacagtgcatgaaagacaacatggccataggcaatacatggcctattcagctgtaccagtccgccattttgctaccaagaaagccaaagccaaagggaaaggacagtcccaaaccagagtgaatattaatgctgccttggttgaggatataatcaacttggaagaggtgaatgaagaaatgaagtctgtgatagaagctctcaaggataatttcaataagactctcaatataaggacctcaccaggatcccttgacaagattgctgtggtaactgctgacgggaagcttgctttaaaccagattagccagatctccatgaagtcgccacagctgattttggtgaatatggccagcttcccagaggaattggcctggattaggagtcttagagtacctggaatccggtcccatctctaccaccaactggctgtttgaccttgggcaagttgcttcactctctgggcctccatttcctcatctgctaatataagtgtacagctgcagctatcaaggctataagagaaagtggaatgaatctgaacccagaagtggaagggacgctaattcgggtacccattccccaagtaaccagagagcacagagaaatgctggtgaaactggccaaacagaacaccaacaaggccaaagactctttacggaaggttcgcaccaactcaatgaacaagc

SEQ ID NO: 154694 - DNA, 1186 bp, Homo sapiens
  Payload ID: 10409
  Gene Symbol: MRRF
  Gene Name: mitochondrial ribosome recycling factor
  Uniprot ID: Q96E11
  ENST ID: ENST00000470366
  CDS Start-End: 42-548
tgggcgatagctgtggatgtttccaaggattgtcttcagtcatggccttgggattaaagtgcttccgcatggtccaccctacctttcgcaattatcttgcagcctctatcagacccgtttcagaagttacactgaagacagtgcatgaaagacaacatggccataggcaatacatggcctattcagctgtaccagtccgccattttgctaccaagaaagccaaagccaaagggaaaggacagtcccaaaccagagtgaatattaatgctgccttggttgaggatataatcaacttggaagaggtgaatgaagaaatgaagtctgtgatagaagctctcaaggataatttcaataagactctcaatataaggacctcaccaggatcccttgacaagattgctgtggtaactgctgacgggaagcttgctttaaaccagattagccagatctccatgaagtcgccacagctgattttggtgaatatggccagcttcccagagactatgaagcaaataaaacaatactttaatgggccaaatgtggcctgagggccaccaatttgtgacctctgcattagtatttggagcagaccctccaggaagtccttttatactagactgaccattgcagaatattgcatggagcacagtgcttccaaaactggaaggaattggcctggattaggagtcttagagtacctggaatccggtcccatctctaccaccaactggctgtttgaccttgggcaagttgcttcactctctgggcctccatttcctcatctgctaatataagtgtacagctgcagctatcaaggctataagagaaagtggaatgaatctgaacccagaagtggaagggacgctaattcgggtacccattccccaagtaaccagagagcacagagaaatgctggtgaaactggccaaacagaacaccaacaaggccaaagactctttacggaaggttcgcaccaactcaatgaacaagctgaagaaatccaaggatacagtctcagaggacaccattaggctaatagagaaacagatcagccaaatggccgatgacacagtggcagaactggacaggcatctggcagtgaagaccaaagaactccttggatgaaagtccactggggccagcaatactccagagcccagtttctgctggatcccatgggtggcac

SEQ ID NO: 154695 - DNA, 1599 bp, Homo sapiens
  Payload ID: 10409
  Gene Symbol: MRRF
  Gene Name: mitochondrial ribosome recycling factor
  Uniprot ID: Q96E11
  ENST ID: ENST00000489572
  CDS Start-End: 45-551
gtcttattctttttagtggatgtttccaaggattgtcttcagtcatggccttgggattaaagtgcttccgcatggtccaccctacctttcgcaattatcttgcagcctctatcagacccgtttcagaagttacactgaagacagtgcatgaaagacaacatggccataggcaatacatggcctattcagctgtaccagtccgccattttgctaccaagaaagccaaagccaaagggaaaggacagtcccaaaccagagtgaatattaatgctgccttggttgaggatataatcaacttggaagaggtgaatgaagaaatgaagtctgtgatagaagctctcaaggataatttcaataagactctcaatataaggacctcaccaggatcccttgacaagattgctgtggtaactgctgacgggaagcttgctttaaaccagattagccagatctccatgaagtcgccacagctgattttggtgaatatggccagcttcccagagactatgaagcaaataaaacaatactttaatgggccaaatgtggcctgagggccaccaatttgtgacctctgcattagtatttggagcagaccctccaggaagtccttttatactagactgaccattgcagaatattgcatggagcacagtgcttccaaaactggaaggaattggcctggattaggagtcttagagtacctggaatccggtcccatctctaccaccaactggctgtttgaccttgggcaagttgcttcactctctgggcctccatttcctcatctgctaatataagtgtacagctgcagctatcaaggctataagagaaagtggaatgaatctgaacccagaagtggaagggacgctaattcgggtacccattccccaagtaaccagagagcacagagaaatgctggtgaaactggccaaacagaacaccaacaaggccaaagactctttacggaaggttcgcaccaactcaatgaacaagctgaagaaatccaaggatacagtctcagaggacaccattaggctaatagagaaacagatcagccaaatggccgatgacacagtggcagaactggacaggcatctggcagtgaagaccaaagaactccttggatgaaagtccactggggccagcaatactccagagcccagtttctgctggatcccatgggtggcacattgggacttctctccctcccccatctacacagaagactgtcaccatgctgacagaagcctgtccttgtaaggcccagccttccaggggaacactcagacatgttcattctcttcctgcttctgctctgggccggtgggtggctctcagaaaatacttgctgctggcaaaaggcctgtactcaggcatttgctttgacttgatgttgccaagggactgaggccattggcaggcttagtaccacctgctcctcatcttaggagtctccttttcaaataattaggctctgttcccattttaaaactctgatattggccttcacctgtgactggacactttactagaggcccattttcactaaacaataaaatctaaataaattggaaggaataacaaccacaaaggaaagaa

SEQ ID NO: 154696 - DNA, 1560 bp, Homo sapiens
  Payload ID: 10410
  Gene Symbol: MTG1
  Gene Name: mitochondrial ribosome-associated GTPase 1
  Uniprot ID: Q9BT17
  ENST ID: ENST00000317502
  CDS Start-End: 51-1055
gcggcgcagaggaggtcagctgcgggagcgtttccggggacggtgccgccatgagattgaccccgcgcgcgctgtgcagcgccgcccaggccgcctggcgggagaacttccccctgtgcggtcgcgacgtggcgcgctggttcccgggccacatggccaaggggctgaagaagatgcagagcagcctgaagctggtggactgtatcatcgaggtccacgatgcccggatcccactttcaggccgcaaccctctgtttcaggaaacccttgggcttaagcctcacttgctggtcctcaacaagatggacttggcggatcttacagagcagcagaaaattatgcaacacttagaaggagaaggcctaaaaaatgtcatttttaccaactgtgtaaaggatgaaaatgtcaagcagatcatcccgatggtcactgaactgattgggagaagccaccgctaccaccgaaaagagaacctggagtactgtatcatggtcattggggtccccaacgtgggcaagtcctccctcatcaactccctccggaggcagcacctcaggaaagggaaagccaccagggtgggtggcgagcctgggatcaccagagctgtgatgtccaaaattcaggtctctgagcggcccctgatgttcctgttggacactcctggcgtgctggctcctcggattgaaagtgtggagacaggcctgaagctggccctgtgtggaacggtgctggaccacctggtcggggaggagaccatggctgactacctgctgtacaccctcaacaaacaccagcgctttgggtacgtgcagcactacggcctgggcagtgcctgtgacaacgtagagcgcgtgctgaagagtgtggctgtgaagctggggaagacgcagaaggtgaaggtgctcacgggcacgggtaacgtgaacattattcagcctaactatcctgcggcagcccgtgacttcctgcagactttccgccgtgggctgctgggttccgtgatgctggacctcgacgtcctgcggggccaccccccggctgagactttgccctgaacttgtccgggtagggagggccggaggcatgtggcctcccagacctcctgacctgggtggttgaggctcaagacagctcacccggtccagaagctccatgctggtcactagggtgctgtgctctctggcgccccacagcctggccagctccagggaccccagttgcagggcccaagcaggtgggagtggacaccaggcttcccagtggacgtccctgagcagctccgcatgcttggttctcccggagcttcctgctcaggcctcttgagaaatggatgctgtctcagaaggagttaaagctataacctgtaacctttaaaatctccagttaaagggcctgtttcttactggcctgtgaggtgcaccgtagtgccttgggcctgtgtgttaaagctgctctcaccagtgaaacctaagaaatgagcaggttggcagctagggtttgtgttggaggctttcggtccagtgtcttgcagtcctacaacaagtgagaggcttgctgcca

SEQ ID NO: 154697 - DNA, 953 bp, Homo sapiens
  Payload ID: 10410
  Gene Symbol: MTG1
  Gene Name: mitochondrial ribosome-associated GTPase 1
  ENST ID: ENST00000432508
  CDS Start-End: 48-899
gcgcagaggaggtcagctgcgggagcgtttccggggacggtgccgccatgagattgaccccgcgcgcgctgtgcagcgccgcccaggccgcctggcgggagaacttccccctgtgcggtcgcgacgtggcgcgctggttcccgggccacatggccaaggggctgaagaagatgcagagcagcctgaagctggtggactgtatcatcgaggtccacgatgcccggatcccactttcaggccgcaaccctctgtttcaggaaacccttgggcttaagcctcacttgctggtcctcaacaagatggacttggcggatcttacagagcagcagaaaattatgcaacacttagaaggagaaggcctaaaaaatgtcatttttaccaactgtgtaaaggatgaaaatgtcaagcagatcatcccgatggtcactgaactgattgggagaagccaccgctaccaccgaaaagaggtctctgagcggcccctgatgttcctgttggacactcctggcgtgctggctcctcggattgaaagtgtggagacaggcctgaagctggccctgtgtggaacggtgctggaccacctggtcggggaggagaccatggctgactacctgctgtacaccctcaacaaacaccagcgctttgggtacgtgcagcactacggcctgggcagtgcctgtgacaacgtagagcgcgtgctgaagagtgtggctgtgaagctggggaagacgcagaaggtgaaggtgctcacgggcacgggtaacgtgaacattattcagcctaactatcctgcggcagcccgtgacttcctgcagactttccgccgtgggctgctgggttccgtgatgctggacctcgacgtcctgcggggccaccccccggctgagactttgccctgaacttgtccgggtagggagggccggaggcatgtggcctcccagacctcctgacct

SEQ ID NO: 154698 - DNA, 1283 bp, Homo sapiens
  Payload ID: 10410
  Gene Symbol: MTG1
  Gene Name: mitochondrial ribosome-associated GTPase 1
  ENST ID: ENST00000477902
  CDS Start-End: 103-984
gtggtgcggccccttggagcgccggaagcccgcagtgccggaggcccgcagcgccggaacctcagaggcgggtcgcagcggcgcagaggagggctgaagaagatgcagagcagcctgaagctggtggactgtatcatcgaggtccacgatgcccggatcccactttcaggccgcaaccctctgtttcaggaaacccttgggcttaagcctcacttgctggtcctcaacaagatggacttggcggatcttacagagcagcagaaaattatgcaacacttagaaggagaaggcctaaaaaatgtcatttttaccaactgtgtaaaggatgaaaatgtcaagcagatcatcccgatggtcactgaactgattgggagaagccaccgctaccaccgaaaagagaacctggagtactgtatcatggtcattggggtccccaacgtgggcaagtcctccctcatcaactccctccggaggcagcacctcaggaaagggaaagccaccagggtgggtggcgagcctgggatcaccagagctgtgatgtccaaaattcaggtctctgagcggcccctgatgttcctgttggacactcctggcgtgctggctcctcggattgaaagtgtggagacaggcctgaagctggccctgtgtggaacggtgctggaccacctggtcggggaggagaccatggctgactacctgctgtacaccctcaacaaacaccagcgctttgggtacgtgcagcactacggcctgggcagtgcctgtgacaacgtagagcgcgtgctgaagagtgtggctgtgaagctggggaagacgcagaaggtgaaggtgctcacgggcacgggtaacgtgaacattattcagcctaactatcctgcggcagcccgtgacttcctgcagactttccgccgtgggctgctgggttccgtgatgctggacctcgacgtcctgcggggccaccccccggctgagactttgccctgaacttgtccgggtagggagggccggaggcatgtggcctcccagacctcctgacctgggtggttgaggctcaagacagctcacccggtccagaagctccatgctggtcactagggtgctgtgctctctggcgccccacagcctggccagctccagggaccccagttgcagggcccaagcaggtgggagtggacaccaggcttcccagtggacgtccctgagcagctccgcatgcttggttctcccggagcttcctgctcaggcctcttgagaaatggatgctgtctcagaaggagttaaag

SEQ ID NO: 154699 - DNA, 2929 bp, Homo sapiens
  Payload ID: 10411
  Gene Symbol: MTG2
  Gene Name: mitochondrial ribosome-associated GTPase 2
  Uniprot ID: Q9H4K7
  ENST ID: ENST00000370823
  CDS Start-End: 19-1239
ctttcccgagccggggccatggcacctgcaaggtgtttctcagcaagattgaggaccgtgtttcagggcgtggggcattgggctttgtccacatgggctggcctgaagcccagccggctactgccacagcgggcttctcccaggctgctctcggtcggccgtgcggacctcgccaagcatcaggaactcccggggaagaagctgctctctgagaaaaagctgaaaaggtactttgtggactatcggagagtgcttgtctgtggaggaaacggaggcgctggggcaagctgcttccacagtgagccccgcaaggagtttggaggccctgatggaggggacggaggcaacggtggacacgtcattctgagagttgaccagcaagtcaagtccctgtcgtcggtcctgtcgcggtaccagggtttcagtggagaagatggagggagtaaaaactgcttcgggcgcagtggcgccgtcctctacatccgggtccccgtgggcacgctggtgaaggagggaggcagagttgtggccgacctgtcttgcgtgggagatgagtacattgccgcgctgggcggggcaggagggaaaggcaaccgcttcttcctggccaacaacaaccgtgcccctgtgacctgtacccctggacagccaggacagcagcgagttctccacctggagctcaagacggtggcccacgccggaatggtgggattccccaacgccgggaagtcctcactgctccgggccatttcaaacgccagacccgccgtggcttcctacccgttcaccaccctgaagccccacgtcgggatcgtccactacgaaggccacctacaaatagcagtggccgacatccccggcatcatacgaggcgcccaccagaacaggggtctggggtccgccttcctcaggcacatcgagcgctgccgctttctcttgttcgtggtggatctttctcagcctgagccgtggactcaagttgacgatttaaaatatgaactggagatgtatgaaaagggcctgtctgcgaggccccacgcaatcgtcgcaaacaagattgacctccctgaagcccaagccaatctgtcccagctccgggatcacttgggacaggaggtcatcgtgctgtcggcgttgaccggcgagaacctggagcagctgctgttgcacctgaaggtgctgtatgacgcctacgcggaggccgagctgggccagggccgccagccgctcaggtggtagccacgccagagcggggtcgcctctgggcctctgtctgagcaaacctgggtgtgaattcggtggttttgaatgcataaagtgccttgtggacacgggggagttgtggtgcttctgggtctctgggccccgcctgctggcctgagatgccctcatgttgggaagcattccgtgccccctaccccgcctgccctccgtatttcctgcacctgtcagcctgcaccgactgatgagccagttgctcatttgtgctgattaacacccctaataaggggttggggtgcccataacggggtggccctgccgctgactcaggtctccgccatgcacgcgtggactctcggatgagctcagcagaaccgcacagccagagccccaggtcagaagtgcagaccagggttctcagcacagtgcccgtcgtgcttccatggcttgctacggagagagacctctggatccacactggggctgcgtctggcccgttgtccagcagccctgcggtaccgcaagcccaggcaccagtgtctcggggggcctcactgctgcgcaaggggtggggccgaggatgcaagtccaggcagagcggcgcaggcagctgtgagcttttctccatcagccgtctgagaagagcagtgaggccagctgcttcctgtccttcagaacacttctctgtgctcagtgggagccaggaagcctcaggcttcacgactgaatgcacccaatatccgacctggctgcgtgtttctggctgggctgccgtgtgcacagcaagttaactagaggggctgtgggccatggaactgtcagcgttattctcagaaggcggccgtggcatgggcagggtatagtgaggagtggaaggagacgtgtgcctggtaatatggggcggaatttccactcagctccatttgctggggatttaaagagaacccttgtgctacgccaggcagttaccgagccgaagggagatgatgggccttcgcccctcagtgggatggcagctgagggggccctgcatttgaccgtcgagactgcagcagcgcctttcctgtctgtggtttaagtctttgcagtcaagtactgatgcatccaagccaggcccatgcctggtgtctccctgactgcagaggagccccagggcaaggacagctcagctgctggcagcctgcctggcccatagacatcccccaagtagtctcaggcctctgacatgtccctgaggggcccctaagaaagaaagtggaggggacactccagaggctgtcgtgggaggatcatgtgagcctgggaggtcaaggctgcagtgagccgtgattgcaccactgcactccagcctgagtgacagagcgagaccctgtctcaaaaaacaaacaaacaaacaaacaaaaacagaacattctgggcacggtggctcatgcctgtagtcccagcactttgggaggccgaggctggtggatcacaaggtcaggagattgagaccatcctggctaacacagtgaaaccccgtctctactaaaaatacaaaaaaattagccaggcgtggtggcggtcacctgtagtcccagctactcgggaggctgaagcaggagaatggcgtgaacctgggaggcggagcttgcagtgagccgagatcacaccactgcactccagcctgagcgacagagcaagactccatctcaaaaaaaaaaaaaaa

SEQ ID NO: 154700 - DNA, 727 bp, Homo sapiens
  Payload ID: 10411
  Gene Symbol: MTG2
  Gene Name: mitochondrial ribosome-associated GTPase 2
  ENST ID: ENST00000448254
  CDS Start-End: 29-727
cgagccgatatttttgacgtgaggggccatggcacctgcaaggtgtttctcagcaagattgaggaccgtgtttcagggcgtggggcattgggctttgtccacatgggctggcctgaagcccagccggctactgccacagcgggcttctcccaggctgctctcggtcggccgtgcggacctcgccaagcatcaggaactcccggggaagaagctgctctctgagaaaaagctgaaaaggtactttgtggactatcggagagtgcttgtctgtggaggaaacggaggcgctggggcaagctgcttccacagtgagccccgcaaggagtttggaggccctgatggaggggacggaggcaacggtggacacgtcattctgagagttgaccagcaagtcaagtccctgtcgtcggtcctgtcgcggtaccagggtttcagtggagaagatggagggagtaaaaactgcttcgggcgcagtggcgccgtcctctacatccgggtccccgtgggcacgctggtgaaggagggaggcagagttgtggccgacctgtcttgcgtgggagatgagtacattgccgcgctgggcggggcaggagggaaaggcaaccgcttcttcctggccaacaacaaccgtgcccctgtgacctgtacccctggacagccaggacagcagcgagttctccacctggagctcaagacggtggcccacgccggaatggtgggattcccc

SEQ ID NO: 154701 - DNA, 2814 bp, Homo sapiens
  Payload ID: 10411
  Gene Symbol: MTG2
  Gene Name: mitochondrial ribosome-associated GTPase 2
  ENST ID: ENST00000467101
  CDS Start-End: 20-439
gctttcccgagccggggccatggcacctgcaaggtgtttctcagcaagattgaggaccgtgtttcagggcgtggggcattgggctttgtccacatgggctggcctgaagcccagccggctactgccacagcgggcttctcccaggctgctctcggtcggccgtgcggacctcgccaagcatcaggaactcccggggaagaagctgctctctgagaaaaagctgaaaaggtactttgtggactatcggagagtgcttgtctgtggaggaaacggaggcgctggggcaagctgcttccacagtgagccccgcaaggagtttggaggccctgatggaggggacggaggcaacggtggacacgtcattctgagaggtccccgtgggcacgctggtgaaggagggaggcagagttgtggccgacctgtcttgcgtgggagatgagtacattgccgcgctgggcggggcaggagggaaaggcaaccgcttcttcctggccaacaacaaccgtgcccctgtgacctgtacccctggacagccaggacagcagcgagttctccacctggagctcaagacggtggcccacgccggaatggtgggattccccaacgccgggaagtcctcactgctccgggccatttcaaacgccagacccgccgtggcttcctacccgttcaccaccctgaagccccacgtcgggatcgtccactacgaaggccacctacaaatagcagtggccgacatccccggcatcatacgaggcgcccaccagaacaggggtctggggtccgccttcctcaggcacatcgagcgctgccgctttctcttgttcgtggtggatctttctcagcctgagccgtggactcaagttgacgatttaaaatatgaactggagatgtatgaaaagggcctgtctgcgaggccccacgcaatcgtcgcaaacaagattgacctccctgaagcccaagccaatctgtcccagctccgggatcacttgggacaggaggtcatcgtgctgtcggcgttgaccggcgagaacctggagcagctgctgttgcacctgaaggtgctgtatgacgcctacgcggaggccgagctgggccagggccgccagccgctcaggtggtagccacgccagagcggggtcgcctctgggcctctgtctgagcaaacctgggtgtgaattcggtggttttgaatgcataaagtgccttgtggacacgggggagttgtggtgcttctgggtctctgggccccgcctgctggcctgagatgccctcatgttgggaagcattccgtgccccctaccccgcctgccctccgtatttcctgcacctgtcagcctgcaccgactgatgagccagttgctcatttgtgctgattaacacccctaataaggggttggggtgcccataacggggtggccctgccgctgactcaggtctccgccatgcacgcgtggactctcggatgagctcagcagaaccgcacagccagagccccaggtcagaagtgcagaccagggttctcagcacagtgcccgtcgtgcttccatggcttgctacggagagagacctctggatccacactggggctgcgtctggcccgttgtccagcagccctgcggtaccgcaagcccaggcaccagtgtctcggggggcctcactgctgcgcaaggggtggggccgaggatgcaagtccaggcagagcggcgcaggcagctgtgagcttttctccatcagccgtctgagaagagcagtgaggccagctgcttcctgtccttcagaacacttctctgtgctcagtgggagccaggaagcctcaggcttcacgactgaatgcacccaatatccgacctggctgcgtgtttctggctgggctgccgtgtgcacagcaagttaactagaggggctgtgggccatggaactgtcagcgttattctcagaaggcggccgtggcatgggcagggtatagtgaggagtggaaggagacgtgtgcctggtaatatggggcggaatttccactcagctccatttgctggggatttaaagagaacccttgtgctacgccaggcagttaccgagccgaagggagatgatgggccttcgcccctcagtgggatggcagctgagggggccctgcatttgaccgtcgagactgcagcagcgcctttcctgtctgtggtttaagtctttgcagtcaagtactgatgcatccaagccaggcccatgcctggtgtctccctgactgcagaggagccccagggcaaggacagctcagctgctggcagcctgcctggcccatagacatcccccaagtagtctcaggcctctgacatgtccctgaggggcccctaagaaagaaagtggaggggacactccagaggctgtcgtgggaggatcatgtgagcctgggaggtcaaggctgcagtgagccgtgattgcaccactgcactccagcctgagtgacagagcgagaccctgtctcaaaaaacaaacaaacaaacaaacaaaaacagaacattctgggcacggtggctcatgcctgtagtcccagcactttgggaggccgaggctggtggatcacaaggtcaggagattgagaccatcctggctaacacagtgaaaccccgtctctactaaaaatacaaaaaaattagccaggcgtggtggcggtcacctgtagtcccagctactcgggaggctgaagcaggagaatggcgtgaacctgggaggcggagcttgcagtgagccgagatcacaccactgcactccagcctgagcgacagagcaagactccatctcaaaaaaaaaaaaaaa

SEQ ID NO: 154702 - DNA, 1857 bp, Homo sapiens
  Payload ID: 10412
  Gene Symbol: MRM1
  Gene Name: mitochondrial rRNA methyltransferase 1
  Uniprot ID: Q6IN84
  ENST ID: ENST00000611231
  CDS Start-End: 240-1301
ggcgggctcccgaacccggaagcgagggacccacgtgggagcctgggagcgggtggtcgtagctcggtagtccagttgtgggtaatcggggctgtttgttcctgtccgagagagctcggcggagacggctgtcgagtacccttcacctcggtgttgggagcctgggagcgaactgcggcgcgggttaccgctcccggggacgcagcaaggggcatcgagtccctggcgggagctgcgccatggcattgctctcgaccgtccggggcgcgacctggggtcgcctcgtcacccgtcatttctcccatgcagcgcggcatggggagcggcctggtggggaggagctaagccgcttgctgctggatgacctggtgccgacctctcggctggagcttctgtttggcatgaccccgtgtctcctggctctgcaggccgcccgccgctctgtggcccggctcctgctccaggcgggtaaagctgggctgcaggggaagcgggccgagctgctccggatggccgaggcgcgggacattccagttctgcggcccagacggcagaaactggacacaatgtgccgctaccaggtccaccagggtgtctgcatggaggtgagcccgctgcggccccggccttggagagaggccggggaggcgagcccaggcgacgacccccagcagttgtggctcgtcctcgatgggatccaggatccccggaattttggggctgtgctgcgttccgcacacttcctcggagtggataaggtcatcaccagccggagaaacagctgcccgctcactccagtagtcagcaagtccagcgcgggggctatggaggtgatggacgtgttctccactgatgacctcaccggatttttacagaccaaagcccagcagggctggctcgtggccggcacggtgggctgcccaagcacagaggatccccagtcctccgagatccccatcatgagttgcttggagttcctctgggaacggcctactctccttgtgctggggaatgagggctcaggtctatcccaggaggtgcaggcctcctgccagcttctcctcaccatcctgccccggcgccagctgcctcctggacttgagtccttgaacgtctctgtggctgcaggaattcttcttcactccatttgcagccagaggaagggtttccccacagagggggagagaaggcagcttctccaagacccccaagaaccctcagccaggtctgaagggctcagcatggctcagcacccagggctgtcttcaggcccagagaaagagaggcaaaatgagggctgacgtggactgtccacagtgttcatgtgctggagtcagggacggccgcacctgcctccgccggctccagtgtgcggggagcctctgcctgagtgtgcaccaggcccatgtttattgaccacagtctgagggggggggaaggggactgcggtggacaccagaggaagctgtttcctgttgtgatgttggacctgtagtaggacatggtgatttgttaatttccatgggaagccatgatggcctagcatggagggaatctgttcccaggccctgcctggaagttgagggaaagtttagacatctgcagagaggcaggcagcccagcccaggggacccgttcctcttgaaccagtcattgcctgtggcaaatgtgtgtatgagaatgtggggggtggagggcggggccctgatgtggagtagacagtgcgcacctcaggcccacacacggccccgccctggggccttgagcgcaggcctcatctttctgtgccgcgggactctgcacctacctcacagggttgttgtgaggctcaaataaaacatcactcagcacgtggga

SEQ ID NO: 154703 - DNA, 1857 bp, Homo sapiens
  Payload ID: 10412
  Gene Symbol: MRM1
  Gene Name: mitochondrial rRNA methyltransferase 1
  Uniprot ID: Q6IN84
  ENST ID: ENST00000614766
  CDS Start-End: 240-1301
ggcgggctcccgaacccggaagcgagggacccacgtgggagcctgggagcgggtggtcgtagctcggtagtccagttgtgggtaatcggggctgtttgttcctgtccgagagagctcggcggagacggctgtcgagtacccttcacctcggtgttgggagcctgggagcgaactgcggcgcgggttaccgctcccggggacgcagcaaggggcatcgagtccctggcgggagctgcgccatggcattgctctcgaccgtccggggcgcgacctggggtcgcctcgtcacccgtcatttctcccatgcagcgcggcatggggagcggcctggtggggaggagctaagccgcttgctgctggatgacctggtgccgacctctcggctggagcttctgtttggcatgaccccgtgtctcctggctctgcaggccgcccgccgctctgtggcccggctcctgctccaggcgggtaaagctgggctgcaggggaagcgggccgagctgctccggatggccgaggcgcgggacattccagttctgcggcccagacggcagaaactggacacaatgtgccgctaccaggtccaccagggtgtctgcatggaggtgagcccgctgcggccccggccttggagagaggccggggaggcgagcccaggcgacgacccccagcagttgtggctcgtcctcgatgggatccaggatccccggaattttggggctgtgctgcgttccgcacacttcctcggagtggataaggtcatcaccagccggagaaacagctgcccgctcactccagtagtcagcaagtccagcgcgggggctatggaggtgatggacgtgttctccactgatgacctcaccggatttttacagaccaaagcccagcagggctggctcgtggccggcacggtgggctgcccaagcacagaggatccccagtcctccgagatccccatcatgagttgcttggagttcctctgggaacggcctactctccttgtgctggggaatgagggctcaggtctatcccaggaggtgcaggcctcctgccagcttctcctcaccatcctgccccggcgccagctgcctcctggacttgagtccttgaacgtctctgtggctgcaggaattcttcttcactccatttgcagccagaggaagggtttccccacagagggggagagaaggcagcttctccaagacccccaagaaccctcagccaggtctgaagggctcagcatggctcagcacccagggctgtcttcaggcccagagaaagagaggcaaaatgagggctgacgtggactgtccacagtgttcatgtgctggagtcagggacggccgcacctgcctccgccggctccagtgtgcggggagcctctgcctgagtgtgcaccaggcccatgtttattgaccacagtctgggggggggggaaggggactgcggtggacaccagaggaagctgtttcctgttgtgatgttggacctgtagtaggacatggtgatttgttaatttccatgggaagccatgatggcctagcatggagggaatctgttcccaggccctgcctggaagttgagggaaagtttagacatctgcagagaggcaggcagcccagcccaggggacccgttcctcttgaaccagtcattgcctgtggcaaatgtgtgtatgagaatgtggggggtggagggcggggccctgatgtggagtagacagtgcgcacctcaggcccacacacggccccgccctggggccttgagcgcaggcctcatctttctgtgccgcgggactccgcacctacctcacagggttgttgtgaggctcaaataaaacatcactcagcacgtggga

SEQ ID NO: 154704 - DNA, 1284 bp, Homo sapiens
  Payload ID: 10412
  Gene Symbol: MRM1
  Gene Name: mitochondrial rRNA methyltransferase 1
  ENST ID: ENST00000612760
  CDS Start-End: 259-735
ttctgtttggcatgaccccgtgtctcctggctctgcaggccgcccgccgctctgtggcccggctcctgctccaggcgggtaaagctgggctgcaggggaagcgggccgagctgctccggatggccgaggcgcgggacattccagttctgcggcccagacggcagaaactggacacaatgtgccgctaccaggtccaccagggtgtctgcatggagctgcccgctcactccagtagtcagcaagtccagcgcgggggctatggaggtgatggacgtgttctccactgatgacctcaccggatttttacagaccaaagcccagcagggctggctcgtggccggcacggtgggctgcccaagcacagaggatccccagtcctccgagatccccatcatgagttgcttggagttcctctgggaacggcctactctccttgtgctggggaatgagggctcaggtctatcccaggaggtgcaggcctcctgccagcttctcctcaccatcctgccccggcgccagctgcctcctggacttgagtccttgaacgtctctgtggctgcaggaattcttcttcactccatttgcagccagaggaagggtttccccacagagggggagagaaggcagcttctccaagacccccaagaaccctcagccaggtctgaagggctcagcatggctcagcacccagggctgtcttcaggcccagagaaagagaggcaaaatgagggctgacgtggactgtccacagtgttcatgtgctggagtcagggacggccgcacctgcctccgccggctccagtgtgcggggagcctctgcctgagtgtgcaccaggcccatgtttattgaccacagtctgggggggggggaaggggactgcggtggacaccagaggaagctgtttcctgttgtgatgttggacctgtagtaggacatggtgatttgttaatttccatgggaagccatgatggcctagcatggagggaatctgttcccaggccctgcctggaagttgagggaaagtttagacatctgcagagaggcaggcagcccagcccaggggacccgttcctcttgaaccagtcattgcctgtggcaaatgtgtgtatgagaatgtggggggtggagggcggggccctgatgtggagtagacagtgcgcacctcaggcccacacacggccccgccctggggccttgagcgcaggcctcatctttctgtgccgcgggactccgcacctacctcacagggttgttgtgaggctcaaataaaacatcactcagca

SEQ ID NO: 154705 - DNA, 1284 bp, Homo sapiens
  Payload ID: 10412
  Gene Symbol: MRM1
  Gene Name: mitochondrial rRNA methyltransferase 1
  ENST ID: ENST00000631971
  CDS Start-End: 259-735
ttctgtttggcatgaccccgtgtctcctggctctgcaggccgcccgccgctctgtggcccggctcctgctccaggcgggtaaagctgggctgcaggggaagcgggccgagctgctccggatggccgaggcgcgggacattccagttctgcggcccagacggcagaaactggacacaatgtgccgctaccaggtccaccagggtgtctgcatggagctgcccgctcactccagtagtcagcaagtccagcgcgggggctatggaggtgatggacgtgttctccactgatgacctcaccggatttttacagaccaaagcccagcagggctggctcgtggccggcacggtgggctgcccaagcacagaggatccccagtcctccgagatccccatcatgagttgcttggagttcctctgggaacggcctactctccttgtgctggggaatgagggctcaggtctatcccaggaggtgcaggcctcctgccagcttctcctcaccatcctgccccggcgccagctgcctcctggacttgagtccttgaacgtctctgtggctgcaggaattcttcttcactccatttgcagccagaggaagggtttccccacagagggggagagaaggcagcttctccaagacccccaagaaccctcagccaggtctgaagggctcagcatggctcagcacccagggctgtcttcaggcccagagaaagagaggcaaaatgagggctgacgtggactgtccacagtgttcatgtgctggagtcagggacggccgcacctgcctccgccggctccagtgtgcggggagcctctgcctgagtgtgcaccaggcccatgtttattgaccacagtctgagggggggggaaggggactgcggtggacaccagaggaagctgtttcctgttgtgatgttggacctgtagtaggacatggtgatttgttaatttccatgggaagccatgatggcctagcatggagggaatctgttcccaggccctgcctggaagttgagggaaagtttagacatctgcagagaggcaggcagcccagcccaggggacccgttcctcttgaaccagtcattgcctgtggcaaatgtgtgtatgagaatgtggggggtggagggcggggccctgatgtggagtagacagtgcgcacctcaggcccacacacggccccgccctggggccttgagcgcaggcctcatctttctgtgccgcgggactctgcacctacctcacagggttgttgtgaggctcaaataaaacatcactcagca

SEQ ID NO: 154706 - DNA, 1353 bp, Homo sapiens
  Payload ID: 10413
  Gene Symbol: MECR
  Gene Name: mitochondrial trans-2-enoyl-CoA reductase
  Uniprot ID: Q9BV79
  ENST ID: ENST00000263702
  CDS Start-End: 27-1148
caggctctgtgttggttggagcgagcatgtgggtctgcagtaccctgtggcgggtgcgaacccccgcccggcagtggcgggggctgctcccagcttctggctgtcacggacctgccgcctcctcctactccgcatccgccgagcctgcccgggtccgggcgcttgtctatgggcaccacggggatccagccaaggtcgtcgaactcaagaacctggagctagctgctgtgagaggatcagatgtccgtgtgaagatgctggcggcccctatcaatccatctgacataaatatgatccaaggaaactacggattccttcctgaactgcctgctgttggagggaacgaaggtgttgcacaggtggtagcggtgggcagcaatgtgaccgggctgaagccaggagactgggtgattccagcaaatgctggtttaggaacctggcggaccgaggctgtgttcagcgaggaagcactgatccaagttccgagtgacatccctcttcagagcgctgccaccctgggtgtcaatccctgcacagcctacaggatgttgatggacttcgagcaactgcagccaggggattctgtcatccagaatgcatccaacagcggagtggggcaagcagtcatccagatcgccgcagccctgggcctaagaaccatcaatgtggtccgagacagacctgatatccagaagctgagtgacagactgaagagtctgggggctgagcatgtcatcacagaagaggagctaagaaggcccgaaatgaaaaacttctttaaggacatgccccagccacggcttgctctcaactgtgttggtgggaaaagctccacagagctgctgcggcagttagcgcgtggaggaaccatggtaacctatggggggatggccaagcagcccgtcgtagcctctgtgagcctgctcatttttaaggatctcaaacttcgaggcttttggttgtcccagtggaagaaggatcacagtccagaccagttcaaggagctgatcctcacactgtgcgatctcatccgccgaggccagctcacagcccctgcctgctcccaggtcccgctgcaggactaccagtctgccttggaagcctccatgaagcccttcatatcttcaaagcagattctcaccatgtgatcatcccaaaagagctggagtgacatgggaggggaggcggatctgaggggctgggtgcaggcccctcagttggggctcccaccttccccagactactgttctcctcactgcctcttcctattaggaggatggtgaagccagccacggttttccccagggccagccttaaggtatctaataaagtctgaactctcccttccaaaaa

SEQ ID NO: 154707 - DNA, 2416 bp, Homo sapiens
  Payload ID: 10413
  Gene Symbol: MECR
  Gene Name: mitochondrial trans-2-enoyl-CoA reductase
  Uniprot ID: Q9BV79
  ENST ID: ENST00000373791
  CDS Start-End: 374-1267
gtgttggttggagcgagcatgtgggtctgcagtaccctgtggcgggtgcgaacccccgcccggcagtggcgggggctgctcccagcttctggctgtcacggacctgccgcctcctcctactccgcatccgccgagcctgcccgggtccgggcgcttgtctatgggcaccacggggatccagccaaggtcgtcgaaaccgtaattcctgggcacacatggcagctcagaaatgttgcctgacctactttgaggagatgatttgagcgaaacacccattctagcctggatgacatgaacatctccgtttggctttgtgcttagactcaagaacctggagctagctgctgtgagaggatcagatgtccgtgtgaagatgctggcggcccctatcaatccatctgacataaatatgatccaaggaaactacggattccttcctgaactgcctgctgttggagggaacgaaggtgttgcacaggtggtagcggtgggcagcaatgtgaccgggctgaagccaggagactgggtgattccagcaaatgctggtttaggaacctggcggaccgaggctgtgttcagcgaggaagcactgatccaagttccgagtgacatccctcttcagagcgctgccaccctgggtgtcaatccctgcacagcctacaggatgttgatggacttcgagcaactgcagccaggggattctgtcatccagaatgcatccaacagcggagtggggcaagcagtcatccagatcgccgcagccctgggcctaagaaccatcaatgtggtccgagacagacctgatatccagaagctgagtgacagactgaagagtctgggggctgagcatgtcatcacagaagaggagctaagaaggcccgaaatgaaaaacttctttaaggacatgccccagccacggcttgctctcaactgtgttggtgggaaaagctccacagagctgctgcggcagttagcgcgtggaggaaccatggtaacctatggggggatggccaagcagcccgtcgtagcctctgtgagcctgctcatttttaaggatctcaaacttcgaggcttttggttgtcccagtggaagaaggatcacagtccagaccagttcaaggagctgatcctcacactgtgcgatctcatccgccgaggccagctcacagcccctgcctgctcccaggtcccgctgcaggactaccagtctgccttggaagcctccatgaagcccttcatatcttcaaagcagattctcaccatgtgatcatcccaaaagagctggagtgacatgggaggggaggcggatctgaggggctgggtgcaggcccctcagttggggctcccaccttccccagactactgttctcctcactgcctcttcctattaggaggatggtgaagccagccacggttttccccagggccagccttaaggtatctaataaagtctgaactctcccttccaaaaagtagaagtcatccctgtcgagaaggaccaacactgtgcactggtcagctcacagcaccaagaggcccccttcctgcttttctgtcatgtgttcccccagtaatcattttctgaccaccctgaaagcaaagcctgggtgggtactggcagtgcaaaggccagtaggccaccatccctggccccaagctgcacaagcccacagacgagggtcctgtagaacaaacgctttgatgtgcttctcaggtagcctgcggcccagtccagggcttggggaggatcagctgcatggaagagtgaatgccaggctgaggtcatcagggccctgaggaacttggacgtggggtcttcactctcatggaactgcccttctaactggagacatagacaatataccagtggttctcaaccagaggcaattttacccccaggagacatttgacaatgtctggggatatttctggctatcacagcttatgaaggaggttgctactggcatctagcaggcagagtgagtgctgctgttaaacccaccacaggacacagaacagtctactgcaacaaagaattacccaaggcctggcgcggtggctcacacctgtaatcccagcactttgggaagccaaggcaagcggatcacttgagcccaggagttcaaggtcaacctaggtaacgtggtgaaacaccatctctacaaaaaatacaaacattagccaggtatggtgctgtgcacctgtagtcccagctactcgggaggttgaggtgggaggatcacctgagcctgggaggtctagactgcagtgagccatgatcatgccactgcattccagcctaggcaacagagcaagaccctatatcaaaaaaaaaaaaaaaatctagccccaaatgttcaatgttcatgaggtcgttgataaaccgtgcattaaacaatctcacagtaattaccat

SEQ ID NO: 154708 - DNA, 915 bp, Homo sapiens
  Payload ID: 10413
  Gene Symbol: MECR
  Gene Name: mitochondrial trans-2-enoyl-CoA reductase
  ENST ID: ENST00000463412
  CDS Start-End: 1-639
gtgattccagcaaatgctggtttaggaacctggcggaccgaggctgtgttcagcgaggaagcactgatccaagttccgagtgacatccctcttcagagcgctgccaccctgggtgtcaatccctgcacagcctacaggatgttgatggacttcgagcaactgcagccaggggattctgtcatccagaatgcatccaacagcggagtggggcaagcagtcatccagatcgccgcagccctgggcctaagaaccatcaatgtggtccgagacagacctgatatccagaagctgagtgacagactgaagagtctgggggctgagcatgtcatcacagaagaggagctaagaaggcccgaaatgaaaaacttctttaaggacatgccccagccacggcttgctctcaactgtgttggtgggaaaagctccacagagctgctgcggcagttagcgcgtggaggaaccatggtaacctatggggggatggccaagcagcccgtcgtagcctctgtggtaagctgggtgcagagggaggcatgcctggagccgggccagacacctcagccaggccacatcccctggcacgacagctgtctaagcttaggcaatgccccgttcctggaggggagtctgtacccttaagcggtacctgaagttcttgccctcagagcccagcatgtccttcctgtgtctgcagagcctgctcatttttaaggatctcaaacttcgaggcttttggttgtcccagtggaagaaggatcacagtccagaccagttcaaggagctgatcctcacactgtgcgatctcatccgccgaggccagctcacagcccctgcctgctcccaggtcccgctgcaggactaccagtctgccttggaagcctccatgaagcccttcatatcttcaaagcagattct

SEQ ID NO: 154709 - DNA, 1997 bp, Homo sapiens
  Payload ID: 10414
  Gene Symbol: MTERF1
  Gene Name: mitochondrial transcription termination factor 1
  Uniprot ID: Q99551
  ENST ID: ENST00000351870
  CDS Start-End: 95-1294
ctagccgctccggaccccagaggcggaagtaaaagcgaactacagtggatgggtgcagttcaggagatagctgttctccagcctttctggagggatgcagagcctttccttaggacaaacaagcatttcaaaaggtttgaactacctaaccattatggcaccaggaaacctctggcatatgagaaataactttctctttggttcaagatgttggatgactcgattttcagcagaaaacatcttcaaatcagtttcatttaggctttttggtgtgaagtgtcataatacagacagtgagcctttgaaaaatgaggacctactgaaaaacttacttactatgggagtagatattgacatggcaaggaaacgacagcctggagtttttcataggatgattaccaatgagcaggacctgaagatgttccttctttccaaaggagctagcaaagaagtgatcgctagcatcatatcaagatatccacgagcaataacacgtactcccgagaatctttcaaaacggtgggatctgtggagaaagattgtgacatcagaccttgaaattgtaaatattttggaacgttctcctgaatccttttttcggtccaataacaacctaaacttagagaataatataaagttcctctactcagttggattgacccgtaaatgcctttgtcgattgttgaccaatgcccctcgtaccttctccaatagtcttgatctgaataaacagatggttgaatttttgcaggcagccggtttgtcattgggtcacaatgatcccgcagattttgtcagaaagataatttttaaaaacccttttatcttaattcagagcaccaagcgggtgaaagctaacattgaattcttacggtcaactttcaatttgaacagtgaggaactgctggttctgatatgtggtccaggagctgaaatcctagacctttccaatgactatgccagaagaagctacgcaaacatcaaagagaagctgttttctcttggatgtactgaagaagaggtacagaagtttgtcttaagctatccagatgtgatcttcttggcagagaaaaagtttaatgataaaatagactgcctcatggaagaaaacattagcatttcacaaataatcgaaaatcctcgggttctggattcaagcataagtactttaaaaagtcgaatcaaagaattggtaaatgctggctgtaacttgagtactttaaacatcactcttctatcttggagtaaaaaaagatatgaagctaaattgaaaaagttaagcagatttgcctaaggatgccaatgtttttaattctcaggaactgtgaatatgttatgccacattgcaaaagaattttgcagaagtgattaatttaaaatgttattaagggccttgagatggggagattatcctgaattactttggagggcctaatataattgtagggatctttaaaagttgaagagggaggcaaaagaggaggtcagagtgatcctgtataagaaagacaactacttttgaaggaagttaaaaggtggctttgaaggaggaagacaccttgagccaaggaatgaagggggcctgtaaaaaaagattgaaaaggcaaggaaacagattctccattagagtccccagaaaggaatgcagccttgctggcacctttttagcccagtgagatcaatgtcaaacttctgacccacagaaccataagatggtaaatttgtgttgttttaaaccactgagtcagtgataatttgctgaagaagcaaatagattaacatagcaactaagtagatgattagttgcattataggtgaagtcaaaaatacagtcctttagtaaagtctctatttcttccttttataagagtaattatatttaaaaaatctacctacccttctggaattgctaatgttagtgtttataaagtcttaaatgtgtgcataaaaaactaaatgtgaatataaaatctaaataaaggaatatgtttgcctaa

SEQ ID NO: 154710 - DNA, 1639 bp, Homo sapiens
  Payload ID: 10414
  Gene Symbol: MTERF1
  Gene Name: mitochondrial transcription termination factor 1
  ENST ID: ENST00000406735
  CDS Start-End: 228-1367
gtaaaagcgaactacagtggatgggtgcagttcaggagatagctgttctccagcctttctggagggatgcagagcctttccttaggacaaacaagaaagtactgatctgatttccagctgacgcattctgcccctttattccagtagaggtcagtcgagcatctggaagagaaaacaggctgttgaactatgcaagcatttcaaaaggtttgaactacctaaccattatggcaccaggaaacctctggcatatgagaaataactttctctttggttcaagatgttggatgactcgattttcagcagaaaacatcttcaaatcagtttcatttaggctttttggtgtgaagtgtcataatacagacagtgagcctttgaaaaatgaggacctactgaaaaacttacttactatgggagtagatattgacatggcaaggaaacgacagcctggagtttttcataggatgattaccaatgagcaggacctgaagatgttccttctttccaaaggagctagcaaagaagtgatcgctagcatcatatcaagatatccacgagcaataacacgtactcccgagaatctttcaaaacggtgggatctgtggagaaagattgtgacatcagaccttgaaattgtaaatattttggaacgttctcctgaatccttttttcggtccaataacaacctaaacttagagaataatataaagttcctctactcagttggattgacccgtaaatgcctttgtcgattgttgaccaatgcccctcgtaccttctccaatagtcttgatctgaataaacagatggttgaatttttgcaggcagccggtttgtcattgggtcacaatgatcccgcagattttgtcagaaagataatttttaaaaacccttttatcttaattcagagcaccaagcgggtgaaagctaacattgaattcttacggtcaactttcaatttgaacagtgaggaactgctggttctgatatgtggtccaggagctgaaatcctagacctttccaatgactatgccagaagaagctacgcaaacatcaaagagaagctgttttctcttggatgtactgaagaagaggtacagaagtttgtcttaagctatccagatgtgatcttcttggcagagaaaaagtttaatgataaaatagactgcctcatggaagaaaacattagcatttcacaaataatcgaaaatcctcgggttctggattcaagcataagtactttaaaaagtcgaatcaaagaattggtaaatgctggctgtaacttgagtactttaaacatcactcttctatcttggagtaaaaaaagatatgaagctaaattgaaaaagttaagcagatttgcctaaggatgccaatgtttttaattctcaggaactgtgaatatgttatgccacattgcaaaagaattttgcagaagtgattaatttaaaatgttattaagggccttgagatggggagattatcctgaattactttggagggcctaatataattgtagggatctttaaaagttgaagagggaggcaaaagaggaggtcagagtgatcctgtataagaaagacaactacttttgaaggaagttaaaaggtggctttgaaggaggaagacaccttgagcc

SEQ ID NO: 154711 - DNA, 554 bp, Homo sapiens
  Payload ID: 10414
  Gene Symbol: MTERF1
  Gene Name: mitochondrial transcription termination factor 1
  ENST ID: ENST00000442961
  CDS Start-End: 79-554
aaaagcgaactacagtggatgggtgcagttcagggtgagattgggaagagatagctgttctccagcctttctggagggatgcagagcctttccttaggacaaacaagcatttcaaaaggtttgaactacctaaccattatggcaccaggaaacctctggcatatgagaaataactttctctttggttcaagatgttggatgactcgattttcagcagaaaacatcttcaaatcagtttcatttaggctttttggtgtgaagtgtcataatacagacagtgagcctttgaaaaatgaggacctactgaaaaacttacttactatgggagtagatattgacatggcaaggaaacgacagcctggagtttttcataggatgattaccaatgagcaggacctgaagatgttccttctttccaaaggagctagcaaagaagtgatcgctagcatcatatcaagatatccacgagcaataacacgtactcccgagaatctttcaaaacggtgggatctgtggagaaagattgtgacatcagaccttgaaattgtaaatat

SEQ ID NO: 154712 - DNA, 720 bp, Homo sapiens
  Payload ID: 10414
  Gene Symbol: MTERF1
  Gene Name: mitochondrial transcription termination factor 1
  ENST ID: ENST00000425936
  CDS Start-End: 641-720
gttcagggtgagattgggaaggtggtgaggctgtgctttcctttctttttgttaagaagtgggtgtgggtgactgctgtacagtgcagccctttgcagatttgtctttggaggaggaagagggatggaaagagccttcggtgtggaattaccttggttttgagttaagaaagacccacctgggttcgaaccctaatgcttcagctagcgaaggcaggctagtatgggagctcggcgctgtttcagattttgtaattttaaggcttatgcctaccttttaaattgttgtggggagtaaagcgagacaatatatatgaagcacttagctttggtacaaaacgtattcgtgattccgctaccttttcccatcatatgtaggcatgtacttgccgttttcttttctgtatgtctgagaaatgttgtttgcaagaggtaatgcatctcacgagaacataatgcaacgagaacgttagctgggatcgatctcttattttgtattaggaaggcctgaaatattttgccttttttttgtgtgtgtgtgtcatttccagagatagctgttctccagcctttctggagggatgcagagcctttccttaggacaaacaagcatttcaaaaggtttgaactacctaaccattatggcaccaggaaacctctggcatatgagaaataactttctctttggttcaagatgttggatgactcgattttcagcaga

SEQ ID NO: 154713 - DNA, 581 bp, Homo sapiens
  Payload ID: 10414
  Gene Symbol: MTERF1
  Gene Name: mitochondrial transcription termination factor 1
  ENST ID: ENST00000456229
  CDS Start-End: 163-581
acagtggatgggtgcagttcaggagatagctgttctccagcctttctggagggatgcagagcctttccttaggacaaacaagaggtcagtcgagcatctggaagagaaaacaggctgttgaactatgcaagcatttcaaaaggtttgaactacctaaccattatggcaccaggaaacctctggcatatgagaaataactttctctttggttcaagatgttggatgactcgattttcagcagaaaacatcttcaaatcagtttcatttaggctttttggtgtgaagtgtcataatacagacagtgagcctttgaaaaatgaggacctactgaaaaacttacttactatgggagtagatattgacatggcaaggaaacgacagcctggagtttttcataggatgattaccaatgagcaggacctgaagatgttccttctttccaaaggagctagcaaagaagtgatcgctagcatcatatcaagatatccacgagcaataacacgtactcccgagaatctttcaaaacggtgggatctgtggagaaagattgtgacatcagaccttgaaattgtaaatatttt

SEQ ID NO: 154714 - DNA, 3882 bp, Homo sapiens
  Payload ID: 10414
  Gene Symbol: MTERF1
  Gene Name: mitochondrial transcription termination factor 1
  ENST ID: ENST00000419292
  CDS Start-End: 78-1217
agaggcggaagtaaaagcgaactacagtggatgggtgcagttcaggcatttcaaaaggtttgaactacctaaccattatggcaccaggaaacctctggcatatgagaaataactttctctttggttcaagatgttggatgactcgattttcagcagaaaacatcttcaaatcagtttcatttaggctttttggtgtgaagtgtcataatacagacagtgagcctttgaaaaatgaggacctactgaaaaacttacttactatgggagtagatattgacatggcaaggaaacgacagcctggagtttttcataggatgattaccaatgagcaggacctgaagatgttccttctttccaaaggagctagcaaagaagtgatcgctagcatcatatcaagatatccacgagcaataacacgtactcccgagaatctttcaaaacggtgggatctgtggagaaagattgtgacatcagaccttgaaattgtaaatattttggaacgttctcctgaatccttttttcggtccaataacaacctaaacttagagaataatataaagttcctctactcagttggattgacccgtaaatgcctttgtcgattgttgaccaatgcccctcgtaccttctccaatagtcttgatctgaataaacagatggttgaatttttgcaggcagccggtttgtcattgggtcacaatgatcccgcagattttgtcagaaagataatttttaaaaacccttttatcttaattcagagcaccaagcgggtgaaagctaacattgaattcttacggtcaactttcaatttgaacagtgaggaactgctggttctgatatgtggtccaggagctgaaatcctagacctttccaatgactatgccagaagaagctacgcaaacatcaaagagaagctgttttctcttggatgtactgaagaagaggtacagaagtttgtcttaagctatccagatgtgatcttcttggcagagaaaaagtttaatgataaaatagactgcctcatggaagaaaacattagcatttcacaaataatcgaaaatcctcgggttctggattcaagcataagtactttaaaaagtcgaatcaaagaattggtaaatgctggctgtaacttgagtactttaaacatcactcttctatcttggagtaaaaaaagatatgaagctaaattgaaaaagttaagcagatttgcctaaggatgccaatgtttttaattctcaggaactgtgaatatgttatgccacattgcaaaagaattttgcagaagtgattaatttaaaatgttattaagggccttgagatggggagattatcctgaattactttggagggcctaatataattgtagggatctttaaaagttgaagagggaggcaaaagaggaggtcagagtgatcctgtataagaaagacaactacttttgaaggaagttaaaaggtggctttgaaggaggaagacaccttgagccaaggaatgaagggggcctgtaaaaaaagattgaaaaggcaaggaaacagattctccattagagtccccagaaaggaatgcagccttgctggcacctttttagcccagtgagatcaatgtcaaacttctgacccacagaaccataagatggtaaatttgtgttgttttaaaccactgagtcagtgataatttgctgaagaagcaaatagattaacatagcaactaagtagatgattagttgcattataggtgaagtcaaaaatacagtcctttagtaaagtctctatttcttccttttataagagtaattatatttaaaaaatctacctacccttctggaattgctaatgttagtgtttataaagtcttaaatgtgtgcataaaaaactaaatgtgaatataaaatctaaataaaggaatatgtttgcctaatatagtttaaggaaatgataatcatttctgtgcattttgttggcatttcagctaatattaaagagtaattttcagaggcattgacttaaaaaatggcaaatcagataatgtcggtattttcaagatacaatctagctctgacataaactgaaagacgtgagacaaattatatgaccttaattttaattgttttccagaggcatttgttttctagatgtggtttttgaattaaataacataatggtgctcaaccttttaaacctcatttgctatcagtgatacttcaaaaaaccttattcctactattgataaaaacaatatgtctgcttttctaaggccatttatatattcaacgatactcctattataatttggttaactatttgatggcaagcatggcatagtttagaaagcaagagctttagagtgatgtatctgggcaccattcctgagtaacttgtgttaatgttttaaatttactaaacctgtttttctcatctgtaacaccagaaattgaccttccagagttggtaggaatcaaatgaaaaagcacctctaaggtttcttgcacatagtaatgatgcaatcagtgatagctataataaaaagatagtattttaaaaagcagctttatacataattcacatattcaatttacctatttaaagtctaacacagttcaatttatatatagagttgtgcaactttatcttccattgcttataatacatttataatttattggaaaatttataaggaaaatgaatttcttacagttatggaagctgagaaatcctaggttgaggggccacatctggtgagagccttcttgctggtggggactctgaagagtcctgaggcggcacagtgtatcacatggcgattgctaatgtacttaggtctcttttcctcttataaagccaccagtccactcccatgatagcctattaattcattaatccatgaatagattaatcaatttctgatgacatagcccttatgatccagtcacctcttaaaggccccacctctcaatactgccacattggggattaaatttcaacatgagttttggaggggatggatagtcaaaccatagcagcaaccatcaccacaatctagttttagaatatgtttgcagtcctaacagaaaccttgtacctgttagtgaatccccattatttccctccatttgttcccccaagcctaagcaaaaatgaatctgttttctgtgtctataaatttgtttattctgagcatttcatataaatggaatcatacagtatggtcttttgtgactggcttctttcacttagcatattttcaaggttcatccatgtagcacatattagtatttcattttttttggcaagtaatattccattgtatgggtacagtagtattgggaatacattttactgttatggcttaaagtattgatttcttaagtcttctgaattgtacgcgagtgttttctgaggtattgttttggaatctaacaagctcataagggacttgaaggaggtgggtagaagagataatagtttattgacatcagcagatcataggattgtagctgggctgatgagaaatggtatagcaacgatagttgcaagtggccagagagaatgtgggttgcactgaagtacagtacagcacttgatcattgggcagtaggggatgggggaaggaaaactttggagaaacaaacagataatgcctgtcaggcaaaattaacatgtcatactttaaggtttgagtctgatcaagggagagtcaattctttttttttaaagatagaattatagaaatattggccagccatgtaatcccagctcacgcctgtaatcccagcaatttgggaggccgaggtgggaggattgcttgagcccaggagttcaagaccagcctgggtaatactagcaagatatcattgctagtagggaaaaaaaaaaaaaaaaa

SEQ ID NO: 154715 - DNA, 1790 bp, Homo sapiens
  Payload ID: 10415
  Gene Symbol: MTERF2
  Gene Name: mitochondrial transcription termination factor 2
  Uniprot ID: Q49AM1
  ENST ID: ENST00000240050
  CDS Start-End: 367-1524
gattggccatgggcgaagggactgatggcctggttggcgctgctgagaactgtcgggagcttcttgagaccgaggaccgaaatcccggctccaggcctcggggactgcggactgtggggaggctggccggagagagagggaaggacggggcctggcccccgggactccctgtgccttgcttggagctgacgccgacggtttattgcagggaactgacaagatcacattttgagaagaagttggaaagaatcccaagtggatgaactgaatatctggatgaggacaagatctgtggggagagactgtaagatagaatgagtccatttaagtcccaggacggtggaaactagctagtagattgcagccatgttgtggaagctgctgctgagatcccagtcctgcaggctgtgttctttcagaaagatgcgatcacctccaaaatacagacctttcttagcatgcttcacctatacaactgataaacagtcgagcaaagaaaatacaagaacagtggaaaagctctataaatgttcagttgacattaggaaaattcgtagattaaaaggatgggtacttttagaggatgaaacctatgttgaagaaattgcgaatattttacaagaactaggtgccgatgagactgctgtagccagtattttggaacgctgcccggaagcaattgtctgtagtccaaccgctgttaacacccagagaaaactctggcagttggtctgcaaaaatgaggaagagttaatcaagttaatagagcagtttccagaatctttctttactattaaagaccaagagaaccagaagctgaatgttcagttctttcaagagttgggactaaaaaatgtggtcattagcagacttttgacagctgcacctaatgtttttcataatcctgttgagaagaataagcaaatggtaagaattctccaagagagttatctagatgtaggtggctctgaggccaacatgaaagtttggctactaaaattgttaagccaaaacccatttattttgttaaattctcccacagctataaaggaaacactagaatttctccaggagcaaggtttcaccagctttgaaattctccagcttctatccaaactcaaaggatttctttttcaactttgcccaagaagtatacagaatagtatttccttctctaaaaatgcttttaaatgcacagatcatgacctgaagcaattagttttgaaatgtcctgcccttttatattattctgttccagttttagaagagagaatgcaaggattattgagagaaggaatttccatagctcagataagagagacgccaatggttcttgaattaacaccacagatagtacagtacaggataaggaaactgaattcctcaggctacagaataaaggatggacatctagcaaatctaaatggatcaaaaaaagagtttgaagctaattttggcaaaattcaggccaaaaaagtaaggccattatttaaccctgtggcaccattaaatgttgaagaatgacatactgactgttgttgcttctttctagcagtgcagggtgaaactaactagcaaagacaaaaattcaggcagtttgtagacaccagtaattttaagaacctgcttagcttctgtgttgtatttaagttatctctaaatagataaattctgactcatgtgccatattataaaatataaatcatatttattttaataaggttggtaacttttaccttgaaccattatttcaaaaactcatatactattaaatggcatatcagtgtgat

SEQ ID NO: 154716 - DNA, 1763 bp, Homo sapiens
  Payload ID: 10415
  Gene Symbol: MTERF2
  Gene Name: mitochondrial transcription termination factor 2
  Uniprot ID: Q49AM1
  ENST ID: ENST00000392830
  CDS Start-End: 340-1497
gggactgatggcctggttggcgctgctgagaactgtcgggagcttcttgagaccgaggaccgaaatcccggctccaggcctcggggactgcggactgtggggaggctggccggagagagagggaaggacggggcctggcccccgggactccctgtgccttgcttggagctgacgccgacggggaactgacaagatcacattttgagaagaagttggaaagaatcccaagtggatgaactgaatatctggatgaggacaagatctgtggggagagactgtaagatagaatgagtccatttaagtcccaggacggtggaaactagctagtagattgcagccatgttgtggaagctgctgctgagatcccagtcctgcaggctgtgttctttcagaaagatgcgatcacctccaaaatacagacctttcttagcatgcttcacctatacaactgataaacagtcgagcaaagaaaatacaagaacagtggaaaagctctataaatgttcagttgacattaggaaaattcgtagattaaaaggatgggtacttttagaggatgaaacctatgttgaagaaattgcgaatattttacaagaactaggtgccgatgagactgctgtagccagtattttggaacgctgcccggaagcaattgtctgtagtccaaccgctgttaacacccagagaaaactctggcagttggtctgcaaaaatgaggaagagttaatcaagttaatagagcagtttccagaatctttctttactattaaagaccaagagaaccagaagctgaatgttcagttctttcaagagttgggactaaaaaatgtggtcattagcagacttttgacagctgcacctaatgtttttcataatcctgttgagaagaataagcaaatggtaagaattctccaagagagttatctagatgtaggtggctctgaggccaacatgaaagtttggctactaaaattgttaagccaaaacccatttattttgttaaattctcccacagctataaaggaaacactagaatttctccaggagcaaggtttcaccagctttgaaattctccagcttctatccaaactcaaaggatttctttttcaactttgcccaagaagtatacagaatagtatttccttctctaaaaatgcttttaaatgcacagatcatgacctgaagcaattagttttgaaatgtcctgcccttttatattattctgttccagttttagaagagagaatgcaaggattattgagagaaggaatttccatagctcagataagagagacgccaatggttcttgaattaacaccacagatagtacagtacaggataaggaaactgaattcctcaggctacagaataaaggatggacatctagcaaatctaaatggatcaaaaaaagagtttgaagctaattttggcaaaattcaggccaaaaaagtaaggccattatttaaccctgtggcaccattaaatgttgaagaatgacatactgactgttgttgcttctttctagcagtgcagggtgaaactaactagcaaagacaaaaattcaggcagtttgtagacaccagtaattttaagaacctgcttagcttctgtgttgtatttaagttatctctaaatagataaattctgactcatgtgccatattataaaatataaatcatatttattttaataaggttggtaacttttaccttgaaccattatttcaaaaactcatatactattaaatggcatatcagtgtgat

SEQ ID NO: 154717 - DNA, 3235 bp, Homo sapiens
  Payload ID: 10415
  Gene Symbol: MTERF2
  Gene Name: mitochondrial transcription termination factor 2
  Uniprot ID: Q49AM1
  ENST ID: ENST00000552029
  CDS Start-End: 2070-3227
tgctgagaactgtcgggagcttcttgagaccgaggaccgaaatcccggctccaggcctcggggactgcggactgtggggaggctggccggagagagagggaaggacggggcctggcccccgggactccctgtgccttgcttggagctgacgccgacgggtgagtcgcccccttcctctgctcctgggcgtgttcctcaccagcggcgccgcagcggtcagggcccgcaaaaccccacgcctcgccagacgctcagctcagcctgccgggtttctctggaaaagcggaggccccacagtgaatgtgcggccttttgatcggtcctggagatcttccgtggaccctcgtttttccttgcttataaacgttggtcaatttgaaactggcagcagggcatatgtgttacgaaagaagaactttattgaaaccagtggtggtgtagagaagaccatactaaccataactgtgtattacagaagtgaatttcactccccaaaaatgcttaagaaacaagcatcctagaacagcccacattgtgatttaacaaacatttaccaaaagcattgctatatgtgggggcacagggctaagagcaggcaggactctggagccaacctgtggggtttgagtccaaattctgccggttttttgttttttgtttttttttttagctgagtaaccttgggcaagttcctttacctgcgtctgtttcctcattttaaaatgagttgttgtgatgatttaatgatttagtatatgtgaagagttttctgcatattctaagtgatttatggtattaactcgtttgatctttgcagtcacccaggagatagtatcaccattttcctgatgccaaactgaggctcagagaggtgaagtaacttcttcaagtcacaacacaactgttgtccaggaatcaggcagtctggctctgctaacccagttttacccactgcattaatgtaccgcatccacttgttcactcagtttcacctgacaaatactaattttgtctctctgtggaacaagttctttgctgggtgcagggaataaagcagaacaccgttcagttcctgccttcccaacgcttgtaaatctagtgcaggtcattcatggccgggctgcagggtgtccatgaatcctgctaaaatcatttgcgaaatgttgtgagcgtgggtcttttcttctggaaagagagtctgtgactctcaggttctgagttgatctgtgatccaaacagaggtgtgaagaagtgttgttttagcagatctgtgcctagtatgcctgatacacagcttgaacttcaaacaaacagcaacaaaattcctactggttggaagaatgaagaacttgtaagagcataataagtgctgcagtagcgtccggagcagggtgctgtggaagagcacacagaaggccacctgcccaggaatgcctcctagaggcagtgaaggcagctgggtgaaggatagggaagcagttcattggaacactgtggtgaccagtctgtccatgtagtgttgagacagaaacaacacgtgaacagctgcagctgttgtaccacttgtgcgcaagtgtaaaagtccatggtgccatgaaatcatgtaatggggacaggaggcttcatgtattcgtgaaggttagaaaagtttccttgagaaagtgacacttaggcctaaaagttggagcattttgggcatggaatctggcccacagtcttcaaagaccacatggtagaaaccagtagagcaccagggactgacaggaagcaaatgcagctggtgcaggagagggaaatgggaattagggtggtggcagagcccaaagaggccttgtaggccatggtaaggcatttctatgttttattttactttgtctttatcctaaaatgccattggcaagtttattgcagggaactgacaagatcacattttgagaagaagttggaaagaatcccaagtggatgaactgaatatctggatgaggacaagatctgtggggagagactgtaagatagaatgagtccatttaagtcccaggacggtggaaactagctagtagattgcagccatgttgtggaagctgctgctgagatcccagtcctgcaggctgtgttctttcagaaagatgcgatcacctccaaaatacagacctttcttagcatgcttcacctatacaactgataaacagtcgagcaaagaaaatacaagaacagtggaaaagctctataaatgttcagttgacattaggaaaattcgtagattaaaaggatgggtacttttagaggatgaaacctatgttgaagaaattgcgaatattttacaagaactaggtgccgatgagactgctgtagccagtattttggaacgctgcccggaagcaattgtctgtagtccaaccgctgttaacacccagagaaaactctggcagttggtctgcaaaaatgaggaagagttaatcaagttaatagagcagtttccagaatctttctttactattaaagaccaagagaaccagaagctgaatgttcagttctttcaagagttgggactaaaaaatgtggtcattagcagacttttgacagctgcacctaatgtttttcataatcctgttgagaagaataagcaaatggtaagaattctccaagagagttatctagatgtaggtggctctgaggccaacatgaaagtttggctactaaaattgttaagccaaaacccatttattttgttaaattctcccacagctataaaggaaacactagaatttctccaggagcaaggtttcaccagctttgaaattctccagcttctatccaaactcaaaggatttctttttcaactttgcccaagaagtatacagaatagtatttccttctctaaaaatgcttttaaatgcacagatcatgacctgaagcaattagttttgaaatgtcctgcccttttatattattctgttccagttttagaagagagaatgcaaggattattgagagaaggaatttccatagctcagataagagagacgccaatggttcttgaattaacaccacagatagtacagtacaggataaggaaactgaattcctcaggctacagaataaaggatggacatctagcaaatctaaatggatcaaaaaaagagtttgaagctaattttggcaaaattcaggccaaaaaagtaaggccattatttaaccctgtggcaccattaaatgttgaagaatgacatactga

SEQ ID NO: 154718 - DNA, 418 bp, Homo sapiens
  Payload ID: 10415
  Gene Symbol: MTERF2
  Gene Name: mitochondrial transcription termination factor 2
  ENST ID: ENST00000550496
  CDS Start-End: 319-418
gagaactgtcgggagcttcttgagaccgaggaccgaaatcccggctccaggcctcggggactgcggactgtggggaggctggccggagagagagggaaggacggggcctggcccccgggactccctgtgccttgcttggagctgacgccgacggtttattgcagggaactgacaagatcacattttgagaagaagttggaaagaatcccaagtggatgaactgaatatctggatgaggacaagatctgtggggagagactgtaagaatgagtccatttaagtcccaggacggtggaaactagctagtagattgcagccatgttgtggaagctgctgctgagatcccagtcctgcaggctgtgttctttcagaaagatgcgatcacctccaaaatacagacctttcttagcatgcttca

SEQ ID NO: 154719 - DNA, 715 bp, Homo sapiens
  Payload ID: 10415
  Gene Symbol: MTERF2
  Gene Name: mitochondrial transcription termination factor 2
  ENST ID: ENST00000548101
  CDS Start-End: 180-715
ccgaaatcccggctccaggcctcggggactgcggactgtggggaggctggccggagagagagggaaggacggggcctggcccccgggactccctgtgccttgcttggagctgacgccgacggatagaatgagtccatttaagtcccaggacggtggaaactagctagtagattgcagccatgttgtggaagctgctgctgagatcccagtcctgcaggctgtgttctttcagaaagatgcgatcacctccaaaatacagacctttcttagcatgcttcacctatacaactgataaacagtcgagcaaagaaaatacaagaacagtggaaaagctctataaatgttcagttgacattaggaaaattcgtagattaaaaggatgggtacttttagaggatgaaacctatgttgaagaaattgcgaatattttacaagaactaggtgccgatgagactgctgtagccagtattttggaacgctgcccggaagcaattgtctgtagtccaaccgctgttaacacccagagaaaactctggcagttggtctgcaaaaatgaggaagagttaatcaagttaatagagcagtttccagaatctttctttactattaaagaccaagagaaccagaagctgaatgttcagttctttcaagagttgggactaaaaaatgtggtcattagcagacttttgacagctgcacctaatgtttttcataa

SEQ ID NO: 154720 - DNA, 581 bp, Homo sapiens
  Payload ID: 10415
  Gene Symbol: MTERF2
  Gene Name: mitochondrial transcription termination factor 2
  ENST ID: ENST00000550736
  CDS Start-End: 323-581
atggtaaggcatttctatgttttattttactttgtctttatcctaaaatgccattggcaagtttattgcagggaactgacaagatcacattttgagaagaagttggaaagaatcccaagtggatgaactgaatatctggatgaggacaagatctgtggggagagactgtaagacctgtaaagagtgagggaaggctgccaacaggctaaattgagccgtactacacacttttgtggcaaggctgagacacttacaacactcttagatagaatgagtccatttaagtcccaggacggtggaaactagctagtagattgcagccatgttgtggaagctgctgctgagatcccagtcctgcaggctgtgttctttcagaaagatgcgatcacctccaaaatacagacctttcttagcatgcttcacctatacaactgataaacagtcgagcaaagaaaatacaagaacagtggaaaagctctataaatgttcagttgacattaggaaaattcgtagattaaaaggatgggtacttttagaggatgaaacctatgttgaagaaattgcgaatattttacaagaac

SEQ ID NO: 154721 - DNA, 1409 bp, Homo sapiens
  Payload ID: 10416
  Gene Symbol: MTERF3
  Gene Name: mitochondrial transcription termination factor 3
  Uniprot ID: Q96E29
  ENST ID: ENST00000287025
  CDS Start-End: 100-1353
cggcgtgcggcgcggcgggacgggacgtgcggcccagcgagttggtcggtcccggggtcacccgctacgggaagcaggcctcgccacagactaagaaaaatggctttgtcagcccaacagatacccagatggtttaactcagttaagttgaggagcctcattaatgctgcacaactcacaaaacgttttactagaccagcaagaacactgttacatggcttttctgctcagcctcagatatcctctgacaattgctttctccagtggggatttaagacttacaggacttcctccttatggaatagttcccagtctactagctcaagtagtcaggagaataattctgcccaaagcagtctgcttccttccatgaatgaacagtcacagaagacacaaaatatatccagctttgattctgagctgtttctagaagaactggatgaattgcctccattgtctccaatgcagccaatttcagaggaagaggctattcagattattgcagaccctccattgccaccagcttcattcacacttcgagactatgtggatcattctgagactctgcagaagttggttcttctaggcgtggatttgtccaagatagaaaaacatccagaagcagcaaacctccttctgagactggattttgaaaaagacattaagcaaatgcttctgtttcttaaagatgtgggtatagaggataaccaactgggagcattcctgacaaaaaatcatgcaattttctctgaagaccttgaaaatctgaagaccagggtggcttatctgcattcaaaaaatttcagtaaagcagatgttgcacagatggtcagaaaagcaccatttttgctgaacttttcagtggaaagactggataacagattgggattttttcagaaagaacttgaacttagtgtgaagaagactagagatctggtagttcgtctcccaaggctgctaactggaagtctggaacccgtgaaagaaaatatgaaggtttatcgtcttgaacttggttttaaacataacgaaattcaacatatgatcaccagaatcccaaagatgttaactgcaaataaaatgaaacttaccgagacgtttgattttgtgcacaatgtgatgagcattccccaccacatcattgtcaagttcccacaggtatttaatacaaggctgtttaaggtcaaagaaagacacttgtttcttacctatttaggaagagcacagtatgatccagcaaaacctaactacatctctttggacaaactagtatctattcctgatgaaatattttgtgaagagattgccaaagcatcagtacaggactttgaaaaattcttaaaaacgctttagatttttatgtatgttaaaatgcagtattgtaaagtgaatatatatatgaataaatg

SEQ ID NO: 154722 - DNA, 776 bp, Homo sapiens
  Payload ID: 10416
  Gene Symbol: MTERF3
  Gene Name: mitochondrial transcription termination factor 3
  ENST ID: ENST00000524341
  CDS Start-End: 193-714
gaggaagaggctattcagattattgcagaccctccattgccaccagcttcattcacacttcgagactatgtggatcattctgagactctgcagaagttggttcttctaggcgtggatttgtccaagatagaaaaacatccagaagcagcaaacctccttctgagactggattttgaaaaagacattaagcaaatgcttctgtttcttaaagatgtgggtatagaggataaccaactgggagcattcctgacaaaaaatcatgcaattttctctgaagaccttgaaaatctgaagaccagggtggcttatctgcattcaaaaaatttcagtaaagcagatgttgcacagatggtcagaaaagcaccatttttgctgaacttttcagtggaaagactggataacagattgggattttttcagaaagaacttgaacttagtgtgaagaagactagagatctggtagttcgtctcccaaggctgctaactggaagtctggaacccgtgaaagaaaatatgaaggtatttaatacaaggctgtttaaggtcaaagaaagacacttgtttcttacctatttaggaagagcacagtatgatccagcaaaacctaactacatctctttggacaaactagtatctattcctgatgaaatattttgtgaagagattgccaaagcatcagtacaggactttgaaaaattcttaaaaacgctttagatttttatgtatgttaaaatgcagtattgtaaagtgaatatatatatgaataaatgaatata

SEQ ID NO: 154723 - DNA, 1529 bp, Homo sapiens
  Payload ID: 10416
  Gene Symbol: MTERF3
  Gene Name: mitochondrial transcription termination factor 3
  ENST ID: ENST00000523821
  CDS Start-End: 121-1206
gtgtagggcgggctgaggagccggcgtgcggcgcggcgggacgggacgtgcggcccagcgagttggtcggtcccggggtcacccgctacgggaagcaggcctcgccacagactaagaaaaatggctttgtcagcccaacagatacccagatggtttaactcagttaagttgaggagcctcattaatgctgcacaactcacaaaacgttttactagaccagcaagaacactgttacatggcttttctgctcagcctcagatatcctctgacaattgctttctccagtggggatttaagacttacaggacttcctccttatggaatagttcccagtctactagctcaagtagtcaggagaataattctgcccaaagcagtctgcttccttccatgaatgaacagtcacagaagacacaaaatatatccagctttgattctgagctgtttctagaagaactggatgaattgcctccattgtctccaatgcagccaatttcagaggaagaggctattcagattattgcagaccctccattgccaccagcttcattcacacttcgagactatgtggatcattctgagactctgcagaagttggttcttctaggcgtggatttgtccaagatagaaaaacatccagaagcagcaaacctccttctgagactggattttgaaaaagacattaagcaaatgcttctgtttcttaaagatgtgggtatagaggataaccaactgggagcattcctgacaaaaaatcatgcaattttctctgaagaccttgaaaatctgaagaccagggtggcttatctgcattcaaaaaatttcagtaaagcagatgttgcacagatggtcagaaaagcaccatttttgctgaacttttcagtggaaagactggataacagattgggattttttcagaaagaacttgaacttagtgtgaagaagactagagatctggtagttcgtctcccaaggctgctaactggaagtctggaacccgtgaaagaaaatatgaaggtttatcgtcttgaacttggttttaaacataacgaaattcaacatatgatcaccagaatcccaaagatgttaactgcaaataaaatgaaacttaccgagacgtttgattttgtgcacaatgtgatgagcattccccaccacatcattgtcaagttcccacagtttcttcacagaaaatataggatttaaatcctctggcatttatcctacttactgaacacatggtatttaatacaaggctgtttaaggtcaaagaaagacacttgtttcttacctatttaggaagagcacagtatgatccagcaaaacctaactacatctctttggacaaactagtatctattcctgatgaaatattttgtgaagagattgccaaagcatcagtacaggactttgaaaaattcttaaaaacgctttagatttttatgtatgttaaaatgcagtattgtaaagtgaatatatatatgaataaatgaatatatttttaaatgcctcgggtctcaactgatatt

SEQ ID NO: 154724 - DNA, 412 bp, Homo sapiens
  Payload ID: 10416
  Gene Symbol: MTERF3
  Gene Name: mitochondrial transcription termination factor 3
  ENST ID: ENST00000517720
  CDS Start-End: 210-412
ggcgtgcggcgcggcgggacgggacgtgcggcccagcgagttggtcggtcccggggtcacccgctacgggaagcaggcctcgccacagcagggtattgtgaatacttacttcttttctaaaatcatcgcagaatgggccgagcgcagtggctcacgcctgtaatcccagcactttgggaagctgggtggatcacctgagactaagaaaaatggctttgtcagcccaacagatacccagatggtttaactcagttaagttgaggagcctcattaatgctgcacaactcacaaaacgttttactagaccagcaagaacactgttacatggcttttctgctcagcctcagatatcctctgacaattgctttctccagtggggatttaagacttacaggacttcctccttatggaa

SEQ ID NO: 154725 - DNA, 1148 bp, Homo sapiens
  Payload ID: 10416
  Gene Symbol: MTERF3
  Gene Name: mitochondrial transcription termination factor 3
  Uniprot ID: Q96E29
  ENST ID: ENST00000522822
  CDS Start-End: 191-1081
cttacctcttaaaaggtgaaaaattagggacttggatgtttaattctaaaatgatcccaagatttaaccactgaaagaagcaaacaagggaagagctggtctttgcagaaatagttttaagtgtgcatattagagcactaatttgtttctctctttcaaagaactggatgaattgcctccattgtctccaatgcagccaatttcagaggaagaggctattcagattattgcagaccctccattgccaccagcttcattcacacttcgagactatgtggatcattctgagactctgcagaagttggttcttctaggcgtggatttgtccaagatagaaaaacatccagaagcagcaaacctccttctgagactggattttgaaaaagacattaagcaaatgcttctgtttcttaaagatgtgggtatagaggataaccaactgggagcattcctgacaaaaaatcatgcaattttctctgaagaccttgaaaatctgaagaccagggtggcttatctgcattcaaaaaatttcagtaaagcagatgttgcacagatggtcagaaaagcaccatttttgctgaacttttcagtggaaagactggataacagattgggattttttcagaaagaacttgaacttagtgtgaagaagactagagatctggtagttcgtctcccaaggctgctaactggaagtctggaacccgtgaaagaaaatatgaaggtttatcgtcttgaacttggttttaaacataacgaaattcaacatatgatcaccagaatcccaaagatgttaactgcaaataaaatgaaacttaccgagacgtttgattttgtgcacaatgtgatgagcattccccaccacatcattgtcaagttcccacaggtatttaatacaaggctgtttaaggtcaaagaaagacacttgtttcttacctatttaggaagagcacagtatgatccagcaaaacctaactacatctctttggacaaactagtatctattcctgatgaaatattttgtgaagagattgccaaagcatcagtacaggactttgaaaaattcttaaaaacgctttagatttttatgtatgttaaaatgcagtattgtaaagtgaatatatatatgaataaatgaatatattttt

SEQ ID NO: 154726 - DNA, 4529 bp, Homo sapiens
  Payload ID: 10417
  Gene Symbol: MTERF4
  Gene Name: mitochondrial transcription termination factor 4
  Uniprot ID: Q7Z6M4
  ENST ID: ENST00000241527
  CDS Start-End: 23-1168
ctgctgccatcttctccgcgctatggctgcgttcggccgtcaggtccttgattggcaccgcctgatccccctcacctgggcctgtatggctaggcagactcctcatcttggagaacagagaaggacgacagcttctttgttgcgcaaactgactacagcctccaatggaggggtcattgaggagttatcttgtgttagatccaataactatgtgcaggaaccagagtgcaggaggaatcttgttcagtgcctccttgagaagcaggggactcctgtggtacaagggtccttggagctagagagggtcatgagttccctcctggacatgggtttcagcaatgcccatattaatgaattgctcagtgtacggcgaggtgccagtcttcaacagttgctggacatcatttcagaatttattctcttgggtctgaatccagagcctgtgtgtgtggtcttgaagaaaagtccccagttattgaaactgcctattatgcaaatgaggaagcgctccagttacctgcaaaagcttgggcttggagaagggaaattaaagagggtgctttactgttgccctgaaattttcaccatgcgccagcaggacattaacgacactgtcaggcttctcaaggagaagtgccttttcacggtacagcaagtcaccaagattttgcacagttgcccctctgttcttcgagaggacctgggtcaactggaatacaagtttcagtatgcatacttcaggatgggaattaagcatccagacattgtaaagagtgagtacttgcagtattcactaaccaagattaagcagagacacatttacctggagcgcctgggacggtaccaaacccctgataagaaggggcagacacagatccctaacccattgctcaaggacattctcagagtttcagaagctgagtttttggccaggacagcctgtacttctgttgaggagtttcaagtttttaagaagctcctggctcgggaggaggaggagtctgagagcagcacatctgatgacaaaagggcaagtctggatgaggatgaggatgacgatgatgaggaggacaatgatgaggatgacaatgatgaggatgacgatgatgaggacgacgacgaggcggaggacaatgatgaggatgaggacgacgacgaggaggaatagctgtgatggaaggactagagcgaaagggcccagagatatcaaggaagcttttcattctcttaaagcttttgggtcctttacttgaatcttctcaagttattttttattctaaaactggtctcttgatgaaaaaaattataagtcacctgagaggcagacagatcaaaccaaacaggaaacaggaaatgcatgtttgatctgttgtcacgtgtctgtggggagggccctgtcccatcctgaataagatacttatgttgagctattcacatcaaggggactcaatatatcaacaattggttttatttttttctcttttgaatatgttggtgataattccgtgacagttggaagatggggttcattcttccggttcaggaatcactatgtatttccttcttgtgataaaaataaaattacgagaaggcaatgtgaggttttagtacatcatagcactttattttatgaaaacatgtagcagattttccacaaaaatgcttatttttaatccaaaagtatattgcttcataatggtattcagtgcacagcagagtaaaagaagttaattcatgatgtactggttaattttgcatggcttcttaaggccagcaaaatgctggcagttttctttatctttgtgaagaacaggcccttcctgtttggggaagttggcttttatgtcagctcttggccagtggtcacttccaagcctggtgtctccggccctgtagtctgtagtgccagactgtgctggcctggagagtgctggggcaggtggaggccagggaatggtcccatacagttatctcccctgccctggttacagacagcttcgagaaccagaggagaagagcatagggtcatggagcagcagcctcgtcttacagcgtgactgcaaagaaaaagacttttgttttgcaaaagaaaagcagctcggtgactccgtccacatcgccacagttgagtcagatggcagtggcagtcctttgccagtggaaggagttcctgctaaggggaggtgcaggaggactaatttattattgtgcaactgccagtcctgcgcattccagctacgctaagcgccctgcccaggcacgtaacaaaacatagacctgttttgaagtggcttgttacccaagggtgcctcactcatctgcgccaccaggaagatgaactgtgagggctcctataaggggcaggaagagcaaagctgtcctaggccaaccagagattcatctttcatgcagtgacatgttgataaaaaatgatggtcagtatgaaactggtaacaggttgtagatggctttctatggtatatcccagtctcttgcaaacgattgtgaagaatgccagtgttgtttaagattcggcagtttgtgtggggaggtgggggcaggatggggtttggttgccaaaagagtttgggaaatgctggcttaaacaaaggcgagaggaagttcctttcacgtcaggatttatgaatgcctatgagcccagtgtcagtgacgactttctagcggcggtcttcaacactttctaaatattaagcgatcaaggcccctgccccacttttagttccaacagaatgccgttcacaagatctgggaggcactctctcagccctctcctggagcccccggaatttctcagcagcccaggccctcccgctgcccgtggcccctcctcccaggtgccaggtggtcttccagcctctccaagggcccacccccctgcctcttcctcccactgcagctgatctaggggtttcttggccacatttcccttgagagagagtgggatttgccctatccacagagagcctcatttccacctgaaggtgtatttgtcagtggctagaccaggttcatgtctgtttccccttggggacttctgaaccttcctgcccgggagtctgtaacacagcagcacaggaccgcgcttcctttagcagtgctgagtaagcaggcagcggcactctgagatcccggggctgggcagtcgccccccacttcccagcagctctgtggtagtggggcgggagcagcagggacgtaccttaagatttctccagtgtctgactcttactttgtttcctgaaataattagagaaaagtcgtttaatgaaaaagagactgtgtaccttgaattctacagctacctcagtccaggctgcctgctgagatcctgtctttagctcacatacattccacggtgggggacaccattagtccagacaccgctgtggagattagcattttagtttgtgtgcgcccgcctggcttgaggcagtagtttaggaatgacaaggctagaaacctggctggctgtgagtcagagagagagaggatggacgtgggagaaagcaagcaaaagctaccctagggaagagccggtgacgtgcacaggccgagcagcacggctggtgagctgcaggctgcggccttgcccggacacttggtaatgccaaacaagtacgtgtggctactcattggtctatgaggacgatgacaggcttcgactctgtggtttctaaagcatataatattctcacgtacttctttcagcaaacgccaaacagtagtaattcttgtaactaccttgaaccctttgtggaaagaacctgggtgtgagtgaataaaaagtaaagagcgacgcgctatatcggccattaaatactcggggctgtccgtaacaccctgtgcttcccaattgtagcaccatgttctgtgtgaatatgcataaccagagtgaccccccccagcacccagcatgcccggctgtgcccctctgggtatgctcacatgcacatatatggacatacagtttcgtagcagaacgtggctgcccaggggctgcctatctgggcgagtagaccgcctggctcagcccacaggcctgcagcatcccatagcaccccgcccttgccccatcaccctgtgggctacatgcaggacacggcatgggcctgctccccagaggcacctgtttggggtcttcttgaggcttgtgctttcacagctctctttgaagcagatgtcttggtgaactcggtagactcttttatacctgttgtcacaagaaagctttgtaaaaccagacagtgaagcaaaatgttgccaactgcttaacctaggctatgtgaacccacagtaaacctgaaggtgtttgagggaaaaactgctattttctgaatgaaacgtgacctcctattgatgtattaaaatgtctaacataaaggtcatgtgatttgtaataaatttattgtggtacagtaatatgcataaaataaacccattttaatgtgcattctgatgagcactgacaaaggatatggtactaaaaataaaatgtgaaatgtcaaaga

SEQ ID NO: 154727 - DNA, 1637 bp, Homo sapiens
  Payload ID: 10417
  Gene Symbol: MTERF4
  Gene Name: mitochondrial transcription termination factor 4
  Uniprot ID: Q7Z6M4
  ENST ID: ENST00000391980
  CDS Start-End: 60-1205
gaaggacgggggaggaccgctgcttccggcgccgtaactgctgccatcttctccgcgctatggctgcgttcggccgtcaggtccttgattggcaccgcctgatccccctcacctgggcctgtatggctaggcagactcctcatcttggagaacagagaaggacgacagcttctttgttgcgcaaactgactacagcctccaatggaggggtcattgaggagttatcttgtgttagatccaataactatgtgcaggaaccagagtgcaggaggaatcttgttcagtgcctccttgagaagcaggggactcctgtggtacaagggtccttggagctagagagggtcatgagttccctcctggacatgggtttcagcaatgcccatattaatgaattgctcagtgtacggcgaggtgccagtcttcaacagttgctggacatcatttcagaatttattctcttgggtctgaatccagagcctgtgtgtgtggtcttgaagaaaagtccccagttattgaaactgcctattatgcaaatgaggaagcgctccagttacctgcaaaagcttgggcttggagaagggaaattaaagagggtgctttactgttgccctgaaattttcaccatgcgccagcaggacattaacgacactgtcaggcttctcaaggagaagtgccttttcacggtacagcaagtcaccaagattttgcacagttgcccctctgttcttcgagaggacctgggtcaactggaatacaagtttcagtatgcatacttcaggatgggaattaagcatccagacattgtaaagagtgagtacttgcagtattcactaaccaagattaagcagagacacatttacctggagcgcctgggacggtaccaaacccctgataagaaggggcagacacagatccctaacccattgctcaaggacattctcagagtttcagaagctgagtttttggccaggacagcctgtacttctgttgaggagtttcaagtttttaagaagctcctggctcgggaggaggaggagtctgagagcagcacatctgatgacaaaagggcaagtctggatgaggatgaggatgacgatgatgaggaggacaatgatgaggatgacaatgatgaggatgacgatgatgaggacgacgacgaggcggaggacaatgatgaggatgaggacgacgacgaggaggaatagctgtgatggaaggactagagcgaaagggcccagagatatcaaggaagcttttcattctcttaaagcttttgggtcctttacttgaatcttctcaagttattttttattctaaaactggtctcttgatgaaaaaaattataagtcacctgagaggcagacagatcaaaccaaacaggaaacaggaaatgcatgtttgatctgttgtcacgtgtctgtggggagggccctgtcccatcctgaataagatacttatgttgagctattcacatcaaggggactcaatatatcaacaattggttttatttttttctcttttgaatatgttggtgataattccgtgacagttggaagatggggttcattcttccggttcaggaatcactatgtatttccttcttgtgataaaaataaaattacgagaaggcaatgtga

SEQ ID NO: 154728 - DNA, 802 bp, Homo sapiens
  Payload ID: 10417
  Gene Symbol: MTERF4
  Gene Name: mitochondrial transcription termination factor 4
  ENST ID: ENST00000406593
  CDS Start-End: 92-673
gtaactgctgccatcttctccgcgctatggctgcgttcggccgtcagggaaattaaagagggtgctttactgttgccctgaaattttcaccatgcgccagcaggacattaacgacactgtcaggcttctcaaggagaagtgccttttcacggtacagcaagtcaccaagattttgcacagttgcccctctgttcttcgagaggacctgggtcaactggaatacaagtttcagtatgcatacttcaggatgggaattaagcatccagacattgtaaagagtgagtacttgcagtattcactaaccaagattaagcagagacacatttacctggagcgcctgggacggtaccaaacccctgataagaaggggcagacacagatccctaacccattgctcaaggacattctcagagtttcagaagctgagtttttggccaggacagcctgtacttctgttgaggagtttcaagtttttaagaagctcctggctcgggaggaggaggagtctgagagcagcacatctgatgacaaaagggcaagtctggatgaggatgaggatgacgatgatgaggaggacaatgatgaggatgacaatgatgaggatgacgatgatgaggacgacgacgaggcggaggacaatgatgaggatgaggacgacgacgaggaggaatagctgtgatggaaggactagagcgaaagggcccagagatatcaaggaagcttttcattctcttaaagcttttgggtcctttacttgaatcttctcaagttattttttattctaaaactggtctcttgatga

SEQ ID NO: 154729 - DNA, 561 bp, Homo sapiens
  Payload ID: 10417
  Gene Symbol: MTERF4
  Gene Name: mitochondrial transcription termination factor 4
  ENST ID: ENST00000401626
  CDS Start-End: 15-561
atcttctccgcgctatggctgcgttcggccgtcaggtccttgattggcaccgcctgatccccctcacctgggcctgtatggctaggcagactcctcatcttggagaacagagaaggacgacagcttctttgttgcgcaaactgactacagcctccaatggaggggtcattgaggagttatcttgtgttagatccaataactatgtgcaggaaccagagtgcaggaggaatcttgttcagtgcctccttgagaagcaggggactcctgtggtacaagggtccttggagctagagagggtcatgagttccctcctggacatgggtttcagcaatgcccatattaatgaattgctcagtgtacggcgaggtgccagtcttcaacagttgctggacatcatttcagaatttattctcttgggtctgaatccagagcctgtgtgtgtggtcttgaagaaaagtccccagttattgaaactgcctattatgcaaatgaggaagcgctccagttacctgcaaaagcttgggcttggagaagcagcctcgtcttacagcgtgactgcaa

SEQ ID NO: 154730 - DNA, 799 bp, Homo sapiens
  Payload ID: 10417
  Gene Symbol: MTERF4
  Gene Name: mitochondrial transcription termination factor 4
  ENST ID: ENST00000407095
  CDS Start-End: 39-797
gcttccggcgccgtaactgctgccatcttctccgcgctatggctgcgttcggccgtcaggtccttgattggcaccgcctgatccccctcacctgggcctgtatggctaggcagactcctcatcttggagaacagagaaggacgacagcttctttgttgcgcaaactgactacagcctccaatggaggggtcattgaggagttatcttgtgttagatccaataactatgtgcaggaaccagagtgcaggaggaatcttgttcagtgcctccttgagaagcaggggactcctgtggtacaagggtccttggagctagagagggtcatgagttccctcctggacatgggtttcagcaatgcccatattaatgaattgctcagtgtacggcgaggtgccagtcttcaacagttgctggacatcatttcagaatttattctcttgggtctgaatccagagcctgtgtgtgtggtcttgaagaaaagtccccagttattgaaactgcctattatgcaaatgaggaagcgctccagttacctgcaaaagcttgggcttggagaagggaaattaaagagggtgctttactgttgccctgaaattttcaccatgcgccagcaggacattaacgacactgtcaggcttctcaaggagaagtgccttttcacggtacagcaagtcaccaagattttgcacagttgcccctctgttcttcgagaggacctgggtcaactggaatacaagtttcaggtgagaatgactgatagcgtgattagcgtagtttcaggtgagaatgactggtaatg

SEQ ID NO: 154731 - DNA, 549 bp, Homo sapiens
  Payload ID: 10417
  Gene Symbol: MTERF4
  Gene Name: mitochondrial transcription termination factor 4
  ENST ID: ENST00000434791
  CDS Start-End: 96-549
aggaaccgcggccgccgagtgtttcacggccaggtcgtggagccctcccggaggtccttgattggcaccgcctgatccccctcacctgggcctgtatggctaggcagactcctcatcttggagaacagagaaggacgacagcttctttgttgcgcaaactgactacagcctccaatggaggggtcattgaggagttatcttgtgttagatccaataactatgtgcaggaaccagagtgcaggaggaatcttgttcagtgcctccttgagaagcaggggactcctgtggtacaagggtccttggagctagagagggtcatgagttccctcctggacatgggtttcagcaatgcccatattaatgaattgctcagtgtacggcgaggtgccagtcttcaacagttgctggacatcatttcagaatttattctcttgggtctgaatccagagcctgtgtgtgtggtcttgaagaaaagtccccagttattgaaactgcctattatgcaaatgaggaagcgctccagttacctgcaaaagcttgggcttggag

SEQ ID NO: 154732 - DNA, 457 bp, Homo sapiens
  Payload ID: 10417
  Gene Symbol: MTERF4
  Gene Name: mitochondrial transcription termination factor 4
  ENST ID: ENST00000414146
  CDS Start-End: 1-457
agttacctgcaaaagcttgggcttggagaagggaaattaaagagggtgctttactgttgccctgaaattttcaccatgcgccagcaggacattaacgacactgtcaggcttctcaaggagaagtgccttttcacggtacagcaagtcaccaagattttgcacagttgcccctctgttcttcgagaggacctgggtcaactggaatacaagtttcagtatgcatacttcaggatgggaattaagcatccagacattgtaaagacagcctcgtcttacagcgtgactgcaaagaaaaagacttttgttttgcaaaagaaaagcagctcggtgactccgtccacatcgccacagttgagtcagatggcagtggcagtcctttgccagtggaaggagttcctgctaaggggaggtgcaggaggactaatttattattgtgcaactgccagtcctgcgcatt

SEQ ID NO: 154733 - DNA, 797 bp, Homo sapiens
  Payload ID: 10417
  Gene Symbol: MTERF4
  Gene Name: mitochondrial transcription termination factor 4
  ENST ID: ENST00000424798
  CDS Start-End: 1-774
gtccttgattggcaccgcctgatccccctcacctgggcctgtatggctaggcagactcctcatcttggagaacagagaaggacgacagcttctttgttgcgcaaactgactacagcctccaatggaggggtcattgaggagttatcttgtgttagatccaataactatgtgcaggaaccagagtgcaggaggaatcttgttcagtgcctccttgagaagcaggggactcctgtggtacaagggtccttggagctagagagggtcatgagttccctcctggacatgggtttcagcaatgcccatattaatgaattgctcagtgtacggcgaggtgccagtcttcaacagttgctggacatcatttcagaatttattctcttgggtctgaatccagagcctgtgtgtgtggtcttgaagaaaagtccccagttattgaaactgcctattatgcaaatgaggaagcgctccagttacctgcaaaagcttgggcttggagaagggaaattaaagagggtgctttactgttgccctgaaattttcaccatgcgccagcaggacattaacgacactgtcaggcttctcaaggagaagtgccttttcacggtacagcaagtcaccaagattttgcacagttgcccctctgttcttcgagaggacctgggtcaactggaatacaagtttcagaaaaataccacctcttccttctgccccttctccctcctgccccttttccctcccacccctttatttcctgctccatgtttctcaggatgaatttgaaagtgttttgaaactgc

SEQ ID NO: 154734 - DNA, 534 bp, Homo sapiens
  Payload ID: 10417
  Gene Symbol: MTERF4
  Gene Name: mitochondrial transcription termination factor 4
  ENST ID: ENST00000449133
  CDS Start-End: 1-324
agcagctcggtgactccgtccacatcgccacagttgagtcagatggcagtggcagtcctttgccagtggaaggagttcctgctaaggggaggtgcaggagagtgtactccttctacttatgaaaaaaagttaactataaaatggcctcaggcaggtccttcaggaggtttccagaagaaggcatcattgtcacaggaggtggcagctccatgtgtgttactgggacacgatgtggaagtggaagaaggtgacatggatgatcctgcccctgtgactaatttattattgtgcaactgccagtcctgcgcattccagctacgctaagcgccctgcccaggcacgtaacaaaacatagacctgttttgaagtggcttgttacccaagggtgcctcactcatctgcgccaccaggaagatgaactgtgagggctcctataaggggcaggaagagcaaagctgtcctaggccaaccagagattcatctttcatgcagtgacatgttgataaaaaatgatggtcagtatgaaactggtaa

SEQ ID NO: 154735 - DNA, 583 bp, Homo sapiens
  Payload ID: 10417
  Gene Symbol: MTERF4
  Gene Name: mitochondrial transcription termination factor 4
  ENST ID: ENST00000439144
  CDS Start-End: 21-583
gctgccatcttctccgcgctatggctgcgttcggccgtcagatggcacctcctggttgtaggaaaacaagctcagggctcccagtgattctacattatgggaaattaaagagggtgctttactgttgccctgaaattttcaccatgcgccagcaggacattaacgacactgtcaggcttctcaaggagaagtgccttttcacggtacagcaagtcaccaagattttgcacagttgcccctctgttcttcgagaggacctgggtcaactggaatacaagtttcagtatgcatacttcaggatgggaattaagcatccagacattgtaaagagtgagtacttgcagtattcactaaccaagattaagcagagacacatttacctggagcgcctgggacggtaccaaacccctgataagaaggggcagacacagatccctaacccattgctcaaggacattctcagagtttcagaagctgagtttttggccaggacagcctgtacttctgttgaggagtttcaagtttttaagaagctcctggctcgggaggaggaggagtctgagagcagcacatctgatgacaa

SEQ ID NO: 154736 - DNA, 909 bp, Homo sapiens
  Payload ID: 10417
  Gene Symbol: MTERF4
  Gene Name: mitochondrial transcription termination factor 4
  ENST ID: ENST00000495694
  CDS Start-End: 37-786
ttccggcgccgtaactgctgccatcttctccgcgctatggctgcgttcggccgtcaggtccttgattggcaccgcctgatccccctcacctgggcctgtatggctaggcagactcctcatcttggagaacagagaaggacgacagcttctttgttgcgcaaactgactacagcctccaatggaggggtcattgaggagttatcttgtgttagatccaataactatgtgcaggaaccagagtgcaggaggaatcttgttcagtgcctccttgagaagcaggggactcctgtggtacaagggtccttggagctagagagggtcatgagttccctcctggacatgggtttcagcaatgcccatattaatgaattgctcagtgtacggcgaggtgccagtcttcaacagttgctggacatcatttcagaatttattctcttgggtctgaatccagagcctgtgtgtgtggtcttgaagaaaagtccccagttattgaaactgcctattatgcaaatgaggaagcgctccagttacctgcaaaagcttgggcttggagaagagtgtactccttctacttatgaaaaaaagttaactataaaatggcctcaggcaggtccttcaggaggtttccagaagaaggcatcattgtcacaggaggtggcagctccatgtgtgttactgggacacgatgtggaagtggaagaaggactaatttattattgtgcaactgccagtcctgcgcattccagctacgctaagcgccctgcccaggcacgtaacaaaacatagacctgttttgaagtggcttgttacccaagggtgcctcactcatctgcgccaccaggaagatgaactgtgagggctcctataaggggcaggaagagcaaagctgtcctaggccaaccagagatt

SEQ ID NO: 154737 - DNA, 4524 bp, Homo sapiens
  Payload ID: 10417
  Gene Symbol: MTERF4
  Gene Name: mitochondrial transcription termination factor 4
  Uniprot ID: Q7Z6M4
  ENST ID: ENST00000614476
  CDS Start-End: 23-1168
ctgctgccatcttctccgcgctatggctgcgttcggccgtcaggtccttgattggcaccgcctgatccccctcacctgggcctgtatggctaggcagactcctcatcttggagaacagagaaggacgacagcttctttgttgcgcaaactgactacagcctccaatggaggggtcattgaggagttatcttgtgttagatccaataactatgtgcaggaaccagagtgcaggaggaatcttgttcagtgcctccttgagaagcaggggactcctgtggtacaagggtccttggagctagagagggtcatgagttccctcctggacatgggtttcagcaatgcccatattaatgaattgctcagtgtacggcgaggtgccagtcttcaacagttgctggacatcatttcagaatttattctcttgggtctgaatccagagcctgtgtgtgtggtcttgaagaaaagtccccagttattgaaactgcctattatgcaaatgaggaagcgctccagttacctgcaaaagcttgggcttggagaagggaaattaaagagggtgctttactgttgccctgaaattttcaccatgcgccagcaggacattaacgacactgtcaggcttctcaaggagaagtgccttttcacggtacagcaagtcaccaagattttgcacagttgcccctctgttcttcgagaggacctgggtcaactggaatacaagtttcagtatgcatacttcaggatgggaattaagcatccagacattgtaaagagtgagtacttgcagtattcactaaccaagattaagcagagacacatttacctggagcgcctgggacggtaccaaacccctgataagaaggggcagacacagatccctaacccattgctcaaggacattctcagagtttcagaagctgagtttttggccaggacagcctgtacttctgttgaggagtttcaagtttttaagaagctcctggctcgggaggaggaggagtctgagagcagcacatctgatgacaaaagggcaagtctggatgaggatgaggatgacgatgatgaggaggacaatgatgaggatgacaatgatgaggatgacgatgatgaggacgacgacgaggcggaggacaatgatgaggatgaggacgacgacgaggaggaatagctgtgatggaaggactagagcgaaagggcccagagatatcaaggaagcttttcattctcttaaagcttttgggtcctttacttgaatcttctcaagttattttttattctaaaactggtctcttgatgaaaaaaattataagtcacctgagaggcagacagatcaaaccaaacaggaaacaggaaatgcatgtttgatctgttgtcacgtgtctgtggggagggccctgtcccatcctgaataagatacttatgttgagctattcacatcaaggggactcaatatatcaacaattggttttatttttttctcttttgaatatgttggtgataattccgtgacagttggaagatggggttcattcttccggttcaggaatcactatgtatttccttcttgtgataaaaataaaattacgagaaggcaatgtgaggttttagtacatcatagcactttattttatgaaaacatgtagcagattttccacaaaaatgcttatttttaatccaaaagtatattgcttcataatggtattcagtgcacagcagagtaaaagaagttaattcatgatgtactggttaattttgcatggcttcttaaggccagcaaaatgctggcagttttctttatctttgtgaagaacaggcccttcctgtttggggaagttggcttttatgtcagctcttggccagtggtcacttccaagcctggtgtctccggccctgtagtctgtagtgccagactgtgctggcctggagagtgctggggcaggtggaggccagggaatggtcccatacagttatctcccctgccctggttacagacagcttcgagaaccagaggagaagagcatagggtcatggagcagcagcctcgtcttacagcgtgactgcaaagaaaaagacttttgttttgcaaaagaaaagcagctcggtgactccgtccacatcgccacagttgagtcagatggcagtggcagtcctttgccagtggaaggagttcctgctaaggggaggtgcaggaggactaatttattattgtgcaactgccagtcctgcgcattccagctacgctaagcgccctgcccaggcacgtaacaaaacatagacctgttttgaagtggcttgttacccaagggtgcctcactcatctgcgccaccaggaagatgaactgtgagggctcctataaggggcaggaagagcaaagctgtcctaggccaaccagagattcatctttcatgcagtgacatgttgataaaaaatgatggtcagtatgaaactggtaacaggttgtagatggctttctatggtatatcccagtctcttgcaaacgattgtgaagaatgccagtgttgtttaagattcggcagtttgtgtggggaggtgggggcaggatggggtttggttgccaaaagagtttgggaaatgctggcttaaacaaaggcgagaggaagttcctttcacgtcaggatttatgaatgcctatgagcccagtgtcagtgacgactttctagcggcggtcttcaacactttctaaatattaagcgatcaaggcccctgccccacttttagttccaacagaatgccgttcacaagatctgggaggcactctctcagccctctcctggagcccccggaatttctcagcagcccaggccctcccgctgcccgtggcccctcctcccaggtgccaggtggtcttccagcctctccaagggcccacccccctgcctcttcctcccactgcagctgatctaggggtttcttggccacatttcccttgagagagagtgggatttgccctatccacagagagcctcatttccacctgaaggtgtatttgtcagtggctagaccaggttcatgtctgtttccccttggggacttctgaaccttcctgcccgggagtctgtaacacagcagcacaggaccgcgcttcctttagcagtgctgagtaagcaggcagcggcactctgagatcccggggctgggcagtcgccccccacttcccagcagctctgtggtagtggggcgggagcagcagggacgtaccttaagatttctccagtgtctgactcttactttgtttcctgaaataattagagaaaagtcgtttaatgaaaaagagactgtgtaccttgaattctacagctacctcagtccaggctgcctgctgagatcctgtctttagctcacatacattccacggtgggggacaccattagtccagacaccgctgtggagattagcattttagtttgtgtgcgcccgcctggcttgaggcagtagtttaggaatgacaaggctagaaacctggctggctgtgagtcagagagagagaggatggacgtgggagaaagcaagcaaaagctaccctagggaagagccggtgacgtgcacaggccgagcagcacggctggtgagctgcaggctgcggccttgcccggacacttggtaatgccaaacaagtacgtgtggctactcattggtctatgaggacgatgacaggcttcgactctgtggtttctaaagcatataatattctcacgtacttctttcagcaaacgccaaacagtagtaattcttgtaactaccttgaaccctttgtggaaagaacctgggtgtgagtgaataaaaagtaaagagcgacgcgctatatcggccattaaatactcggggctgtccgtaacaccctgtgcttcccaattgtagcaccatgttctgtgtgaatatgcataaccagagtgaccccccccagcacccagcatgcccggctgtgcccctctgggtatgctcacatgcacatatatggacatacagtttcgtagcagaacgtggctgcccaggggctgcctatctgggcgagtagaccgcctggctcagcccacaggcctgcagcatcccatagcaccccgcccttgccccatcaccctgtgggctacatgcaggacacggcatgggcctgctccccagaggcacctgtttggggtcttcttgaggcttgtgctttcacagctctctttgaagcagatgtcttggtgaactcggtagactcttttatacctgttgtcacaagaaagctttgtaaaaccagacagtgaagcaaaatgttgccaactgcttaacctaggctatgtgaacccacagtaaacctgaaggtgtttgagggaaaaactgctattttctgaatgaaacgtgacctcctattgatgtattaaaatgtctaacataaaggtcatgtgatttgtaataaatttattgtggtacagtaatatgcataaaataaacccattttaatgtgcattctgatgagcactgacaaaggatatggtactaaaaataaaatgtgaaatgtc

SEQ ID NO: 154738 - DNA, 2528 bp, Homo sapiens
  Payload ID: 10418
  Gene Symbol: MTIF2
  Gene Name: mitochondrial translational initiation factor 2
  Uniprot ID: P46199
  ENST ID: ENST00000263629
  CDS Start-End: 317-2500
ggactgacctaccgaccattcttccgggtccagaaggtgatctccgcccgtgctcagaatccaggggcccggggctgtagattccttgacaaggatatcctagcggcgaaacaacaccgtactgggagtcagaacgtctgggttctagtcttgactgccattaactagcggtatgacattggagaagcttttttgacccttctggatttccgtttccttttctgtaaaatgaggagcttggaagatccggaaaatgaggcccataggaaacaagtgacttgctgagtccagataacactgactgtcagagagaaacatgaaccagaagctactgaagttggagaacttgctacgatttcacactatttataggcaactgcacagtctgtgtcaaagaagagcattaagacagtggaggcatgggttttcatctgcttaccctgtgtggacagctcaactgtgtgcctggccctggccaacagatgtgctcactggggctgctttatctcagtataggcttctagtaacaaaaaaggaagaaggaccatggaaatctcagttatcttcaacaaaatctaaaaaggtggtagaagtatggattggaatgactattgaggaactggccagggcaatggaaaaaaacacagattatgtatatgaagctttattgaacactgatattgacatagattcactggaagcagactcacatttagatgaagtctggatcaaagaagtgataacgaaggcagggatgaagttaaagtggagtaaattaaaacaggacaaagtcagaaaaaataaagatgctgtaagaaggccccaggcagatccagctttattaaccccaaggtccccagttgttactataatgggccatgttgatcacgggaaaacgacattacttgacaaatttcgaaaaactcaagtggcagcagtggaaactggaggcatcactcagcacattggtgcctttcttgtctctctgccttctggggaaaagataacttttcttgatactccaggacatgctgctttctcagcaatgagagccagaggtgctcaggtcactgacattgtcgtattggttgtagctgcagatgatggagtgatgaaacaaactgtagaatctattcagcatgccaaagatgcacaggttcctattatccttgccgtaaataaatgtgacaaagctgaggctgatcctgagaaagtgaaaaaagagctgctggcttacgatgtggtatgtgaagattatggaggtgatgttcaagcagtgcctgtctccgcacttacgggcgataatctgatggctttggcagaagcaacagttgctcttgcagaaatgttagaattgaaagcagatcccaatggtccagtggaaggaacagtaatagagtctttcacagacaaaggaagaggtcttgttactacagctataattcaaagaggaactttaagaaaaggctctgttctggttgctggaaaatgttgggcaaaagtacgcttaatgtttgatgaaaatggaaaaacaattgatgaggcctatcccagcatgccagtgggaattacaggctggagagaccttccttctgcaggagaagaaattcttgaagtagaatctgagccaagggcacgtgaagttgttgactggaggaaatatgaacaagaacaggagaaaggtcaggaggatctgaaaataatagaagaaaagcgaaaggaacacaaagaagcacatcagaaagcccgtgagaagtatggccatctactgtggaagaagagatcaattctacggtttttagaaagaaaagaacaaatacccttaaagccaaaagagaaaagggaaagagattcaaatgtactttctgtgattattaaaggtgatgttgatggttctgttgaggccattttgaacattatagatacctatgatgcttcacacgagtgtgaactagaattagtacattttggagtgggtgatgtaagtgcaaatgatgttaaccttgctgaaacatttgatggtgttatatatggctttaatgtgaatgcaggcaatgttatccaacagtcagctgcaaaaaaaggagtaaaaattaaacttcacaaaataatttaccgtcttgttgaagatttgcaagaggaactgagcagcagattaccctgtgctgtggaagagcacccagtaggtgaggcatctatactagctaccttctctgtaacagaagggaagaaaaaagttcctgtggctggctgcagagtccaaaagggacagttagaaaaacaaaaaaaatttaaactaacccgtaatggacatgtaatttggaagggctcattaacctcattgaaacaccataaagatgacatttcaattgtcaaaacgggaatggattgtggtctcagtttagatgaagacaatatggaatttcaagtgggagacagaattgtttgttatgaagaaaagcaaattcaagccaagacttcttgggatccaggattttaaaattacattaaaaatgtaaataactcaa

SEQ ID NO: 154739 - DNA, 2221 bp, Homo sapiens
  Payload ID: 10418
  Gene Symbol: MTIF2
  Gene Name: mitochondrial translational initiation factor 2
  Uniprot ID: P46199
  ENST ID: ENST00000394600
  CDS Start-End: 11-2194
caggagaaacatgaaccagaagctactgaagttggagaacttgctacgatttcacactatttataggcaactgcacagtctgtgtcaaagaagagcattaagacagtggaggcatgggttttcatctgcttaccctgtgtggacagctcaactgtgtgcctggccctggccaacagatgtgctcactggggctgctttatctcagtataggcttctagtaacaaaaaaggaagaaggaccatggaaatctcagttatcttcaacaaaatctaaaaaggtggtagaagtatggattggaatgactattgaggaactggccagggcaatggaaaaaaacacagattatgtatatgaagctttattgaacactgatattgacatagattcactggaagcagactcacatttagatgaagtctggatcaaagaagtgataacgaaggcagggatgaagttaaagtggagtaaattaaaacaggacaaagtcagaaaaaataaagatgctgtaagaaggccccaggcagatccagctttattaaccccaaggtccccagttgttactataatgggccatgttgatcacgggaaaacgacattacttgacaaatttcgaaaaactcaagtggcagcagtggaaactggaggcatcactcagcacattggtgcctttcttgtctctctgccttctggggaaaagataacttttcttgatactccaggacatgctgctttctcagcaatgagagccagaggtgctcaggtcactgacattgtcgtattggttgtagctgcagatgatggagtgatgaaacaaactgtagaatctattcagcatgccaaagatgcacaggttcctattatccttgccgtaaataaatgtgacaaagctgaggctgatcctgagaaagtgaaaaaagagctgctggcttacgatgtggtatgtgaagattatggaggtgatgttcaagcagtgcctgtctccgcacttacgggcgataatctgatggctttggcagaagcaacagttgctcttgcagaaatgttagaattgaaagcagatcccaatggtccagtggaaggaacagtaatagagtctttcacagacaaaggaagaggtcttgttactacagctataattcaaagaggaactttaagaaaaggctctgttctggttgctggaaaatgttgggcaaaagtacgcttaatgtttgatgaaaatggaaaaacaattgatgaggcctatcccagcatgccagtgggaattacaggctggagagaccttccttctgcaggagaagaaattcttgaagtagaatctgagccaagggcacgtgaagttgttgactggaggaaatatgaacaagaacaggagaaaggtcaggaggatctgaaaataatagaagaaaagcgaaaggaacacaaagaagcacatcagaaagcccgtgagaagtatggccatctactgtggaagaagagatcaattctacggtttttagaaagaaaagaacaaatacccttaaagccaaaagagaaaagggaaagagattcaaatgtactttctgtgattattaaaggtgatgttgatggttctgttgaggccattttgaacattatagatacctatgatgcttcacacgagtgtgaactagaattagtacattttggagtgggtgatgtaagtgcaaatgatgttaaccttgctgaaacatttgatggtgttatatatggctttaatgtgaatgcaggcaatgttatccaacagtcagctgcaaaaaaaggagtaaaaattaaacttcacaaaataatttaccgtcttgttgaagatttgcaagaggaactgagcagcagattaccctgtgctgtggaagagcacccagtaggtgaggcatctatactagctaccttctctgtaacagaagggaagaaaaaagttcctgtggctggctgcagagtccaaaagggacagttagaaaaacaaaaaaaatttaaactaacccgtaatggacatgtaatttggaagggctcattaacctcattgaaacaccataaagatgacatttcaattgtcaaaacgggaatggattgtggtctcagtttagatgaagacaatatggaatttcaagtgggagacagaattgtttgttatgaagaaaagcaaattcaagccaagacttcttgggatccaggattttaaaattacattaaaaatgtaaataactca

SEQ ID NO: 154740 - DNA, 437 bp, Homo sapiens
  Payload ID: 10418
  Gene Symbol: MTIF2
  Gene Name: mitochondrial translational initiation factor 2
  ENST ID: ENST00000404297
  CDS Start-End: 227-437
atcctcaaagcttataagcgagtatcaagacatgtgatatggttttaaaatagctgatgataaagtatatacatcatctcattttctcctcttagtcttgtaataggaaggacagatattcaaacacttatttatttatttatttttaacagagatccggaaaatgaggcccataggaaacaagtgacttgctgagtccagataacactgactgtcagagagaaacatgaaccagaagctactgaagttggagaacttgctacgatttcacactatttataggcaactgcacagtctgtgtcaaagaagagcattaagacagtggaggcatgggttttcatctgcttaccctgtgtggacagctcaactgtgtgcctggccctggccaacagatgtgctcactggggctgctttatctcagtataggcttctagtaa

SEQ ID NO: 154741 - DNA, 2386 bp, Homo sapiens
  Payload ID: 10418
  Gene Symbol: MTIF2
  Gene Name: mitochondrial translational initiation factor 2
  Uniprot ID: P46199
  ENST ID: ENST00000403721
  CDS Start-End: 150-2333
gacctaccgaccattcttccgggtccagaaggtgatctccgcccgtgctcagaatccaggggcccggggctgtagagatccggaaaatgaggcccataggaaacaagtgacttgctgagtccagataacactgactgtcagagagaaacatgaaccagaagctactgaagttggagaacttgctacgatttcacactatttataggcaactgcacagtctgtgtcaaagaagagcattaagacagtggaggcatgggttttcatctgcttaccctgtgtggacagctcaactgtgtgcctggccctggccaacagatgtgctcactggggctgctttatctcagtataggcttctagtaacaaaaaaggaagaaggaccatggaaatctcagttatcttcaacaaaatctaaaaaggtggtagaagtatggattggaatgactattgaggaactggccagggcaatggaaaaaaacacagattatgtatatgaagctttattgaacactgatattgacatagattcactggaagcagactcacatttagatgaagtctggatcaaagaagtgataacgaaggcagggatgaagttaaagtggagtaaattaaaacaggacaaagtcagaaaaaataaagatgctgtaagaaggccccaggcagatccagctttattaaccccaaggtccccagttgttactataatgggccatgttgatcacgggaaaacgacattacttgacaaatttcgaaaaactcaagtggcagcagtggaaactggaggcatcactcagcacattggtgcctttcttgtctctctgccttctggggaaaagataacttttcttgatactccaggacatgctgctttctcagcaatgagagccagaggtgctcaggtcactgacattgtcgtattggttgtagctgcagatgatggagtgatgaaacaaactgtagaatctattcagcatgccaaagatgcacaggttcctattatccttgccgtaaataaatgtgacaaagctgaggctgatcctgagaaagtgaaaaaagagctgctggcttacgatgtggtatgtgaagattatggaggtgatgttcaagcagtgcctgtctccgcacttacgggcgataatctgatggctttggcagaagcaacagttgctcttgcagaaatgttagaattgaaagcagatcccaatggtccagtggaaggaacagtaatagagtctttcacagacaaaggaagaggtcttgttactacagctataattcaaagaggaactttaagaaaaggctctgttctggttgctggaaaatgttgggcaaaagtacgcttaatgtttgatgaaaatggaaaaacaattgatgaggcctatcccagcatgccagtgggaattacaggctggagagaccttccttctgcaggagaagaaattcttgaagtagaatctgagccaagggcacgtgaagttgttgactggaggaaatatgaacaagaacaggagaaaggtcaggaggatctgaaaataatagaagaaaagcgaaaggaacacaaagaagcacatcagaaagcccgtgagaagtatggccatctactgtggaagaagagatcaattctacggtttttagaaagaaaagaacaaatacccttaaagccaaaagagaaaagggaaagagattcaaatgtactttctgtgattattaaaggtgatgttgatggttctgttgaggccattttgaacattatagatacctatgatgcttcacacgagtgtgaactagaattagtacattttggagtgggtgatgtaagtgcaaatgatgttaaccttgctgaaacatttgatggtgttatatatggctttaatgtgaatgcaggcaatgttatccaacagtcagctgcaaaaaaaggagtaaaaattaaacttcacaaaataatttaccgtcttgttgaagatttgcaagaggaactgagcagcagattaccctgtgctgtggaagagcacccagtaggtgaggcatctatactagctaccttctctgtaacagaagggaagaaaaaagttcctgtggctggctgcagagtccaaaagggacagttagaaaaacaaaaaaaatttaaactaacccgtaatggacatgtaatttggaagggctcattaacctcattgaaacaccataaagatgacatttcaattgtcaaaacgggaatggattgtggtctcagtttagatgaagacaatatggaatttcaagtgggagacagaattgtttgttatgaagaaaagcaaattcaagccaagacttcttgggatccaggattttaaaattacattaaaaatgtaaataactcaacgtgttgtttgtttgaaggtagaaa

SEQ ID NO: 154742 - DNA, 583 bp, Homo sapiens
  Payload ID: 10418
  Gene Symbol: MTIF2
  Gene Name: mitochondrial translational initiation factor 2
  ENST ID: ENST00000441307
  CDS Start-End: 372-583
gcagacagtcccacccccagcggcgacagcaactctctgaattccggaaagaaccttttccagcgggaccggaagcccggcggggaccgtagcggggacggactgacctaccgaccattcttccgggtccagaagattccttgacaaggatatcctagcggcgaaacaacaccgtactgggagtcagaacgtctgggttctagtcttgactgccattaactagcggtatgacattggagaagcttttttgacccttctggatttccgtttccttttctgtaaaatgaggagcttggaagatccggaaaatgaggcccataggaaacaagtgacttgctgagtccagataacactgactgtcagagagaaacatgaaccagaagctactgaagttggagaacttgctacgatttcacactatttataggcaactgcacagtctgtgtcaaagaagagcattaagacagtggaggcatgggttttcatctgcttaccctgtgtggacagctcaactgtgtgcctggccctggccaacagatgtgctcactggggctgctttatctcagtataggcttctagtaac

SEQ ID NO: 154743 - DNA, 580 bp, Homo sapiens
  Payload ID: 10418
  Gene Symbol: MTIF2
  Gene Name: mitochondrial translational initiation factor 2
  ENST ID: ENST00000412530
  CDS Start-End: 559-580
cagggttgtccggtgcaggtggtgtgtgttgtttcgcctaacgtgtcagtggcacaaatcacgcgaacttcataaacattgtgcgttcggaagcctttccaagatgcatttaatccctgcgtgagcccacgttaggcattcacgaaggcatgtgcactgttctctcggaagcggctggccggcttcccctcctcgcgcgcggctgtgggtgcaggtcctcacttcccagcctcccatgggcccaaggccttctgggctccaatttgaggcgagccaccccagatccgtaatttttctgcagtgatttatttttacctttctgattccttgacaaggatatcctagcggcgaaacaacaccgtactgggagtcagaacgtctgggttctagtcttgactgccattaactagcggtatgacattggagaagcttttttgacccttctggatttccgtttccttttctgtaaaatgaggagcttggaagatccggaaaatgaggcccataggaaacaagtgacttgctgagtccagataacactgactgtcagagagaaacatgaaccagaagctactgaagt

SEQ ID NO: 154744 - DNA, 955 bp, Homo sapiens
  Payload ID: 10418
  Gene Symbol: MTIF2
  Gene Name: mitochondrial translational initiation factor 2
  ENST ID: ENST00000366137
  CDS Start-End: 738-955
cggggctgtaggtaggagttaagtgggtaggatcccttaaccagggttgtccggtgcaggtggtgtgtgttgtttcgcctaacgtgtcagtggcacaaatcacgcgaacttcataaacattgtgcgttcggaagcctttccaagatgcatttaatccctgcgtgagcccacgttaggcattcacgaaggcatgtgcactgttctctcggaagcggctggccggcttcccctcctcgcgcgcggctgtgggtgcaggtcctcacttcccagcctcccatgggcccaaggccttctgggctccaatttgaggcgagccaccccagatccgtaatttttctgcagtgatttatttttacctttctgattccttgacaaggatatcctagcggcgaaacaacaccgtactgggagtcagaacgtctgggttctagtcttgactgccattaactagcggtatgacattggagaagcttttttgacccttctggatttccgtttccttttctgtaaaatgaggagcttggaagatccggaaaatgaggcccataggaaacaagtgacttgctgagtccagataacactgactgtcagaagtctcgctctgtctccccggctggagtgcagtggcgtgatcttggctcactgcaacctctgtctcccgggttcaagaaattctcctgcctcagcctcccaagtagctgggactacaggcatgtgccaccacgcccaggagaaacatgaaccagaagctactgaagttggagaacttgctacgatttcacactatttataggcaactgcacagtctgtgtcaaagaagagcattaagacagtggaggcatgggttttcatctgcttaccctgtgtggacagctcaactgtgtgcctggccctggccaacagatgtgctcactggggctgctttatctcagtataggcttctagtaacaaaaaa

SEQ ID NO: 154745 - DNA, 566 bp, Homo sapiens
  Payload ID: 10418
  Gene Symbol: MTIF2
  Gene Name: mitochondrial translational initiation factor 2
  ENST ID: ENST00000417363
  CDS Start-End: 536-566
aagatgcatttaatccctgcgtgagcccacgttaggcattcacgaaggcatgtgcactgttctctcggaagcggctggccggcttcccctcctcgcgcgcggctgtgggtgcaggtcctcacttcccagcctcccatgggcccaaggccttctgggctccaatttgaggcgagccaccccagatccgtaatttttctgcagtgatttatttttacctttctggtaagttccaaagcttccagctcacattcagacgttttccctaacgcaactacgtatttgcaacatacttttttcagattccttgacaaggatatcctagcggcgaaacaacaccgtactgggagtcagaacgtctgggttctagtcttgactgccattaactagcggtatgacattggagaagcttttttgacccttctggatttccgtttccttttctgtaaaatgaggagcttggaagatccggaaaatgaggcccataggaaacaagtgacttgctgagtccagataacactgactgtcagagagaaacatgaaccagaagctactgaagttggagaact

SEQ ID NO: 154746 - DNA, 903 bp, Homo sapiens
  Payload ID: 10418
  Gene Symbol: MTIF2
  Gene Name: mitochondrial translational initiation factor 2
  ENST ID: ENST00000418823
  CDS Start-End: 1-903
ttcctattatccttgccgtaaataaatgtgacaaagctgaggctgatcctgagaaagtgaaaaaagagctgctggcttacgatgtggtatgtgaagattatggaggtgatgttcaagcagtgcctgtctccgcacttacgggcgataatctgatggctttggcagaagcaacagttgctcttgcagaaatgttagaattgaaagcagatcccaatggtccagtggaaggaacagtaatagagtctttcacagacaaaggaagaggtcttgttactacagctataattcaaagaggaactttaagaaaaggctctgttctggttgctggaaaatgttgggcaaaaccaagggcacgtgaagttgttgactggaggaaatatgaacaagaacaggagaaaggtcaggaggatctgaaaataatagaagaaaagcgaaaggaacacaaagaagcacatcagaaagcccgtgagaagtatggccatctactgtggaagaagagatcaattctacggtttttagaaagaaaagaacaaatacccttaaagccaaaagagaaaagggaaagagattcaaatgtactttctgtgattattaaaggtgatgttgatggttctgttgaggccattttgaacattatagatacctatgatgcttcacacgagtgtgaactagaattagtacattttggagtgggtgatgtaagtgcaaatgatgttaaccttgctgaaacatttgatggtgttatatatggctttaatgtgaatgcaggcaatgttatccaacagtcagctgcaaaaaaaggagtaaaaattaaacttcacaaaataatttaccgtcttgttgaagatttgcaagaggaactgagcagcagattaccctgtgctgtggaagagcacccagtag

SEQ ID NO: 154747 - DNA, 517 bp, Homo sapiens
  Payload ID: 10418
  Gene Symbol: MTIF2
  Gene Name: mitochondrial translational initiation factor 2
  ENST ID: ENST00000420637
  CDS Start-End: 439-517
agaatccaggggcccggggctgtaggtaggagttaagtgggtaggatcccttaaccagggttgtccggtgcaggtggtgtgtgttgtttcgcctaacgtgtcagtggcacaaatcacgcgaacttcataaacattgtgcgttcggaagcctttccaagatgcatttaatccctgcgtgagcccacgttaggcattcacgaagattccttgacaaggatatcctagcggcgaaacaacaccgtactgggagtcagaacgtctgggttctagtcttgactgccattaactagcggtatgacattggagaagcttttttgacccttctggatttccgtttccttttctgtaaaatgaggagcttggaagatccggaaaatgaggcccataggaaacaagtgacttgctgagtccagataacactgactgtcagagagaaacatgaaccagaagctactgaagttggagaacttgctacgatttcacactatttataggcaactgcacagtctgtgtcaaa

SEQ ID NO: 154748 - DNA, 1104 bp, Homo sapiens
  Payload ID: 10419
  Gene Symbol: MTIF3
  Gene Name: mitochondrial translational initiation factor 3
  Uniprot ID: Q9H2K0
  ENST ID: ENST00000381116
  CDS Start-End: 236-1072
gcagatccgctgtacttgcgtccgctacagtatgtcaatcgcttgccccagcacagtgggctccgtggcttaagacttgaaccaagtaaacgaagttctcttactgagaagtctcagtttcaaaagagcttctcctcatcaactggggatgattacagttcttcctaaaaaagcctacttgatgtgaagacaatgaggatgaagacctttatggtgatccacttccacttaatagatggctgctctttttctaaagaggttaacactacaaactgtaaagtctgaaaatagttgcattagatgttttggtaaacacatcctgcaaaagacagcaccagcacagttgtcccctattgcttctgccccaagactctccttcctaattcatgcaaaagcctttagtaccgctgaagacacccagaatgaaggaaaaaagacaaaaaagaataaaacagcttttagtaacgttggaagaaaaattagtcagcgagttattcacttatttgatgagaagggcaatgatttgggaaacatgcaccgagcaaatgtgattagacttatggatgagcgagacctgcgactggttcaaaggaacaccagcacagaacctgcagagtatcagctcatgacaggattgcagatcctccaggagcggcagaggctgagggagatggagaaggcgaaccccaaaactggaccaaccctgagaaaggaactgattttgtcttcaaatattggacaacatgatttggacacaaagactaaacagattcagcagtggattaagaaaaaacacctagtccagattaccataaagaaaggaaaaaatgtagacgtgtcagaaaatgaaatggaggagatatttcatcaaatactccagactatgcctggaatagctacattctcatctaggccacaagctgttcaaggaggaaaagctttaatgtgtgttcttcgtgctttcagcaaaaatgaggagaaggcatataaagaaactcaagagacccaggaaagagacactttgaacaaagaccatggaaatgataaggaatcaaatgttctgcatcagtaattttaataaagaaaagcatgctctgagagaaa

SEQ ID NO: 154749 - DNA, 1005 bp, Homo sapiens
  Payload ID: 10419
  Gene Symbol: MTIF3
  Gene Name: mitochondrial translational initiation factor 3
  Uniprot ID: Q9H2K0
  ENST ID: ENST00000381120
  CDS Start-End: 137-973
gggactcgccgcagatccgctgtacttgcgtccgctacagtatgtcaatcgcttgccccagcacagctgtcattcttctctacagaagagcttctcctcatcaactggggatgattacagttcttcctaaaaaaggatggctgctctttttctaaagaggttaacactacaaactgtaaagtctgaaaatagttgcattagatgttttggtaaacacatcctgcaaaagacagcaccagcacagttgtcccctattgcttctgccccaagactctccttcctaattcatgcaaaagcctttagtaccgctgaagacacccagaatgaaggaaaaaagacaaaaaagaataaaacagcttttagtaacgttggaagaaaaattagtcagcgagttattcacttatttgatgagaagggcaatgatttgggaaacatgcaccgagcaaatgtgattagacttatggatgagcgagacctgcgactggttcaaaggaacaccagcacagaacctgcagagtatcagctcatgacaggattgcagatcctccaggagcggcagaggctgagggagatggagaaggcgaaccccaaaactggaccaaccctgagaaaggaactgattttgtcttcaaatattggacaacatgatttggacacaaagactaaacagattcagcagtggattaagaaaaaacacctagtccagattaccataaagaaaggaaaaaatgtagacgtgtcagaaaatgaaatggaggagatatttcatcaaatactccagactatgcctggaatagctacattctcatctaggccacaagctgttcaaggaggaaaagctttaatgtgtgttcttcgtgctttcagcaaaaatgaggagaaggcatataaagaaactcaagagacccaggaaagagacactttgaacaaagaccatggaaatgataaggaatcaaatgttctgcatcagtaattttaataaagaaaagcatgctctgagagaaa

SEQ ID NO: 154750 - DNA, 889 bp, Homo sapiens
  Payload ID: 10419
  Gene Symbol: MTIF3
  Gene Name: mitochondrial translational initiation factor 3
  Uniprot ID: Q9H2K0
  ENST ID: ENST00000405591
  CDS Start-End: 28-864
atgaactcttcttactactttcttaggatggctgctctttttctaaagaggttaacactacaaactgtaaagtctgaaaatagttgcattagatgttttggtaaacacatcctgcaaaagacagcaccagcacagttgtcccctattgcttctgccccaagactctccttcctaattcatgcaaaagcctttagtaccgctgaagacacccagaatgaaggaaaaaagacaaaaaagaataaaacagcttttagtaacgttggaagaaaaattagtcagcgagttattcacttatttgatgagaagggcaatgatttgggaaacatgcaccgagcaaatgtgattagacttatggatgagcgagacctgcgactggttcaaaggaacaccagcacagaacctgcagagtatcagctcatgacaggattgcagatcctccaggagcggcagaggctgagggagatggagaaggcgaaccccaaaactggaccaaccctgagaaaggaactgattttgtcttcaaatattggacaacatgatttggacacaaagactaaacagattcagcagtggattaagaaaaaacacctagtccagattaccataaagaaaggaaaaaatgtagacgtgtcagaaaatgaaatggaggagatatttcatcaaatactccagactatgcctggaatagctacattctcatctaggccacaagctgttcaaggaggaaaagctttaatgtgtgttcttcgtgctttcagcaaaaatgaggagaaggcatataaagaaactcaagagacccaggaaagagacactttgaacaaagaccatggaaatgataaggaatcaaatgttctgcatcagtaattttaataaagaaaagcatgctctg

SEQ ID NO: 154751 - DNA, 1948 bp, Homo sapiens
  Payload ID: 10420
  Gene Symbol: MTRF1
  Gene Name: mitochondrial translational release factor 1
  Uniprot ID: O75570
  ENST ID: ENST00000379477
  CDS Start-End: 471-1808
gtactcacagttctttcctgatcttccccgccgcctcctgtattgcctctttatggaatcactccatatactgagttacacagcatggtttgcccgtgctgctgccccgcgggctgtcgcttctgacctgcctacactcagaactttccccaaagcatcagagtaatactgttactgtgatgggtaatggagaagtcgtgctgttctcagcgtgttgctttgtcgcccacgctggttgcagtggtgcgatctcagttcactgcaaccttcgcctcccaggttcaagcgattatcctgcctcagcttcccgagcagctaggactacaggatctcagctaaacgggaagcatttttgaaaagtgattgcacaattgagagtgaaaattactgagtcctgaacaggcaacttacattctaataccagctctgtctccatccagccgactgaatagtcgtgattaaatgctgagatgaatcgtcacctgtgtgtttggctttttagacatccatctcttaatggttacctccagtgtcacatccagctccattctcatcaatttagacagatacatcttgatacaaggctgcaagtttttagacaaaacaggaattgcattcttcatctgttaagtaagaattggtccaggagatattgccatcaagacaccaagatgctctggaagcataaagcactacagaaatatatggagaacctgagtaaggagtaccaaacacttgagcaatgtctgcagcatatccctgtgaatgaggaaaaccgaaggtccttgaacagaaggcatgctgagttggcacctcttgcagccatttaccaagaaattcaggagactgaacaagcaattgaagaattagaatcaatgtgtaaaagcctaaataaacaagatgaaaagcagttacaagaacttgcactggaagaaaggcaaaccattgatcaaaaaatcaacatgttgtacaatgagcttttccagagccttgtgccaaaggagaaatatgacaaaaatgatgttattttagaggtgacagctggaaggactactggaggtgacatctgccaacaatttacccgagaaatatttgacatgtaccagaattattcgtgctataaacactggcaatttgaacttctgaattatacaccagcagattatggtggactacatcatgcagccgcccgaatttccggtgacggtgtctataagcatttgaagtatgagggtgggattcaccgagttcagcgcatccccgaggtgggcctgtcctcaaggatgcagcgcattcacacaggaacgatgtcggttattgtccttcctcagccagatgaggtggatgtgaaattggaccccaaggatttgcgaatagatacatttcgagccaaaggagcaggagggcagcatgttaataaaactgatagtgccgtcagacttgtccacatccccacagggctagtagtagaatgccaacaagaaagatcacagataaaaaataaagaaatagcctttcgtgtgttgagagctagactctaccagcagattattgagaaagacaagcgtcagcaacaaagtgctagaaaactgcaggtgggaacaagagcccagtcagagcgaattcggacatataatttcacccaggatagagtcagtgaccacaggatagcatatgaagttcgtgatattaaggaatttttatgtggtgggaagggcctggatcagctaattcagagactgcttcaatcagcagatgaagaagccattgctgaacttttggatgaacaccttaaatcagcaaaataaatactaacttattattatttatgattatataaatgaaatggacctatatcaagaggcagactgaagcttggaaatcattatgaatatttgtaaattacagctttaagaacacattacacataaatatatgttttgtaatt

SEQ ID NO: 154752 - DNA, 2185 bp, Homo sapiens
  Payload ID: 10420
  Gene Symbol: MTRF1
  Gene Name: mitochondrial translational release factor 1
  Uniprot ID: O75570
  ENST ID: ENST00000379480
  CDS Start-End: 102-1439
cgtgatctcgggtttgtcgggctgaaatgtggcgggtctcggaaggttccgacctcagtaaagagagctaacgtgtattcttctttttcttagatgctgagatgaatcgtcacctgtgtgtttggctttttagacatccatctcttaatggttacctccagtgtcacatccagctccattctcatcaatttagacagatacatcttgatacaaggctgcaagtttttagacaaaacaggaattgcattcttcatctgttaagtaagaattggtccaggagatattgccatcaagacaccaagatgctctggaagcataaagcactacagaaatatatggagaacctgagtaaggagtaccaaacacttgagcaatgtctgcagcatatccctgtgaatgaggaaaaccgaaggtccttgaacagaaggcatgctgagttggcacctcttgcagccatttaccaagaaattcaggagactgaacaagcaattgaagaattagaatcaatgtgtaaaagcctaaataaacaagatgaaaagcagttacaagaacttgcactggaagaaaggcaaaccattgatcaaaaaatcaacatgttgtacaatgagcttttccagagccttgtgccaaaggagaaatatgacaaaaatgatgttattttagaggtgacagctggaaggactactggaggtgacatctgccaacaatttacccgagaaatatttgacatgtaccagaattattcgtgctataaacactggcaatttgaacttctgaattatacaccagcagattatggtggactacatcatgcagccgcccgaatttccggtgacggtgtctataagcatttgaagtatgagggtgggattcaccgagttcagcgcatccccgaggtgggcctgtcctcaaggatgcagcgcattcacacaggaacgatgtcggttattgtccttcctcagccagatgaggtggatgtgaaattggaccccaaggatttgcgaatagatacatttcgagccaaaggagcaggagggcagcatgttaataaaactgatagtgccgtcagacttgtccacatccccacagggctagtagtagaatgccaacaagaaagatcacagataaaaaataaagaaatagcctttcgtgtgttgagagctagactctaccagcagattattgagaaagacaagcgtcagcaacaaagtgctagaaaactgcaggtgggaacaagagcccagtcagagcgaattcggacatataatttcacccaggatagagtcagtgaccacaggatagcatatgaagttcgtgatattaaggaatttttatgtggtgggaagggcctggatcagctaattcagagactgcttcaatcagcagatgaagaagccattgctgaacttttggatgaacaccttaaatcagcaaaataaatactaacttattattatttatgattatataaatgaaatggacctatatcaagaggcagactgaagcttggaaatcattatgaatatttgtaaattacagctttaagaacacattacacataaatatatgttttgtaattaatcgaagtcacatttcctgacctaagaatttattttaggtttcctgtaaagtacaatccaactcatcaagtagaaaataagcatgcatcattgaaaagagaaagtattgagaattgattgtgtcatttaggacaagtcacttgttctctttatatgccttttttccccagccatctatgaattaatttaaatatatttttaatctactacttcaggaaaatatggtaaaatttagtaaaatatgaattttagacttccttataaaccttttatttaaatacaaagtaccttggcctatagtggatgcttatgcctgtaatcccagtgctttgaagggccaaagggggaagatctcttgaggtaagaatttgagaccagcctgggcaaaatagaccccatgtctacaaaaaaactcaaaacataaagaaaaaccataatactgttaatcatgttaaagttaagacttagactgcaacttttaaataaaaattatgaagaatatgagtcattcaataacaatgagcatctgggtacagacagtaaagccctttgattgctgtatgaattccacactatataaacaataagctgatattttaaataga

SEQ ID NO: 154753 - DNA, 820 bp, Homo sapiens
  Payload ID: 10420
  Gene Symbol: MTRF1
  Gene Name: mitochondrial translational release factor 1
  ENST ID: ENST00000452359
  CDS Start-End: 143-820
ggcgggtctcggaaggttccgacctcagtaaagagagctaacgtgtattcttctttttcttaggaaagtattccatgctacatgtgcaagaaacttggaaaacactgaaaagtagaaaaaatagcaagcaaaagatgctgagatgaatcgtcacctgtgtgtttggctttttagacatccatctcttaatggttacctccagtgtcacatccagctccattctcatcaatttagacagatacatcttgatacaaggctgcaagtttttagacaaaacaggaattgcattcttcatctgttaagtaagaattggtccaggagatattgccatcaagacaccaagatgctctggaagcataaagcactacagaaatatatggagaacctgagtaaggagtaccaaacacttgagcaatgtctgcagcatatccctgtgaatgaggaaaaccgaaggtccttgaacagaaggcatgctgagttggcacctcttgcagccatttaccaagaaattcaggagactgaacaagcaattgaagaattagaatcaatgtgtaaaagcctaaataaacaagatgaaaagcagttacaagaacttgcactggaagaaaggcaaaccattgatcaaaaaatcaacatgttgtacaatgagcttttccagagccttgtgccaaaggagaaatatgacaaaaatgatgttattttagaggtgacagctggaaggactactggaggtgacatctgccaacaatttacccgagaaatatttgacatgtaccagaattattcgtgctataaacactggcaatttgaacttctgaat

SEQ ID NO: 154754 - DNA, 557 bp, Homo sapiens
  Payload ID: 10420
  Gene Symbol: MTRF1
  Gene Name: mitochondrial translational release factor 1
  ENST ID: ENST00000430347
  CDS Start-End: 102-557
cgtgatctcgggtttgtcgggctgaaatgtggcgggtctcggaaggttccgacctcagtaaagagagctaacgtgtattcttctttttcttagatgctgagatgaatcgtcacctgtgtgtttggctttttagacatccatctcttaatggttacctccagtgtcacatccagctccattctcatcaatttagacagatacatcttgatacaaggctgcaagtttttagacaaaacaggaattgcattcttcatctgttaagtaagaattggtccaggagatattgccatcaagacaccaagatgctctggaagcataaagcactacagaaatatatggagaacctgagtaaggagtaccaaacacttgagcaatgtctgcagcatatccctgtgaatgaggaaaaccgaaggtccttgaacagaaggcatgctgagttggcacctcttgcagccatttaccaagaaattcaggagactgaacaagcaattgaagaattagaatcaatgtgtaaaaagacagagtcttgctctgtggcccaggctggaatgcagtag

SEQ ID NO: 154755 - DNA, 1561 bp, Homo sapiens
  Payload ID: 10420
  Gene Symbol: MTRF1
  Gene Name: mitochondrial translational release factor 1
  ENST ID: ENST00000239852
  CDS Start-End: 378-833
cgggtttgtcgggctgaaatgtggcgggtctcggaaggttccgacctcagtaaagagagctaacgtgtattcttctttttcttagcgtgttgctttgtcgcccacgctggttgcagtggtgcgatctcagttcactgcaaccttcgcctcccaggttcaagcgattatcctgcctcagcttcccgagcagctaggactacaggtgtgtgccatcacgctcagctaatttttttggtatttttagtagagatggggttttcccatgttggccaggctggtctcgaactcctgacctcagatgatctgcccgcctcggcctcccaaagtggtaggattacaggcgtgagccactgtgctcggcacattttgatgctgagatgaatcgtcacctgtgtgtttggctttttagacatccatctcttaatggttacctccagtgtcacatccagctccattctcatcaatttagacagatacatcttgatacaaggctgcaagtttttagacaaaacaggaattgcattcttcatctgttaagtaagaattggtccaggagatattgccatcaagacaccaagatgctctggaagcataaagcactacagaaatatatggagaacctgagtaaggagtaccaaacacttgagcaatgtctgcagcatatccctgtgaatgaggaaaaccgaaggtccttgaacagaaggcatgctgagttggcacctcttgcagccatttaccaagaaattcaggagactgaacaagcaattgaagaattagaatcaatgtgtaaaaagacagagtcttgctctgtggcccaggctggaatgcagtagtgtaatcatagctcactttaaccttgaactcctggactcaagcaatcctccaacctcagcctcccaagtagctgggactacaggcctaaataaacaagatgaaaagcagttacaagaacttgcactggaagaaaggcaaaccattgatcaaaaaatcaacatgttgtacaatgagcttttccagagccttgtgccaaaggagaaatatgacaaaaatgatgttattttagaggtgacagctggaaggactactggaggtgacatctgccaacaatttacccgagaaatatttgacatgtaccagaattattcgtgctataaacactggcaatttgaacttctgaattatacaccagcagattatggtaggcatattgaggaatttgcctgtaggagatactgaaaattattttacctctgatcttgattagaaccatattgtcccatttttttttgaaacttttggtgtatatctactaaacactgtggcataggctcatcaatcacagtggcttactattatagcagagttgttagctaggagaagacagtagaaaggagggaagcatttgcttagggagaaatatgtgaattagagaaaattcccctgaggaacttagatacgtatcttgcctcaaaatcatttttctctattattgaaagcaaaggtatattaaggtttttactttaaataactttataaaataatataagtattactaattaga

SEQ ID NO: 154756 - DNA, 737 bp, Homo sapiens
  Payload ID: 10420
  Gene Symbol: MTRF1
  Gene Name: mitochondrial translational release factor 1
  ENST ID: ENST00000480434
  CDS Start-End: 1-414
agaaggcatgctgagttggcacctcttgcagccatttaccaagaaattcaggagactgaacaagcaattgaagaattagaatcaatgtgtaaaagcctaaataaacaagatgaaaagcagttacaagaacttgcactggaagaaaggcaaaccattgatcaaaaaatcaacatgttgtacaatgagcttttccagagccttgtgccaaaggagaaatatgacaaaaatgatgttattttagaggtgacagctggaaggactactggaggtgacatctgccaacaatttacccgagaaatatttgacatgtaccagaattattcgtgctataaacactggcaatttgaacttctgaattatacaccagcagattatggtaggcatattgaggaatttgcctgtaggagatactgaaaattattttacctctgatcttgattagaaccatattgtcccatttttttttgaaacttttggtgtatatctactaaacactgtggcataggctcatcaatcacagtggcttactattatagcagagttgttagctaggagaagacagtagaaaggagggaagcatttgcttagggagaaatatgtgaattagagaaaattcccctgaggaacttagatacgtatcttgcctcaaaatcatttttctctattattgaaagcaaaggtatattaaggtttttactttaaataactttataaaataatataagtattactaatta

SEQ ID NO: 154757 - DNA, 863 bp, Homo sapiens
  Payload ID: 10420
  Gene Symbol: MTRF1
  Gene Name: mitochondrial translational release factor 1
  ENST ID: ENST00000497679
  CDS Start-End: 102-563
cgtgatctcgggtttgtcgggctgaaatgtggcgggtctcggaaggttccgacctcagtaaagagagctaacgtgtattcttctttttcttagatgctgagatgaatcgtcacctgtgtgtttggctttttagacatccatctcttaatggttacctccagtgtcacatccagctccattctcatcaatttagacagatacatcttgatacaaggctgcaagtttttagacaaaacaggaattgcattcttcatctgttaagtaagaattggtccaggagatattgccatcaagacaccaagatgctctggaagcataaagcactacagaaatatatggagaacctgagtaaggagtaccaaacacttgagcaatgtctgcagcatatccctgtgaatgaggaaaaccgaaggtccttgaacagaaggcatgctgagttggcacctcttgcagccatttaccaagaaattcaggagactgaacaagcaattgaagaattagaatcaatgtgtaaaagagacagagtcttgctctgtggcccaggctggaatgcagtagtgtaatcatagctcactttaaccttgaactcctggactcaagcaatcctccaacctcagcctcccaagtagctgggactacaggcctaaataaacaagatgaaaagcagttacaagaacttgcactggaagaaaggcaaaccattgatcaaaaaatcaacatgttgtacaatgagcttttccagagccttgtgccaaaggagaaatatgacaaaaatgatgttattttagaggtgacagctggaaggactactggaggtgacatctgccaacaatttacccgagaaatatttgacatgtaccaga

SEQ ID NO: 154758 - DNA, 3431 bp, Homo sapiens
  Payload ID: 10421
  Gene Symbol: MTRF1L
  Gene Name: mitochondrial translational release factor 1-like
  Uniprot ID: Q9UGC7
  ENST ID: ENST00000367230
  CDS Start-End: 1-708
atgcggtcccgggttctgtggggcgctgcccggtggctctggccccgccgggccgttggcccagcccgccggcccctgagctccggtagcccgccgctggaggagctgttcacccggggcgggcccttgcggaccttcctcgagcgccaggcggggtctgaagcccatttgaaggtcaggaggcccgagttgctggcggtgatcaaactgctgaacgagaaggagcgggagctgcgggagactgagcacttgctgcacgatgagaatgaagatttaaggaaacttgcagagaatgaaatcactttgtgtcaaaaagaaataactcagctgaagcatcagattatcttacttttggttccctcagaagaaacagatgaaaatgatttgatcctggaagtaactgcaggagttggaggtggccttagacatgcatctgccagcattgggggttcagaagcctataggcacatgaaatttgaaggaggtgttcacagagtacaaagagtgccaaagacagaaaagcaaggccgcgtccatactagcaccatgactgtagcaatattaccccagcctactgagattaatctggtgattaatccgaaagatttgagaattgacactaagcgagccagtggagctggggggcagcatgtaaataccacggacagtgctgtccggatagttcatcttccaacagattggaagtaaaggaagatcagagaaaataagaacatataattttccacagaaccgggtcacagatcacagaataaacaagacgctgcatgatcttgaaacttttatgcaaggagattatctactggatgaacttgtacagtcattgaaggaatacgccgattatgaatctttagtagaaattatttcccaaaaagtttaagttgatttgttatttatagactttcgtagcttagaaaaattctacagtacatccacatagggtgaaagtacccttactctcttgaaaaacgttgagttaacacagttggaggtaatatgcatattctgaagtcatagataatttacacagatctctctcaatgcattagcaaaaatcatacaatatacagatggtcctcgatttacattgtggttaattcccaataaacccatcataagttaaaaatgcatataacgttagcaacacagcagtctcctaattaatgacagcttgacttaacaattttccaactttaccatggtgtgaaagaggtatgattcctaagccctaaggagctcctcagcttgaaatggggctgcatccctataaacccatcataaagtcaaaaaatcctaaaacataagttggtgaccatctgtaatcatgatgtggtggtaaatcttggacgctaccttacaataactagacaaaggaaaatcatcctttgtcctgttctgtgtaaatatttaatgaatgatcaaaacttcagtttaaatattatgaaaaactttaaacataaagtagtagaaataagacagtaaatactgtatcctaatatccagtcaggatacagaaaccataccattaacttgaacagggataattttaatataaaaactgttaactgataatggtattaacttttaagagggatgaaagagagctatgatgtcctaggactgagagtaccccaggaaagaatacccttgaaagggtctccccttccccatggtgaagtcaggcctaatggagagagtggctacagcctactcagtgattgggaaattccctgtcttgccctgggccagagctggtgtaccgctggtggatcaggtcttacaagcaaagaacctcacactcccaactggtaagccagaagcctcttgctagggtgtgagcaaaacttggacaggaactctcagtagatgtttgtgtttgtcaagattctccagacaaacttccttaaaaggattggcttgtgttgttattattaagtctaacaagtccaaaagctggagtgtgaggcaggaggctggaaacccaggaaagctgatggtgcaaggtccagtccaaaggtatctgttggaggattctcttgttctgggaagaggacggtctttttttctcttcagaccttcacctgactggatcaagcccactaacatcgaggaggacagtctgcattactcagagttcactgattgatttaaatgtcaatctcatataaaacaccctcacagaaacacctagaataatgtttgaccttataattggaaaatcagagcaaaagttaaatctcaaaaaaaaaaaaaaaaaaagtatgacccagtagctaggcacctgtggccccgccaagttgacacataaaattaactgtcacagtatcatcttagaagtgaaagaagcccctttatcctgcagtgcccctctaccaccacctactgacaaagaacatggtgctatctggcatgggagaaatgttcagtttgctatggcttgtatgtgtcccctcaaattcaagtgttgccaatgtgacagcatcaagaggtggggtctttaagagatcactaggccatgagggattctcttaggactgggatgaaggcccataataaaagaggtttcggggagcatcctgctagcttgccttctgtatgtgagaacacagcaagaaagccctagtcaacaagtgccagctccttgatcttagacttcccatcctccagaactgtgagaaatacatttctgttccttacaaattacccagtctcctgtattctgttatagcagcacaaaatgaagataccatacctgaacacctgaacattcttcacaaggtagtaaatgcactgctttattctggtctcagtattgtgtgcttaataaggaaatgagaaagggtggatcagggcataggatgaacaagttactgctagacctctcacaatgccactaatggataagattgtattttcatcattcttgtctcttcggaagctaacaccatgctataataggcactaaatagatgtctaaaaacaccttaagtatttgtctagaaatctggtgcattgttcagaaagaaccaaaattcaaaataatttcaaagggcctaaagcactagttaatcaaaattcattagtttttaatggtactaccactctcaaatttaaaatgtcatcttacgttcctcttcctcgcattggatttattgctaaaacctggtaaacacttttaatccttttcaattccattaccactgctcttgtccagaattacttcgcagactaatagtcacctgacttctcccctgcatccgatttgctgtctaattctggttacaaataagtaactgccaaactaatctttctaaaaagcaagactgatctcgtcactcctttgctcaacaatgtaaaagctcccattgtctcccaaataaaaccagctttccactgtgtatacaatacatcca

SEQ ID NO: 154759 - DNA, 3539 bp, Homo sapiens
  Payload ID: 10421
  Gene Symbol: MTRF1L
  Gene Name: mitochondrial translational release factor 1-like
  Uniprot ID: Q9UGC7
  ENST ID: ENST00000367231
  CDS Start-End: 1-816
atgcggtcccgggttctgtggggcgctgcccggtggctctggccccgccgggccgttggcccagcccgccggcccctgagctccggtagcccgccgctggaggagctgttcacccggggcgggcccttgcggaccttcctcgagcgccaggcggggtctgaagcccatttgaaggtcaggaggcccgagttgctggcggtgatcaaactgctgaacgagaaggagcgggagctgcgggagactgagcacttgctgcacgatgagaatgaagatttaaggaaacttgcagagaatgaaatcactttgtgtcaaaaagaaataactcagctgaagcatcagattatcttacttttggttccctcagaagaaacagatgaaaatgatttgatcctggaagtaactgcaggagttggaggtcaggaggcaatgttgtttacatcagagatatttgatatgtatcagcaatatgctgcatttaaaagatggcattttgaaaccctggaatattttccaagtgaactaggtggccttagacatgcatctgccagcattgggggttcagaagcctataggcacatgaaatttgaaggaggtgttcacagagtacaaagagtgccaaagacagaaaagcaaggccgcgtccatactagcaccatgactgtagcaatattaccccagcctactgagattaatctggtgattaatccgaaagatttgagaattgacactaagcgagccagtggagctggggggcagcatgtaaataccacggacagtgctgtccggatagttcatcttccaacagattggaagtaaaggaagatcagagaaaataagaacatataattttccacagaaccgggtcacagatcacagaataaacaagacgctgcatgatcttgaaacttttatgcaaggagattatctactggatgaacttgtacagtcattgaaggaatacgccgattatgaatctttagtagaaattatttcccaaaaagtttaagttgatttgttatttatagactttcgtagcttagaaaaattctacagtacatccacatagggtgaaagtacccttactctcttgaaaaacgttgagttaacacagttggaggtaatatgcatattctgaagtcatagataatttacacagatctctctcaatgcattagcaaaaatcatacaatatacagatggtcctcgatttacattgtggttaattcccaataaacccatcataagttaaaaatgcatataacgttagcaacacagcagtctcctaattaatgacagcttgacttaacaattttccaactttaccatggtgtgaaagaggtatgattcctaagccctaaggagctcctcagcttgaaatggggctgcatccctataaacccatcataaagtcaaaaaatcctaaaacataagttggtgaccatctgtaatcatgatgtggtggtaaatcttggacgctaccttacaataactagacaaaggaaaatcatcctttgtcctgttctgtgtaaatatttaatgaatgatcaaaacttcagtttaaatattatgaaaaactttaaacataaagtagtagaaataagacagtaaatactgtatcctaatatccagtcaggatacagaaaccataccattaacttgaacagggataattttaatataaaaactgttaactgataatggtattaacttttaagagggatgaaagagagctatgatgtcctaggactgagagtaccccaggaaagaatacccttgaaagggtctccccttccccatggtgaagtcaggcctaatggagagagtggctacagcctactcagtgattgggaaattccctgtcttgccctgggccagagctggtgtaccgctggtggatcaggtcttacaagcaaagaacctcacactcccaactggtaagccagaagcctcttgctagggtgtgagcaaaacttggacaggaactctcagtagatgtttgtgtttgtcaagattctccagacaaacttccttaaaaggattggcttgtgttgttattattaagtctaacaagtccaaaagctggagtgtgaggcaggaggctggaaacccaggaaagctgatggtgcaaggtccagtccaaaggtatctgttggaggattctcttgttctgggaagaggacggtctttttttctcttcagaccttcacctgactggatcaagcccactaacatcgaggaggacagtctgcattactcagagttcactgattgatttaaatgtcaatctcatataaaacaccctcacagaaacacctagaataatgtttgaccttataattggaaaatcagagcaaaagttaaatctcaaaaaaaaaaaaaaaaaaagtatgacccagtagctaggcacctgtggccccgccaagttgacacataaaattaactgtcacagtatcatcttagaagtgaaagaagcccctttatcctgcagtgcccctctaccaccacctactgacaaagaacatggtgctatctggcatgggagaaatgttcagtttgctatggcttgtatgtgtcccctcaaattcaagtgttgccaatgtgacagcatcaagaggtggggtctttaagagatcactaggccatgagggattctcttaggactgggatgaaggcccataataaaagaggtttcggggagcatcctgctagcttgccttctgtatgtgagaacacagcaagaaagccctagtcaacaagtgccagctccttgatcttagacttcccatcctccagaactgtgagaaatacatttctgttccttacaaattacccagtctcctgtattctgttatagcagcacaaaatgaagataccatacctgaacacctgaacattcttcacaaggtagtaaatgcactgctttattctggtctcagtattgtgtgcttaataaggaaatgagaaagggtggatcagggcataggatgaacaagttactgctagacctctcacaatgccactaatggataagattgtattttcatcattcttgtctcttcggaagctaacaccatgctataataggcactaaatagatgtctaaaaacaccttaagtatttgtctagaaatctggtgcattgttcagaaagaaccaaaattcaaaataatttcaaagggcctaaagcactagttaatcaaaattcattagtttttaatggtactaccactctcaaatttaaaatgtcatcttacgttcctcttcctcgcattggatttattgctaaaacctggtaaacacttttaatccttttcaattccattaccactgctcttgtccagaattacttcgcagactaatagtcacctgacttctcccctgcatccgatttgctgtctaattctggttacaaataagtaactgccaaactaatctttctaaaaagcaagactgatctcgtcactcctttgctcaacaatgtaaaagctcccattgtctcccaaataaaaccagctttccactgtgtatacaatacatcca

SEQ ID NO: 154760 - DNA, 3676 bp, Homo sapiens
  Payload ID: 10421
  Gene Symbol: MTRF1L
  Gene Name: mitochondrial translational release factor 1-like
  Uniprot ID: Q9UGC7
  ENST ID: ENST00000367233
  CDS Start-End: 1-1143
atgcggtcccgggttctgtggggcgctgcccggtggctctggccccgccgggccgttggcccagcccgccggcccctgagctccggtagcccgccgctggaggagctgttcacccggggcgggcccttgcggaccttcctcgagcgccaggcggggtctgaagcccatttgaaggtcaggaggcccgagttgctggcggtgatcaaactgctgaacgagaaggagcgggagctgcgggagactgagcacttgctgcacgatgagaatgaagatttaaggaaacttgcagagaatgaaatcactttgtgtcaaaaagaaataactcagctgaagcatcagattatcttacttttggttccctcagaagaaacagatgaaaatgatttgatcctggaagtaactgcaggagttggaggtcaggaggcaatgttgtttacatcagagatatttgatatgtatcagcaatatgctgcatttaaaagatggcattttgaaaccctggaatattttccaagtgaactaggtggccttagacatgcatctgccagcattgggggttcagaagcctataggcacatgaaatttgaaggaggtgttcacagagtacaaagagtgccaaagacagaaaagcaaggccgcgtccatactagcaccatgactgtagcaatattaccccagcctactgagattaatctggtgattaatccgaaagatttgagaattgacactaagcgagccagtggagctggggggcagcatgtaaataccacggacagtgctgtccggatagttcatcttccaacaggtgttgtttctgaatgtcaacaagagagatctcagctgaaaaataaagagctggctatgacaaagttacgtgcaaaactgtacagcatgcatctagaagaagaaataaataaaagacagaatgctagaaaaattcagattggaagtaaaggaagatcagagaaaataagaacatataattttccacagaaccgggtcacagatcacagaataaacaagacgctgcatgatcttgaaacttttatgcaaggagattatctactggatgaacttgtacagtcattgaaggaatacgccgattatgaatctttagtagaaattatttcccaaaaagtttaagttgatttgttatttatagactttcgtagcttagaaaaattctacagtacatccacatagggtgaaagtacccttactctcttgaaaaacgttgagttaacacagttggaggtaatatgcatattctgaagtcatagataatttacacagatctctctcaatgcattagcaaaaatcatacaatatacagatggtcctcgatttacattgtggttaattcccaataaacccatcataagttaaaaatgcatataacgttagcaacacagcagtctcctaattaatgacagcttgacttaacaattttccaactttaccatggtgtgaaagaggtatgattcctaagccctaaggagctcctcagcttgaaatggggctgcatccctataaacccatcataaagtcaaaaaatcctaaaacataagttggtgaccatctgtaatcatgatgtggtggtaaatcttggacgctaccttacaataactagacaaaggaaaatcatcctttgtcctgttctgtgtaaatatttaatgaatgatcaaaacttcagtttaaatattatgaaaaactttaaacataaagtagtagaaataagacagtaaatactgtatcctaatatccagtcaggatacagaaaccataccattaacttgaacagggataattttaatataaaaactgttaactgataatggtattaacttttaagagggatgaaagagagctatgatgtcctaggactgagagtaccccaggaaagaatacccttgaaagggtctccccttccccatggtgaagtcaggcctaatggagagagtggctacagcctactcagtgattgggaaattccctgtcttgccctgggccagagctggtgtaccgctggtggatcaggtcttacaagcaaagaacctcacactcccaactggtaagccagaagcctcttgctagggtgtgagcaaaacttggacaggaactctcagtagatgtttgtgtttgtcaagattctccagacaaacttccttaaaaggattggcttgtgttgttattattaagtctaacaagtccaaaagctggagtgtgaggcaggaggctggaaacccaggaaagctgatggtgcaaggtccagtccaaaggtatctgttggaggattctcttgttctgggaagaggacggtctttttttctcttcagaccttcacctgactggatcaagcccactaacatcgaggaggacagtctgcattactcagagttcactgattgatttaaatgtcaatctcatataaaacaccctcacagaaacacctagaataatgtttgaccttataattggaaaatcagagcaaaagttaaatctcaaaaaaaaaaaaaaaaaaagtatgacccagtagctaggcacctgtggccccgccaagttgacacataaaattaactgtcacagtatcatcttagaagtgaaagaagcccctttatcctgcagtgcccctctaccaccacctactgacaaagaacatggtgctatctggcatgggagaaatgttcagtttgctatggcttgtatgtgtcccctcaaattcaagtgttgccaatgtgacagcatcaagaggtggggtctttaagagatcactaggccatgagggattctcttaggactgggatgaaggcccataataaaagaggtttcggggagcatcctgctagcttgccttctgtatgtgagaacacagcaagaaagccctagtcaacaagtgccagctccttgatcttagacttcccatcctccagaactgtgagaaatacatttctgttccttacaaattacccagtctcctgtattctgttatagcagcacaaaatgaagataccatacctgaacacctgaacattcttcacaaggtagtaaatgcactgctttattctggtctcagtattgtgtgcttaataaggaaatgagaaagggtggatcagggcataggatgaacaagttactgctagacctctcacaatgccactaatggataagattgtattttcatcattcttgtctcttcggaagctaacaccatgctataataggcactaaatagatgtctaaaaacaccttaagtatttgtctagaaatctggtgcattgttcagaaagaaccaaaattcaaaataatttcaaagggcctaaagcactagttaatcaaaattcattagtttttaatggtactaccactctcaaatttaaaatgtcatcttacgttcctcttcctcgcattggatttattgctaaaacctggtaaacacttttaatccttttcaattccattaccactgctcttgtccagaattacttcgcagactaatagtcacctgacttctcccctgcatccgatttgctgtctaattctggttacaaataagtaactgccaaactaatctttctaaaaagcaagactgatctcgtcactcctttgctcaacaatgtaaaagctcccattgtctcccaaataaaaccagctttccactgtgtatacaatacatcca

SEQ ID NO: 154761 - DNA, 3229 bp, Homo sapiens
  Payload ID: 10421
  Gene Symbol: MTRF1L
  Gene Name: mitochondrial translational release factor 1-like
  ENST ID: ENST00000414771
  CDS Start-End: 1-696
attatcttacttttggttccctcagaagaaacagatgaaaatgatttgatcctggaagtaactgcaggagttggaggtggccttagacatgcatctgccagcattgggggttcagaagcctataggcacatgaaatttgaaggaggtgttcacagagtacaaagagtgccaaagacagaaaagcaaggccgcgtccatactagcaccatgactgtagcaatattaccccagcctactgagattaatctggtgattaatccgaaagatttgagaattgacactaagcgagccagtggagctggggggcagcatgtaaataccacggacagtgctgtccggatagttcatcttccaacaggtgttgtttctgaatgtcaacaagagagatctcagctgaaaaataaagagctggctatgacaaagttacgtgcaaaactgtacagcatgcatctagaagaagaaataaataaaagacagaatgctagaaaaattcagattggaagtaaaggaagatcagagaaaataagaacatataattttccacagaaccgggtcacagatcacagaataaacaagacgctgcatgatcttgaaacttttatgcaaggagattatctactggatgaacttgtacagtcattgaaggaatacgccgattatgaatctttagtagaaattatttcccaaaaagtttaagttgatttgttatttatagactttcgtagcttagaaaaattctacagtacatccacatagggtgaaagtacccttactctcttgaaaaacgttgagttaacacagttggaggtaatatgcatattctgaagtcatagataatttacacagatctctctcaatgcattagcaaaaatcatacaatatacagatggtcctcgatttacattgtggttaattcccaataaacccatcataagttaaaaatgcatataacgttagcaacacagcagtctcctaattaatgacagcttgacttaacaattttccaactttaccatggtgtgaaagaggtatgattcctaagccctaaggagctcctcagcttgaaatggggctgcatccctataaacccatcataaagtcaaaaaatcctaaaacataagttggtgaccatctgtaatcatgatgtggtggtaaatcttggacgctaccttacaataactagacaaaggaaaatcatcctttgtcctgttctgtgtaaatatttaatgaatgatcaaaacttcagtttaaatattatgaaaaactttaaacataaagtagtagaaataagacagtaaatactgtatcctaatatccagtcaggatacagaaaccataccattaacttgaacagggataattttaatataaaaactgttaactgataatggtattaacttttaagagggatgaaagagagctatgatgtcctaggactgagagtaccccaggaaagaatacccttgaaagggtctccccttccccatggtgaagtcaggcctaatggagagagtggctacagcctactcagtgattgggaaattccctgtcttgccctgggccagagctggtgtaccgctggtggatcaggtcttacaagcaaagaacctcacactcccaactggtaagccagaagcctcttgctagggtgtgagcaaaacttggacaggaactctcagtagatgtttgtgtttgtcaagattctccagacaaacttccttaaaaggattggcttgtgttgttattattaagtctaacaagtccaaaagctggagtgtgaggcaggaggctggaaacccaggaaagctgatggtgcaaggtccagtccaaaggtatctgttggaggattctcttgttctgggaagaggacggtctttttttctcttcagaccttcacctgactggatcaagcccactaacatcgaggaggacagtctgcattactcagagttcactgattgatttaaatgtcaatctcatataaaacaccctcacagaaacacctagaataatgtttgaccttataattggaaaatcagagcaaaagttaaatctcaaaaaaaaaaaaaaaaaaagtatgacccagtagctaggcacctgtggccccgccaagttgacacataaaattaactgtcacagtatcatcttagaagtgaaagaagcccctttatcctgcagtgcccctctaccaccacctactgacaaagaacatggtgctatctggcatgggagaaatgttcagtttgctatggcttgtatgtgtcccctcaaattcaagtgttgccaatgtgacagcatcaagaggtggggtctttaagagatcactaggccatgagggattctcttaggactgggatgaaggcccataataaaagaggtttcggggagcatcctgctagcttgccttctgtatgtgagaacacagcaagaaagccctagtcaacaagtgccagctccttgatcttagacttcccatcctccagaactgtgagaaatacatttctgttccttacaaattacccagtctcctgtattctgttatagcagcacaaaatgaagataccatacctgaacacctgaacattcttcacaaggtagtaaatgcactgctttattctggtctcagtattgtgtgcttaataaggaaatgagaaagggtggatcagggcataggatgaacaagttactgctagacctctcacaatgccactaatggataagattgtattttcatcattcttgtctcttcggaagctaacaccatgctataataggcactaaatagatgtctaaaaacaccttaagtatttgtctagaaatctggtgcattgttcagaaagaaccaaaattcaaaataatttcaaagggcctaaagcactagttaatcaaaattcattagtttttaatggtactaccactctcaaatttaaaatgtcatcttacgttcctcttcctcgcattggatttattgctaaaacctggtaaacacttttaatccttttcaattccattaccactgctcttgtccagaattacttcgcagactaatagtcacctgacttctcccctgcatccgatttgctgtctaattctggttacaaataagtaactgccaaactaatctttctaaaaagcaagactgatctcgtcactcctttgctcaacaatgtaaaagctcccattgtctcccaaataaaaccagctttccactgtgtatacaatacatcca

SEQ ID NO: 154762 - DNA, 508 bp, Homo sapiens
  Payload ID: 10421
  Gene Symbol: MTRF1L
  Gene Name: mitochondrial translational release factor 1-like
  ENST ID: ENST00000448966
  CDS Start-End: 18-508
tatgttttacagtctccatgttcatctccttttatgactttaaaaatatacctcaagatagtagatgtgatggtcaattatttataaatggcaggaataataaaaataattctatttccctgtattttcaaggtggccttagacatgcatctgccagcattgggggttcagaagcctataggcacatgaaatttgaaggaggtgttcacagagtacaaagagtgccaaagacagaaaagcaaggccgcgtccatactagcaccatgactgtagcaatattaccccagcctactgagattaatctggtgattaatccgaaagatttgagaattgacactaagcgagccagtggagctggggggcagcatgtaaataccacggacagtgctgtccggatagttcatcttccaacaggtgttgtttctgaatgtcaacaagagagatctcagctgaaaaataaagagctggctatgacaaagttacgtgcaaaactgtacagcatgcatct

SEQ ID NO: 154763 - DNA, 2961 bp, Homo sapiens
  Payload ID: 10422
  Gene Symbol: MTO1
  Gene Name: mitochondrial tRNA translation optimization 1
  Uniprot ID: Q9Y2Z2
  ENST ID: ENST00000370300
  CDS Start-End: 91-2244
ggccgcgccctgcagattgtctcttgttgcgtaagtttttttgaccgtcactcgtgtcagcttcaaagtcagatagatttttctcccagcatgttctacttccgaggctgtggccgttgggtcgcggtttccttcaccaagcagcaatttccgttggcacggttgagcagtgacagcgcggcgccccggactccgcacttcgacgtgatagtcattggtggaggacatgccgggactgaggcagccaccgccgccgctcggtgcggctctcggactctgctcctcactcaccgcgtggacacgatcggtcagatgtcatgtaatccttcctttggtggcatcggaaagggacatttaatgagggaagtagatgccttggatggcctgtgttctcgcatctgtgaccagtctggtgtacattataaagtattaaaccggcgtaagggaccagctgtgtggggtctgagagctcagattgataggaaactctataaacagaacatgcagaaagaaatcttgaatacaccactgcttactgttcaggagggagctgtagaagatcttattcttacagaaccagagcctgaacacactgggaaatgccgtgtcagtggggttgttttggtggatggaagcacagtatatgcagagagtgtgattctgactactgggacatttctgagaggcatgattgtaattggattggagacgcatccagcaggacgtttaggggatcagccttctataggattggctcagacactggagaagttagggtttgtggtgggaaggttgaagactgggactccaccccgaattgccaaagagtccattaatttcagtattctaaacaagcatataccggacaatccatccataccattcagctttaccaatgagacagtatggattaagccagaagatcagctgccatgttacttgactcacaccaaccctagagtggatgagattgtccttaagaaccttcaccttaatagtcatgttaaagaaacgacaagaggacctcgatactgtccctccattgaatcaaaagttttgcgttttccaaaccgtctacatcaggtttggttggaacctgaaggaatggattctgaccttatctacccacaggggttatctatgacgctaccagctgagttacaagagaaaatgatcacatgcatcagaggcttggagaaagctaaagtgattcagccagacggagttttgctcttgttgcccaggatggagtgcaatggtgcgatctcggctcaccacaacctccccctgccaggctacggtgttcagtatgattacttagatccccgtcagatcaccccttccttggagactcatttggttcaacgactcttctttgctggacagatcaatggcaccactggttatgaggaagctgcagctcaaggtgtgatagccggaatcaacgccagtcttcgggtcagtcgcaagcctccctttgtggttagccgaacagaaggttacataggagtcttgattgatgacctcactactctgggcaccagtgaaccataccgcatgtttaccagccgagtagagttccgtttgtcactgcgccctgataatgctgacagccggctcacactgcgagggtataaagacgctggctgtgtgtcccaacaacgatatgaaagagcttgttggatgaagtcttctttagaagaaggcatttctgtgttgaaatctattgagtttttgagctctaaatggaaaaaattaatcccagaggcttctataagtactagtagaagtctgcctgtcagagctctcgatgttctgaagtatgaggaagttgacatggattcattagccaaggctgttccagagcccttgaagaagtatactaaatgtagagagctggctgaaagactgaaaatagaagccacttatgaatcagtgttgttccatcaactacaagaaataaagggagttcagcaagatgaagctctccaactgccaaaagacctagattatttgactatcagggatgtgtctttgtcccatgaagttcgagagaaactacattttagtcgtccacagacgatcggggctgctagtcgcatacccggagtaacacctgccgccatcatcaatctgctgagatttgtgaagaccactcaacgaagacagtcggctatgaatgaatcatccaagactgatcaatacttatgtgatgcagacagacttcaagagagagagttatagctttcaattcataaaagatttttaaagagcatataaataatttgatcaatacaacagtatagataaaagaattatttagcacatgttaaaatagctttattaggttactatgggtttgccattaatttctgagtgggacagaaattataattgtgctttttcgtgtatatgaaaaaactagtcgtaaacaatttgtactctttctttaaggagctgtaatacaaataactttgtgcagtgttcatcaaagagagagacagtgaacctaaaactgaacctggaataaaactcaacatgcagatttgcctactcatagggactttgcctattaagtctaccaaattaaaagtcttatcattcagcgtgttttgagagttaataatcttttgcttggttatactaggctaggaagcaatatcaaagcccttaaattctcaagactaaagacttgagattatataaaattatccagaatcattcagctaatactattggaatatagtatgtagggtgaaagttgacagaaatctgtacttcttcaggaaatcctcactggtaattgttttgaacattaatgaaagccctataaaatagaaagattggaaatcaccattgtttcctattatccacagtgtggatggatacttatttggtgacctagttatgggagaattgagtaacgttagttattttatatcataccataaaaatattttc

SEQ ID NO: 154764 - DNA, 2174 bp, Homo sapiens
  Payload ID: 10422
  Gene Symbol: MTO1
  Gene Name: mitochondrial tRNA translation optimization 1
  Uniprot ID: Q9Y2Z2
  ENST ID: ENST00000370305
  CDS Start-End: 55-1986
cgtgatattaaagcaagatggccgcgccctgcagattgtctcttgttgcgtcagatgtcatgtaatccttcctttggtggcatcggaaagggacatttaatgagggaagtagatgccttggatggcctgtgttctcgcatctgtgaccagtctggtgtacattataaagtattaaaccggcgtaagggaccagctgtgtggggtctgagagctcagattgataggaaactctataaacagaacatgcagaaagaaatcttgaatacaccactgcttactgttcaggagggagctgtagaagatcttattcttacagaaccagagcctgaacacactgggaaatgccgtgtcagtggggttgttttggtggatggaagcacagtatatgcagagagtgtgattctgactactgggacatttctgagaggcatgattgtaattggattggagacgcatccagcaggacgtttaggggatcagccttctataggattggctcagacactggagaagttagggtttgtggtgggaaggttgaagactgggactccaccccgaattgccaaagagtccattaatttcagtattctaaacaagcatataccggacaatccatccataccattcagctttaccaatgagacagtatggattaagccagaagatcagctgccatgttacttgactcacaccaaccctagagtggatgagattgtccttaagaaccttcaccttaatagtcatgttaaagaaacgacaagaggacctcgatactgtccctccattgaatcaaaagttttgcgttttccaaaccgtctacatcaggtttggttggaacctgaaggaatggattctgaccttatctacccacaggggttatctatgacgctaccagctgagttacaagagaaaatgatcacatgcatcagaggcttggagaaagctaaagtgattcagccagacggagttttgctcttgttgcccaggatggagtgcaatggtgcgatctcggctcaccacaacctccccctgccaggctacggtgttcagtatgattacttagatccccgtcagatcaccccttccttggagactcatttggttcaacgactcttctttgctggacagatcaatggcaccactggttatgaggaagctgcagctcaaggtgtgatagccggaatcaacgccagtcttcgggtcagtcgcaagcctccctttgtggttagccgaacagaaggttacataggagtcttgattgatgacctcactactctgggcaccagtgaaccataccgcatgtttaccagccgagtagagttccgtttgtcactgcgccctgataatgctgacagccggctcacactgcgagggtataaagacgctggctgtgtgtcccaacaacgatatgaaagagcttgttggatgaagtcttctttagaagaaggcatttctgtgttgaaatctattgagtttttgagctctaaatggaaaaaattaatcccagaggcttctataagtactagtagaagtctgcctgtcagagctctcgatgttctgaagtatgaggaagttgacatggattcattagccaaggctgttccagagcccttgaagaagtatactaaatgtagagagctggctgaaagactgaaaatagaagccacttatgaatcagtgttgttccatcaactacaagaaataaagggagttcagcaagatgaagctctccaactgccaaaagacctagattatttgactatcagggatgtgtctttgtcccatgaagttcgagagaaactacattttagtcgtccacagacgatcggggctgctagtcgcatacccggagtaacacctgccgccatcatcaatctgctgagatttgtgaagaccactcaacgaagacagtcggctatgaatgaatcatccaagactgatcaatacttatgtgatgcagacagacttcaagagagagagttatagctttcaattcataaaagatttttaaagagcatataaataatttgatcaatacaacagtatagataaaagaattatttagcacatgttaaaatagctttattaggttactatgggtttgccattaatttctgagtgggacagaaattataattgtgctttttcgtgtatatgaaaaaactagtcgtaaa

SEQ ID NO: 154765 - DNA, 521 bp, Homo sapiens
  Payload ID: 10422
  Gene Symbol: MTO1
  Gene Name: mitochondrial tRNA translation optimization 1
  ENST ID: ENST00000442897
  CDS Start-End: 59-415
accccgtgatattaaagcaagatggccgcgccctgcagattgtctcttgttgcgtcagatgtcatgtaatccttcctttggtggcatcggaaagggacatttaatgagggaagtagatgccttggatggcctgtgttctcgcatctgtgaccagtctggtgtacattataaagtattaaaccggcgtaagggaccagctgtgtggggtctgagagctcagattgataggaaactctataaacagaacatgcagaaagaaatcttgaatacaccactgcttactgttcaggagggagctgtagaagatcttattcttacagaaccagagcctgaacacactgggaaatgccgtgtcagtggggttgttttggccagaagatcagctgccatgttacttgactcacaccaaccctagagtggatgagattgtccttaagaaccttcaccttaatagtcatgttaaagaaacgacaagaggacctcgatactgtccctccattgaatcaaaagttttgcgtttt

SEQ ID NO: 154766 - DNA, 2837 bp, Homo sapiens
  Payload ID: 10422
  Gene Symbol: MTO1
  Gene Name: mitochondrial tRNA translation optimization 1
  Uniprot ID: Q9Y2Z2
  ENST ID: ENST00000415954
  CDS Start-End: 278-2476
taaataaataaataaataaaaataaaaaataataataataaaaaaagcccgcacgaactaggaaagaaaatacacaaccggccctccgtgcgatcacccatctccctcaccaggaaagtagctccaaaccgccaatcagcggcgacgctggacgtagacgtcctaccccgtgatattaaagcaagatggccgcgccctgcagattgtctcttgttgcgtaagtttttttgaccgtcactcgtgtcagcttcaaagtcagatagatttttctcccagcatgttctacttccgaggctgtggccgttgggtcgcggtttccttcaccaagcagcaatttccgttggcacggttgagcagtgacagcgcggcgccccggactccgcacttcgacgtgatagtcattggtggaggacatgccgggactgaggcagccaccgccgccgctcggtgcggctctcggactctgctcctcactcaccgcgtggacacgatcggtcagatgtcatgtaatccttcctttggtggcatcggaaagggacatttaatgagggaagtagatgccttggatggcctgtgttctcgcatctgtgaccagtctggtgtacattataaagtattaaaccggcgtaagggaccagctgtgtggggtctgagagctcagattgataggaaactctataaacagaacatgcagaaagaaatcttgaatacaccactgcttactgttcaggagggagctgtagaagatcttattcttacagaaccagagcctgaacacactgggaaatgccgtgtcagtggggttgttttggtggatggaagcacagtatatgcagagagtgtgattctgactactgggacatttctgagaggcatgattgtaattggattggagacgcatccagcaggacgtttaggggatcagccttctataggattggctcagacactggagaagttagggtttgtggtgggaaggttgaagactgggactccaccccgaattgccaaagagtccattaatttcagtattctaaacaagcatataccggacaatccatccataccattcagctttaccaatgagacagtatggattaagccagaagatcagctgccatgttacttgactcacaccaaccctagagtggatgagattgtccttaagaaccttcaccttaatagtcatgttaaagaaacgacaagaggacctcgatactgtccctccattgaatcaaaagttttgcgttttccaaaccgtctacatcaggtttggttggaacctgaaggaatggattctgaccttatctacccacaggggttatctatgacgctaccagctgagttacaagagaaaatgatcacatgcatcagaggcttggagaaagctaaagtgattcagccaggctacggtgttcagtatgattacttagatccccgtcagatcaccccttccttggagactcatttggttcaacgactcttctttgctggacagatcaatggcaccactggttatgaggaagctgcagctcaaacagagtgttgctctgttgccaggctggagtgcagtgatatgatctcccagcttcaagcgatcctcctgcctcagccctccctagtagctgggactgcaggcatgcaccacaacacccagggtgtgatagccggaatcaacgccagtcttcgggtcagtcgcaagcctccctttgtggttagccgaacagaaggttacataggagtcttgattgatgacctcactactctgggcaccagtgaaccataccgcatgtttaccagccgagtagagttccgtttgtcactgcgccctgataatgctgacagccggctcacactgcgagggtataaagacgctggctgtgtgtcccaacaacgatatgaaagagcttgttggatgaagtcttctttagaagaaggcatttctgtgttgaaatctattgagtttttgagctctaaatggaaaaaattaatcccagaggcttctataagtactagtagaagtctgcctgtcagagctctcgatgttctgaagtatgaggaagttgacatggattcattagccaaggctgttccagagcccttgaagaagtatactaaatgtagagagctggctgaaagactgaaaatagaagccacttatgaatcagtgttgttccatcaactacaagaaataaagggagttcagcaagatgaagctctccaactgccaaaagacctagattatttgactatcagggatgtgtctttgtcccatgaagttcgagagaaactacattttagtcgtccacagacgatcggggctgctagtcgcatacccggagtaacacctgccgccatcatcaatctgctgagatttgtgaagaccactcaacgaagacagtcggctatgaatgaatcatccaagactgatcaatacttatgtgatgcagacagacttcaagagagagagttatagctttcaattcataaaagatttttaaagagcatataaataatttgatcaatacaacagtatagataaaagaattatttagcacatgttaaaatagctttattaggttactatgggtttgccattaatttctgagtgggacagaaattataattgtgctttttcgtgtatatgaaaaaactagtcgtaaacaatttgtactctttctttaaggagctgtaatacaaataactttgtgcagtgttcatcaaagagagagacagtgaacctaaaactgaacctggaataaaactcaacatgcagatttgcctactcatagggactttgcctattaagtctaccaaattaaaagtcttatcattca

SEQ ID NO: 154767 - DNA, 665 bp, Homo sapiens
  Payload ID: 10422
  Gene Symbol: MTO1
  Gene Name: mitochondrial tRNA translation optimization 1
  ENST ID: ENST00000445187
  CDS Start-End: 1-297
gaacctgaaggaatggattctgaccttatctacccacaggggttatctatgacgctaccagctgagttacaagagaaaatgatcacatgcatcagaggcttggagaaagctaaagtgattcagccaggctacggtgttcagtatgattacttagatccccgtcagatcaccccttccttggagactcatttggttcaacgactcttctttgctggacagatcaatggcaccactggttatgaggaagctgcagctcaaagtgttgctctgttgccaggctggagtgcagtgatatgatctcccagcttcaagcgatcctcctgcctcagccctccctagtagctgggactgcaggcatgcaccacaacacccagggtgtgatagccggaatcaacgccagtcttcgggtcagtcgcaagcctccctttgtggttagccgaacagaaggttacataggagtcttgattgatgacctcactactctgggcaccagtgaaccataccgcatgtttaccagccgagtagagttccgtttgtcactgcgccctgataatgctgacagccggctcacactgcgagggtataaagacgctggctgtgtgtcccaacaacgatatgaaagagcttgttggatgaagtcttctttagaagaaggcatttctgtg

SEQ ID NO: 154768 - DNA, 2240 bp, Homo sapiens
  Payload ID: 10422
  Gene Symbol: MTO1
  Gene Name: mitochondrial tRNA translation optimization 1
  ENST ID: ENST00000415228
  CDS Start-End: 91-669
ggccgcgccctgcagattgtctcttgttgcgtaagtttttttgaccgtcactcgtgtcagcttcaaagtcagatagatttttctcccagcatgttctacttccgaggctgtggccgttgggtcgcggtttccttcaccaagcagcaatttccgttggcacggttgagcagtgacagcgcggcgccccggactccgcacttcgacgtgatagtcattggtggaggacatgccgggactgaggcagccaccgccgccgctcggtgcggctctcggactctgctcctcactcaccgcgtggacacgatcggtcagatgtcatgtaatccttcctttggtggcatcggaaagggacatttaatgagggaagtagatgccttggatggcctgtgttctcgcatctgtgaccagtctggtgtacattataaagtattaaaccggcgtaagggaccagctgtgtggggtctgagagctcagattgataggaaactctataaacagaacatgcagaaagaaatcttgaatacaccactgcttactgttcaggagggagctgtagaagatcttattcttacagaaccagagcctgaacacactgggaaatgccgtgtcagtggggttgttttggccagaagatcagctgccatgttacttgactcacaccaaccctagagtggatgagattgtccttaagaaccttcaccttaatagtcatgttaaagaaacgacaagaggacctcgatactgtccctccattgaatcaaaagttttgcgttttccaaaccgtctacatcaggtttggttggaacctgaaggaatggattctgaccttatctacccacaggggttatctatgacgctaccagctgagttacaagagaaaatgatcacatgcatcagaggcttggagaaagctaaagtgattcagccaggctacggtgttcagtatgattacttagatccccgtcagatcaccccttccttggagactcatttggttcaacgactcttctttgctggacagatcaatggcaccactggttatgaggaagctgcagctcaaggtgtgatagccggaatcaacgccagtcttcgggtcagtcgcaagcctccctttgtggttagccgaacagaaggttacataggagtcttgattgatgacctcactactctgggcaccagtgaaccataccgcatgtttaccagccgagtagagttccgtttgtcactgcgccctgataatgctgacagccggctcacactgcgagggtataaagacgctggctgtgtgtcccaacaacgatatgaaagagcttgttggatgaagtcttctttagaagaaggcatttctgtgttgaaatctattgagtttttgagctctaaatggaaaaaattaatcccagaggcttctataagtactagtagaagtctgcctgtcagagctctcgatgttctgaagtatgaggaagttgacatggattcattagccaaggctgttccagagcccttgaagaagtatactaaatgtagagagctggctgaaagactgaaaatagaagccacttatgaatcagtgttgttccatcaactacaagaaataaagggagttcagcaagatgaagctctccaactgccaaaagacctagattatttgactatcagggatgtgtctttgtcccatgaagttcgagagaaactacattttagtcgtccacagacgatcggggctgctagtcgcatacccggagtaacacctgccgccatcatcaatctgctgagatttgtgaagaccactcaacgaagacagtcggctatgaatgaatcatccaagactgatcaatacttatgtgatgcagacagacttcaagagagagagttatagctttcaattcataaaagatttttaaagagcatataaataatttgatcaatacaacagtatagataaaagaattatttagcacatgttaaaatagctttattaggttactatgggtttgccattaatttctgagtgggacagaaattataattgtgctttttcgtgtatatgaaaaaactagtcgtaaacaatttgtactctttctttaaggagctgtaatacaaataactttgtgcagtgttcatcaaagagagagacagtgaacctaaaactgaacctggaataaaactcaacatgcagatttgcctactcatagggactttgcctattaagtctaccaaattaaaagtcttatcattca

SEQ ID NO: 154769 - DNA, 10857 bp, Homo sapiens
  Payload ID: 10422
  Gene Symbol: MTO1
  Gene Name: mitochondrial tRNA translation optimization 1
  Uniprot ID: Q9Y2Z2
  ENST ID: ENST00000498286
  CDS Start-End: 278-2356
taaataaataaataaataaaaataaaaaataataataataaaaaaagcccgcacgaactaggaaagaaaatacacaaccggccctccgtgcgatcacccatctccctcaccaggaaagtagctccaaaccgccaatcagcggcgacgctggacgtagacgtcctaccccgtgatattaaagcaagatggccgcgccctgcagattgtctcttgttgcgtaagtttttttgaccgtcactcgtgtcagcttcaaagtcagatagatttttctcccagcatgttctacttccgaggctgtggccgttgggtcgcggtttccttcaccaagcagcaatttccgttggcacggttgagcagtgacagcgcggcgccccggactccgcacttcgacgtgatagtcattggtggaggacatgccgggactgaggcagccaccgccgccgctcggtgcggctctcggactctgctcctcactcaccgcgtggacacgatcggtcagatgtcatgtaatccttcctttggtggcatcggaaagggacatttaatgagggaagtagatgccttggatggcctgtgttctcgcatctgtgaccagtctggtgtacattataaagtattaaaccggcgtaagggaccagctgtgtggggtctgagagctcagattgataggaaactctataaacagaacatgcagaaagaaatcttgaatacaccactgcttactgttcaggagggagctgtagaagatcttattcttacagaaccagagcctgaacacactgggaaatgccgtgtcagtggggttgttttggtggatggaagcacagtatatgcagagagtgtgattctgactactgggacatttctgagaggcatgattgtaattggattggagacgcatccagcaggacgtttaggggatcagccttctataggattggctcagacactggagaagttagggtttgtggtgggaaggttgaagactgggactccaccccgaattgccaaagagtccattaatttcagtattctaaacaagcatataccggacaatccatccataccattcagctttaccaatgagacagtatggattaagccagaagatcagctgccatgttacttgactcacaccaaccctagagtggatgagattgtccttaagaaccttcaccttaatagtcatgttaaagaaacgacaagaggacctcgatactgtccctccattgaatcaaaagttttgcgttttccaaaccgtctacatcaggtttggttggaacctgaaggaatggattctgaccttatctacccacaggggttatctatgacgctaccagctgagttacaagagaaaatgatcacatgcatcagaggcttggagaaagctaaagtgattcagccaggctacggtgttcagtatgattacttagatccccgtcagatcaccccttccttggagactcatttggttcaacgactcttctttgctggacagatcaatggcaccactggttatgaggaagctgcagctcaaggtgtgatagccggaatcaacgccagtcttcgggtcagtcgcaagcctccctttgtggttagccgaacagaaggttacataggagtcttgattgatgacctcactactctgggcaccagtgaaccataccgcatgtttaccagccgagtagagttccgtttgtcactgcgccctgataatgctgacagccggctcacactgcgagggtataaagacgctggctgtgtgtcccaacaacgatatgaaagagcttgttggatgaagtcttctttagaagaaggcatttctgtgttgaaatctattgagtttttgagctctaaatggaaaaaattaatcccagaggcttctataagtactagtagaagtctgcctgtcagagctctcgatgttctgaagtatgaggaagttgacatggattcattagccaaggctgttccagagcccttgaagaagtatactaaatgtagagagctggctgaaagactgaaaatagaagccacttatgaatcagtgttgttccatcaactacaagaaataaagggagttcagcaagatgaagctctccaactgccaaaagacctagattatttgactatcagggatgtgtctttgtcccatgaagttcgagagaaactacattttagtcgtccacagacgatcggggctgctagtcgcatacccggagtaacacctgccgccatcatcaatctgctgagatttgtgaagaccactcaacgaagacagtcggctatgaatgaatcatccaagactgatcaatacttatgtgatgcagacagacttcaagagagagagttatagctttcaattcataaaagatttttaaagagcatataaataatttgatcaatacaacagtatagataaaagaattatttagcacatgttaaaatagctttattaggttactatgggtttgccattaatttctgagtgggacagaaattataattgtgctttttcgtgtatatgaaaaaactagtcgtaaacaatttgtactctttctttaaggagctgtaatacaaataactttgtgcagtgttcatcaaagagagagacagtgaacctaaaactgaacctggaataaaactcaacatgcagatttgcctactcatagggactttgcctattaagtctaccaaattaaaagtcttatcattcagcgtgttttgagagttaataatcttttgcttggttatactaggctaggaagcaatatcaaagcccttaaattctcaagactaaagacttgagattatataaaattatccagaatcattcagctaatactattggaatatagtatgtagggtgaaagttgacagaaatctgtacttcttcaggaaatcctcactggtaattgttttgaacattaatgaaagccctataaaatagaaagattggaaatcaccattgtttcctattatccacagtgtggatggatacttatttggtgacctagttatgggagaattgagtaacgttagttattttatatcataccataaaaatattttcttaagaaattgtcatggccatcatttcttaataatgaagacaggtccatagtaactggtgagtggtgtttccctgtttttaagtcagaatgacagaaaaaacagaatagtggtagtacccctcttcctctccagtacttcaatggtatgtcttcacaggggttagagtgggataatcagctgggccttttgactcagatacctcagatacctcaaccattctaaatagactaagggatgaatacagccaaatgggccagacagccctgcttgtctctggaattccaacccagatctctggtgtcagcctagggagaagctcccgtgtcaccttcgggccaaagcaggtactcaggagagttctaagggccccaaagtcactttggctacagatgtgtatgttaagcctgattatgggtgtgaggcaaccaagtatcttgttactataattgcatatggccacttggaggtagcttagttttcttgggtttattttatctaattttagtctttccagaaagcagtaagattagtagcaagtaaaaagtatttgtagtgctggataatttaggaatgatgaatattttttaatacttgattcagtgatttcaaaaggtcgtaacttttagtcatagctactcctgggcaaaattcttcttacagagacaatattaattacaataccacattgtgtatatattttgaaaagaggctggttgcagcagctcacgcctgtaatcccagcactttgggaggctgaggcgggtggataacctgaagtcaggagttcaagaccagcctggccaacatggcaaaaccccatctccactaaaaataccaaaattagccaggcgtggtggagcaagcctgtagtcccagctactcaggaggctgaggcaggagaatcgcttgaacccaggaggcagaggttgcagtgagctgagattgtgccactgcactccagcctgggcgacagagtgagactgtttcaaaaaaaagaaaaagaaaagaaggtattttgtgtttttgtgctacccgttcagcaaaataatgaaattcattgtttctaaacttttttttctgattaaatacaagagtaaaaaaagtgaatggagtgccttttgaatagaatataacaaaaatttatcttaaagaaacgggaagtaacctggcacagtggctcacgcctgtaatcccagcactttgggaggctgaggcaggtggatcacgaggtcaggagatcgagaccatcctgcccaacatggtgaaaccccatctctactaaaaatacaaaaattagctaggtgtgttggcacgtgcctgtagtcccaactactcaggaggctgaggcaagagaatcacttgaactcaggaggcagaggttgcagtgagccaagatcatgccactgcactccagcctggcaacagagtgagactctgtctcaaaaaaaaaaaaagaaacaggaagttcaaatattttgggaggttcttgacagctacaatttggggctagtgacactatacacatataaagaaactttaaagtttcttagtaatgaaggtttgtaatgctattccattacaatagtaactgtctcactgaaaaatgtttcatggaaaatacatattttagattctatgatttgctttaggatgtgaacttctttattttttagagacagggtctcactctgttgcccaggctgtagtgcagtggtacaatcatagctcactgcagccttgatctcctgggctcaagtgatccttatgcctcagcctcccaagtggctgggactacaggcacatgccaccatgcctggctaagttttaaaaaaattttttgtaggaatgaagtctcactatgttgcccaggctggtcttgaacttctggcctcaaatgatcctcttgccttggcctcccaaagtgctcagattacaggcatgagccaccacacgtggcctgaaacctctttaaatccacaatgtttgtatgttaacttaaacaaaattacatcacttaatatgtcaaaacagcctaccctctggtgctgctatgcagaagtactacagaatatgatgccctaggaagaaatcagctaaaaatgtaaccttactcaatgtagttacttcatagaaatcccatcactgacaataatcagctgccaacgaaagctggccatacttgtgacttcctctattcaccacagaccagactgcctaccagttgaaaaagccaggtattttttcaattcaattcaacaggaacaccaaaaaataagaaatgactaagaaacactaagcatttgtaaaattactgggggaggaaggatgaagatacgaacctatgctaaattaaacgattatggccttgaaaatgaagttcctttatagccaagagcttaaattttgttactgatggttttaaaagtattttgtcattttttagtttcaacctagattggaatagccatggcttttctacttcagaaatttcaactcctagaagaatgccctgtccagaagaagtggtcaggagtatcaggaaagccaccagcagagactaggggtttattctgatctggaagagccacttaacactggaatgcacacagtgaaaattaattgttcctcttacactccctctccacaatacttctattattacacttacttcgttctaccttaatgtttttatttagagacaagatctcactctgccaccctggctggagtgcagtggcatgattacagctcactgcagcctcaacctccctggctctagctattctcccatctcagccctccaagtagctgggactacaggtgtgcaccaccatgcacggctaatttttaagtttttgtagatatggggtcttactatgttgcccaggctggtctcaaagtcctgggctcaattaatcctccctcttcagcctcctgtgtaggtgatagtacaggcatgagccaccatgtgcctggccctaccttaatgttaatatctgtctaccttaagaagatataagccttgtaaatataagcaatatcacagttgtagatactcgtgctttttaaatagattaatgaatactactaaaggcaagaaatggtattactaaaactcaagtgaataattaaatgagatcaaaatatttgtgacaggccaggcacggtggcttacgcctgtaatcccagcactttgggaggccaggcggatcacttgagctcagcagttcaagaccagcctgggcaacatggcgaaactccgtctttaccaaaaatacaaaaataagccaagcatggtggcacgtacctgttgttccagcaacttgggggctgaggcaggagaatcacttgagccggggagtttgaggctgcagtgagttgatagcatgccaccacactccagcctgggcaacagagtgagaccctgcctgaaaaaaagcccaggtgtggtggctcacatctgtaatcccagcattttgggattacaaatctgccagcgcaagcagatcacttgaggataggagtttgagaccagcctgaccaacatgttgaaaccccatctcttattaaaatacaaaaattagctgggcgtggtggcatgcgcctgtaatccgagctactcaggtggctgaggcacaagaatcgcttgaacctgggagatggaagttgcaatgagctgagatcaagccactgcactccagcctgggcaacagagcaagactgtctcaaaaaaaaaaaatttgtacagtcatgttcaaagtagcattaattcacaatagccaaaagctggaagtagcccaagtatccaccaatgaatgaaaggataaacaaaatgtggcatatacatacaatggaatattatacagccttaaaaaggaaggaaattcatatacatgctacagcatggataaaccttgaaaaagttatgctaactgaaatcagccagtcacaaaaagacaaatactgtatgattccctttataagagttacctggagcactcaaattcatagagacagtaaaatgatggttaccaggggatgggggagggagaaacaggaaactattctttagtgagtacagaatttcagtttttttgttttgtttttgtttttgtttttgagatggagcctcacactgtcacccaggctggagtgcaatggtgtgatcttggttcactgcaacctctgcctcctaggttcaaatgattcttctgcctcagtctcctgagtctgggattacaggcgcctgccatcatgcccagctaatttttgtatttttaatagagacagggtttcacaggttggccaagctagtctcgaactcctgacctcatgatccgcccacctcgacctcccaaagtgctgggattacaggggtgagccaccatgcccagtccagaatttcaagttttgcaagatgaaaagagttctggagatggttgatggtgatggttgcacaacaatttgaatattttaaatgccaatgaactgttcatttacaaatggttacgatggaatttttctttttcttttttttttcttgagacggagtctcgctctgtcactcaggctagagtgcagtggcactatctcggctcactgcaacctcctcctgctgggttaaagtgattctcttgcctcagcctcccgagcagctgagactacaggcgcgtgccaccatgctcagctaattttttctatttttagtggagacagggtttcaccatgttagccagatggtctcgatctcctgacctcgtgatccacctccctcagcctctcaaagtgctgggattacaggcatgagccaccgtgcacagccaagatggaaatttttatgttctttgtttgatatggtttggctgtgtccccacccaaatctcaacttgaactgtatctctcagaattcccacatgttgtgggagggacccacagggaggtaattgaatcacaagggccggtttttaccatgctttcttgtgatagtgaataagtctcacaagatctgatgggtttatcaggggtttccgattttgcttcttcctcattttctcttgccactcccatgtaagaagtgcctttcgcctcccgccaagattctgaggcttcctcagccatgtggaactttggggacgaaaagaggtttaattggacttaaagttccaattaaagtttcaggtatgtctttatcagcagcatgaaaatgaactaatacagtgttttatcactttttttttttttttttttttttgagatggagtttcgctcttgttgcccaggctggagtgcaatggcgcaacatcaggtcactgcaaactctgcctcccgggttcaagcgattctcttgcctcagcctcctgagtagctgggattacaggcttgtgccaccacacccggctaatttttgtatttttagtagagacagagtttcaccatgttggccaggctagtcttgaactcctgacctcaggtgatccacccaccttggcttcccaaagtgggtggatgacctctgggattacaggcgtgcgccaccgcgctcggtctatattcaccaattttaagatgcacatctttccatattttagtatctctaagttggagtatgtcttacaattaatggcatctgacagttataactggcagcatttgtgactgaaaaacatcttagatgcaatgaaatacagtgtgtgtgtttgtattgtgctgcaatataaaatgtatttcaggccaggtatggtggttcacacctgtaatcccagcactttggaaggccaaagtgggaggatcacttgagcccaggagttcaaggctgcagtgagctctgattataccactgtactccagcctaggcaacagagcaagacccagtctctaaaaaataaatgaaaatgtttcttattgtggatcacagtcaaaagtttgaaaaaacacaatctgtttgaacagcactactttctgacaggaaaaccccaacaggttaggatctgtgtattcctcagagtaagaatttttctaaaaagtttttaaaaacttaaagtcttactgatctcttcctatgctccaattttatagatataacttagccttgcgaggtgatgtaattaaagtctaacttcaagttgctgttgagcatagatctcaggtcttctgacttcacaacacctttctgccactttcagtggatttttccctcctagggaccagaggtcctctactggattaaaagtttctccatcccggcagggtgcggtggctcacgcctgtaatcccaacactttgggaggccaaggcgggcggatcacgaggtcaggaaatagagaccatcctggctaacatggtgaaaccccgtgtctactaaaaatacgaaaaattagccgggtgtggtggtgcgcgcctgtagtcccagctactcgggaggctgaggcaggagaatggcgtgaagccaggaggcggagcttgcaatgagccgagatcgcgccactgcactctagcctgggcgacaaagcgagactctgtctcaaaaaaaaaaaaaaaaaaaaaaaattctccatcccttttgaacaatctggaagtctgtttctcttaaccttcagttcccattccaatcctttgtaacctatttcaggttaagcatttatggaggtgccatgcttaattagccattatggcactcactctatttcaaaggttatcccagaatttggaggctgtaggggaattcagagtgtgaatttcacttgaacagcaccctctgcagacttaaaatattcctcctatatctgaagacaataataatttcttagaatttgctaggctaaacaactattttttagtccagtggcttgtaattaagtcatttttagtctttaattatgttggttgcttttagaattctcttttagagttggtctacatccttttaaaacatgggcaatccaaatttataacagtaaattaagatacataaaaaaaaacactggctaaatttaaaaggaaacacttctagaatatactgtattttgacacaagaccagactgtgctatgtgtatgtggtgtttcaagtaatttaagaaaactgttggaattttctgtatttccagtttcacaagaaacaacctcaaggagggcagtttaactgaaaattcagaggtattatagctctgaagaaaaatactgatgagcagttatacaaaatgagaaattgagttctaagaaatgcatccctaacttcaacataaagatagctatgagaaaacattctttgtacccaaccataaatgaataaaaatcacctcatttctcatcagatgtttactgggttgctagttatatatagaatcctgcaagaggctcaacagggaagtccaaagagtcaatcaagaaggtatgataatggctaaagatggggactgtaggtcaatgctccacgaggttcttcttttgttgcaccaatatagctgcactgttatacccatatggttacaatccaggcctcagaaaatgttgcagatgccctcaccagaaggctgagaaccagttcctcagtttgcatgcctccagacagcactagaagtcaaactcaaattgcttacatggtaacttggtttatcccaacaccaactaggatattccctcaatcacatgattgtactgaaaatataaccaagttttatttatgtttttcatttggtattagccatctggtatttaacctctgaaaaccacacaatcttctatacgcttttttcactggaataaatgaaactgcttacttttga

SEQ ID NO: 154770 - DNA, 574 bp, Homo sapiens
  Payload ID: 10422
  Gene Symbol: MTO1
  Gene Name: mitochondrial tRNA translation optimization 1
  ENST ID: ENST00000521032
  CDS Start-End: 54-386
gtgatattaaagcaagatggccgcgccctgcagattgtctcttgttgcgtcagatgtcatgtaatccttcctttggtggcatcggaaagggacatttaatgagggaagtagatgccttggatggcctgtgttctcgcatctgtgaccagtctggtgtacattataaagtattaaaccggcgtaagggaccagctgtgtggggtctgagagctcagattgataggaaactctataaacagaacatgcagaaagaaatcttgaatacaccactgcttactgttcaggagggagctgtagaagatcttattcttacagaaccagagcctgaacacactgggaaatgccgtgtcagtggggttgttttgggctggagtgcagtggcatgatcacagctcgctgtagcctcgaccacctggacccaagtgatcttcctgcctcagcctcctgtgtagctgggaccacagtggatggaagcacagtatatgcagagagtgtgattctgactactgggacatttctgagaggcatgattgtaattggattggagacgcatccagcaggacgtttaggggat

SEQ ID NO: 154771 - DNA, 886 bp, Homo sapiens
  Payload ID: 10422
  Gene Symbol: MTO1
  Gene Name: mitochondrial tRNA translation optimization 1
  ENST ID: ENST00000521156
  CDS Start-End: 1-435
tacataggagtcttgattgatgacctcactactctgggcaccagtgaaccataccgcatgtttaccagccgagtagagttccgtttgtcactgcgccctgataatgctgacagccggctcacactgcgagggtataaagacgctggctgtgtgtcccaacaacgatatgaaagagcttgttggatgaagtcttctttagaagaaggcatttctgtgttgaaatctattgagtttttgagctctaaatggaaaaaattaatcccagaggcttctataagtactagtagaagtctgcctgtcagagctctcgatgttctgaagtatgaggaagttgacatggattcattagccaaggctgttccagagcccttgaagaagtatactaaatgtagagagctggctgaaagactgaaaatagaagatcggggctgctagtcgcatacccggagtaacacctgccgccatcatcaatctgctgagatttgtgaagaccactcaacgaagacagtcggctatgaatgaatcatccaagactgatcaatacttatgtgatgcagacagacttcaagagagagagttatagctttcaattcataaaagatttttaaagagcatataaataatttgatcaatacaacagtatagataaaagaattatttagcacatgttaaaatagctttattaggttactatgggtttgccattaatttctgagtgggacagaaattataattgtgctttttcgtgtatatgaaaaaactagtcgtaaacaatttgtactctttctttaaggagctgtaatacaaataactttgtgcagtgttcatcaaagagagagacagtgaacctaaaactgaacctggaataaaactcaacatgcagatt

SEQ ID NO: 154772 - DNA, 882 bp, Homo sapiens
  Payload ID: 10422
  Gene Symbol: MTO1
  Gene Name: mitochondrial tRNA translation optimization 1
  ENST ID: ENST00000522205
  CDS Start-End: 78-365
agattgtctcttgttgcgtaagtttttttgaccgtcactcgtgtcagcttcaaagtcagatagatttttctcccagcatgttctacttccgaggctgtggccgttgggtcgcggtttccttcaccaagcagcaatttccgttggcacggttgagcagtgacagcgcggcgccccggactccgcacttcgacgtgatagtcattggtggaggacatgccgggactgaggcagccaccgccgccgctcggtgcggctctcggactctgctcctcactcaccgcgtggacacgatcggtgaggagcgcgggtgctgtggaacttggcgtaggacgcaggctgcttccttcccgcctcccccggtctgaagcgggggacctcttcctttcctcaaagctagtcagatgtcatgtaatccttcctttggtggcatcggaaagggacatttaatgagggaagtagatgccttggatggcctgtgttctcgcatctgtgaccagtctggtgtacattataaagtattaaaccggcgtaagggaccagctgtgtggggtctgagagctcagattgataggaaactctataaacagaacatgcagaaagaaatcttgaatacaccactgcttactgttcaggagggagctgtagaagatcttattcttacagaaccagagcctgaacacactgggaaatgccgtgtcagtggggttgttttggtggatggaagcacagtatatgcagagagtgtgattctgactactgggacatttctgagaggcatgattgtaattggattggagacgcatccagcaggacgtttaggggatcagccttctataggattggctcagacactggagaagttagggtttgtggtgggaaggt

SEQ ID NO: 154773 - DNA, 696 bp, Homo sapiens
  Payload ID: 10422
  Gene Symbol: MTO1
  Gene Name: mitochondrial tRNA translation optimization 1
  ENST ID: ENST00000523763
  CDS Start-End: 1-346
tgatgacctcactactctgggcaccagtgaaccataccgcatgtttaccagccgagtagagttccgtttgtcactgcgccctgataatgctgacagccggctcacactgcgagggtataaagacgctggctgtgtgtcccaacaacgatatgaaagagcttgttggatgaagtcttctttagaagaaggcatttctgtgttgaaatctattgagtttttgagctctaaatggaaaaaattaatcccagaggcttctataagtactagtagaagtctgcctgtcaggcgtggtggcagacatcttaatcccagctacttgggaggcagaggcaggagaatcgtttgaacctgggaagcggaggttgcagtgagccgagatcaagccattgcacccaaacctgagggacaagagtgagacttctctcaaaaaaaaagaaaagactcatacaagctctcgatgttctgaagtatgaggaagttgacatggattcattagccaaggctgttccagagcccttgaagaagtatactaaatgtagagagctggctgaaagactgaaaatagaagatcggggctgctagtcgcatacccggagtaacacctgccgccatcatcaatctgctgagatttgtgaagaccactcaacgaagacagtcggctatgaatgaatcatccaagactgatcaatacttatg

SEQ ID NO: 154774 - DNA, 467 bp, Homo sapiens
  Payload ID: 10422
  Gene Symbol: MTO1
  Gene Name: mitochondrial tRNA translation optimization 1
  ENST ID: ENST00000524046
  CDS Start-End: 1-260
gagttttgctcttgttgcccaggatggagtgcaatggtgcgatctcggctcaccacaacctccccctgccaggctacggtgttcagtatgattacttagatccccgtcagatcaccccttccttggagactcatttggttcaacgactcttctttgctggacagatcaatggcaccactggttatgaggaagctgcagctcaaggtataaagacgctggctgtgtgtcccaacaacgatatgaaagagcttgttggatgaagtcttctttagaagaaggcatttctgtgttgaaatctattgagtttttgagctctaaatggaaaaaattaatcccagaggcttctataagtactagtagaagtctgcctgtcagagctctcgatgttctgaagtatgaggaagttgacatggattcattagccaaggctgttccagagcccttgaagaagtatactaaatgtagag

SEQ ID NO: 154775 - DNA, 681 bp, Homo sapiens
  Payload ID: 10423
  Gene Symbol: MT-ATP6
  Gene Name: mitochondrially encoded ATP synthase 6
  Uniprot ID: P00846
  ENST ID: ENST00000361899
  CDS Start-End: 1-681
atgaacgaaaatctgttcgcttcattcattgcccccacaatcctaggcctacccgccgcagtactgatcattctatttccccctctattgatccccacctccaaatatctcatcaacaaccgactaatcaccacccaacaatgactaatcaaactaacctcaaaacaaatgataaccatacacaacactaaaggacgaacctgatctcttatactagtatccttaatcatttttattgccacaactaacctcctcggactcctgcctcactcatttacaccaaccacccaactatctataaacctagccatggccatccccttatgagcgggcacagtgattataggctttcgctctaagattaaaaatgccctagcccacttcttaccacaaggcacacctacaccccttatccccatactagttattatcgaaaccatcagcctactcattcaaccaatagccctggccgtacgcctaaccgctaacattactgcaggccacctactcatgcacctaattggaagcgccaccctagcaatatcaaccattaaccttccctctacacttatcatcttcacaattctaattctactgactatcctagaaatcgctgtcgccttaatccaagcctacgttttcacacttctagtaagcctctacctgcacgacaacacataa

SEQ ID NO: 154776 - DNA, 207 bp, Homo sapiens
  Payload ID: 10424
  Gene Symbol: MT-ATP8
  Gene Name: mitochondrially encoded ATP synthase 8
  Uniprot ID: P03928
  ENST ID: ENST00000361851
  CDS Start-End: 1-207
atgccccaactaaatactaccgtatggcccaccataattacccccatactccttacactattcctcatcacccaactaaaaatattaaacacaaactaccacctacctccctcaccaaagcccataaaaataaaaaattataacaaaccctgagaaccaaaatgaacgaaaatctgttcgcttcattcattgcccccacaatcctag

SEQ ID NO: 154777 - DNA, 1141 bp, Homo sapiens
  Payload ID: 10425
  Gene Symbol: MT-CYB
  Gene Name: mitochondrially encoded cytochrome b
  Uniprot ID: P00156
  ENST ID: ENST00000361789
  CDS Start-End: 1-1141
atgaccccaatacgcaaaactaaccccctaataaaattaattaaccactcattcatcgacctccccaccccatccaacatctccgcatgatgaaacttcggctcactccttggcgcctgcctgatcctccaaatcaccacaggactattcctagccatgcactactcaccagacgcctcaaccgccttttcatcaatcgcccacatcactcgagacgtaaattatggctgaatcatccgctaccttcacgccaatggcgcctcaatattctttatctgcctcttcctacacatcgggcgaggcctatattacggatcatttctctactcagaaacctgaaacatcggcattatcctcctgcttgcaactatagcaacagccttcataggctatgtcctcccgtgaggccaaatatcattctgaggggccacagtaattacaaacttactatccgccatcccatacattgggacagacctagttcaatgaatctgaggaggctactcagtagacagtcccaccctcacacgattctttacctttcacttcatcttgcccttcattattgcagccctagcaacactccacctcctattcttgcacgaaacgggatcaaacaaccccctaggaatcacctcccattccgataaaatcaccttccacccttactacacaatcaaagacgccctcggcttacttctcttccttctctccttaatgacattaacactattctcaccagacctcctaggcgacccagacaattataccctagccaaccccttaaacacccctccccacatcaagcccgaatgatatttcctattcgcctacacaattctccgatccgtccctaacaaactaggaggcgtccttgccctattactatccatcctcatcctagcaataatccccatcctccatatatccaaacaacaaagcataatatttcgcccactaagccaatcactttattgactcctagccgcagacctcctcattctaacctgaatcggaggacaaccagtaagctacccttttaccatcattggacaagtagcatccgtactatacttcacaacaatcctaatcctaataccaactatctccctaattgaaaacaaaatactcaaatgggcct

SEQ ID NO: 154778 - DNA, 1542 bp, Homo sapiens
  Payload ID: 10426
  Gene Symbol: MT-CO1
  Gene Name: mitochondrially encoded cytochrome c oxidase I
  Uniprot ID: P00395
  ENST ID: ENST00000361624
  CDS Start-End: 1-1542
atgttcgccgaccgttgactattctctacaaaccacaaagacattggaacactatacctattattcggcgcatgagctggagtcctaggcacagctctaagcctccttattcgagccgagctgggccagccaggcaaccttctaggtaacgaccacatctacaacgttatcgtcacagcccatgcatttgtaataatcttcttcatagtaatacccatcataatcggaggctttggcaactgactagttcccctaataatcggtgcccccgatatggcgtttccccgcataaacaacataagcttctgactcttacctccctctctcctactcctgctcgcatctgctatagtggaggccggagcaggaacaggttgaacagtctaccctcccttagcagggaactactcccaccctggagcctccgtagacctaaccatcttctccttacacctagcaggtgtctcctctatcttaggggccatcaatttcatcacaacaattatcaatataaaaccccctgccataacccaataccaaacgcccctcttcgtctgatccgtcctaatcacagcagtcctacttctcctatctctcccagtcctagctgctggcatcactatactactaacagaccgcaacctcaacaccaccttcttcgaccccgccggaggaggagaccccattctataccaacacctattctgatttttcggtcaccctgaagtttatattcttatcctaccaggcttcggaataatctcccatattgtaacttactactccggaaaaaaagaaccatttggatacataggtatggtctgagctatgatatcaattggcttcctagggtttatcgtgtgagcacaccatatatttacagtaggaatagacgtagacacacgagcatatttcacctccgctaccataatcatcgctatccccaccggcgtcaaagtatttagctgactcgccacactccacggaagcaatatgaaatgatctgctgcagtgctctgagccctaggattcatctttcttttcaccgtaggtggcctgactggcattgtattagcaaactcatcactagacatcgtactacacgacacgtactacgttgtagcccacttccactatgtcctatcaataggagctgtatttgccatcataggaggcttcattcactgatttcccctattctcaggctacaccctagaccaaacctacgccaaaatccatttcactatcatattcatcggcgtaaatctaactttcttcccacaacactttctcggcctatccggaatgccccgacgttactcggactaccccgatgcatacaccacatgaaacatcctatcatctgtaggctcattcatttctctaacagcagtaatattaataattttcatgatttgagaagccttcgcttcgaagcgaaaagtcctaatagtagaagaaccctccataaacctggagtgactatatggatgccccccaccctaccacacattcgaagaacccgtatacataaaatctaga

SEQ ID NO: 154779 - DNA, 684 bp, Homo sapiens
  Payload ID: 10427
  Gene Symbol: MT-CO2
  Gene Name: mitochondrially encoded cytochrome c oxidase II
  Uniprot ID: P00403
  ENST ID: ENST00000361739
  CDS Start-End: 1-684
atggcacatgcagcgcaagtaggtctacaagacgctacttcccctatcatagaagagcttatcacctttcatgatcacgccctcataatcattttccttatctgcttcctagtcctgtatgcccttttcctaacactcacaacaaaactaactaatactaacatctcagacgctcaggaaatagaaaccgtctgaactatcctgcccgccatcatcctagtcctcatcgccctcccatccctacgcatcctttacataacagacgaggtcaacgatccctcccttaccatcaaatcaattggccaccaatggtactgaacctacgagtacaccgactacggcggactaatcttcaactcctacatacttcccccattattcctagaaccaggcgacctgcgactccttgacgttgacaatcgagtagtactcccgattgaagcccccattcgtataataattacatcacaagacgtcttgcactcatgagctgtccccacattaggcttaaaaacagatgcaattcccggacgtctaaaccaaaccactttcaccgctacacgaccgggggtatactacggtcaatgctctgaaatctgtggagcaaaccacagtttcatgcccatcgtcctagaattaattcccctaaaaatctttgaaatagggcccgtatttaccctatag

SEQ ID NO: 154780 - DNA, 784 bp, Homo sapiens
  Payload ID: 10428
  Gene Symbol: MT-CO3
  Gene Name: mitochondrially encoded cytochrome c oxidase III
  Uniprot ID: P00414
  ENST ID: ENST00000362079
  CDS Start-End: 1-784
atgacccaccaatcacatgcctatcatatagtaaaacccagcccatgacccctaacaggggccctctcagccctcctaatgacctccggcctagccatgtgatttcacttccactccataacgctcctcatactaggcctactaaccaacacactaaccatataccaatgatggcgcgatgtaacacgagaaagcacataccaaggccaccacacaccacctgtccaaaaaggccttcgatacgggataatcctatttattacctcagaagtttttttcttcgcaggatttttctgagccttttaccactccagcctagcccctaccccccaattaggagggcactggcccccaacaggcatcaccccgctaaatcccctagaagtcccactcctaaacacatccgtattactcgcatcaggagtatcaatcacctgagctcaccatagtctaatagaaaacaaccgaaaccaaataattcaagcactgcttattacaattttactgggtctctattttaccctcctacaagcctcagagtacttcgagtctcccttcaccatttccgacggcatctacggctcaacattttttgtagccacaggcttccacggacttcacgtcattattggctcaactttcctcactatctgcttcatccgccaactaatatttcactttacatccaaacatcactttggcttcgaagccgccgcctgatactggcattttgtagatgtggtttgactatttctgtatgtctccatctattgatgagggtctt

SEQ ID NO: 154781 - DNA, 956 bp, Homo sapiens
  Payload ID: 10429
  Gene Symbol: MT-ND1
  Gene Name: mitochondrially encoded NADH dehydrogenase 1
  Uniprot ID: P03886
  ENST ID: ENST00000361390
  CDS Start-End: 1-956
atacccatggccaacctcctactcctcattgtacccattctaatcgcaatggcattcctaatgcttaccgaacgaaaaattctaggctatatacaactacgcaaaggccccaacgttgtaggcccctacgggctactacaacccttcgctgacgccataaaactcttcaccaaagagcccctaaaacccgccacatctaccatcaccctctacatcaccgccccgaccttagctctcaccatcgctcttctactatgaacccccctccccatacccaaccccctggtcaacctcaacctaggcctcctatttattctagccacctctagcctagccgtttactcaatcctctgatcagggtgagcatcaaactcaaactacgccctgatcggcgcactgcgagcagtagcccaaacaatctcatatgaagtcaccctagccatcattctactatcaacattactaataagtggctcctttaacctctccacccttatcacaacacaagaacacctctgattactcctgccatcatgacccttggccataatatgatttatctccacactagcagagaccaaccgaacccccttcgaccttgccgaaggggagtccgaactagtctcaggcttcaacatcgaatacgccgcaggccccttcgccctattcttcatagccgaatacacaaacattattataataaacaccctcaccactacaatcttcctaggaacaacatatgacgcactctcccctgaactctacacaacatattttgtcaccaagaccctacttctaacctccctgttcttatgaattcgaacagcatacccccgattccgctacgaccaactcatacacctcctatgaaaaaacttcctaccactcaccctagcattacttatatgatatgtctccatacccattacaatctccagcattccccctcaaaccta

SEQ ID NO: 154782 - DNA, 1042 bp, Homo sapiens
  Payload ID: 10430
  Gene Symbol: MT-ND2
  Gene Name: mitochondrially encoded NADH dehydrogenase 2
  Uniprot ID: P03891
  ENST ID: ENST00000361453
  CDS Start-End: 1-1042
attaatcccctggcccaacccgtcatctactctaccatctttgcaggcacactcatcacagcgctaagctcgcactgattttttacctgagtaggcctagaaataaacatgctagcttttattccagttctaaccaaaaaaataaaccctcgttccacagaagctgccatcaagtatttcctcacgcaagcaaccgcatccataatccttctaatagctatcctcttcaacaatatactctccggacaatgaaccataaccaatactaccaatcaatactcatcattaataatcataatagctatagcaataaaactaggaatagccccctttcacttctgagtcccagaggttacccaaggcacccctctgacatccggcctgcttcttctcacatgacaaaaactagcccccatctcaatcatataccaaatctctccctcactaaacgtaagccttctcctcactctctcaatcttatccatcatagcaggcagttgaggtggattaaaccaaacccagctacgcaaaatcttagcatactcctcaattacccacataggatgaataatagcagttctaccgtacaaccctaacataaccattcttaatttaactatttatattatcctaactactaccgcattcctactactcaacttaaactccagcaccacgaccctactactatctcgcacctgaaacaagctaacatgactaacacccttaattccatccaccctcctctccctaggaggcctgcccccgctaaccggctttttgcccaaatgggccattatcgaagaattcacaaaaaacaatagcctcatcatccccaccatcatagccaccatcaccctccttaacctctacttctacctacgcctaatctactccacctcaatcacactactccccatatctaacaacgtaaaaataaaatgacagtttgaacatacaaaacccaccccattcctccccacactcatcgcccttaccacgctactcctacctatctccccttttatactaataatcttat

SEQ ID NO: 154783 - DNA, 346 bp, Homo sapiens
  Payload ID: 10431
  Gene Symbol: MT-ND3
  Gene Name: mitochondrially encoded NADH dehydrogenase 3
  Uniprot ID: P03897
  ENST ID: ENST00000361227
  CDS Start-End: 1-346
ataaacttcgccttaattttaataatcaacaccctcctagccttactactaataattattacattttgactaccacaactcaacggctacatagaaaaatccaccccttacgagtgcggcttcgaccctatatcccccgcccgcgtccctttctccataaaattcttcttagtagctattaccttcttattatttgatctagaaattgccctccttttacccctaccatgagccctacaaacaactaacctgccactaatagttatgtcatccctcttattaatcatcatcctagccctaagtctggcctatgagtgactacaaaaaggattagactgaaccgaat

SEQ ID NO: 154784 - DNA, 1378 bp, Homo sapiens
  Payload ID: 10432
  Gene Symbol: MT-ND4
  Gene Name: mitochondrially encoded NADH dehydrogenase 4
  Uniprot ID: P03905
  ENST ID: ENST00000361381
  CDS Start-End: 1-1378
atgctaaaactaatcgtcccaacaattatattactaccactgacatgactttccaaaaaacacataatttgaatcaacacaaccacccacagcctaattattagcatcatccctctactattttttaaccaaatcaacaacaacctatttagctgttccccaaccttttcctccgaccccctaacaacccccctcctaatactaactacctgactcctacccctcacaatcatggcaagccaacgccacttatccagtgaaccactatcacgaaaaaaactctacctctctatactaatctccctacaaatctccttaattataacattcacagccacagaactaatcatattttatatcttcttcgaaaccacacttatccccaccttggctatcatcacccgatgaggcaaccagccagaacgcctgaacgcaggcacatacttcctattctacaccctagtaggctcccttcccctactcatcgcactaatttacactcacaacaccctaggctcactaaacattctactactcactctcactgcccaagaactatcaaactcctgagccaacaacttaatatgactagcttacacaatagcttttatagtaaagatacctctttacggactccacttatgactccctaaagcccatgtcgaagcccccatcgctgggtcaatagtacttgccgcagtactcttaaaactaggcggctatggtataatacgcctcacactcattctcaaccccctgacaaaacacatagcctaccccttccttgtactatccctatgaggcataattataacaagctccatctgcctacgacaaacagacctaaaatcgctcattgcatactcttcaatcagccacatagccctcgtagtaacagccattctcatccaaaccccctgaagcttcaccggcgcagtcattctcataatcgcccacgggcttacatcctcattactattctgcctagcaaactcaaactacgaacgcactcacagtcgcatcataatcctctctcaaggacttcaaactctactcccactaatagctttttgatgacttctagcaagcctcgctaacctcgccttaccccccactattaacctactgggagaactctctgtgctagtaaccacgttctcctgatcaaatatcactctcctacttacaggactcaacatactagtcacagccctatactccctctacatatttaccacaacacaatggggctcactcacccaccacattaacaacataaaaccctcattcacacgagaaaacaccctcatgttcatacacctatcccccattctcctcctatccctcaaccccgacatcattaccgggttttcctctt

SEQ ID NO: 154785 - DNA, 297 bp, Homo sapiens
  Payload ID: 10433
  Gene Symbol: MT-ND4L
  Gene Name: mitochondrially encoded NADH dehydrogenase 4L
  Uniprot ID: P03901
  ENST ID: ENST00000361335
  CDS Start-End: 1-297
atgcccctcatttacataaatattatactagcatttaccatctcacttctaggaatactagtatatcgctcacacctcatatcctccctactatgcctagaaggaataatactatcgctgttcattatagctactctcataaccctcaacacccactccctcttagccaatattgtgcctattgccatactagtctttgccgcctgcgaagcagcggtgggcctagccctactagtctcaatctccaacacatatggcctagactacgtacataacctaaacctactccaatgctaa

SEQ ID NO: 154786 - DNA, 1812 bp, Homo sapiens
  Payload ID: 10434
  Gene Symbol: MT-ND5
  Gene Name: mitochondrially encoded NADH dehydrogenase 5
  Uniprot ID: P03915
  ENST ID: ENST00000361567
  CDS Start-End: 1-1812
ataaccatgcacactactataaccaccctaaccctgacttccctaattccccccatccttaccaccctcgttaaccctaacaaaaaaaactcatacccccattatgtaaaatccattgtcgcatccacctttattatcagtctcttccccacaacaatattcatgtgcctagaccaagaagttattatctcgaactgacactgagccacaacccaaacaacccagctctccctaagcttcaaactagactacttctccataatattcatccctgtagcattgttcgttacatggtccatcatagaattctcactgtgatatataaactcagacccaaacattaatcagttcttcaaatatctactcatcttcctaattaccatactaatcttagttaccgctaacaacctattccaactgttcatcggctgagagggcgtaggaattatatccttcttgctcatcagttgatgatacgcccgagcagatgccaacacagcagccattcaagcaatcctatacaaccgtatcggcgatatcggtttcatcctcgccttagcatgatttatcctacactccaactcatgagacccacaacaaatagcccttctaaacgctaatccaagcctcaccccactactaggcctcctcctagcagcagcaggcaaatcagcccaattaggtctccacccctgactcccctcagccatagaaggccccaccccagtctcagccctactccactcaagcactatagttgtagcaggaatcttcttactcatccgcttccaccccctagcagaaaatagcccactaatccaaactctaacactatgcttaggcgctatcaccactctgttcgcagcagtctgcgcccttacacaaaatgacatcaaaaaaatcgtagccttctccacttcaagtcaactaggactcataatagttacaatcggcatcaaccaaccacacctagcattcctgcacatctgtacccacgccttcttcaaagccatactatttatgtgctccgggtccatcatccacaaccttaacaatgaacaagatattcgaaaaataggaggactactcaaaaccatacctctcacttcaacctccctcaccattggcagcctagcattagcaggaatacctttcctcacaggtttctactccaaagaccacatcatcgaaaccgcaaacatatcatacacaaacgcctgagccctatctattactctcatcgctacctccctgacaagcgcctatagcactcgaataattcttctcaccctaacaggtcaacctcgcttccccacccttactaacattaacgaaaataaccccaccctactaaaccccattaaacgcctggcagccggaagcctattcgcaggatttctcattactaacaacatttcccccgcatcccccttccaaacaacaatccccctctacctaaaactcacagccctcgctgtcactttcctaggacttctaacagccctagacctcaactacctaaccaacaaacttaaaataaaatccccactatgcacattttatttctccaacatactcggattctaccctagcatcacacaccgcacaatcccctatctaggccttcttacgagccaaaacctgcccctactcctcctagacctaacctgactagaaaagctattacctaaaacaatttcacagcaccaaatctccacctccatcatcacctcaacccaaaaaggcataattaaactttacttcctctctttcttcttcccactcatcctaaccctactcctaatcacataa

SEQ ID NO: 154787 - DNA, 525 bp, Homo sapiens
  Payload ID: 10435
  Gene Symbol: MT-ND6
  Gene Name: mitochondrially encoded NADH dehydrogenase 6
  Uniprot ID: P03923
  ENST ID: ENST00000361681
  CDS Start-End: 1-525
atgatgtatgctttgtttctgttgagtgtgggtttagtaatggggtttgtggggttttcttctaagccttctcctatttatgggggtttagtattgattgttagcggtgtggtcgggtgtgttattattctgaattttgggggaggttatatgggtttaatagtttttttaatttatttagggggaatgatggttgtctttggatatactacagcgatggctattgaggagtatcctgaggcatgggggtcaggggttgaggtcttggtgagtgttttagtggggttagcgatggaggtaggattggtgctgtgggtgaaagagtatgatggggtggtggttgtggtaaactttaatagtgtaggaagctgaataatttatgaaggagaggggtcagggttgattcgggaggatcctattggtgcgggggctttgtatgattatgggcgttgattagtagtagttactggttgaacattgtttgttggtgtatatattgtaattgagattgctcgggggaatagg

SEQ ID NO: 154788 - DNA, 1339 bp, Homo sapiens
  Payload ID: 10436
  Gene Symbol: MGARP
  Gene Name: mitochondria-localized glutamic acid-rich protein
  Uniprot ID: Q8TDB4
  ENST ID: ENST00000398955
  CDS Start-End: 181-903
gttaggggaggatggtgaggactacaaaggtctccccacctcccgggggccgcggaggcggggctggatgaaggtcgacgtgcctcctccgggcggggcgctgccaggctctcagcctctctgtggaagggcagcctgcgcctgggtaccgaggctgctgcgcggcggacagcgggcgcgatgtatctccgcagggcggtctccaagactctggcgctgccgctgagggcgccccccaaccccgcgccgctcggaaaggacgcatctctgcgccggatgtcatctaacagattccctggatcatctggatcaaatatgatttattatctggttgtaggcgtcacagtcagtgctggtggatattatgcttacaagacagtcacatcagaccaagccaaacacacagaacataaaacaaatttgaaagaaaaaacaaaagcagagatacatccatttcaaggtgaaaaggagaatgttgcggaaactgagaaagcaagttcagaagccccagaagaacttatagtggaagctgaggtggtagatgctgaagaaagtcccagtgctacagttgtggtcataaaagaggcatctgcctgtccaggtcacgtggaggctgctccggagaccacagcagtcagtgctgaaaccgggccagaggtcacagatgcagcggcgagggaaaccacggaagtaaaccctgaaacaaccccagaggttacaaatgctgccctggatgaagctgtcaccatcgataatgataaagatacaacaaagaacgaaacctctgatgaatatgctgaactagaagaagaaaattctccagctgagtcagagtcctctgctggagatgatttacaggaggaagccagtgttggctctgaggctgcttcggctcaaggctaatctccagccggtagacatttcagcaacaaatgccatagggtgtctgataagtgcttttgtgtttttagtacacttagtttaaaaaaaaaaagacttattttctagaaaacgttaatgggtcttgaagatttttggcatccactgatagattttaggactgagagacttgagattgtacatttcttactactcttctactgtctgagatcagaatatgacattgcagtaaagagcttaaatagtttcatctttggtttttttttctagacacttttcttttatcccagtcatctctgaatttacattttatattaaagaaattgagctatccatacaacctgtatttactttaatttcactatgctttcagcttactttattgtatgatatgtaggtctaaaatatagtttgagtcaaataaaattagaaaagcttt

SEQ ID NO: 154789 - DNA, 2754 bp, Homo sapiens
  Payload ID: 10437
  Gene Symbol: MFN1
  Gene Name: mitofusin 1
  ENST ID: ENST00000263969
  CDS Start-End: 92-2317
ttgatgaatgtcactggtgtgtcatcagtttgcatgtctatcatccactttagttggtgcttttctaactttatctccctctagtagcataatggcagaacctgtttctccactgaagcactttgtgctggctaagaaggcgattactgcaatctttgaccagttactggagtttgttactgaaggatcacattttgttgaagcaacatataagaatccggaacttgatcgaatagccactgaagatgatctggtagaaatgcaaggatataaagacaagctttccatcattggtgaggtgctatctcggagacacatgaaggtggcattttttggcaggacaagcagtgggaagagctctgttatcaatgcaatgttgtgggataaagttctccctagtgggattggccatataaccaattgcttcctaagtgttgaaggaactgatggagataaagcctatcttatgacagaaggatcagatgaaaaaaagagtgtgaagacagttaatcaactggcccatgcccttcacatggacaaagatttgaaagctggctgtcttgtacgtgtgttttggccaaaagcaaaatgtgccctcttgagagatgacctggtgttagtagacagtccaggcacagatgtcactacagagctggatagctggattgataagttttgcctagatgctgatgtctttgttttggtcgcaaactctgaatcaacactaatgaatacggaaaaacacttttttcacaaggtgaatgagcggctttccaagcctaatattttcattctcaataatcgttgggatgcctctgcatcagagccagaatatatggaagacgtacgcagacagcacatggaaagatgcctgcatttcttggtggaggagctcaaagttgtaaatgctttagaagcacagaatcgtatcttctttgtttcagcaaaggaagttcttagtgctagaaagcaaaaagcacaggggatgccagaaagtggtgtggcacttgctgaaggatttcatgcaagattacaggaatttcagaattttgaacaaatctttgaggagtgtatctcgcagtcagcagtgaaaacaaagttcgaacagcacactatcagagctaaacagatactagctactgtgaaaaacataatggattcagtaaacctggcagctgaagataaaaggcattattcagtggaagagagggaagaccaaattgatagactggactttattcgaaaccagatgaaccttttaacactggatgttaagaaaaaaatcaaggaggttaccgaggaggtggcaaacaaagtttcatgtgcaatgacagatgaaatttgtcgactgtctgttttggttgatgaattttgttcagagtttcatcctaatccagatgtattaaaaatatataaaagtgaattaaataagcacatagaggatggtatgggaagaaatttggctgatcgatgcaccgatgaagtaaacgccttagtgcttcagacccagcaagaaattattgaaaatttgaagccattacttccagctggtatacaggataaactacatacactgatcccttgcaagaaatttgatctcagttataatctaaattaccacaagttatgttcagattttcaagaggatattgtatttcgtttttccctgggctggtcttcccttgtacatcgatttttgggccctagaaatgctcaaagggtgctcctaggattatcagagcctatctttcagctccctagatctttagcttctactcccactgctcctaccactccagcaacgccagataatgcatcacaggaagaactcatgattacattagtaacaggattggcgtccgttacatctagaacttctatgggcatcattattgttggaggagtgatttggaaaactataggctggaaactcctatctgtttcattaactatgtatggagctttgtatctttatgaaagactgagctggaccacccatgccaaggagcgagcctttaaacagcagtttgtaaactatgcaactgaaaaactgaggatgattgttagctccacgagtgcaaactgcagtcaccaagtaaaacaacaaatagctaccacttttgctcgcctgtgccaacaagttgatattactcaaaaacagctggaagaagaaattgctagattacccaaagaaatagatcagttggagaaaatacaaaacaattcaaagctcttaagaaataaagctgttcaacttgaaaatgagctggagaattttactaagcagtttctaccttcaagcaatgaagaatcctaacaatagagattgctttggtgaccatgataggaggaaacgaaacttgtaagattggaacagttgttatttttatgaaattactttaaatatgaattgtactaactgtacctaaatagcaaagccctgtgtagattctggtaatgatctgtctcagggtatgtgtatttttgaagagtgttatgtccttagttttaattttgagtaaagaaaaggctaaaatcatgaattagttacaagcaacagtaccaacttatgtgacccctgaggggtggggctgtgagctcttaatttgtttttgattctgaaaaactctgcttcctggcatccaggagttagagattgagcctttcatcttctttctcaaaactagtttttgatgctttctttcatgggaatagtcacttttttatttagtaaatcgcattgctggaaccacc

SEQ ID NO: 154790 - DNA, 3148 bp, Homo sapiens
  Payload ID: 10437
  Gene Symbol: MFN1
  Gene Name: mitofusin 1
  Uniprot ID: Q8IWA4
  ENST ID: ENST00000357390
  CDS Start-End: 84-1196
aacttctcgggaagatgaggcagtttggcatctgtggccgagttgctgttgccgggtgatagttggagcggagacttagcataatggcagaacctgtttctccactgaagcactttgtgctggctaagaaggcgattactgcaatctttgaccagttactggagtttgttactgaaggatcacattttgttgaagcaacatataagaatccggaacttgatcgaatagccactgaagatgatctggtagaaatgcaaggatataaagacaagctttccatcattggtgaggtgctatctcggagacacatgaaggtggcattttttggcaggacaagcagtgggaagagctctgttatcaatgcaatgttgtgggataaagttctccctagtgggattggccatataaccaattgcttcctaagtgttgaaggaactgatggagataaagcctatcttatgacagaaggatcagatgaaaaaaagagtgtgaagacagttaatcaactggcccatgcccttcacatggacaaagatttgaaagctggctgtcttgtacgtgtgttttggccaaaagcaaaatgtgccctcttgagagatgacctggtgttagtagacagtccaggcacagatgtcactacagagctggatagctggattgataagttttgcctagatgctgatgtctttgttttggtcgcaaactctgaatcaacactaatgaatacggaaaaacacttttttcacaaggtgaatgagcggctttccaagcctaatattttcattctcaataatcgttgggatgcctctgcatcagagccagaatatatggaagacgtacgcagacagcacatggaaagatgcctgcatttcttggtggaggagctcaaagttgtaaatgctttagaagcacagaatcgtatcttctttgtttcagcaaaggaagttcttagtgctagaaagcaaaaagcacaggggatgccagaaagtggtgtggcacttgctgaaggatttcatgcaagattacaggaatttcagaattttgaacaaatctttgaggagtgtatctcgcagtcagcagtgaaaacaaagttcgaacagcacactatcagagctaaacagatactagctactgtgaaaaacataatggattcagtaaacctggcagctgaagataaaaggtttcatgtgcaatgacagatgaaatttgtcgactgtctgttttggttgatgaattttgttcagagtttcatcctaatccagatgtattaaaaatatataaaagtgaattaaataagcacatagaggatggtatgggaagaaatttggctgatcgatgcaccgatgaagtaaacgccttagtgcttcagacccagcaagaaattattgaaaatttgaagccattacttccagctggtatacaggataaactacatacactgatcccttgcaagaaatttgatctcagttataatctaaattaccacaagttatgttcagattttcaagaggatattgtatttcgtttttccctgggctggtcttcccttgtacatcgatttttgggccctagaaatgctcaaagggtgctcctaggattatcagagcctatctttcagctccctagatctttagcttctactcccactgctcctaccactccagcaacgccagataatgcatcacaggaagaactcatgattacattagtaacaggattggcgtccgttacatctagaacttctatgggcatcattattgttggaggagtgatttggaaaactataggctggaaactcctatctgtttcattaactatgtatggagctttgtatctttatgaaagactgagctggaccacccatgccaaggagcgagcctttaaacagcagtttgtaaactatgcaactgaaaaactgaggatgattgttagctccacgagtgcaaactgcagtcaccaagtaaaacaacaaatagctaccacttttgctcgcctgtgccaacaagttgatattactcaaaaacagctggaagaagaaattgctagattacccaaagaaatagatcagttggagaaaatacaaaacaattcaaagctcttaagaaataaagctgttcaacttgaaaatgagctggagaattttactaagcagtttctaccttcaagcaatgaagaatcctaacaatagagattgctttggtgaccatgataggaggaaacgaaacttgtaagattggaacagttgttatttttatgaaattactttaaatatgaattgtactaactgtacctaaatagcaaagccctgtgtagattctggtaatgatctgtctcagggtatgtgtatttttgaagagtgttatgtccttagttttaattttgagtaaagaaaaggctaaaatcatgaattagttacaagcaacagtaccaacttatgtgacccctgaggggtggggctgtgagctcttaatttgtttttgattctgaaaaactctgcttcctggcatccaggagttagagattgagcctttcatcttctttctcaaaactagtttttgatgctttctttcatgggaatagtcacttttttatttagtaaatcgcattgctggaaccaccaaggagtgtggaatgtccttgagtgtattatttatgcaagtcacagtcacgttgccatcatggcagctatgtgaaacactaataaatgtgtttttactttttattcccgttaaaactgatgtaaaacaggataaaggcttgttatagtcacttataagtatctgggtctaagtaatttccttagatgtttctaaagaaacattttcagctttgctcccattatgattccaataaggaacgctttcctagtgcaattttaggagtaaagtttgaagagataaaaatagccaaagataggagacgtctgaattttgaatgataaacagtgatgttttaaaaaagctgttgttcttcaggaggcatttgcctaggatattgctggattataccccattggaggcttttaattttatttgtatgaattttccaggatttcattaaaaattattattgtattttttaccttaatgaaagattttgggttcaaatatctttctatattaaaagctgattgagtctgtacatatgt

SEQ ID NO: 154791 - DNA, 543 bp, Homo sapiens
  Payload ID: 10437
  Gene Symbol: MFN1
  Gene Name: mitofusin 1
  ENST ID: ENST00000467174
  CDS Start-End: 80-543
tgcgcggggcgggggtgggctctggccctgactcctgcgcccggtgtgggaaggtgggaggccttttctaagtagcataatggcagaacctgtttctccactgaagcactttgtgctggctaagaaggcgattactgcaatctttgaccagttactggagtttgttactgaaggatcacattttgttgaagcaacatataagaatccggaacttgatcgaatagccactgaagatgatctggtagaaatgcaaggatataaagacaagctttccatcattggtgaggtgctatctcggagacacatgaaggtggcattttttggcaggacaagcagtgggaagagctctgttatcaatgcaatgttgtgggataaagttctccctagtgggattggccatataaccaattgcttcctaagtgttgaaggaactgatggagataaagcctatcttatgacagaaggatcagatgaaaaaaagagtgtgaagacagttaatcaactggcccatgcccttcacatggacaaagatttgaaagctgg

SEQ ID NO: 154792 - DNA, 1919 bp, Homo sapiens
  Payload ID: 10437
  Gene Symbol: MFN1
  Gene Name: mitofusin 1
  ENST ID: ENST00000474903
  CDS Start-End: 1-1482
acagttaatcaactggcccatgcccttcacatggacaaagatttgaaagctggctgtcttgtacgtgtgttttggccaaaagcaaaatgtgccctcttgagagatgacctggtgttagtagacagtccaggcacagatgtcactacagagctggatagctggattgataagttttgcctagatgctgatgtctttgttttggtcgcaaactctgaatcaacactaatgaatacggaaaaacacttttttcacaaggtgaatgagcggctttccaagcctaatattttcattctcaataatcgttgggatgcctctgcatcagagccagaatatatggaagacgtacgcagacagcacatggaaagatgcctgcatttcttggtggaggagctcaaagttgtaaatgctttagaagcacagaatcgtatcttctttgtttcagcaaaggaagttcttagtgctagaaagcaaaaagcacaggggatgccagaaagtggtgtggcacttgctgaaggatttcatgcaagattacaggaatttcagaattttgaacaaatctttgaggagtgtatctcgcagtcagcagtgaaaacaaagttcgaacagcacactatcagagctaaacagatactagctactgtgaaaaacataatggattcagtaaacctggcagctgaagataaaaggcattattcagtggaagagagggaagaccaaattgatagactggactttattcgaaaccagatgaaccttttaacactggatgttaagaaaaaaatcaaggaggttaccgaggaggtggcaaacaaagtttcatgtgcaatgacagatgaaatttgtcgactgtctgttttggttgatgaattttgttcagagtttcatcctaatccagatgtattaaaaatatataaaagtctccctagatctttagcttctactcccactgctcctaccactccagcaacgccagataatgcatcacaggaagaactcatgattacattagtaacaggattggcgtccgttacatctagaacttctatgggcatcattattgttggaggagtgatttggaaaactataggctggaaactcctatctgtttcattaactatgtatggagctttgtatctttatgaaagactgagctggaccacccatgccaaggagcgagcctttaaacagcagtttgtaaactatgcaactgaaaaactgaggatgattgttagctccacgagtgcaaactgcagtcaccaagtaaaacaacaaatagctaccacttttgctcgcctgtgccaacaagttgatattactcaaaaacagctggaagaagaaattgctagattacccaaagaaatagatcagttggagaaaatacaaaacaattcaaagctcttaagaaataaagctgttcaacttgaaaatgagctggagaattttactaagcagtttctaccttcaagcaatgaagaatcctaacaatagagattgctttggtgaccatgataggaggaaacgaaacttgtaagattggaacagttgttatttttatgaaattactttaaatatgaattgtactaactgtacctaaatagcaaagccctgtgtagattctggtaatgatctgtctcagggtatgtgtatttttgaagagtgttatgtccttagttttaattttgagtaaagaaaaggctaaaatcatgaattagttacaagcaacagtaccaacttatgtgacccctgaggggtggggctgtgagctcttaatttgtttttgattctgaaaaactctgcttcctggcatccaggagttagagattgagcctttcatcttctttctcaaaactagtttttgatgctttctttcatgggaatagtcacttttttatttagtaaatcgcattgctggaaccacc

SEQ ID NO: 154793 - DNA, 543 bp, Homo sapiens
  Payload ID: 10437
  Gene Symbol: MFN1
  Gene Name: mitofusin 1
  ENST ID: ENST00000489329
  CDS Start-End: 172-543
atgcgccaccacacccggccaaaaagcactgttaatatttctaactttgaaagccatcactaagtattttgagtactctaaatttttttttcacttcataactaaattagtgaaaaaataaaacttgtccttaatttaaagacagttaatcaactggcccatgcccttcacatggacaaagatttgaaagctggctgtcttgtacgtgtgttttggccaaaagcaaaatgtgccctcttgagagatgacctggtgttagtagacagtccaggcacagatgtcactacagagctggatagctggattgataagttttgcctagatgctgatgtctttgttttggtcgcaaactctgaatcaacactaatgaatacggaaaaacacttttttcacaaggtgaatgagcggctttccaagcctaatattttcattctcaataatcgttgggatgcctctgcatcagagccagaatatatggaagacgtacgcagacagcacatggaaagatgcctgcatttcttggtggaggagctcaaagttgta

SEQ ID NO: 154794 - DNA, 5224 bp, Homo sapiens
  Payload ID: 10437
  Gene Symbol: MFN1
  Gene Name: mitofusin 1
  ENST ID: ENST00000471841
  CDS Start-End: 127-2352
agtgaccgccctttgccactccccctgcctcctctccgcctttaacttctcgggaagatgaggcagtttggcatctgtggccgagttgctgttgccgggtgatagttggagcggagacttagcataatggcagaacctgtttctccactgaagcactttgtgctggctaagaaggcgattactgcaatctttgaccagttactggagtttgttactgaaggatcacattttgttgaagcaacatataagaatccggaacttgatcgaatagccactgaagatgatctggtagaaatgcaaggatataaagacaagctttccatcattggtgaggtgctatctcggagacacatgaaggtggcattttttggcaggacaagcagtgggaagagctctgttatcaatgcaatgttgtgggataaagttctccctagtgggattggccatataaccaattgcttcctaagtgttgaaggaactgatggagataaagcctatcttatgacagaaggatcagatgaaaaaaagagtgtgaagacagttaatcaactggcccatgcccttcacatggacaaagatttgaaagctggctgtcttgtacgtgtgttttggccaaaagcaaaatgtgccctcttgagagatgacctggtgttagtagacagtccaggcacagatgtcactacagagctggatagctggattgataagttttgcctagatgctgatgtctttgttttggtcgcaaactctgaatcaacactaatgaatacggaaaaacacttttttcacaaggtgaatgagcggctttccaagcctaatattttcattctcaataatcgttgggatgcctctgcatcagagccagaatatatggaagacgtacgcagacagcacatggaaagatgcctgcatttcttggtggaggagctcaaagttgtaaatgctttagaagcacagaatcgtatcttctttgtttcagcaaaggaagttcttagtgctagaaagcaaaaagcacaggggatgccagaaagtggtgtggcacttgctgaaggatttcatgcaagattacaggaatttcagaattttgaacaaatctttgaggagtgtatctcgcagtcagcagtgaaaacaaagttcgaacagcacactatcagagctaaacagatactagctactgtgaaaaacataatggattcagtaaacctggcagctgaagataaaaggcattattcagtggaagagagggaagaccaaattgatagactggactttattcgaaaccagatgaaccttttaacactggatgttaagaaaaaaatcaaggaggttaccgaggaggtggcaaacaaagtttcatgtgcaatgacagatgaaatttgtcgactgtctgttttggttgatgaattttgttcagagtttcatcctaatccagatgtattaaaaatatataaaagtgaattaaataagcacatagaggatggtatgggaagaaatttggctgatcgatgcaccgatgaagtaaacgccttagtgcttcagacccagcaagaaattattgaaaatttgaagccattacttccagctggtatacaggataaactacatacactgatcccttgcaagaaatttgatctcagttataatctaaattaccacaagttatgttcagattttcaagaggatattgtatttcgtttttccctgggctggtcttcccttgtacatcgatttttgggccctagaaatgctcaaagggtgctcctaggattatcagagcctatctttcagctccctagatctttagcttctactcccactgctcctaccactccagcaacgccagataatgcatcacaggaagaactcatgattacattagtaacaggattggcgtccgttacatctagaacttctatgggcatcattattgttggaggagtgatttggaaaactataggctggaaactcctatctgtttcattaactatgtatggagctttgtatctttatgaaagactgagctggaccacccatgccaaggagcgagcctttaaacagcagtttgtaaactatgcaactgaaaaactgaggatgattgttagctccacgagtgcaaactgcagtcaccaagtaaaacaacaaatagctaccacttttgctcgcctgtgccaacaagttgatattactcaaaaacagctggaagaagaaattgctagattacccaaagaaatagatcagttggagaaaatacaaaacaattcaaagctcttaagaaataaagctgttcaacttgaaaatgagctggagaattttactaagcagtttctaccttcaagcaatgaagaatcctaacaatagagattgctttggtgaccatgataggaggaaacgaaacttgtaagattggaacagttgttatttttatgaaattactttaaatatgaattgtactaactgtacctaaatagcaaagccctgtgtagattctggtaatgatctgtctcagggtatgtgtatttttgaagagtgttatgtccttagttttaattttgagtaaagaaaaggctaaaatcatgaattagttacaagcaacagtaccaacttatgtgacccctgaggggtggggctgtgagctcttaatttgtttttgattctgaaaaactctgcttcctggcatccaggagttagagattgagcctttcatcttctttctcaaaactagtttttgatgctttctttcatgggaatagtcacttttttatttagtaaatcgcattgctggaaccaccaaggagtgtggaatgtccttgagtgtattatttatgcaagtcacagtcacgttgccatcatggcagctatgtgaaacactaataaatgtgtttttactttttattcccgttaaaactgatgtaaaacaggataaaggcttgttatagtcacttataagtatctgggtctaagtaatttccttagatgtttctaaagaaacattttcagctttgctcccattatgattccaataaggaacgctttcctagtgcaattttaggagtaaagtttgaagagataaaaatagccaaagataggagacgtctgaattttgaatgataaacagtgatgttttaaaaaagctgttgttcttcaggaggcatttgcctaggatattgctggattataccccattggaggcttttaattttatttgtatgaattttccaggatttcattaaaaattattattgtattttttaccttaatgaaagattttgggttcaaatatctttctatattaaaagctgattgagtctgtacatatgtaaattatgcctagtggaggttctgttgactttcttccccactgtggaagaggccagttttgcctccatttgcacattcatttcagttatttctgatccataaatataacatttacaaaattcttccttgagctggtggaaatgcctcaccagtttcctctttaatgaatcaaataaaatctttaactgatgttaaaaaaaattgattgaaactcagatggaatggaaatgtacaaaaatgacaccattctaggaatttgctagacaaaatgtaggactaccagatcagtatctcctagacacttgttagaaatgcacaatcccggggaacgcagtacatttggccacatgtagtttatgtttccttttcatgggagggataaaatttaaagctttttttttctttgaatacagtccttccttttctatgccttttaaggcttctagatgctattcagcctttttacagcaggtgcaactctatttttcaaggtatcttagaagataacactaggccattgaagcctttcaaaaatatatttttatgcaaattgacacgagtgcagtatactaatgcaaattaattttggtgtttagcttttattgctcatttataacccaagaaatggtacagaccacagtaagtgggattaggtaacaactacaacatggaaaaacagtgtctaagatcacgtactgctaatttaggttacaaaactcaaggctgtaacctttatatgaaagtacttaagcttgaaagttcataatagtttggtatcacctcattagtatagtacagtggttctcaaagtttggtcctgggtcatcgacattacttctttttctttctgagacagggtctcagtctgtcacccaggatggagtgcagtggcgtgatcatggctcactgcagcctcaacctctcgggttcaggtgatcctcccacatcagcctcctgggtggctgggactacaggcacacgccaccatgcctggctagtttttgtaaagacgaggtttccccatgttgtgcaggctggtcttgaactcacagactcaagtgatccttttacctcagcctcccaaactgttgggataacaggtgtaagccaccacacacagctataatcaaccttcaaacttataaaaagtgtggatccttgggtctgaacccagacctatggagtcagacagtaggtttgaggcccagcaatctatggtttaacaagccatccaggtgtttctgatgcacagtgaaattggggtaccactggtattaggtttggtatggcaactttttcatcacttgttttatgtagttgtctgatcaattgtgaaaacataatgaatgttggaaatggaacagtaaaataacgaaagccaactttttttttttttttttttttttttgagacggagtctcgctctgtcgcccaggctggagtgcagtggcgcgatctcggctcactgcaagctccgcctcccgggttcacgccattctcctgcctcagcctcccgagtagctgggactacaggcgcccgccaccacgcccggctaattttttgtatttttagtagagacggggtttcaccgtgttagccaggatggtctcgatctcctgacctcgtgatccacccgcctcggcctcccaaagtgctgggattacaggcgtgagccaccgcgcccggccgaaagccaactcttatgcctagaaatatgtgcacctatgaccaagcccatgaattatacaggaattatgtaattatgagtgatgtacttcaaagttattgcacatacacttgtttactttgtatgtttgcaggattaaactttgtataatctttttacaaaaattttttttcagtatgcaagcttgcaagatgaaaataaaacctgtttgcctgata

SEQ ID NO: 154795 - DNA, 4539 bp, Homo sapiens
  Payload ID: 10438
  Gene Symbol: MFN2
  Gene Name: mitofusin 2
  Uniprot ID: O95140
  ENST ID: ENST00000235329
  CDS Start-End: 323-2596
gtaggcggggcgagccggctgggctcagggtccaccagctcacccgggtcgaggggcaatctgaggcgactggtgacgcgcttatccacttccctcctcccgcctccccctggggtggcgctcgctggtgacgtagtgagtgtgatggccgccgcgaggccgggaaggtgaagtcaggactggtggagtcaacacagtcaatcaatagccaacctcaacctgagacaggacagaagagaactcagaatctttttgtcttttggacttcagccatgtccatgatgcctaccctgtgaagatctctcaccatccaaaaaacgcaatgtccctgctcttctctcgatgcaactctatcgtcacagtcaagaaaaataagagacacatggctgaggtgaatgcatccccacttaagcactttgtcactgccaagaagaagatcaatggcatttttgagcagctgggggcctacatccaggagagcgccaccttccttgaagacacgtacaggaatgcagaactggaccccgttaccacagaagaacaggttctggacgtcaaaggttacctatccaaagtgagaggcatcagtgaggtgctggctcggaggcacatgaaagtggctttttttggccggacgagcaatgggaagagcaccgtgatcaatgccatgctctgggacaaagttctgccctctgggattggccacaccaccaattgcttcctgcgggtagagggcacagatggccatgaggcctttctccttaccgagggctcagaggaaaagaggagtgccaagactgtgaaccagctggcccatgccctccaccaggacaagcagctccatgccggcagcctagtgagtgtgatgtggcccaactctaagtgcccacttctgaaggatgacctcgttttgatggacagccctggtattgatgtcaccacagagctggacagctggattgacaagttttgtctggatgctgatgtgtttgtgctggtggccaactcagagtccaccctgatgcagacggaaaagcacttcttccacaaggtgagtgagcgtctctcccggccaaacatcttcatcctgaacaaccgctgggatgcatctgcctcagagcccgagtacatggaggaggtgcggcggcagcacatggagcgttgtaccagcttcctggtggatgagctgggcgtggtggatcgatcccaggccggggaccgcatcttctttgtgtctgctaaggaggtgctcaacgccaggattcagaaagcccagggcatgcctgaaggagggggcgctctcgcagaaggctttcaagtgaggatgtttgagtttcagaattttgagaggagatttgaggagtgcatctcccagtctgcagtgaagaccaagtttgagcagcacacggtccgggccaagcagattgcagaggcggttcgactcatcatggactccctgcacatggcggctcgggagcagcaggtttactgcgaggaaatgcgtgaagagcggcaagaccgactgaaatttattgacaaacagctggagctcttggctcaagactataagctgcgaattaagcagattacggaggaagtggagaggcaggtgtcgactgcaatggccgaggagatcaggcgcctctctgtactggtggacgattaccagatggacttccacccttctccagtagtcctcaaggtttataagaatgagctgcaccgccacatagaggaaggactgggtcgaaacatgtctgaccgctgctccacggccatcaccaactccctgcagaccatgcagcaggacatgatagatggcttgaaacccctccttcctgtgtctgtgcggagtcagatagacatgctggtcccacgccagtgcttctccctcaactatgacctaaactgtgacaagctgtgtgctgacttccaggaagacattgagttccatttctctctcggatggaccatgctggtgaataggttcctgggccccaagaacagccgtcgggccttgatgggctacaatgaccaggtccagcgtcccatccctctgacgccagccaaccccagcatgcccccactgccacagggctcgctcacccaggaggagttcatggtttccatggttaccggcctggcctccttgacatccaggacctccatgggcattcttgttgttggaggagtggtgtggaaggcagtgggctggcggctcattgccctctcctttgggctctatggcctcctctacgtctatgagcgtctgacctggaccaccaaggccaaggagagggccttcaagcgccagtttgtggagcatgccagcgagaagctgcagcttgtcatcagctacactggctccaactgcagccaccaagtccagcaggaactgtctgggacctttgctcatctgtgtcagcaagttgacgtcacccgggagaacctggagcaggaaattgccgccatgaacaagaaaattgaggttcttgactcacttcagagcaaagcaaagctgctcaggaataaagccggttggttggacagtgagctcaacatgttcacacaccagtacctgcagcccagcagatagtgggcacctgaggcggagtctgcgtggagaggggcggtgctgccagccctaagtgccatgtgggctcccccaggggcacgtgtggctcctgccccctggccactgccaagagaatgaagcacccagtctcgtaccattttgagccctccagcactacttattttcccccacctttgcctgctgttgctggaagagctggctcatacccccaaaggacactttcagcgacagctatggacagcatggtaccaaggagttaagttgaggctttttccagctttctctggttcatttgattgcttgataaggcctcaggatctcagcattgcacaatgcctcatggaagcctttgagggtatcacacagacacccccaccttcctccagcctgtgcgcacctgccctccttgcagcccagcacacctgcaggtgtaagggacgattggagtttcttcccagagagtctgtcccagaaggactgtggcttgtgtgtgtccatctcgcctgttggctcagtgcttcatcccatttgcagagcctcagacacgtcttggtggtgaggctcagttacccctgggcttaggctgaggcgggccctgtgctgggggtggtagaaaggatgctgctgaggcagctggaggagtgggagtagctcagaggggagggctgttggatgtatggggagctggcagagcaggtggcagtcactgggacaaggagggacttgcctctcttctcattattgtgtcctttgctttagtgtcagtcctggacttgtgcaggcctgttttgtgtagatctgttttggaagatggcatggtctaggtggttgaaggatgtagtagaaggatggatggtggaaggtggggacgttggtggctggctgaggtgcatgggccccacacaggacagctggagaatgggccgtccacttggcctcgttctgcgaggggctcatgggtctgagagcccccacccactaggcttgattgcatccctgttgtgccctttaagagacatgtttccaccccacccccaaccttgtcccaagtgccctggactaaatttcctgtgccagtgactgcagttggccaagggacaatgtggaaaacccagtgtccatctttccaccctccctgatctccagaaccttcgactgacccccttgtctttatgctgatgttgagttttgggattgttactggttgaagtgggggcagatgcctgtcaccaaggtgttgactgtgtgagaaaagcagtttgggtgacaaatcctgtgtggcacaagttggatcgcttcctagaaataagcaacacctctcccaaaaagcagcccacaaggcaggggcccagcagcccagccatcactcatctttgaggaaatgagttggtagcctctgtgcactgtttggtggccacatcacaggtgatgtcctgttcacatacctgcttgtatttaaagccctcagtctgtcctgttgtgtggggcgaagtgatggactctgccaggtggacatgctgtgggtggatgttcccggcgtgtgccgggcctgaatggacaggggccacttcacagcatgtcagggaaaatcactgtcacacaattccaatggattttgtgctctttttgaaaaaaaaaaattctttagcgtaaacatgaattttttttcaatgtagcccctggggaatgaatgaaattttgagcttcttcaatacgtaaaattaaatttataccactgagggagagaccctttctgaaagaagtatggccaaaagcactttaatgctgctgacattgttgtttttatgttcatttgctggagcgcaagacgtgctgacacagtgagttttctctgatgtatttaaggtgatgtatttgcttgagttactcctgtatcattgctcataatattggaaactaaaataaaacctagttggaaatcc

SEQ ID NO: 154796 - DNA, 489 bp, Homo sapiens
  Payload ID: 10438
  Gene Symbol: MFN2
  Gene Name: mitofusin 2
  ENST ID: ENST00000412236
  CDS Start-End: 196-489
agtcaatcaatagccaacctcaacctgagacaggacagaagagaactcagaatctttttgtcttttggacttcagccatgtccatgatgcctaccctgtgaagatctctcaccatccaaaaaattgtgccagcagacgatccgtggatccattttattttccctgctaggagttgctgtacataacactggcgcaatgtccctgctcttctctcgatgcaactctatcgtcacagtcaagaaaaataagagacacatggctgaggtgaatgcatccccacttaagcactttgtcactgccaagaagaagatcaatggcatttttgagcagctgggggcctacatccaggagagcgccaccttccttgaagacacgtacaggaatgcagaactggaccccgttaccacagaagaacaggttctggacgtcaaaggttacctatccaaagtgagaggcatcagtgaggtgctggctcggaggcacatgaaa

SEQ ID NO: 154797 - DNA, 4531 bp, Homo sapiens
  Payload ID: 10438
  Gene Symbol: MFN2
  Gene Name: mitofusin 2
  Uniprot ID: O95140
  ENST ID: ENST00000444836
  CDS Start-End: 309-2582
atgatgcagtgggagtccgagcctctgcgtcgtccgcttgggacgcgccggcggaggagtggcgcgcggaggagtggcgcgctgagacgccgctcgaagcgccgagtcgcggggcagcagaggcgtaaggagtaggcggggcgagccggctgggctcagggtccaccagctcacccgggtcgaggggcaatctgaggcgactggtgacgcgcttatccacttccctcctcccgcctccccctggggtggcgctcgctggtgacgtagtgagtgtgatggccgccgcgaggccgggaaggtgaagcgcaatgtccctgctcttctctcgatgcaactctatcgtcacagtcaagaaaaataagagacacatggctgaggtgaatgcatccccacttaagcactttgtcactgccaagaagaagatcaatggcatttttgagcagctgggggcctacatccaggagagcgccaccttccttgaagacacgtacaggaatgcagaactggaccccgttaccacagaagaacaggttctggacgtcaaaggttacctatccaaagtgagaggcatcagtgaggtgctggctcggaggcacatgaaagtggctttttttggccggacgagcaatgggaagagcaccgtgatcaatgccatgctctgggacaaagttctgccctctgggattggccacaccaccaattgcttcctgcgggtagagggcacagatggccatgaggcctttctccttaccgagggctcagaggaaaagaggagtgccaagactgtgaaccagctggcccatgccctccaccaggacaagcagctccatgccggcagcctagtgagtgtgatgtggcccaactctaagtgcccacttctgaaggatgacctcgttttgatggacagccctggtattgatgtcaccacagagctggacagctggattgacaagttttgtctggatgctgatgtgtttgtgctggtggccaactcagagtccaccctgatgcagacggaaaagcacttcttccacaaggtgagtgagcgtctctcccggccaaacatcttcatcctgaacaaccgctgggatgcatctgcctcagagcccgagtacatggaggaggtgcggcggcagcacatggagcgttgtaccagcttcctggtggatgagctgggcgtggtggatcgatcccaggccggggaccgcatcttctttgtgtctgctaaggaggtgctcaacgccaggattcagaaagcccagggcatgcctgaaggagggggcgctctcgcagaaggctttcaagtgaggatgtttgagtttcagaattttgagaggagatttgaggagtgcatctcccagtctgcagtgaagaccaagtttgagcagcacacggtccgggccaagcagattgcagaggcggttcgactcatcatggactccctgcacatggcggctcgggagcagcaggtttactgcgaggaaatgcgtgaagagcggcaagaccgactgaaatttattgacaaacagctggagctcttggctcaagactataagctgcgaattaagcagattacggaggaagtggagaggcaggtgtcgactgcaatggccgaggagatcaggcgcctctctgtactggtggacgattaccagatggacttccacccttctccagtagtcctcaaggtttataagaatgagctgcaccgccacatagaggaaggactgggtcgaaacatgtctgaccgctgctccacggccatcaccaactccctgcagaccatgcagcaggacatgatagatggcttgaaacccctccttcctgtgtctgtgcggagtcagatagacatgctggtcccacgccagtgcttctccctcaactatgacctaaactgtgacaagctgtgtgctgacttccaggaagacattgagttccatttctctctcggatggaccatgctggtgaataggttcctgggccccaagaacagccgtcgggccttgatgggctacaatgaccaggtccagcgtcccatccctctgacgccagccaaccccagcatgcccccactgccacagggctcgctcacccaggaggagttcatggtttccatggttaccggcctggcctccttgacatccaggacctccatgggcattcttgttgttggaggagtggtgtggaaggcagtgggctggcggctcattgccctctcctttgggctctatggcctcctctacgtctatgagcgtctgacctggaccaccaaggccaaggagagggccttcaagcgccagtttgtggagcatgccagcgagaagctgcagcttgtcatcagctacactggctccaactgcagccaccaagtccagcaggaactgtctgggacctttgctcatctgtgtcagcaagttgacgtcacccgggagaacctggagcaggaaattgccgccatgaacaagaaaattgaggttcttgactcacttcagagcaaagcaaagctgctcaggaataaagccggttggttggacagtgagctcaacatgttcacacaccagtacctgcagcccagcagatagtgggcacctgaggcggagtctgcgtggagaggggcggtgctgccagccctaagtgccatgtgggctcccccaggggcacgtgtggctcctgccccctggccactgccaagagaatgaagcacccagtctcgtaccattttgagccctccagcactacttattttcccccacctttgcctgctgttgctggaagagctggctcatacccccaaaggacactttcagcgacagctatggacagcatggtaccaaggagttaagttgaggctttttccagctttctctggttcatttgattgcttgataaggcctcaggatctcagcattgcacaatgcctcatggaagcctttgagggtatcacacagacacccccaccttcctccagcctgtgcgcacctgccctccttgcagcccagcacacctgcaggtgtaagggacgattggagtttcttcccagagagtctgtcccagaaggactgtggcttgtgtgtgtccatctcgcctgttggctcagtgcttcatcccatttgcagagcctcagacacgtcttggtggtgaggctcagttacccctgggcttaggctgaggcgggccctgtgctgggggtggtagaaaggatgctgctgaggcagctggaggagtgggagtagctcagaggggagggctgttggatgtatggggagctggcagagcaggtggcagtcactgggacaaggagggacttgcctctcttctcattattgtgtcctttgctttagtgtcagtcctggacttgtgcaggcctgttttgtgtagatctgttttggaagatggcatggtctaggtggttgaaggatgtagtagaaggatggatggtggaaggtggggacgttggtggctggctgaggtgcatgggccccacacaggacagctggagaatgggccgtccacttggcctcgttctgcgaggggctcatgggtctgagagcccccacccactaggcttgattgcatccctgttgtgccctttaagagacatgtttccaccccacccccaaccttgtcccaagtgccctggactaaatttcctgtgccagtgactgcagttggccaagggacaatgtggaaaacccagtgtccatctttccaccctccctgatctccagaaccttcgactgacccccttgtctttatgctgatgttgagttttgggattgttactggttgaagtgggggcagatgcctgtcaccaaggtgttgactgtgtgagaaaagcagtttgggtgacaaatcctgtgtggcacaagttggatcgcttcctagaaataagcaacacctctcccaaaaagcagcccacaaggcaggggcccagcagcccagccatcactcatctttgaggaaatgagttggtagcctctgtgcactgtttggtggccacatcacaggtgatgtcctgttcacatacctgcttgtatttaaagccctcagtctgtcctgttgtgtggggcgaagtgatggactctgccaggtggacatgctgtgggtggatgttcccggcgtgtgccgggcctgaatggacaggggccacttcacagcatgtcagggaaaatcactgtcacacaattccaatggattttgtgctctttttgaaaaaaaaaaattctttagcgtaaacatgaattttttttcaatgtagcccctggggaatgaatgaaattttgagcttcttcaatacgtaaaattaaatttataccactgagggagagaccctttctgaaagaagtatggccaaaagcactttaatgctgctgacattgttgtttttatgttcatttgctggagcgcaagacgtgctgacacagtgagttttctctgatgtatttaaggtgatgtatttgcttgagttactcctgtatcattgctcataatattggaaactaaaataaaacctagttggaaatcctttgtg

SEQ ID NO: 154798 - DNA, 11022 bp, Homo sapiens
  Payload ID: 10439
  Gene Symbol: MAPK1
  Gene Name: mitogen-activated protein kinase 1
  Uniprot ID: P28482
  ENST ID: ENST00000215832
  CDS Start-End: 190-1272
aggcaatcggtccgagtggctgtcggctcttcagctctcccgctcggcgtcttccttcctcctcccggtcagcgtcggcggctgcaccggcggcggcgcagtccctgcgggaggggcgacaagagctgagcggcggccgccgagcgtcgagctcagcgcggcggaggcggcggcggcccggcagccaacatggcggcggcggcggcggcgggcgcgggcccggagatggtccgcgggcaggtgttcgacgtggggccgcgctacaccaacctctcgtacatcggcgagggcgcctacggcatggtgtgctctgcttatgataatgtcaacaaagttcgagtagctatcaagaaaatcagcccctttgagcaccagacctactgccagagaaccctgagggagataaaaatcttactgcgcttcagacatgagaacatcattggaatcaatgacattattcgagcaccaaccatcgagcaaatgaaagatgtatatatagtacaggacctcatggaaacagatctttacaagctcttgaagacacaacacctcagcaatgaccatatctgctattttctctaccagatcctcagagggttaaaatatatccattcagctaacgttctgcaccgtgacctcaagccttccaacctgctgctcaacaccacctgtgatctcaagatctgtgactttggcctggcccgtgttgcagatccagaccatgatcacacagggttcctgacagaatatgtggccacacgttggtacagggctccagaaattatgttgaattccaagggctacaccaagtccattgatatttggtctgtaggctgcattctggcagaaatgctttctaacaggcccatctttccagggaagcattatcttgaccagctgaaccacattttgggtattcttggatccccatcacaagaagacctgaattgtataataaatttaaaagctaggaactatttgctttctcttccacacaaaaataaggtgccatggaacaggctgttcccaaatgctgactccaaagctctggacttattggacaaaatgttgacattcaacccacacaagaggattgaagtagaacaggctctggcccacccatatctggagcagtattacgacccgagtgacgagcccatcgccgaagcaccattcaagttcgacatggaattggatgacttgcctaaggaaaagctcaaagaactaatttttgaagagactgctagattccagccaggatacagatcttaaatttgtcaggacaagggctcagaggactggacgtgctcagacatcggtgttcttcttcccagttcttgacccctggtcctgtctccagcccgtcttggcttatccactttgactcctttgagccgtttggaggggcggtttctggtagttgtggcttttatgctttcaaagaatttcttcagtccagagaattcctcctggcagccctgtgtgtgtcacccattggtgacctgcggcagtatgtacttcagtgcacctactgcttactgttgctttagtcactaattgctttctggtttgaaagatgcagtggttcctccctctcctgaatccttttctacatgatgccctgctgaccatgcagccgcaccagagagagattcttccccaattggctctagtcactggcatctcactttatgatagggaaggctactacctagggcactttaagtcagtgacagccccttatttgcacttcaccttttgaccataactgtttccccagagcaggagcttgtggaaataccttggctgatgttgcagcctgcagcaagtgcttccgtctccggaatccttggggagcacttgtccacgtcttttctcatatcatggtagtcactaacatatataaggtatgtgctattggcccagcttttagaaaatgcagtcatttttctaaataaaaaggaagtactgcacccagcagtgtcactctgtagttactgtggtcacttgtaccatatagaggtgtaacacttgtcaagaagcgttatgtgcagtacttaatgtttgtaagacttacaaaaaaagatttaaagtggcagcttcactcgacatttggtgagagaagtacaaaggttgcagtgctgagctgtgggcggtttctggggatgtcccagggtggaactccacatgctggtgcatatacgcccttgagctacttcaaatgtgggtgtttcagtaaccacgttccatgcctgaggatttagcagagaggaacactgcgtctttaaatgagaaagtatacaattctttttccttctacagcatgtcagcatctcaagttcatttttcaacctacagtataacaatttgtaataaagcctccaggagctcatgacgtgaagcactgttctgtcctcaagtactcaaatatttctgatactgctgagtcagactgtcagaaaaagctagcactaactcgtgtttggagctctatccatattttactgatctctttaagtatttgttcctgccactgtgtactgtggagttgactcggtgttctgtcccagtgcggtgcctcctcttgacttccccactgctctctgtggtgagaaatttgccttgttcaataattactgtaccctcgcatgactgttacagctttctgtgcagagatgactgtccaagtgccacatgcctacgattgaaatgaaaactctattgttacctctgagttgtgttccacggaaaatgctatccagcagatcatttaggaaaaataattctatttttagcttttcatttctcagctgtccttttttcttgtttgatttttgacagcaatggagaatgggttatataaagactgcctgctaatatgaacagaaatgcatttgtaattcatgaaaataaatgtacatcttctatcttcacattcatgttaagattcagtgttgctttcctctggatcagcgtgtctgaatggacagtcaggttcaggttgtgctgaacacagaaatgctcacaggcctcactttgccgcccaggcactggcccagcacttggatttacataagatgagttagaaaggtacttctgtagggtcctttttacctctgctcggcagagaatcgatgctgtcatgttcctttattcacaatcttaggtctcaaatattctgtcaaaccctaacaaagaagccccgacatctcaggttggattccctggttctctctaaagagggcctgcccttgtgccccagaggtgctgctgggcacagccaagagttgggaagggccgccccacagtacgcagtcctcaccacccagcccagggtgctcacgctcaccactcctgtggctgaggaaggatagctggctcatcctcggaaaacagacccacatctctattcttgccctgaaatacgcgcttttcacttgcgtgctcagagctgccgtctgaaggtccacacagcattgacgggacacagaaatgtgactgttaccggataacactgattagtcagttttcatttataaaaaagcattgacagttttattactcttgtttctttttaaatggaaagttactattataaggttaatttggagtcctcttctaaatagaaaaccatatccttggctactaacatctggagactgtgagctccttcccattccccttcctggtactgtggagtcagattggcatgaaaccactaacttcattctagaatcattgtagccataagttgtgtgctttttattaatcatgccaaacataatgtaactgggcagagaatggtcctaaccaaggtacctatgaaaagcgctagctatcatgtgtagtagatgcatcattttggctcttcttacatttgtaaaaatgtacagattaggtcatcttaattcatattagtgacacggaacagcacctccactatttgtatgttcaaataagctttcagactaatagcttttttggtgtctaaaatgtaagcaaaaaattcctgctgaaacattccagtcctttcatttagtataaaagaaatactgaacaagccagtgggatggaattgaaagaactaatcatgaggactctgtcctgacacaggtcctcaaagctagcagagatacgcagacattgtggcatctgggtagaagaatactgtattgtgtgtgcagtgcacagtgtgtggtgtgtgcacactcattccttctgctcttgggcacaggcagtgggtgtagaggtaaccagtagctttgagaagctacatgtagctcaccagtggttttctctaaggaatcacaaaagtaaactacccaaccacatgccacgtaatatttcagccattcagaggaaactgttttctctttatttgcttatatgttaatatggtttttaaattggtaacttttatatagtatggtaacagtatgttaatacacacatacatacgcacacatgctttgggtccttccataatacttttatatttgtaaatcaatgttttggagcaatcccaagtttaagggaaatatttttgtaaatgtaatggttttgaaaatctgagcaatccttttgcttatacatttttaaagcatttgtgctttaaaattgttatgctggtgtttgaaacatgatactcctgtggtgcagatgagaagctataacagtgaatatgtggtttctcttacgtcatccaccttgacatgatgggtcagaaacaaatggaaatccagagcaagtcctccagggttgcaccaggtttacctaaagcttgttgccttttcttgtgctgtttatgcgtgtagagcactcaagaaagttctgaaactgctttgtatctgctttgtactgttggtgccttcttggtattgtaccccaaaattctgcatagattatttagtataatggtaagttaaaaaatgttaaaggaagattttattaagaatctgaatgtttattcattatattgttacaatttaacattaacatttatttgtggtatttgtgatttggttaatctgtataaaaattgtaagtagaaaggtttatatttcatcttaattcttttgatgttgtaaacgtactttttaaaagatggattatttgaatgtttatggcacctgacttgtaaaaaaaaaaaactacaaaaaaatccttagaatcattaaattgtgtccctgtattaccaaaataacacagcaccgtgcatgtatagtttaattgcagtttcatctgtgaaaacgtgaaattgtctagtccttcgttatgttccccagatgtcttccagatttgctctgcatgtggtaacttgtgttagggctgtgagctgttcctcgagttgaatggggatgtcagtgctcctagggttctccaggtggttcttcagaccttcacctgtgggggggggggtaggcggtgcccacgcccatctcctcatcctcctgaacttctgcaaccccactgctgggcagacatcctgggcaaccccttttttcagagcaagaagtcataaagataggatttcttggacatttggttcttatcaatattgggcattatgtaatgacttatttacaaaacaaagatactggaaaatgttttggatgtggtgttatggaaagagcacaggccttggacccatccagctgggttcagaactaccccctgcttataactgcggctggctgtgggccagtcattctgcgtctctgctttcttcctctgcttcagactgtcagctgtaaagtggaagcaatattacttgccttgtatatggtaaagattataaaaatacatttcaactgttcagcatagtacttcaaagcaagtactcagtaaatagcaagtctttttaaatgctgctttatttcactaaattttgttgtgaggtgtcactaaaatgcctgcaaacaaacgtaactgctaatctgagaggaaaccctcttactaatcagagaagaaaccctcctgtcagaaaccttcagggaagtgagctgatcacacctaaactgggagtttgcaatggggtatttgaagcactgtgggagtattccactggccctctccctgagagacttaacagtcttccctgttgtccagattctgtataaggcaatcagaataatcatcttccttgttcagcagaggagcctggtcccattttccccactttgtgatgggcttctctcagcggtagctcagcagttccagatggcagtttggaccagcatctaggctggccagttcgctgtgtttacttagaaccaacacgttcagagctggcctggaccatctgaggggaacaggaaacacccctaggctgtggaagcaagtgcagacccccacccccggccctgaagccaagggggcagggtttgggagtggccaaagagaagcagtgcagggatgggttttcctagggacaggcttagcattcctgactctaggaagaaggagcagtgaggcggagaaacagtggaggggatggtggcattgggccccatggggccgagatggacacagggctcgttctcttgagtctggtgccaaggacagctgaagacgacatcattttcaggtggagaggagagagtggagggagatcatgccctgtgatgtgtcttttgcaggtgaaggtgggagacaaggtctctgctgacgatgaggcagagccaccgtgaaagttgtaataggaggactgcccgccgctggaagggcctgcagtgacgctaggacaccctctgcctgcatgtcacgttagctgggctgggcgaagtagaagaccaaggggaagaggtgcagtggggagaccaggtgggatgcaaccacaggaccagtggaggggctgtggcacgtgggcggagactgagtggctgggcatgtgttgtggctgagcatgtggtgtgggcagtggtcctagaccccgccatgtccggacaatgatatagagcgtctcagcatcgccagtctagactgtctatggagagcagaaagttgtctggggctgcctggggaactgtgaggccagctatatcaccgtcgctgatggtgacattacggtggtggcaggagcaaggagagagggaagaaggaccccgtccagctttagtcacaaaatacccaatggaagatgccagtgccaatcctgtgggtttccttgggacttcacactggctttcttatctgctccagatccattcagtagtcactgagttcctgccaaatactttgtagcgccagaagccaggagcggggtctgcagcagggcagtccccattttcaggaaatgcctggagctgctggtccctgagagaaaggaaaacatctttcagccgtacgcaggccaagaaggccaatgtccagtagctttgtgattttttttatatttttttatttatttatttttgagatagagtcttgctctgtcgctcaggctggagtgcagtggcgtgatctccactcactgcaacttccgcctcctggggtcaagcagttctgcctcagcctcccgagtagctgggattacaggcacacgccaccacacccagctaatttttgtgtttttagtagagacggtttcaccatgtcggccaggctggtctcaaactcctgacctcagatgattcagcctcccaaagtgctgggattacaggtgtgagccactgcacccagcctgtgatgtttctgtggggttccacaaatgtgtgtgtgtgtaaaagctgatgattacagcaagaatgtgaacagtagcagttttccatttgaaggcaagttttgtctttatctgggtatcagaaggaccctctgggccattgtcgcttcctgtactcagagccaccctagtactacgggcacacacagaaaacagcagcctgcgtactttcaaaggaaaggcatctttaatcaccaatgcctggaaaaattattttgtttccctcttccttccgtcttgtttcctaacttcttaccaaagtttagagtctgagtttttcgtataataatgtcccacatccacacatcgggcctacagatgctctcccttgaatcgactggaaacatgacaccggttccatgctctggaactgtcacctgtgatgtgctgggctgtgtcccaagcacaggaatcccagcagtttcagctcgatgcagaaccaccatgctccagacacaggcttgggaaagacacgtcaaaattaaaatactaggtaagagaagcacctgattgggtagaagttggagaggaatcctggaattttgtggccagaaggagccactgccccttttgtttagtaagactagacagtaacagaagccagttgtcagctatgaaagtggtgggtgaagcaggggaggctcctctatggtgggaccctggacaagggaagccgaatgtgtgaagaaggggtgcgggggtgtgcggtgccctaggacactagggcaaaggtttcaaacctggaacaaggcactggaggaagatctgctgccagtcagcagtgcgggccctcgagttagcagtccgtgcgcagaggggccagttctgagaccagtttggagagtcaggcagtgacccattggccatgtcataattccttcagcctgcctcctctttaatcccagagagtgctctttcttcatacttcctttaaaatactaaattgttcccattccatggggagctggctaggctttacaggctaggaaatgtaggttttctgagatggaaccatctacacaaggaggaggaaggcactaagactacagatgagacccatgacagggctgagcatttggaagccaaccctggttgcttttcaagaattgctttgtggctgggtgcagtggttcacacctgtaattgcagcactttgggaggctgaggcaggtggattgcttgaacccaggagttcgagaccagcctgggcaacatatgggacaccccaccgcccccggctctgcaaaaaaattaaaaattagccaggcgtggtgtcatgagcctgtggtctcaactactcaggaggctgaggctggaggatcgcttgaacctgggaggtcaaggctccagtgaaccataattgtgccactgcactgcagcctgggcgacaatttgttttctaaattgcttttgaaagtctactgcattacatattccaaaaagcagtggttttcaaatacttttatcaccgatatccttttatgaaatgaaatcagtagaactttctctgctctgaataagcaagggtgggaacctgtctacctcccacagatagcataatgtgcctgccatagaggagccaaaaaatggtgatgggaactgagaggagagcaaatgtcacaaaagactgagcaattgagaaaacaaaacaagaccacagatgactgttaacgcctccacagtggaccaagaaaggacagagagctggcagcatgggcatcactgtctggtcggcagcaggaaggcctcgctagggaattgagtacagtcatctaactagtttaaaagtacaggaaggatgattaaggctattggagaggtcatacaaataggggaggggcaggcaatggctgataagacatgaatttgtaaggcgatgagtattgcagtcagcaaaacaaacgagactgctctcccaacacataactcagcagggaggccaggcattggtttaaccatttaatataaagaagttaaaattacaaatgcgctaagtgcctaaagaagaataagtgcaggaatgagagcagcatggactgccacagttttagaataagcactgtcactgctagattggaaacaaaaatccataaatttggcccggtgtggtggcggacgcctgtagtcccagctacttggaggctgaggcgtgagaatcgcttgaacccgggaggcggaggttgcagtgagccgagatggcgccactgcactccagcctgggcgtcagagtgagaactctgtatcaaaaaataaaaataaaaaaaagtccataaatctgcaatgtctcagttaagaaagaaagactgggccaatgcagatttcaaaccggagaaagtcatactgtcagtgaaggccgcctgtggccggaaggcgccaggggattagcaccctggactcagtgttgctgggaaacagggccccaaggctgggagcacagtgtttaaagggcatctacccaagaagggagcacagggcaaggaggagctgcaggggggcttggctgccaaagtgaattctgaggagagagctattgctgcctacgatatgcaggctgcacagaacacaagtggaatcagcaggcaggagaggcagctaacgacgcagcccgtttcttatttctgttttctcacaagcgatgaaagtggaaaagagggtgagcaggtggcccacacatgtgcctccagtgctgcggcccctccggggaccatcagccaggccccggggagggagccagccacagtgtgtccggctcttctctgaagggaagagagccttgaatagactgaagcgaagacggttctgcaaggacaaggcagaccgaaggcattggttttttttttcagataaggagaattagactcccaagtagacaccagagtcactgtttggttggtgggtgatagtggggtcacagtggctgcctgtgctcccccagggtgagcgtgactgtgctaacctgggtggggcagcatgcacacccctctggcagccctttgttgctcgctgatgacaagtttggatgatcccgccaaacagcttgctaagatgtagtccccagtgttggaggtggggcctgatgggaggtgctacccttgtgagataaggttgtgtaaaagcctgtggcacctccccacactgacgctctcacccctgctctggccatgtgccgcgcctgctcccacttccccttctgccaggagtaaaagcccccgagacctcccagaagccaagcagatgctagtgccatgcttcctctgcagcctgcagaactgtgagccaattaaacctcttttctctataaa

SEQ ID NO: 154799 - DNA, 1487 bp, Homo sapiens
  Payload ID: 10439
  Gene Symbol: MAPK1
  Gene Name: mitogen-activated protein kinase 1
  Uniprot ID: P28482
  ENST ID: ENST00000398822
  CDS Start-End: 241-1323
gcccctccctccgcccgcccgccggcccgcccgtcagtctggcaggcaggcaggcaatcggtccgagtggctgtcggctcttcagctctcccgctcggcgtcttccttcctcctcccggtcagcgtcggcggctgcaccggcggcggcgcagtccctgcgggaggggcgacaagagctgagcggcggccgccgagcgtcgagctcagcgcggcggaggcggcggcggcccggcagccaacatggcggcggcggcggcggcgggcgcgggcccggagatggtccgcgggcaggtgttcgacgtggggccgcgctacaccaacctctcgtacatcggcgagggcgcctacggcatggtgtgctctgcttatgataatgtcaacaaagttcgagtagctatcaagaaaatcagcccctttgagcaccagacctactgccagagaaccctgagggagataaaaatcttactgcgcttcagacatgagaacatcattggaatcaatgacattattcgagcaccaaccatcgagcaaatgaaagatgtatatatagtacaggacctcatggaaacagatctttacaagctcttgaagacacaacacctcagcaatgaccatatctgctattttctctaccagatcctcagagggttaaaatatatccattcagctaacgttctgcaccgtgacctcaagccttccaacctgctgctcaacaccacctgtgatctcaagatctgtgactttggcctggcccgtgttgcagatccagaccatgatcacacagggttcctgacagaatatgtggccacacgttggtacagggctccagaaattatgttgaattccaagggctacaccaagtccattgatatttggtctgtaggctgcattctggcagaaatgctttctaacaggcccatctttccagggaagcattatcttgaccagctgaaccacattttgggtattcttggatccccatcacaagaagacctgaattgtataataaatttaaaagctaggaactatttgctttctcttccacacaaaaataaggtgccatggaacaggctgttcccaaatgctgactccaaagctctggacttattggacaaaatgttgacattcaacccacacaagaggattgaagtagaacaggctctggcccacccatatctggagcagtattacgacccgagtgacgagcccatcgccgaagcaccattcaagttcgacatggaattggatgacttgcctaaggaaaagctcaaagaactaatttttgaagagactgctagattccagccaggatacagatcttaaatttgtcaggtacctggagtttaatacagtgagctctagcaagggaggcgctgccttttgtttctagaatattatgttcctcaaggtccattattttgtattcttttccaagctccttattggaaggtatttttttaaatttagaattaaaaattatttagaaa

SEQ ID NO: 154800 - DNA, 951 bp, Homo sapiens
  Payload ID: 10439
  Gene Symbol: MAPK1
  Gene Name: mitogen-activated protein kinase 1
  Uniprot ID: P28482
  ENST ID: ENST00000544786
  CDS Start-End: 1-951
atggcggcggcggcggcggcgggcgcgggcccggagatggtccgcgggcaggtgttcgacgtggggccgcgctacaccaacctctcgtacatcggcgagggcgcctacggcatggtgtgctctgcttatgataatgtcaacaaagttcgagtagctatcaagaaaatcagcccctttgagcaccagacctactgccagagaaccctgagggagataaaaatcttactgcgcttcagacatgagaacatcattggaatcaatgacattattcgagcaccaaccatcgagcaaatgaaagatgtatatatagtacaggacctcatggaaacagatctttacaagctcttgaagacacaacacctcagcaatgaccatatctgctattttctctaccagatcctcagagggttaaaatatatccattcagctaacgttctgcaccgtgacctcaagccttccaacctgctgctcaacaccacctgtgatctcaagatctgtgactttggcctggcccgtgttgcagatccagaccatgatcacacagggttcctgacagaatatgtggccacacgttggtacagggctccagaaattatgttgaattccaagggctacaccaagtccattgatatttggtctgtaggctgcattctggcagaaatgctttctaacaggcccatctttccagggaagcattatcttgaccagctgaaccacattttggctctggacttattggacaaaatgttgacattcaacccacacaagaggattgaagtagaacaggctctggcccacccatatctggagcagtattacgacccgagtgacgagcccatcgccgaagcaccattcaagttcgacatggaattggatgacttgcctaaggaaaagctcaaagaactaatttttgaagagactgctagattccagccaggatacagatcttaa

SEQ ID NO: 154801 - DNA, 6480 bp, Homo sapiens
  Payload ID: 10440
  Gene Symbol: MAPK1IP1L
  Gene Name: mitogen-activated protein kinase 1 interacting protein 1-like
  Uniprot ID: Q8NDC0
  ENST ID: ENST00000395468
  CDS Start-End: 178-915
aggcggtgcgctcggcgcttcctgttccggcgccaggaggagccgcgcgctgctggtgctgttgccgccgctgctctagctgccgtcagtcaggctgcgcccgcgtcttcagggcccagtccctcggacccatcgccgcttctagaccctactgcggtctcggatattgccgggaaaatgtctgatgaattttcgttggcagatgcactacctgaacactcccctgccaaaacctctgctgtgagcaatacaaaacctggccaacctcctcaaggctggccaggctccaacccttggaataatccgagtgctccatcttcagtgccatctggactcccaccaagtgcaacaccctccactgtgccttttggaccagcaccaacaggaatgtatccctccgtgcctcccaccggaccacctccaggacccccagcaccctttcctccttccggaccatcatgtcccccacctggtggtccttatccagccccaactgtgccgggccctggccccacagggccatatcctacaccaaatatgccctttccagagctacccagaccatatggtgcacccacagatccagctgcagctggtcctttaggtccatggggatccatgtcttctggaccttgggcgccaggaatgggagggcagtatcctacccctaatatgccatatccatctccaggcccatatcccgctcctcctcctccccaagcccctggggcagcaccacctgttccatggggcaccgttccaccaggagcctggggaccaccagcaccatatcctgcccctacaggatcgtatcccacaccaggactctatcctactcccagtaatcctttccaagtgccttcaggaccttctggtgctccaccaatgcctggtggcccccattcttaccattaagttaacaatggacgaagagatgacgctttgctttttgaagtacatgtatatgcacatgaatgcatatataaaaattgctggtttcactattagagggcattcatgaaagaacaactcttgcacctctcagagaagataactgcctcttgtacttggatgcgtagtacatcatatgtatacaatcagataaaagcatagaagtaaatcattcggatgtgatttttatttggttttcatggaaagttaaagtgataaagtatattgaatagttctttgacagaatttgtttaaactatgaaactacacacttaaaaatctaagatgtggattattgttagaatctgcaacttcattggcaaattatttcaagtatttttctataatcactttccccttctaaataaataaacttcgagaataacccatcataatccaaacaaatgatgcctcaacattttgagctgctctgtcggacaaataaacctggtcctcttgaggttatattttggatatacatttttaaactgtcagtaattattgtcagatgtggagttcaatagccagccagtgttcatttttatccttgagcttttagtaaaaacttcctggttttatttttagtcattgggtcatacagcactaaagtctgctatttatggaaactaacttttttgtttttaatccaggccaacatgtatgtaaattaaatttttagataattgattatctctttgtactacttgagatttgattatgagatgtgcatattgctttgggaagagctcgaggaaggaaataattctctcctttgttttgaacctcaaactagataaaccctaggaattgcttaactgcaacaagtaattttcattcccacaaaaacctgaggcagctcttttgcccagagcgttccctgtagccacccccaccccacttgcccttggttctttagaaggagcacacacatcccttgattcctccctgatgtggtaaactggcacactccaggggtctaaaacataaaacagttgtgtttagggaaccttaagtcatgcagacatgactgttctctttgtacaagtgtgaatcaaaatatgtatctctttttcagagtctggttaagctatgtcattgtctactgcatagtttcctgagtctgtttgtaaagtgcttatggctaacagttcagttctgtatttgttgacaggtaaataagtggagttgagtgccatctttgaaaaaattaccctctagctctaacactgaaaataataataaattgtagatctctgcaactaagtttaaagcagtgtgactgtgttgcttaaatatcaagtattgtttataaccaccaaaaaaaaaaagccctggtagttttttggcaccttatgtttaaatcagattcttagatttggagtagacctgaccttgttatttattagataacattttgaatgtatccattggatttctaaaatgtattgtgaatttctcagacaaacaggatttatgctggagctctgttttgcttagaaataaaatatttagtagtttatttctgctctaattaaaatgtcaagaatgccaaatgctgccagttttttggtttgatagctacctccttctaagaaagcaaaatggttacctttgagaggaacattcagtgtttaatcatcccttatgttaactagatgatagattcaagcttttagaaatgagaaagtagaaactaatttgttaagatattttcagactgcggaatgttgttagctttttctttcacttctcttcaaggacaggtgttagctgtctacaatactgttgaactctgttgtcaaagtagcccccttagtctacaaggcaggtagccttggcttgaattatcaatatcaaaatgtcagttaaccatggagggataaagtaatgtgaaaagtgagatggctgcaaagatagctctccttacagttattttggctgtcctacattgggataagctgacaaattagcagtatttagtttaacactggagcaaatataatttgagtaggaagaagagatagcaggtttgggaatctataattatgaagtccattgattttgggagaaaatctgttgctaaaggatttgaagggccatgaacacaatttgggattattactccctataagtataataattttgctagtgacccatactgtccagtgtgccctaaatcatactgctattgtactccctttgttttcaaggactttgcaactggtatttgggggagatttttttttttttttgagacggagtctcgctctgtcgcccatgctggagtgcagtggtgctatcttggttcactgcaagctccatctcccaggttcacaccattctcctgcctcagcctcccaagcagctgggactacaggtgcccgccaccatgcccggctaatttttttttttttttttttttagtagagatggggtttcactgtgttagccaggatggtctcgatctcctgacctcgtgatctgcccgccttggcttcccaaagtgctgggattacaggcgtgagccaccacgtccggccgatttttttttttttttttaatgtaagaatggagataaaagggataatataatttgcttttatattgttatttttgtaaagcatcttttcttcaattcttgttggcattctgggccaaaatatttcaggttggttcggtgtggagttaagaaaagcaggcgttttagtggagaaatggggaacagcatcaagaaaggcttttttccttttttcttttttttttggagacagagtcttgccctgtcacccaggctggagtgcaatggcgtgatcttggctcgctgcaacctctgcctccaggttcaaacgattcttctgcctcagcctcccaagtagctgggattacaggtgcccgccaccacacccatttttgtatttttagtagagacgggggtttcaccatgttggccagggtggtctgaaactcctgacctcgtgatccgcctgcctcagcctcccaaagtgctgagattacaggcgtgagccaccatgcgtgacctttttttctttttaaaagggaacaatgttgctttcaaaacaagacatgctaggctgaaactgatttatggaaaagactgcttgttagcaagtatatttggtcttgagggggatacagattatagaatatgctgacatttgggcttcagaggaagaattttcaaatctaatggaaatagttgaggtgttcaggaatgctgtttcttggagttggaagcttaggttttgaaatgttgaaaccaaaaagacaaaaattaaaacatagaccttaggtcgtcattcacacccggttctcaagaatcaagtggagcacttcaaagaccttggcttgtctgtcccatcctgccactttctcatcttttcatgcttttgaagacaccatttacagctctgactcagccctattttgtgtaaagtaatatattgattattcagaaatagacaatacattttttaattacccaaggactgactgttttgtgcattttactgttggttgtcttcagtagagaatagtaatagggcagagaaaagtatatattttgcctcagtcagtcccaccaccacaatggactattgggatattttctaaaaaaccaatcaatttgcccatgattacctcacaaataattagtgctacctggggtactctcaaatatacagcttttgaaactgtagatgaaaaaagctctactcagagtttttgtcaagactgtgcctgggttgaatatcagtcaattgcctacacttctaaacaataagtgccaatgtctcaattttctcaccctgaatgatagaagctagctttatcaaatgccaaggttagaaagcctggaaataaaacttaagcacagacattcaagtttttgaaaagcataagcctaaattcagataaatcacactgatatattgtactatgcatagaaagttgtaggtggcgttcagggaagactttgattttaataaagcaatatttagtattgaagacaaacactttttattttcagatttctgccaagtaaaacagaaattgccaataaaataatcagtattttgtaaatggcaggcaagcttctggctgtcgaaaacatctgagtcatttattcagtagacaatatgtccttgatccaggttctttgccagctataagggaatccctgtccttgagaggctcatagtctataagtaacattacagaatttgttagcatacccattcattattagttttacctaaacgtgttaggatcactactggtggaaattgtaaccagcctttgggcatcttaaagggtgacatgtggcatgcctttttttttttttaagaatttaatgtttttcaagattgtagtgttgatcagcgcaacaattcaagtgtgcaaagtaacaggatagtttgcctcttcactttacccctggataaaggcactttcactgcctgtcactgatcagcagatactgacttgttgccattaagtgaacttgacttcttatgtgtgctctatgagtttgttgtaattttcttcttgaaattgtgatttttcactgacagtaatgacaaatttaatgtatgtaattgtctatgcattttaagttaaactgcctaaaatgtgatttgagacatatacatatgtttgtattataaattgtaagcaatcagtttgagatactaggttttatcacctgctgctgtatttgtaaacaaagacaaatgttgctttaagaagtaattataattaggaataggctatggatgtgatacttggtattttttaagataaacttgtttgcttttgtgtattatacctggaaactttttttaaaaaatgtattttcatggtttcacagatttttcatgttattttattctttaggcccaattctgggcttctctgagcaagtccagagcctaattaactgtaaatttgttgtcaaaaaggaagaaaaaagggcctgagatacctctttgcatgtgacctgcattcactaaggatatctggaaaccacccttcctccgcaaaccctctcagcaacatggtgtccattgtggtgattttctcttcttttaaggctaggctactcttggtaaccagattatccgtatatatgataatatgaagtcagggaactttctctgtctgtccctactcccctcactcccccactttctgttatgaaagatagttctacttttatcattaactgctacgcatttagtgagggtcacattattaaacttggagtttaccattttcccacaggagatttcgctggcattccttggaactcccaatttcagtagggcaatgaatgaatgaatactttgcagtgctacttttggaaggaatttctgctttttgccttatgattggacaaaatgcagctgtaaaattttaaattgtttttgatatgttattcaatatcccatgaaagtattcacctaaagtggagttatgaaatggatggtgaaataataagaccattctggagca

SEQ ID NO: 154802 - DNA, 2836 bp, Homo sapiens
  Payload ID: 10440
  Gene Symbol: MAPK1IP1L
  Gene Name: mitogen-activated protein kinase 1 interacting protein 1-like
  Uniprot ID: Q8NDC0
  ENST ID: ENST00000622254
  CDS Start-End: 126-863
ctggtgctgttgccgccgctgctctagctgccgtcagtcaggctgcgcccgcgtcttcagggcccagtccctcggacccatcgccgcttctagaccctactgcggtctcggatattgccgggaaaatgtctgatgaattttcgttggcagatgcactacctgaacactcccctgccaaaacctctgctgtgagcaatacaaaacctggccaacctcctcaaggctggccaggctccaacccttggaataatccgagtgctccatcttcagtgccatctggactcccaccaagtgcaacaccctccactgtgccttttggaccagcaccaacaggaatgtatccctccgtgcctcccaccggaccacctccaggacccccagcaccctttcctccttccggaccatcatgtcccccacctggtggtccttatccagccccaactgtgccgggccctggccccacagggccatatcctacaccaaatatgccctttccagagctacccagaccatatggtgcacccacagatccagctgcagctggtcctttaggtccatggggatccatgtcttctggaccttgggcgccaggaatgggagggcagtatcctacccctaatatgccatatccatctccaggcccatatcccgctcctcctcctccccaagcccctggggcagcaccacctgttccatggggcaccgttccaccaggagcctggggaccaccagcaccatatcctgcccctacaggatcgtatcccacaccaggactctatcctactcccagtaatcctttccaagtgccttcaggaccttctggtgctccaccaatgcctggtggcccccattcttaccattaagttaacaatggacgaagagatgacgctttgctttttgaagtacatgtatatgcacatgaatgcatatataaaaattgctggtttcactattagagggcattcatgaaagaacaactcttgcacctctcagagaagataactgcctcttgtacttggatgcgtagtacatcatatgtatacaatcagataaaagcatagaagtaaatcattcggatgtgatttttatttggttttcatggaaagttaaagtgataaagtatattgaatagttctttgacagaatttgtttaaactatgaaactacacacttaaaaatctaagatgtggattattgttagaatctgcaacttcattggcaaattatttcaagtatttttctataatcactttccccttctaaataaataaacttcgagaataacccatcataatccaaacaaatgatgcctcaacattttgagctgctctgtcggacaaataaacctggtcctcttgaggttatattttggatatacatttttaaactgtcagtaattattgtcagatgtggagttcaatagccagccagtgttcatttttatccttgagcttttagtaaaaacttcctggttttatttttagtcattgggtcatacagcactaaagtctgctatttatggaaactaacttttttgtttttaatccaggccaacatgtatgtaaattaaatttttagataattgattatctctttgtactacttgagatttgattatgagatgtgcatattgctttgggaagagctcgaggaaggaaataattctctcctttgttttgaacctcaaactagataaaccctaggaattgcttaactgcaacaagtaattttcattcccacaaaaacctgaggcagctcttttgcccagagcgttccctgtagccacccccaccccacttgcccttggttctttagaaggagcacacacatcccttgattcctccctgatgtggtaaactggcacactccaggggtctaaaacataaaacagttgtgtttagggaaccttaagtcatgcagacatgactgttctctttgtacaagtgtgaatcaaaatatgtatctctttttcagagtctggttaagctatgtcattgtctactgcatagtttcctgagtctgtttgtaaagtgcttatggctaacagttcagttctgtatttgttgacaggtaaataagtggagttgagtgccatctttgaaaaaattaccctctagctctaacactgaaaataataataaattgtagatctctgcaactaagtttaaagcagtgtgactgtgttgcttaaatatcaagtattgtttataaccaccaaaaaaaaaaagccctggtagttttttggcaccttatgtttaaatcagattcttagatttggagtagacctgaccttgttatttattagataacattttgaatgtatccattggatttctaaaatgtattgtgaatttctcagacaaacaggatttatgctggagctctgttttgcttagaaataaaatatttagtagtttatttctgctctaattaaaatgtcaatttacccctggataaaggcactttcactgcctgtcactgatcagcagatactgacttgttgccattaagtgaacttgacttcttatgtgtgctctatgagtttgttgtaattttcttcttgaaattgtgatttttcactgacagtaatgacaaatttaatgtatgtaattgtctatgcattttaagttaaactgcctaaaatgtgatttgagacatatacatatgtttgtattataaattgtaagcaatcagtttgagatactaggttttatcacctgctgctgtatttgtaaacaaagacaaatgttgctttaagaagtaattataattaggaataggctatggatgtgatacttggtattttttaagataaacttgtttgcttttgtgtatt

SEQ ID NO: 154803 - DNA, 2477 bp, Homo sapiens
  Payload ID: 10441
  Gene Symbol: MAPK10
  Gene Name: mitogen-activated protein kinase 10
  ENST ID: ENST00000310816
  CDS Start-End: 392-823
cctgtgaggccaggcagaaatggcgtggcaggggacccagcgagcccagagggattttgccgctgcttcctctacccctgtatttcacgcagctctctaaattgactcagctccagaaccataattatcatgtgatctagacctgatacattgtagatgaagaaacatgtcgacagagccactatctgcccaacatctgatgggtagtcatagtcacagtggaactgagactaaggtttccatttttatttgactatgcttcttcccaaggctagtgtgagaaacaccaacagcaggcccatctcagatcttcactatggcaacttatgcaagaaactgttgaattagacccgtttcctatagatgagaaaccatacaagctgtggtatttatgagcctccatttcttatactactgcagtgaaccaacattggatgtgaaaattgccttttgtcagggattcgataaacaagtggatgtgtcatatattgccaaacattacaacatgagcaaaagcaaagttgacaaccagttctacagtgtggaagtgggagactcaaccttcacagttctcaagcgctaccagaatctaaagcctattggctctggggctcagggcatagtttgtgccgcgtatgatgctgtccttgacagaaatgtggccattaagaagctcagcagaccctttcagaaccaaacacatgccaagagagcgtaccgggagctggtcctcatgaagtgtgtgaaccataaaaacttacttagtaatggaactgatggatgccaacttatgtcaagtgattcagatggaattagaccatgagcgaatgtcttacctgctgtaccaaatgttgtgtggcattaagcacctccattctgctggaattattcacagggatttaaaaccaagtaacattgtagtcaagtctgattgcacattgaaaatcctggactttggactggccaggacagcaggcacaagcttcatgatgactccatatgtggtgacacgttattacagagcccctgaggtcatcctggggatgggctacaaggagaacgttgacatgtggtcagtagggtgcatcatgggagaaatgataaaaggtgcagtgctgtttcctggcactgatcatattgaccagtggaataaggtaattgaacaactaggaacaccatgtccagaattcatgaagaaattgcaacccacagtaagaaactatgtggagaatcggcccaagtatgcgggactcaccttccccaaactcttcccagattccctcttcccagcggactccgagcacaataaactcaaagccagccaagccagggacttgttgtcaaagatgctagtgattgacccagcaaaaagaatatcagtggacgacgccttacagcatccctacatcaacgtctggtatgacccagccgaagtggaggcgcctccacctcagatatatgacaagcagttggatgaaagagaacacacaattgaagaatggaaagaacttatctacaaggaagtaatgaattcagaagaaaagactaaaaatggtgtagtaaaaggacagccttctccttcaggtgcagcagtgaacagcagtgagagtctccctccatcctcgtctgtcaatgacatctcctccatgtccaccgaccagaccctggcatctgacactgacagcagcctggaagcctcggcaggacccctgggttgttgcaggtgactagccgcctgcctgcgaaacccagcgttcttcaggagatgatgtgatggaacacacacacacgcagacacacacacacacacaaatgcagacacacaacatcaagaaaacagcaagggagagaatccaagcctaaaattaaataaatctttcagcctgcttcttccccagggttctgtattgcagctaagctcaaatgtatatttaacttctagttgctcttgctttggtcttcttccaatgatgcttactacagaaagcaaatcagacacaattagagaagccttttccataaagtgtaattttaatggctgcaaaaccggcaacctgtaactgcccttttaaatggcatgacaaggtgtgcagtggccccatccagcatgtgtgtgtctctatcttgcatctacctgctccttggcctagtcagatggatgtagatacagatccgcatgtgtctgtattcatacagcactacttacttagagatgctactgtcagtgtcctcagggctctaccaagacataatgcactggggtaccacatggtccatttcatgtgatctattactctgacataaacccatctgtaatatattgccagtatataagctgtttagtttgttaattgattaaactgtatgtcttataagaaaacatgtaaagggggaatatatggggggagtgagctctctcagacccttgaagatgtagcttccaaatttgaatggattaaatggcacctgtataccaa

SEQ ID NO: 154804 - DNA, 2672 bp, Homo sapiens
  Payload ID: 10441
  Gene Symbol: MAPK10
  Gene Name: mitogen-activated protein kinase 10
  Uniprot ID: P53779
  ENST ID: ENST00000359221
  CDS Start-End: 528-1922
ggtaggttccacaatggtacaggcagcatcacgctgcacaatggtttccaggcagtgaaagagggtgattcagcaagccactcttcttctattttctttaacctccccttcactttttatttttatgggggtgggtggtgcttgctatatgcttacctttttcttttcttttttcatttttacaaatttccttttttgtcctcacccctcaattcctaggggcttgagtgagtttaagattgggttttcttggaaatcacctgtccatcgttaattttaaacaatctccatatctccaaagaatctcttccatgttagtctggaatgtggttaatgaaaaacaagtagggaggatttctggggcaaacactgccggatcaggatcgtagttctcaggcacggaatggctagtgtgagaaacaccaacagcaggcccatctcagatcttcactatggcaacttatgcaagaaactgttgaattagacccgtttcctatagatgagaaaccatacaagctgtggtatttatgagcctccatttcttatactactgcagtgaaccaacattggatgtgaaaattgccttttgtcagggattcgataaacaagtggatgtgtcatatattgccaaacattacaacatgagcaaaagcaaagttgacaaccagttctacagtgtggaagtgggagactcaaccttcacagttctcaagcgctaccagaatctaaagcctattggctctggggctcagggcatagtttgtgccgcgtatgatgctgtccttgacagaaatgtggccattaagaagctcagcagaccctttcagaaccaaacacatgccaagagagcgtaccgggagctggtcctcatgaagtgtgtgaaccataaaaacattattagtttattaaatgtcttcacaccccagaaaacgctggaggagttccaagatgtttacttagtaatggaactgatggatgccaacttatgtcaagtgattcagatggaattagaccatgagcgaatgtcttacctgctgtaccaaatgttgtgtggcattaagcacctccattctgctggaattattcacagggatttaaaaccaagtaacattgtagtcaagtctgattgcacattgaaaatcctggactttggactggccaggacagcaggcacaagcttcatgatgactccatatgtggtgacacgttattacagagcccctgaggtcatcctggggatgggctacaaggagaacgtggatatatggtctgtgggatgcattatgggagaaatggttcgccacaaaatcctctttccaggaagggactatattgaccagtggaataaggtaattgaacaactaggaacaccatgtccagaattcatgaagaaattgcaacccacagtaagaaactatgtggagaatcggcccaagtatgcgggactcaccttccccaaactcttcccagattccctcttcccagcggactccgagcacaataaactcaaagccagccaagccagggacttgttgtcaaagatgctagtgattgacccagcaaaaagaatatcagtggacgacgccttacagcatccctacatcaacgtctggtatgacccagccgaagtggaggcgcctccacctcagatatatgacaagcagttggatgaaagagaacacacaattgaagaatggaaagaacttatctacaaggaagtaatgaattcagaagaaaagactaaaaatggtgtagtaaaaggacagccttctccttcaggtgcagcagtgaacagcagtgagagtctccctccatcctcgtctgtcaatgacatctcctccatgtccaccgaccagaccctggcatctgacactgacagcagcctggaagcctcggcaggacccctgggttgttgcaggtgactagccgcctgcctgcgaaacccagcgttcttcaggagatgatgtgatggaacacacacacacgcagacacacacacacacacaaatgcagacacacaacatcaagaaaacagcaagggagagaatccaagcctaaaattaaataaatctttcagcctgcttcttccccagggttctgtattgcagctaagctcaaatgtatatttaacttctagttgctcttgctttggtcttcttccaatgatgcttactacagaaagcaaatcagacacaattagagaagccttttccataaagtgtaattttaatggctgcaaaaccggcaacctgtaactgcccttttaaatggcatgacaaggtgtgcagtggccccatccagcatgtgtgtgtctctatcttgcatctacctgctccttggcctagtcagatggatgtagatacagatccgcatgtgtctgtattcatacagcactacttacttagagatgctactgtcagtgtcctcagggctctaccaagacataatgcactggggtaccacatggtccatttcatgtgatctattactctgacataaacccatctgtaatatattgccagtatataagctgtttagtttgttaattgattaaactgtatgtcttataagaaaacatgtaaagggggaatatatggggggagtgagctctctcagacccttgaagatgtagcttccaaatttgaatggattaaatggcacctgtataccaa

SEQ ID NO: 154805 - DNA, 2371 bp, Homo sapiens
  Payload ID: 10441
  Gene Symbol: MAPK10
  Gene Name: mitogen-activated protein kinase 10
  Uniprot ID: P53779
  ENST ID: ENST00000361569
  CDS Start-End: 223-1491
agaaatggcgtggcaggggacccagcgagcccagagggattttgccgctgcttcctctacccctgtatttcacgcagctctctaaattgactcagctccaggctagtgtgagaaacaccaacagcaggcccatctcagatcttcactatggcaacttatgcaagaaactgttgaattagacccgtttcctatagatgagaaaccatacaagctgtggtatttatgagcctccatttcttatactactgcagtgaaccaacattggatgtgaaaattgccttttgtcagggattcgataaacaagtggatgtgtcatatattgccaaacattacaacatgagcaaaagcaaagttgacaaccagttctacagtgtggaagtgggagactcaaccttcacagttctcaagcgctaccagaatctaaagcctattggctctggggctcagggcatagtttgtgccgcgtatgatgctgtccttgacagaaatgtggccattaagaagctcagcagaccctttcagaaccaaacacatgccaagagagcgtaccgggagctggtcctcatgaagtgtgtgaaccataaaaacattattagtttattaaatgtcttcacaccccagaaaacgctggaggagttccaagatgtttacttagtaatggaactgatggatgccaacttatgtcaagtgattcagatggaattagaccatgagcgaatgtcttacctgctgtaccaaatgttgtgtggcattaagcacctccattctgctggaattattcacagggatttaaaaccaagtaacattgtagtcaagtctgattgcacattgaaaatcctggactttggactggccaggacagcaggcacaagcttcatgatgactccatatgtggtgacacgttattacagagcccctgaggtcatcctggggatgggctacaaggagaacgtggatatatggtctgtgggatgcattatgggagaaatggttcgccacaaaatcctctttccaggaagggactatattgaccagtggaataaggtaattgaacaactaggaacaccatgtccagaattcatgaagaaattgcaacccacagtaagaaactatgtggagaatcggcccaagtatgcgggactcaccttccccaaactcttcccagattccctcttcccagcggactccgagcacaataaactcaaagccagccaagccagggacttgttgtcaaagatgctagtgattgacccagcaaaaagaatatcagtggacgacgccttacagcatccctacatcaacgtctggtatgacccagccgaagtggaggcgcctccacctcagatatatgacaagcagttggatgaaagagaacacacaattgaagaatggaaagaacttatctacaaggaagtaatgaattcagaagaaaagactaaaaatggtgtagtaaaaggacagccttctccttcagcacaggtgcagcagtgaacagcagtgagagtctccctccatcctcgtctgtcaatgacatctcctccatgtccaccgaccagaccctggcatctgacactgacagcagcctggaagcctcggcaggacccctgggttgttgcaggtgactagccgcctgcctgcgaaacccagcgttcttcaggagatgatgtgatggaacacacacacacgcagacacacacacacacacaaatgcagacacacaacatcaagaaaacagcaagggagagaatccaagcctaaaattaaataaatctttcagcctgcttcttccccagggttctgtattgcagctaagctcaaatgtatatttaacttctagttgctcttgctttggtcttcttccaatgatgcttactacagaaagcaaatcagacacaattagagaagccttttccataaagtgtaattttaatggctgcaaaaccggcaacctgtaactgcccttttaaatggcatgacaaggtgtgcagtggccccatccagcatgtgtgtgtctctatcttgcatctacctgctccttggcctagtcagatggatgtagatacagatccgcatgtgtctgtattcatacagcactacttacttagagatgctactgtcagtgtcctcagggctctaccaagacataatgcactggggtaccacatggtccatttcatgtgatctattactctgacataaacccatctgtaatatattgccagtatataagctgtttagtttgttaattgattaaactgtatgtcttataagaaaacatgtaaagggggaatatatggggggagtgagctctctcagacccttgaagatgtagcttccaaatttgaatggattaaatggcacctgtatacca

SEQ ID NO: 154806 - DNA, 1828 bp, Homo sapiens
  Payload ID: 10441
  Gene Symbol: MAPK10
  Gene Name: mitogen-activated protein kinase 10
  ENST ID: ENST00000395157
  CDS Start-End: 119-1078
gacagaaatgtggccattaagaagctcagcagaccctttcagaaccaaacacatgccaagagagcgtaccgggagctggtcctcatgaagtgtgtgaaccataaaaacttacttagtaatggaactgatggatgccaacttatgtcaagtgattcagatggaattagaccatgagcgaatgtcttacctgctgtaccaaatgttgtgtggcattaagcacctccattctgctggaattattcacagggatttaaaaccaagtaacattgtagtcaagtctgattgcacattgaaaatcctggactttggactggccaggacagcaggcacaagcttcatgatgactccatatgtggtgacacgttattacagagcccctgaggtcatcctggggatgggctacaaggagaacgtggatatatggtctgtgggatgcattatgggagaaatggttcgccacaaaatcctctttccaggaagggactatattgaccagtggaataaggtaattgaacaactaggaacaccatgtccagaattcatgaagaaattgcaacccacagtaagaaactatgtggagaatcggcccaagtatgcgggactcaccttccccaaactcttcccagattccctcttcccagcggactccgagcacaataaactcaaagccagccaagccagggacttgttgtcaaagatgctagtgattgacccagcaaaaagaatatcagtggacgacgccttacagcatccctacatcaacgtctggtatgacccagccgaagtggaggcgcctccacctcagatatatgacaagcagttggatgaaagagaacacacaattgaagaatggaaagaacttatctacaaggaagtaatgaattcagaagaaaagactaaaaatggtgtagtaaaaggacagccttctccttcaggtgcagcagtgaacagcagtgagagtctccctccatcctcgtctgtcaatgacatctcctccatgtccaccgaccagaccctggcatctgacactgacagcagcctggaagcctcggcaggacccctgggttgttgcaggtgactagccgcctgcctgcgaaacccagcgttcttcaggagatgatgtgatggaacacacacacacgcagacacacacacacacacaaatgcagacacacaacatcaagaaaacagcaagggagagaatccaagcctaaaattaaataaatctttcagcctgcttcttccccagggttctgtattgcagctaagctcaaatgtatatttaacttctagttgctcttgctttggtcttcttccaatgatgcttactacagaaagcaaatcagacacaattagagaagccttttccataaagtgtaattttaatggctgcaaaaccggcaacctgtaactgcccttttaaatggcatgacaaggtgtgcagtggccccatccagcatgtgtgtgtctctatcttgcatctacctgctccttggcctagtcagatggatgtagatacagatccgcatgtgtctgtattcatacagcactacttacttagagatgctactgtcagtgtcctcagggctctaccaagacataatgcactggggtaccacatggtccatttcatgtgatctattactctgacataaacccatctgtaatatattgccagtatataagctgtttagtttgttaattgattaaactgtatgtcttataagaaaacatgtaaagggggaatatatggggggagtgagctctctcagacccttgaagatgtagcttccaaatttgaatggattaaatggcacctgtataccaa

SEQ ID NO: 154807 - DNA, 2154 bp, Homo sapiens
  Payload ID: 10441
  Gene Symbol: MAPK10
  Gene Name: mitogen-activated protein kinase 10
  Uniprot ID: P53779
  ENST ID: ENST00000395160
  CDS Start-End: 442-1275
aattatatgctatattcttggcaagatctttttcttctcctttgccctcttctactccttccccccttctcctgtttctccttcttcccttcctccaactcttcttcatcctcctagcatgtagaatattcttatgccagtcactcatatctttacttaaagcctgattggcatgtgaccagagtagacagtatctaagattccgaaatagcattttctttaccagtatccttaatcaagtaggcaagagttctaaggaatcttttgttcttaattctgagttgctcttggatctctacagtgccgcgtatgatgctgtccttgacagaaatgtggccattaagaagctcagcagaccctttcagaaccaaacacatgccaagagagcgtaccgggagctggtcctcatgaagtgtgtgaaccataaaaacttacttagtaatggaactgatggatgccaacttatgtcaagtgattcagatggaattagaccatgagcgaatgtcttacctgctgtaccaaatgttgtgtggcattaagcacctccattctgctggaattattcacagggatttaaaaccaagtaacattgtagtcaagtctgattgcacattgaaaatcctggactttggactggccaggacagcaggcacaagcttcatgatgactccatatgtggtgacacgttattacagagcccctgaggtcatcctggggatgggctacaaggagaacgtggatatatggtctgtgggatgcattatgggagaaatggttcgccacaaaatcctctttccaggaagggactatattgaccagtggaataaggtaattgaacaactaggaacaccatgtccagaattcatgaagaaattgcaacccacagtaagaaactatgtggagaatcggcccaagtatgcgggactcaccttccccaaactcttcccagattccctcttcccagcggactccgagcacaataaactcaaagccagccaagccagggacttgttgtcaaagatgctagtgattgacccagcaaaaagaatatcagtggacgacgccttacagcatccctacatcaacgtctggtatgacccagccgaagtggaggcgcctccacctcagatatatgacaagcagttggatgaaagagaacacacaattgaagaatggaaagaacttatctacaaggaagtaatgaattcagaagaaaagactaaaaatggtgtagtaaaaggacagccttctccttcagcacaggtgcagcagtgaacagcagtgagagtctccctccatcctcgtctgtcaatgacatctcctccatgtccaccgaccagaccctggcatctgacactgacagcagcctggaagcctcggcaggacccctgggttgttgcaggtgactagccgcctgcctgcgaaacccagcgttcttcaggagatgatgtgatggaacacacacacacgcagacacacacacacacacaaatgcagacacacaacatcaagaaaacagcaagggagagaatccaagcctaaaattaaataaatctttcagcctgcttcttccccagggttctgtattgcagctaagctcaaatgtatatttaacttctagttgctcttgctttggtcttcttccaatgatgcttactacagaaagcaaatcagacacaattagagaagccttttccataaagtgtaattttaatggctgcaaaaccggcaacctgtaactgcccttttaaatggcatgacaaggtgtgcagtggccccatccagcatgtgtgtgtctctatcttgcatctacctgctccttggcctagtcagatggatgtagatacagatccgcatgtgtctgtattcatacagcactacttacttagagatgctactgtcagtgtcctcagggctctaccaagacataatgcactggggtaccacatggtccatttcatgtgatctattactctgacataaacccatctgtaatatattgccagtatataagctgtttagtttgttaattgattaaactgtatgtcttataagaaaacatgtaaagggggaatatatggggggagtgagctctctcagacccttgaagatgtagcttccaaatttgaatggattaaatggcacctgtatacc

SEQ ID NO: 154808 - DNA, 4186 bp, Homo sapiens
  Payload ID: 10441
  Gene Symbol: MAPK10
  Gene Name: mitogen-activated protein kinase 10
  ENST ID: ENST00000395161
  CDS Start-End: 1122-2081
ttcaccggaaaacacagtagctgtagctgcacatagacgcttcctctttctgtttccccctcatccccctccctagacctctctgggctttgacgtcatgtgtgctcctttcggttgccatagcaaccccattccccaagccctctgtccgtctcctctggtaggttccacaatggtacaggcagcatcacgctgcacaatggtttccaggcagtgaaagagggtgattcagcaagccactcttcttctattttctttaacctccccttcactttttatttttatgggggtgggtggtgcttgctatatgcttacctttttcttttcttttttcatttttacaaatttccttttttgtcctcacccctcaattcctaggggcttgagtgagtttaagattgggttttcttggaaatcacctgtccatcgttaattttaaacaatctccatatctccaaagaatctcttccatgttagtctggaatgtggttaatgaaaaacaagtagggaggatttctggggcaaacactgccggatcaggatcgtagttctcaggcacggaatggctagtgtgagaaacaccaacagcaggcccatctcagatcttcactatggcaacttatgcaagaaactgttgaattagacccgtttcctatagatgagaaaccatacaagctgtggtatttatgagcctccatttcttatactactgcagtgaaccaacattggatgtgaaaattgccttttgtcagggattcgataaacaagtggatgtgtcatatattgccaaacattacaacatgagcaaaagcaaagttgacaaccagttctacagtgtggaagtgggagactcaaccttcacagttctcaagcgctaccagaatctaaagcctattggctctggggctcagggcatagtttgtgccgcgtatgatgctgtccttgacagaaatgtggccattaagaagctcagcagaccctttcagaaccaaacacatgccaagagagcgtaccgggagctggtcctcatgaagtgtgtgaaccataaaaacattattagtttattaaatgtcttcacaccccagaaaacgctggaggagttccaagatgtttacttagtaatggaactgatggatgccaacttatgtcaagtgattcagatggaattagaccatgagcgaatgtcttacctgctgtaccaaatgttgtgtggcattaagcacctccattctgctggaattattcacagggatttaaaaccaagtaacattgtagtcaagtctgattgcacattgaaaatcctggactttggactggccaggacagcaggcacaagcttcatgatgactccatatgtggtgacacgttattacagagcccctgaggtcatcctggggatgggctacaaggagaacgttgacatgtggtcagtagggtgcatcatgggagaaatgataaaaggtgcagtgctgtttcctggcactgatcatattgaccagtggaataaggtaattgaacaactaggaacaccatgtccagaattcatgaagaaattgcaacccacagtaagaaactatgtggagaatcggcccaagtatgcgggactcaccttccccaaactcttcccagattccctcttcccagcggactccgagcacaataaactcaaagccagccaagccagggacttgttgtcaaagatgctagtgattgacccagcaaaaagaatatcagtggacgacgccttacagcatccctacatcaacgtctggtatgacccagccgaagtggaggcgcctccacctcagatatatgacaagcagttggatgaaagagaacacacaattgaagaatggaaagaacttatctacaaggaagtaatgaattcagaagaaaagactaaaaatggtgtagtaaaaggacagccttctccttcaggtgcagcagtgaacagcagtgagagtctccctccatcctcgtctgtcaatgacatctcctccatgtccaccgaccagaccctggcatctgacactgacagcagcctggaagcctcggcaggacccctgggttgttgcaggtgactagccgcctgcctgcgaaacccagcgttcttcaggagatgatgtgatggaacacacacacacgcagacacacacacacacacaaatgcagacacacaacatcaagaaaacagcaagggagagaatccaagcctaaaattaaataaatctttcagcctgcttcttccccagggttctgtattgcagctaagctcaaatgtatatttaacttctagttgctcttgctttggtcttcttccaatgatgcttactacagaaagcaaatcagacacaattagagaagccttttccataaagtgtaattttaatggctgcaaaaccggcaacctgtaactgcccttttaaatggcatgacaaggtgtgcagtggccccatccagcatgtgtgtgtctctatcttgcatctacctgctccttggcctagtcagatggatgtagatacagatccgcatgtgtctgtattcatacagcactacttacttagagatgctactgtcagtgtcctcagggctctaccaagacataatgcactggggtaccacatggtccatttcatgtgatctattactctgacataaacccatctgtaatatattgccagtatataagctgtttagtttgttaattgattaaactgtatgtcttataagaaaacatgtaaagggggaatatatggggggagtgagctctctcagacccttgaagatgtagcttccaaatttgaatggattaaatggcacctgtataccaatttgtagaaagaacatatgtgatacttatgtaaagtgtggggcgagtgggtaacagttttcaggcacaaaatggtttggccttctgaaggcaggtgtgaataaaagctgagagtcttttctgtgacagtaaagagtaggagagactggagggtagtgtgtggtgtggactaagactgaaaggaggttattacccagatactaggagacactggtgtccctgttttagagatttggctctatacccatttgtcatttctcaattactggtcacaacaagaggccactggagaaagtggcaggtggtgaagcaaggttattgtgtgtgcttttgatgataagaatctctctctggaactgagcagaattgcctccatgtgaattccttcaacaaaaaaatgagcctgcctagactactttcagattgtggattgtgttttccatgtgtgggctgcttccctgattcatactctgccaaagttttattttgagaaataatattactttcctcttctgaaataaaataataataataataatgaaacccccaaaccacagtgtgagtctcaggttagcatttgaaaacatctccagagacattgttattcctcaggagtttccctgactccttaatgtggctgatgtttcatgtttatttatttattttaataagtatgagcaatcgaagggctgatcatctgagttttgtactgcagtagatgtaagagcaataactctgcccataaatttactgctgccaaatagttttagcaatatgagtttgtcttaaaagccatgaagcattaatgtcaatgtttagcaaaatctccagaatttagcttaaattaaattaaatgaaagtgctttcctgagcacttaaggaggcactgtgaaacatcttggttatgtacaaggcaataccaaggtgatctcagcaataatcaggcttcccttcttattcacttcgaagtatccatcacagttatttgcactctgaccatgttggtgctcactagagtggtgatatttcacctgaagaagtgaaagacaggaagtggatggttgatgagtgtgaactgattggcaaatagaatatccccaaaacagagcaaacaagaatgccagtgctctgaaaactgccttaaatataataatagggaactttctttctctcttcaagcaatagagaccacagggaactgcacccacctgcaccatcgccatgccagtggtgctgccattctgagattatttcacacagtcagattcagtacacgcagtcatttgtttaaaataaatagaagaacattcctttgtgcagcttgtcccctggaataaaaatggcccattttctcta

SEQ ID NO: 154809 - DNA, 3081 bp, Homo sapiens
  Payload ID: 10441
  Gene Symbol: MAPK10
  Gene Name: mitogen-activated protein kinase 10
  Uniprot ID: P53779
  ENST ID: ENST00000395166
  CDS Start-End: 1053-2333
attctgtgctgggatactgtgtcccctgcaaatgtcagagctcttttgaaaaaaaaatcagaaataagtatggcagtatatttgttagaatctatgtatttgtgccttcaacaaaataaatgtaatttactggaaaatctgtaagtaaatcaggctatagatattacaagaaaactatctatccatatatttttctcaccctccccaaacatttaaatctagagacctagtctctgcttttacccccttaaacagataacttcccagggtactgcaatttagccacagaaaaagaatggcttatgccacagcagtaggctctgaagcaatcacaaggttgtttacatgggctgcctttggtgcagagcctgacagtgtctgtacagcagccctgcctgcttctggccatgttgatgataacttttatgaacaaactgcaaggaagcaggctaagtcatatgggatagactacagttcaggtggaaggaaaacgagtgtaagtgcaccaggcattgccagcacaacatccaatatctccttctatccctcatcggctagttgtcggaccctggaagataacacagaatgcttatcaacatatttaaaatagttgcagtaaggaccatttctctcagagaagcttctgtgaattttctactttaggtgagcatatatgttacaaatatataacaaataaatatataagtatatcacaagcttctgactccacttcagaaccattagattttaggggctggatgctttggatgtagcggtttggctgcctctggctagtgtgagaaacaccaacagcaggcccatctcagatcttcactatggcaacttatgcaagaaactgttgaattagacccgtttcctatagatgagaaaccatacaagctgtggtatttatgagcctccatttcttatactactgcagtgaaccaacattggatgtgaaaattgccttttgtcaggtgtgtgttccttacaggtaaaacaagggattcgataaacaagtggatgtgtcatatattgccaaacattacaacatgagcaaaagcaaagttgacaaccagttctacagtgtggaagtgggagactcaaccttcacagttctcaagcgctaccagaatctaaagcctattggctctggggctcagggcatagtttgtgccgcgtatgatgctgtccttgacagaaatgtggccattaagaagctcagcagaccctttcagaaccaaacacatgccaagagagcgtaccgggagctggtcctcatgaagtgtgtgaaccataaaaacattattagtttattaaatgtcttcacaccccagaaaacgctggaggagttccaagatgtttacttagtaatggaactgatggatgccaacttatgtcaagtgattcagatggaattagaccatgagcgaatgtcttacctgctgtaccaaatgttgtgtggcattaagcacctccattctgctggaattattcacagggatttaaaaccaagtaacattgtagtcaagtctgattgcacattgaaaatcctggactttggactggccaggacagcaggcacaagcttcatgatgactccatatgtggtgacacgttattacagagcccctgaggtcatcctggggatgggctacaaggagaacgtggatatatggtctgtgggatgcattatgggagaaatggttcgccacaaaatcctctttccaggaagggactatattgaccagtggaataaggtaattgaacaactaggaacaccatgtccagaattcatgaagaaattgcaacccacagtaagaaactatgtggagaatcggcccaagtatgcgggactcaccttccccaaactcttcccagattccctcttcccagcggactccgagcacaataaactcaaagccagccaagccagggacttgttgtcaaagatgctagtgattgacccagcaaaaagaatatcagtggacgacgccttacagcatccctacatcaacgtctggtatgacccagccgaagtggaggcgcctccacctcagatatatgacaagcagttggatgaaagagaacacacaattgaagaatggaaagaacttatctacaaggaagtaatgaattcagaagaaaagactaaaaatggtgtagtaaaaggacagccttctccttcaggtgcagcagtgaacagcagtgagagtctccctccatcctcgtctgtcaatgacatctcctccatgtccaccgaccagaccctggcatctgacactgacagcagcctggaagcctcggcaggacccctgggttgttgcaggtgactagccgcctgcctgcgaaacccagcgttcttcaggagatgatgtgatggaacacacacacacgcagacacacacacacacacaaatgcagacacacaacatcaagaaaacagcaagggagagaatccaagcctaaaattaaataaatctttcagcctgcttcttccccagggttctgtattgcagctaagctcaaatgtatatttaacttctagttgctcttgctttggtcttcttccaatgatgcttactacagaaagcaaatcagacacaattagagaagccttttccataaagtgtaattttaatggctgcaaaaccggcaacctgtaactgcccttttaaatggcatgacaaggtgtgcagtggccccatccagcatgtgtgtgtctctatcttgcatctacctgctccttggcctagtcagatggatgtagatacagatccgcatgtgtctgtattcatacagcactacttacttagagatgctactgtcagtgtcctcagggctctaccaagacataatgcactggggtaccacatggtccatttcatgtgatctattactctgacataaacccatctgtaatatattgccagtatataagctgtttagtttgttaattgattaaactgtatgtcttataagaaaacatgtaaagggggaatatatggggggagtgagctctctcagacccttgaagatgtagcttccaaatttgaatggattaaatggcacctgtatacc

SEQ ID NO: 154810 - DNA, 4107 bp, Homo sapiens
  Payload ID: 10441
  Gene Symbol: MAPK10
  Gene Name: mitogen-activated protein kinase 10
  Uniprot ID: P53779
  ENST ID: ENST00000395169
  CDS Start-End: 722-2002
cctttcggttgccatagcaaccccattccccaagccctctgtccgtctcctctggtaggttccacaatggtacaggcagcatcacgctgcacaatggtttccaggcagtgaaagagggtgattcagcaagccactcttcttctattttctttaacctccccttcactttttatttttatgggggtgggtggtgcttgctatatgcttacctttttcttttcttttttcatttttacaaatttccttttttgtcctcacccctcaattcctaggggcttgagtgagtttaagattgggttttcttggaaatcacctgtccatcgttaattttaaacaatctccatatctccaaagaatctcttccatgttagtctggaatgtggttaatgaaaaacaagtagggaggatttctggggcaaacactgccggatcaggatcgtagttctcaggcacggaatggctagtgtgagaaacaccaacagcaggcccatctcagatcttcactatggcaacttatgcaagaaactgttgaattagacccgtttcctatagatgagaaaccatacaagctgtggtatttatgagcctccatttcttatactactgcagtgaaccaacattggatgtgaaaattgccttttgtcaggtgtgtgttccttacaggtaaaacaagggattcgataaacaagtggatgtgtcatatattgccaaacattacaacatgagcaaaagcaaagttgacaaccagttctacagtgtggaagtgggagactcaaccttcacagttctcaagcgctaccagaatctaaagcctattggctctggggctcagggcatagtttgtgccgcgtatgatgctgtccttgacagaaatgtggccattaagaagctcagcagaccctttcagaaccaaacacatgccaagagagcgtaccgggagctggtcctcatgaagtgtgtgaaccataaaaacattattagtttattaaatgtcttcacaccccagaaaacgctggaggagttccaagatgtttacttagtaatggaactgatggatgccaacttatgtcaagtgattcagatggaattagaccatgagcgaatgtcttacctgctgtaccaaatgttgtgtggcattaagcacctccattctgctggaattattcacagggatttaaaaccaagtaacattgtagtcaagtctgattgcacattgaaaatcctggactttggactggccaggacagcaggcacaagcttcatgatgactccatatgtggtgacacgttattacagagcccctgaggtcatcctggggatgggctacaaggagaacgtggatatatggtctgtgggatgcattatgggagaaatggttcgccacaaaatcctctttccaggaagggactatattgaccagtggaataaggtaattgaacaactaggaacaccatgtccagaattcatgaagaaattgcaacccacagtaagaaactatgtggagaatcggcccaagtatgcgggactcaccttccccaaactcttcccagattccctcttcccagcggactccgagcacaataaactcaaagccagccaagccagggacttgttgtcaaagatgctagtgattgacccagcaaaaagaatatcagtggacgacgccttacagcatccctacatcaacgtctggtatgacccagccgaagtggaggcgcctccacctcagatatatgacaagcagttggatgaaagagaacacacaattgaagaatggaaagaacttatctacaaggaagtaatgaattcagaagaaaagactaaaaatggtgtagtaaaaggacagccttctccttcaggtgcagcagtgaacagcagtgagagtctccctccatcctcgtctgtcaatgacatctcctccatgtccaccgaccagaccctggcatctgacactgacagcagcctggaagcctcggcaggacccctgggttgttgcaggtgactagccgcctgcctgcgaaacccagcgttcttcaggagatgatgtgatggaacacacacacacgcagacacacacacacacacaaatgcagacacacaacatcaagaaaacagcaagggagagaatccaagcctaaaattaaataaatctttcagcctgcttcttccccagggttctgtattgcagctaagctcaaatgtatatttaacttctagttgctcttgctttggtcttcttccaatgatgcttactacagaaagcaaatcagacacaattagagaagccttttccataaagtgtaattttaatggctgcaaaaccggcaacctgtaactgcccttttaaatggcatgacaaggtgtgcagtggccccatccagcatgtgtgtgtctctatcttgcatctacctgctccttggcctagtcagatggatgtagatacagatccgcatgtgtctgtattcatacagcactacttacttagagatgctactgtcagtgtcctcagggctctaccaagacataatgcactggggtaccacatggtccatttcatgtgatctattactctgacataaacccatctgtaatatattgccagtatataagctgtttagtttgttaattgattaaactgtatgtcttataagaaaacatgtaaagggggaatatatggggggagtgagctctctcagacccttgaagatgtagcttccaaatttgaatggattaaatggcacctgtataccaatttgtagaaagaacatatgtgatacttatgtaaagtgtggggcgagtgggtaacagttttcaggcacaaaatggtttggccttctgaaggcaggtgtgaataaaagctgagagtcttttctgtgacagtaaagagtaggagagactggagggtagtgtgtggtgtggactaagactgaaaggaggttattacccagatactaggagacactggtgtccctgttttagagatttggctctatacccatttgtcatttctcaattactggtcacaacaagaggccactggagaaagtggcaggtggtgaagcaaggttattgtgtgtgcttttgatgataagaatctctctctggaactgagcagaattgcctccatgtgaattccttcaacaaaaaaatgagcctgcctagactactttcagattgtggattgtgttttccatgtgtgggctgcttccctgattcatactctgccaaagttttattttgagaaataatattactttcctcttctgaaataaaataataataataataatgaaacccccaaaccacagtgtgagtctcaggttagcatttgaaaacatctccagagacattgttattcctcaggagtttccctgactccttaatgtggctgatgtttcatgtttatttatttattttaataagtatgagcaatcgaagggctgatcatctgagttttgtactgcagtagatgtaagagcaataactctgcccataaatttactgctgccaaatagttttagcaatatgagtttgtcttaaaagccatgaagcattaatgtcaatgtttagcaaaatctccagaatttagcttaaattaaattaaatgaaagtgctttcctgagcacttaaggaggcactgtgaaacatcttggttatgtacaaggcaataccaaggtgatctcagcaataatcaggcttcccttcttattcacttcgaagtatccatcacagttatttgcactctgaccatgttggtgctcactagagtggtgatatttcacctgaagaagtgaaagacaggaagtggatggttgatgagtgtgaactgattggcaaatagaatatccccaaaacagagcaaacaagaatgccagtgctctgaaaactgccttaaatataataatagggaactttctttctctcttcaagcaatagagaccacagggaactgcacccacctgcaccatcgccatgccagtggtgctgccattctgagattatttcacacagtcagattcagtacacgcagtcatttgtttaaaataaatagaagaacattcctttgtgcagcttgtcccctggaataaaaatggcccattttctcta

SEQ ID NO: 154811 - DNA, 2382 bp, Homo sapiens
  Payload ID: 10441
  Gene Symbol: MAPK10
  Gene Name: mitogen-activated protein kinase 10
  ENST ID: ENST00000449047
  CDS Start-End: 675-1634
ctctcttttccattttgttacagaaccataattatcatgtgatctagacctgatacattgtagatgaagaaacatgtcgacagagccactatctgcccaacatctgatgggtagtcatagtcacagtggaactgagactaaggtttccatttttatttgactatgcttcttcccaaggctagtgtgagaaacaccaacagcaggcccatctcagatcttcactatggcaacttatgcaagaaactgttgaattagacccgtttcctatagatgagaaaccatacaagctgtggtatttatgagcctccatttcttatactactgcagtgaaccaacattggatgtgaaaattgccttttgtcagggattcgataaacaagtggatgtgtcatatattgccaaacattacaacatgagcaaaagcaaagttgacaaccagttctacagtgtggaagtgggagactcaaccttcacagttctcaagcgctaccagaatctaaagcctattggctctggggctcagggcatagtttgtgccgcgtatgatgctgtccttgacagaaatgtggccattaagaagctcagcagaccctttcagaaccaaacacatgccaagagagcgtaccgggagctggtcctcatgaagtgtgtgaaccataaaaacttacttagtaatggaactgatggatgccaacttatgtcaagtgattcagatggaattagaccatgagcgaatgtcttacctgctgtaccaaatgttgtgtggcattaagcacctccattctgctggaattattcacagggatttaaaaccaagtaacattgtagtcaagtctgattgcacattgaaaatcctggactttggactggccaggacagcaggcacaagcttcatgatgactccatatgtggtgacacgttattacagagcccctgaggtcatcctggggatgggctacaaggagaacgttgacatgtggtcagtagggtgcatcatgggagaaatgataaaaggtgcagtgctgtttcctggcactgatcatattgaccagtggaataaggtaattgaacaactaggaacaccatgtccagaattcatgaagaaattgcaacccacagtaagaaactatgtggagaatcggcccaagtatgcgggactcaccttccccaaactcttcccagattccctcttcccagcggactccgagcacaataaactcaaagccagccaagccagggacttgttgtcaaagatgctagtgattgacccagcaaaaagaatatcagtggacgacgccttacagcatccctacatcaacgtctggtatgacccagccgaagtggaggcgcctccacctcagatatatgacaagcagttggatgaaagagaacacacaattgaagaatggaaagaacttatctacaaggaagtaatgaattcagaagaaaagactaaaaatggtgtagtaaaaggacagccttctccttcaggtgcagcagtgaacagcagtgagagtctccctccatcctcgtctgtcaatgacatctcctccatgtccaccgaccagaccctggcatctgacactgacagcagcctggaagcctcggcaggacccctgggttgttgcaggtgactagccgcctgcctgcgaaacccagcgttcttcaggagatgatgtgatggaacacacacacacgcagacacacacacacacacaaatgcagacacacaacatcaagaaaacagcaagggagagaatccaagcctaaaattaaataaatctttcagcctgcttcttccccagggttctgtattgcagctaagctcaaatgtatatttaacttctagttgctcttgctttggtcttcttccaatgatgcttactacagaaagcaaatcagacacaattagagaagccttttccataaagtgtaattttaatggctgcaaaaccggcaacctgtaactgcccttttaaatggcatgacaaggtgtgcagtggccccatccagcatgtgtgtgtctctatcttgcatctacctgctccttggcctagtcagatggatgtagatacagatccgcatgtgtctgtattcatacagcactacttacttagagatgctactgtcagtgtcctcagggctctaccaagacataatgcactggggtaccacatggtccatttcatgtgatctattactctgacataaacccatctgtaatatattgccagtatataagctgtttagtttgttaattgattaaactgtatgtcttataagaaaacatgtaaagggggaatatatggggggagtgagctctctcagacccttgaagatgtagcttccaaatttgaatggattaaatggcacctgtatacc

SEQ ID NO: 154812 - DNA, 489 bp, Homo sapiens
  Payload ID: 10441
  Gene Symbol: MAPK10
  Gene Name: mitogen-activated protein kinase 10
  ENST ID: ENST00000513186
  CDS Start-End: 344-489
gccccggttgccatgacaaccagtgccttgggcctggcttttcgcgttcttcggactagccagaggctcaggttggtgaccgagcggcagagttcctagcgcctgcagtgtggtgaactccaacttttaggccaagttgaaaatgcagccgacgacccccacacttctaacttcagaatcaaaactatgaccctagggagtgaggaggagagtgaaaaatgcgctagtgtgagaaacaccaacagcaggcccatctcagatcttcactatggcaacttatgcaagaaactgttgaattagacccgtttcctatagatgagaaaccatacaagctgtggtatttatgagcctccatttcttatactactgcagtgaaccaacattggatgtgaaaattgccttttgtcagggattcgataaacaagtggatgtgtcatatattgccaaacattacaacatgagcaaaagcaaagttgacaaccagttcta

SEQ ID NO: 154813 - DNA, 562 bp, Homo sapiens
  Payload ID: 10441
  Gene Symbol: MAPK10
  Gene Name: mitogen-activated protein kinase 10
  ENST ID: ENST00000506773
  CDS Start-End: 289-562
gtaagtgcaccaggcattgccagcacaacatccaatatctccttctatccctcatcggctagttgtcggaccctggaagataacacagaatgcttatcaacatatttaaaatagttgcagtaaggaccatttctctcagagaagcttctgtgaattttctactttaggctagtgtgagaaacaccaacagcaggcccatctcagatcttcactatggcaacttatgcaagaaactgttgaattagacccgtttcctatagatgagaaaccatacaagctgtggtatttatgagcctccatttcttatactactgcagtgaaccaacattggatgtgaaaattgccttttgtcagggattcgataaacaagtggatgtgtcatatattgccaaacattacaacatgagcaaaagcaaagttgacaaccagttctacagtgtggaagtgggagactcaaccttcacagttctcaagcgctaccagaatctaaagcctattggctctggggctcagggcatagtttgtgccgcgtatgatgctgtccttgacagaaatgtggcca

SEQ ID NO: 154814 - DNA, 581 bp, Homo sapiens
  Payload ID: 10441
  Gene Symbol: MAPK10
  Gene Name: mitogen-activated protein kinase 10
  ENST ID: ENST00000503911
  CDS Start-End: 430-581
agctttcccagtgcctccagcagccctcctcaaggacccctgtgaggccaggcagaaatggcgtggcaggggacccagcgagcccagagggattttgccgctgcttcctctacccctgtatttcacgcagctctctaaattgactcagctccagagacaggatctagttctgtcacccaggctggatggagtgcagtggcattatcatagctcattgcagccagaaactcctgtgcttgagtgatcctcctgcctcagccttcccaatggctgggactacaggttcaaaccactaggacagcatttgccacattattgttccactaatgaaccacctcagtggctatggagatgaaattagaggcgcagggttggtgtgtggagatgggtattgacagtcaattctcccagataatataacaggtatttatgagcctccatttcttatactactgcagtgaaccaacattggatgtgaaaattgccttttgtcagggattcgataaacaagtggatgtgtcatatattgccaaacattacaacatgagcaaaagcaaagttgacaaccagttctacagtgt

SEQ ID NO: 154815 - DNA, 569 bp, Homo sapiens
  Payload ID: 10441
  Gene Symbol: MAPK10
  Gene Name: mitogen-activated protein kinase 10
  ENST ID: ENST00000511328
  CDS Start-End: 218-569
tttcccagtgcctccagcagccctcctcaaggacccctgtgaggccaggcagaaatggcgtggcaggggacccagcgagcccagagggattttgccgctgcttcctctacccctgtatttcacgcagctctctaaattgactcagctccaggttcaaaccactaggacagcatttgccacattattgttccactaatgaaccacctcagtggtatttatgagcctccatttcttatactactgcagtgaaccaacattggatgtgaaaattgccttttgtcagggattcgataaacaagtggatgtgtcatatattgccaaacattacaacatgagcaaaagcaaagttgacaaccagttctacagtgtggaagtgggagactcaaccttcacagttctcaagcgctaccagaatctaaagcctattggctctggggctcagggcatagtttgtgccgcgtatgatgctgtccttgacagaaatgtggccattaagaagctcagcagaccctttcagaaccaaacacatgccaagagagcgtaccgggagctggtcctcatgaagtgtg

SEQ ID NO: 154816 - DNA, 743 bp, Homo sapiens
  Payload ID: 10441
  Gene Symbol: MAPK10
  Gene Name: mitogen-activated protein kinase 10
  ENST ID: ENST00000511167
  CDS Start-End: 380-743
ttcctctgctgttgcaaagtgtctttaatttgaggggctcctgttcttaaaaaatcctcacagtttcagtaaaacgattctggatagtgaggcagtaagaaattatatgtagagtgggaaaatcagctgcctccagcttcctgcctgctagccccagaacagcatctgctgttgagaggagtgtgtttgccatgctggaaggggatgtttatgaacagatcccagaggggctgagtgtgtttttgctgtcattgtctggctagtgtgagaaacaccaacagcaggcccatctcagatcttcactatggcaacttatgcaagaaactgttgaattagacccgtttcctatagatgagaaaccatacaagctgtggtatttatgagcctccatttcttatactactgcagtgaaccaacattggatgtgaaaattgccttttgtcagggattcgataaacaagtggatgtgtcatatattgccaaacattacaacatgagcaaaagcaaagttgacaaccagttctacagtgtggaagtgggagactcaaccttcacagttctcaagcgctaccagaatctaaagcctattggctctggggctcagggcatagtttgtgccgcgtatgatgctgtccttgacagaaatgtggccattaagaagctcagcagaccctttcagaaccaaacacatgccaagagagcgtaccgggagctggtcctcatgaagtgtgtgaaccataaaa

SEQ ID NO: 154817 - DNA, 564 bp, Homo sapiens
  Payload ID: 10441
  Gene Symbol: MAPK10
  Gene Name: mitogen-activated protein kinase 10
  ENST ID: ENST00000512564
  CDS Start-End: 313-564
ttagattttaggggctggatgctttggatgtagcggtttggctgcctctggctagtgtgagaaacaccaacagcaggcccatctcagatcttcactatggcaacttatgcaagaaactgttgaattagacccgtttcctatagatgagaaaccatacaagctgtggtatttatgagcctccatttcttatactactgcagtgaaccaacattggatgtgaaaattgccttttgtcaggtgtgtgttccttacaggtaaaacaagggattcgataaacaagtggatgtgtcatatattgccaaacattacaacatgagcaaaagcaaagttgacaaccagttctacagtgtggaagtgggagactcaaccttcacagttctcaagcgctaccagaatctaaagcctattggctctggggctcagggcatagtttgtgccgcgtatgatgctgtccttgacagaaatgtggccattaagaagctcagcagaccctttcagaaccaaacacatgccaagagagcgtaccgggagctggtcctcatgaagtgtgtgaaccataaaaac

SEQ ID NO: 154818 - DNA, 563 bp, Homo sapiens
  Payload ID: 10441
  Gene Symbol: MAPK10
  Gene Name: mitogen-activated protein kinase 10
  ENST ID: ENST00000502302
  CDS Start-End: 464-563
agtgccttgggcctggcttttcgcgttcttcggactagccagaggctcaggttggtgaccgagcggcagagttcctagcgcctgcagtgtggtgaactccaacttttaggccaagttgaaaatgcagccgacgacccccacacttctaacttcagaatcaaaactatgaccctagggagtgaggaggagagtgaaaaatgcgctagtgtgagaaacaccaacagcaggcccatctcagatcttcactatggcaacttatgcaagaaactgttgaattagacccgtttcctatagatgagaaaccatacaagctgtggtatttatgagcctccatttcttatactactgcagtgaaccaacattggatgtgaaaattgccttttgtcaggtgtgtgttccttacaggtaaaacaagggattcgataaacaagtggatgtgtcatatattgccaaacattacaacatgagcaaaagcaaagttgacaaccagttctacagtgtggaagtgggagactcaaccttcacagttctcaagcgctaccagaatctaaagcctattggct

SEQ ID NO: 154819 - DNA, 550 bp, Homo sapiens
  Payload ID: 10441
  Gene Symbol: MAPK10
  Gene Name: mitogen-activated protein kinase 10
  ENST ID: ENST00000509464
  CDS Start-End: 330-550
atgctggaaggggatgtttatgaacagatcccagaggggctgagtgtgtttttgctgtcattgtctggctagtgtgagaaacaccaacagcaggcccatctcagatcttcactatggcaacttatgcaagaaactgttgaattagacccgtttcctatagatgagaaaccatacaagctgtggtatttatgagcctccatttcttatactactgcagtgaaccaacattggatgtgaaaattgccttttgtcaggtgtgtgttccttacaggtaaaacaagggattcgataaacaagtggatgtgtcatatattgccaaacattacaacatgagcaaaagcaaagttgacaaccagttctacagtgtggaagtgggagactcaaccttcacagttctcaagcgctaccagaatctaaagcctattggctctggggctcagggcatagtttgtgccgcgtatgatgctgtccttgacagaaatgtggccattaagaagctcagcagaccctttcagaaccaaacacatgccaagagagcgtaccgggagct

SEQ ID NO: 154820 - DNA, 1331 bp, Homo sapiens
  Payload ID: 10441
  Gene Symbol: MAPK10
  Gene Name: mitogen-activated protein kinase 10
  ENST ID: ENST00000515400
  CDS Start-End: 1-1006
aaatgtggccattaagaagctcagcagaccctttcagaaccaaacacatgccaagagagcgtaccgggagctggtcctcatgaagtgtgtgaaccataaaaacattattagtttattaaatgtcttcacaccccagaaaacgctggaggagttccaagatgtttacttagtaatggaactgatggatgccaacttatgtcaagtgattcagatggaattagaccatgagcgaatgtcttacctgctgtaccaaatgttgtgtggcattaagcacctccattctgctggaattattcacagggatttaaaaccaagtaacattgtagtcaagtctgattgcacattgaaaatcctggactttggactggccaggacagcaggcacaagcttcatgatgactccatatgtggtgacacgttattacagagcccctgaggtcatcctggggatgggctacaaggagaacgttgacatgtggtcagtagggtgcatcatgggagaaatgataaaaggtgcagtgctgtttcctggcactgatcatattgaccagtggaataaggtaattgaacaactaggaacaccatgtccagaattcatgaagaaattgcaacccacagtaagaaactatgtggagaatcggcccaagtatgcgggactcaccttccccaaactcttcccagattccctcttcccagcggactccgagcacaataaactcaaagccagccaagccagggacttgttgtcaaagatgctagtgattgacccagcaaaaagaatatcagtggacgacgccttacagcatccctacatcaacgtctggtatgacccagccgaagtggaggcgcctccacctcagatatatgacaagcagttggatgaaagagaacacacaattgaagaatggaaagaacttatctacaaggaagtaatgaattcagaagaaaagactaaaaatggtgtagtaaaaggacagccttctccttcagcacaggtgcagcagtgaacagcagtgagagtctccctccatcctcgtctgtcaatgacatctcctccatgtccaccgaccagaccctggcatctgacactgacagcagcctggaagcctcggcaggacccctgggttgttgcaggtgactagccgcctgcctgcgaaacccagcgttcttcaggagatgatgtgatggaacacacacacacgcagacacacacacacacacaaatgcagacacacaacatcaagaaaacagcaagggagagaatccaagcctaaaattaaataaatctttcagcctgcttcttccccagggttctgtattgcagctaagctc

SEQ ID NO: 154821 - DNA, 595 bp, Homo sapiens
  Payload ID: 10441
  Gene Symbol: MAPK10
  Gene Name: mitogen-activated protein kinase 10
  ENST ID: ENST00000512017
  CDS Start-End: 173-595
attagattttaggggctggatgctttggatgtagcggtttggctgcctctggctagtgtgagaaacaccaacagcaggcccatctcagatcttcactatggcaacttatgcaagaaactgttgaattagacccgtttcctatagatgagaaaccatacaagctgtggtatttatgagcctccatttcttatactactgcagtgaaccaacattggatgtgaaaattgccttttgtcagggattcgataaacaagtggatgtgtcatatattgccaaacattacaacatgagcaaaagcaaagttgacaaccagttctacagtgtggaagtgggagactcaaccttcacagttctcaagcgctaccagaatctaaagcctattggctctggggctcagggcatagtttgtgccgcgtatgatgctgtccttgacagaaatgtggccattaagaagctcagcagaccctttcagaaccaaacacatgccaagagagcgtaccgggagctggtcctcatgaagtgtgtgaaccataaaaacattattagtttattaaatgtcttcacaccccagaaaacgctggaggagttccaagat

SEQ ID NO: 154822 - DNA, 722 bp, Homo sapiens
  Payload ID: 10441
  Gene Symbol: MAPK10
  Gene Name: mitogen-activated protein kinase 10
  ENST ID: ENST00000512689
  CDS Start-End: 568-722
ggtgcagagcctgacagtgtctgtacagcagccctgcctgcttctggccatgttgatgataacttttatgaacaaactgcaaggaagcaggctaagtcatatgggatagactacagttcaggtggaaggaaaacgagtgtaagtgcaccaggcattgccagcacaacatccaatatctccttctatccctcatcggctagttgtcggaccctggaagataacacagaatgcttatcaacatatttaaaatagttgcagtaaggaccatttctctcagagaagcttctgtgaattttctactttaggctagtgtgagaaacaccaacagcaggcccatctcagatcttcactatggcaacttatgcaagaaactgttgaattagacccgtttcctatagatgagaaaccatacaagctgtggtatttatgagcctccatttcttatactactgcagtgaaccaacattggatgtgaaaattgccttttgtcaggtgtgtgttccttacaggtaaaacaagggattcgataaacaagtggatgtgtcatatattgccaaacattacaacatgagcaaaagcaaagttgacaaccagttctacagtgtggaagtgggagactcaaccttcacagttctcaagcgctaccagaatctaaagcctattggctctggggctcagggcatagtttgtgccgcgtatgatgctgtccttgacagaaatgt

SEQ ID NO: 154823 - DNA, 2431 bp, Homo sapiens
  Payload ID: 10442
  Gene Symbol: MAPK11
  Gene Name: mitogen-activated protein kinase 11
  Uniprot ID: Q15759
  ENST ID: ENST00000330651
  CDS Start-End: 102-1196
cgccgcctccgccgccctccgctccgctcggctcgggctcggctcgggcgcgggcgcggggcgcggggctgggcccgggcggagcggcggctgctccggacatgtcgggccctcgcgccggcttctaccggcaggagctgaacaagaccgtgtgggaggtgccgcagcggctgcaggggctgcgcccggtgggctccggcgcctacggctccgtctgttcggcctacgacgcccggctgcgccagaaggtggcggtgaagaagctgtcgcgccccttccagtcgctgatccacgcgcgcagaacgtaccgggagctgcggctgctcaagcacctgaagcacgagaacgtcatcgggcttctggacgtcttcacgccggccacgtccatcgaggacttcagcgaagtgtacttggtgaccaccctgatgggcgccgacctgaacaacatcgtcaagtgccaggcgctgagcgacgagcacgttcaattcctggtttaccagctgctgcgcgggctgaagtacatccactcggccgggatcatccaccgggacctgaagcccagcaacgtggctgtgaacgaggactgtgagctcaggatcctggattttgggctggcgcgccaggcggacgaggagatgaccggctatgtggccacgcgctggtaccgggcacctgagatcatgctcaactggatgcattacaaccaaacagtggatatctggtccgtgggctgcatcatggctgagctgctccagggcaaggccctcttcccgggaagcgactacattgaccagctgaagcgcatcatggaagtggtgggcacacccagccctgaggttctggcaaaaatctcctcagaacacgcccggacatatatccagtccctgccccccatgccccagaaggacctgagcagcatcttccgtggagccaaccccctggccatagacctccttggaaggatgctggtgctggacagtgaccagagggtcagtgcagctgaggcactggcccacgcctacttcagccagtaccacgaccccgaggatgagccagaggccgagccatatgatgagagcgttgaggccaaggagcgcacgctggaggagtggaaggagctcacttaccaggaagtcctcagcttcaagcccccagagccaccgaagccacctggcagcctggagattgagcagtgaggtgctgcccagcagcccctgagagcctgtggaggggcttgggcctgcacccttccacagctggcctggtttcctcgagaggcacctcccacactcctatggtcacagacttctggcctaggacccctcgccttcaggagaatctacacgcatgtatgcatgcacaaacatgtgtgtacatgtgcttgccatgtgtaggagtctgggcacaagtgtccctgggcctaccttggtcctcctgtcctcttctggctactgcactctccactgggacctgactgtggggtcctagatgccaaaggggttcccctgcggagttcccctgtctgtcccaggccgacccaagggagtgtcagccttgggctctcttctgtcccagggctttctggaggacgcgctggggccgggaccccgggagactcaaagggagaggtctcagtggttagagctgctcagcctggaggtagggggctgtcttggtcactgctgagacccacaggtctaagaggagaggcagagccagtgtgccaccaggctgggcagggacaaccaccaggtgtcaaatgagaaaagctgcctggagtcttgtgttcacccgtgggtgtgtgtgggcacgtgtggatgagcgtgcactccccgtgttcatatgtcagggcacatgtgatgtggtgcgtgtgaatctgtgggcgcccaaggccagcagccatatctggcaagaagctggagccggggtgggtgtgctgttgccttccctctcctcggttcctgatgccttgaggggtgtttcagactggcggctccagtgggccaaagggcaaccacatgagcatgggcaggggctttctccttggatgtgggacccacagcagcttcctgaggctgggggtgggtgggtgggtggtttggccttgaggacgctagggcaggcagcacacctggatgtggacttggactcggacacttctgccctgcaccctggcccgctctctacctctgcccaccgttgtggccctgcagccggagatctgaggtgctctggtctgtgggtcagtcctctttccttgtcccaggatggagctgatccagtaacctcggagacgggaccctgcccagagctgagttgggggtgtggctctgccctggaaagggggtgacctcttgcctcgaggggcccagggaagcctgggtgtcaagtgcctgcaccaggggtgcacaataaagggggttctctctca

SEQ ID NO: 154824 - DNA, 1512 bp, Homo sapiens
  Payload ID: 10442
  Gene Symbol: MAPK11
  Gene Name: mitogen-activated protein kinase 11
  Uniprot ID: Q15759
  ENST ID: ENST00000395764
  CDS Start-End: 102-1196
cgccgcctccgccgccctccgctccgctcggctcgggctcggctcgggcgcgggcgcggggcgcggggctgggcccgggcggagcggcggctgctccggacatgtcgggccctcgcgccggcttctaccggcaggagctgaacaagaccgtgtgggaggtgccgcagcggctgcaggggctgcgcccggtgggctccggcgcctacggctccgtctgttcggcctacgacgcccggctgcgccagaaggtggcggtgaagaagctgtcgcgccccttccagtcgctgatccacgcgcgcagaacgtaccgggagctgcggctgctcaagcacctgaagcacgagaacgtcatcgggcttctggacgtcttcacgccggccacgtccatcgaggacttcagcgaagtgtacttggtgaccaccctgatgggcgccgacctgaacaacatcgtcaagtgccaggcgctgagcgacgagcacgttcaattcctggtttaccagctgctgcgcgggctgaagtacatccactcggccgggatcatccaccgggacctgaagcccagcaacgtggctgtgaacgaggactgtgagctcaggatcctggattttgggctggcgcgccaggcggacgaggagatgaccggctatgtggccacgcgctggtaccgggcacctgagatcatgctcaactggatgcattacaaccaaacagtggatatctggtccgtgggctgcatcatggctgagctgctccagggcaaggccctcttcccgggaagcgactacattgaccagctgaagcgcatcatggaagtggtgggcacacccagccctgaggttctggcaaaaatctcctcagaacacgcccggacatatatccagtccctgccccccatgccccagaaggacctgagcagcatcttccgtggagccaaccccctggccatagacctccttggaaggatgctggtgctggacagtgaccagagggtcagtgcagctgaggcactggcccacgcctacttcagccagtaccacgaccccgaggatgagccagaggccgagccatatgatgagagcgttgaggccaaggagcgcacgctggaggagtggaaggagctcacttaccaggaagtcctcagcttcaagcccccagagccaccgaagccacctggcagcctggagattgagcagtgaggtgctgcccagcagcccctgagagcctgtggaggggcttgggcctgcacccttccacagctggcctggtttcctcgagaggcacctcccacactcctatggtcacagacttctggcctaggacccctcgccttcaggagaatctacacgcatgatggagctgatccagtaacctcggagacgggaccctgcccagagctgagttgggggtgtggctctgccctggaaagggggtgacctcttgcctcgaggggcccagggaagcctgggtgtcaagtgcctgcaccaggggtgcacaataaagggggttctctct

SEQ ID NO: 154825 - DNA, 2409 bp, Homo sapiens
  Payload ID: 10442
  Gene Symbol: MAPK11
  Gene Name: mitogen-activated protein kinase 11
  ENST ID: ENST00000417877
  CDS Start-End: 102-593
cgccgcctccgccgccctccgctccgctcggctcgggctcggctcgggcgcgggcgcggggcgcggggctgggcccgggcggagcggcggctgctccggacatgtcgggccctcgcgccggcttctaccggcaggagctgaacaagaccgtgtgggaggtgccgcagcggctgcaggggctgcgcccggtgggctccggcgcctacggctccgtctgttcggcctacgacgcccggctgcgccagaaggtggcggtgaagaagctgtcgcgccccttccagtcgctgatccacgcgcgcagaacgtaccgggagctgcggctgctcaagcacctgaagcacgagaacgtcatcgggcttctggacgtcttcacgccggccacgtccatcgaggacttcagcgaagtgtacttggtgaccaccctgatgggcgccgacctgaacaacatcgtcaagtgccaggcgctgagcgacgagcacgttcaattcctggtttaccagctgctgcgcgggctgaagtacatccactcggccgggatcatccaccgggtaggacctgaagcccagcaacgtggctgtgaacgaggactgtgagctcaggatcctggattttgggctggcgcgccaggcggacgaggagatgaccggctatgtggccacgcgctggtaccgggcacctgagatcatgctcaactggatgcattacaaccaaacagtggatatctggtccgtgggctgcatcatggctgagctgctccagggcaaggccctcttcccgggaagcgactacattgaccagctgaagcgcatcatggaagtggtgggcacacccagccctgaggttctggcaaaaatctcctcagaacacgcccggacatatatccagtccctgccccccatgccccagaaggacctgagcagcatcttccgtggagccaaccccctggccatagacctccttggaaggatgctggtgctggacagtgaccagagggtcagtgcagctgaggcactggcccacgcctacttcagccagtaccacgaccccgaggatgagccagaggccgagccatatgatgagagcgttgaggccaaggagcgcacgctggaggagtggaaggagctcacttaccaggaagtcctcagcttcaagcccccagagccaccgaagccacctggcagcctggagattgagcagtgaggtgctgcccagcagcccctgagagcctgtggaggggcttgggcctgcacccttccacagctggcctggtttcctcgagaggcacctcccacactcctatggtcacagacttctggcctaggacccctcgccttcaggagaatctacacgcatgtatgcatgcacaaacatgtgtgtacatgtgcttgccatgtgtaggagtctgggcacaagtgtccctgggcctaccttggtcctcctgtcctcttctggctactgcactctccactgggacctgactgtggggtcctagatgccaaaggggttcccctgcggagttcccctgtctgtcccaggccgacccaagggagtgtcagccttgggctctcttctgtcccagggctttctggaggacgcgctggggccgggaccccgggagactcaaagggagaggtctcagtggttagagctgctcagcctggaggtagggggctgtcttggtcactgctgagacccacaggtctaagaggagaggcagagccagtgtgccaccaggctgggcagggacaaccaccaggtgtcaaatgagaaaagctgcctggagtcttgtgttcacccgtgggtgtgtgtgggcacgtgtggatgagcgtgcactccccgtgttcatatgtcagggcacatgtgatgtggtgcgtgtgaatctgtgggcgcccaaggccagcagccatatctggcaagaagctggagccggggtgggtgtgctgttgccttccctctcctcggttcctgatgccttgaggggtgtttcagactggcggctccagtgggccaaagggcaaccacatgagcatgggcaggggctttctccttggatgtgggacccacagcagcttcctgaggctgggggtgggtgggtgggtggtttggccttgaggacgctagggcaggcagcacacctggatgtggacttggactcggacacttctgccctgcaccctggcccgctctctacctctgcccaccgttgtggccctgcagccggagatctgaggtgctctggtctgtgggtcagtcctctttccttgtcccaggatggagctgatccagtaacctcggagacgggaccctgcccagagctgagttgggggtgtggctctgccctggaaagggggtgacctcttgcctcgaggggcccagggaagcctgggtgtcaagtgcctgcaccagggg

SEQ ID NO: 154826 - DNA, 1918 bp, Homo sapiens
  Payload ID: 10443
  Gene Symbol: MAPK12
  Gene Name: mitogen-activated protein kinase 12
  Uniprot ID: P53778
  ENST ID: ENST00000215659
  CDS Start-End: 317-1420
cggcggcggccgcctcgggtttccggaggggccggagggcgggcgagggcgtcacgtgcgcgccgcccgcgggccggttggtccccgggcgggggaggggccgtgcgcagcctgggtcggggtcgggccggggtcggcacctgggacatccctgagggaagggccgggagcgggagcgccccagcggccggcgggcgggcgggcgagcggacgagcggcgcggagccggcccgaggcgcgcgccgagggagccccgtccccggtcgtgggggcaccgcccgcaggctctgcggggtgggcagctcccgggcctgccatgagctctccgccgcccgcccgcagtggcttttaccgccaggaggtgaccaagacggcctgggaggtgcgcgccgtgtaccgggacctgcagcccgtgggctcgggcgcctacggcgcggtgtgctcggccgtggacggccgcaccggcgctaaggtggccatcaagaagctgtatcggcctttccagtccgagctgttcgccaagcgcgcctaccgcgagctgcgcctgctcaagcacatgcgccacgagaacgtgatcgggctgctggacgtattcactcctgatgagaccctggatgacttcacggacttttacctggtgatgccgttcatgggcaccgacctgggcaagctcatgaaacatgagaagctaggcgaggaccggatccagttcctcgtgtaccagatgctgaaggggctgaggtatatccacgctgccggcatcatccacagagacctgaagcccggcaacctggctgtgaacgaagactgtgagctgaagatcctggacttcggcctggccaggcaggcagacagtgagatgactgggtacgtggtgacccggtggtaccgggctcccgaggtcatcttgaattggatgcgctacacgcagacggtggacatctggtctgtgggctgcatcatggcggagatgatcacaggcaagacgctgttcaagggcagcgaccacctggaccagctgaaggagatcatgaaggtgacggggacgcctccggctgagtttgtgcagcggctgcagagcgatgaggccaagaactacatgaagggcctccccgaattggagaagaaggattttgcctctatcctgaccaatgcaagccctctggctgtgaacctcctggagaagatgctggtgctggacgcggagcagcgggtgacggcaggcgaggcgctggcccatccctacttcgagtccctgcacgacacggaagatgagccccaggtccagaagtatgatgactcctttgacgacgttgaccgcacactggatgaatggaagcgtgttacttacaaagaggtgctcagcttcaagcctccccggcagctgggggccagggtctccaaggagacgcctctgtgaagatctctgggctccggggtggcagtgaggaccaccttcaccttccacctgagaggggactctcgttgccaccttgaccttggctggggcttgcatcccaaggcatccatcagagcagacgcccgggttccatggaccctcctccccacggccatgcctctgctcttgggcgcccatcatggaggagcacctgaactttctggacaagacctctggccgacctggggatggcctctgatccctggagcagtggcccacttgcccggtgctctcagaaacctcagagctggtggggctccagatcaggccttggcctctgagccctgcctgctctgggccatgcagaggaaggacagagggtgggcgcagggcaccaactcagggacatcccctctcctgggcgacgtcagtggaccttcctgcacccccagcctggaatgtaaatcagctgtgtggtgcccgcgtggctggaaggaaatagacccttttgtagctccc

SEQ ID NO: 154827 - DNA, 605 bp, Homo sapiens
  Payload ID: 10443
  Gene Symbol: MAPK12
  Gene Name: mitogen-activated protein kinase 12
  ENST ID: ENST00000395778
  CDS Start-End: 35-394
aggctctgcggggtgggcagctcccgggcctgccatgagctctccgccgcccgcccgcagtggcttttaccgccaggaggtgaccaagacggcctgggaggtgcgcgccgtgtaccgggacctgcagcccgtgggctcgggcgcctacggcgcggtgtgctcggccgtggacggccgcaccggcgctaaggtggccatcaagaagctgtatcggcctttccagtccgagctgttcgccaagcgcgcctaccgcgagctgcgcctgctcaagcacatgcgccacgagaacgtgatcgggctgctggacgtattcactcctgatgagaccctggatgacttcacggacttgaaggtcccgtgctcgggaccctggcaccaagtgtgtggccggtaactggagctgctgaccttttccagcgggtgggggagaagcggtagggaggacccaccctgcccctgccctgcagccgaccaccctgggactcacaccctgtcggccaagagtgaagggccaggccgaggaaggcctggagagggtagcaggcgcctcccgcctgacttgcagaggtcaagtcagtggcctctgggaaggtgctaaataccat

SEQ ID NO: 154828 - DNA, 1459 bp, Homo sapiens
  Payload ID: 10443
  Gene Symbol: MAPK12
  Gene Name: mitogen-activated protein kinase 12
  ENST ID: ENST00000395780
  CDS Start-End: 128-961
tccgccccgcagctcggccgtggacggccgcaccggcgctaaggtggccatcaagaagctgtatcggcctttccagtccgagctgttcgccaagcgcgcctaccgcgagctgcgcctgctcaagcacatgcgccacgagaacgtgatcgggctgctggacgtattcactcctgatgagaccctggatgacttcacggacttttacctggtgatgccgttcatgggcaccgacctgggcaagctcatgaaacatgagaagctaggcgaggaccggatccagttcctcgtgtaccagatgctgaaggggctgagggacctgaagcccggcaacctggctgtgaacgaagactgtgagctgaagatcctggacttcggcctggccaggcaggcagacagtgagatgactgggtacgtggtgacccggtggtaccgggctcccgaggtcatcttgaattggatgcgctacacgcagacggtggacatctggtctgtgggctgcatcatggcggagatgatcacaggcaagacgctgttcaagggcagcgaccacctggaccagctgaaggagatcatgaaggtgacggggacgcctccggctgagtttgtgcagcggctgcagagcgatgaggccaagaactacatgaagggcctccccgaattggagaagaaggattttgcctctatcctgaccaatgcaagccctctggctgtgaacctcctggagaagatgctggtgctggacgcggagcagcgggtgacggcaggcgaggcgctggcccatccctacttcgagtccctgcacgacacggaagatgagccccaggtccagaagtatgatgactcctttgacgacgttgaccgcacactggatgaatggaagcgtgttacttacaaagaggtgctcagcttcaagcctccccggcagctgggggccagggtctccaaggagacgcctctgtgaagatctctgggctccggggtggcagtgaggaccaccttcaccttccacctgagaggggactctcgttgccaccttgaccttggctggggcttgcatcccaaggcatccatcagagcagacgcccgggttccatggaccctcctccccacggccatgcctctgctcttgggcgcccatcatggaggagcacctgaactttctggacaagacctctggccgacctggggatggcctctgatccctggagcagtggcccacttgcccggtgctctcagaaacctcagagctggtggggctccagatcaggccttggcctctgagccctgcctgctctgggccatgcagaggaaggacagagggtgggcgcagggcaccaactcagggacatcccctctcctgggcgacgtcagtggaccttcctgcacccccagcctggaatgtaaatcagctgtgtggtgcccgcgtggctggaaggaaatagacccttttgtagctccc

SEQ ID NO: 154829 - DNA, 1779 bp, Homo sapiens
  Payload ID: 10443
  Gene Symbol: MAPK12
  Gene Name: mitogen-activated protein kinase 12
  Uniprot ID: P53778
  ENST ID: ENST00000622558
  CDS Start-End: 208-1281
gcctgggtcggggtcgggccggggtcggcacctgggacatccctgagggaagggccgggagcgggagcgccccagcggccggcgggcgggcgggcgagcggacgagcggcgcggagccggcccgaggcgcgcgccgagggagccccgtccccggtcgtgggggcaccgcccgcaggctctgcggggtgggcagctcccgggcctgccatgagctctccgccgcccgcccgcagtggcttttaccgccaggaggtgaccaagacggcctgggaggtgcgcgccgtgtaccgggacctgcagcccgtgggctcgggcgcctacggcgcggtgtgctcggccgtggacggccgcaccggcgctaaggtggccatcaagaagctgtatcggcctttccagtccgagctgttcgccaagcgcgcctaccgcgagctgcgcctgctcaagcacatgcgccacgagaacgtgatcgggctgctggacgtattcactcctgatgagaccctggatgacttcacggacttttacctggtgatgccgttcatgggcaccgacctgggcaagctcatgaaacatgagaagctaggcgaggaccggatccagttcctcgtgtaccagatgctgaaggggctgagggacctgaagcccggcaacctggctgtgaacgaagactgtgagctgaagatcctggacttcggcctggccaggcaggcagacagtgagatgactgggtacgtggtgacccggtggtaccgggctcccgaggtcatcttgaattggatgcgctacacgcagacggtggacatctggtctgtgggctgcatcatggcggagatgatcacaggcaagacgctgttcaagggcagcgaccacctggaccagctgaaggagatcatgaaggtgacggggacgcctccggctgagtttgtgcagcggctgcagagcgatgaggccaagaactacatgaagggcctccccgaattggagaagaaggattttgcctctatcctgaccaatgcaagccctctggctgtgaacctcctggagaagatgctggtgctggacgcggagcagcgggtgacggcaggcgaggcgctggcccatccctacttcgagtccctgcacgacacggaagatgagccccaggtccagaagtatgatgactcctttgacgacgttgaccgcacactggatgaatggaagcgtgttacttacaaagaggtgctcagcttcaagcctccccggcagctgggggccagggtctccaaggagacgcctctgtgaagatctctgggctccggggtggcagtgaggaccaccttcaccttccacctgagaggggactctcgttgccaccttgaccttggctggggcttgcatcccaaggcatccatcagagcagacgcccgggttccatggaccctcctccccacggccatgcctctgctcttgggcgcccatcatggaggagcacctgaactttctggacaagacctctggccgacctggggatggcctctgatccctggagcagtggcccacttgcccggtgctctcagaaacctcagagctggtggggctccagatcaggccttggcctctgagccctgcctgctctgggccatgcagaggaaggacagagggtgggcgcagggcaccaactcagggacatcccctctcctgggcgacgtcagtggaccttcctgcacccccagcctggaatgtaaatcagctgtgtggtgcccgcgtggctggaaggaaatagacccttttgtagctccc

SEQ ID NO: 154830 - DNA, 2052 bp, Homo sapiens
  Payload ID: 10444
  Gene Symbol: MAPK13
  Gene Name: mitogen-activated protein kinase 13
  Uniprot ID: O15264
  ENST ID: ENST00000211287
  CDS Start-End: 263-1360
cgtgcctgggccgcacctgccgcagtggctccgtcgggccgggcggaagcgcgggagcgcagggctggacaggcccgggcgtggcggccccggcgcacctgggcgagccggcaggtgggagcgtagcagcccggggcccccgccctcgcgcgggggaggagcgggcggcgcggggcgggcgcagcgggggtcggggcgctgggagcccgttgggccgcgaacgcagccgccacgctggggccgccgagatcgggtgcccgggatgagcctcatccggaaaaagggcttctacaagcaggacgtcaacaagacagcctgggagctgcccaagacctacgtgtccccgacgcacgtcggcagcggggcctatggctccgtgtgctcggccatcgacaagcggtcaggggagaaggtggccatcaagaagctgagccgaccctttcagtccgagatcttcgccaagcgcgcctaccgggagctgctgctgctgaagcacatgcagcatgagaacgtcattgggctcctggatgtcttcaccccagcctcctccctgcgcaacttctatgacttctacctggtgatgcccttcatgcagacggatctgcagaagatcatggggatggagttcagtgaggagaagatccagtacctggtgtatcagatgctcaaaggccttaagtacatccactctgctggggtcgtgcacagggacctgaagccaggcaacctggctgtgaatgaggactgtgaactgaagattctggattttgggctggcgcgacatgcagacgccgagatgactggctacgtggtgacccgctggtaccgagcccccgaggtgatcctcagctggatgcactacaaccagacagtggacatctggtctgtgggctgtatcatggcagagatgctgacagggaaaactctgttcaaggggaaagattacctggaccagctgacccagatcctgaaagtgaccggggtgcctggcacggagtttgtgcagaagctgaacgacaaagcggccaaatcctacatccagtccctgccacagacccccaggaaggatttcactcagctgttcccacgggccagcccccaggctgcggacctgctggagaagatgctggagctagacgtggacaagcgcctgacggccgcgcaggccctcacccatcccttctttgaacccttccgggaccctgaggaagagacggaggcccagcagccgtttgatgattccttagaacacgagaaactcacagtggatgaatggaagcagcacatctacaaggagattgtgaacttcagccccattgcccggaaggactcacggcgccggagtggcatgaagctgtagggactcatcttgcatggcaccgccggccagacactgcccaaggaccagtatttgtcactaccaaactcagcccttcttggaatacagcctttcaagcagaggacagaagggtccttctccttatgtgggaaatgggcctagtagatgcagaattcaaagatgtcggttgggagaaactagctctgatcctaacaggccacgttaaactgcccatctggagaatcgcctgcaggtggggccctttccttcccgccagagtggggctgagtgggcgctgagccaggccgggggcctatggcagtgatgctgtgttggtttcctagggatgctctaacgaattaccacaaacctggtggattgaaacagcagaacttgattcccttacagttctggaggctggaaatctgggatggaggtgttggcagggctgtggtccctttgaaggctctggggaagaatccttccttggctctttttagcttgtggcggcagtgggcagtccgtggcattccccagcttattgctgcatcactccagtctctgtctcttctgttctctcctcttttaacaacagtcattggatttagggcccaccctaatcctgtgtgatcttatcttgatccttattaattaaacctgcaaatactctagttccaaataaagtcacattctcaggttccaggtggacatga

SEQ ID NO: 154831 - DNA, 1036 bp, Homo sapiens
  Payload ID: 10444
  Gene Symbol: MAPK13
  Gene Name: mitogen-activated protein kinase 13
  ENST ID: ENST00000373759
  CDS Start-End: 155-613
cccgacgcacgtcggcagcggggcctatggctccgtgtgctcggccatcgacaagcggtcaggggagaaggtggccatcaagaagctgagccgaccctttcagtccgagatcttcgccaagcgcgcctaccgggagctgctgctgctgaagcacatgcagcatgagaacgtcattgggctcctggatgtcttcaccccagcctcctccctgcgcaacttctatgacttctacctggtgatgcccttcatgcagacggatctgcagaagatcatggggatggagttcagtgaggagaagatccagtacctggtgtatcagatgctcaaaggccttaagtacatccactctgctggggtcgtgcacagggacctgaagccaggcaacctggctgtgaatgaggactgtgaactgaagattctggattttgggctggcgcgacatgcagacgccgagatgactggctacgtggtgacccgctggtaccgagcccccgaggtgatcctcagctggatgcactacaaccagacaggccaaatcctacatccagtccctgccacagacccccaggaaggatttcactcagctgttcccacgggccagcccccagggtgagtctcagagcccgctccccaggggcctctcagcgtatcccagagggcgggctctcccagcccctggtgtgaggctcttggctctgcccctgcagctgcggacctgctggagaagatgctggagctagacgtggacaagcgcctgacggccgcgcaggccctcacccatcccttctttgaacccttccgggaccctgaggaagagacggaggcccagcagccgtttgatgattccttagaacacgagaaactcacagtggatgaatggaagcgtaagagctggggcctcgggcttcctcgcctccgcctgcagcctctcttccttgcttcctccatctttgtgcctggcctctgccagccctacctgccacctccttcttggtgggcattgtctcctgggtgcttctttctccttgagctgact

SEQ ID NO: 154832 - DNA, 6196 bp, Homo sapiens
  Payload ID: 10444
  Gene Symbol: MAPK13
  Gene Name: mitogen-activated protein kinase 13
  Uniprot ID: O15264
  ENST ID: ENST00000373766
  CDS Start-End: 100-873
ggcggcgcggggcgggcgcagcgggggtcggggcgctgggagcccgttgggccgcgaacgcagccgccacgctggggccgccgagatcgggtgcccgggatgagcctcatccggaaaaagggcttctacaagcaggacgtcaacaagacagcctgggagctgcccaagacctacgtgtccccgacgcacgtcggcagcggggcctatggctccgtgtgctcggccatcgacaagcggtcaggggagaaggtggccatcaagaagctgagccgaccctttcagtccgagatcttcgccaagcgcgcctaccgggagctgctgctgctgaagcacatgcagcatgagaacgtcattgggctcctggatgtcttcaccccagcctcctccctgcgcaacttctatgacttctacctggtgatgcccttcatgcagacggatctgcagaagatcatggggatggagttcagtgaggagaagatccagtacctggtgtatcagatgctcaaaggccttaagtacatccactctgctggggtcgtgcacagggacctgaagccaggcaacctggctgtgaatgaggactgtgaactgaagattctggattttgggctggcgcgacatgcagacgccgagatgactggctacgtggtgacccgctggtaccgagcccccgaggtgatcctcagctggatgcactacaaccagacaggccaaatcctacatccagtccctgccacagacccccaggaaggatttcactcagctgttcccacgggccagcccccaggctgcggacctgctggagaagatgctggagctagacgtggacaagcgcctgacggccgcgcaggccctcacccatcccttctttgaacccttccgggaccctgaggaagagacggaggcccagcagccgtttgatgattccttagaacacgagaaactcacagtggatgaatggaagcagcacatctacaaggagattgtgaacttcagccccattgcccggaaggactcacggcgccggagtggcatgaagctgtagggactcatcttgcatggcaccgccggccagacactgcccaaggaccagtatttgtcactaccaaactcagcccttcttggaatacagcctttcaagcagaggacagaagggtccttctccttatgtgggaaatgggcctagtagatgcagaattcaaagatgtcggttgggagaaactagctctgatcctaacaggccacgttaaactgcccatctggagaatcgcctgcaggtggggccctttccttcccgccagagtggggctgagtgggcgctgagccaggccgggggcctatggcagtgatgctgtgttggtttcctagggatgctctaacgaattaccacaaacctggtggattgaaacagcagaacttgattcccttacagttctggaggctggaaatctgggatggaggtgttggcagggctgtggtccctttgaaggctctggggaagaatccttccttggctctttttagcttgtggcggcagtgggcagtccgtggcattccccagcttattgctgcatcactccagtctctgtctcttctgttctctcctcttttaacaacagtcattggatttagggcccaccctaatcctgtgtgatcttatcttgatccttattaattaaacctgcaaatactctagttccaaataaagtcacattctcaggttccaggtggacatgaattccagggggaaatgattcaactcactacagacagctgggagggaggggccccttcctgggccccgtgctgaggccttgtgctctgtgaaggaacccaatgtgtttggctgctaaattaagggagttgcagagagagctgcagctggtgcgattgcattcaggttattttgggtgagtgataagcaatcaagatatgaaacaacagcaggctcggagactgcgagctgcacaggcagaaatgggctcttgcctggcttgatggcaaaccgttctgctccctttgggagatggcacagctctccagagctttgacctgacagtggctagaacctctctgtttttatctgagaaactttggcagaacaaatttccatgtgcacaagctgtcgggcacagtgggtctcaaatttccttgtgcaccaggggacttgttaaaatgcagattcctgggccccaccccagggcttgtgactcagcaggtctgcagttgagaccttagaatgtgcatttgaatgaggacctctcgccctgacccaagcctagtgattctgatggatatcagaccatagttcgagacatttagtggatttcagtcatacttgatttgttgggaggcctaaatcaaaaacctataggaggagactggggggcttcagatggagtttcacactcatcttacaggtgttaaaactgaggctcagaaagcttttttttgtttgtttgtttgagacagggtctggctctgtcacccgggctggagttcagtggcacaattacatcttactgcaacctcagcctcctgggctcaagccatcctcccacctcagcctcctaagtagctgggactacaggtctgtgccacccaggtgcaccaggactgcaggtggctaattaaaacattttttttcttttttgtataggcggggtttctctatgttgcccaggctgatcttgaacttctggactcaagtgatcctcccactttggcctcccaaagtgctgggattataggcatgagccaccctgcaggcccagacagcatttttaaggccttgaaactcttctgtataatactgtaatggtggatacctattgtgcatttgttaccatctgtaggactggataacacagagtgaaccctcaagtaaactatggacttcagttaataataatgtatcagtattggttcataaattgtaacaattgtgccacactaatgcaagatgttactcatcaagaaaactgaggagagagaaggggaggaagtaggtgggaacctctatactttctaccaacctaaaactgctctaaaaaataaaccacaggccggtcgcagtagctcacgcctgtaatcccagcaccttgggaggctgaggtgggcggatcacttgaggtcaggagttcaagaccagcctggccaacatggtgaaaccccatctctaccaaaaatacaaaaattagctgggcttggtggtgcatgcctgtaatcccaaactactcgggaggctgaggcagaattgcttgaacctgggaggtggaggttgcagtgagctgagatcacaccactgcactccagcctgggtgacagagtgagactccatctcaaaaaaacaaaaaaaacaaataccctgaggacacagagacattgggtcagacacccacagctaggaagtggtggagtcagattggaacccaagtaggcttgagcactgtacccagcttggattcaagggttgcccagccttccctcttcacgccagtctgagacccttactgctgactgtgtccatggtctctgttttctctcccacagaatggccctgctgtcaaggagctggggagtccttgactgggactggctagtcttgccacagccctggcctcgctggttactaaaactgccccaggttccctgagtctacatccctctaagcctcctgagaattctcactgccccaaggaaaaagtctagccttccttcttggcctggcattcaaaaccccttgtgttctctctaatctcatcagctcccactgcctcccctagctagtccttatgtcagtgtgggacaccagtcctgggatccaccgtaaggttcattctgcattcacaggttaaaggtcttgacaagtcctgcagtaaagagatccgttcctcatttaatccagaacttcccagatgtacttaaccgcaggacccattttctcccaacagcatgacacacatagccttttttgcccagtgcagcccagtgcacaggtcccgatattgcctctccccaagtaggcttggccttcttttagtgcccgtgcgtggaaggccctccattctcctctccattctccttggccttcaaggctctaccttaggcctccctccaggcagctgttctccatcatcccccctgggctgcaggccctctgtgggcagcatttagtgtgtggtttggcctccccttcccattgcccactgtgagcaaatacctgtgcgtgaatgaataatgagtgaaagatgtcccaggggcctgtcggtcacttctttgccccgaccaggccaatgtcatatggaaggtggcagagagcccagcaggaagcagaagtgggcggccctgggctgtacctttgagctgctctcctgaaaatctctattatttcagactcccagaccccaccccccgcttcatcctctggtgtcctcctaggccatccccactccggaattaaacctcagcccctcccacagagttttctcaaatctgtgaagtttcttcaaaaggcggtggaggtgctcagcagtgcaaggtggggggtggagggggtggggagtagagggagtgggggttccacgggtttgggtcttgcccagtgggcacatggcctgtgtaataggaaacaagtccattctcctgctgtggggggcagaggagctggcggggcgagggagggggagatgtgggctcaggtattcttggtggatgcgcttcgttctgtggctgatggggtggcttaaaagatcttaacagagagagatcaggaagccagactgcaaggtgggggacatttcctaagagcaagtgtaccctccattccctcttttgaggaacaaagagtatctttgctggggcctgagtcatccatgaaaacagacagcagcggtgtcccagggcagggcttgcctggcgtggattggggtggtgctgcccccagtgaggggcagcacaaggggagacagaaatggaggaatagcccccgtaagggcaagcccagtgtgcaccagtgcccagagctgcctgatggaggaacagctccgtaagggtgaacccagtgtgcacgggtgcccggagctgcctgcgtgaggctgggggctagtttggatgagggcatggctcaactttcacttggcacattgaaatagcttttgctgtctgctagggtgtggaaaactgtttttccatggccccaagcaatgctatagctacagctgaggagggaggaatctctccctgcctctcctcccaactcttggcttttgcttccttaaatttgaacaattccctaagatctaatgctgggaggctccccttccttcattacacagtgaactcatgtgctctatctgcattccccctaaatcctcctgagcttttaggtaagaggccgatgatttcacaatcggcagcagaggcctaaggccattccatcaaactgaagatggcagcaagttgtcctcacttcttcattgagcacccatgggtgtgtactggagcaagggtggtgccagggattctcctgctctggttcctcctgcggggtccctgctcagctgggcagctgccctcactctgggcgggtggcatgtgagtgtcaacagggcccctctcagtcaggggctcttggccattttttgtgccatggatcgcttctcaaaatcatattttcttttcttttcttttgagatggggtctcactccattacccaggctggagtgcagtggtgcaatcacagctcactgtagcctcgacctccctgggttcaggtgatcctcccacctcagcctcccaagtagctgggactataggcatgcaccaccatgcctggctaatttcagaataatattttcatacacataaaatatgtaggattacaaagtaagctagttatatttatatacagttgtcaaaatatttttaaaatgtataacgtgatactatgtgtataggtttctttattaacatattgaataaaaagatcgagggtaggcctattaaacaatggtaaactgaagagagatgagtgtaaacaatattttaagatagatacctgtggcaaactgtaaagggatatgaaaaactctgtaatttctattggcactgctgatacaactgcactttgctacctttgttcataaccaaggaaatagaaatgactgaaaataaagttgtattctattccaatcc

SEQ ID NO: 154833 - DNA, 3779 bp, Homo sapiens
  Payload ID: 10445
  Gene Symbol: MAPK14
  Gene Name: mitogen-activated protein kinase 14
  Uniprot ID: Q16539
  ENST ID: ENST00000229794
  CDS Start-End: 389-1471
cgggaggctcccgtttgctggctcttggaaccgcgaccactggagccttagcgggcgcagcagctggaacgggagtactgcgacgcagcccggagtcggccttgtaggggcgaaggtgcagggagatcgcggcgggcgcagtcttgagcgccggagcgcgtccctgcccttagcggggcttgccccagtcgcaggggcacatccagccgctgcggctgacagcagccgcgcgcgcgggagtctgcggggtcgcggcagccgcacctgcgcgggcgaccagcgcaaggtccccgcccggctgggcgggcagcaagggccggggagagggtgcgggtgcaggcgggggccccacagggccaccttcttgcccggcggctgccgctggaaaatgtctcaggagaggcccacgttctaccggcaggagctgaacaagacaatctgggaggtgcccgagcgttaccagaacctgtctccagtgggctctggcgcctatggctctgtgtgtgctgcttttgacacaaaaacggggttacgtgtggcagtgaagaagctctccagaccatttcagtccatcattcatgcgaaaagaacctacagagaactgcggttacttaaacatatgaaacatgaaaatgtgattggtctgttggacgtttttacacctgcaaggtctctggaggaattcaatgatgtgtatctggtgacccatctcatgggggcagatctgaacaacattgtgaaatgtcagaagcttacagatgaccatgttcagttccttatctaccaaattctccgaggtctaaagtatatacattcagctgacataattcacagggacctaaaacctagtaatctagctgtgaatgaagactgtgagctgaagattctggattttggactggctcggcacacagatgatgaaatgacaggctacgtggccactaggtggtacagggctcctgagatcatgctgaactggatgcattacaaccagacagttgatatttggtcagtgggatgcataatggccgagctgttgactggaagaacattgtttcctggtacagaccatattgatcagttgaagctcattttaagactcgttggaaccccaggggctgagcttttgaagaaaatctcctcagagtctgcaagaaactatattcagtctttgactcagatgccgaagatgaactttgcgaatgtatttattggtgccaatcccctggctgtcgacttgctggagaagatgcttgtattggactcagataagagaattacagcggcccaagcccttgcacatgcctactttgctcagtaccacgatcctgatgatgaaccagtggccgatccttatgatcagtcctttgaaagcagggacctccttatagatgagtggaaaagcctgacctatgatgaagtcatcagctttgtgccaccaccccttgaccaagaagagatggagtcctgagcacctggtttctgttctgttgatcccacttcactgtgaggggaaggccttttcacgggaactctccaaatattattcaagtgcctcttgttgcagagatttcctccatggtggaagggggtgtgcgtgcgtgtgcgtgcgtgttagtgtgtgtgcatgtgtgtgtctgtctttgtgggagggtaagacaatatgaacaaactatgatcacagtgactttacaggaggttgtggatgctccagggcagcctccaccttgctcttctttctgagagttggctcaggcagacaagagctgctgtccttttaggaatatgttcaatgcaaagtaaaaaaatatgaattgtccccaatcccggtcatgcttttgccactttggcttctcctgtgaccccaccttgacggtggggcgtagacttgacaacatcccacagtggcacggagagaaggcccataccttctggttgcttcagacctgacaccgtccctcagtgatacgtacagccaaaaaggaccaactggcttctgtgcactagcctgtgattaacttgcttagtatggttctcagatcttgacagtatatttgaaactgtaaatatgtttgtgccttaaaaggagagaagaaagtgtagatagttaaaagactgcagctgctgaagttctgagccgggcaagtcgagagggctgttggacagctgcttgtgggcccggagtaatcaggcagccttcataggcggtcatgtgtgcatgtgagcacatgcgtatatgtgcgtctctctttctccctcacccccaggtgttgccatttctctgcttacccttcacctttggtgcagaggtttcttgaatatctgccccagtagtcagaagcaggttcttgatgtcatgtacttcctgtgtactctttatttctagcagagtgaggatgtgttttgcacgtcttgctatttgagcatgcacagctgcttgtcctgctctcttcaggaggccctggtgtcaggcaggtttgccagtgaagacttcttgggtagtttagatcccatgtcacctcagctgatattatggcaagtgatatcacctctcttcagcccctagtgctattctgtgttgaacacaattgatacttcaggtgcttttgatgtgaaaatcatgaaaagaggaacaggtggatgtatagcatttttattcatgccatctgttttcaaccaactatttttgaggaattatcatgggaaaagaccagggcttttcccaggaatatcccaaacttcggaaacaagttattctcttcactcccaataactaatgctaagaaatgctgaaaatcaaagtaaaaaattaaagcccataaggccagaaactccttttgctgtctttctctaaatatgattactttaaaataaaaaagtaacaaggtgtcttttccactcctatggaaaagggtcttcttggcagcttaacattgacttcttggtttggggagaaataaattttgtttcagaattttgtatattgtaggaatcctttgagaatgtgattccttttgatggggagaaagggcaaattattttaatattttgtattttcaactttataaagataaaatatcctcaggggtggagaagtgtcgttttcataacttgctgaatttcaggcattttgttctacatgaggactcatatatttaagccttttgtgtaataagaaagtataaagtcacttccagtgttggctgtgtgacagaatcttgtatttgggccaaggtgtttccatttctcaatcagtgcagtgatacatgtactccagagggacagggtggaccccctgagtcaactggagcaagaaggaaggaggcagactgatggcgattccctctcacccgggactctccccctttcaaggaaagtgaacctttaaagtaaaggcctcatctcctttattgcagttcaaatcctcaccatccacagcaagatgaattttatcagccatgtttggttgtaaatgctcgtgtgatttcctacagaaatactgctctgaatattttgtaataaaggtctttgcacatgtgaccacatacgtgttaggaggctgcatgctctggaagcctggactctaagctggagctcttggaagagctcttcggtttctgagcataatgctcccatctcctgatttctctgaacagaaaacaaaagagagaatgagggaaattgctattttatttgtattcatgaacttggctgtaatcagttatgccgtataggatgtcagacaataccactggttaaaataaagcctatttttcaaa

SEQ ID NO: 154834 - DNA, 4319 bp, Homo sapiens
  Payload ID: 10445
  Gene Symbol: MAPK14
  Gene Name: mitogen-activated protein kinase 14
  Uniprot ID: Q16539
  ENST ID: ENST00000229795
  CDS Start-End: 448-1530
atattgggtaaaatctcggctctcggagagtcccgggagctgttctcgcgagagtactgcgggaggctcccgtttgctggctcttggaaccgcgaccactggagccttagcgggcgcagcagctggaacgggagtactgcgacgcagcccggagtcggccttgtaggggcgaaggtgcagggagatcgcggcgggcgcagtcttgagcgccggagcgcgtccctgcccttagcggggcttgccccagtcgcaggggcacatccagccgctgcggctgacagcagccgcgcgcgcgggagtctgcggggtcgcggcagccgcacctgcgcgggcgaccagcgcaaggtccccgcccggctgggcgggcagcaagggccggggagagggtgcgggtgcaggcgggggccccacagggccaccttcttgcccggcggctgccgctggaaaatgtctcaggagaggcccacgttctaccggcaggagctgaacaagacaatctgggaggtgcccgagcgttaccagaacctgtctccagtgggctctggcgcctatggctctgtgtgtgctgcttttgacacaaaaacggggttacgtgtggcagtgaagaagctctccagaccatttcagtccatcattcatgcgaaaagaacctacagagaactgcggttacttaaacatatgaaacatgaaaatgtgattggtctgttggacgtttttacacctgcaaggtctctggaggaattcaatgatgtgtatctggtgacccatctcatgggggcagatctgaacaacattgtgaaatgtcagaagcttacagatgaccatgttcagttccttatctaccaaattctccgaggtctaaagtatatacattcagctgacataattcacagggacctaaaacctagtaatctagctgtgaatgaagactgtgagctgaagattctggattttggactggctcggcacacagatgatgaaatgacaggctacgtggccactaggtggtacagggctcctgagatcatgctgaactggatgcattacaaccagacagttgatatttggtcagtgggatgcataatggccgagctgttgactggaagaacattgtttcctggtacagaccatattaaccagcttcagcagattatgcgtctgacaggaacaccccccgcttatctcattaacaggatgccaagccatgaggcaagaaactatattcagtctttgactcagatgccgaagatgaactttgcgaatgtatttattggtgccaatcccctggctgtcgacttgctggagaagatgcttgtattggactcagataagagaattacagcggcccaagcccttgcacatgcctactttgctcagtaccacgatcctgatgatgaaccagtggccgatccttatgatcagtcctttgaaagcagggacctccttatagatgagtggaaaagcctgacctatgatgaagtcatcagctttgtgccaccaccccttgaccaagaagagatggagtcctgagcacctggtttctgttctgttgatcccacttcactgtgaggggaaggccttttcacgggaactctccaaatattattcaagtgcctcttgttgcagagatttcctccatggtggaagggggtgtgcgtgcgtgtgcgtgcgtgttagtgtgtgtgcatgtgtgtgtctgtctttgtgggagggtaagacaatatgaacaaactatgatcacagtgactttacaggaggttgtggatgctccagggcagcctccaccttgctcttctttctgagagttggctcaggcagacaagagctgctgtccttttaggaatatgttcaatgcaaagtaaaaaaatatgaattgtccccaatcccggtcatgcttttgccactttggcttctcctgtgaccccaccttgacggtggggcgtagacttgacaacatcccacagtggcacggagagaaggcccataccttctggttgcttcagacctgacaccgtccctcagtgatacgtacagccaaaaaggaccaactggcttctgtgcactagcctgtgattaacttgcttagtatggttctcagatcttgacagtatatttgaaactgtaaatatgtttgtgccttaaaaggagagaagaaagtgtagatagttaaaagactgcagctgctgaagttctgagccgggcaagtcgagagggctgttggacagctgcttgtgggcccggagtaatcaggcagccttcataggcggtcatgtgtgcatgtgagcacatgcgtatatgtgcgtctctctttctccctcacccccaggtgttgccatttctctgcttacccttcacctttggtgcagaggtttcttgaatatctgccccagtagtcagaagcaggttcttgatgtcatgtacttcctgtgtactctttatttctagcagagtgaggatgtgttttgcacgtcttgctatttgagcatgcacagctgcttgtcctgctctcttcaggaggccctggtgtcaggcaggtttgccagtgaagacttcttgggtagtttagatcccatgtcacctcagctgatattatggcaagtgatatcacctctcttcagcccctagtgctattctgtgttgaacacaattgatacttcaggtgcttttgatgtgaaaatcatgaaaagaggaacaggtggatgtatagcatttttattcatgccatctgttttcaaccaactatttttgaggaattatcatgggaaaagaccagggcttttcccaggaatatcccaaacttcggaaacaagttattctcttcactcccaataactaatgctaagaaatgctgaaaatcaaagtaaaaaattaaagcccataaggccagaaactccttttgctgtctttctctaaatatgattactttaaaataaaaaagtaacaaggtgtcttttccactcctatggaaaagggtcttcttggcagcttaacattgacttcttggtttggggagaaataaattttgtttcagaattttgtatattgtaggaatcctttgagaatgtgattccttttgatggggagaaagggcaaattattttaatattttgtattttcaactttataaagataaaatatcctcaggggtggagaagtgtcgttttcataacttgctgaatttcaggcattttgttctacatgaggactcatatatttaagccttttgtgtaataagaaagtataaagtcacttccagtgttggctgtgtgacagaatcttgtatttgggccaaggtgtttccatttctcaatcagtgcagtgatacatgtactccagagggacagggtggaccccctgagtcaactggagcaagaaggaaggaggcagactgatggcgattccctctcacccgggactctccccctttcaaggaaagtgaacctttaaagtaaaggcctcatctcctttattgcagttcaaatcctcaccatccacagcaagatgaattttatcagccatgtttggttgtaaatgctcgtgtgatttcctacagaaatactgctctgaatattttgtaataaaggtctttgcacatgtgaccacatacgtgttaggaggctgcatgctctggaagcctggactctaagctggagctcttggaagagctcttcggtttctgagcataatgctcccatctcctgatttctctgaacagaaaacaaaagagagaatgagggaaattgctattttatttgtattcatgaacttggctgtaatcagttatgccgtataggatgtcagacaataccactggttaaaataaagcctatttttcaaatttagtgagtttctcaagtttattatatttttctcttgtttttatttaatgcacaatatggcattatatcaatatcctttaaactgtgacctggcatacttgtctgacagatcttaatactactcctaacatttagaaaatgttgataaagcttcttagttgtacattttttggtgaagagtatccaggtctttgctgtggatgggtaaagcaaagagcaaatgaacgaagtattaagcattggggcctgtcttatctacactcgagtgtaagagtggccgaaatgacagggctcagcagactgtggcctgagggccaaatctggcccaccacctgtttggtgtagcctgctaagaatggcttttacatttttaaatggttgggaaagaaaaaaaaagaagtagtagattttgtagcatgtgatgtaagtaatgtaaaacttaaattccagtatccataaataaagttttatgagaacaga

SEQ ID NO: 154835 - DNA, 1066 bp, Homo sapiens
  Payload ID: 10445
  Gene Symbol: MAPK14
  Gene Name: mitogen-activated protein kinase 14
  Uniprot ID: Q16539
  ENST ID: ENST00000310795
  CDS Start-End: 1-924
atgtctcaggagaggcccacgttctaccggcaggagctgaacaagacaatctgggaggtgcccgagcgttaccagaacctgtctccagtgggctctggcgcctatggctctgtgtgtgctgcttttgacacaaaaacggggttacgtgtggcagtgaagaagctctccagaccatttcagtccatcattcatgcgaaaagaacctacagagaactgcggttacttaaacatatgaaacatgaaaatgtgattggtctgttggacgtttttacacctgcaaggtctctggaggaattcaatgatgtgtatctggtgacccatctcatgggggcagatctgaacaacattgtgaaatgtcagaagcttacagatgaccatgttcagttccttatctaccaaattctccgaggtctaaagtatatacattcagctgacataattcacagggacctaaaacctagtaatctagctgtgaatgaagactgtgagctgaagattctggattttggactggctcggcacacagatgatgaaatgacaggctacgtggccactaggtggtacagggctcctgagatcatgctgaactggatgcattacaaccagacagttgatatttggtcagtgggatgcataatggccgagctgttgactggaagaacattgtttcctggtacagaccatattgatcagttgaagctcattttaagactcgttggaaccccaggggctgagcttttgaagaaaatctcctcagagtctctgtcgacttgctggagaagatgcttgtattggactcagataagagaattacagcggcccaagcccttgcacatgcctactttgctcagtaccacgatcctgatgatgaaccagtggccgatccttatgatcagtcctttgaaagcagggacctccttatagatgagtggaaaagcctgacctatgatgaagtcatcagctttgtgccaccaccccttgaccaagaagagatggagtcctgagcacctggtttctgttctgttgatcccacttcactgtgaggggaaggccttttcacgggaac

SEQ ID NO: 154836 - DNA, 823 bp, Homo sapiens
  Payload ID: 10445
  Gene Symbol: MAPK14
  Gene Name: mitogen-activated protein kinase 14
  ENST ID: ENST00000474429
  CDS Start-End: 1-271
caagacaatctgggaggtgcccgagcgttaccagaacctgtctccagtgggctctggcgcctatggctctgtgtgtgctgcttttgacacaaaaacggggttacgtgtggcagtgaagaagctctccagaccatttcagtccatcattcatgcgaaaagaacctacagagaactgcggttacttaaacatatgaaacatgaaaatgtgattggtctgttggacgtttttacacctgcaaggtctctggaggaattcaatgatgtggcttaaacaaacaagtaaacaacttttctaatggaaaattcaaacacataaaatcacagtatatacattcagctgacataattcacagggacctaaaacctagtaatctagctgtgaatgaagactgtgagctgaagattctggattttggactggctcggcacacagatgatgaaatgacaggctacgtggccactaggtggtacagggctcctgagatcatgctgaactggatgcattacaaccagacagttgatatttggtcagtgggatgcataatggccgagctgttgactggaagaacattgtttcctggtacagaccatattgatcagttgaagctcattttaagactcgttggaaccccaggggctgagcttttgaagaaaatctcctcagagtctgcaagaaactatattcagtctttgactcagatgccgaagatgaactttgcgaatgtatttattggtgccaatcccctggctgtcgacttgctggagaagatgcttgtattggactcagataagagaattacagcggcccaagcccttgcacatg

SEQ ID NO: 154837 - DNA, 2777 bp, Homo sapiens
  Payload ID: 10445
  Gene Symbol: MAPK14
  Gene Name: mitogen-activated protein kinase 14
  ENST ID: ENST00000491957
  CDS Start-End: 1-522
atgtctcaggagaggcccacgttctaccggcaggagctgaacaagacaatctgggaggtgcccgagcgttaccagaacctgtctccagtgggctctggcgcctatggctctgtgtgtgctgcttttgacacaaaaacggggttacgtgtggcagtgaagaagctctccagaccatttcagtccatcattcatgcgaaaagaacctacagagaactgcggttacttaaacatatgaaacatgaaaatgtgattggtctgttggacgtttttacacctgcaaggtctctggaggaattcaatgatgtgtatctggtgacccatctcatgggggcagatctgaacaacattgtgaaatgtcagaagcttacagatgaccatgttcagttccttatctaccaaattctccgaggtctaaagtatatacattcagctgacataattcacagggacctaaaacctagtaatctagctgtgaatgaagactgtgagctgaagtttgtctgttcctcttctgccctttagattctggattttggactggctcggcacacagatgatgaaatgacaggctacgtggccactaggtggtacagggctcctgagatcatgctgaactggatgcattacaaccagacagttgatatttggtcagtgggatgcataatggccgagctgttgactggaagaacattgtttcctggtacagaccatattgatcagttgaagctcattttaagactcgttggaaccccaggggctgagcttttgaagaaaatctcctcagagtctgtgagttgatgctttgtaattatctgccctgttgggagcctctgccacttgccttctaccaatctgtactttgacctgggtgtgtttgtaagcacacatgccctttgtgtgctgacttcccggatgagtgaggtataagacagtgtgagtgtgtgtgtgcgtgcacgcatgtgtgcctgcttgcatgcacaagtgtgttttattctctatctgggtacacactaagatcacgggagcctccattagacaatagtatcccagtaaagcaatgagatttgagattctaattcattccaagagattaatgtaaactttgtgtctctgtcctcaagacctgactttcttctttctcagaagtttcacgtatgctctagagctcttttcactgtttctagtgtttgttctcagagcatgagcttcaccatgtatttagtttaacttaatcactaaaagaataaaatgtacattgtctgcacactgttgccccttcccagaagttattttttattgttttagaatagatactcacatatcctatgtaaaatgtttgttcccaacagagggacctttctacccagtccctagaccccactcagaagaaacagcttcactcctgatacctcagatacacaggaatgtggttataaattttcctcctattgccttgtaattataagttagataacctgagacagagtttggaactagtgctttcttgcttctaagcagggacttagacagaagccatgggaatgtgagtctggcttacttttgctatgatttcctgctcttggtcattttcttgggccagaggcatgagagaagccatgaaagcccagcttttctttttccctcgatctgctgccaggcagttgaacaaaagaaaaaaagagctatggagccaagctccagttatgccttcctggattctcctcccaacatttatgactgaaggggccctttgcctagttgggaagatggctgggtagcttgaggcaagcataagcaggtgagttggaaccgttcatcatcttcctgacaaaataaagaataccgtcatctggtatgtatccggtacatttcttgaaaggatcccaaagcccagtgtatttctgaacctccactctgaatttgtttcatttacttatttaagataaagaagcaaaagcccagaagggcagtgacttttccatgtcatgcactgaatcacgtggcagagctgagtatagatcccagatgttctgataacatgatccaaactataatcccatgtgattacacactattttgaaagtcattgtcagtgttaccacaatgtcaacctaaagaggtatttttttctcctttatgatatgtagaagctgaattagagtgaatcaaagatatcagatgatgcttagaaagagcagtactttttttttaatgtttttgcttagaaacactgtcttacagtaagaggacctaagggcagagggaggagctcaattaataaatagtgctaatgagaccaagcaaattcatttccttcctgagagtgtctcctagcagccctttcttagtcttctcttccatcccaaccatctgccctatagatacgtgctattagtcatttggaattggattaggaattcaaaccaaagtctaggtaaaatagtcaatagtatttatctgtcattaatccatcacttatttttaagaaagaaacaatgagtgcacagcctaataatggaggtctctctgtgaaatgaggcacattatacatttcaacagctctactgaaattgagtaccagaatacagaacttaactcaaataatattatattgagtataagaataagaaaggtttttttttttggtttgtttcctacataattggggtgagtggataaaagtagtttaaacatcctaaggggtagacaagattaatttgatgttcgtgacacggcccaagtacctgtttatcttaaaagcgcatgatgtatgggaa

SEQ ID NO: 154838 - DNA, 585 bp, Homo sapiens
  Payload ID: 10445
  Gene Symbol: MAPK14
  Gene Name: mitogen-activated protein kinase 14
  ENST ID: ENST00000472333
  CDS Start-End: 188-585
tcatttggagcaagaaagattcagatctgtaaggcgccctcaagatcaaaaagttattaacagtgctgggagtgctgcttttgacacaaaaacggggttacgtgtggcagtgaagaagctctccagaccatttcagtccatcattcatgcgaaaagaacctacagagaactgcggttacttaaacatatgaaacatgaaaatgtgattggtctgttggacgtttttacacctgcaaggtctctggaggaattcaatgatgtgtatctggtgacccatctcatgggggcagatctgaacaacattgtgaaatgtcagaagcttacagatgaccatgttcagttccttatctaccaaattctccgaggtctaaagtatatacattcagctgacataattcacagggacctaaaacctagtaatctagctgtgaatgaagactgtgagctgaagattctggattttggactggctcggcacacagatgatgaaatgacaggctacgtggccactaggtggtacagggctcctgagatcatgctgaactggatgcattacaaccagacagttgatatttggtcagtggg

SEQ ID NO: 154839 - DNA, 1376 bp, Homo sapiens
  Payload ID: 10445
  Gene Symbol: MAPK14
  Gene Name: mitogen-activated protein kinase 14
  ENST ID: ENST00000468133
  CDS Start-End: 302-1153
gtttgctggctcttggaaccgcgaccactggagccttagcgggcgcagcagctggaacgggagtactgcgacgcagcccggagtcggccttgtaggggcgaaggagctgaacaagacaatctgggaggtgcccgagcgttaccagaacctgtctccagtgggctctggcgcctatggctctgtgtgtgctgcttttgacacaaaaacggggttacgtgtggcagtgaagaagctctccagaccatttcagtccatcattcatgcgaaaagaacctacagagaactgcggttacttaaacatatgaaacatgaaaatgtgattggtctgttggacgtttttacacctgcaaggtctctggaggaattcaatgatgtgtatctggtgacccatctcatgggggcagatctgaacaacattgtgaaatgtcagaagcttacagatgaccatgttcagttccttatctaccaaattctccgaggtctaaagtatatacattcagctgacataattcacagggacctaaaacctagtaatctagctgtgaatgaagactgtgagctgaagattctggattttggactggctcggcacacagatgatgaaatgacaggctacgtggccactaggtggtacagggctcctgagatcatgctgaactggatgcattacaaccagacagttgatatttggtcagtgggatgcataatggccgagctgttgactggaagaacattgtttcctggtacagaccatattgatcagttgaagctcattttaagactcgttggaaccccaggggctgagcttttgaagaaaatctcctcagagtctgcaagaaactatattcagtctttgactcagatgccgaagatgaactttgcgaatgtatttattggtgccaatcccctggctgtcgacttgctggagaagatgcttgtattggactcagataagagaattacagcggcccaagcccttgcacatgcctactttgctcagtaccacgatcctgatgatgaaccagtggccgatccttatgatcagtcctttgaaagcagggacctccttatagatgagtggaaaagcctgacctatgatgaagtcatcagctttgtgccaccaccccttgaccaagaagagatggagtcctgagcacctggtttctgttctgttgatcccacttcactgtgaggggaaggccttttcacgggaactctccaaatattattcaagtgcctcttgttgcagagatttcctccatggtggaagggggtgtgcgtgcgtgtgcgtgcgtgttagtgtgtgtgcatgtgtgtgtctgtctttgtgggagggtaagacaatatgaacaaactatgatcacagtgactttaca

SEQ ID NO: 154840 - DNA, 1003 bp, Homo sapiens
  Payload ID: 10445
  Gene Symbol: MAPK14
  Gene Name: mitogen-activated protein kinase 14
  ENST ID: ENST00000622903
  CDS Start-End: 482-1003
ttctctcacgaagccccgcccgcggagaggttccatattgggtaaaatctcggctctcggagagtcccgggagctgttctcgcgagagtactgcgggaggctcccgtttgctggctcttggaaccgcgaccactggagccttagcgggcgcagcagctggaacgggagtactgcgacgcagcccggagtcggccttgtaggggcgaaggtgcagggagatcgcggcgggcgcagtcttgagcgccggagcgcgtccctgcccttagcggggcttgccccagtcgcaggggcacatccagccgctgcggctgacagcagccgcgcgcgcgggagtctgcggggtcgcggcagccgcacctgcgcgggcgaccagcgcaaggtccccgcccggctgggcgggcagcaagggccggggagagggtgcgggtgcaggcgggggccccacagggccaccttcttgcccggcggctgccgctggaaaatgtctcaggagaggcccacgttctaccggcaggagctgaacaagacaatctgggaggtgcccgagcgttaccagaacctgtctccagtgggctctggcgcctatggctctgtgtgtgctgcttttgacacaaaaacggggttacgtgtggcagtgaagaagctctccagaccatttcagtccatcattcatgcgaaaagaacctacagagaactgcggttacttaaacatatgaaacatgaaaatgtgattggtctgttggacgtttttacacctgcaaggtctctggaggaattcaatgatgtgtatctggtgacccatctcatgggggcagatctgaacaacattgtgaaatgtcagaagcttacagatgaccatgttcagttccttatctaccaaattctccgaggtctaaagtatatacattcagctgacataattcacagggacctaaaacctagtaatctagctgtgaatgaagactgtgagctgaagtttgtctgttcctcttctgccctttag

SEQ ID NO: 154841 - DNA, 1961 bp, Homo sapiens
  Payload ID: 10446
  Gene Symbol: MAPK15
  Gene Name: mitogen-activated protein kinase 15
  Uniprot ID: Q8TD08
  ENST ID: ENST00000338033
  CDS Start-End: 120-1754
ccggggcctgccgggggcggggggtgttgggaggggcgccccgaggggcggggccgggccgccgtcggttcccacggcaaccgactcaacagtaaggccccgcgggcgtcctggccgccatgtgcaccgtagtggaccctcgcattgtccggagatacctactcaggcggcagctcgggcagggggcctatggcattgtgtggaaggcagtggaccggaggactggtgaggtcgtggccatcaagaaaatctttgatgcttttagggataagacagatgcccagagaacattccgggaaatcacgctcctccaggagtttggggaccatcccaacatcatcagcctccttgacgtgatccgggcagagaacgacagggacatttacctggtgtttgagtttatggacactgacctgaacgcagtcatccggaagggcggcctgctgcaggacgtccacgtgcgctccatcttctaccagctcctgcgggccacccggttcctccactcggggcacgttgtgcaccgggaccagaagccgtccaatgtgctcctggatgccaactgcacagtgaagctgtgtgactttggcctggcccgctccctgggcgacctccccgaggggcctgaggaccaggccgtgacagagtacgtggccacacgctggtaccgagcaccggaggtgctgctctcttcgcaccgatacacccttggggtggacatgtggagtctgggctgtatcctgggggagatgctgcgggggagacccctgttccccggcacgtccaccctccaccagctggagctgatcctggagaccatcccaccgccatctgaggaggacctcctggctctcggctcaggctgccgtgcctctgtgctgcaccagctggggtcccggccacgacagacgctggatgccctcctaccgccagacacctccccagaggccttggacctccttaggcgactcctggtgttcgccccggacaagcggttaagcgcgacccaggcactgcagcacccctacgtgcagaggttccactgccccagcgacgagtgggcacgagaggcagatgtgcggccccgggcacacgaaggggtccagctctctgtgcctgagtaccgcagccgcgtctatcagatgatcctggagtgtggaggcagcagcggcacctcgagagagaagggcccggagggtgtctccccaagccaggcacacctgcacaaacccagagccgaccctcagctgccttctaggacacctgtgcagggtcccagacccaggccccagagcagcccaggccatgaccctgccgagcacgagtccccccgtgcagccaagaacgttcccaggcagaactccgctcccctgctccaaactgctctcctagggaatggggaaaggccccctggggcgaaggaagcgccccccttgacactctcgctggtgaagccaagcgggaggggagctgcgccctccctgacctcccaggctgcggctcaggtggccaaccaggccctgatccggggtgactggaaccggggcggtggggtgagggtggccagcgtacaacaggtccctccccggcttcctccggaggcccggcccggccggaggatgttcagcacctctgccttgcagggtgcccaggggggtgccagggctttgcttggaggctactcccaagcctacgggactgtctgccactcggcactgggccacctgcccctgctggaggggcaccatgtgtgagccgccctactcccttcacctggccctctgttcctgccccagccccttccccagacccctctccagtctcctgcaccccttagccctccctgctttgcctggcccgttgaagttccagggagcttgcccgggtctcctcgggggagcagatgagggccctgcccccgccccactgacttcctccaataaagtcatgtctgcccccaa

SEQ ID NO: 154842 - DNA, 834 bp, Homo sapiens
  Payload ID: 10446
  Gene Symbol: MAPK15
  Gene Name: mitogen-activated protein kinase 15
  Uniprot ID: Q8TD08
  ENST ID: ENST00000395107
  CDS Start-End: 1-834
atgtgcaccgtagtggaccctcgcattgtccggagatacctactcaggcggcagctcgggcagggggcctatggcattgtgtggaaggcagtggaccggaggactggtgaggtcgtggccatcaagaaaatctttgatgcttttagggataagacagatgcccagagaacattccgggaaatcacgctcctccaggagtttggggaccatcccaacatcatcagcctccttgacgtgatccgggcagagaacgacagggacatttacctggtgtttgagtttatgggttgcccccccagccccccacccccgactgcagtgcgcaccctctctgcagacactgacctgaacgcagtcatccggaagggcggcctgctgcaggacgtccacgtgcgctccatcttctaccagctcctgcgggccacccggttcctccactcggggcacgttgtgcaccgggaccagaagccgtccaatgtgctcctggatgccaactgcacagtgaagctgtgtgactttggcctggcccgctccctgggcgacctccccgaggggcctgaggaccaggccgtgacagagtacgtggccacacgctggtaccgagcaccggaggtgctgctctcttcgcaccgatacacccttggggtggacatgtggagtctgggctgtatcctgggggagatgctgcgggggagacccctgttccccggcacgtccaccctccaccagctggagctgatcctggagaccatcccaccgccatctgaggaggacctcctggctctcggctcaggctgccgtgcctctgtgctgcaccagctggggtcccggtga

SEQ ID NO: 154843 - DNA, 765 bp, Homo sapiens
  Payload ID: 10446
  Gene Symbol: MAPK15
  Gene Name: mitogen-activated protein kinase 15
  Uniprot ID: Q8TD08
  ENST ID: ENST00000395108
  CDS Start-End: 1-765
atgtgcaccgtagtggaccctcgcattgtccggagatacctactcaggcggcagctcgggcagggggcctatggcattgtgtggaaggcagtggaccggaggactggtgaggtcgtggccatcaagaaaatctttgatgcttttagggataagacagatgcccagagaacattccgggaaatcacgctcctccaggagtttggggaccatcccaacatcatcagcctccttgacgtgatccgggcagagaacgacagggacatttacctggtgtttgagtttatggacactgacctgaacgcagtcatccggaagggcggcctgctgcaggacgtccacgtgcgctccatcttctaccagctcctgcgggccacccggttcctccactcggggcacgttgtgcaccgggaccagaagccgtccaatgtgctcctggatgccaactgcacagtgaagctgtgtgactttggcctggcccgctccctgggcgacctccccgaggggcctgaggaccaggccgtgacagagtacgtggccacacgctggtaccgagcaccggaggtgctgctctcttcgcaccgatacacccttggggtggacatgtggagtctgggctgtatcctgggggagatgctgcgggggagacccctgttccccggcacgtccaccctccaccagctggagctgatcctggagaccatcccaccgccatctgaggagggggcccagactgcctgcaggtcaggcacaggggcatctacctag

SEQ ID NO: 154844 - DNA, 868 bp, Homo sapiens
  Payload ID: 10446
  Gene Symbol: MAPK15
  Gene Name: mitogen-activated protein kinase 15
  ENST ID: ENST00000620781
  CDS Start-End: 39-868
cgactcaacagtaaggccccgcgggcgtcctggccgccatgtgcaccgtagtggaccctcgcattgtccggagatacctactcaggcggcagctcgggcagggggcctatggcattgtgtggaaggcagtggaccggaggactggtgaggtcgtggccatcaagaaaatctttgatgcttttagggataagacagatgcccagagaacattccgggaaatcacgctcctccaggagtttggggaccatcccaacatcatcagcctccttgacgtgatccgggcagagaacgacagggacatttacctggtgtttgagtttatgggttgcccccccagccccccacccccgactgcagtgcgcaccctctctgcagacactgacctgaacgcagtcatccggaagggcggcctgctgcaggacgtccacgtgcgctccatcttctaccagctcctgcgggccacccggttcctccactcggggcacgttgtgcaccgggaccagaagccgtccaatgtgctcctggatgccaactgcacagtgaagctgtgtgactttggcctggcccgctccctgggcgacctccccgaggggcctgaggaccaggccgtgacagagtacgtggccacacgctggtaccgagcaccggaggtgctgctctcttcgcaccgatacacccttggggtggacatgtggagtctgggctgtatcctgggggagatgctgcgggggagacccctgttccccggcacgtccaccctccaccagctggagctgatcctggagaccatcccaccgccatctgaggaggacctcctggctctcggctcaggctgccgtgcctctgtgctgcaccagctggggtcccg

SEQ ID NO: 154845 - DNA, 1961 bp, Homo sapiens; identical to SEQ ID NO: 154841
  Payload ID: 10446
  Gene Symbol: MAPK15
  Gene Name: mitogen-activated protein kinase 15
  Uniprot ID: Q8TD08
  ENST ID: ENST00000615253
  CDS Start-End: 120-1754

SEQ ID NO: 154846 - DNA, 1861 bp, Homo sapiens
  Payload ID: 10447
  Gene Symbol: MAPK3
  Gene Name: mitogen-activated protein kinase 3
  Uniprot ID: P27361
  ENST ID: ENST00000263025
  CDS Start-End: 86-1225
ctgcgggtgacaggcaggcgggaaggggcggggcctcgggcggggccgccgtggggaggagggcggtgggaggggaggagtggagatggcggcggcggcggctcaggggggcgggggcggggagccccgtagaaccgagggggtcggcccgggggtcccgggggaggtggagatggtgaaggggcagccgttcgacgtgggcccgcgctacacgcagttgcagtacatcggcgagggcgcgtacggcatggtcagctcggcctatgaccacgtgcgcaagactcgcgtggccatcaagaagatcagccccttcgaacatcagacctactgccagcgcacgctccgggagatccagatcctgctgcgcttccgccatgagaatgtcatcggcatccgagacattctgcgggcgtccaccctggaagccatgagagatgtctacattgtgcaggacctgatggagactgacctgtacaagttgctgaaaagccagcagctgagcaatgaccatatctgctacttcctctaccagatcctgcggggcctcaagtacatccactccgccaacgtgctccaccgagatctaaagccctccaacctgctcatcaacaccacctgcgaccttaagatttgtgatttcggcctggcccggattgccgatcctgagcatgaccacaccggcttcctgacggagtatgtggctacgcgctggtaccgggccccagagatcatgctgaactccaagggctataccaagtccatcgacatctggtctgtgggctgcattctggctgagatgctctctaaccggcccatcttccctggcaagcactacctggatcagctcaaccacattctgggcatcctgggctccccatcccaggaggacctgaattgtatcatcaacatgaaggcccgaaactacctacagtctctgccctccaagaccaaggtggcttgggccaagcttttccccaagtcagactccaaagcccttgacctgctggaccggatgttaacctttaaccccaataaacggatcacagtggaggaagcgctggctcacccctacctggagcagtactatgacccgacggatgagccagtggccgaggagcccttcaccttcgccatggagctggatgacctacctaaggagcggctgaaggagctcatcttccaggagacagcacgcttccagcccggagtgctggaggccccctagcccagacagacatctctgcaccctggggcctggacctgcctcctgcctgcccctctcccgccagactgttagaaaatggacactgtgcccagcccggaccttggcagcccaggccggggtggagcatgggcctggccacctctctcctttgctgaggcctccagcttcaggcaggccaaggccttctcctccccacccgccctccccacggggcctcgggacctcaggtggccccagttcaatctcccgctgctgctgctgcgcccttaccttccccagcgtcccagtctctggcagttctggaatggaagggttctggctgccccaacctgctgaagggcagaggtggagggtggggggcgctgagtagggactcagggccatgcctgcccccctcatctcattcaaaccccaccctagtttccctgaaggaacattccttagtctcaagggctagcatccctgaggagccaggccgggccgaatcccctccctgtcaaagctgtcacttcgcgtgccctcgctgcttctgtgtgtggtgagcagaagtggagctggggggcgtggagagcccggcgcccctgccacctccctgacccgtctaatatataaatatagagatgtgtctatggctga

SEQ ID NO: 154847 - DNA, 1743 bp, Homo sapiens
  Payload ID: 10447
  Gene Symbol: MAPK3
  Gene Name: mitogen-activated protein kinase 3
  Uniprot ID: P27361
  ENST ID: ENST00000322266
  CDS Start-End: 101-1108
ctggcgcgcgcggccctgcgggtgacaggcaggcgggaaggggcggggcctcgggcggggccgccgtggggaggagggcggtgggaggggaggagtggagatggcggcggcggcggctcaggggggcgggggcggggagccccgtagaaccgagggggtcggcccgggggtcccgggggaggtggagatggtgaaggggcagccgttcgacgtgggcccgcgctacacgcagttgcagtacatcggcgagggcgcgtacggcatggtcagctcggcctatgaccacgtgcgcaagactcgcgtggccatcaagaagatcagccccttcgaacatcagacctactgccagcgcacgctccgggagatccagatcctgctgcgcttccgccatgagaatgtcatcggcatccgagacattctgcgggcgtccaccctggaagccatgagagatgtctacattgtgcaggacctgatggagactgacctgtacaagttgctgaaaagccagcagctgagcaatgaccatatctgctacttcctctaccagatcctgcggggcctcaagtacatccactccgccaacgtgctccaccgagatctaaagccctccaacctgctcatcaacaccacctgcgaccttaagatttgtgatttcggcctggcccggattgccgatcctgagcatgaccacaccggcttcctgacggagtatgtggctacgcgctggtaccgggccccagagatcatgctgaactccaagggctataccaagtccatcgacatctggtctgtgggctgcattctggctgagatgctctctaaccggcccatcttccctggcaagcactacctggatcagctcaaccacattctggcccttgacctgctggaccggatgttaacctttaaccccaataaacggatcacagtggaggaagcgctggctcacccctacctggagcagtactatgacccgacggatgagccagtggccgaggagcccttcaccttcgccatggagctggatgacctacctaaggagcggctgaaggagctcatcttccaggagacagcacgcttccagcccggagtgctggaggccccctagcccagacagacatctctgcaccctggggcctggacctgcctcctgcctgcccctctcccgccagactgttagaaaatggacactgtgcccagcccggaccttggcagcccaggccggggtggagcatgggcctggccacctctctcctttgctgaggcctccagcttcaggcaggccaaggccttctcctccccacccgccctccccacggggcctcgggacctcaggtggccccagttcaatctcccgctgctgctgctgcgcccttaccttccccagcgtcccagtctctggcagttctggaatggaagggttctggctgccccaacctgctgaagggcagaggtggagggtggggggcgctgagtagggactcagggccatgcctgcccccctcatctcattcaaaccccaccctagtttccctgaaggaacattccttagtctcaagggctagcatccctgaggagccaggccgggccgaatcccctccctgtcaaagctgtcacttcgcgtgccctcgctgcttctgtgtgtggtgagcagaagtggagctggggggcgtggagagcccggcgcccctgccacctccctgacccgtctaatatataaatatagagatgtgtctatggctg

SEQ ID NO: 154848 - DNA, 1074 bp, Homo sapiens
  Payload ID: 10447
  Gene Symbol: MAPK3
  Gene Name: mitogen-activated protein kinase 3
  Uniprot ID: P27361
  ENST ID: ENST00000395199
  CDS Start-End: 1-1074
atggcggcggcggcggctcaggggggcgggggcggggagccccgtagaaccgagggggtcggcccgggggtcccgggggaggtggagatggtgaaggggcagccgttcgacgtgggcccgcgctacacgcagttgcagtacatcggcgagggcgcgtacggcatggtcagctcggcctatgaccacgtgcgcaagactcgcgtggccatcaagaagatcagccccttcgaacatcagacctactgccagcgcacgctccgggagatccagatcctgctgcgcttccgccatgagaatgtcatcggcatccgagacattctgcgggcgtccaccctggaagccatgagagatgtctacattgtgcaggacctgatggagactgacctgtacaagttgctgaaaagccagcagctgagcaatgaccatatctgctacttcctctaccagatcctgcggggcctcaagtacatccactccgccaacgtgctccaccgagatctaaagccctccaacctgctcatcaacaccacctgcgaccttaagatttgtgatttcggcctggcccggattgccgatcctgagcatgaccacaccggcttcctgacggagtatgtggctacgcgctggtaccgggccccagagatcatgctgaactccaagggctataccaagtccatcgacatctggtctgtgggctgcattctggctgagatgctctctaaccggcccatcttccctggcaagcactacctggatcagctcaaccacattctgggcatcctgggctccccatcccaggaggacctgaattgtatcatcaacatgaaggcccgaaactacctacagtctctgccctccaagaccaaggtggcttgggccaagcttttccccaagtcagactccaaagcccttgacctgctggaccggatgttaacctttaaccccaataaacggatcacagtggaggaagcgctggctcacccctacctggagcagtactatgacccgacggatgaggtgggccagtccccagcagcagtggggctgggggcaggggagcaggggggcacgtag

SEQ ID NO: 154849 - DNA, 997 bp, Homo sapiens
  Payload ID: 10447
  Gene Symbol: MAPK3
  Gene Name: mitogen-activated protein kinase 3
  ENST ID: ENST00000395200
  CDS Start-End: 29-964
cggcccgggggtcccgggggaggtggagatggtgaaggggcagccgttcgacgtgggcccgcgctacacgcagttgcagtacatcggcgagggcgcgtacggcatggtcagctcggcctatgaccacgtgcgcaagactcgcgtggccatcaagaagatcagccccttcgaacatcagacctactgccagcgcacgctccgggagatccagatcctgctgcgcttccgccatgagaatgtcatcggcatccgagacattctgcgggcgtccaccctggaagccatgagagatgtctacattgtgcaggacctgatggagactgacctgtacaagttgctgaaaagccagcagctgagcaatgaccatatctgctacttcctctaccagatcctgcggggcctcaagtacatccactccgccaacgtgctccaccgagatctaaagccctccaacctgctcatcaacaccacctgcgaccttaagggctataccaagtccatcgacatctggtctgtgggctgcattctggctgagatgctctctaaccggcccatcttccctggcaagcactacctggatcagctcaaccacattctgggcatcctgggctccccatcccaggaggacctgaattgtatcatcaacatgaaggcccgaaactacctacagtctctgccctccaagaccaaggtggcttgggccaagcttttccccaagtcagactccaaagcccttgacctgctggaccggatgttaacctttaaccccaataaacggatcacagtggaggaagcgctggctcacccctacctggagcagtactatgacccgacggatgagccagtggccgaggagcccttcaccttcgccatggagctggatgacctacctaaggagcggctgaaggagctcatcttccaggagacagcacgcttccagcccggagtgctggaggccccctagcccagacagacatctctgcaccctggggcctgg

SEQ ID NO: 154850 - DNA, 1008 bp, Homo sapiens
  Payload ID: 10447
  Gene Symbol: MAPK3
  Gene Name: mitogen-activated protein kinase 3
  Uniprot ID: P27361
  ENST ID: ENST00000395202
  CDS Start-End: 1-1008
atggcggcggcggcggctcaggggggcgggggcggggagccccgtagaaccgagggggtcggcccgggggtcccgggggaggtggagatggtgaaggggcagccgttcgacgtgggcccgcgctacacgcagttgcagtacatcggcgagggcgcgtacggcatggtcagctcggcctatgaccacgtgcgcaagactcgcgtggccatcaagaagatcagccccttcgaacatcagacctactgccagcgcacgctccgggagatccagatcctgctgcgcttccgccatgagaatgtcatcggcatccgagacattctgcgggcgtccaccctggaagccatgagagatgtctacattgtgcaggacctgatggagactgacctgtacaagttgctgaaaagccagcagctgagcaatgaccatatctgctacttcctctaccagatcctgcggggcctcaagtacatccactccgccaacgtgctccaccgagatctaaagccctccaacctgctcatcaacaccacctgcgaccttaagatttgtgatttcggcctggcccggattgccgatcctgagcatgaccacaccggcttcctgacggagtatgtggctacgcgctggtaccgggccccagagatcatgctgaactccaagggctataccaagtccatcgacatctggtctgtgggctgcattctggctgagatgctctctaaccggcccatcttccctggcaagcactacctggatcagctcaaccacattctggcccttgacctgctggaccggatgttaacctttaaccccaataaacggatcacagtggaggaagcgctggctcacccctacctggagcagtactatgacccgacggatgagccagtggccgaggagcccttcaccttcgccatggagctggatgacctacctaaggagcggctgaaggagctcatcttccaggagacagcacgcttccagcccggagtgctggaggccccctag

SEQ ID NO: 154851 - DNA, 961 bp, Homo sapiens
  Payload ID: 10447
  Gene Symbol: MAPK3
  Gene Name: mitogen-activated protein kinase 3
  ENST ID: ENST00000478356
  CDS Start-End: 554-961
cgggagaggaggaggaggcgccgagcgctttccgggacgtggagacgcggagcgtcccgaggagctcggcctatgaccacgtgcgcaagactcgcgtggccatcaagaagatcagccccttcgaacatcagacctactgccagcgcacgctccgggagatccagatcctgctgcgcttccgccatgagaatgtcatcggcatccgagacattctgcgggcgtccaccctggaagccatgagagatgtctacattgtgcaggacctgatggagactgacctgtacaagttgctgaaaagccagcagctgagcaatgaccatatctgctacttcctctaccagatcctgcggggcctcaagtacatccactccgccaacgtgctccaccgagatctaaagccctccaacctgctcatcaacaccacctgcgaccttaagatttgtgatttcggcctggcccggattgccgatcctgagcatgaccacaccggcttcctgacggaggctataccaagtccatcgacatctggtctgtgggctgcattctggctgagatgctctctaaccggcccatcttccctggcaagcactacctggatcagctcaaccacattctgggcatcctgggctccccatcccaggaggacctgaattgtatcatcaacatgaaggcccgaaactacctacagtctctgccctccaagaccaaggtggcttgggccaagcttttccccaagtcagactccaaagcccttgacctgctggaccggatgttaacctttaaccccaataaacggatcacagtggaggaagcgctggctcacccctacctggagcagtactatgacccgacggatgagccagtggccgaggagcccttcaccttcgccatggagctggatgacctacctaaggagcggctgaaggagctcatcttccaggagacagcacgcttccagccc

SEQ ID NO: 154852 - DNA, 1718 bp, Homo sapiens
  Payload ID: 10447
  Gene Symbol: MAPK3
  Gene Name: mitogen-activated protein kinase 3
  ENST ID: ENST00000490298
  CDS Start-End: 19-1038
gggaggggaggagtggagatggcggcggcggcggctcaggggggcgggggcggggagccccgtagaaccgagggggtcggcccgggggtcccgggggaggtggagatggtgaaggggcagccgttcgacgtgggcccgcgctacacgcagttgcagtacatcggcgagggcgcgtacggcatggtcagctcggcctatgaccacgtgcgcaagactcgcgtggccatcaagaagatcagccccttcgaacatcagacctactgccagcgcacgctccgggagatccagatcctgctgcgcttccgccatgagaatgtcatcggcatccgagacattctgcgggcgtccaccctggaagccatgagagatgtctacattgtgcaggacctgatggagactgacctgtacaagttgctgaaaagccagcagctgagcaatgaccatatctgctacttcctctaccagatcctgcggggcctcaagtacatccactccgccaacgtgctccaccgagatctaaagccctccaacctgctcatcaacaccacctgcgaccttaagatttgtgatttcggcctggcccggattgccgatcctgagcatgaccacaccggcttcctgacggagtatgtggctacgcgctggtaccgggccccagagatcatgctgaactccaagggctataccaagtccatcgacatctggtctgtgggctgcattctggctgagatgctctctaaccggcccatcttccctggcaagcactacctggatcagctcaaccacattctgggcatcctgggctccccatcccaggaggacctgaattgtatcatcaacatgaaggcccgaaactacctacagtctctgccctccaagaccaaggtggcttgggccaagcttttccccaagtcagactccaaagcccttgacctgctggaccggatgttaacctttaaccccaataaacggatcacatggccgaggagcccttcaccttcgccatggagctggatgacctacctaaggagcggctgaaggagctcatcttccaggagacagcacgcttccagcccggagtgctggaggccccctagcccagacagacatctctgcaccctggggcctggacctgcctcctgcctgcccctctcccgccagactgttagaaaatggacactgtgcccagcccggaccttggcagcccaggccggggtggagcatgggcctggccacctctctcctttgctgaggcctccagcttcaggcaggccaaggccttctcctccccacccgccctccccacggggcctcgggacctcaggtggccccagttcaatctcccgctgctgctgctgcgcccttaccttccccagcgtcccagtctctggcagttctggaatggaagggttctggctgccccaacctgctgaagggcagaggtggagggtggggggcgctgagtagggactcagggccatgcctgcccccctcatctcattcaaaccccaccctagtttccctgaaggaacattccttagtctcaagggctagcatccctgaggagccaggccgggccgaatcccctccctgtcaaagctgtcacttcgcgtgccctcgctgcttctgtgtgtggtgagcagaagtggagctggggggcgtggagagcccggcgcccctgccacctccctgacccgtctaatatataaatatagaga

SEQ ID NO: 154853 - DNA, 2567 bp, Homo sapiens
  Payload ID: 10447
  Gene Symbol: MAPK3
  Gene Name: mitogen-activated protein kinase 3
  ENST ID: ENST00000484663
  CDS Start-End: 1135-1932
gagcgctttccgggacgtggagacgcggagcgtcccgaggaggcaggagactcgggatgatcgggagcgtcccagggagggggcccctgagtgctttctgggggagggggcgctgcctacgtcctcaggggagcaggcttggaggctttgagtccacccttctgtaatgatgggaggggcatccgagtgcatgtgggggcccgcggggaccctagtgacacggggcgaggcccagaggatgagtactctcggggaggcgacatccttagtgaagaggcagtggagggcccgttttgggggaaagggtgtcttggattccccctgtgaggcagtgccagggagcctgggggagaagagccgagatcagggtggggcagggctttggccccaccaccccaggggcccagagagagatgaggcggccaggagtgccacctgcatgttttgggaggggtctgtgagtgcccccggccccaccgtgtgctctgggcctctatccctctgggacagccccgctgcccggatccctcaccctgggaccctcccctgccctgtccattctctcctgcccctcccctggctgccaccttcccagtatttgccccatggtgtgtccccagcatctgcacccccggacctgtcttgggttaaggagcctttcctgggaatgggggcgaagggttcagggccagtagaatggaaggggattgaggagaggggaagtcagtgagcggtcagtctcttcctctgtttgtaaagtcaccgaagggccgcctggctggtccccagctttctctctggagatcccaggcctccacagcaggaaggaaccagcattgtttatgatttgaccagagccagctcctgctctctcccctccctgccaaggcctgggtggggccaccaggcccggactccccctttgtaaggccacagcagcagcctctctccggtcccctcagctcggcctatgaccacgtgcgcaagactcgcgtggccatcaagaagatcagccccttcgaacatcagacctactgccagcgcacgctccgggagatccagatcctgctgcgcttccgccatgagaatgtcatcggcatccgagacattctgcgggcgtccaccctggaagccatgagagatgtctacattgtgcaggacctgatggagactgacctgtacaagttgctgaaaagccagcagctgagcaatgaccatatctgctacttcctctaccagatcctgcggggcctcaagtacatccactccgccaacgtgctccaccgagatctaaagccctccaacctgctcatcaacaccacctgcgaccttaagatttgtgatttcggcctggcccggattgccgatcctgagcatgaccacaccggcttcctgacggagtatgtggctacgcgctggtaccgggccccagagatcatgctgaactccaagggctataccaagtccatcgacatctggtctgtgggctgcattctggctgagatgctctctaaccggcccatcttccctggcaagcactacctggatcagctcaaccacattctgggcatcctgggctccccatcccaggaggacctgaattgtatcatcaacatgaaggcccgaaactacctacagtctctgccctccaagaccaaggtggcttgggccaagcttttccccaagtcagactccaaagcccttgacctgctggaccggatgttaacctttaaccccaataaacggatcacagtggaggaagcgctggctcacccctacctggagcagtactatgacccgacggatgagccagtggccgaggagcccttcaccttcgccatggagctggatgacctacctaaggagcggctgaaggagctcatcttccaggagacagcacgcttccagcccggagtgctggaggccccctagcccagacagacatctctgcaccctggggcctggacctgcctcctgcctgcccctctcccgccagactgttagaaaatggacactgtgcccagcccggaccttggcagcccaggccggggtggagcatgggcctggccacctctctcctttgctgaggcctccagcttcaggcaggccaaggccttctcctccccacccgccctccccacggggcctcgggacctcaggtggccccagttcaatctcccgctgctgctgctgcgcccttaccttccccagcgtcccagtctctggcagttctggaatggaagggttctggctgccccaacctgctgaagggcagaggtggagggtggggggcgctgagtagggactcagggccatgcctgcccccctcatctcattcaaaccccaccctagtttccctgaaggaacattccttagtctcaagggctagcatccctgaggagccaggccgggccgaatcccctccctgtcaaagctgtcacttcgcgtgccctcgctgcttctgtgtgtggtgagcagaagtggagctggggggcgtggagagcccggcgcccctgccacctccctgacccgtctaatatataaatatagagatgtgtctatggctg

SEQ ID NO: 154854 - DNA, 465 bp, Homo sapiens
  Payload ID: 10447
  Gene Symbol: MAPK3
  Gene Name: mitogen-activated protein kinase 3
  ENST ID: ENST00000481230
  CDS Start-End: 204-465
acgccctggccgcttcgccatcgaggggaggctcggcctatgaccacgtgcgcaagactcgcgtggccatcaagaagatcagccccttcgaacatcagacctactgccagcgcacgctccgggagatccagatcctgctgcgcttccgccatgagaatgtcatcggcatccgagacattctgcgggcgtccaccctggaagccatgagagatgtctacattgtgcaggacctgatggagactgacctgtacaagttgctgaaaagccagcagctgagcaatgaccatatctgctacttcctctaccagatcctgcggggcctcaagtacatccactccgccaacgtgctccaccgagatctaaagccctccaacctgctcatcaacaccacctgcgaccttaagatttgtgatttcggcctggcccggattgccgatcctgagcatgaccacaccggcttcctga

SEQ ID NO: 154855 - DNA, 1878 bp, Homo sapiens
  Payload ID: 10447
  Gene Symbol: MAPK3
  Gene Name: mitogen-activated protein kinase 3
  ENST ID: ENST00000466521
  CDS Start-End: 86-1036
ctgcgggtgacaggcaggcgggaaggggcggggcctcgggcggggccgccgtggggaggagggcggtgggaggggaggagtggagatggcggcggcggcggctcaggggggcgggggcggggagccccgtagaaccgagggggtcggcccgggggtcccgggggaggtggagatggtgaaggggcagccgttcgacgtgggcccgcgctacacgcagttgcagtacatcggcgagggcgcgtacggcatggtcagctcggcctatgaccacgtgcgcaagactcgcgtggccatcaagaagatcagccccttcgaacatcagacctactgccagcgcacgctccgggagatccagatcctgctgcgcttccgccatgagaatgtcatcggcatccgagacattctgcgggcgtccaccctggaagccatgagagatgtctacattgtgcaggacctgatggagactgacctgtacaagttgctgaaaagccagcagctgagcaatgaccatatctgctacttcctctaccagatcctgcggggcctcaagtacatccactccgccaacgtgctccaccgagatctaaagccctccaacctgctcatcaacaccacctgcgaccttaagatttgtgatttcggcctggcccggattgccgatcctgagcatgaccacaccggcttcctgacggagtatgtggctacgcgctggtaccgggccccagagatcatgctgaactccaagggctataccaagtccatcgacatctggtctgtgggctgcattctggctgagatgctctctaaccggcccatcttccctggcaagcactacctggatcagctcaaccacattctgggcatcctgggctccccatcccaggaggacctgaattgtatcatcaacatgaaggcccgaaactacctacagtctctgccctccaagaccaaggtggcttgggccaagcttttccccaagtcagactccaaaggttcgagagacatgaggcccttgacctgctggaccggatgttaacctttaaccccaataaacggatcacagtggaggaagcgctggctcacccctacctggagcagtactatgacccgacggatgagccagtggccgaggagcccttcaccttcgccatggagctggatgacctacctaaggagcggctgaaggagctcatcttccaggagacagcacgcttccagcccggagtgctggaggccccctagcccagacagacatctctgcaccctggggcctggacctgcctcctgcctgcccctctcccgccagactgttagaaaatggacactgtgcccagcccggaccttggcagcccaggccggggtggagcatgggcctggccacctctctcctttgctgaggcctccagcttcaggcaggccaaggccttctcctccccacccgccctccccacggggcctcgggacctcaggtggccccagttcaatctcccgctgctgctgctgcgcccttaccttccccagcgtcccagtctctggcagttctggaatggaagggttctggctgccccaacctgctgaagggcagaggtggagggtggggggcgctgagtagggactcagggccatgcctgcccccctcatctcattcaaaccccaccctagtttccctgaaggaacattccttagtctcaagggctagcatccctgaggagccaggccgggccgaatcccctccctgtcaaagctgtcacttcgcgtgccctcgctgcttctgtgtgtggtgagcagaagtggagctggggggcgtggagagcccggcgcccctgccacctccctgacccgtctaatatataaatatagagatgtgtctatggctga

SEQ ID NO: 154856 - DNA, 612 bp, Homo sapiens
  Payload ID: 10447
  Gene Symbol: MAPK3
  Gene Name: mitogen-activated protein kinase 3
  ENST ID: ENST00000461737
  CDS Start-End: 1-366
ggcatcctgggctccccatcccaggaggacctgaattgtatcatcaacatgaaggcccgaaactacctacagtctctgccctccaagaccaaggtggcttgggccaagcttttccccaagtcagactccaaagcccttgacctgctggaccggatgttaacctttaaccccaataaacggatcacagtggaggaagcgctggctcacccctacctggagcagtactatgacccgacggatgagccagtggccgaggagcccttcaccttcgccatggagctggatgacctacctaaggagcggctgaaggagctcatcttccaggagacagcacgcttccagcccggagtgctggaggccccctagcccagacagacatctctgcaccctggggcctggaacagaactggcaaagaggcaagaggtcactgagggcctctgtcacccaggacctgcctcctgcctgcccctctcccgccagactgttagaaaatggacactgtgcccagcccggaccttggcagcccaggccggggtggagcatgggcctggccacctctctcctttgctgaggcctccagcttcaggcaggccaaggccttctcctcccca

SEQ ID NO: 154857 - DNA, 4770 bp, Homo sapiens
  Payload ID: 10448
  Gene Symbol: MAPK4
  Gene Name: mitogen-activated protein kinase 4
  Uniprot ID: P31152
  ENST ID: ENST00000400384
  CDS Start-End: 1037-2800
gcgggagccggagcccgagctggagcagcgagccgggctgtcggggcgaccgcgggagctcgccgtgcgccgtggctgggaccggcctggccgagcgcgccggcgccgcggccgcagacaaagggcggctcgcgcccgggccgccacgctctcgggctctgcctcgggaaggagacttggtctgaaagatgccacattcctgcagcctctcttggtgcagtggaatacagtcttgggcgaggtggcgtggatgagctggtgaaagaggatgctgcccacatccaaaggctccagaggatcctggcctggcagctgagctcccctgcatttggaacctcaggcgtaacttggtgtagagctcatgaaaggtgcttgtgtttctccagcttttttcaccagtgcttaccagactggctcaggttttggaatctaaggtgagctggtagaaacaggagaggtagaaagaagcccctggatgcctccagaattcattgatgggatccctgcatactgcttggaacacagaaagaggctgtgacacagctgagctttggagcatcttaaggagctcagctcagcaaacaactcttgcatttcagccagaaagagcctcttgtaacaaagtattcaaaggggagagtttctgcatcttttactttgcagtccactatggtagaaaacttgacattccatagataatgatactgggttttctttccaagatgccagctttaaaagaaatatgagccattctaagctttaagaagggttcaggaaacacaggaattagtagacagccctcccaatgcaggttaagacgacagcctgcgcccccaactagcacagctcagcgagcatgaccatatgccattctcgtctccagagagctggtggcagtgacctcactaggagaaaacacatccctcagccgtgggacttgacagaatgaggtgcgcgagggaggccgctagccgagacttggcctttcctgactgcccctgtgttacctgggcagctccagatcactgagcccacaatggctgagaagggtgactgcatcgccagtgtctatgggtatgacctcggtgggcgctttgttgacttccaacccctgggcttcggtgtcaatggtttggtgctgtcggccgtggacagccgggcctgccggaaggtcgctgtgaagaagattgccctgagcgatgcccgcagcatgaagcacgcgctccgagagatcaagatcattcggcgcctggaccacgacaacatcgtcaaagtgtacgaggtgctcggtcccaagggcactgacctgcagggtgagctgttcaagttcagcgtggcgtacatcgtccaggagtacatggagaccgacctggcacgcctgctggagcagggcacgctggcagaagagcatgccaagctgttcatgtaccagctgctccgcgggctcaagtacatccactccgccaacgtgctgcacagggacctgaagcccgccaacatcttcatcagcacagaggacctcgtgctcaagattggggatttcgggttggcaaggatcgttgatcagcattactcccacaagggttatctgtcagaagggttggtaacaaagtggtaccgttccccacgactgctcctttcccccaataactacaccaaagccatcgacatgtgggccgccggctgcatcctggctgagatgcttacggggagaatgctctttgctggggcccatgagctggagcagatgcaactcatcctggagaccatccctgtaatccgggaggaagacaaggacgagctgctcagggtgatgccttcctttgtcagcagcacctgggaggtgaagaggcctctgcgcaagctgctccctgaagtgaacagtgaagccatcgactttctggagaagatcctgacctttaaccccatggatcgcctaacagctgagatggggctgcaacacccctacatgagcccatactcgtgccctgaggacgagcccacctcacaacaccccttccgcattgaggatgagatcgacgacatcgtgctgatggccgctaaccagagccagctgtccaactgggacacgtgcagttccaggtaccctgtgagcctgtcgtcggacctggagtggcggcctgaccggtgccaggacgccagcgaggtacagcgcgacccgcgcgcgggttcggcgccactggctgaggacgtgcaggtggacccgcgcaaggactcgcacagcagctccgagcgcttcctagagcagtcgcactcgtccatggagcgcgccttcgaggccgactacgggcgctcctgcgactacaaggtggggtcgccgtcctacctggacaagctgctgtggcgcgacaacaagccgcaccactactcggagcccaagctcatcctggacctgtcgcactggaagcaggcggccggcgcgccccccacggccacggggctggcggacacgggggcgcgcgaggacgagccggccagcctcttcctggagatcgcgcagtgggtcaagagcacgcagggcggcccagagcacgccagcccgcccgccgacgaccccgagcgccgcttgtctgcctcgccccccggccgcccggccccggtggacggcggcgccagcccccagttcgacctggacgtgttcatctcccgcgccctgaagctctgcaccaagcccgaggacctgccggacaataaactgggcgacctcaatggtgcgtgcatccccgagcaccctggcgacctcgtgcagaccgaggccttctccaaagaaaggtggtgagggcggaggggccgctccaggccccacagagcaggagacccccagagaaagccggggctggcaggaggcggccgcccttcccgcccctctctgctgccttggggttggcagaacacgtgaaggatccgaggagcgagaggaatgtccatttcttaaactgccttaataactagcctttaacctgtgggagcgggtttgaacaggaccctggcttaggggttgatcactttcctagcaaaggggagaccacatgtggtgcacagggaagaaacggctttagacagcagtctgcgggccccacctgggtggcaggatgccgagaaatcttgcagaggtagctccgaaaccatctggcccaactagcctcaactgacagctgaggaaaggcaattaggcccagagaggcagagacactcgcttaagatcacaggcttagtgtgaggacgagcttgaaatcccagtctcctggcccccaggccagggtctgtccaccatagaatgtcttcctctactggggtcgttctggctttttgttagaaacttggtctgagatgtttcttccctgtccattaccattcgatgttcttttattcagagcaatgtttcttgtattctgaaactggaaactgaaccagtttgtttctcctagtcaccaagcatactttcctggctccccaagtacttaaatgttctcatctgtcgcacccctgtatttgcctcacccctgcatggtcggaaatcttcgtttcaggtcagaacagcctggggtctgtgggtaaaatcagcccttctcccaggcctgtgcacacaccccctcagcactccctatgcactttcctgacacgcaaagacacagccctctttccccactgggcgtcctaccccagtgaggttgaaggcaccaattccaagaatccctccaacctccctgccagcactcccccttcaccccacacccggcccccccacctaaccacagcgcctctccagacctacctcgggacctaatgttctctacatgaactgctcatttggaggacagcagtgaggtcctgccatagagcaaatgtgttaggagagaaggtttcacatgggacccaacatccttcatcaatactttcctgagtttgatcatccatttagccttgacaaacagcagaccctacagagatgtgttggagagcacgtcgtgaccttgggggcaaggaatccagaaaggtaggaagatatgaaaagagaggtgtcaacagcaagggctcttaggggtcaggcaccagcatggagacctcatgacaaaggaagggactcaaagcagcaatgcccctcatagtgtaggctaaggtgagtttggtgcatgcaaacctgtgtgctcacccacagagcatggggtaatggtgtgtagacacaggccctctgcagaagcgtggggtggggacactgacagcccctatctggtccccaggaacattctaccatttctgccactggtgttcagctccttctcttcccccaacactcccaaagatacccacaggaagtccagccagtttccaggtagaggattccaccagttggtcttgggctgcgttcaccctcacatcacagcaccttaaatctaatcagcaaactataatttgtacgttgaaacctgcaacacattagaaacttatatttaaaaacagaattaatcacactgaccaacttttaaatggaaaatatgtaaataggaagtgtttgggttttgttttttctttaagaaaaagaaatgtacaccactcctcatgtgccattttgtcctcagagggcggctttacttttttggtaaaggaacaagctgctggccttgaccaggagttcatatataactgttattacagaggaattgttataactactaatgtttttaaaaaatttattaaacattattaaacttgatcaggtcaggccaaataaagttttattggaacaca

SEQ ID NO: 154858 - DNA, 1576 bp, Homo sapiens
  Payload ID: 10448
  Gene Symbol: MAPK4
  Gene Name: mitogen-activated protein kinase 4
  ENST ID: ENST00000540640
  CDS Start-End: 199-1329
gagctcgccgtgcgccgtggctgggaccggcctggccgagcgcgccggcgccgcggccgcagacaaagggcggctcgcgcccgggccgccacgctctcgggctctgcctcgggttatctgtcagaagggttggtaacaaagtggtaccgttccccacgactgctcctttcccccaataactacaccaaagccatcgacatgtgggccgccggctgcatcctggctgagatgcttacggggagaatgctctttgctggggcccatgagctggagcagatgcaactcatcctggagaccatccctgtaatccgggaggaagacaaggacgagctgctcagggtgatgccttcctttgtcagcagcacctgggaggtgaagaggcctctgcgcaagctgctccctgaagtgaacagtgaagccatcgactttctggagaagatcctgacctttaaccccatggatcgcctaacagctgagatggggctgcaacacccctacatgagcccatactcgtgccctgaggacgagcccacctcacaacaccccttccgcattgaggatgagatcgacgacatcgtgctgatggccgctaaccagagccagctgtccaactgggacacgtgcagttccaggtaccctgtgagcctgtcgtcggacctggagtggcggcctgaccggtgccaggacgccagcgaggtacagcgcgacccgcgcgcgggttcggcgccactggctgaggacgtgcaggtggacccgcgcaaggactcgcacagcagctccgagcgcttcctagagcagtcgcactcgtccatggagcgcgccttcgaggccgactacgggcgctcctgcgactacaaggtggggtcgccgtcctacctggacaagctgctgtggcgcgacaacaagccgcaccactactcggagcccaagctcatcctggacctgtcgcactggaagcaggcggccggcgcgccccccacggccacggggctggcggacacgggggcgcgcgaggacgagccggccagcctcttcctggagatcgcgcagtgggtcaagagcacgcagggcggcccagagcacgccagcccgcccgccgacgaccccgagcgccgcttgtctgcctcgccccccggccgcccggccccggtggacggcggcgccagcccccagttcgacctggacgtgttcatctcccgcgccctgaagctctgcaccaagcccgaggacctgccggacaataaactgggcgacctcaatggtgcgtgcatccccgagcaccctggcgacctcgtgcagaccgaggccttctccaaagaaaggtggtgagggcggaggggccgctccaggccccacagagcaggagacccccagagaaagccggggctggcaggaggcggccgcccttcccgcccctctctgctgccttggggttggcagaacacgtgaaggatccgaggagcgagaggaatgtccatttcttaaactgccttaataactagcctttaacctgtgggagcgggtttgaacaggaccctggcttaggggttgatcactttcctagcaaaggggagac

SEQ ID NO: 154859 - DNA, 3144 bp, Homo sapiens
  Payload ID: 10448
  Gene Symbol: MAPK4
  Gene Name: mitogen-activated protein kinase 4
  ENST ID: ENST00000588540
  CDS Start-End: 989-1834
gagttcagattcggatcgcagtcccgattatcctcccctccagcctctccctttctcgttgaagggttaatacagcgtcctctcccctcgccacccgacagaggcgcctacactggcgggaaggagacttggtctgaaagatgccacattcctgcagcctctcttggtgcagtggaatacagtcttgggcgaggtggcgtggatgagctggtgaaagaggatgctgcccacatccaaaggctccagaggatcctggcctggcagctgagctcccctgcatttggaacctcaggcgtaacttggtgtagagctcatgaaaggtgcttgtgtttctccagcttttttcaccagtgcttaccagactggctcaggttttggaatctaaggtgagctggtagaaacaggagaggtagaaagaagcccctggatgcctccagaattcattgatgggatccctgcatactgcttggaacacagaaagaggctgtgacacagctgagctttggagcatcttaaggagctcagctcagcaaacaactcttgcatttcagccagaaagagcctcttgtaacaaagtattcaaaggggagagtttctgcatcttttactttgcagtccactatggtagaaaacttgacattccatagataatgatactgggttttctttccaagatgccagctttaaaagaaatatgagccattctaagctttaagaagggttcaggaaacacaggaattagtagacagccctcccaatgcaggttaagacgacagcctgcgcccccaactagcacagctcagcgagcatgaccatatgccattctcgtctccagagagctggtggcagtgacctcactaggagaaaacacatccctcagccgtgggacttgacagaatgaggtgcgcgagggaggccgctagccgagacttggcctttcctgactgcccctgtgttacctgggcagctccagatcactgagcccacaatggctgagaagggtgactgcatcgccagtgtctatgggtatgacctcggtgggcgctttgttgacttccaacccctgggcttcggtgtcaatggtttggtgctgtcggccgtggacagccgggcctgccggaaggtcgctgtgaagaagattgccctgagcgatgcccgcagcatgaagcacgcgctccgagagatcaagatcattcggcgcctggaccacgacaacatcgtcaaagtgtacgaggtgctcggtcccaagggcactgacctgcagggtgagctgttcaagttcagcgtggcgtacatcgtccaggagtacatggagaccgacctggcacgcctgctggagcagggcacgctggcagaagagcatgccaagctgttcatgtaccagctgctccgcgggctcaagtacatccactccgccaacgtgctgcacagggacctgaagcccgccaacatcttcatcagcacagaggacctcgtgctcaagattggggatttcgggttggcaaggatcgttgatcagcattactcccacaagtctactgattgcatcacaagcattgtgggtcacattccagagccttctgagaagggagaagtcagggaagttccttttgttcttctgagcgttctctgcaagtcaaactggggagagttccagtcctgtggggtgggagcagctgtgaagaggctggaatcggagggaactttggggcctggaggcctaatggaggactctgtgatgttggactatgttgtgtcgttaccctccctgcctctgcatcctcttctgtggagcagggacaatgacagcagccatcctgggagagcatcatgatgaccaaatggaaggaaacagagggtgaggagcaccccaagcacatggtcagcacctggcaggtggctgttattattacccactcctcaaaagtgcttttggactcacattttctttctttctttttgagggtggaggtgtagagaggtgaaataaagctctgagtctgacctccaggttggtcccaggcaagattagcagcctgaggggtccggcttccacacggtagcatgaatagcatgttcaatagaaaaccggacccataccccacacggcagagggctaggcttgagcacagacactacctttgtcctgagatttctacatggcaatgaaacttcgagctaattttctcctgactggtggtcagttcctgaatttcatgggcatatcaatcattcctttagctcaacgtttttactccattcattcacccgattgtaagtgagcgcctatcttgtacagaggtgcactgcagacagagggaaaacaactggctcttgccttcaggagccctcgctgcctcccctgctatagagttaatgaagttagatgaaggggtccaggaggctgtgtgaacacaaagccttgccagctaagtcagagaggagggtcctgcagtaatatccccaaatgtaaaatgaaaaataaataccttcaacagggttctcaggaggtgagctgagctactgctggcaaaatcccttgtacagagtggatgtcaacaaatattccctcccctccctaatgtgctctcagttatgtacctggatgttaataagggagctgagagaaaagtttgctaggagggcggagaaagtttccaccctcctcgggggaagaggtcggggacagaaaggggaggcctggggctcagagaccaacgtctcatgtcttctaccacatggccacgtggctcgccccttgactcactctggtctctgctcgaatgtccccttacatgagaggcctttctggaccacccaccccatcactctctatctccttaccctgctttatttccattccttgcacttatctccactagacatatcatccatttgtttgttcagctgtctttccatccaaagtgtgcacctcatgattacagggactttgttttgctcactgctgggatcagatctcagctctgccaattattagttaatttgatcttgctcaagttagccccatctctctacctgtttcacagggtcattttgataattaaatgcactattaataaagcagtacttggcacggtgcctggcacatcataatttctcaataaacgatagctattattatga

SEQ ID NO: 154860 - DNA, 4330 bp, Homo sapiens
  Payload ID: 10448
  Gene Symbol: MAPK4
  Gene Name: mitogen-activated protein kinase 4
  ENST ID: ENST00000592595
  CDS Start-End: 973-1674
gtgcgccgtggctgggaccggcctggccgagcgcgccggcgccgcggccgcagacaaagggcggctcgcgcccgggccgccacgctctcgggctctgcctcgggaaggagacttggtctgaaagatgccacattcctgcagcctctcttggtgcagtggaatacagtcttgggcgaggtggcgtggatgagctggtgaaagaggatgctgcccacatccaaaggctccagaggatcctggcctggcagctgagctcccctgcatttggaacctcaggcgtaacttggtgtagagctcatgaaaggtgcttgtgtttctccagcttttttcaccagtgcttaccagactggctcaggttttggaatctaaggtgagctggtagaaacaggagaggtagaaagaagcccctggatgcctccagaattcattgatgggatccctgcatactgcttggaacacagaaagaggctgtgacacagctgagctttggagcatcttaaggagctcagctcagcaaacaactcttgcatttcagccagaaagagcctcttgtaacaaagtattcaaaggggagagtttctgcatcttttactttgcagtccactatggtagaaaacttgacattccatagataatgatactgggttttctttccaagatgccagctttaaaagaaatatgagccattctaagctttaagaagggttcaggaaacacaggaattagtagacagccctcccaatgcaggttaagacgacagcctgcgcccccaactagcacagctcagcgagcatgaccatatgccattctcgtctccagagagctggtggcagtgacctcactaggagaaaacacatccctcagccgtgggacttgacagaatgaggtgcgcgagggaggccgctagccgagacttggcctttcctgactgcccctgtgttacctgggcagctccagatcactgagcccacaatggctgagaagggtgactgcatcgccagtgtctatgggtatgacctcggtgggcgctttgttgacttccaacccctgggcttcggtgtcaatggtttggtgctgtcggccgtggacagccgggcctgccggaaggtcgctgtgaagaagattgccctgagcgatgcccgcagcatgaagcacgcgctccgagagatcaagatcattcggcgcctggaccacgacaacatcgtcaaagtgtacgaggtgctcggtcccaagggcactgacctgcagggtgagctgttcaagttcagcgtggcgtacatcgtccaggagtacatggagaccgacctggcacgcctgctggagcagggcacgctggcagaagagcatgccaagctgttcatgtaccagctgctccgcgggctcaagtacatccactccgccaacgtgctgcacagggacctgaagcccgccaacatcttcatcagcacagaggacctcgtgctcaagattggggatttcgggttggcaaggatcgttgatcagcattactcccacaagggttatctgtcagaagggttggtaacaaagtggtaccgttccccacgactgctcctttcccccaataactacaccaaagccatcgacatgtgggccgccggctgcatcctggctgagatgcttacggggagaatgctctttgctggtaccctgtgagcctgtcgtcggacctggagtggcggcctgaccggtgccaggacgccagcgaggtacagcgcgacccgcgcgcgggttcggcgccactggctgaggacgtgcaggtggacccgcgcaaggactcgcacagcagctccgagcgcttcctagagcagtcgcactcgtccatggagcgcgccttcgaggccgactacgggcgctcctgcgactacaaggtggggtcgccgtcctacctggacaagctgctgtggcgcgacaacaagccgcaccactactcggagcccaagctcatcctggacctgtcgcactggaagcaggcggccggcgcgccccccacggccacggggctggcggacacgggggcgcgcgaggacgagccggccagcctcttcctggagatcgcgcagtgggtcaagagcacgcagggcggcccagagcacgccagcccgcccgccgacgaccccgagcgccgcttgtctgcctcgccccccggccgcccggccccggtggacggcggcgccagcccccagttcgacctggacgtgttcatctcccgcgccctgaagctctgcaccaagcccgaggacctgccggacaataaactgggcgacctcaatggtgcgtgcatccccgagcaccctggcgacctcgtgcagaccgaggccttctccaaagaaaggtggtgagggcggaggggccgctccaggccccacagagcaggagacccccagagaaagccggggctggcaggaggcggccgcccttcccgcccctctctgctgccttggggttggcagaacacgtgaaggatccgaggagcgagaggaatgtccatttcttaaactgccttaataactagcctttaacctgtgggagcgggtttgaacaggaccctggcttaggggttgatcactttcctagcaaaggggagaccacatgtggtgcacagggaagaaacggctttagacagcagtctgcgggccccacctgggtggcaggatgccgagaaatcttgcagaggtagctccgaaaccatctggcccaactagcctcaactgacagctgaggaaaggcaattaggcccagagaggcagagacactcgcttaagatcacaggcttagtgtgaggacgagcttgaaatcccagtctcctggcccccaggccagggtctgtccaccatagaatgtcttcctctactggggtcgttctggctttttgttagaaacttggtctgagatgtttcttccctgtccattaccattcgatgttcttttattcagagcaatgtttcttgtattctgaaactggaaactgaaccagtttgtttctcctagtcaccaagcatactttcctggctccccaagtacttaaatgttctcatctgtcgcacccctgtatttgcctcacccctgcatggtcggaaatcttcgtttcaggtcagaacagcctggggtctgtgggtaaaatcagcccttctcccaggcctgtgcacacaccccctcagcactccctatgcactttcctgacacgcaaagacacagccctctttccccactgggcgtcctaccccagtgaggttgaaggcaccaattccaagaatccctccaacctccctgccagcactcccccttcaccccacacccggcccccccacctaaccacagcgcctctccagacctacctcgggacctaatgttctctacatgaactgctcatttggaggacagcagtgaggtcctgccatagagcaaatgtgttaggagagaaggtttcacatgggacccaacatccttcatcaatactttcctgagtttgatcatccatttagccttgacaaacagcagaccctacagagatgtgttggagagcacgtcgtgaccttgggggcaaggaatccagaaaggtaggaagatatgaaaagagaggtgtcaacagcaagggctcttaggggtcaggcaccagcatggagacctcatgacaaaggaagggactcaaagcagcaatgcccctcatagtgtaggctaaggtgagtttggtgcatgcaaacctgtgtgctcacccacagagcatggggtaatggtgtgtagacacaggccctctgcagaagcgtggggtggggacactgacagcccctatctggtccccaggaacattctaccatttctgccactggtgttcagctccttctcttcccccaacactcccaaagatacccacaggaagtccagccagtttccaggtagaggattccaccagttggtcttgggctgcgttcaccctcacatcacagcaccttaaatctaatcagcaaactataatttgtacgttgaaacctgcaacacattagaaacttatatttaaaaacagaattaatcacactgaccaacttttaaatggaaaatatgtaaataggaagtgtttgggttttgttttttctttaagaaaaagaaatgtacaccactcctcatgtgccattttgtcctcagagggcggctttacttttttggtaaaggaacaagctgctggccttgaccaggagttcatatataactgttattacagaggaattgttataactactaatgtttttaaaaaatttattaaacattattaaacttgatcaggtcaggccaaataaagttttattggaacaca

SEQ ID NO: 154861 - DNA, 5345 bp, Homo sapiens
  Payload ID: 10449
  Gene Symbol: MAPK6
  Gene Name: mitogen-activated protein kinase 6
  Uniprot ID: Q16659
  ENST ID: ENST00000261845
  CDS Start-End: 808-2973
cgcgaagccccgccccctcttcctcgccctctctcgcgggtcggggttacatggcggcgactgcggcaaagcgagagcctcggagacgccgctgccgccagcacagccggagacctgagccgacactgggggcagtccgcgagccccgcactctctcgatgagtcggagaagtcccgttgtatcagagtaagatggacggtagctttgattgtgattgtggtgagctggagccacctgatcactaacaaaagacatcttctgttaaccaacagccgccagggcttcctgttgaaataaatatatagcaacaaaggaaaaaaagaagcaaaacggaaatagtgcttaccagcaccttagaatgatgctgctcaggaccagtccaacactgaatgtatctgcactgtgaggagaatgttcatagaagcctgttgtgtgcatatttattcacatttttgttaaatgttaaatcgtttagcacggtaatctgagtgcacagtatgtcatttcattccgtttgagtttcttgttttcgttaaatgtctgcagagttgctgcccctttcttgaactatgagtactgcaatctttttaattctcaatatgaatagagctttttgagctttaaatctaaggggaactcgacaggcctgtttggcatatgcaatgaacatcaagaaaccatcttgctgtggaagcataattatttttcttctccctttttgaaagatctttccttttgatgccagttttcttccttgtttacacaagttcaatttgaaaggaaaaggcaatagtaagggtttcaaaatggcagagaaatttgaaagtctcatgaacattcatggttttgatctgggttctaggtatatggacttaaaaccattgggttgtggaggcaatggcttggttttttctgctgtagacaatgactgtgacaaaagagtagccatcaagaaaattgtccttactgatccccagagtgtcaaacatgctctacgtgaaatcaaaattattagaagacttgaccatgataacattgtgaaagtgtttgagattcttggtcccagtggaagccaattaacagacgatgtgggctctcttacggaactgaacagtgtttacattgttcaggagtacatggagacagacttggctaatgtgctggagcagggccctttactggaagagcatgccaggcttttcatgtatcagctgctacgggggctcaagtatattcactctgcaaatgtactgcacagagatctcaaaccagctaatcttttcattaatacggaagacttggtgctgaagataggtgactttggtcttgcacggatcatggatcctcattattcccataagggtcatctttctgaaggattggttactaaatggtacagatctccacgtcttttactttctcctaataattatactaaagccattgacatgtgggctgcaggctgcatctttgctgaaatgctgactggtaaaaccctttttgcaggtgcacatgaacttgaacagatgcagctgattttagaatctattcctgttgtacatgaggaagatcgtcaggagcttctcagcgtaattccagtttacattagaaatgacatgactgagccacacaaacctttaactcagctgcttccaggaattagtcgagaagcactggatttcctggaacaaattttgacatttagccccatggatcggttaacagcagaagaagcactctcccatccttacatgagcatatattcttttccaatggatgagccaatttcaagccatccttttcatattgaagatgaagttgatgatattttgcttatggatgaaactcacagtcacatttataactgggaaaggtatcatgattgtcagttttcagagcatgattggcctgtacataacaactttgatattgatgaagttcagcttgatccaagagctctgtccgatgtcactgatgaagaagaagtacaagttgatccccgaaaatatttggatggagatcgggaaaagtatctggaggatcctgcttttgataccaattactctactgagccttgttggcaatactcagatcatcatgaaaacaaatattgtgatctggagtgtagccatacttgtaactacaaaacgaggtcatcatcatatttagataacttagtttggagagagagtgaagttaaccattactatgaacccaagcttattatagatctttccaattggaaagaacaaagcaaagaaaaatctgataagaaaggcaaatcaaaatgtgaaaggaatggattggttaaagcccagatagcgctagaggaagcatcacagcaactggctggaaaagaaagggaaaagaatcagggatttgattttgattcctttattgcaggaactattcagcttagttcccagcatgagcctactgatgttgttgataaattaaatgacttgaatagctcagtgtcccaactagaattgaaaagtttgatatcaaagtcagtaagccaagaaaaacaggaaaaaggaatggcaaatctggctcaattagaagccttgtaccagtcttcttgggacagccagtttgtgagtggtggggaggactgttttttcataaatcagttttgtgaggtaaggaaggatgaacaagttgagaaggaaaacacttacactagttacttggacaagttctttagcaggaaagaagatactgaaatgctagaaactgagccagtagaggatgggaagcttggggagagaggacatgaggaaggatttctgaacaacagtggggagttcctctttaacaagcagctcgagtccataggcatcccacagtttcacagtccagttgggtcaccacttaagtcaatacaggccacattaacaccttctgctatgaaatcttcccctcaaattcctcatcaaacatacagcagcattctgaaacatctgaactaaaacactcagcagacatttatctttgtattcttcatgaaatgtgttttgtctttttttattactagtgtttaagtcattttttacttgaatcagatggtgtcatttagtaaggattttatgagttcttgttttttaaaatccagactttctttttctacatgtgagatagttttcattttaactggcatgtcatttgcacacaaaaataaagactagagcaaaataatgcaacgcaggaggagaaaagaaatgcactaagacaagaacattctctcatagaacattgatctgttttacaggaaacaaaccttgccttgaaatttacacagtgagactgtacataattgcatgaaaatagctatttttttcctaagacatttttcattcatgaatattttcaagtttttcatactgtacacatttcttaaaacacatgataccagcagcaactgaaaatgaatgccgaatttggtacacatgtgttatctacctcaaggtaacaagagtatgtggcaaaacatataccacccatagtgcttcacaaaatgcacttctatttagccagcgtttattgtagtaaactattcttaataaaactcactcactgtttataaatgttctggtatgcattctttatagtgaagtgttaatacatcacatcttatttattttagcaaatcagtatattttctgtatttaattataaaaaattaacttagtttttaaaatttatttgcaaatatactttactttttccatttggcactatggtttgttgcctacctagctgcatctataatgtcagcttatcctaaggctgtccacgtacttaatttacttaagtgttcattttaagtaacgtgctcactgtgtataggaatttgtattttggaggtgcttgatctatctacaaagaaaaattaattaggaattactttattataaaatgctcctagaagtcttaattgtgtttattttttaaaaaaacaaatgttagacttgtgtgcatggaagtaattaaggtacatcattattgtagtttgaaagttgtacatgataagacattttgtttttactgtatgtttttactgaatgatctattccccatcccaaggcaagcatgaataaaattaggttaaacgtagcatgtggcatcgcagtctcttagaatttgtttcatctattttattttattgaatactgtctgtatctttggttatcctgtttgaagaaaaaggacaaataaaacatggccagcaaatacagctcctgtttcactcttgggttaatgaaaattttctgctagaatgaaaattactaccagaatcactttgaattatggccataaattgctagtctgaaaggctgagaaggttcaagtcttttgacttaaaccatcacatattagaatggaataaagctttataatatttcaaaactgttaggtaaaatgtgtagttgaaactttgaactgtgcagtcagaaaacttgagatttgctctgtaatacatctttgcgtaagaacttacccttttacctatccagctacaaaaccatcctcttcacctcacttttctttcatccttgttttgtacaacaccaattctattaatatctgcccacctaccttctcaacaactccatcctcttcacctcacttttctttcatccttgttttgtacaacaccaattctattaatatctgcccacctaccttctcaacaactgacttcatctggattcacaaagccatatatatacacgtgtgtgtgtgtgtgtgtgtgtgtgtgtgtatatatattcatttatttattttctggttgaatactgtcacgttattaatttaaacatactcaaattaccttaagaggacaagctctgaagtgcagtcatgagaattgatttgtggggaaaaaaaaaatgggacacttttagttggagctgggtggggtgacaagtgcagaggctttgagtgtcatgagagcatcagacaggatgtaaaggaagcaacgggcagcagacattggtccctgatcctccattataaccaattttttgcaaacgtatgttgattttgagaataattagctttgactctaaaatgctgtcttccctgaaggagacctaggatttttcttactgggaaacttggctcctggacttaatccacattcgttaaactgtcaccttggcagtttagtggccatctacacaatgatctgacttgttggcattaaaaagtccaaacatagtcatcaaaggaagaagaaagtaaaactgaaaccccttatataaaatatgcttgctttagggtgacccaggctgagtactaagttgtaaagtcaatttccaataaaaattttatgtgccaa

SEQ ID NO: 154862 - DNA, 2715 bp, Homo sapiens
  Payload ID: 10450
  Gene Symbol: MAPK7
  Gene Name: mitogen-activated protein kinase 7
  Uniprot ID: Q13164
  ENST ID: ENST00000299612
  CDS Start-End: 369-2402
cgcgggctccgcagaggagcagaggttgggcggccgcctcggttaactccgctgcagcccaaagcacgggaatcgcgggacagacaaacgagcggagggaagatacctagaagccaggaaaccgcgagctgcagtccaacttggccggaagctgcggagaggctcagccaccggaagtcagtggagggttcggccggacgctctagaatcccggaggaccgggatctctgtggttggccgtgacgggcaccctctaccggggatgacacattcccagagctcctgggaccaagcaaatggcggacacaattccctgggcggaaggggacttcgggagccagtagccaagctacgtggtcctggacctgatggaaagcgacctgcaccagatcatccactcctcacagcccctcacactggaacacgtgcgctacttcctgtaccaactgctgcggggcctgaagtacatgcactcggctcaggtcatccaccgtgacctgaagccctccaacctattggtgaatgagaactgtgagctcaagattggtgactttggtatggctcgtggcctgtgcacctcgcccgctgaacatcagtacttcatgactgagtatgtggccacgcgctggtaccgtgcgcccgagctcatgctctctttgcatgagtatacacaggctattgacctctggtctgtgggctgcatctttggtgagatgctggcccggcgccagctcttcccaggcaaaaactatgtacaccagctacagctcatcatgatggtgctgggtaccccatcaccagccgtgattcaggctgtgggggctgagagggtgcgggcctatatccagagcttgccaccacgccagcctgtgccctgggagacagtgtacccaggtgccgaccgccaggccctatcactgctgggtcgcatgctgcgttttgagcccagcgctcgcatctcagcagctgctgcccttcgccaccctttcctggccaagtaccatgatcctgatgatgagcctgactgtgccccgccctttgactttgcctttgaccgcgaagccctcactcgggagcgcattaaggaggccattgtggctgaaattgaggacttccatgcaaggcgtgagggcatccgccaacagatccgcttccagccttctctacagcctgtggctagtgagcctggctgtccagatgttgaaatgcccagtccctgggctcccagtggggactgtgccatggagtctccaccaccagccccgccaccatgccccggccctgcacctgacaccattgatctgaccctgcagccacctccaccagtcagtgagcctgccccaccaaagaaagatggtgccatctcagacaatactaaggctgcccttaaagctgccctgctcaagtctttgaggagccggctcagagatggccccagcgcacccctggaggctcctgagcctcggaagccggtgacagcccaggagcgccagcgggagcgggaggagaagcggcggaggcggcaagaacgagccaaggagcgggagaaacggcggcaggagcgggagcgaaaggaacggggggctggggcctctgggggcccctccactgaccccttggctggactagtgctcagtgacaatgacagaagcctgttggaacgctggactcgaatggcccggcccgcagccccagccctcacctctgtgccggcccctgccccagcgccaacgccaaccccaaccccagtccaacctaccagtcctcctcctggccctgtagcccagcccactggcccgcaaccacaatctgcgggctctacctctggccctgtaccccagcctgcctgcccaccccctggccctgcaccccaccccactggccctcctgggcccatccctgtccccgcgccaccccagattgccacctccaccagcctcctggctgcccagtcacttgtgccaccccctgggctgcctggctccagcaccccaggagttttgccttacttcccacctggcctgccgcccccagacgccgggggagcccctcagtcttccatgtcagagtcacctgatgtcaaccttgtgacccagcagctatctaagtcacaggtggaggaccccctgccccctgtgttctcaggcacaccaaagggcagtggggctggctacggtgttggctttgacctggaggaattcttaaaccagtctttcgacatgggcgtggctgatgggccacaggatggccaggcagattcagcctctctctcagcctccctgcttgctgactggctcgaaggccatggcatgaaccctgccgatattgagtccctgcagcgtgagatccagatggactccccaatgctgctggctgacctgcctgacctccaggacccctgaggcccccagcctgtgccttgctgccacagtagacctagttccaggatccatgggagcattctcaaaggctttagccctggacccagcaggtgaggctcggcttggattattctgcaggttcatctcagacccacctttcagccttaagcagccacctgagccaccaccgagccatggcaggatcgggagaccccaactccccctgaacaatccttttcagtattatatttttattattattatgttattattacactgtctttttgccatcaaaatgaggcctgtgaaatacaaggttcccttctgcacctga

SEQ ID NO: 154863 - DNA, 3149 bp, Homo sapiens
  Payload ID: 10450
  Gene Symbol: MAPK7
  Gene Name: mitogen-activated protein kinase 7
  Uniprot ID: Q13164
  ENST ID: ENST00000308406
  CDS Start-End: 387-2837
acagctcggttccagcgagggctccgcccacccgcgggctccgcagaggagcagaggttgggcggccgcctcggttaactccgctgcagcccaaagcacgggaatcgcgggacagacaaacgagcggagggaagatacctagaagccaggaaaccgcgagctgcagtccaacttggccggaagctgcggagaggctcagccaccggaagtcagtggagggttcggccggacgctctagaatcccggaggaccgggatctctgtggttggccgtgacgggcaccctctaccggggatgacacattcccagagctcctgggaccaagcaaatggcggacacaattccctgggcggaaggggacttcgggagccagtagccaagacaccatggccgagcctctgaaggaggaagacggcgaggacggctctgcggagccccccgggcccgtgaaggccgaacccgcccacaccgctgcctctgtagcggccaagaacctggccctgcttaaagcccgctccttcgatgtgacctttgacgtgggcgacgagtacgagatcatcgagaccataggcaacggggcctatggagtggtgtcctccgcccgccgccgcctcaccggccagcaggtggccatcaagaagatccctaatgctttcgatgtggtgaccaatgccaagcggaccctcagggagctgaagatcctcaagcactttaaacacgacaacatcatcgccatcaaggacatcctgaggcccaccgtgccctatggcgaattcaaatctgtctacgtggtcctggacctgatggaaagcgacctgcaccagatcatccactcctcacagcccctcacactggaacacgtgcgctacttcctgtaccaactgctgcggggcctgaagtacatgcactcggctcaggtcatccaccgtgacctgaagccctccaacctattggtgaatgagaactgtgagctcaagattggtgactttggtatggctcgtggcctgtgcacctcgcccgctgaacatcagtacttcatgactgagtatgtggccacgcgctggtaccgtgcgcccgagctcatgctctctttgcatgagtatacacaggctattgacctctggtctgtgggctgcatctttggtgagatgctggcccggcgccagctcttcccaggcaaaaactatgtacaccagctacagctcatcatgatggtgctgggtaccccatcaccagccgtgattcaggctgtgggggctgagagggtgcgggcctatatccagagcttgccaccacgccagcctgtgccctgggagacagtgtacccaggtgccgaccgccaggccctatcactgctgggtcgcatgctgcgttttgagcccagcgctcgcatctcagcagctgctgcccttcgccaccctttcctggccaagtaccatgatcctgatgatgagcctgactgtgccccgccctttgactttgcctttgaccgcgaagccctcactcgggagcgcattaaggaggccattgtggctgaaattgaggacttccatgcaaggcgtgagggcatccgccaacagatccgcttccagccttctctacagcctgtggctagtgagcctggctgtccagatgttgaaatgcccagtccctgggctcccagtggggactgtgccatggagtctccaccaccagccccgccaccatgccccggccctgcacctgacaccattgatctgaccctgcagccacctccaccagtcagtgagcctgccccaccaaagaaagatggtgccatctcagacaatactaaggctgcccttaaagctgccctgctcaagtctttgaggagccggctcagagatggccccagcgcacccctggaggctcctgagcctcggaagccggtgacagcccaggagcgccagcgggagcgggaggagaagcggcggaggcggcaagaacgagccaaggagcgggagaaacggcggcaggagcgggagcgaaaggaacggggggctggggcctctgggggcccctccactgaccccttggctggactagtgctcagtgacaatgacagaagcctgttggaacgctggactcgaatggcccggcccgcagccccagccctcacctctgtgccggcccctgccccagcgccaacgccaaccccaaccccagtccaacctaccagtcctcctcctggccctgtagcccagcccactggcccgcaaccacaatctgcgggctctacctctggccctgtaccccagcctgcctgcccaccccctggccctgcaccccaccccactggccctcctgggcccatccctgtccccgcgccaccccagattgccacctccaccagcctcctggctgcccagtcacttgtgccaccccctgggctgcctggctccagcaccccaggagttttgccttacttcccacctggcctgccgcccccagacgccgggggagcccctcagtcttccatgtcagagtcacctgatgtcaaccttgtgacccagcagctatctaagtcacaggtggaggaccccctgccccctgtgttctcaggcacaccaaagggcagtggggctggctacggtgttggctttgacctggaggaattcttaaaccagtctttcgacatgggcgtggctgatgggccacaggatggccaggcagattcagcctctctctcagcctccctgcttgctgactggctcgaaggccatggcatgaaccctgccgatattgagtccctgcagcgtgagatccagatggactccccaatgctgctggctgacctgcctgacctccaggacccctgaggcccccagcctgtgccttgctgccacagtagacctagttccaggatccatgggagcattctcaaaggctttagccctggacccagcaggtgaggctcggcttggattattctgcaggttcatctcagacccacctttcagccttaagcagccacctgagccaccaccgagccatggcaggatcgggagaccccaactccccctgaacaatccttttcagtattatatttttattattattatgttattattacactgtctttttgccatcaaaatgaggcctgtgaaatacaaggttcccttctgcacctg

SEQ ID NO: 154864 - DNA, 3059 bp, Homo sapiens
  Payload ID: 10450
  Gene Symbol: MAPK7
  Gene Name: mitogen-activated protein kinase 7
  Uniprot ID: Q13164
  ENST ID: ENST00000395602
  CDS Start-End: 296-2746
agtgcgcatgcgtttgaaggcggtgcagggcggggagcacacccctgcgaagtgccgggcaccctttgggcggctcccgccggcgagctggacagcggcgcgcgccaggcgtggctttctcggccggtgggctaggattggacgcagtaggtagaaggggcaggaccctccgcagcagtagctcagcgattggccaggagctggagggagcgtggccttgggaggcggggcggagggggacggacagggcagctcaagacgctgaggtggtggctgcggcctttgaacaaacaccatggccgagcctctgaaggaggaagacggcgaggacggctctgcggagccccccgggcccgtgaaggccgaacccgcccacaccgctgcctctgtagcggccaagaacctggccctgcttaaagcccgctccttcgatgtgacctttgacgtgggcgacgagtacgagatcatcgagaccataggcaacggggcctatggagtggtgtcctccgcccgccgccgcctcaccggccagcaggtggccatcaagaagatccctaatgctttcgatgtggtgaccaatgccaagcggaccctcagggagctgaagatcctcaagcactttaaacacgacaacatcatcgccatcaaggacatcctgaggcccaccgtgccctatggcgaattcaaatctgtctacgtggtcctggacctgatggaaagcgacctgcaccagatcatccactcctcacagcccctcacactggaacacgtgcgctacttcctgtaccaactgctgcggggcctgaagtacatgcactcggctcaggtcatccaccgtgacctgaagccctccaacctattggtgaatgagaactgtgagctcaagattggtgactttggtatggctcgtggcctgtgcacctcgcccgctgaacatcagtacttcatgactgagtatgtggccacgcgctggtaccgtgcgcccgagctcatgctctctttgcatgagtatacacaggctattgacctctggtctgtgggctgcatctttggtgagatgctggcccggcgccagctcttcccaggcaaaaactatgtacaccagctacagctcatcatgatggtgctgggtaccccatcaccagccgtgattcaggctgtgggggctgagagggtgcgggcctatatccagagcttgccaccacgccagcctgtgccctgggagacagtgtacccaggtgccgaccgccaggccctatcactgctgggtcgcatgctgcgttttgagcccagcgctcgcatctcagcagctgctgcccttcgccaccctttcctggccaagtaccatgatcctgatgatgagcctgactgtgccccgccctttgactttgcctttgaccgcgaagccctcactcgggagcgcattaaggaggccattgtggctgaaattgaggacttccatgcaaggcgtgagggcatccgccaacagatccgcttccagccttctctacagcctgtggctagtgagcctggctgtccagatgttgaaatgcccagtccctgggctcccagtggggactgtgccatggagtctccaccaccagccccgccaccatgccccggccctgcacctgacaccattgatctgaccctgcagccacctccaccagtcagtgagcctgccccaccaaagaaagatggtgccatctcagacaatactaaggctgcccttaaagctgccctgctcaagtctttgaggagccggctcagagatggccccagcgcacccctggaggctcctgagcctcggaagccggtgacagcccaggagcgccagcgggagcgggaggagaagcggcggaggcggcaagaacgagccaaggagcgggagaaacggcggcaggagcgggagcgaaaggaacggggggctggggcctctgggggcccctccactgaccccttggctggactagtgctcagtgacaatgacagaagcctgttggaacgctggactcgaatggcccggcccgcagccccagccctcacctctgtgccggcccctgccccagcgccaacgccaaccccaaccccagtccaacctaccagtcctcctcctggccctgtagcccagcccactggcccgcaaccacaatctgcgggctctacctctggccctgtaccccagcctgcctgcccaccccctggccctgcaccccaccccactggccctcctgggcccatccctgtccccgcgccaccccagattgccacctccaccagcctcctggctgcccagtcacttgtgccaccccctgggctgcctggctccagcaccccaggagttttgccttacttcccacctggcctgccgcccccagacgccgggggagcccctcagtcttccatgtcagagtcacctgatgtcaaccttgtgacccagcagctatctaagtcacaggtggaggaccccctgccccctgtgttctcaggcacaccaaagggcagtggggctggctacggtgttggctttgacctggaggaattcttaaaccagtctttcgacatgggcgtggctgatgggccacaggatggccaggcagattcagcctctctctcagcctccctgcttgctgactggctcgaaggccatggcatgaaccctgccgatattgagtccctgcagcgtgagatccagatggactccccaatgctgctggctgacctgcctgacctccaggacccctgaggcccccagcctgtgccttgctgccacagtagacctagttccaggatccatgggagcattctcaaaggctttagccctggacccagcaggtgaggctcggcttggattattctgcaggttcatctcagacccacctttcagccttaagcagccacctgagccaccaccgagccatggcaggatcgggagaccccaactccccctgaacaatccttttcagtattatatttttattattattatgttattattacactgtctttttgccatcaaaatgaggcctgtgaaatacaaggttcccttctgcacctga

SEQ ID NO: 154865 - DNA, 3077 bp, Homo sapiens
  Payload ID: 10450
  Gene Symbol: MAPK7
  Gene Name: mitogen-activated protein kinase 7
  Uniprot ID: Q13164
  ENST ID: ENST00000395604
  CDS Start-End: 314-2764
cggctcccgccggcgagctggacagcggcgcgcgccaggcgtggctttctcggccggtgggctaggattggacgcagtaggtagaaggggcaggaccctccgcagcagtagctcagcgattggccaggagctggagggagcgtggccttgggaggcggggcggagggggacggacagggcagctcaagacgctgaggtggtggctgcggcctttgaacaagtaagtgagccaccctcggagacccccgcgctggggacgggaggccggcgagcctcgggacctctgaaagccttgaggaggcgcggggacaccatggccgagcctctgaaggaggaagacggcgaggacggctctgcggagccccccgggcccgtgaaggccgaacccgcccacaccgctgcctctgtagcggccaagaacctggccctgcttaaagcccgctccttcgatgtgacctttgacgtgggcgacgagtacgagatcatcgagaccataggcaacggggcctatggagtggtgtcctccgcccgccgccgcctcaccggccagcaggtggccatcaagaagatccctaatgctttcgatgtggtgaccaatgccaagcggaccctcagggagctgaagatcctcaagcactttaaacacgacaacatcatcgccatcaaggacatcctgaggcccaccgtgccctatggcgaattcaaatctgtctacgtggtcctggacctgatggaaagcgacctgcaccagatcatccactcctcacagcccctcacactggaacacgtgcgctacttcctgtaccaactgctgcggggcctgaagtacatgcactcggctcaggtcatccaccgtgacctgaagccctccaacctattggtgaatgagaactgtgagctcaagattggtgactttggtatggctcgtggcctgtgcacctcgcccgctgaacatcagtacttcatgactgagtatgtggccacgcgctggtaccgtgcgcccgagctcatgctctctttgcatgagtatacacaggctattgacctctggtctgtgggctgcatctttggtgagatgctggcccggcgccagctcttcccaggcaaaaactatgtacaccagctacagctcatcatgatggtgctgggtaccccatcaccagccgtgattcaggctgtgggggctgagagggtgcgggcctatatccagagcttgccaccacgccagcctgtgccctgggagacagtgtacccaggtgccgaccgccaggccctatcactgctgggtcgcatgctgcgttttgagcccagcgctcgcatctcagcagctgctgcccttcgccaccctttcctggccaagtaccatgatcctgatgatgagcctgactgtgccccgccctttgactttgcctttgaccgcgaagccctcactcgggagcgcattaaggaggccattgtggctgaaattgaggacttccatgcaaggcgtgagggcatccgccaacagatccgcttccagccttctctacagcctgtggctagtgagcctggctgtccagatgttgaaatgcccagtccctgggctcccagtggggactgtgccatggagtctccaccaccagccccgccaccatgccccggccctgcacctgacaccattgatctgaccctgcagccacctccaccagtcagtgagcctgccccaccaaagaaagatggtgccatctcagacaatactaaggctgcccttaaagctgccctgctcaagtctttgaggagccggctcagagatggccccagcgcacccctggaggctcctgagcctcggaagccggtgacagcccaggagcgccagcgggagcgggaggagaagcggcggaggcggcaagaacgagccaaggagcgggagaaacggcggcaggagcgggagcgaaaggaacggggggctggggcctctgggggcccctccactgaccccttggctggactagtgctcagtgacaatgacagaagcctgttggaacgctggactcgaatggcccggcccgcagccccagccctcacctctgtgccggcccctgccccagcgccaacgccaaccccaaccccagtccaacctaccagtcctcctcctggccctgtagcccagcccactggcccgcaaccacaatctgcgggctctacctctggccctgtaccccagcctgcctgcccaccccctggccctgcaccccaccccactggccctcctgggcccatccctgtccccgcgccaccccagattgccacctccaccagcctcctggctgcccagtcacttgtgccaccccctgggctgcctggctccagcaccccaggagttttgccttacttcccacctggcctgccgcccccagacgccgggggagcccctcagtcttccatgtcagagtcacctgatgtcaaccttgtgacccagcagctatctaagtcacaggtggaggaccccctgccccctgtgttctcaggcacaccaaagggcagtggggctggctacggtgttggctttgacctggaggaattcttaaaccagtctttcgacatgggcgtggctgatgggccacaggatggccaggcagattcagcctctctctcagcctccctgcttgctgactggctcgaaggccatggcatgaaccctgccgatattgagtccctgcagcgtgagatccagatggactccccaatgctgctggctgacctgcctgacctccaggacccctgaggcccccagcctgtgccttgctgccacagtagacctagttccaggatccatgggagcattctcaaaggctttagccctggacccagcaggtgaggctcggcttggattattctgcaggttcatctcagacccacctttcagccttaagcagccacctgagccaccaccgagccatggcaggatcgggagaccccaactccccctgaacaatccttttcagtattatatttttattattattatgttattattacactgtctttttgccatcaaaatgaggcctgtgaaatacaaggttcccttctgcacctga

SEQ ID NO: 154866 - DNA, 850 bp, Homo sapiens
  Payload ID: 10450
  Gene Symbol: MAPK7
  Gene Name: mitogen-activated protein kinase 7
  ENST ID: ENST00000443215
  CDS Start-End: 127-850
gcggggagcacacccctgcgaagtgccgggcaccctttgggcggctcccgccggcgagctggacagcggcgcgcgccaggcgtggctttctcggccggtgggctaggattggacgcagtagacaccatggccgagcctctgaaggaggaagacggcgaggacggctctgcggagccccccgggcccgtgaaggccgaacccgcccacaccgctgcctctgtagcggccaagaacctggccctgcttaaagcccgctccttcgatgtgacctttgacgtgggcgacgagtacgagatcatcgagaccataggcaacggggcctatggagtggtgtcctccgcccgccgccgcctcaccggccagcaggtggccatcaagaagatccctaatgctttcgatgtggtgaccaatgccaagcggaccctcagggagctgaagatcctcaagcactttaaacacgacaacatcatcgccatcaaggacatcctgaggcccaccgtgccctatggcgaattcaaatctgtctacgtggtcctggacctgatggaaagcgacctgcaccagatcatccactcctcacagcccctcacactggaacacgtgcgctacttcctgtaccaactgctgcggggcctgaagtacatgcactcggctcaggtcatccaccgtgacctgaagccctccaacctattggtgaatgagaactgtgagctcaagattggtgactttggtatggctcgtggcctgtgcacctcgcccgctgaacatcagtacttcatgactgagtatgtggccacgcgctggtaccgtgcgcccgagctcatgctctctttgcatgagtatacacagg

SEQ ID NO: 154867 - DNA, 640 bp, Homo sapiens
  Payload ID: 10450
  Gene Symbol: MAPK7
  Gene Name: mitogen-activated protein kinase 7
  ENST ID: ENST00000482850
  CDS Start-End: 54-640
agacgctgaggtggtggctgcggcctttgaacaactacgtggtcctggacctgatggaaagcgacctgcaccagatcatccactcctcacagcccctcacactggaacacgtgcgctacttcctgtaccaactgctgcggggcctgaagtacatgcactcggctcaggtcatccaccgtgacctgaagccctccaacctattggtgaatgagaactgtgagctcaagattggtgactttggtatggctcgtggcctgtgcacctcgcccgctgaacatcagtacttcatgactgagtatgtggccacgcgctggtaccgtgcgcccgagctcatgctctctttgcatgagtatacacaggctattgacctctggtctgtgggctgcatctttggtgagatgctggcccggcgccagctcttcccaggcaaaaactatgtacaccagctacagctcatcatgatggtgctgggtaccccatcaccagccgtgattcaggctgtgggggctgagagggtgcgggcctatatccagagcttgccaccacgccagcctgtgccctgggagacagtgtacccaggtgccgaccgccaggccctatcactgctgggtcgcatgctgcgttttgagcccagcgctcg

SEQ ID NO: 154868 - DNA, 773 bp, Homo sapiens
  Payload ID: 10450
  Gene Symbol: MAPK7
  Gene Name: mitogen-activated protein kinase 7
  ENST ID: ENST00000581260
  CDS Start-End: 110-352
tgcggcctttgaacaagtaagtgagccaccctcggagacccccgcgctggggacgggaggccggcgagcctcgggacctctgaaagccttgaggaggcgcggggacaccatggccgagcctctgaaggaggaagacggcgaggacggctctgcggagccccccgggcccgtgaaggccgaacccgcccacaccgctgcctctgtagcggccaagaacctggccctgcttaaagcccgctccttcgatgtgacctttgacgtgggcgacgagtacgagatcatcgagaccataggcaacggggcctatggagtggtgtcctccgcccgccgccgcctcaccggggagttgtgaaggccagcaggtggccatcaagaagatccctaatgctttcgatgtggtgaccaatgccaagcggaccctcagggagctgaagatcctcaagcactttaaacacgacaacatcatcgccatcaaggacatcctgaggcccaccgtgccctatggcgaattcaaatctgtctacgtggtcctggacctgatggaaagcgacctgcaccagatcatccactcctcacagcccctcacactggaacacgtgcgctacttcctgtaccaactgctgcggggcctgaagtacatgcactcggctcaggtcatccaccgtgacctgaagccctccaacctattggtgaatgagaactgtgagctcaagattggtgactttggtatggctcgtggcctgtgcacctcgcccgctgaacatcagtacttc

SEQ ID NO: 154869 - DNA, 615 bp, Homo sapiens
  Payload ID: 10450
  Gene Symbol: MAPK7
  Gene Name: mitogen-activated protein kinase 7
  ENST ID: ENST00000579284
  CDS Start-End: 145-615
atgcgtttgaaggcggtgcagggcggggagcacacccctgcgaagtgccgggcaccctttgggcggctcccgccggcgagctggacagcggcgcgcgccaggcgtggctttctcggccggtgggctaggattggacgcaacaccatggccgagcctctgaaggaggaagacggcgaggacggctctgcggagccccccgggcccgtgaaggccgaacccgcccacaccgctgcctctgtagcggccaagaacctggccctgcttaaagcccgctccttcgatgtgacctttgacgtgggcgacgagtacgagatcatcgagaccataggcaacggggcctatggagtggtgtcctccgcccgccgccgcctcaccggccagcaggtggccatcaagaagatccctaatgctttcgatgtggtgaccaatgccaagcggaccctcagggagctgaagatcctcaagcactttaaacacgacaacatcatcgccatcaaggacatcctgaggcccaccgtgccctatggcgaattcaaatctgtctacgtggtcctggacctgatggaaagcgacctgcaccagatcatccactcctcacagcccctcacactggaa

SEQ ID NO: 154870 - DNA, 582 bp, Homo sapiens
  Payload ID: 10450
  Gene Symbol: MAPK7
  Gene Name: mitogen-activated protein kinase 7
  ENST ID: ENST00000603493
  CDS Start-End: 151-582
agctagtctgccacgaaccagccgcgcgcttctgcccttgtcggtttaggaaactgggaagttccctggtcctgctccccagcccgcagaggggacactgaggcccacggtaggtggtcctctcctcacccgagtctccacacagacaccatggccgagcctctgaaggaggaagacggcgaggacggctctgcggagccccccgggcccgtgaaggccgaacccgcccacaccgctgcctctgtagcggccaagaacctggccctgcttaaagcccgctccttcgatgtgacctttgacgtgggcgacgagtacgagatcatcgagaccataggcaacggggcctatggagtggtgtcctccgcccgccgccgcctcaccggccagcaggtggccatcaagaagatccctaatgctttcgatgtggtgaccaatgccaagcggaccctcagggagctgaagatcctcaagcactttaaacacgacaacatcatcgccatcaaggacatcctgaggcccaccgtgccctatggcgaattcaaatctgtcccctatggggtcccaggctacgtggtcctggac

SEQ ID NO: 154871 - DNA, 5438 bp, Homo sapiens
  Payload ID: 10451
  Gene Symbol: MAPK8
  Gene Name: mitogen-activated protein kinase 8
  Uniprot ID: P45983
  ENST ID: ENST00000360332
  CDS Start-End: 50-976
cttcttggtgaatttttggatgaagccattaaattaattgcttgccatcatgagcagaagcaagcgtgacaacaatttttatagtgtagagattggagattctacattcacagtcctgaaacgatatcagaatttaaaacctataggctcaggagctcaaggaatagtatgcgcagcttatgatgccattcttgaaagaaatgttgcaatcaagaagctaagccgaccatttcagaatcagactcatgccaagcgggcctacagagagctagttcttatgaaatgtgttaatcacaaaaatataattggccttttgaatgttttcacaccacagaaatccctagaagaatttcaagatgtttacatagtcatggagctcatggatgcaaatctttgccaagtgattcagatggagctagatcatgaaagaatgtcctaccttctctatcagatgctgtgtggaatcaagcaccttcattctgctggaattattcatcgggacttaaagcccagtaatatagtagtaaaatctgattgcactttgaagattcttgacttcggtctggccaggactgcaggaacgagttttatgatgacgccttatgtagtgactcgctactacagagcacccgaggtcatccttggcatgggctacaaggaaaacgctgactcagaacacaacaaacttaaagccagtcaggcaagggatttgttatccaaaatgctggtaatagatgcatctaaaaggatctctgtagatgaagctctccaacacccgtacatcaatgtctggtatgatccttctgaagcagaagctccaccaccaaagatccctgacaagcagttagatgaaagggaacacacaatagaagagtggaaagaattgatatataaggaagttatggacttggaggagagaaccaagaatggagttatacgggggcagccctctcctttagcacaggtgcagcagtgatcaatggctctcagcatccatcatcatcgtcgtctgtcaatgatgtgtcttcaatgtcaacagatccgactttggcctctgatacagacagcagtctagaagcagcagctgggcctctgggctgctgtagatgactacttgggccatcggggggtgggagggatggggagtcggttagtcattgatagaactactttgaaaacaattcagtggtcttatttttgggtgatttttcaaaaaatgtagaattcattttgtagtaaagtagtttattttttttaatttcaagtgatgtaatttaaaacctaagttgtgtttcaaaacagcaacaaaactgtattgtattttttttgctgtaattaactgtataatgtaaacctaattattttatcatggtttaaattttttgcatatttgctttatcttatgctgctgatttttttaactgaatttgtaagattttgtttatcaaagcaactattatgtggtgacttgcctatatcatgaattatttaagatttttatagttttttttaattagaatttatttcagatgttttgttcatgatactatccttcagggttatgtgcttatcaatgaaataaccccagaggagtgagggaaaataacttgtagccagttatattcaggaataactactgtaaatgatgaacgtgttaggagacctccaatatttgctacttgccaatcctaatttagttacaagaattggtaggcaatcctacttaattttggcaaaagccccgtcatctaaatggcagaataactcagagcatgtctttgaagatgctgggcgtctaccaccaccttatgtccccaccctacccaacaaaaataagtaaaaagaatatggtgtattctacaaatttgtggcatgctcaaagtttatgatcacataaaggcaagaggatacttcatgaataatacatttcaatgcaaataaacagatggttcacttctactagctatgagcctgtttttgtatacactgagttaatctactcaggctgtaggtcccagcaatgttctagagtctggtctttccctttcctgcagcttcgggtccttggacctttcctgtttcctattacttggagtgtctgtcagttgagcaccagttgttctggtgtttcatttgattctacttgtagcataatcatttatacgagctattgggaggttccaaaccctacctagatttgtgtaggtgatgtatcaaatgagcaatataccgttcatctgaaaatagtagcacacagccatatataggatatcattttctaaggactgtttcttcacattgagcagagcaggcataaatggtggttatttagtctaagtcttttatttttttatacctgattttcaacataacacgcaatgtggatgtcgagtagtgttaagaatggtgctgctcctgacaagtgtatgttaactgtttacattttctatctgtagaattatttctctattactgaacttttcctaagtaaaatgtctttgaagtctcgttatttctgaaatacgttgtctgtaatagacccaggcaccttttaaattatctctggaacaagagggatttcatgtaatgaactaggaaatgcatactcacataagcaacaaggttctaggcagaaagccccttggaatttgtgaccaacaggagcaagaacaggtgcggctcaacatgcaatgtctgaaaatttgcttggcattttattcatatatttagtgcaaaattatttttgagtgagatattttacatcactgttaatgtgcaatatttaagattaaaatacattagcttttttatatactttgaagtagcaagtttgttttcgatggcttagagtcatgatttccagcttcccagcctttttatcagtcccttttctaatacaacaaggtgcattaatttgattaggcaaattagagttctaagacacttcttgaattgtagacagaaaatattggattcacaatttcagcagaaatttgagaatgagtgtgtttatattaatttcacaattagctgtattttctgtagcatagattatgtcactgttgcactttcacagcagacatgctttcagaaggttctcatattttatgtttgattgctgataagccatctctattgatacagattttggttaagtaaggaaaaccaggtgtgtgtctgtatcatttattgtaaatgccagctgccacttgccaaccatcatgttcagttcaattcaaagaaaacaaactctcattacttagtgtaaactaaaatacttaacaaattatatcctaaaaacaaggtctctttgttaaatgttgcatgccctaggttttaaattactacatccaaatacagttttcgtcttaaatttgttaagctaaatatatgttggttctttttattttggaatcctttaagcatcttaaacattttttttttgaagagaagttacaaataacatttctatcaggtagtacttgtatgaaaccacctttcttattctataattttgatttttcaattttatatacttaatatactcactgtcttactatcagaaagttattttgaccaagatttttattatcttcatagattcagaaagagatgctaattctgtaccaatgtcttcctggttactattctcttccctctaatatatactggccatttgtaaaaccattgtgttgttgggatcacttagttatactatacgcagatagagcatctcaactctgtcatagtgtttgctgaacagttttcagtgtcatgcacctttggctgctaattgttcctgacgtgcactcttccgagttggtaaaggcacagtgtgttcatgccagacttctaagagaaacaccagcctcttaaatcagaagcctacacacaacccccttaacaatccaaagaagcttgatggtgtgcaaagaagcatcctgccagccttgtcattgttctgttctatgctaatcctgctgtgttgtctaaaagatggagggaagaggacatcagtgtctgatagtgaaatcatcagcaggaaagtgaagctctttccttggttacagataagacttggtttacactattggccagtatctgctaaacatatgaagacttaactattcagtgttgcctaggcattcgcctgcacaacattttgaggttagaacatagaatattttcagaaatactgttgtagtttgtgagtgttgttcattagttacacattagctatagagtggatgcatgaagccccatgacaccagtaaacttctcttaccagtaggtaaaccaaacaccattctgtcattagcagccctcttaaatgttgcctctccgtatcctgttgcatttttgtgtgcattgtgtttctactgatctctcttaggtttttacggaatcaaaggaaactaatttttccttaatagcaagaaagatgaagaggtaaagggcattgaagcagaaatgtatagtttggggtacgattagaaaactcgtaaggaaaacagaagtcctaatttcaaactgactgctcttcgttaagtgctcttaaggagagtctagtaacagtaacactttctggccatttctagtttagattctcttcgttactgaaacttttgagaaatattacctgtggattaattttgcacaatgttctattctcataatgacttacaaattaaactaggtttttattgaactacctcacactaattttctatgctttcccaagtaagctgttgccctgttagatctttactgagtgaattataaatgtgtgttaaatactttctagccaatgttgacacaataccagtaagtatgtaaagtatataccttacatcagtaagagacacgtgtaaaatctttgactgtatgtcttgcaaaattgtgctcgttgacattattactgtttttgtaagtagaaacctgctcgtgatatcggtccatttacattttacaaaaggagtaaatcttagtaaaaattttacgaagaaataaattacttttgtaggcccaatatttggtatatttttgagaagctgttaatcttttagctgaataatgaagttagactgaattacgtgtctccctggactgtgacatctattttctcattacagtttatcctggtcagcagggtgtcacacctggaaacctgagtatgatagctgacatttgcttttctccctctgcgatgtcattcctcctccattcctctccttccctgtgttccgttccctctcctttcctctagacaaaacaaaatggggcactttttagggaatgctgagatcattattgtggtttttcatcattcatgccctagtcattaaacatgcaccactggaatgtaaacaatgttatctagtatgtcaattggttataatattttaaataaaaaagaaaaaagtggtatgaaaattatg

SEQ ID NO: 154872 - DNA, 739 bp, Homo sapiens
  Payload ID: 10451
  Gene Symbol: MAPK8
  Gene Name: mitogen-activated protein kinase 8
  ENST ID: ENST00000374174
  CDS Start-End: 1-657
atgagcagaagcaagcgtgacaacaatttttatagtgtagagattggagattctacattcacagtcctgaaacgatatcagaatttaaaacctataggctcaggagctcaaggaatagtatgcgcagcttatgatgccattcttgaaagaaatgttgcaatcaagaagctaagccgaccatttcagaatcagactcatgccaagcgggcctacagagagctagttcttatgaaatgtgttaatcacaaaaatataattggccttttgaatgttttcacaccacagaaatccctagaagaatttcaagatgtttacatagtcatggagctcatggatgcaaatctttgccaagtgattcagatggagctagatcatgaaagaatgtcctaccttctctatcagatgctgtgtggaatcaagcaccttcattctgctggaattattcatcgggacttaaagcccagtaatatagtagtaaaatctgattgcactttgaagattcttgacttcggtctggccaggactgcaggaacgagttttatgatgacgccttatgtagtgactcgctactacagagcacccgaggtcatccttggcatgggctacaaggaaaacggaggaagaatgggaaaaggcatattcacaaggttacaataaggtgcctgtgagatataaaatttataactgccacatcctttcttaggaatttttaaatttctattttcttgtaatatgaata

SEQ ID NO: 154873 - DNA, 5628 bp, Homo sapiens
  Payload ID: 10451
  Gene Symbol: MAPK8
  Gene Name: mitogen-activated protein kinase 8
  Uniprot ID: P45983
  ENST ID: ENST00000374176
  CDS Start-End: 14-1297
attgcttgccatcatgagcagaagcaagcgtgacaacaatttttatagtgtagagattggagattctacattcacagtcctgaaacgatatcagaatttaaaacctataggctcaggagctcaaggaatagtatgcgcagcttatgatgccattcttgaaagaaatgttgcaatcaagaagctaagccgaccatttcagaatcagactcatgccaagcgggcctacagagagctagttcttatgaaatgtgttaatcacaaaaatataattggccttttgaatgttttcacaccacagaaatccctagaagaatttcaagatgtttacatagtcatggagctcatggatgcaaatctttgccaagtgattcagatggagctagatcatgaaagaatgtcctaccttctctatcagatgctgtgtggaatcaagcaccttcattctgctggaattattcatcgggacttaaagcccagtaatatagtagtaaaatctgattgcactttgaagattcttgacttcggtctggccaggactgcaggaacgagttttatgatgacgccttatgtagtgactcgctactacagagcacccgaggtcatccttggcatgggctacaaggaaaacgttgacatttggtcagttgggtgcatcatgggagaaatgatcaaaggtggtgttttgttcccaggtacagatcatattgatcagtggaataaagttattgaacagcttggaacaccatgtcctgaattcatgaagaaactgcaaccaacagtaaggacttacgttgaaaacagacctaaatatgctggatatagctttgagaaactcttccctgatgtccttttcccagctgactcagaacacaacaaacttaaagccagtcaggcaagggatttgttatccaaaatgctggtaatagatgcatctaaaaggatctctgtagatgaagctctccaacacccgtacatcaatgtctggtatgatccttctgaagcagaagctccaccaccaaagatccctgacaagcagttagatgaaagggaacacacaatagaagagtggaaagaattgatatataaggaagttatggacttggaggagagaaccaagaatggagttatacgggggcagccctctcctttaggtgcagcagtgatcaatggctctcagcatccatcatcatcgtcgtctgtcaatgatgtgtcttcaatgtcaacagatccgactttggcctctgatacagacagcagtctagaagcagcagctgggcctctgggctgctgtagatgactacttgggccatcggggggtgggagggatggggagtcggttagtcattgatagaactactttgaaaacaattcagtggtcttatttttgggtgatttttcaaaaaatgtagaattcattttgtagtaaagtagtttattttttttaatttcaagtgatgtaatttaaaacctaagttgtgtttcaaaacagcaacaaaactgtattgtattttttttgctgtaattaactgtataatgtaaacctaattattttatcatggtttaaattttttgcatatttgctttatcttatgctgctgatttttttaactgaatttgtaagattttgtttatcaaagcaactattatgtggtgacttgcctatatcatgaattatttaagatttttatagttttttttaattagaatttatttcagatgttttgttcatgatactatccttcagggttatgtgcttatcaatgaaataaccccagaggagtgagggaaaataacttgtagccagttatattcaggaataactactgtaaatgatgaacgtgttaggagacctccaatatttgctacttgccaatcctaatttagttacaagaattggtaggcaatcctacttaattttggcaaaagccccgtcatctaaatggcagaataactcagagcatgtctttgaagatgctgggcgtctaccaccaccttatgtccccaccctacccaacaaaaataagtaaaaagaatatggtgtattctacaaatttgtggcatgctcaaagtttatgatcacataaaggcaagaggatacttcatgaataatacatttcaatgcaaataaacagatggttcacttctactagctatgagcctgtttttgtatacactgagttaatctactcaggctgtaggtcccagcaatgttctagagtctggtctttccctttcctgcagcttcgggtccttggacctttcctgtttcctattacttggagtgtctgtcagttgagcaccagttgttctggtgtttcatttgattctacttgtagcataatcatttatacgagctattgggaggttccaaaccctacctagatttgtgtaggtgatgtatcaaatgagcaatataccgttcatctgaaaatagtagcacacagccatatataggatatcattttctaaggactgtttcttcacattgagcagagcaggcataaatggtggttatttagtctaagtcttttatttttttatacctgattttcaacataacacgcaatgtggatgtcgagtagtgttaagaatggtgctgctcctgacaagtgtatgttaactgtttacattttctatctgtagaattatttctctattactgaacttttcctaagtaaaatgtctttgaagtctcgttatttctgaaatacgttgtctgtaatagacccaggcaccttttaaattatctctggaacaagagggatttcatgtaatgaactaggaaatgcatactcacataagcaacaaggttctaggcagaaagccccttggaatttgtgaccaacaggagcaagaacaggtgcggctcaacatgcaatgtctgaaaatttgcttggcattttattcatatatttagtgcaaaattatttttgagtgagatattttacatcactgttaatgtgcaatatttaagattaaaatacattagcttttttatatactttgaagtagcaagtttgttttcgatggcttagagtcatgatttccagcttcccagcctttttatcagtcccttttctaatacaacaaggtgcattaatttgattaggcaaattagagttctaagacacttcttgaattgtagacagaaaatattggattcacaatttcagcagaaatttgagaatgagtgtgtttatattaatttcacaattagctgtattttctgtagcatagattatgtcactgttgcactttcacagcagacatgctttcagaaggttctcatattttatgtttgattgctgataagccatctctattgatacagattttggttaagtaaggaaaaccaggtgtgtgtctgtatcatttattgtaaatgccagctgccacttgccaaccatcatgttcagttcaattcaaagaaaacaaactctcattacttagtgtaaactaaaatacttaacaaattatatcctaaaaacaaggtctctttgttaaatgttgcatgccctaggttttaaattactacatccaaatacagttttcgtcttaaatttgttaagctaaatatatgttggttctttttattttggaatcctttaagcatcttaaacattttttttttgaagagaagttacaaataacatttctatcaggtagtacttgtatgaaaccacctttcttattctataattttgatttttcaattttatatacttaatatactcactgtcttactatcagaaagttattttgaccaagatttttattatcttcatagattcagaaagagatgctaattctgtaccaatgtcttcctggttactattctcttccctctaatatatactggccatttgtaaaaccattgtgttgttgggatcacttagttatactatacgcagatagagcatctcaactctgtcatagtgtttgctgaacagttttcagtgtcatgcacctttggctgctaattgttcctgacgtgcactcttccgagttggtaaaggcacagtgtgttcatgccagacttctaagagaaacaccagcctcttaaatcagaagcctacacacaacccccttaacaatccaaagaagcttgatggtgtgcaaagaagcatcctgccagccttgtcattgttctgttctatgctaatcctgctgtgttgtctaaaagatggagggaagaggacatcagtgtctgatagtgaaatcatcagcaggaaagtgaagctctttccttggttacagataagacttggtttacactattggccagtatctgctaaacatatgaagacttaactattcagtgttgcctaggcattcgcctgcacaacattttgaggttagaacatagaatattttcagaaatactgttgtagtttgtgagtgttgttcattagttacacattagctatagagtggatgcatgaagccccatgacaccagtaaacttctcttaccagtaggtaaaccaaacaccattctgtcattagcagccctcttaaatgttgcctctccgtatcctgttgcatttttgtgtgcattgtgtttctactgatctctcttaggtttttacggaatcaaaggaaactaatttttccttaatagcaagaaagatgaagaggtaaagggcattgaagcagaaatgtatagtttggggtacgattagaaaactcgtaaggaaaacagaagtcctaatttcaaactgactgctcttcgttaagtgctcttaaggagagtctagtaacagtaacactttctggccatttctagtttagattctcttcgttactgaaacttttgagaaatattacctgtggattaattttgcacaatgttctattctcataatgacttacaaattaaactaggtttttattgaactacctcacactaattttctatgctttcccaagtaagctgttgccctgttagatctttactgagtgaattataaatgtgtgttaaatactttctagccaatgttgacacaataccagtaagtatgtaaagtatataccttacatcagtaagagacacgtgtaaaatctttgactgtatgtcttgcaaaattgtgctcgttgacattattactgtttttgtaagtagaaacctgctcgtgatatcggtccatttacattttacaaaaggagtaaatcttagtaaaaattttacgaagaaataaattacttttgtaggcccaatatttggtatatttttgagaagctgttaatcttttagctgaataatgaagttagactgaattacgtgtctccctggactgtgacatctattttctcattacagtttatcctggtcagcagggtgtcacacctggaaacctgagtatgatagctgacatttgcttttctccctctgcgatgtcattcctcctccattcctctccttccctgtgttccgttccctctcctttcctctagacaaaacaaaatggggcactttttagggaatgctgagatcattattgtggtttttcatcattcatgccctagtcattaaacatgcaccactggaatgtaaacaatgttatctagtatgtcaattggttataatattttaaataaaaaagaaaaaagtggtatgaaaattatgaaa

SEQ ID NO: 154874 - DNA, 5637 bp, Homo sapiens
  Payload ID: 10451
  Gene Symbol: MAPK8
  Gene Name: mitogen-activated protein kinase 8
  Uniprot ID: P45983
  ENST ID: ENST00000374179
  CDS Start-End: 18-1172
attaattgcttgccatcatgagcagaagcaagcgtgacaacaatttttatagtgtagagattggagattctacattcacagtcctgaaacgatatcagaatttaaaacctataggctcaggagctcaaggaatagtatgcgcagcttatgatgccattcttgaaagaaatgttgcaatcaagaagctaagccgaccatttcagaatcagactcatgccaagcgggcctacagagagctagttcttatgaaatgtgttaatcacaaaaatataattggccttttgaatgttttcacaccacagaaatccctagaagaatttcaagatgtttacatagtcatggagctcatggatgcaaatctttgccaagtgattcagatggagctagatcatgaaagaatgtcctaccttctctatcagatgctgtgtggaatcaagcaccttcattctgctggaattattcatcgggacttaaagcccagtaatatagtagtaaaatctgattgcactttgaagattcttgacttcggtctggccaggactgcaggaacgagttttatgatgacgccttatgtagtgactcgctactacagagcacccgaggtcatccttggcatgggctacaaggaaaacgttgacatttggtcagttgggtgcatcatgggagaaatgatcaaaggtggtgttttgttcccaggtacagatcatattgatcagtggaataaagttattgaacagcttggaacaccatgtcctgaattcatgaagaaactgcaaccaacagtaaggacttacgttgaaaacagacctaaatatgctggatatagctttgagaaactcttccctgatgtccttttcccagctgactcagaacacaacaaacttaaagccagtcaggcaagggatttgttatccaaaatgctggtaatagatgcatctaaaaggatctctgtagatgaagctctccaacacccgtacatcaatgtctggtatgatccttctgaagcagaagctccaccaccaaagatccctgacaagcagttagatgaaagggaacacacaatagaagagtggaaagaattgatatataaggaagttatggacttggaggagagaaccaagaatggagttatacgggggcagccctctcctttagcacaggtgcagcagtgatcaatggctctcagcatccatcatcatcgtcgtctgtcaatgatgtgtcttcaatgtcaacagatccgactttggcctctgatacagacagcagtctagaagcagcagctgggcctctgggctgctgtagatgactacttgggccatcggggggtgggagggatggggagtcggttagtcattgatagaactactttgaaaacaattcagtggtcttatttttgggtgatttttcaaaaaatgtagaattcattttgtagtaaagtagtttattttttttaatttcaagtgatgtaatttaaaacctaagttgtgtttcaaaacagcaacaaaactgtattgtattttttttgctgtaattaactgtataatgtaaacctaattattttatcatggtttaaattttttgcatatttgctttatcttatgctgctgatttttttaactgaatttgtaagattttgtttatcaaagcaactattatgtggtgacttgcctatatcatgaattatttaagatttttatagttttttttaattagaatttatttcagatgttttgttcatgatactatccttcagggttatgtgcttatcaatgaaataaccccagaggagtgagggaaaataacttgtagccagttatattcaggaataactactgtaaatgatgaacgtgttaggagacctccaatatttgctacttgccaatcctaatttagttacaagaattggtaggcaatcctacttaattttggcaaaagccccgtcatctaaatggcagaataactcagagcatgtctttgaagatgctgggcgtctaccaccaccttatgtccccaccctacccaacaaaaataagtaaaaagaatatggtgtattctacaaatttgtggcatgctcaaagtttatgatcacataaaggcaagaggatacttcatgaataatacatttcaatgcaaataaacagatggttcacttctactagctatgagcctgtttttgtatacactgagttaatctactcaggctgtaggtcccagcaatgttctagagtctggtctttccctttcctgcagcttcgggtccttggacctttcctgtttcctattacttggagtgtctgtcagttgagcaccagttgttctggtgtttcatttgattctacttgtagcataatcatttatacgagctattgggaggttccaaaccctacctagatttgtgtaggtgatgtatcaaatgagcaatataccgttcatctgaaaatagtagcacacagccatatataggatatcattttctaaggactgtttcttcacattgagcagagcaggcataaatggtggttatttagtctaagtcttttatttttttatacctgattttcaacataacacgcaatgtggatgtcgagtagtgttaagaatggtgctgctcctgacaagtgtatgttaactgtttacattttctatctgtagaattatttctctattactgaacttttcctaagtaaaatgtctttgaagtctcgttatttctgaaatacgttgtctgtaatagacccaggcaccttttaaattatctctggaacaagagggatttcatgtaatgaactaggaaatgcatactcacataagcaacaaggttctaggcagaaagccccttggaatttgtgaccaacaggagcaagaacaggtgcggctcaacatgcaatgtctgaaaatttgcttggcattttattcatatatttagtgcaaaattatttttgagtgagatattttacatcactgttaatgtgcaatatttaagattaaaatacattagcttttttatatactttgaagtagcaagtttgttttcgatggcttagagtcatgatttccagcttcccagcctttttatcagtcccttttctaatacaacaaggtgcattaatttgattaggcaaattagagttctaagacacttcttgaattgtagacagaaaatattggattcacaatttcagcagaaatttgagaatgagtgtgtttatattaatttcacaattagctgtattttctgtagcatagattatgtcactgttgcactttcacagcagacatgctttcagaaggttctcatattttatgtttgattgctgataagccatctctattgatacagattttggttaagtaaggaaaaccaggtgtgtgtctgtatcatttattgtaaatgccagctgccacttgccaaccatcatgttcagttcaattcaaagaaaacaaactctcattacttagtgtaaactaaaatacttaacaaattatatcctaaaaacaaggtctctttgttaaatgttgcatgccctaggttttaaattactacatccaaatacagttttcgtcttaaatttgttaagctaaatatatgttggttctttttattttggaatcctttaagcatcttaaacattttttttttgaagagaagttacaaataacatttctatcaggtagtacttgtatgaaaccacctttcttattctataattttgatttttcaattttatatacttaatatactcactgtcttactatcagaaagttattttgaccaagatttttattatcttcatagattcagaaagagatgctaattctgtaccaatgtcttcctggttactattctcttccctctaatatatactggccatttgtaaaaccattgtgttgttgggatcacttagttatactatacgcagatagagcatctcaactctgtcatagtgtttgctgaacagttttcagtgtcatgcacctttggctgctaattgttcctgacgtgcactcttccgagttggtaaaggcacagtgtgttcatgccagacttctaagagaaacaccagcctcttaaatcagaagcctacacacaacccccttaacaatccaaagaagcttgatggtgtgcaaagaagcatcctgccagccttgtcattgttctgttctatgctaatcctgctgtgttgtctaaaagatggagggaagaggacatcagtgtctgatagtgaaatcatcagcaggaaagtgaagctctttccttggttacagataagacttggtttacactattggccagtatctgctaaacatatgaagacttaactattcagtgttgcctaggcattcgcctgcacaacattttgaggttagaacatagaatattttcagaaatactgttgtagtttgtgagtgttgttcattagttacacattagctatagagtggatgcatgaagccccatgacaccagtaaacttctcttaccagtaggtaaaccaaacaccattctgtcattagcagccctcttaaatgttgcctctccgtatcctgttgcatttttgtgtgcattgtgtttctactgatctctcttaggtttttacggaatcaaaggaaactaatttttccttaatagcaagaaagatgaagaggtaaagggcattgaagcagaaatgtatagtttggggtacgattagaaaactcgtaaggaaaacagaagtcctaatttcaaactgactgctcttcgttaagtgctcttaaggagagtctagtaacagtaacactttctggccatttctagtttagattctcttcgttactgaaacttttgagaaatattacctgtggattaattttgcacaatgttctattctcataatgacttacaaattaaactaggtttttattgaactacctcacactaattttctatgctttcccaagtaagctgttgccctgttagatctttactgagtgaattataaatgtgtgttaaatactttctagccaatgttgacacaataccagtaagtatgtaaagtatataccttacatcagtaagagacacgtgtaaaatctttgactgtatgtcttgcaaaattgtgctcgttgacattattactgtttttgtaagtagaaacctgctcgtgatatcggtccatttacattttacaaaaggagtaaatcttagtaaaaattttacgaagaaataaattacttttgtaggcccaatatttggtatatttttgagaagctgttaatcttttagctgaataatgaagttagactgaattacgtgtctccctggactgtgacatctattttctcattacagtttatcctggtcagcagggtgtcacacctggaaacctgagtatgatagctgacatttgcttttctccctctgcgatgtcattcctcctccattcctctccttccctgtgttccgttccctctcctttcctctagacaaaacaaaatggggcactttttagggaatgctgagatcattattgtggtttttcatcattcatgccctagtcattaaacatgcaccactggaatgtaaacaatgttatctagtatgtcaattggttataatattttaaataaaaaagaaaaaagtggtatgaaaattatgaaa

SEQ ID NO: 154875 - DNA, 5638 bp, Homo sapiens
  Payload ID: 10451
  Gene Symbol: MAPK8
  Gene Name: mitogen-activated protein kinase 8
  Uniprot ID: P45983
  ENST ID: ENST00000374182
  CDS Start-End: 19-1173
aattaattgcttgccatcatgagcagaagcaagcgtgacaacaatttttatagtgtagagattggagattctacattcacagtcctgaaacgatatcagaatttaaaacctataggctcaggagctcaaggaatagtatgcgcagcttatgatgccattcttgaaagaaatgttgcaatcaagaagctaagccgaccatttcagaatcagactcatgccaagcgggcctacagagagctagttcttatgaaatgtgttaatcacaaaaatataattggccttttgaatgttttcacaccacagaaatccctagaagaatttcaagatgtttacatagtcatggagctcatggatgcaaatctttgccaagtgattcagatggagctagatcatgaaagaatgtcctaccttctctatcagatgctgtgtggaatcaagcaccttcattctgctggaattattcatcgggacttaaagcccagtaatatagtagtaaaatctgattgcactttgaagattcttgacttcggtctggccaggactgcaggaacgagttttatgatgacgccttatgtagtgactcgctactacagagcacccgaggtcatccttggcatgggctacaaggaaaacgtggatttatggtctgtggggtgcattatgggagaaatggtttgccacaaaatcctctttccaggaagggactatattgatcagtggaataaagttattgaacagcttggaacaccatgtcctgaattcatgaagaaactgcaaccaacagtaaggacttacgttgaaaacagacctaaatatgctggatatagctttgagaaactcttccctgatgtccttttcccagctgactcagaacacaacaaacttaaagccagtcaggcaagggatttgttatccaaaatgctggtaatagatgcatctaaaaggatctctgtagatgaagctctccaacacccgtacatcaatgtctggtatgatccttctgaagcagaagctccaccaccaaagatccctgacaagcagttagatgaaagggaacacacaatagaagagtggaaagaattgatatataaggaagttatggacttggaggagagaaccaagaatggagttatacgggggcagccctctcctttagcacaggtgcagcagtgatcaatggctctcagcatccatcatcatcgtcgtctgtcaatgatgtgtcttcaatgtcaacagatccgactttggcctctgatacagacagcagtctagaagcagcagctgggcctctgggctgctgtagatgactacttgggccatcggggggtgggagggatggggagtcggttagtcattgatagaactactttgaaaacaattcagtggtcttatttttgggtgatttttcaaaaaatgtagaattcattttgtagtaaagtagtttattttttttaatttcaagtgatgtaatttaaaacctaagttgtgtttcaaaacagcaacaaaactgtattgtattttttttgctgtaattaactgtataatgtaaacctaattattttatcatggtttaaattttttgcatatttgctttatcttatgctgctgatttttttaactgaatttgtaagattttgtttatcaaagcaactattatgtggtgacttgcctatatcatgaattatttaagatttttatagttttttttaattagaatttatttcagatgttttgttcatgatactatccttcagggttatgtgcttatcaatgaaataaccccagaggagtgagggaaaataacttgtagccagttatattcaggaataactactgtaaatgatgaacgtgttaggagacctccaatatttgctacttgccaatcctaatttagttacaagaattggtaggcaatcctacttaattttggcaaaagccccgtcatctaaatggcagaataactcagagcatgtctttgaagatgctgggcgtctaccaccaccttatgtccccaccctacccaacaaaaataagtaaaaagaatatggtgtattctacaaatttgtggcatgctcaaagtttatgatcacataaaggcaagaggatacttcatgaataatacatttcaatgcaaataaacagatggttcacttctactagctatgagcctgtttttgtatacactgagttaatctactcaggctgtaggtcccagcaatgttctagagtctggtctttccctttcctgcagcttcgggtccttggacctttcctgtttcctattacttggagtgtctgtcagttgagcaccagttgttctggtgtttcatttgattctacttgtagcataatcatttatacgagctattgggaggttccaaaccctacctagatttgtgtaggtgatgtatcaaatgagcaatataccgttcatctgaaaatagtagcacacagccatatataggatatcattttctaaggactgtttcttcacattgagcagagcaggcataaatggtggttatttagtctaagtcttttatttttttatacctgattttcaacataacacgcaatgtggatgtcgagtagtgttaagaatggtgctgctcctgacaagtgtatgttaactgtttacattttctatctgtagaattatttctctattactgaacttttcctaagtaaaatgtctttgaagtctcgttatttctgaaatacgttgtctgtaatagacccaggcaccttttaaattatctctggaacaagagggatttcatgtaatgaactaggaaatgcatactcacataagcaacaaggttctaggcagaaagccccttggaatttgtgaccaacaggagcaagaacaggtgcggctcaacatgcaatgtctgaaaatttgcttggcattttattcatatatttagtgcaaaattatttttgagtgagatattttacatcactgttaatgtgcaatatttaagattaaaatacattagcttttttatatactttgaagtagcaagtttgttttcgatggcttagagtcatgatttccagcttcccagcctttttatcagtcccttttctaatacaacaaggtgcattaatttgattaggcaaattagagttctaagacacttcttgaattgtagacagaaaatattggattcacaatttcagcagaaatttgagaatgagtgtgtttatattaatttcacaattagctgtattttctgtagcatagattatgtcactgttgcactttcacagcagacatgctttcagaaggttctcatattttatgtttgattgctgataagccatctctattgatacagattttggttaagtaaggaaaaccaggtgtgtgtctgtatcatttattgtaaatgccagctgccacttgccaaccatcatgttcagttcaattcaaagaaaacaaactctcattacttagtgtaaactaaaatacttaacaaattatatcctaaaaacaaggtctctttgttaaatgttgcatgccctaggttttaaattactacatccaaatacagttttcgtcttaaatttgttaagctaaatatatgttggttctttttattttggaatcctttaagcatcttaaacattttttttttgaagagaagttacaaataacatttctatcaggtagtacttgtatgaaaccacctttcttattctataattttgatttttcaattttatatacttaatatactcactgtcttactatcagaaagttattttgaccaagatttttattatcttcatagattcagaaagagatgctaattctgtaccaatgtcttcctggttactattctcttccctctaatatatactggccatttgtaaaaccattgtgttgttgggatcacttagttatactatacgcagatagagcatctcaactctgtcatagtgtttgctgaacagttttcagtgtcatgcacctttggctgctaattgttcctgacgtgcactcttccgagttggtaaaggcacagtgtgttcatgccagacttctaagagaaacaccagcctcttaaatcagaagcctacacacaacccccttaacaatccaaagaagcttgatggtgtgcaaagaagcatcctgccagccttgtcattgttctgttctatgctaatcctgctgtgttgtctaaaagatggagggaagaggacatcagtgtctgatagtgaaatcatcagcaggaaagtgaagctctttccttggttacagataagacttggtttacactattggccagtatctgctaaacatatgaagacttaactattcagtgttgcctaggcattcgcctgcacaacattttgaggttagaacatagaatattttcagaaatactgttgtagtttgtgagtgttgttcattagttacacattagctatagagtggatgcatgaagccccatgacaccagtaaacttctcttaccagtaggtaaaccaaacaccattctgtcattagcagccctcttaaatgttgcctctccgtatcctgttgcatttttgtgtgcattgtgtttctactgatctctcttaggtttttacggaatcaaaggaaactaatttttccttaatagcaagaaagatgaagaggtaaagggcattgaagcagaaatgtatagtttggggtacgattagaaaactcgtaaggaaaacagaagtcctaatttcaaactgactgctcttcgttaagtgctcttaaggagagtctagtaacagtaacactttctggccatttctagtttagattctcttcgttactgaaacttttgagaaatattacctgtggattaattttgcacaatgttctattctcataatgacttacaaattaaactaggtttttattgaactacctcacactaattttctatgctttcccaagtaagctgttgccctgttagatctttactgagtgaattataaatgtgtgttaaatactttctagccaatgttgacacaataccagtaagtatgtaaagtatataccttacatcagtaagagacacgtgtaaaatctttgactgtatgtcttgcaaaattgtgctcgttgacattattactgtttttgtaagtagaaacctgctcgtgatatcggtccatttacattttacaaaaggagtaaatcttagtaaaaattttacgaagaaataaattacttttgtaggcccaatatttggtatatttttgagaagctgttaatcttttagctgaataatgaagttagactgaattacgtgtctccctggactgtgacatctattttctcattacagtttatcctggtcagcagggtgtcacacctggaaacctgagtatgatagctgacatttgcttttctccctctgcgatgtcattcctcctccattcctctccttccctgtgttccgttccctctcctttcctctagacaaaacaaaatggggcactttttagggaatgctgagatcattattgtggtttttcatcattcatgccctagtcattaaacatgcaccactggaatgtaaacaatgttatctagtatgtcaattggttataatattttaaataaaaaagaaaaaagtggtatgaaaattatgaaa

SEQ ID NO: 154876 - DNA, 5796 bp, Homo sapiens
  Payload ID: 10451
  Gene Symbol: MAPK8
  Gene Name: mitogen-activated protein kinase 8
  Uniprot ID: P45983
  ENST ID: ENST00000374189
  CDS Start-End: 182-1465
gcggccgaggccggacgacgcggcttggattgcggagccgcgagcagcgctgggtaacggccgcggcgaccaccccggacggcccctgtccccgctggcgggcttccctgtcgccgttcgctgcgctgccggcttcttggtgaatttttggatgaagccattaaattaattgcttgccatcatgagcagaagcaagcgtgacaacaatttttatagtgtagagattggagattctacattcacagtcctgaaacgatatcagaatttaaaacctataggctcaggagctcaaggaatagtatgcgcagcttatgatgccattcttgaaagaaatgttgcaatcaagaagctaagccgaccatttcagaatcagactcatgccaagcgggcctacagagagctagttcttatgaaatgtgttaatcacaaaaatataattggccttttgaatgttttcacaccacagaaatccctagaagaatttcaagatgtttacatagtcatggagctcatggatgcaaatctttgccaagtgattcagatggagctagatcatgaaagaatgtcctaccttctctatcagatgctgtgtggaatcaagcaccttcattctgctggaattattcatcgggacttaaagcccagtaatatagtagtaaaatctgattgcactttgaagattcttgacttcggtctggccaggactgcaggaacgagttttatgatgacgccttatgtagtgactcgctactacagagcacccgaggtcatccttggcatgggctacaaggaaaacgtggatttatggtctgtggggtgcattatgggagaaatggtttgccacaaaatcctctttccaggaagggactatattgatcagtggaataaagttattgaacagcttggaacaccatgtcctgaattcatgaagaaactgcaaccaacagtaaggacttacgttgaaaacagacctaaatatgctggatatagctttgagaaactcttccctgatgtccttttcccagctgactcagaacacaacaaacttaaagccagtcaggcaagggatttgttatccaaaatgctggtaatagatgcatctaaaaggatctctgtagatgaagctctccaacacccgtacatcaatgtctggtatgatccttctgaagcagaagctccaccaccaaagatccctgacaagcagttagatgaaagggaacacacaatagaagagtggaaagaattgatatataaggaagttatggacttggaggagagaaccaagaatggagttatacgggggcagccctctcctttaggtgcagcagtgatcaatggctctcagcatccatcatcatcgtcgtctgtcaatgatgtgtcttcaatgtcaacagatccgactttggcctctgatacagacagcagtctagaagcagcagctgggcctctgggctgctgtagatgactacttgggccatcggggggtgggagggatggggagtcggttagtcattgatagaactactttgaaaacaattcagtggtcttatttttgggtgatttttcaaaaaatgtagaattcattttgtagtaaagtagtttattttttttaatttcaagtgatgtaatttaaaacctaagttgtgtttcaaaacagcaacaaaactgtattgtattttttttgctgtaattaactgtataatgtaaacctaattattttatcatggtttaaattttttgcatatttgctttatcttatgctgctgatttttttaactgaatttgtaagattttgtttatcaaagcaactattatgtggtgacttgcctatatcatgaattatttaagatttttatagttttttttaattagaatttatttcagatgttttgttcatgatactatccttcagggttatgtgcttatcaatgaaataaccccagaggagtgagggaaaataacttgtagccagttatattcaggaataactactgtaaatgatgaacgtgttaggagacctccaatatttgctacttgccaatcctaatttagttacaagaattggtaggcaatcctacttaattttggcaaaagccccgtcatctaaatggcagaataactcagagcatgtctttgaagatgctgggcgtctaccaccaccttatgtccccaccctacccaacaaaaataagtaaaaagaatatggtgtattctacaaatttgtggcatgctcaaagtttatgatcacataaaggcaagaggatacttcatgaataatacatttcaatgcaaataaacagatggttcacttctactagctatgagcctgtttttgtatacactgagttaatctactcaggctgtaggtcccagcaatgttctagagtctggtctttccctttcctgcagcttcgggtccttggacctttcctgtttcctattacttggagtgtctgtcagttgagcaccagttgttctggtgtttcatttgattctacttgtagcataatcatttatacgagctattgggaggttccaaaccctacctagatttgtgtaggtgatgtatcaaatgagcaatataccgttcatctgaaaatagtagcacacagccatatataggatatcattttctaaggactgtttcttcacattgagcagagcaggcataaatggtggttatttagtctaagtcttttatttttttatacctgattttcaacataacacgcaatgtggatgtcgagtagtgttaagaatggtgctgctcctgacaagtgtatgttaactgtttacattttctatctgtagaattatttctctattactgaacttttcctaagtaaaatgtctttgaagtctcgttatttctgaaatacgttgtctgtaatagacccaggcaccttttaaattatctctggaacaagagggatttcatgtaatgaactaggaaatgcatactcacataagcaacaaggttctaggcagaaagccccttggaatttgtgaccaacaggagcaagaacaggtgcggctcaacatgcaatgtctgaaaatttgcttggcattttattcatatatttagtgcaaaattatttttgagtgagatattttacatcactgttaatgtgcaatatttaagattaaaatacattagcttttttatatactttgaagtagcaagtttgttttcgatggcttagagtcatgatttccagcttcccagcctttttatcagtcccttttctaatacaacaaggtgcattaatttgattaggcaaattagagttctaagacacttcttgaattgtagacagaaaatattggattcacaatttcagcagaaatttgagaatgagtgtgtttatattaatttcacaattagctgtattttctgtagcatagattatgtcactgttgcactttcacagcagacatgctttcagaaggttctcatattttatgtttgattgctgataagccatctctattgatacagattttggttaagtaaggaaaaccaggtgtgtgtctgtatcatttattgtaaatgccagctgccacttgccaaccatcatgttcagttcaattcaaagaaaacaaactctcattacttagtgtaaactaaaatacttaacaaattatatcctaaaaacaaggtctctttgttaaatgttgcatgccctaggttttaaattactacatccaaatacagttttcgtcttaaatttgttaagctaaatatatgttggttctttttattttggaatcctttaagcatcttaaacattttttttttgaagagaagttacaaataacatttctatcaggtagtacttgtatgaaaccacctttcttattctataattttgatttttcaattttatatacttaatatactcactgtcttactatcagaaagttattttgaccaagatttttattatcttcatagattcagaaagagatgctaattctgtaccaatgtcttcctggttactattctcttccctctaatatatactggccatttgtaaaaccattgtgttgttgggatcacttagttatactatacgcagatagagcatctcaactctgtcatagtgtttgctgaacagttttcagtgtcatgcacctttggctgctaattgttcctgacgtgcactcttccgagttggtaaaggcacagtgtgttcatgccagacttctaagagaaacaccagcctcttaaatcagaagcctacacacaacccccttaacaatccaaagaagcttgatggtgtgcaaagaagcatcctgccagccttgtcattgttctgttctatgctaatcctgctgtgttgtctaaaagatggagggaagaggacatcagtgtctgatagtgaaatcatcagcaggaaagtgaagctctttccttggttacagataagacttggtttacactattggccagtatctgctaaacatatgaagacttaactattcagtgttgcctaggcattcgcctgcacaacattttgaggttagaacatagaatattttcagaaatactgttgtagtttgtgagtgttgttcattagttacacattagctatagagtggatgcatgaagccccatgacaccagtaaacttctcttaccagtaggtaaaccaaacaccattctgtcattagcagccctcttaaatgttgcctctccgtatcctgttgcatttttgtgtgcattgtgtttctactgatctctcttaggtttttacggaatcaaaggaaactaatttttccttaatagcaagaaagatgaagaggtaaagggcattgaagcagaaatgtatagtttggggtacgattagaaaactcgtaaggaaaacagaagtcctaatttcaaactgactgctcttcgttaagtgctcttaaggagagtctagtaacagtaacactttctggccatttctagtttagattctcttcgttactgaaacttttgagaaatattacctgtggattaattttgcacaatgttctattctcataatgacttacaaattaaactaggtttttattgaactacctcacactaattttctatgctttcccaagtaagctgttgccctgttagatctttactgagtgaattataaatgtgtgttaaatactttctagccaatgttgacacaataccagtaagtatgtaaagtatataccttacatcagtaagagacacgtgtaaaatctttgactgtatgtcttgcaaaattgtgctcgttgacattattactgtttttgtaagtagaaacctgctcgtgatatcggtccatttacattttacaaaaggagtaaatcttagtaaaaattttacgaagaaataaattacttttgtaggcccaatatttggtatatttttgagaagctgttaatcttttagctgaataatgaagttagactgaattacgtgtctccctggactgtgacatctattttctcattacagtttatcctggtcagcagggtgtcacacctggaaacctgagtatgatagctgacatttgcttttctccctctgcgatgtcattcctcctccattcctctccttccctgtgttccgttccctctcctttcctctagacaaaacaaaatggggcactttttagggaatgctgagatcattattgtggtttttcatcattcatgccctagtcattaaacatgcaccactggaatgtaaacaatgttatctagtatgtcaattggttataatattttaaataaaaaagaaaaaagtggtatgaaaattatgaaa

SEQ ID NO: 154877 - DNA, 5844 bp, Homo sapiens
  Payload ID: 10451
  Gene Symbol: MAPK8
  Gene Name: mitogen-activated protein kinase 8
  Uniprot ID: P45983
  ENST ID: ENST00000395611
  CDS Start-End: 233-1516
gacgtgcgcgggcgtgcgcggtgacggcccgcgtctctgttactcagccgagcggccgaggccggacgacgcggcttggattgcggagccgcgagcagcgctgggtaacggccgcggcgaccaccccggacggcccctgtccccgctggcgggcttccctgtcgccgttcgctgcgctgccggcttcttggtgaatttttggatgaagccattaaattaattgcttgccatcatgagcagaagcaagcgtgacaacaatttttatagtgtagagattggagattctacattcacagtcctgaaacgatatcagaatttaaaacctataggctcaggagctcaaggaatagtatgcgcagcttatgatgccattcttgaaagaaatgttgcaatcaagaagctaagccgaccatttcagaatcagactcatgccaagcgggcctacagagagctagttcttatgaaatgtgttaatcacaaaaatataattggccttttgaatgttttcacaccacagaaatccctagaagaatttcaagatgtttacatagtcatggagctcatggatgcaaatctttgccaagtgattcagatggagctagatcatgaaagaatgtcctaccttctctatcagatgctgtgtggaatcaagcaccttcattctgctggaattattcatcgggacttaaagcccagtaatatagtagtaaaatctgattgcactttgaagattcttgacttcggtctggccaggactgcaggaacgagttttatgatgacgccttatgtagtgactcgctactacagagcacccgaggtcatccttggcatgggctacaaggaaaacgttgacatttggtcagttgggtgcatcatgggagaaatgatcaaaggtggtgttttgttcccaggtacagatcatattgatcagtggaataaagttattgaacagcttggaacaccatgtcctgaattcatgaagaaactgcaaccaacagtaaggacttacgttgaaaacagacctaaatatgctggatatagctttgagaaactcttccctgatgtccttttcccagctgactcagaacacaacaaacttaaagccagtcaggcaagggatttgttatccaaaatgctggtaatagatgcatctaaaaggatctctgtagatgaagctctccaacacccgtacatcaatgtctggtatgatccttctgaagcagaagctccaccaccaaagatccctgacaagcagttagatgaaagggaacacacaatagaagagtggaaagaattgatatataaggaagttatggacttggaggagagaaccaagaatggagttatacgggggcagccctctcctttaggtgcagcagtgatcaatggctctcagcatccatcatcatcgtcgtctgtcaatgatgtgtcttcaatgtcaacagatccgactttggcctctgatacagacagcagtctagaagcagcagctgggcctctgggctgctgtagatgactacttgggccatcggggggtgggagggatggggagtcggttagtcattgatagaactactttgaaaacaattcagtggtcttatttttgggtgatttttcaaaaaatgtagaattcattttgtagtaaagtagtttattttttttaatttcaagtgatgtaatttaaaacctaagttgtgtttcaaaacagcaacaaaactgtattgtattttttttgctgtaattaactgtataatgtaaacctaattattttatcatggtttaaattttttgcatatttgctttatcttatgctgctgatttttttaactgaatttgtaagattttgtttatcaaagcaactattatgtggtgacttgcctatatcatgaattatttaagatttttatagttttttttaattagaatttatttcagatgttttgttcatgatactatccttcagggttatgtgcttatcaatgaaataaccccagaggagtgagggaaaataacttgtagccagttatattcaggaataactactgtaaatgatgaacgtgttaggagacctccaatatttgctacttgccaatcctaatttagttacaagaattggtaggcaatcctacttaattttggcaaaagccccgtcatctaaatggcagaataactcagagcatgtctttgaagatgctgggcgtctaccaccaccttatgtccccaccctacccaacaaaaataagtaaaaagaatatggtgtattctacaaatttgtggcatgctcaaagtttatgatcacataaaggcaagaggatacttcatgaataatacatttcaatgcaaataaacagatggttcacttctactagctatgagcctgtttttgtatacactgagttaatctactcaggctgtaggtcccagcaatgttctagagtctggtctttccctttcctgcagcttcgggtccttggacctttcctgtttcctattacttggagtgtctgtcagttgagcaccagttgttctggtgtttcatttgattctacttgtagcataatcatttatacgagctattgggaggttccaaaccctacctagatttgtgtaggtgatgtatcaaatgagcaatataccgttcatctgaaaatagtagcacacagccatatataggatatcattttctaaggactgtttcttcacattgagcagagcaggcataaatggtggttatttagtctaagtcttttatttttttatacctgattttcaacataacacgcaatgtggatgtcgagtagtgttaagaatggtgctgctcctgacaagtgtatgttaactgtttacattttctatctgtagaattatttctctattactgaacttttcctaagtaaaatgtctttgaagtctcgttatttctgaaatacgttgtctgtaatagacccaggcaccttttaaattatctctggaacaagagggatttcatgtaatgaactaggaaatgcatactcacataagcaacaaggttctaggcagaaagccccttggaatttgtgaccaacaggagcaagaacaggtgcggctcaacatgcaatgtctgaaaatttgcttggcattttattcatatatttagtgcaaaattatttttgagtgagatattttacatcactgttaatgtgcaatatttaagattaaaatacattagcttttttatatactttgaagtagcaagtttgttttcgatggcttagagtcatgatttccagcttcccagcctttttatcagtcccttttctaatacaacaaggtgcattaatttgattaggcaaattagagttctaagacacttcttgaattgtagacagaaaatattggattcacaatttcagcagaaatttgagaatgagtgtgtttatattaatttcacaattagctgtattttctgtagcatagattatgtcactgttgcactttcacagcagacatgctttcagaaggttctcatattttatgtttgattgctgataagccatctctattgatacagattttggttaagtaaggaaaaccaggtgtgtgtctgtatcatttattgtaaatgccagctgccacttgccaaccatcatgttcagttcaattcaaagaaaacaaactctcattacttagtgtaaactaaaatacttaacaaattatatcctaaaaacaaggtctctttgttaaatgttgcatgccctaggttttaaattactacatccaaatacagttttcgtcttaaatttgttaagctaaatatatgttggttctttttattttggaatcctttaagcatcttaaacattttttttttgaagagaagttacaaataacatttctatcaggtagtacttgtatgaaaccacctttcttattctataattttgatttttcaattttatatacttaatatactcactgtcttactatcagaaagttattttgaccaagatttttattatcttcatagattcagaaagagatgctaattctgtaccaatgtcttcctggttactattctcttccctctaatatatactggccatttgtaaaaccattgtgttgttgggatcacttagttatactatacgcagatagagcatctcaactctgtcatagtgtttgctgaacagttttcagtgtcatgcacctttggctgctaattgttcctgacgtgcactcttccgagttggtaaaggcacagtgtgttcatgccagacttctaagagaaacaccagcctcttaaatcagaagcctacacacaacccccttaacaatccaaagaagcttgatggtgtgcaaagaagcatcctgccagccttgtcattgttctgttctatgctaatcctgctgtgttgtctaaaagatggagggaagaggacatcagtgtctgatagtgaaatcatcagcaggaaagtgaagctctttccttggttacagataagacttggtttacactattggccagtatctgctaaacatatgaagacttaactattcagtgttgcctaggcattcgcctgcacaacattttgaggttagaacatagaatattttcagaaatactgttgtagtttgtgagtgttgttcattagttacacattagctatagagtggatgcatgaagccccatgacaccagtaaacttctcttaccagtaggtaaaccaaacaccattctgtcattagcagccctcttaaatgttgcctctccgtatcctgttgcatttttgtgtgcattgtgtttctactgatctctcttaggtttttacggaatcaaaggaaactaatttttccttaatagcaagaaagatgaagaggtaaagggcattgaagcagaaatgtatagtttggggtacgattagaaaactcgtaaggaaaacagaagtcctaatttcaaactgactgctcttcgttaagtgctcttaaggagagtctagtaacagtaacactttctggccatttctagtttagattctcttcgttactgaaacttttgagaaatattacctgtggattaattttgcacaatgttctattctcataatgacttacaaattaaactaggtttttattgaactacctcacactaattttctatgctttcccaagtaagctgttgccctgttagatctttactgagtgaattataaatgtgtgttaaatactttctagccaatgttgacacaataccagtaagtatgtaaagtatataccttacatcagtaagagacacgtgtaaaatctttgactgtatgtcttgcaaaattgtgctcgttgacattattactgtttttgtaagtagaaacctgctcgtgatatcggtccatttacattttacaaaaggagtaaatcttagtaaaaattttacgaagaaataaattacttttgtaggcccaatatttggtatatttttgagaagctgttaatcttttagctgaataatgaagttagactgaattacgtgtctccctggactgtgacatctattttctcattacagtttatcctggtcagcagggtgtcacacctggaaacctgagtatgatagctgacatttgcttttctccctctgcgatgtcattcctcctccattcctctccttccctgtgttccgttccctctcctttcctctagacaaaacaaaatggggcactttttagggaatgctgagatcattattgtggtttttcatcattcatgccctagtcattaaacatgcaccactggaatgtaaacaatgttatctagtatgtcaattggttataatattttaaataaaaaagaaaaaagtggtatgaaaattatg

SEQ ID NO: 154878 - DNA, 907 bp, Homo sapiens
  Payload ID: 10451
  Gene Symbol: MAPK8
  Gene Name: mitogen-activated protein kinase 8
  ENST ID: ENST00000432379
  CDS Start-End: 480-907
cgcggtgacggcccgcgtctctgttactcagccgagcggccgaggccggacgacgcggcttggattgcggagccgcgagcagcgctgggtaacggccgcggcgaccaccccggacggcccctgtccccgctggcgggcttccctgtcgccgttcgctgcgctgccggtcttgcagccttacagtcatttgtaatggttacctcagattcccctgctgtggttaacgttaaacctaggaggtcagatgctctaagtgaacatgtttagtgctgtgcctgacaaaagcaagcaatcaaaatgggacttccttgagggcaggcctgtcttgcatctgtttctccaccacctagcctggaatataactggccttatgggtttctagaaggaaaatcacagaggtaaagcatcatttcatcacatcctgtcaaggcttcttggtgaatttttggatgaagccattaaattaattgcttgccatcatgagcagaagcaagcgtgacaacaatttttatagtgtagagattggagattctacattcacagtcctgaaacgatatcagaatttaaaacctataggctcaggagctcaaggaatagtatgcgcagcttatgatgccattcttgaaagaaatgttgcaatcaagaagctaagccgaccatttcagaatcagactcatgccaagcgggcctacagagagctagttcttatgaaatgtgttaatcacaaaaatataattggccttttgaatgttttcacaccacagaaatccctagaagaatttcaagatgtttacatagtcatggagctcatggatgcaaatctttgccaagtgattcagatggagctagatcatgaaagaatgtcctaccttctctatcagatgctgtgtggaatcaagcaccttca

SEQ ID NO: 154879 - DNA, 603 bp, Homo sapiens
  Payload ID: 10451
  Gene Symbol: MAPK8
  Gene Name: mitogen-activated protein kinase 8
  ENST ID: ENST00000429041
  CDS Start-End: 311-603
actcagccgagcggccgaggccggacgacgcggcttggattgcggagccgcgagcagcgctgggtaacggccgcggcgaccaccccggacggcccctgtccccgctggcgggcttccctgtcgccgttcgctgcgctgccggcttcttggtgaatttttggatgaagccattaaattaattgcttgccatcatgagcagaagcaagcgtgacaacaatttttatagtgtagagattggagattctacattcacagtcctgaaacgatatcagaatttaaaacctataggctcaggagctcaaggaatagtatgataattggccttttgaatgttttcacaccacagaaatccctagaagaatttcaagatgtttacatagtcatggagctcatggatgcaaatctttgccaagtgattcagatggagctagatcatgaaagaatgtcctaccttctctatcagatgctgtgtggaatcaagcaccttcattctgctggaattattcatcgggacttaaagcccagtaatatagtagtaaaatctgattgcactttgaagattcttgacttcggtctggccaggactgcaggaacgagttttat

SEQ ID NO: 154880 - DNA, 860 bp, Homo sapiens
  Payload ID: 10451
  Gene Symbol: MAPK8
  Gene Name: mitogen-activated protein kinase 8
  ENST ID: ENST00000426557
  CDS Start-End: 435-860
acctgggtgcgctccgctgcccgccagcccgcctgccgccgcgagccccgcccgcctgtcctctcgcgtcctcttcgcgtgggtcctgcctccgcggcgggagaagaaaatggagcggggggtcttgcagccttacagtcatttgtaatggttacctcagattcccctgctgtggttaacgttaaacctaggaggtcagatgctctaagtgaacatgtttagtgctgtgcctgacaaaagcaagcaatcaaaatgggacttccttgagggcaggcctgtcttgcatctgtttctccaccacctagcctggaatataactggccttatgggtttctagaaggaaaatcacagaggtaaagcatcatttcatcacatcctgtcaaggcttcttggtgaatttttggatgaagccattaaattaattgcttgccatcatgagcagaagcaagcgtgacaacaatttttatagtgtagagattggagattctacattcacagtcctgaaacgatatcagaatttaaaacctataggctcaggagctcaaggaatagtatgcgcagcttatgatgccattcttgaaagaaatgttgcaatcaagaagctaagccgaccatttcagaatcagactcatgccaagcgggcctacagagagctagttcttatgaaatgtgttaatcacaaaaatataattggccttttgaatgttttcacaccacagaaatccctagaagaatttcaagatgtttacatagtcatggagctcatggatgcaaatctttgccaagtgattcagatggagctagatcatgaaagaatgtcctaccttctctatcagatgctgtgtggaatcaagcacctt

SEQ ID NO: 154881 - DNA, 3050 bp, Homo sapiens
  Payload ID: 10452
  Gene Symbol: MAPK8IP1
  Gene Name: mitogen-activated protein kinase 8 interacting protein 1
  Uniprot ID: Q9UQF2
  ENST ID: ENST00000241014
  CDS Start-End: 171-2306
agtcccgcgggccgtgcgcggtgctgtgccgcgccctgccagacacaggtgcgcccgcctagcccgaactccgcggcggcggctgccctctcgccgcgcctccgcctccttcgcagccgccgcctcctccgcgccgcgctccgcccggatggccagggctgtgcccgagaatggcggagcgagaaagcggcggcctgggagggggggccgcgtccccgcccgccgcctccccgttcctggggctgcacatcgcttcgcctcccaatttcaggctcacccatgacatcagcctggaggagtttgaggatgaagacctctcggagatcactgatgagtgtggcatcagcttacagtgcaaagacaccctgtccttacggcccccgcgcgccgggctgctctctgcgggcggcggcggcgcggggagccggttgcaggccgagatgctgcagatggacctgatcgacgcgacgggggacactcccggggccgaggacgacgaggaggacgacgacgaggagcgcgcggcccggcggccgggagcggggccgcccaaggccgagtccggccaggagccggcgtcccgcggccagggccagagccaaggccagagccagggcccgggcagcggggacacgtaccggcccaagcggcccaccacgctcaacctctttccgcaggtgccgcggtctcaggacacactgaataataattctctgggcaaaaagcacagttggcaggatcgggtgtctcgatcatcctcacccctgaagacaggggagcagacaccaccgcatgaacacatctgcctgagcgatgagctgcccccccagagcggccccgcccccaccacagatcgaggcacctccaccgacagcccttgccgccgcagcacagccacccagatggcacctccgggtggtccccctgctgccccgcctgggggtcggggccactcgcatcgagaccgaatccactaccaggccgatgtgcgactagaggccactgaggagatctacctgaccccagtgcagaggcccccagacgctgcagagcccacctccgccttcctgccgcccactgagagccggatgtcagtcagctccgatccagaccctgccgcctacccctccacggcagggcggccgcacccctccatcagtgaagaggaagagggcttcgactgcctgtcgtccccagagcgggctgagcccccaggcggagggtggcgggggagcctgggggagccgccgccacctccacgggcctctctgagctcggacaccagcgccctgtcctatgactctgtcaagtacacgctggtggtagatgagcatgcacagctggagctggtgagcctgcggccgtgcttcggagactacagtgacgagagtgactctgccaccgtctatgacaactgtgcctccgtctcctcgccctatgagtcggccatcggagaggaatatgaggaggccccgcggccccagccccctgcctgcctctccgaggactccacgcctgatgaacccgacgtccatttctccaagaaattcctgaacgtcttcatgagtggccgctcccgctcctccagtgctgagtccttcgggctgttctcctgcatcatcaacggggaggagcaggagcagacccaccgggccatattcaggtttgtgcctcgacacgaagacgaacttgagctggaagtggatgaccctctgctagtggagctccaggctgaagactactggtacgaggcctacaacatgcgcactggtgcccggggtgtctttcctgcctattacgccatcgaggtcaccaaggagcccgagcacatggcagccctggccaaaaacagtgactgggtggaccagttccgggtgaagttcctgggctcagtccaggttccctatcacaagggcaatgacgtcctctgtgctgctatgcaaaagattgccaccacccgccggctcaccgtgcactttaacccgccctccagctgtgtcctggagatcagcgtgcggggtgtgaagataggcgtcaaggccgatgactcccaggaggccaaggggaataaatgtagccactttttccagttaaaaaacatctctttctgcggatatcatccaaagaacaacaagtactttgggttcatcaccaagcaccccgccgaccaccggtttgcctgccacgtctttgtgtctgaagactccaccaaagccctggcagagtccgtggggagagcattccagcagttctacaagcagtttgtggagtacacctgccccacagaagatatctacctggagtagctgtgcagccccgccctctgcgtcccccagccctcaggccagtgccaggacagctggctgctgacaggatgtggcactgcttgaggaggggcacctgccaccgccagaggacaaggaagtgggggccgctggcccagggtaggggagggtggggcaatggggagaggcaaatgcagtttattgtaatatatgggattagattcatctatggagggcagagtgggctgcctggggattgggagggacagggcttggggagcaggtctctggcagagaaggatgtccgttccaggagcacacggccctgccccatcctgggccttacctcccctgccagggctcgggcgctgtggctcctgccttgatgaagcccgtgtcctgccttgatgaagcctgtgccacctgcaagtgcccgccctgcccctgccccaacccccaccgaagagccctgagctcaggctgagcccagccacctcccaaggactttccagtgaggaaatggcaacacgtggaggtgaagtccctgttctcagctccgtcatctgcggggcttctgggtggctcctgccactgacctcaccggcatgctggcctgtggcaggcctaggacctcaggcggggaggaggagctgccgcaaggccctgtcccagcagaagagggaggcttcctgactgacacaggccagccccatcttggtcctgtcaccctggccccaactattaaagtgccatttcctgtctgga

SEQ ID NO: 154882 - DNA, 3180 bp, Homo sapiens
  Payload ID: 10452
  Gene Symbol: MAPK8IP1
  Gene Name: mitogen-activated protein kinase 8 interacting protein 1
  ENST ID: ENST00000395629
  CDS Start-End: 331-2436
gattgcagtaacctgatcccgtgagggaggcggccacagcggcagcagcgcaagggccaggccagccgggaggaaggtgcctgcagctgagggctgcgctgggaagagctggggctgggacccgggtcggcagctgcagcctcctctcctggcctgtctatttttaatgagctccccaggcttctgcagcaggcaggacgcagaaagacaggcccaagcggtggaggccagaggcccccagccctgccttgagccctggcccccccacccttccgggcatgagagggcagccctggggccccgcagccccccggccgggcagggctctccatgcagctggtgctgaagatggattcgagcccagacaatgacagctggttggaggatcaatgggagcgctggctcacccatgacatcagcctggaggagtttgaggatgaagacctctcggagatcactgatgagtgtggcatcagcttacagtgcaaagacaccctgtccttacggcccccgcgcgccgggctgctctctgcgggcggcggcggcgcggggagccggttgcaggccgagatgctgcagatggacctgatcgacgcgacgggggacactcccggggccgaggacgacgaggaggacgacgacgaggagcgcgcggcccggcggccgggagcggggccgcccaaggccgagtccggccaggagccggcgtcccgcggccagggccagagccaaggccagagccagggcccgggcagcggggacacgtaccggcccaagcggcccaccacgctcaacctctttccgcaggtgccgcggtctcaggacacactgaataataattctctgggcaaaaagcacagttggcaggatcgggtgtctcgatcatcctcacccctgaagacaggggagcagacaccaccgcatgaacacatctgcctgagcgatgagctgcccccccagagcggccccgcccccaccacagatcgaggcacctccaccgacagcccttgccgccgcagcacagccacccagatggcacctccgggtggtccccctgctgccccgcctgggggtcggggccactcgcatcgagaccgaatccactaccaggccgatgtgcgactagaggccactgaggagatctacctgaccccagtgcagaggcccccagacgctgcagagcccacctccgccttcctgccgcccactgagagccggatgtcagtcagctccgatccagaccctgccgcctacccctccacggcagggcggccgcacccctccatcagtgaagaggaagagggcttcgactgcctgtcgtccccagagcgggctgagcccccaggcggagggtggcgggggagcctgggggagccgccgccacctccacgggcctctctgagctcggacaccagcgccctgtcctatgactctgtcaagtacacgctggtggtagatgagcatgcacagctggagctggtgagcctgcggccgtgcttcggagactacagtgacgagagtgactctgccaccgtctatgacaactgtgcctccgtctcctcgccctatgagtcggccatcggagaggaatatgaggaggccccgcggccccagccccctgcctgcctctccgaggactccacgcctgatgaacccgacgtccatttctccaagaaattcctgaacgtcttcatgagtggccgctcccgctcctccagtgctgagtccttcgggctgttctcctgcatcatcaacggggaggagcaggagcagacccaccgggccatattcaggtttgtgcctcgacacgaagacgaacttgagctggaagtggatgaccctctgctagtggagctccaggctgaagactactggtacgaggcctacaacatgcgcactggtgcccggggtgtctttcctgcctattacgccatcgaggtcaccaaggagcccgagcacatggcagccctggccaaaaacagtgactgggtggaccagttccgggtgaagttcctgggctcagtccaggttccctatcacaagggcaatgacgtcctctgtgctgctatgcaaaagattgccaccacccgccggctcaccgtgcactttaacccgccctccagctgtgtcctggagatcagcgtgcggggtgtgaagataggcgtcaaggccgatgactcccaggaggccaaggggaataaatgtagccactttttccagttaaaaaacatctctttctgcggatatcatccaaagaacaacaagtactttgggttcatcaccaagcaccccgccgaccaccggtttgcctgccacgtctttgtgtctgaagactccaccaaagccctggcagagtccgtggggagagcattccagcagttctacaagcagtttgtggagtacacctgccccacagaagatatctacctggagtagctgtgcagccccgccctctgcgtcccccagccctcaggccagtgccaggacagctggctgctgacaggatgtggcactgcttgaggaggggcacctgccaccgccagaggacaaggaagtgggggccgctggcccagggtaggggagggtggggcaatggggagaggcaaatgcagtttattgtaatatatgggattagattcatctatggagggcagagtgggctgcctggggattgggagggacagggcttggggagcaggtctctggcagagaaggatgtccgttccaggagcacacggccctgccccatcctgggccttacctcccctgccagggctcgggcgctgtggctcctgccttgatgaagcccgtgtcctgccttgatgaagcctgtgccacctgcaagtgcccgccctgcccctgccccaacccccaccgaagagccctgagctcaggctgagcccagccacctcccaaggactttccagtgaggaaatggcaacacgtggaggtgaagtccctgttctcagctccgtcatctgcggggcttctgggtggctcctgccactgacctcaccggcatgctggcctgtggcaggcctaggacctcaggcggggaggaggagctgccgcaaggccctgtcccagcagaagagggaggcttcctgactgacacaggccagccccatcttggtcctgtcaccctggccccaactattaaagtgccatttcctgtctgga
